United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 206

SEQ ID NO: 8553389 - DNA, 22 bp, Homo sapiens
aaattccagaaactcagtatat

SEQ ID NO: 8553390 - DNA, 22 bp, Homo sapiens
aaattccagttcttttacctgc

SEQ ID NO: 8553391 - DNA, 22 bp, Homo sapiens
aaattccattaggaaacttcca

SEQ ID NO: 8553392 - DNA, 22 bp, Homo sapiens
aaattccattatgataatttcg

SEQ ID NO: 8553393 - DNA, 22 bp, Homo sapiens
aaattccattatgataatttcg

SEQ ID NO: 8553394 - DNA, 22 bp, Homo sapiens
aaattcagatggctttcttttc

SEQ ID NO: 8553395 - DNA, 22 bp, Homo sapiens
aaattcagcatcctgcactgga

SEQ ID NO: 8553396 - DNA, 22 bp, Homo sapiens
aaattcagttcctcagccacat

SEQ ID NO: 8553397 - DNA, 22 bp, Homo sapiens
aaattcagttcctcagccacat

SEQ ID NO: 8553398 - DNA, 22 bp, Homo sapiens
aaattcatttttcttagtgtgc

SEQ ID NO: 8553399 - DNA, 22 bp, Homo sapiens
aaattcatttttcttagtgtgc

SEQ ID NO: 8553400 - DNA, 22 bp, Homo sapiens
aaattccaccagaatcagtaat

SEQ ID NO: 8553401 - DNA, 22 bp, Homo sapiens
aaattcatatgttgaaatgcta

SEQ ID NO: 8553402 - DNA, 22 bp, Homo sapiens
aaattcatatgttgaaatgcta

SEQ ID NO: 8553403 - DNA, 22 bp, Homo sapiens
aaattcagttttaataatcact

SEQ ID NO: 8553404 - DNA, 22 bp, Homo sapiens
aaattcatatgttgaaatgcta

SEQ ID NO: 8553405 - DNA, 22 bp, Homo sapiens
aaattgtatattccatttgtat

SEQ ID NO: 8553406 - DNA, 22 bp, Homo sapiens
aaattgtatattccatttgtat

SEQ ID NO: 8553407 - DNA, 22 bp, Homo sapiens
aaattgtaggatcacatgacct

SEQ ID NO: 8553408 - DNA, 22 bp, Homo sapiens
aaattgtcagaattcagaaagt

SEQ ID NO: 8553409 - DNA, 22 bp, Homo sapiens
aaattgtcagttatctgggata

SEQ ID NO: 8553410 - DNA, 22 bp, Homo sapiens
aaattgtccttttaagaaacag

SEQ ID NO: 8553411 - DNA, 22 bp, Homo sapiens
aaattgtcatttctgtgcccta

SEQ ID NO: 8553412 - DNA, 23 bp, Homo sapiens
aaattgtcgtaaggtggagatgt

SEQ ID NO: 8553413 - DNA, 22 bp, Homo sapiens
aaagcagcaacagctgttagaa

SEQ ID NO: 8553414 - DNA, 22 bp, Homo sapiens
aaagcagcacatggatatcagt

SEQ ID NO: 8553415 - DNA, 22 bp, Homo sapiens
aaagcagcaagtatttgttact

SEQ ID NO: 8553416 - DNA, 22 bp, Homo sapiens
aaattgtagagatcgctttgtg

SEQ ID NO: 8553417 - DNA, 22 bp, Homo sapiens
aaattgtaggatcacatgacct

SEQ ID NO: 8553418 - DNA, 22 bp, Homo sapiens
aaattggcagttcagggaatta

SEQ ID NO: 8553419 - DNA, 22 bp, Homo sapiens
aaattgtaatgacttcacttga

SEQ ID NO: 8553420 - DNA, 22 bp, Homo sapiens
aaattggattttaaactgttgg

SEQ ID NO: 8553421 - DNA, 20 bp, Homo sapiens
aaagcagtatgcaagtagag

SEQ ID NO: 8553422 - DNA, 20 bp, Homo sapiens
aaagcagtatgcaagtagag

SEQ ID NO: 8553423 - DNA, 22 bp, Homo sapiens
aaagcagtctcagacttaagca

SEQ ID NO: 8553424 - DNA, 22 bp, Homo sapiens
aaagcagtatagtggaagggct

SEQ ID NO: 8553425 - DNA, 22 bp, Homo sapiens
aaagcagtataagtaacggaag

SEQ ID NO: 8553426 - DNA, 22 bp, Homo sapiens
aaagcagtatattggtagttgt

SEQ ID NO: 8553427 - DNA, 22 bp, Homo sapiens
aaagcagtagttttcaaatagt

SEQ ID NO: 8553428 - DNA, 22 bp, Homo sapiens
aaaagttacctctgtaatataa

SEQ ID NO: 8553429 - DNA, 22 bp, Homo sapiens
aaaagttacctctgtaatataa

SEQ ID NO: 8553430 - DNA, 22 bp, Homo sapiens
aaaagttattgatgcaggacaa

SEQ ID NO: 8553431 - DNA, 22 bp, Homo sapiens
aaaagttagctattagtaggtg

SEQ ID NO: 8553432 - DNA, 22 bp, Homo sapiens
aaaagttacctctgtaatataa

SEQ ID NO: 8553433 - DNA, 22 bp, Homo sapiens
aaaagttacctctgtaatataa

SEQ ID NO: 8553434 - DNA, 22 bp, Homo sapiens
aaaagttagctattagtaggtg

SEQ ID NO: 8553435 - DNA, 22 bp, Homo sapiens
aaaagtttaagactcattctag

SEQ ID NO: 8553436 - DNA, 22 bp, Homo sapiens
aaaagtttaagactcattctag

SEQ ID NO: 8553437 - DNA, 22 bp, Homo sapiens
aaaagtttaagactcattctag

SEQ ID NO: 8553438 - DNA, 22 bp, Homo sapiens
aaaagtttaagactcattctag

SEQ ID NO: 8553439 - DNA, 22 bp, Homo sapiens
aaaagttccctggttagaaaag

SEQ ID NO: 8553440 - DNA, 22 bp, Homo sapiens
aaaagtgttcaggaagaataat

SEQ ID NO: 8553441 - DNA, 22 bp, Homo sapiens
aaaagtgttcaggaagaataat

SEQ ID NO: 8553442 - DNA, 22 bp, Homo sapiens
aaaagtgttcaggaagaataat

SEQ ID NO: 8553443 - DNA, 22 bp, Homo sapiens
aaaagtgttcaggaagaataat

SEQ ID NO: 8553444 - DNA, 22 bp, Homo sapiens
aaaagtgtccagattatgaaga

SEQ ID NO: 8553445 - DNA, 19 bp, Homo sapiens
aaaaggaatattctttggg

SEQ ID NO: 8553446 - DNA, 22 bp, Homo sapiens
aaaagtattttgagcactttat

SEQ ID NO: 8553447 - DNA, 22 bp, Homo sapiens
aaaagctctttctgctgtagat

SEQ ID NO: 8553448 - DNA, 22 bp, Homo sapiens
aaaagctagtcaatgatgtatt

SEQ ID NO: 8553449 - DNA, 19 bp, Homo sapiens
aaaaggaatattctttggg

SEQ ID NO: 8553450 - DNA, 22 bp, Homo sapiens
aaaataacttctactatttgca

SEQ ID NO: 8553451 - DNA, 22 bp, Homo sapiens
aaaataacttctactatttgca

SEQ ID NO: 8553452 - DNA, 22 bp, Homo sapiens
aaaataacttctactatttgca

SEQ ID NO: 8553453 - DNA, 22 bp, Homo sapiens
aaaataacttctactatttgca

SEQ ID NO: 8553454 - DNA, 22 bp, Homo sapiens
aaaatacacatactaggggaaa

SEQ ID NO: 8553455 - DNA, 22 bp, Homo sapiens
aaaataagttggtcctgtcctt

SEQ ID NO: 8553456 - DNA, 22 bp, Homo sapiens
aaaagtttgtgcaaacactcag

SEQ ID NO: 8553457 - DNA, 22 bp, Homo sapiens
aaaagtttgtgcaaacactcag

SEQ ID NO: 8553458 - DNA, 18 bp, Homo sapiens
aaaataacaaagttggct

SEQ ID NO: 8553459 - DNA, 18 bp, Homo sapiens
aaaataacaaagttggct

SEQ ID NO: 8553460 - DNA, 22 bp, Homo sapiens
aaaataacttctactatttgca

SEQ ID NO: 8553461 - DNA, 22 bp, Homo sapiens
aaaataacttctactatttgca

SEQ ID NO: 8553462 - DNA, 22 bp, Homo sapiens
aaaataacttctactatttgca

SEQ ID NO: 8553463 - DNA, 22 bp, Homo sapiens
aaaatgagcatattgatccttt

SEQ ID NO: 8553464 - DNA, 22 bp, Homo sapiens
aaaatgagacacatgtgactcc

SEQ ID NO: 8553465 - DNA, 22 bp, Homo sapiens
aaaatactgtggagtgttgaaa

SEQ ID NO: 8553466 - DNA, 22 bp, Homo sapiens
aaaatacacatactaggggaaa

SEQ ID NO: 8553467 - DNA, 22 bp, Homo sapiens
aaaatactactgtcttcttccc

SEQ ID NO: 8553468 - DNA, 22 bp, Homo sapiens
aaagcagcagcacgtggaagag

SEQ ID NO: 8553469 - DNA, 22 bp, Homo sapiens
aaagcagcagaatctctcaggg

SEQ ID NO: 8553470 - DNA, 22 bp, Homo sapiens
aaagcagccacagagagagcgt

SEQ ID NO: 8553471 - DNA, 22 bp, Homo sapiens
aaagcagccacagagagagcgt

SEQ ID NO: 8553472 - DNA, 22 bp, Homo sapiens
aaagcagcctgctcatcctgga

SEQ ID NO: 8553473 - DNA, 22 bp, Homo sapiens
aaagcaatggcacatgatggta

SEQ ID NO: 8553474 - DNA, 22 bp, Homo sapiens
aaagcagcagaaagctggcccc

SEQ ID NO: 8553475 - DNA, 21 bp, Homo sapiens
aaaatgtgagcgtgatgctta

SEQ ID NO: 8553476 - DNA, 21 bp, Homo sapiens
aaaatgtgagcgtgatgctta

SEQ ID NO: 8553477 - DNA, 22 bp, Homo sapiens
aaaatgtatgatggaggtgcta

SEQ ID NO: 8553478 - DNA, 21 bp, Homo sapiens
aaaatgtagacttttccctga

SEQ ID NO: 8553479 - DNA, 21 bp, Homo sapiens
aaaatgtagacttttccctga

SEQ ID NO: 8553480 - DNA, 22 bp, Homo sapiens
aaagcagcggtgtctttactgc

SEQ ID NO: 8553481 - DNA, 22 bp, Homo sapiens
aaagcagctgatctcagagcct

SEQ ID NO: 8553482 - DNA, 22 bp, Homo sapiens
aaagcagggtccaaggagatgt

SEQ ID NO: 8553483 - DNA, 22 bp, Homo sapiens
aaaatgtaaagcttgagtgtag

SEQ ID NO: 8553484 - DNA, 22 bp, Homo sapiens
aaaatggtctcagctggcacca

SEQ ID NO: 8553485 - DNA, 22 bp, Homo sapiens
aaaatgggtttcttcaacctca

SEQ ID NO: 8553486 - DNA, 22 bp, Homo sapiens
aaaatggtctcagctggcacca

SEQ ID NO: 8553487 - DNA, 22 bp, Homo sapiens
aaaatgtaaagcttgagtgtag

SEQ ID NO: 8553488 - DNA, 22 bp, Homo sapiens
aaaatgctgggaaagttggaat

SEQ ID NO: 8553489 - DNA, 22 bp, Homo sapiens
aaaatggctgtggtctggcaag

SEQ ID NO: 8553490 - DNA, 18 bp, Homo sapiens
aaaatgcaggcgacatgg

SEQ ID NO: 8553491 - DNA, 18 bp, Homo sapiens
aaaatgcaggcgacatgg

SEQ ID NO: 8553492 - DNA, 18 bp, Homo sapiens
aaaatgcaggcgacatgg

SEQ ID NO: 8553493 - DNA, 18 bp, Homo sapiens
aaaatgcaggcgacatgg

SEQ ID NO: 8553494 - DNA, 18 bp, Homo sapiens
aaaatgcaggcgacatgg

SEQ ID NO: 8553495 - DNA, 18 bp, Homo sapiens
aaaatgcaggcgacatgg

SEQ ID NO: 8553496 - DNA, 22 bp, Homo sapiens
aaaatgcatgagaatgtgctcg

SEQ ID NO: 8553497 - DNA, 22 bp, Homo sapiens
aaaatgcatgagaatgtgctcg

SEQ ID NO: 8553498 - DNA, 22 bp, Homo sapiens
aaaatgcatgagaatgtgctcg

SEQ ID NO: 8553499 - DNA, 22 bp, Homo sapiens
aaaatgcatgagaatgtgctcg

SEQ ID NO: 8553500 - DNA, 22 bp, Homo sapiens
aaaatgctatttcatggaggag

SEQ ID NO: 8553501 - DNA, 22 bp, Homo sapiens
aaaatgaggaacggatcatggc

SEQ ID NO: 8553502 - DNA, 22 bp, Homo sapiens
aaaatgatatcctgacttttat

SEQ ID NO: 8553503 - DNA, 22 bp, Homo sapiens
aaaatgatatcctgacttttat

SEQ ID NO: 8553504 - DNA, 22 bp, Homo sapiens
aaaatgatatcctgacttttat

SEQ ID NO: 8553505 - DNA, 22 bp, Homo sapiens
aaaatgatatcctgacttttat

SEQ ID NO: 8553506 - DNA, 22 bp, Homo sapiens
aaaatgaggtcaatatcctttt

SEQ ID NO: 8553507 - DNA, 22 bp, Homo sapiens
aaaatgatatcctgacttttat

SEQ ID NO: 8553508 - DNA, 20 bp, Homo sapiens
aaaatgatgggcagggcagg

SEQ ID NO: 8553509 - DNA, 22 bp, Homo sapiens
aaaatgcaaacctacctacata

SEQ ID NO: 8553510 - DNA, 22 bp, Homo sapiens
aaaatgcaaacctacctacata

SEQ ID NO: 8553511 - DNA, 22 bp, Homo sapiens
aaaatgcaaacctacctacata

SEQ ID NO: 8553512 - DNA, 22 bp, Homo sapiens
aaaatgatgctgtaatttggca

SEQ ID NO: 8553513 - DNA, 22 bp, Homo sapiens
aaaatgatgctgtaatttggca

SEQ ID NO: 8553514 - DNA, 22 bp, Homo sapiens
aaaatgatgctgtaatttggca

SEQ ID NO: 8553515 - DNA, 22 bp, Homo sapiens
aaaatgatgctgtaatttggca

SEQ ID NO: 8553516 - DNA, 22 bp, Homo sapiens
aaaacatgtccatacagaaact

SEQ ID NO: 8553517 - DNA, 22 bp, Homo sapiens
aaaacatgtccatacagaaact

SEQ ID NO: 8553518 - DNA, 22 bp, Homo sapiens
aaaacatgtccatacagaaact

SEQ ID NO: 8553519 - DNA, 22 bp, Homo sapiens
aaaacatgtccatacagaaact

SEQ ID NO: 8553520 - DNA, 22 bp, Homo sapiens
aaaacatgtccatacagaaact

SEQ ID NO: 8553521 - DNA, 22 bp, Homo sapiens
aaaacattctgtgaactctcaa

SEQ ID NO: 8553522 - DNA, 22 bp, Homo sapiens
aaaacattgaattgcacactat

SEQ ID NO: 8553523 - DNA, 22 bp, Homo sapiens
aaaacattgaattgcacactat

SEQ ID NO: 8553524 - DNA, 22 bp, Homo sapiens
aaaacattttactgccatctca

SEQ ID NO: 8553525 - DNA, 22 bp, Homo sapiens
aaaacattttactgccatctca

SEQ ID NO: 8553526 - DNA, 22 bp, Homo sapiens
aaaaccacaattacttttgcac

SEQ ID NO: 8553527 - DNA, 22 bp, Homo sapiens
aaaaccacaatgacttttgcag

SEQ ID NO: 8553528 - DNA, 22 bp, Homo sapiens
aaaaccacaatgacttttgcac

SEQ ID NO: 8553529 - DNA, 22 bp, Homo sapiens
aaaaccacaaaagtggcttggt

SEQ ID NO: 8553530 - DNA, 22 bp, Homo sapiens
aaaaccaagttttccttagtct

SEQ ID NO: 8553531 - DNA, 22 bp, Homo sapiens
aaaaccacaattatttttgcac

SEQ ID NO: 8553532 - DNA, 22 bp, Homo sapiens
aaaaccacagttacttttgcac

SEQ ID NO: 8553533 - DNA, 22 bp, Homo sapiens
aaaaccagacactgtttctggg

SEQ ID NO: 8553534 - DNA, 22 bp, Homo sapiens
aaaaccacttccttgctattgg

SEQ ID NO: 8553535 - DNA, 22 bp, Homo sapiens
aaaagagtgactgataagtata

SEQ ID NO: 8553536 - DNA, 22 bp, Homo sapiens
aaaagagtcttaggcagtcata

SEQ ID NO: 8553537 - DNA, 22 bp, Homo sapiens
aaaagagtcttaggcagtcata

SEQ ID NO: 8553538 - DNA, 22 bp, Homo sapiens
aaaaccaggcgtttcctattat

SEQ ID NO: 8553539 - DNA, 22 bp, Homo sapiens
aaaaccaggcgtttcctattat

SEQ ID NO: 8553540 - DNA, 22 bp, Homo sapiens
aaaaccagacactgtttctggg

SEQ ID NO: 8553541 - DNA, 22 bp, Homo sapiens
aaaagcaagaggctggattaaa

SEQ ID NO: 8553542 - DNA, 22 bp, Homo sapiens
aaaagcaaggcagtctgtctga

SEQ ID NO: 8553543 - DNA, 22 bp, Homo sapiens
aaaagcaagaggctggattaaa

SEQ ID NO: 8553544 - DNA, 22 bp, Homo sapiens
aaaagcaagttgcctaggttga

SEQ ID NO: 8553545 - DNA, 20 bp, Homo sapiens
aaaaattgatatcgcttcct

SEQ ID NO: 8553546 - DNA, 22 bp, Homo sapiens
aaaaatttatggttcttctctg

SEQ ID NO: 8553547 - DNA, 22 bp, Homo sapiens
aaaacacaagaagcagggtaca

SEQ ID NO: 8553548 - DNA, 22 bp, Homo sapiens
aaaacacaagaagcagggtaca

SEQ ID NO: 8553549 - DNA, 22 bp, Homo sapiens
aaaaatctatgactgcttctcc

SEQ ID NO: 8553550 - DNA, 22 bp, Homo sapiens
aaaaatgttatctactgtccga

SEQ ID NO: 8553551 - DNA, 22 bp, Homo sapiens
aaaaatgtgaccacagggtgtt

SEQ ID NO: 8553552 - DNA, 22 bp, Homo sapiens
aaaaatgttatctactgtccga

SEQ ID NO: 8553553 - DNA, 22 bp, Homo sapiens
aaaaatgttatctactgtccga

SEQ ID NO: 8553554 - DNA, 22 bp, Homo sapiens
aaaagccaaggtcctcttcaga

SEQ ID NO: 8553555 - DNA, 22 bp, Homo sapiens
aaaagccatgcatacctaagag

SEQ ID NO: 8553556 - DNA, 22 bp, Homo sapiens
aaaagccatgcatacctaagag

SEQ ID NO: 8553557 - DNA, 22 bp, Homo sapiens
aaaagcaggtactcagcttggg

SEQ ID NO: 8553558 - DNA, 22 bp, Homo sapiens
aaaagcaggtactcagcttggg

SEQ ID NO: 8553559 - DNA, 20 bp, Homo sapiens
aaaagcagccagagatggta

SEQ ID NO: 8553560 - DNA, 22 bp, Homo sapiens
aaaagcagttatctgggaggaa

SEQ ID NO: 8553561 - DNA, 22 bp, Homo sapiens
aaaagcagtttatagtcagttg

SEQ ID NO: 8553562 - DNA, 22 bp, Homo sapiens
aaaagcactacaatttcgcttc

SEQ ID NO: 8553563 - DNA, 22 bp, Homo sapiens
aaaagcagagactctggagcta

SEQ ID NO: 8553564 - DNA, 22 bp, Homo sapiens
aaaagcagatctccaaagtcta

SEQ ID NO: 8553565 - DNA, 22 bp, Homo sapiens
aaaagcagatctccaaagtcta

SEQ ID NO: 8553566 - DNA, 22 bp, Homo sapiens
aaaagcaattgcgggttttgcc

SEQ ID NO: 8553567 - DNA, 22 bp, Homo sapiens
aaaagcaagttgcctaggttga

SEQ ID NO: 8553568 - DNA, 22 bp, Homo sapiens
aaaagcaagttgcctaggttga

SEQ ID NO: 8553569 - DNA, 22 bp, Homo sapiens
aaaacagtttaggcatcacagt

SEQ ID NO: 8553570 - DNA, 22 bp, Homo sapiens
aaaacagtttaggcatcacagt

SEQ ID NO: 8553571 - DNA, 22 bp, Homo sapiens
aaaacagtttaggcatcacagt

SEQ ID NO: 8553572 - DNA, 22 bp, Homo sapiens
aaaacagtttttgctaactgct

SEQ ID NO: 8553573 - DNA, 22 bp, Homo sapiens
aaaacagtttttgctaactgct

SEQ ID NO: 8553574 - DNA, 22 bp, Homo sapiens
aaaagaggagtggtttatgaca

SEQ ID NO: 8553575 - DNA, 22 bp, Homo sapiens
aaaagaggagtggtttatgaca

SEQ ID NO: 8553576 - DNA, 22 bp, Homo sapiens
aaaagagccacttatgacctca

SEQ ID NO: 8553577 - DNA, 22 bp, Homo sapiens
aaaacaggagttttggtaggct

SEQ ID NO: 8553578 - DNA, 22 bp, Homo sapiens
aaaacagttataaacagagtca

SEQ ID NO: 8553579 - DNA, 22 bp, Homo sapiens
aaaacagttataaacagagtca

SEQ ID NO: 8553580 - DNA, 22 bp, Homo sapiens
aaaacagttataaacagagtca

SEQ ID NO: 8553581 - DNA, 22 bp, Homo sapiens
aaaacagtttaggcatcacagt

SEQ ID NO: 8553582 - DNA, 22 bp, Homo sapiens
aaaacagtttaggcatcacagt

SEQ ID NO: 8553583 - DNA, 22 bp, Homo sapiens
aaaacacaagaagcagggtaca

SEQ ID NO: 8553584 - DNA, 22 bp, Homo sapiens
aaaacacaagaagcagggtaca

SEQ ID NO: 8553585 - DNA, 22 bp, Homo sapiens
aaaacactgcaaagctgattgg

SEQ ID NO: 8553586 - DNA, 22 bp, Homo sapiens
aaaacacactggaccaatttaa

SEQ ID NO: 8553587 - DNA, 23 bp, Homo sapiens
aaaacagcttcctccagtggctc

SEQ ID NO: 8553588 - DNA, 23 bp, Homo sapiens
aaaacagcttcctccagtggctc

SEQ ID NO: 8553589 - DNA, 22 bp, Homo sapiens
aaaacagacagccagtgtagag

SEQ ID NO: 8553590 - DNA, 22 bp, Homo sapiens
aaaacagacagccagtgtagag

SEQ ID NO: 8553591 - DNA, 22 bp, Homo sapiens
aaaacagacagccagtgtagag

SEQ ID NO: 8553592 - DNA, 22 bp, Homo sapiens
aaaacactgcctgcttgactga

SEQ ID NO: 8553593 - DNA, 22 bp, Homo sapiens
aaaattttactggtgtttcctt

SEQ ID NO: 8553594 - DNA, 22 bp, Homo sapiens
aaaattttactggtgtttcctt

SEQ ID NO: 8553595 - DNA, 22 bp, Homo sapiens
aaaattttcagcttgacttgat

SEQ ID NO: 8553596 - DNA, 22 bp, Homo sapiens
aaaattttcagcttgacttgat

SEQ ID NO: 8553597 - DNA, 22 bp, Homo sapiens
aaaattttgccctatccttcat

SEQ ID NO: 8553598 - DNA, 22 bp, Homo sapiens
aaaattgtgaaggtttctgaaa

SEQ ID NO: 8553599 - DNA, 22 bp, Homo sapiens
aaaattgtgaaggtttctgaaa

SEQ ID NO: 8553600 - DNA, 22 bp, Homo sapiens
aaaatttccaccatctttgtgt

SEQ ID NO: 8553601 - DNA, 22 bp, Homo sapiens
aaaatttccaccatctttgtgt

SEQ ID NO: 8553602 - DNA, 22 bp, Homo sapiens
aaaattgtcgaacagtagtaac

SEQ ID NO: 8553603 - DNA, 22 bp, Homo sapiens
aaaattgtcgaacagtagtaac

SEQ ID NO: 8553604 - DNA, 22 bp, Homo sapiens
aaaattgtcgaacagtagtaac

SEQ ID NO: 8553605 - DNA, 22 bp, Homo sapiens
aaaattgtcagaagttgatctt

SEQ ID NO: 8553606 - DNA, 22 bp, Homo sapiens
aaagccagggacagtgtgcatg

SEQ ID NO: 8553607 - DNA, 22 bp, Homo sapiens
aaagctagaaggaaattttatg

SEQ ID NO: 8553608 - DNA, 22 bp, Homo sapiens
aaaattttgccctatccttcat

SEQ ID NO: 8553609 - DNA, 22 bp, Homo sapiens
aaagctagtaatattttaatcc

SEQ ID NO: 8553610 - DNA, 22 bp, Homo sapiens
aaagctatagggtcaagcattt

SEQ ID NO: 8553611 - DNA, 22 bp, Homo sapiens
aaagctatagggtcaagcattt

SEQ ID NO: 8553612 - DNA, 22 bp, Homo sapiens
aaagctatcatcaatgcaactt

SEQ ID NO: 8553613 - DNA, 22 bp, Homo sapiens
aaagctatttattacagagaat

SEQ ID NO: 8553614 - DNA, 22 bp, Homo sapiens
aaagctatttattacagagaat

SEQ ID NO: 8553615 - DNA, 22 bp, Homo sapiens
aaagctatttgtgagttataga

SEQ ID NO: 8553616 - DNA, 22 bp, Homo sapiens
aaagctatttgttatgagagaa

SEQ ID NO: 8553617 - DNA, 22 bp, Homo sapiens
aaagctattcaacacgaacatg

SEQ ID NO: 8553618 - DNA, 22 bp, Homo sapiens
aaagctatttattacagagaat

SEQ ID NO: 8553619 - DNA, 22 bp, Homo sapiens
aaagctattcaacacgaacatg

SEQ ID NO: 8553620 - DNA, 22 bp, Homo sapiens
aaagctatgaggcatgcatttc

SEQ ID NO: 8553621 - DNA, 22 bp, Homo sapiens
aaagctatgaggcatgcatttc

SEQ ID NO: 8553622 - DNA, 22 bp, Homo sapiens
aaagctatgaggcatgcatttc

SEQ ID NO: 8553623 - DNA, 22 bp, Homo sapiens
aaaggagaaaacatacaggact

SEQ ID NO: 8553624 - DNA, 22 bp, Homo sapiens
aaaggagaaaacatacaggact

SEQ ID NO: 8553625 - DNA, 22 bp, Homo sapiens
aaaggagaaaacatacaggact

SEQ ID NO: 8553626 - DNA, 22 bp, Homo sapiens
aaaggttaaggtgttcaagaaa

SEQ ID NO: 8553627 - DNA, 22 bp, Homo sapiens
aaaggttaaggtgttcaagaaa

SEQ ID NO: 8553628 - DNA, 22 bp, Homo sapiens
aaaggagagtgagtcagatgcc

SEQ ID NO: 8553629 - DNA, 22 bp, Homo sapiens
aaaggagagtaggttactccat

SEQ ID NO: 8553630 - DNA, 22 bp, Homo sapiens
aaaggaatgagcttctgttagg

SEQ ID NO: 8553631 - DNA, 22 bp, Homo sapiens
aaaggacatgtcaatatcaggc

SEQ ID NO: 8553632 - DNA, 22 bp, Homo sapiens
aaagctcttaatgagattatcc

SEQ ID NO: 8553633 - DNA, 22 bp, Homo sapiens
aaaggaatattcaaaacagtca

SEQ ID NO: 8553634 - DNA, 22 bp, Homo sapiens
aaagctcacagtaatacaaggc

SEQ ID NO: 8553635 - DNA, 22 bp, Homo sapiens
aaagctcatcattaggaggcta

SEQ ID NO: 8553636 - DNA, 22 bp, Homo sapiens
aaagtacatgcaattcttctga

SEQ ID NO: 8553637 - DNA, 22 bp, Homo sapiens
aaagtcatacatggtgcttact

SEQ ID NO: 8553638 - DNA, 22 bp, Homo sapiens
aaagtcatcagaaccttccaga

SEQ ID NO: 8553639 - DNA, 22 bp, Homo sapiens
aaagtcaggctgtgtacctaac

SEQ ID NO: 8553640 - DNA, 22 bp, Homo sapiens
aaagtcacttccttctgtcagc

SEQ ID NO: 8553641 - DNA, 22 bp, Homo sapiens
aaagtcagttggccagatcact

SEQ ID NO: 8553642 - DNA, 22 bp, Homo sapiens
aaagtacaaggaaaggatctga

SEQ ID NO: 8553643 - DNA, 22 bp, Homo sapiens
aaaggttaatgttgtcatgtta

SEQ ID NO: 8553644 - DNA, 22 bp, Homo sapiens
aaaggttagacagctctgcata

SEQ ID NO: 8553645 - DNA, 22 bp, Homo sapiens
aaagtacaatattgagattgat

SEQ ID NO: 8553646 - DNA, 22 bp, Homo sapiens
aaagtacagatggtgaggttgg

SEQ ID NO: 8553647 - DNA, 22 bp, Homo sapiens
aaagtacagatggtgaggttgg

SEQ ID NO: 8553648 - DNA, 22 bp, Homo sapiens
aaagtcatctaggagcagattt

SEQ ID NO: 8553649 - DNA, 22 bp, Homo sapiens
aaagtcatctaggagcagattt

SEQ ID NO: 8553650 - DNA, 22 bp, Homo sapiens
aaagtcatcatttcttttcaaa

SEQ ID NO: 8553651 - DNA, 22 bp, Homo sapiens
aaagtcatccaaatttttatgt

SEQ ID NO: 8553652 - DNA, 22 bp, Homo sapiens
aaagtcatctaggagcagattt

SEQ ID NO: 8553653 - DNA, 22 bp, Homo sapiens
aaagtcatgtaatgatatgatt

SEQ ID NO: 8553654 - DNA, 22 bp, Homo sapiens
aaagtcatggaaaatcttggaa

SEQ ID NO: 8553655 - DNA, 22 bp, Homo sapiens
aaagtcatgcagttgaactttt

SEQ ID NO: 8553656 - DNA, 22 bp, Homo sapiens
aaagtcatgatgaaccaccgta

SEQ ID NO: 8553657 - DNA, 22 bp, Homo sapiens
aaagtcatctgtcctaggctct

SEQ ID NO: 8553658 - DNA, 22 bp, Homo sapiens
aaagtcattgctgttatcaatg

SEQ ID NO: 8553659 - DNA, 22 bp, Homo sapiens
aaagtcattgctgttatcaatg

SEQ ID NO: 8553660 - DNA, 22 bp, Homo sapiens
aaagtcattggaatattaatga

SEQ ID NO: 8553661 - DNA, 22 bp, Homo sapiens
aaagttcattgatgactgaggt

SEQ ID NO: 8553662 - DNA, 22 bp, Homo sapiens
aaagtcattgtaatatatgcta

SEQ ID NO: 8553663 - DNA, 22 bp, Homo sapiens
aaataaactgaagcacagagag

SEQ ID NO: 8553664 - DNA, 22 bp, Homo sapiens
aaagttttattcaagcattagt

SEQ ID NO: 8553665 - DNA, 22 bp, Homo sapiens
aaagttttattcaagcattagt

SEQ ID NO: 8553666 - DNA, 22 bp, Homo sapiens
aaatgacagagtaagctgttta

SEQ ID NO: 8553667 - DNA, 22 bp, Homo sapiens
aaatgacagagtaagctgttta

SEQ ID NO: 8553668 - DNA, 22 bp, Homo sapiens
aaatgacagagctgggactagt

SEQ ID NO: 8553669 - DNA, 22 bp, Homo sapiens
aaactgtgcttcccaaatgccc

SEQ ID NO: 8553670 - DNA, 22 bp, Homo sapiens
aaactgtgagctagtaaatagg

SEQ ID NO: 8553671 - DNA, 22 bp, Homo sapiens
aaactgtgagctagtaaatagg

SEQ ID NO: 8553672 - DNA, 22 bp, Homo sapiens
aaactgttgtggtttatcatta

SEQ ID NO: 8553673 - DNA, 23 bp, Homo sapiens
aaactgttgcttcaatgtatcct

SEQ ID NO: 8553674 - DNA, 22 bp, Homo sapiens
aaactgttatagcagaaaggac

SEQ ID NO: 8553675 - DNA, 22 bp, Homo sapiens
aaactgttcctttttcagcaac

SEQ ID NO: 8553676 - DNA, 22 bp, Homo sapiens
aaactgttgtggtttatcatta

SEQ ID NO: 8553677 - DNA, 22 bp, Homo sapiens
aaactgtttccctccataacct

SEQ ID NO: 8553678 - DNA, 22 bp, Homo sapiens
aaactgttgtggtttatcatta

SEQ ID NO: 8553679 - DNA, 22 bp, Homo sapiens
aaatgacactaggctttttgca

SEQ ID NO: 8553680 - DNA, 22 bp, Homo sapiens
aaatgacactaggctttttgca

SEQ ID NO: 8553681 - DNA, 22 bp, Homo sapiens
aaatgacaataaaagtccatgc

SEQ ID NO: 8553682 - DNA, 22 bp, Homo sapiens
aaatgacaataaaagtccatgc

SEQ ID NO: 8553683 - DNA, 22 bp, Homo sapiens
aaatgaactcaatgatctccca

SEQ ID NO: 8553684 - DNA, 22 bp, Homo sapiens
aaatgaactcttcctgcatccc

SEQ ID NO: 8553685 - DNA, 21 bp, Homo sapiens
aaatgaatgtggtagtgcaag

SEQ ID NO: 8553686 - DNA, 21 bp, Homo sapiens
aaatgaatgtggtagtgcaag

SEQ ID NO: 8553687 - DNA, 22 bp, Homo sapiens
aaatgaactcttcctgcatccc

SEQ ID NO: 8553688 - DNA, 21 bp, Homo sapiens
aaatgaatgtggtagtgcaag

SEQ ID NO: 8553689 - DNA, 21 bp, Homo sapiens
aaatgaatgtggtagtgcaag

SEQ ID NO: 8553690 - DNA, 22 bp, Homo sapiens
aaatacagagttatggacctca

SEQ ID NO: 8553691 - DNA, 22 bp, Homo sapiens
aaatacagagttatggacctca

SEQ ID NO: 8553692 - DNA, 22 bp, Homo sapiens
aaatacagagttgcttaaaagc

SEQ ID NO: 8553693 - DNA, 22 bp, Homo sapiens
aaatacagagttgcttaaaagc

SEQ ID NO: 8553694 - DNA, 22 bp, Homo sapiens
aaatacagagttgcttaaaagc

SEQ ID NO: 8553695 - DNA, 21 bp, Homo sapiens
aaatacagatgcaaatctgtt

SEQ ID NO: 8553696 - DNA, 21 bp, Homo sapiens
aaatacagatgcaaatctgtt

SEQ ID NO: 8553697 - DNA, 21 bp, Homo sapiens
aaatacagatgcaaatctgtt

SEQ ID NO: 8553698 - DNA, 21 bp, Homo sapiens
aaatacagatgcaaatctgtt

SEQ ID NO: 8553699 - DNA, 20 bp, Homo sapiens
aaatccagtgtgtattttac

SEQ ID NO: 8553700 - DNA, 22 bp, Homo sapiens
aaataacagtcagggacaacat

SEQ ID NO: 8553701 - DNA, 22 bp, Homo sapiens
aaataaaggtccactttagggc

SEQ ID NO: 8553702 - DNA, 22 bp, Homo sapiens
aaataacagtcagggacaacat

SEQ ID NO: 8553703 - DNA, 22 bp, Homo sapiens
aaatacaatttcaggctgtaat

SEQ ID NO: 8553704 - DNA, 22 bp, Homo sapiens
aaatacaatttcaggctgtaat

SEQ ID NO: 8553705 - DNA, 22 bp, Homo sapiens
aaatacacgtacatgtgtaaaa

SEQ ID NO: 8553706 - DNA, 22 bp, Homo sapiens
aaatacacgtacatgtgtaaaa

SEQ ID NO: 8553707 - DNA, 22 bp, Homo sapiens
aaatgtgagttatagcaataga

SEQ ID NO: 8553708 - DNA, 23 bp, Homo sapiens
aaatgtgagggaaaatctttctg

SEQ ID NO: 8553709 - DNA, 22 bp, Homo sapiens
aaatgtgagactgagttttcct

SEQ ID NO: 8553710 - DNA, 22 bp, Homo sapiens
aaatgtctttcaatagagaaat

SEQ ID NO: 8553711 - DNA, 22 bp, Homo sapiens
aaatgtctttcaatagagaaat

SEQ ID NO: 8553712 - DNA, 22 bp, Homo sapiens
aaatgtctttcaatagagaaat

SEQ ID NO: 8553713 - DNA, 22 bp, Homo sapiens
aaatgtctttcaatagagaaat

SEQ ID NO: 8553714 - DNA, 22 bp, Homo sapiens
aaatgtctttcaatagagaaat

SEQ ID NO: 8553715 - DNA, 22 bp, Homo sapiens
aaatgtctttcttctgctacgt

SEQ ID NO: 8553716 - DNA, 22 bp, Homo sapiens
aaatgtgacagatgcagtacag

SEQ ID NO: 8553717 - DNA, 22 bp, Homo sapiens
aaatgtctttgagtatttctgc

SEQ ID NO: 8553718 - DNA, 22 bp, Homo sapiens
aaagacagatggcaaggatgat

SEQ ID NO: 8553719 - DNA, 22 bp, Homo sapiens
aaagacagatggcaaggatgat

SEQ ID NO: 8553720 - DNA, 22 bp, Homo sapiens
aaagacagacggaaacctgagg

SEQ ID NO: 8553721 - DNA, 22 bp, Homo sapiens
aaagacacatgtctcttagatt

SEQ ID NO: 8553722 - DNA, 22 bp, Homo sapiens
aaagacagatggcaaggatgat

SEQ ID NO: 8553723 - DNA, 22 bp, Homo sapiens
aaagacagtggattcaaaatcc

SEQ ID NO: 8553724 - DNA, 22 bp, Homo sapiens
aaagacatatttctaagtttat

SEQ ID NO: 8553725 - DNA, 22 bp, Homo sapiens
aaacttcagactccccacttct

SEQ ID NO: 8553726 - DNA, 22 bp, Homo sapiens
aaacttcagactccccacttct

SEQ ID NO: 8553727 - DNA, 22 bp, Homo sapiens
aaacttcaaggatttgcaaatc

SEQ ID NO: 8553728 - DNA, 22 bp, Homo sapiens
aaacttcaaggatttgcaaatc

SEQ ID NO: 8553729 - DNA, 22 bp, Homo sapiens
aaacttcaaggatttgcaaatc

SEQ ID NO: 8553730 - DNA, 22 bp, Homo sapiens
aaacttcaaggatttgcaaatc

SEQ ID NO: 8553731 - DNA, 22 bp, Homo sapiens
aaacttattttatcacagttca

SEQ ID NO: 8553732 - DNA, 22 bp, Homo sapiens
aaacttcaagattcaagcctgg

SEQ ID NO: 8553733 - DNA, 22 bp, Homo sapiens
aaacttcaactggaatgggcta

SEQ ID NO: 8553734 - DNA, 22 bp, Homo sapiens
aaacttcagtgaatgacttatg

SEQ ID NO: 8553735 - DNA, 22 bp, Homo sapiens
aaacttcatggataatataaag

SEQ ID NO: 8553736 - DNA, 22 bp, Homo sapiens
aaacttcatggataatataaag

SEQ ID NO: 8553737 - DNA, 17 bp, Homo sapiens
aaacttcattctcagga

SEQ ID NO: 8553738 - DNA, 23 bp, Homo sapiens
aaacttcagtagtgtcatcagcc

SEQ ID NO: 8553739 - DNA, 22 bp, Homo sapiens
aaacttcagtgaatgacttatg

SEQ ID NO: 8553740 - DNA, 22 bp, Homo sapiens
aaacttcagggaataaaagagt

SEQ ID NO: 8553741 - DNA, 22 bp, Homo sapiens
aaacttcagtaggagccaacct

SEQ ID NO: 8553742 - DNA, 22 bp, Homo sapiens
aaacttcagggaataaaagagt

SEQ ID NO: 8553743 - DNA, 22 bp, Homo sapiens
aaacttcagtaggagccaacct

SEQ ID NO: 8553744 - DNA, 22 bp, Homo sapiens
aaatgtctgtatgagaaagaga

SEQ ID NO: 8553745 - DNA, 22 bp, Homo sapiens
aaatgtctgtctcatgaggaaa

SEQ ID NO: 8553746 - DNA, 22 bp, Homo sapiens
aaatgtctgttagtcatatcat

SEQ ID NO: 8553747 - DNA, 22 bp, Homo sapiens
aaatgtctttatctcatgtaac

SEQ ID NO: 8553748 - DNA, 22 bp, Homo sapiens
aaatgtctgttagtcatatcat

SEQ ID NO: 8553749 - DNA, 23 bp, Homo sapiens
aaatgtcttctagctcttgagaa

SEQ ID NO: 8553750 - DNA, 22 bp, Homo sapiens
aaatgtctttatctcatgtaac

SEQ ID NO: 8553751 - DNA, 22 bp, Homo sapiens
aaatgtctatctggcatattcc

SEQ ID NO: 8553752 - DNA, 22 bp, Homo sapiens
aaatggtgtttctaatgctaga

SEQ ID NO: 8553753 - DNA, 22 bp, Homo sapiens
aaatgtctgagacttctgaact

SEQ ID NO: 8553754 - DNA, 22 bp, Homo sapiens
aaatggtggctcttttaaattg

SEQ ID NO: 8553755 - DNA, 22 bp, Homo sapiens
aaatgtctgtatgagaaagaga

SEQ ID NO: 8553756 - DNA, 22 bp, Homo sapiens
aaatgtctgagacttctgaact

SEQ ID NO: 8553757 - DNA, 22 bp, Homo sapiens
aaatgtctgagacttctgaact

SEQ ID NO: 8553758 - DNA, 22 bp, Homo sapiens
aatacagcagatggagacaaat

SEQ ID NO: 8553759 - DNA, 22 bp, Homo sapiens
aatacagaggggtcacaattca

SEQ ID NO: 8553760 - DNA, 22 bp, Homo sapiens
aatacagaggggtcacaattca

SEQ ID NO: 8553761 - DNA, 22 bp, Homo sapiens
aatacagaggggtcacaattca

SEQ ID NO: 8553762 - DNA, 22 bp, Homo sapiens
aataatgtaggatgataaatga

SEQ ID NO: 8553763 - DNA, 22 bp, Homo sapiens
aataatgtaggatgataaatga

SEQ ID NO: 8553764 - DNA, 22 bp, Homo sapiens
aataatgagcttgtctaattgt

SEQ ID NO: 8553765 - DNA, 22 bp, Homo sapiens
aataatgagacagcttatttaa

SEQ ID NO: 8553766 - DNA, 22 bp, Homo sapiens
aataatgagcttgtctaattgt

SEQ ID NO: 8553767 - DNA, 22 bp, Homo sapiens
aataatcctgcccgtctctccg

SEQ ID NO: 8553768 - DNA, 22 bp, Homo sapiens
aataatcttgactactgaatca

SEQ ID NO: 8553769 - DNA, 22 bp, Homo sapiens
aataatctccctttttgtatgt

SEQ ID NO: 8553770 - DNA, 22 bp, Homo sapiens
aataagaattgccagatttgaa

SEQ ID NO: 8553771 - DNA, 22 bp, Homo sapiens
aataatattcctctgtgtgcgt

SEQ ID NO: 8553772 - DNA, 22 bp, Homo sapiens
aataatatttgaagcttcaaag

SEQ ID NO: 8553773 - DNA, 22 bp, Homo sapiens
aagttacaggagaaagagatca

SEQ ID NO: 8553774 - DNA, 22 bp, Homo sapiens
aagttacagtcagaggttaaca

SEQ ID NO: 8553775 - DNA, 22 bp, Homo sapiens
aataagaattgccagatttgaa

SEQ ID NO: 8553776 - DNA, 22 bp, Homo sapiens
aataagaattgccagatttgaa

SEQ ID NO: 8553777 - DNA, 22 bp, Homo sapiens
aagttacagttattatttaaaa

SEQ ID NO: 8553778 - DNA, 22 bp, Homo sapiens
aacagtttatgagatatgctat

SEQ ID NO: 8553779 - DNA, 22 bp, Homo sapiens
aacagttattatcacattagtg

SEQ ID NO: 8553780 - DNA, 22 bp, Homo sapiens
aacagtttatcaagtttttaca

SEQ ID NO: 8553781 - DNA, 22 bp, Homo sapiens
aatatttcaaaaggaaacacag

SEQ ID NO: 8553782 - DNA, 22 bp, Homo sapiens
aatatttccaaggcctgtcagg

SEQ ID NO: 8553783 - DNA, 22 bp, Homo sapiens
aatatttctccttcgttatagc

SEQ ID NO: 8553784 - DNA, 22 bp, Homo sapiens
aatatttctggtgcttctcact

SEQ ID NO: 8553785 - DNA, 22 bp, Homo sapiens
aatccactttgtgcccctctct

SEQ ID NO: 8553786 - DNA, 22 bp, Homo sapiens
aatccactaatgaagaatgggc

SEQ ID NO: 8553787 - DNA, 22 bp, Homo sapiens
aatatttctgtagctatgttct

SEQ ID NO: 8553788 - DNA, 22 bp, Homo sapiens
aatatttatgacaggaagtagc

SEQ ID NO: 8553789 - DNA, 22 bp, Homo sapiens
aatatttatgacaggaagtagc

SEQ ID NO: 8553790 - DNA, 22 bp, Homo sapiens
aatattgtttcaagatcacaga

SEQ ID NO: 8553791 - DNA, 22 bp, Homo sapiens
aatatttatatttctcttccct

SEQ ID NO: 8553792 - DNA, 22 bp, Homo sapiens
aatatttatatttctcttccct

SEQ ID NO: 8553793 - DNA, 22 bp, Homo sapiens
aatattgtttcaagatcacaga

SEQ ID NO: 8553794 - DNA, 22 bp, Homo sapiens
aatatctgtggccatacaattt

SEQ ID NO: 8553795 - DNA, 22 bp, Homo sapiens
aatatctgtctctaatgcatat

SEQ ID NO: 8553796 - DNA, 22 bp, Homo sapiens
aatatctgtggccatacaattt

SEQ ID NO: 8553797 - DNA, 22 bp, Homo sapiens
aatatctgtctctaatgcatat

SEQ ID NO: 8553798 - DNA, 22 bp, Homo sapiens
aatatctggagatgctttttgt

SEQ ID NO: 8553799 - DNA, 22 bp, Homo sapiens
aatatctgtctctaatgcatat

SEQ ID NO: 8553800 - DNA, 22 bp, Homo sapiens
aatattgagaaccagcatgttt

SEQ ID NO: 8553801 - DNA, 22 bp, Homo sapiens
aatatctgtggccatacaattt

SEQ ID NO: 8553802 - DNA, 22 bp, Homo sapiens
aatatctgtggccatacaattt

SEQ ID NO: 8553803 - DNA, 22 bp, Homo sapiens
aatatctgttgttctaagccac

SEQ ID NO: 8553804 - DNA, 21 bp, Homo sapiens
aatacagtgaagaatttcttt

SEQ ID NO: 8553805 - DNA, 19 bp, Homo sapiens
aatacagtgttatagaatt

SEQ ID NO: 8553806 - DNA, 22 bp, Homo sapiens
aatacatatggaattccatgtt

SEQ ID NO: 8553807 - DNA, 22 bp, Homo sapiens
aatacataataagttttgtctg

SEQ ID NO: 8553808 - DNA, 22 bp, Homo sapiens
aatacagcagatggagacaaat

SEQ ID NO: 8553809 - DNA, 22 bp, Homo sapiens
aatacagtaggtaatagttcat

SEQ ID NO: 8553810 - DNA, 22 bp, Homo sapiens
aatatcagtatattgtatcagt

SEQ ID NO: 8553811 - DNA, 22 bp, Homo sapiens
aatatctcaccatgacaaagca

SEQ ID NO: 8553812 - DNA, 22 bp, Homo sapiens
aatatctagcctttagcagctt

SEQ ID NO: 8553813 - DNA, 22 bp, Homo sapiens
aatatccattgggagcaaatgg

SEQ ID NO: 8553814 - DNA, 22 bp, Homo sapiens
aactttaaggctataaattatg

SEQ ID NO: 8553815 - DNA, 22 bp, Homo sapiens
aactttaaggctataaattatg

SEQ ID NO: 8553816 - DNA, 22 bp, Homo sapiens
aactttaaagaggaggcttggg

SEQ ID NO: 8553817 - DNA, 22 bp, Homo sapiens
aactttacactgctttacatga

SEQ ID NO: 8553818 - DNA, 23 bp, Homo sapiens
aactttactattttgaataatgc

SEQ ID NO: 8553819 - DNA, 22 bp, Homo sapiens
aactttaaaaaatatgtctgtt

SEQ ID NO: 8553820 - DNA, 20 bp, Homo sapiens
aacttgttttgttttctaat

SEQ ID NO: 8553821 - DNA, 22 bp, Homo sapiens
aacttgtttcttccattcaaca

SEQ ID NO: 8553822 - DNA, 20 bp, Homo sapiens
aacttgttttgttttctaat

SEQ ID NO: 8553823 - DNA, 22 bp, Homo sapiens
aacttgtatatgttattcagag

SEQ ID NO: 8553824 - DNA, 22 bp, Homo sapiens
aacttgtaggactgcactgtag

SEQ ID NO: 8553825 - DNA, 21 bp, Homo sapiens
aacttgtatttctccttattc

SEQ ID NO: 8553826 - DNA, 20 bp, Homo sapiens
aacttgtcttcctgtttggc

SEQ ID NO: 8553827 - DNA, 20 bp, Homo sapiens
aacttgttctacctgtttca

SEQ ID NO: 8553828 - DNA, 22 bp, Homo sapiens
aatgtacaaaccttctttgtag

SEQ ID NO: 8553829 - DNA, 22 bp, Homo sapiens
aatgtacaaaccttctttgtag

SEQ ID NO: 8553830 - DNA, 22 bp, Homo sapiens
aatgtacaaaccttctttgtag

SEQ ID NO: 8553831 - DNA, 22 bp, Homo sapiens
aatgtacaaaagtcagccaact

SEQ ID NO: 8553832 - DNA, 22 bp, Homo sapiens
aatgtacaaaagtcagccaact

SEQ ID NO: 8553833 - DNA, 22 bp, Homo sapiens
aatgtaaagctcaggtcaggag

SEQ ID NO: 8553834 - DNA, 22 bp, Homo sapiens
aatgtaaagttgggcacaaatg

SEQ ID NO: 8553835 - DNA, 22 bp, Homo sapiens
aactttacttgaaagaacatgt

SEQ ID NO: 8553836 - DNA, 22 bp, Homo sapiens
aactttacttgaaagaacatgt

SEQ ID NO: 8553837 - DNA, 22 bp, Homo sapiens
aactttacttgaaagaacatgt

SEQ ID NO: 8553838 - DNA, 22 bp, Homo sapiens
aatgtaaacagcaagagaaggg

SEQ ID NO: 8553839 - DNA, 22 bp, Homo sapiens
aatgtaaacagcaagagaaggg

SEQ ID NO: 8553840 - DNA, 22 bp, Homo sapiens
aacttcatttataatgtcatta

SEQ ID NO: 8553841 - DNA, 22 bp, Homo sapiens
aacttgtaatgaaaggcaatag

SEQ ID NO: 8553842 - DNA, 22 bp, Homo sapiens
aacttggtaccaccttctgaag

SEQ ID NO: 8553843 - DNA, 22 bp, Homo sapiens
aacttcattcctttttatgact

SEQ ID NO: 8553844 - DNA, 22 bp, Homo sapiens
aacttcatttataatgtcatta

SEQ ID NO: 8553845 - DNA, 22 bp, Homo sapiens
aacttcatttataatgtcatta

SEQ ID NO: 8553846 - DNA, 22 bp, Homo sapiens
aatgctttcaaaaatgtgcagt

SEQ ID NO: 8553847 - DNA, 22 bp, Homo sapiens
aatgcttatgggttccataata

SEQ ID NO: 8553848 - DNA, 22 bp, Homo sapiens
aatgcttcaacctcccacatgt

SEQ ID NO: 8553849 - DNA, 22 bp, Homo sapiens
aatgcttattattaatagaatg

SEQ ID NO: 8553850 - DNA, 22 bp, Homo sapiens
aatgcttcaacctcccacatgt

SEQ ID NO: 8553851 - DNA, 22 bp, Homo sapiens
aatgcttccaaaataccaagcc

SEQ ID NO: 8553852 - DNA, 22 bp, Homo sapiens
aatgcttcctcctcacctcagg

SEQ ID NO: 8553853 - DNA, 22 bp, Homo sapiens
aatgcttcctcctcacctcagg

SEQ ID NO: 8553854 - DNA, 22 bp, Homo sapiens
aatgcttccaaaataccaagcc

SEQ ID NO: 8553855 - DNA, 22 bp, Homo sapiens
aatgcttatacctaatgatctt

SEQ ID NO: 8553856 - DNA, 22 bp, Homo sapiens
aatgcttatacctaatgatctt

SEQ ID NO: 8553857 - DNA, 22 bp, Homo sapiens
aatgcttataacgttagaatgt

SEQ ID NO: 8553858 - DNA, 22 bp, Homo sapiens
aatgcttataacgttagaatgt

SEQ ID NO: 8553859 - DNA, 22 bp, Homo sapiens
aatgctgtcttttctacttcat

SEQ ID NO: 8553860 - DNA, 22 bp, Homo sapiens
aatgctgttgagttgttcctgt

SEQ ID NO: 8553861 - DNA, 22 bp, Homo sapiens
aatgcttaattcaatactgtgt

SEQ ID NO: 8553862 - DNA, 22 bp, Homo sapiens
aatgcagtttcatttgtagaat

SEQ ID NO: 8553863 - DNA, 22 bp, Homo sapiens
aatgcataatggtttgtgacaa

SEQ ID NO: 8553864 - DNA, 22 bp, Homo sapiens
aatgcataatggtttgtgacaa

SEQ ID NO: 8553865 - DNA, 22 bp, Homo sapiens
aatgcataatggtttgtgacaa

SEQ ID NO: 8553866 - DNA, 22 bp, Homo sapiens
aatgctgtatatcttagctaat

SEQ ID NO: 8553867 - DNA, 22 bp, Homo sapiens
aatgctgtatatcttagctaat

SEQ ID NO: 8553868 - DNA, 22 bp, Homo sapiens
aatgcagtgagccattaaatgg

SEQ ID NO: 8553869 - DNA, 22 bp, Homo sapiens
aatgcagtgagccattaaatgg

SEQ ID NO: 8553870 - DNA, 21 bp, Homo sapiens
aatgatgaaagatgacagagt

SEQ ID NO: 8553871 - DNA, 22 bp, Homo sapiens
aatgatgaactcagagggaacc

SEQ ID NO: 8553872 - DNA, 22 bp, Homo sapiens
aatgatgacaggataaagaaca

SEQ ID NO: 8553873 - DNA, 22 bp, Homo sapiens
aatgcacaaaggtgtctattgc

SEQ ID NO: 8553874 - DNA, 22 bp, Homo sapiens
aatgaacaaaatatgctttgca

SEQ ID NO: 8553875 - DNA, 22 bp, Homo sapiens
aatgaaatgtagcttatccata

SEQ ID NO: 8553876 - DNA, 18 bp, Homo sapiens
aatgaaatgtacaccttt

SEQ ID NO: 8553877 - DNA, 18 bp, Homo sapiens
aatgaaatgtacaccttt

SEQ ID NO: 8553878 - DNA, 22 bp, Homo sapiens
aatgaaatgaagatatgatcag

SEQ ID NO: 8553879 - DNA, 22 bp, Homo sapiens
aatgcacagctaaagtggttcc

SEQ ID NO: 8553880 - DNA, 22 bp, Homo sapiens
aatgcacagcgttccatgcttg

SEQ ID NO: 8553881 - DNA, 22 bp, Homo sapiens
aatgcacacatttggtactgaa

SEQ ID NO: 8553882 - DNA, 22 bp, Homo sapiens
aatgcacagcgttccatgcttg

SEQ ID NO: 8553883 - DNA, 18 bp, Homo sapiens
aatgcacacatttactcc

SEQ ID NO: 8553884 - DNA, 18 bp, Homo sapiens
aatgcacacatttactcc

SEQ ID NO: 8553885 - DNA, 18 bp, Homo sapiens
aatgcacacatttactcc

SEQ ID NO: 8553886 - DNA, 22 bp, Homo sapiens
aatgcacatgccacatgtggta

SEQ ID NO: 8553887 - DNA, 22 bp, Homo sapiens
aatgcacatgccacatgtggta

SEQ ID NO: 8553888 - DNA, 22 bp, Homo sapiens
aatgcacatatatttccttatt

SEQ ID NO: 8553889 - DNA, 22 bp, Homo sapiens
aatgcacataaatatggtctta

SEQ ID NO: 8553890 - DNA, 22 bp, Homo sapiens
aatgcacataaatatggtctta

SEQ ID NO: 8553891 - DNA, 22 bp, Homo sapiens
aatgcacatatatgtgtataca

SEQ ID NO: 8553892 - DNA, 22 bp, Homo sapiens
aatgcacatgttgtaataaata

SEQ ID NO: 8553893 - DNA, 22 bp, Homo sapiens
aatgcacatgtcttggcctcac

SEQ ID NO: 8553894 - DNA, 22 bp, Homo sapiens
aatgcacatgtcttggcctcac

SEQ ID NO: 8553895 - DNA, 22 bp, Homo sapiens
aatgcacatgttgtaataaata

SEQ ID NO: 8553896 - DNA, 22 bp, Homo sapiens
aatgcacctaccttgattctgc

SEQ ID NO: 8553897 - DNA, 22 bp, Homo sapiens
aatgcaccttggcagggattca

SEQ ID NO: 8553898 - DNA, 22 bp, Homo sapiens
aatgcagagtaaatatttaatt

SEQ ID NO: 8553899 - DNA, 22 bp, Homo sapiens
aatctcttcccagtaaaaatgg

SEQ ID NO: 8553900 - DNA, 22 bp, Homo sapiens
aatctcttcccagtaaaaatgg

SEQ ID NO: 8553901 - DNA, 22 bp, Homo sapiens
aatctcttggttcagaagcctc

SEQ ID NO: 8553902 - DNA, 22 bp, Homo sapiens
aatctcttgggaggaatgaatt

SEQ ID NO: 8553903 - DNA, 22 bp, Homo sapiens
aatctgagggaacttgaactcc

SEQ ID NO: 8553904 - DNA, 22 bp, Homo sapiens
aatctgagggaacttgaactcc

SEQ ID NO: 8553905 - DNA, 22 bp, Homo sapiens
aatctgaatatttatgtgtatt

SEQ ID NO: 8553906 - DNA, 22 bp, Homo sapiens
aatctgaagggagatacatgta

SEQ ID NO: 8553907 - DNA, 20 bp, Homo sapiens
aatctgaatcccagtcctag

SEQ ID NO: 8553908 - DNA, 22 bp, Homo sapiens
aatctctttggctcaaggatcc

SEQ ID NO: 8553909 - DNA, 22 bp, Homo sapiens
aatctgaaagtatggagcagta

SEQ ID NO: 8553910 - DNA, 22 bp, Homo sapiens
aatctgaaagtatggagcagta

SEQ ID NO: 8553911 - DNA, 22 bp, Homo sapiens
aatgaaactgtatatagactgt

SEQ ID NO: 8553912 - DNA, 22 bp, Homo sapiens
aatgaaactgtatatagactgt

SEQ ID NO: 8553913 - DNA, 22 bp, Homo sapiens
aatgaaatctgctgggtaaaga

SEQ ID NO: 8553914 - DNA, 22 bp, Homo sapiens
aatctggacacagttctcatgc

SEQ ID NO: 8553915 - DNA, 22 bp, Homo sapiens
aatctggacacagttctcatgc

SEQ ID NO: 8553916 - DNA, 22 bp, Homo sapiens
aaggcactgaaaaattgtgtgt

SEQ ID NO: 8553917 - DNA, 22 bp, Homo sapiens
aaggcactgaacttaaattctg

SEQ ID NO: 8553918 - DNA, 17 bp, Homo sapiens
aaggatattatagttct

SEQ ID NO: 8553919 - DNA, 22 bp, Homo sapiens
aaggatcaagtggattttctta

SEQ ID NO: 8553920 - DNA, 22 bp, Homo sapiens
aaggatcatagtaaacattgat

SEQ ID NO: 8553921 - DNA, 22 bp, Homo sapiens
aaggcactcattcaaggagata

SEQ ID NO: 8553922 - DNA, 22 bp, Homo sapiens
aaggcactagcagaattagtga

SEQ ID NO: 8553923 - DNA, 22 bp, Homo sapiens
aaggagtctgggccattcagag

SEQ ID NO: 8553924 - DNA, 22 bp, Homo sapiens
aaggagtctgggccattcagag

SEQ ID NO: 8553925 - DNA, 22 bp, Homo sapiens
aaggagtctgggccattcagag

SEQ ID NO: 8553926 - DNA, 22 bp, Homo sapiens
aaggagtctgggccattcagag

SEQ ID NO: 8553927 - DNA, 22 bp, Homo sapiens
aaggaggttatcccagtggact

SEQ ID NO: 8553928 - DNA, 22 bp, Homo sapiens
aaggagtctcagctgggcctga

SEQ ID NO: 8553929 - DNA, 22 bp, Homo sapiens
aaggagggttcccaggtcctgg

SEQ ID NO: 8553930 - DNA, 22 bp, Homo sapiens
aaggatacttttagagcctgag

SEQ ID NO: 8553931 - DNA, 22 bp, Homo sapiens
aaggagtgatatatgggtgcta

SEQ ID NO: 8553932 - DNA, 22 bp, Homo sapiens
aaggagtctgggccattcagag

SEQ ID NO: 8553933 - DNA, 22 bp, Homo sapiens
aaggagtgcatgactcagagta

SEQ ID NO: 8553934 - DNA, 22 bp, Homo sapiens
aaggagtggggcatatcacaga

SEQ ID NO: 8553935 - DNA, 22 bp, Homo sapiens
aaatggatctgtggaatacatt

SEQ ID NO: 8553936 - DNA, 22 bp, Homo sapiens
aaatggaagaagtgcaatactg

SEQ ID NO: 8553937 - DNA, 22 bp, Homo sapiens
aaatggaatgtgtttataattc

SEQ ID NO: 8553938 - DNA, 22 bp, Homo sapiens
aaatggcaacagaagggagttc

SEQ ID NO: 8553939 - DNA, 22 bp, Homo sapiens
aaatggatgttgagttaaatgt

SEQ ID NO: 8553940 - DNA, 22 bp, Homo sapiens
aaatggcaacagaagggagttc

SEQ ID NO: 8553941 - DNA, 22 bp, Homo sapiens
aaggagaagtctgttgagattg

SEQ ID NO: 8553942 - DNA, 22 bp, Homo sapiens
aaggctgagagtcacagtccta

SEQ ID NO: 8553943 - DNA, 22 bp, Homo sapiens
aaggctgagacagcacaggtcc

SEQ ID NO: 8553944 - DNA, 22 bp, Homo sapiens
aaggctgagagtcacagtccta

SEQ ID NO: 8553945 - DNA, 22 bp, Homo sapiens
aaggctgagacagcacaggtcc

SEQ ID NO: 8553946 - DNA, 21 bp, Homo sapiens
aaggctgagacaactcaggag

SEQ ID NO: 8553947 - DNA, 21 bp, Homo sapiens
aaggctgagacaactcaggag

SEQ ID NO: 8553948 - DNA, 22 bp, Homo sapiens
aaggctgagacagcacaggtcc

SEQ ID NO: 8553949 - DNA, 22 bp, Homo sapiens
aaggctgagacagcacaggtcc

SEQ ID NO: 8553950 - DNA, 22 bp, Homo sapiens
aaggctgacgtttgtgtttatt

SEQ ID NO: 8553951 - DNA, 22 bp, Homo sapiens
aaggctgactcaacagggggcc

SEQ ID NO: 8553952 - DNA, 22 bp, Homo sapiens
aaggctgacgtttgtgtttatt

SEQ ID NO: 8553953 - DNA, 22 bp, Homo sapiens
aaggctgaccagtttacacttt

SEQ ID NO: 8553954 - DNA, 22 bp, Homo sapiens
aaggctgaccagtttacacttt

SEQ ID NO: 8553955 - DNA, 22 bp, Homo sapiens
aaggctgaccagtttacacttt

SEQ ID NO: 8553956 - DNA, 22 bp, Homo sapiens
aaggctgaattcaagggtaggc

SEQ ID NO: 8553957 - DNA, 22 bp, Homo sapiens
aagggcaggaaaagatggatgt

SEQ ID NO: 8553958 - DNA, 22 bp, Homo sapiens
aagggcaggaaaagatggatgt

SEQ ID NO: 8553959 - DNA, 22 bp, Homo sapiens
aagggcaggaaaagatggatgt

SEQ ID NO: 8553960 - DNA, 22 bp, Homo sapiens
aagggcaggagaagacggatat

SEQ ID NO: 8553961 - DNA, 22 bp, Homo sapiens
aagggcaggagaagacggatat

SEQ ID NO: 8553962 - DNA, 22 bp, Homo sapiens
aagggcaggagaagacggatat

SEQ ID NO: 8553963 - DNA, 22 bp, Homo sapiens
aagggcaggcacccaccctcac

SEQ ID NO: 8553964 - DNA, 22 bp, Homo sapiens
aagggcaggcacccaccctcac

SEQ ID NO: 8553965 - DNA, 22 bp, Homo sapiens
aagggcaggcagagatcatata

SEQ ID NO: 8553966 - DNA, 22 bp, Homo sapiens
aagggcaggcagagatcatata

SEQ ID NO: 8553967 - DNA, 22 bp, Homo sapiens
aagggcaggcacccaccctcac

SEQ ID NO: 8553968 - DNA, 22 bp, Homo sapiens
aaggctgaaagaccttgaacct

SEQ ID NO: 8553969 - DNA, 22 bp, Homo sapiens
aaggcccttccaccagtcctcg

SEQ ID NO: 8553970 - DNA, 22 bp, Homo sapiens
aaggcccttcggcttcctcagc

SEQ ID NO: 8553971 - DNA, 22 bp, Homo sapiens
aaggccctggccccagcttctt

SEQ ID NO: 8553972 - DNA, 22 bp, Homo sapiens
aaggccctggcaggaagcagga

SEQ ID NO: 8553973 - DNA, 22 bp, Homo sapiens
aaggccctaatagagcacatat

SEQ ID NO: 8553974 - DNA, 22 bp, Homo sapiens
aaggccctcatgcgtcagagcc

SEQ ID NO: 8553975 - DNA, 22 bp, Homo sapiens
aaggcactgtactagttagtta

SEQ ID NO: 8553976 - DNA, 22 bp, Homo sapiens
aaggccatctacttacggaatt

SEQ ID NO: 8553977 - DNA, 22 bp, Homo sapiens
aaggccatgaccacttgctgtg

SEQ ID NO: 8553978 - DNA, 22 bp, Homo sapiens
aaggccatgcacatcctaggca

SEQ ID NO: 8553979 - DNA, 22 bp, Homo sapiens
aaggccatgcttgagttgaagg

SEQ ID NO: 8553980 - DNA, 22 bp, Homo sapiens
aaggccatgtaggaggcatgcg

SEQ ID NO: 8553981 - DNA, 22 bp, Homo sapiens
aaggccattgtaatgtaaatat

SEQ ID NO: 8553982 - DNA, 22 bp, Homo sapiens
aaggccattgtaatgtaaatat

SEQ ID NO: 8553983 - DNA, 22 bp, Homo sapiens
aaggccattattctgatatatt

SEQ ID NO: 8553984 - DNA, 18 bp, Homo sapiens
aagtcttggaatttccac

SEQ ID NO: 8553985 - DNA, 22 bp, Homo sapiens
aagtcttttgctaagagtaatg

SEQ ID NO: 8553986 - DNA, 22 bp, Homo sapiens
aagtctgatcatttcttctata

SEQ ID NO: 8553987 - DNA, 22 bp, Homo sapiens
aagtgcattagatagaatgatg

SEQ ID NO: 8553988 - DNA, 22 bp, Homo sapiens
aagtgcatggtatggtctccat

SEQ ID NO: 8553989 - DNA, 22 bp, Homo sapiens
aagtgcattagatagaatgatg

SEQ ID NO: 8553990 - DNA, 22 bp, Homo sapiens
aagtgcattagatagaatgatg

SEQ ID NO: 8553991 - DNA, 22 bp, Homo sapiens
aagtgcatatttttgttgtaga

SEQ ID NO: 8553992 - DNA, 22 bp, Homo sapiens
aagtgcatcactactcattaca

SEQ ID NO: 8553993 - DNA, 22 bp, Homo sapiens
aagtgaaacatgtatctcttta

SEQ ID NO: 8553994 - DNA, 22 bp, Homo sapiens
aagtctttttgaatctataact

SEQ ID NO: 8553995 - DNA, 22 bp, Homo sapiens
aagtgaaacatgtatctcttta

SEQ ID NO: 8553996 - DNA, 21 bp, Homo sapiens
aagtgccacccacagatgcat

SEQ ID NO: 8553997 - DNA, 22 bp, Homo sapiens
aagtgcctgacctagcctggag

SEQ ID NO: 8553998 - DNA, 22 bp, Homo sapiens
aagtgcctgacctagcctggag

SEQ ID NO: 8553999 - DNA, 22 bp, Homo sapiens
aacagtgttttgctctttgccc

SEQ ID NO: 8554000 - DNA, 22 bp, Homo sapiens
aacagtgtttttcttcagcact

SEQ ID NO: 8554001 - DNA, 22 bp, Homo sapiens
aacagtgtttttcttcagcact

SEQ ID NO: 8554002 - DNA, 22 bp, Homo sapiens
aacagtgcttcattcacacatt

SEQ ID NO: 8554003 - DNA, 22 bp, Homo sapiens
aacagtgtcaggattacagata

SEQ ID NO: 8554004 - DNA, 22 bp, Homo sapiens
aacagtgtgtacacatcatagg

SEQ ID NO: 8554005 - DNA, 22 bp, Homo sapiens
aacagtgtctgtggttaaaggt

SEQ ID NO: 8554006 - DNA, 22 bp, Homo sapiens
aacagtaaagacagaatttatc

SEQ ID NO: 8554007 - DNA, 22 bp, Homo sapiens
aagtgcttaggtcaaaggacat

SEQ ID NO: 8554008 - DNA, 22 bp, Homo sapiens
aagtgcttaaaagggtggtcta

SEQ ID NO: 8554009 - DNA, 17 bp, Homo sapiens
aacagtaagccctgttt

SEQ ID NO: 8554010 - DNA, 22 bp, Homo sapiens
aagtgctgagactacaggcatg

SEQ ID NO: 8554011 - DNA, 22 bp, Homo sapiens
aagtgctgagactacaggcatg

SEQ ID NO: 8554012 - DNA, 22 bp, Homo sapiens
aagtgctgggattacaggcatg

SEQ ID NO: 8554013 - DNA, 22 bp, Homo sapiens
aagtgctgggattacaggcatg

SEQ ID NO: 8554014 - DNA, 22 bp, Homo sapiens
aagtgctgggattacaggtgtc

SEQ ID NO: 8554015 - DNA, 22 bp, Homo sapiens
aagtgctgggattacaggtgtg

SEQ ID NO: 8554016 - DNA, 22 bp, Homo sapiens
aagtgctgggattataggcatg

SEQ ID NO: 8554017 - DNA, 22 bp, Homo sapiens
aagtctgagagaaactctctca

SEQ ID NO: 8554018 - DNA, 22 bp, Homo sapiens
aagtctgatcatttcttctata

SEQ ID NO: 8554019 - DNA, 22 bp, Homo sapiens
aagtctgatcatttcttctata

SEQ ID NO: 8554020 - DNA, 22 bp, Homo sapiens
aagtacaacgcatacagagaaa

SEQ ID NO: 8554021 - DNA, 22 bp, Homo sapiens
aagtaatggttaaataattcta

SEQ ID NO: 8554022 - DNA, 22 bp, Homo sapiens
aagtaatctggaatttggtttt

SEQ ID NO: 8554023 - DNA, 22 bp, Homo sapiens
aagtaacatctgaacatgatgt

SEQ ID NO: 8554024 - DNA, 22 bp, Homo sapiens
aagtaacatctgaacatgatgt

SEQ ID NO: 8554025 - DNA, 22 bp, Homo sapiens
aagtaacatctgaacatgatgt

SEQ ID NO: 8554026 - DNA, 22 bp, Homo sapiens
aagtaactaaagatatccattt

SEQ ID NO: 8554027 - DNA, 22 bp, Homo sapiens
aagtaacatgggaacatctgaa

SEQ ID NO: 8554028 - DNA, 22 bp, Homo sapiens
aagtaaggcagtgaatgagatt

SEQ ID NO: 8554029 - DNA, 22 bp, Homo sapiens
aagggcagggagtttgtgtcta

SEQ ID NO: 8554030 - DNA, 22 bp, Homo sapiens
aagggctgcaatccaaaacact

SEQ ID NO: 8554031 - DNA, 22 bp, Homo sapiens
aagggcaggtgggcatttctgg

SEQ ID NO: 8554032 - DNA, 22 bp, Homo sapiens
aagggctgcatttgatgtgtca

SEQ ID NO: 8554033 - DNA, 22 bp, Homo sapiens
aagggcaggtgggcatttctgg

SEQ ID NO: 8554034 - DNA, 22 bp, Homo sapiens
aagggctgccagggggtgccag

SEQ ID NO: 8554035 - DNA, 22 bp, Homo sapiens
aagggctgccagggggtgccag

SEQ ID NO: 8554036 - DNA, 22 bp, Homo sapiens
aagggctgccagggggtgccag

SEQ ID NO: 8554037 - DNA, 22 bp, Homo sapiens
aaggtgttcaggttttcccatt

SEQ ID NO: 8554038 - DNA, 22 bp, Homo sapiens
aaggtgtgaactgattcattgg

SEQ ID NO: 8554039 - DNA, 22 bp, Homo sapiens
aagggctggaatatctcttaga

SEQ ID NO: 8554040 - DNA, 18 bp, Homo sapiens
aagaactgaggtcctaga

SEQ ID NO: 8554041 - DNA, 23 bp, Homo sapiens
aagaactgcgaatggagaaagta

SEQ ID NO: 8554042 - DNA, 21 bp, Homo sapiens
aagaactattgaggtacacag

SEQ ID NO: 8554043 - DNA, 22 bp, Homo sapiens
aagaactatctctggctgtagg

SEQ ID NO: 8554044 - DNA, 22 bp, Homo sapiens
aagaacctatatgctgatgaat

SEQ ID NO: 8554045 - DNA, 22 bp, Homo sapiens
aagaacattttgtagaatgaca

SEQ ID NO: 8554046 - DNA, 22 bp, Homo sapiens
aagaacattttgtagaatgaca

SEQ ID NO: 8554047 - DNA, 22 bp, Homo sapiens
aagaacattttgtagaatgaca

SEQ ID NO: 8554048 - DNA, 22 bp, Homo sapiens
aagaacattttgtagaatgaca

SEQ ID NO: 8554049 - DNA, 22 bp, Homo sapiens
aagaacattttgtagaatgaca

SEQ ID NO: 8554050 - DNA, 22 bp, Homo sapiens
aagaacattgatattgtctatg

SEQ ID NO: 8554051 - DNA, 22 bp, Homo sapiens
aagaacattttgtagaatgaca

SEQ ID NO: 8554052 - DNA, 22 bp, Homo sapiens
aatgtacaagggttccagtttt

SEQ ID NO: 8554053 - DNA, 22 bp, Homo sapiens
aatgtacaagggttccagtttt

SEQ ID NO: 8554054 - DNA, 22 bp, Homo sapiens
aatgtacaagggttccagtttt

SEQ ID NO: 8554055 - DNA, 22 bp, Homo sapiens
aagaacaggttctagaaccatt

SEQ ID NO: 8554056 - DNA, 22 bp, Homo sapiens
aagaacatgttaaaagattcac

SEQ ID NO: 8554057 - DNA, 22 bp, Homo sapiens
aagaacatgttaaaagattcac

SEQ ID NO: 8554058 - DNA, 22 bp, Homo sapiens
aagaacaggttctagaaccatt

SEQ ID NO: 8554059 - DNA, 22 bp, Homo sapiens
aagaagaagtgttatttttaga

SEQ ID NO: 8554060 - DNA, 22 bp, Homo sapiens
aagaagaagtgttatttttaga

SEQ ID NO: 8554061 - DNA, 22 bp, Homo sapiens
aagaagaagtgttatttttaga

SEQ ID NO: 8554062 - DNA, 22 bp, Homo sapiens
aagaagagaaatgtgctgctgg

SEQ ID NO: 8554063 - DNA, 22 bp, Homo sapiens
aagaagagaaatgtgctgctgg

SEQ ID NO: 8554064 - DNA, 22 bp, Homo sapiens
aagaactttaaagcacttatga

SEQ ID NO: 8554065 - DNA, 22 bp, Homo sapiens
aagaactgtatcaagatgtagt

SEQ ID NO: 8554066 - DNA, 22 bp, Homo sapiens
aagaactgtgctccaggctcca

SEQ ID NO: 8554067 - DNA, 22 bp, Homo sapiens
acaaaaattagctgggcatggt

SEQ ID NO: 8554068 - DNA, 22 bp, Homo sapiens
acaaaaattagctgggcatggt

SEQ ID NO: 8554069 - DNA, 22 bp, Homo sapiens
aattttatctctaagcaggctt

SEQ ID NO: 8554070 - DNA, 22 bp, Homo sapiens
aattttatctctaagcaggctt

SEQ ID NO: 8554071 - DNA, 19 bp, Homo sapiens
aagaagcaataagctgtga

SEQ ID NO: 8554072 - DNA, 19 bp, Homo sapiens
aagaagcaataagctgtga

SEQ ID NO: 8554073 - DNA, 21 bp, Homo sapiens
aagaagcaatttattggaagg

SEQ ID NO: 8554074 - DNA, 22 bp, Homo sapiens
aattttatctctaagcaggctt

SEQ ID NO: 8554075 - DNA, 22 bp, Homo sapiens
aagaagatggttaactttcagt

SEQ ID NO: 8554076 - DNA, 22 bp, Homo sapiens
aagaagatggttaactttcagt

SEQ ID NO: 8554077 - DNA, 19 bp, Homo sapiens
aagaagcaataagctgtga

SEQ ID NO: 8554078 - DNA, 22 bp, Homo sapiens
aagaatatagattttttgaagt

SEQ ID NO: 8554079 - DNA, 22 bp, Homo sapiens
acaaaatagagttctcccctgg

SEQ ID NO: 8554080 - DNA, 22 bp, Homo sapiens
aagaatatagattttttgaagt

SEQ ID NO: 8554081 - DNA, 22 bp, Homo sapiens
aagaatatctgttttatttagg

SEQ ID NO: 8554082 - DNA, 22 bp, Homo sapiens
aagaatatctgttttatttagg

SEQ ID NO: 8554083 - DNA, 22 bp, Homo sapiens
aagaatatctgttttatttagg

SEQ ID NO: 8554084 - DNA, 22 bp, Homo sapiens
aagaatcattgtaaagttctgt

SEQ ID NO: 8554085 - DNA, 17 bp, Homo sapiens
aagaatcattagagaag

SEQ ID NO: 8554086 - DNA, 22 bp, Homo sapiens
aagaatcatctgaactttgagg

SEQ ID NO: 8554087 - DNA, 22 bp, Homo sapiens
aagaatcatcctgcaagagtct

SEQ ID NO: 8554088 - DNA, 22 bp, Homo sapiens
aagaatcatcctgcaagagtct

SEQ ID NO: 8554089 - DNA, 22 bp, Homo sapiens
acaaaagaataagatgagtcat

SEQ ID NO: 8554090 - DNA, 22 bp, Homo sapiens
acaaaagaataagatgagtcat

SEQ ID NO: 8554091 - DNA, 22 bp, Homo sapiens
acaaaaccagaaaatctctacc

SEQ ID NO: 8554092 - DNA, 22 bp, Homo sapiens
acaaaaccagaaaatctctacc

SEQ ID NO: 8554093 - DNA, 22 bp, Homo sapiens
acaaaagcactgcagagtaagc

SEQ ID NO: 8554094 - DNA, 22 bp, Homo sapiens
acaaaagtgtaggaattcctta

SEQ ID NO: 8554095 - DNA, 22 bp, Homo sapiens
acaaaagtgtaggaattcctta

SEQ ID NO: 8554096 - DNA, 19 bp, Homo sapiens
acaaattgtcctcatcaag

SEQ ID NO: 8554097 - DNA, 22 bp, Homo sapiens
acaaatgactatttggtacagg

SEQ ID NO: 8554098 - DNA, 22 bp, Homo sapiens
acaaatgaatcatacataatgt

SEQ ID NO: 8554099 - DNA, 22 bp, Homo sapiens
acaaatgaatcatacataatgt

SEQ ID NO: 8554100 - DNA, 22 bp, Homo sapiens
acaaatgaatcatacataatgt

SEQ ID NO: 8554101 - DNA, 22 bp, Homo sapiens
acaaatgaacatataagcttga

SEQ ID NO: 8554102 - DNA, 22 bp, Homo sapiens
acaaatccagtgaactccagtg

SEQ ID NO: 8554103 - DNA, 22 bp, Homo sapiens
acaaatgaacctgaaatctcag

SEQ ID NO: 8554104 - DNA, 22 bp, Homo sapiens
acaaatgaacatataagcttga

SEQ ID NO: 8554105 - DNA, 22 bp, Homo sapiens
acaaatgaacctgaaatctcag

SEQ ID NO: 8554106 - DNA, 22 bp, Homo sapiens
acaaagctagagaagagaattg

SEQ ID NO: 8554107 - DNA, 22 bp, Homo sapiens
acaaatatttactgaatccact

SEQ ID NO: 8554108 - DNA, 22 bp, Homo sapiens
acaaatatttactgaatccact

SEQ ID NO: 8554109 - DNA, 22 bp, Homo sapiens
acaaatatttactgaatccact

SEQ ID NO: 8554110 - DNA, 22 bp, Homo sapiens
acaaatatttactgaatccact

SEQ ID NO: 8554111 - DNA, 22 bp, Homo sapiens
aagaatctctgatcaggcttta

SEQ ID NO: 8554112 - DNA, 22 bp, Homo sapiens
acaaagctagagaagagaattg

SEQ ID NO: 8554113 - DNA, 22 bp, Homo sapiens
aagaatctatggtacatccaag

SEQ ID NO: 8554114 - DNA, 22 bp, Homo sapiens
acacagcaacttgcagtatgga

SEQ ID NO: 8554115 - DNA, 22 bp, Homo sapiens
acacagcaacttgcagtatgga

SEQ ID NO: 8554116 - DNA, 22 bp, Homo sapiens
acacagcaacttgcagtatgga

SEQ ID NO: 8554117 - DNA, 22 bp, Homo sapiens
acacagcaacttgcagtatgga

SEQ ID NO: 8554118 - DNA, 22 bp, Homo sapiens
acacagagctggaactgcttca

SEQ ID NO: 8554119 - DNA, 22 bp, Homo sapiens
acacagagctggaactgcttca

SEQ ID NO: 8554120 - DNA, 22 bp, Homo sapiens
acacagagcaaatcatgacaga

SEQ ID NO: 8554121 - DNA, 22 bp, Homo sapiens
acacagagccaaaccatatcac

SEQ ID NO: 8554122 - DNA, 22 bp, Homo sapiens
acacagagcaaatcatgacaga

SEQ ID NO: 8554123 - DNA, 22 bp, Homo sapiens
acacagagcaaatcatgacaga

SEQ ID NO: 8554124 - DNA, 17 bp, Homo sapiens
acacagagattaacaca

SEQ ID NO: 8554125 - DNA, 22 bp, Homo sapiens
acacagagccagggaatacagt

SEQ ID NO: 8554126 - DNA, 22 bp, Homo sapiens
acacagagccaaaccatatcac

SEQ ID NO: 8554127 - DNA, 22 bp, Homo sapiens
acacagagccagggaatacagt

SEQ ID NO: 8554128 - DNA, 22 bp, Homo sapiens
acacagagccagggaatacagt

SEQ ID NO: 8554129 - DNA, 22 bp, Homo sapiens
acacagagccagggaatacagt

SEQ ID NO: 8554130 - DNA, 22 bp, Homo sapiens
acacacatgcctttcctaagta

SEQ ID NO: 8554131 - DNA, 22 bp, Homo sapiens
acacacatgcctttcctaagta

SEQ ID NO: 8554132 - DNA, 22 bp, Homo sapiens
acacacatgcctttcctaagta

SEQ ID NO: 8554133 - DNA, 22 bp, Homo sapiens
acacacatgcctttcctaagta

SEQ ID NO: 8554134 - DNA, 22 bp, Homo sapiens
acacacatgcctttcctaagta

SEQ ID NO: 8554135 - DNA, 17 bp, Homo sapiens
acacagagattaacaca

SEQ ID NO: 8554136 - DNA, 17 bp, Homo sapiens
acacagagattaacaca

SEQ ID NO: 8554137 - DNA, 17 bp, Homo sapiens
acacagagattaacaca

SEQ ID NO: 8554138 - DNA, 17 bp, Homo sapiens
acacagagattaacaca

SEQ ID NO: 8554139 - DNA, 22 bp, Homo sapiens
acacagagatgtaaagttaggc

SEQ ID NO: 8554140 - DNA, 22 bp, Homo sapiens
acacagctcacaacgtgtgcat

SEQ ID NO: 8554141 - DNA, 22 bp, Homo sapiens
acacagctagtgagtggcagag

SEQ ID NO: 8554142 - DNA, 22 bp, Homo sapiens
acacagctatggggtaggaaac

SEQ ID NO: 8554143 - DNA, 22 bp, Homo sapiens
acacagctatggggtaggaaac

SEQ ID NO: 8554144 - DNA, 22 bp, Homo sapiens
acacagctttcagtcattatct

SEQ ID NO: 8554145 - DNA, 22 bp, Homo sapiens
acacagctttcagtcattatct

SEQ ID NO: 8554146 - DNA, 22 bp, Homo sapiens
acacagcttcaaagtctaattc

SEQ ID NO: 8554147 - DNA, 22 bp, Homo sapiens
acacagctgtgcagttttttca

SEQ ID NO: 8554148 - DNA, 21 bp, Homo sapiens
acacagctgccggagacggat

SEQ ID NO: 8554149 - DNA, 22 bp, Homo sapiens
acacagccagggtagtaaggct

SEQ ID NO: 8554150 - DNA, 22 bp, Homo sapiens
acacagcagaaggcccgtgtct

SEQ ID NO: 8554151 - DNA, 17 bp, Homo sapiens
acacagccaggttctcc

SEQ ID NO: 8554152 - DNA, 22 bp, Homo sapiens
acacagctagtgagtggcagag

SEQ ID NO: 8554153 - DNA, 22 bp, Homo sapiens
aagataatgttctagctgtcag

SEQ ID NO: 8554154 - DNA, 22 bp, Homo sapiens
aagatacaaatgtcaatattgg

SEQ ID NO: 8554155 - DNA, 22 bp, Homo sapiens
aagatacaaatgtcaatattgg

SEQ ID NO: 8554156 - DNA, 22 bp, Homo sapiens
aagatacaaatgtcaatattgg

SEQ ID NO: 8554157 - DNA, 22 bp, Homo sapiens
aagatacaaatgtcaatattgg

SEQ ID NO: 8554158 - DNA, 22 bp, Homo sapiens
aagatacaccaagagcctagta

SEQ ID NO: 8554159 - DNA, 22 bp, Homo sapiens
aagagtttccatgctctgtgct

SEQ ID NO: 8554160 - DNA, 22 bp, Homo sapiens
aagataacaggaggagtttgta

SEQ ID NO: 8554161 - DNA, 22 bp, Homo sapiens
aagagtttatgatataacatgt

SEQ ID NO: 8554162 - DNA, 22 bp, Homo sapiens
acacagctttcagtcattatct

SEQ ID NO: 8554163 - DNA, 22 bp, Homo sapiens
aagataatattcattaactaga

SEQ ID NO: 8554164 - DNA, 22 bp, Homo sapiens
aagataatattcattaactaga

SEQ ID NO: 8554165 - DNA, 22 bp, Homo sapiens
aagataatattcattaactaga

SEQ ID NO: 8554166 - DNA, 22 bp, Homo sapiens
aagataagtaacgagcctcagt

SEQ ID NO: 8554167 - DNA, 22 bp, Homo sapiens
aagataagtaacgagcctcagt

SEQ ID NO: 8554168 - DNA, 22 bp, Homo sapiens
acaatgtctcatattcgtgttc

SEQ ID NO: 8554169 - DNA, 22 bp, Homo sapiens
acaatgtctcatattcgtgttc

SEQ ID NO: 8554170 - DNA, 23 bp, Homo sapiens
acaatgtctgttcataaaatacc

SEQ ID NO: 8554171 - DNA, 22 bp, Homo sapiens
acaatgtgataatttaaagata

SEQ ID NO: 8554172 - DNA, 22 bp, Homo sapiens
acaatgtgtttttatacatttg

SEQ ID NO: 8554173 - DNA, 21 bp, Homo sapiens
acaatgtcaaggtcagacatt

SEQ ID NO: 8554174 - DNA, 22 bp, Homo sapiens
acaatgtcacctctcatgtttt

SEQ ID NO: 8554175 - DNA, 22 bp, Homo sapiens
acaatgtcaaaataggaaacat

SEQ ID NO: 8554176 - DNA, 22 bp, Homo sapiens
acaatgtagttgtcatgagaca

SEQ ID NO: 8554177 - DNA, 22 bp, Homo sapiens
acaatgtagttgtcatgagaca

SEQ ID NO: 8554178 - DNA, 22 bp, Homo sapiens
acaatgtaggctgaaaaagctt

SEQ ID NO: 8554179 - DNA, 22 bp, Homo sapiens
acaatgtaggagtatgacagta

SEQ ID NO: 8554180 - DNA, 22 bp, Homo sapiens
acaatgtaggagtatgacagta

SEQ ID NO: 8554181 - DNA, 22 bp, Homo sapiens
acaatgtaggatatgtacttgt

SEQ ID NO: 8554182 - DNA, 22 bp, Homo sapiens
acaatgtaggatatgtacttgt

SEQ ID NO: 8554183 - DNA, 22 bp, Homo sapiens
acaatatagtccatgagcatgc

SEQ ID NO: 8554184 - DNA, 22 bp, Homo sapiens
acaatatagtccatgagcatgc

SEQ ID NO: 8554185 - DNA, 22 bp, Homo sapiens
acaatatagtccatgagcatgc

SEQ ID NO: 8554186 - DNA, 22 bp, Homo sapiens
acaatatgggatatacatttta

SEQ ID NO: 8554187 - DNA, 20 bp, Homo sapiens
acaatatgtagatgaatagc

SEQ ID NO: 8554188 - DNA, 22 bp, Homo sapiens
acaatatttgggggcagtttgt

SEQ ID NO: 8554189 - DNA, 22 bp, Homo sapiens
acaatagacccatgacacatac

SEQ ID NO: 8554190 - DNA, 22 bp, Homo sapiens
acaatagacccatgacacatac

SEQ ID NO: 8554191 - DNA, 22 bp, Homo sapiens
acaacaaaatcactagtcttcc

SEQ ID NO: 8554192 - DNA, 22 bp, Homo sapiens
acaacaaaatcactagtcttcc

SEQ ID NO: 8554193 - DNA, 22 bp, Homo sapiens
acaatagatactgggcacatat

SEQ ID NO: 8554194 - DNA, 22 bp, Homo sapiens
acaatagacccatgacacatac

SEQ ID NO: 8554195 - DNA, 22 bp, Homo sapiens
acaatagagttctcataggaca

SEQ ID NO: 8554196 - DNA, 22 bp, Homo sapiens
acaatagagttctcataggaca

SEQ ID NO: 8554197 - DNA, 22 bp, Homo sapiens
acaatagtcaatgcacgtcatt

SEQ ID NO: 8554198 - DNA, 22 bp, Homo sapiens
acaatatacacatcctaatggg

SEQ ID NO: 8554199 - DNA, 22 bp, Homo sapiens
acaatagtgcctggcatagagt

SEQ ID NO: 8554200 - DNA, 22 bp, Homo sapiens
acaataggtgtccaattaacaa

SEQ ID NO: 8554201 - DNA, 22 bp, Homo sapiens
acaaatttcataggcaaatttt

SEQ ID NO: 8554202 - DNA, 22 bp, Homo sapiens
acaaattgttgcttcatgaatg

SEQ ID NO: 8554203 - DNA, 22 bp, Homo sapiens
acaaatttattgaagggcatat

SEQ ID NO: 8554204 - DNA, 22 bp, Homo sapiens
acaaatttgtgtagttatggca

SEQ ID NO: 8554205 - DNA, 22 bp, Homo sapiens
acaaatttggtgagagtaaata

SEQ ID NO: 8554206 - DNA, 22 bp, Homo sapiens
acaaatttggtgagagtaaata

SEQ ID NO: 8554207 - DNA, 22 bp, Homo sapiens
acaaatttgaatcctgacttct

SEQ ID NO: 8554208 - DNA, 22 bp, Homo sapiens
acagccaggcccagcacgcagg

SEQ ID NO: 8554209 - DNA, 22 bp, Homo sapiens
aagccaggttccatggaggagc

SEQ ID NO: 8554210 - DNA, 22 bp, Homo sapiens
aagccaggttccatggaggagc

SEQ ID NO: 8554211 - DNA, 22 bp, Homo sapiens
aagcccagcatccctgcaccag

SEQ ID NO: 8554212 - DNA, 22 bp, Homo sapiens
aagcccagatgtgagaactgag

SEQ ID NO: 8554213 - DNA, 22 bp, Homo sapiens
aagccagtaagtttttgtcatt

SEQ ID NO: 8554214 - DNA, 22 bp, Homo sapiens
aagcccagatgtgagaactgag

SEQ ID NO: 8554215 - DNA, 22 bp, Homo sapiens
acagccaggaggaactcagtga

SEQ ID NO: 8554216 - DNA, 22 bp, Homo sapiens
acagccaggagccatgggcagg

SEQ ID NO: 8554217 - DNA, 22 bp, Homo sapiens
acagccaggagccatgggcagg

SEQ ID NO: 8554218 - DNA, 22 bp, Homo sapiens
acagccaggcccagcacgcagg

SEQ ID NO: 8554219 - DNA, 22 bp, Homo sapiens
acagccaggcccagcacgcagg

SEQ ID NO: 8554220 - DNA, 23 bp, Homo sapiens
acagccaggatgggagcagaagc

SEQ ID NO: 8554221 - DNA, 23 bp, Homo sapiens
acagccaggatgggagcagaagc

SEQ ID NO: 8554222 - DNA, 22 bp, Homo sapiens
acagccagatctgagagatctt

SEQ ID NO: 8554223 - DNA, 19 bp, Homo sapiens
acagcaggtgtggggataa

SEQ ID NO: 8554224 - DNA, 22 bp, Homo sapiens
acagcaggttacagtggcacag

SEQ ID NO: 8554225 - DNA, 21 bp, Homo sapiens
acagccaggaacatgaggggc

SEQ ID NO: 8554226 - DNA, 22 bp, Homo sapiens
acagccaggaattctggagaag

SEQ ID NO: 8554227 - DNA, 22 bp, Homo sapiens
acagccaggaattctggagaag

SEQ ID NO: 8554228 - DNA, 22 bp, Homo sapiens
acagccaggacttggccctctt

SEQ ID NO: 8554229 - DNA, 22 bp, Homo sapiens
aagcccagtaccttcagtgagg

SEQ ID NO: 8554230 - DNA, 22 bp, Homo sapiens
aagcccagtaccttcagtgagg

SEQ ID NO: 8554231 - DNA, 19 bp, Homo sapiens
aagcccagtgtatgctctt

SEQ ID NO: 8554232 - DNA, 22 bp, Homo sapiens
aagcccagtttcacactgagac

SEQ ID NO: 8554233 - DNA, 22 bp, Homo sapiens
aagcccagctgaaagcattttt

SEQ ID NO: 8554234 - DNA, 22 bp, Homo sapiens
aagcccagctgaaagcattttt

SEQ ID NO: 8554235 - DNA, 22 bp, Homo sapiens
aagcccagctgaaagcattttt

SEQ ID NO: 8554236 - DNA, 22 bp, Homo sapiens
aagcccagggaatggtcgggag

SEQ ID NO: 8554237 - DNA, 22 bp, Homo sapiens
aagcccagcatccctgcaccag

SEQ ID NO: 8554238 - DNA, 22 bp, Homo sapiens
aagcccagctctgcctgctctg

SEQ ID NO: 8554239 - DNA, 23 bp, Homo sapiens
aagccctgaaggtttcaggccct

SEQ ID NO: 8554240 - DNA, 21 bp, Homo sapiens
acagctggaaattacttgccc

SEQ ID NO: 8554241 - DNA, 22 bp, Homo sapiens
acagctggacaggggagagttt

SEQ ID NO: 8554242 - DNA, 22 bp, Homo sapiens
acagctgctctatatctcagcc

SEQ ID NO: 8554243 - DNA, 22 bp, Homo sapiens
aagcaggtgtgagccagtgggc

SEQ ID NO: 8554244 - DNA, 22 bp, Homo sapiens
aagcaggttatgaaatatagaa

SEQ ID NO: 8554245 - DNA, 22 bp, Homo sapiens
aagcagggtgtcttgacccatg

SEQ ID NO: 8554246 - DNA, 22 bp, Homo sapiens
aagcagggtgtcttgacccatg

SEQ ID NO: 8554247 - DNA, 22 bp, Homo sapiens
aagcagggctccctggggactc

SEQ ID NO: 8554248 - DNA, 22 bp, Homo sapiens
aagcagggctccctggggactc

SEQ ID NO: 8554249 - DNA, 18 bp, Homo sapiens
aagcagggtccattgtgc

SEQ ID NO: 8554250 - DNA, 18 bp, Homo sapiens
aagcagggtccattgtgc

SEQ ID NO: 8554251 - DNA, 21 bp, Homo sapiens
aagcaggacatatgatgccct

SEQ ID NO: 8554252 - DNA, 21 bp, Homo sapiens
aagcaggacatatgatgccct

SEQ ID NO: 8554253 - DNA, 22 bp, Homo sapiens
aagcaggaaggagcccagggca

SEQ ID NO: 8554254 - DNA, 22 bp, Homo sapiens
acagagcaattcttgggtgttt

SEQ ID NO: 8554255 - DNA, 22 bp, Homo sapiens
aagcaggcttggtgtggccgct

SEQ ID NO: 8554256 - DNA, 22 bp, Homo sapiens
acagcagggggagctgttggac

SEQ ID NO: 8554257 - DNA, 22 bp, Homo sapiens
acagcagggggagctgttggac

SEQ ID NO: 8554258 - DNA, 21 bp, Homo sapiens
acagcagggctggcatgacag

SEQ ID NO: 8554259 - DNA, 22 bp, Homo sapiens
acagcagggtcacattccctct

SEQ ID NO: 8554260 - DNA, 22 bp, Homo sapiens
acagcagggtcacattccctct

SEQ ID NO: 8554261 - DNA, 22 bp, Homo sapiens
acagcaggggtggaataaacgt

SEQ ID NO: 8554262 - DNA, 22 bp, Homo sapiens
aagcagttactatttactatta

SEQ ID NO: 8554263 - DNA, 22 bp, Homo sapiens
aagcagtgcgctcatctaaggg

SEQ ID NO: 8554264 - DNA, 22 bp, Homo sapiens
aagcagtgatgcatacagctgt

SEQ ID NO: 8554265 - DNA, 22 bp, Homo sapiens
aagcagtgactctcagaggcag

SEQ ID NO: 8554266 - DNA, 22 bp, Homo sapiens
aagcagtcttggctgggttcag

SEQ ID NO: 8554267 - DNA, 20 bp, Homo sapiens
aagcagtgaggtgaggagtg

SEQ ID NO: 8554268 - DNA, 22 bp, Homo sapiens
aagcataaaacgttacaacatg

SEQ ID NO: 8554269 - DNA, 22 bp, Homo sapiens
aagcataacttgctgcacatag

SEQ ID NO: 8554270 - DNA, 22 bp, Homo sapiens
aagcataacttgctgcacatag

SEQ ID NO: 8554271 - DNA, 22 bp, Homo sapiens
aagcagtttttcaactgtttag

SEQ ID NO: 8554272 - DNA, 22 bp, Homo sapiens
aagcataaaacgttacaacatg

SEQ ID NO: 8554273 - DNA, 22 bp, Homo sapiens
acagacatttaataaatgctga

SEQ ID NO: 8554274 - DNA, 22 bp, Homo sapiens
acagacatttaataaatgctga

SEQ ID NO: 8554275 - DNA, 22 bp, Homo sapiens
acagacattttaagacacttta

SEQ ID NO: 8554276 - DNA, 22 bp, Homo sapiens
acagacattttaagacacttta

SEQ ID NO: 8554277 - DNA, 22 bp, Homo sapiens
acagaccaaaaaaggatattgg

SEQ ID NO: 8554278 - DNA, 22 bp, Homo sapiens
acagaccaagtttccagcaggt

SEQ ID NO: 8554279 - DNA, 22 bp, Homo sapiens
acagacattttctgtattgcct

SEQ ID NO: 8554280 - DNA, 23 bp, Homo sapiens
acagacattccataatgtacacc

SEQ ID NO: 8554281 - DNA, 23 bp, Homo sapiens
acagacattccataatgtacacc

SEQ ID NO: 8554282 - DNA, 23 bp, Homo sapiens
acagacattccataatgtacacc

SEQ ID NO: 8554283 - DNA, 23 bp, Homo sapiens
acagacattccataatgtacacc

SEQ ID NO: 8554284 - DNA, 23 bp, Homo sapiens
acagacaacactgatgagagaaa

SEQ ID NO: 8554285 - DNA, 23 bp, Homo sapiens
acagacaacactgatgagagaaa

SEQ ID NO: 8554286 - DNA, 23 bp, Homo sapiens
acagacaacactgatgagagaaa

SEQ ID NO: 8554287 - DNA, 22 bp, Homo sapiens
acagaaatgatgtttggcaata

SEQ ID NO: 8554288 - DNA, 22 bp, Homo sapiens
acagaaatattcgtggtgcttg

SEQ ID NO: 8554289 - DNA, 23 bp, Homo sapiens
acagaaatcatttgtaaggtacc

SEQ ID NO: 8554290 - DNA, 23 bp, Homo sapiens
acagaaagttctgctggacagag

SEQ ID NO: 8554291 - DNA, 22 bp, Homo sapiens
acagaaataactttttatgttt

SEQ ID NO: 8554292 - DNA, 22 bp, Homo sapiens
acagaaataactttttatgttt

SEQ ID NO: 8554293 - DNA, 18 bp, Homo sapiens
acagaaatagctgtgcct

SEQ ID NO: 8554294 - DNA, 22 bp, Homo sapiens
acagaaatatagaaggtaggaa

SEQ ID NO: 8554295 - DNA, 22 bp, Homo sapiens
acagaaatatagaaggtaggaa

SEQ ID NO: 8554296 - DNA, 18 bp, Homo sapiens
acagaaatagctgtgcct

SEQ ID NO: 8554297 - DNA, 18 bp, Homo sapiens
acagaaatagctgtgcct

SEQ ID NO: 8554298 - DNA, 22 bp, Homo sapiens
acagactggcctgtctcgcacc

SEQ ID NO: 8554299 - DNA, 23 bp, Homo sapiens
acagagatcttgacttgtatgga

SEQ ID NO: 8554300 - DNA, 22 bp, Homo sapiens
acagacctatggcagctgccat

SEQ ID NO: 8554301 - DNA, 22 bp, Homo sapiens
acagactgattcattgctcagg

SEQ ID NO: 8554302 - DNA, 22 bp, Homo sapiens
acagagcaactttatttcatgg

SEQ ID NO: 8554303 - DNA, 22 bp, Homo sapiens
acagagcaactttatttcatgg

SEQ ID NO: 8554304 - DNA, 22 bp, Homo sapiens
acagagatgtggatgagggatt

SEQ ID NO: 8554305 - DNA, 22 bp, Homo sapiens
acagagatgtcagattggcagc

SEQ ID NO: 8554306 - DNA, 22 bp, Homo sapiens
acagagcaataacagggagagg

SEQ ID NO: 8554307 - DNA, 22 bp, Homo sapiens
acagagcaataacagggagagg

SEQ ID NO: 8554308 - DNA, 22 bp, Homo sapiens
acagagatgtcagattggcagc

SEQ ID NO: 8554309 - DNA, 22 bp, Homo sapiens
acagagatgcaagtgtgtattt

SEQ ID NO: 8554310 - DNA, 22 bp, Homo sapiens
acagagatggcacagagaaggt

SEQ ID NO: 8554311 - DNA, 22 bp, Homo sapiens
acacatataccactgtaaatga

SEQ ID NO: 8554312 - DNA, 20 bp, Homo sapiens
acacatagataagaagctga

SEQ ID NO: 8554313 - DNA, 22 bp, Homo sapiens
acacataagcctaatcatctcc

SEQ ID NO: 8554314 - DNA, 22 bp, Homo sapiens
acacatacatggggaagatgag

SEQ ID NO: 8554315 - DNA, 22 bp, Homo sapiens
acacatagaaaataaatagtta

SEQ ID NO: 8554316 - DNA, 20 bp, Homo sapiens
acacatatagcagcataaac

SEQ ID NO: 8554317 - DNA, 20 bp, Homo sapiens
acacatatagcagcataaac

SEQ ID NO: 8554318 - DNA, 20 bp, Homo sapiens
acacatatagcagcataaac

SEQ ID NO: 8554319 - DNA, 20 bp, Homo sapiens
acacatatagcagcataaac

SEQ ID NO: 8554320 - DNA, 22 bp, Homo sapiens
acacatatatacatatttgtgc

SEQ ID NO: 8554321 - DNA, 22 bp, Homo sapiens
aagatacacgttgtattgaata

SEQ ID NO: 8554322 - DNA, 22 bp, Homo sapiens
aagatacacgttgtattgaata

SEQ ID NO: 8554323 - DNA, 22 bp, Homo sapiens
aagatacagacagagccaaaat

SEQ ID NO: 8554324 - DNA, 22 bp, Homo sapiens
aagatacagacagagccaaaat

SEQ ID NO: 8554325 - DNA, 22 bp, Homo sapiens
aagatacatcaaagcaaattgg

SEQ ID NO: 8554326 - DNA, 22 bp, Homo sapiens
aagatacagtgaaagggcattg

SEQ ID NO: 8554327 - DNA, 22 bp, Homo sapiens
aagatacataaaggtagagtct

SEQ ID NO: 8554328 - DNA, 22 bp, Homo sapiens
acacataagcctaatcatctcc

SEQ ID NO: 8554329 - DNA, 22 bp, Homo sapiens
acacataagcctaatcatctcc

SEQ ID NO: 8554330 - DNA, 22 bp, Homo sapiens
acacataagcctaatcatctcc

SEQ ID NO: 8554331 - DNA, 22 bp, Homo sapiens
aagatacatcaaagcaaattgg

SEQ ID NO: 8554332 - DNA, 22 bp, Homo sapiens
aagatacatcaaagcaaattgg

SEQ ID NO: 8554333 - DNA, 23 bp, Homo sapiens
acagaaagttctgctggacagag

SEQ ID NO: 8554334 - DNA, 23 bp, Homo sapiens
acagaaagttctgctggacagag

SEQ ID NO: 8554335 - DNA, 20 bp, Homo sapiens
acagaaagctgccttgtccc

SEQ ID NO: 8554336 - DNA, 22 bp, Homo sapiens
acagaaagatgatttgaaatgg

SEQ ID NO: 8554337 - DNA, 22 bp, Homo sapiens
acagaaagatgatttgaaatgg

SEQ ID NO: 8554338 - DNA, 22 bp, Homo sapiens
acactttaagcatttcacactg

SEQ ID NO: 8554339 - DNA, 22 bp, Homo sapiens
acacttgataggtcaaatcagt

SEQ ID NO: 8554340 - DNA, 22 bp, Homo sapiens
acacttgataggtcaaatcagt

SEQ ID NO: 8554341 - DNA, 22 bp, Homo sapiens
acacttgaggtttttaggtgcg

SEQ ID NO: 8554342 - DNA, 22 bp, Homo sapiens
acacttgaggtttttaggtgcg

SEQ ID NO: 8554343 - DNA, 20 bp, Homo sapiens
acacttgacaccagaaatgg

SEQ ID NO: 8554344 - DNA, 22 bp, Homo sapiens
acacttgaggaatgtggtgatt

SEQ ID NO: 8554345 - DNA, 22 bp, Homo sapiens
acacttgaggaatgtggtgatt

SEQ ID NO: 8554346 - DNA, 20 bp, Homo sapiens
acacttgacaccagaaatgg

SEQ ID NO: 8554347 - DNA, 20 bp, Homo sapiens
acacttgacaccagaaatgg

SEQ ID NO: 8554348 - DNA, 22 bp, Homo sapiens
acacttgataggtcaaatcagt

SEQ ID NO: 8554349 - DNA, 22 bp, Homo sapiens
acacttggagcaacacttatgg

SEQ ID NO: 8554350 - DNA, 22 bp, Homo sapiens
acacttggagcaacacttatgg

SEQ ID NO: 8554351 - DNA, 22 bp, Homo sapiens
acacttcagctccacaaacatt

SEQ ID NO: 8554352 - DNA, 22 bp, Homo sapiens
acactggttgttaatagtaaca

SEQ ID NO: 8554353 - DNA, 21 bp, Homo sapiens
acacttcagtttttaaaggga

SEQ ID NO: 8554354 - DNA, 22 bp, Homo sapiens
acacttcatagcaaggttggag

SEQ ID NO: 8554355 - DNA, 22 bp, Homo sapiens
acacttcaggactctggggcaa

SEQ ID NO: 8554356 - DNA, 22 bp, Homo sapiens
acacttcatttacattataggc

SEQ ID NO: 8554357 - DNA, 22 bp, Homo sapiens
acacttcatagcaaggttggag

SEQ ID NO: 8554358 - DNA, 22 bp, Homo sapiens
acacttcatgcattcttcactc

SEQ ID NO: 8554359 - DNA, 22 bp, Homo sapiens
acacttcatgcattcttcactc

SEQ ID NO: 8554360 - DNA, 22 bp, Homo sapiens
acacttctattccctgcacaaa

SEQ ID NO: 8554361 - DNA, 22 bp, Homo sapiens
acacttctcatttgatactaac

SEQ ID NO: 8554362 - DNA, 22 bp, Homo sapiens
acacttctcccatctcctgttg

SEQ ID NO: 8554363 - DNA, 22 bp, Homo sapiens
acacttctttgtcacctgcttc

SEQ ID NO: 8554364 - DNA, 22 bp, Homo sapiens
acacttctctttgaagaacaat

SEQ ID NO: 8554365 - DNA, 18 bp, Homo sapiens
acacttcctggtggtgtg

SEQ ID NO: 8554366 - DNA, 20 bp, Homo sapiens
acacttcatttgcagcagct

SEQ ID NO: 8554367 - DNA, 18 bp, Homo sapiens
acacttcctggtggtgtg

SEQ ID NO: 8554368 - DNA, 18 bp, Homo sapiens
acacttcctggtggtgtg

SEQ ID NO: 8554369 - DNA, 22 bp, Homo sapiens
acacttctattccctgcacaaa

SEQ ID NO: 8554370 - DNA, 22 bp, Homo sapiens
acacttctattccctgcacaaa

SEQ ID NO: 8554371 - DNA, 22 bp, Homo sapiens
cagaaactatgtaagaaagtga

SEQ ID NO: 8554372 - DNA, 22 bp, Homo sapiens
cagaaactgctcccctggtagg

SEQ ID NO: 8554373 - DNA, 22 bp, Homo sapiens
cagaaactagatttagacacaa

SEQ ID NO: 8554374 - DNA, 22 bp, Homo sapiens
cagaaactatgtaagaaagtga

SEQ ID NO: 8554375 - DNA, 22 bp, Homo sapiens
cagaaacatgtataaagttgta

SEQ ID NO: 8554376 - DNA, 22 bp, Homo sapiens
cagaaacttctggtgtcaaata

SEQ ID NO: 8554377 - DNA, 22 bp, Homo sapiens
cagaaactgtggattcattaaa

SEQ ID NO: 8554378 - DNA, 22 bp, Homo sapiens
cagaaactgtttgttaatattt

SEQ ID NO: 8554379 - DNA, 22 bp, Homo sapiens
cagaaactgtttgttaatattt

SEQ ID NO: 8554380 - DNA, 22 bp, Homo sapiens
cagaaactttctttactgagca

SEQ ID NO: 8554381 - DNA, 22 bp, Homo sapiens
cagaaactttctttactgagca

SEQ ID NO: 8554382 - DNA, 22 bp, Homo sapiens
cagaaagacctgattggcagtt

SEQ ID NO: 8554383 - DNA, 20 bp, Homo sapiens
cagaaagaaggtagattttt

SEQ ID NO: 8554384 - DNA, 22 bp, Homo sapiens
cagaaagacctgggctcaagag

SEQ ID NO: 8554385 - DNA, 22 bp, Homo sapiens
cagaaagacctgggctcaagag

SEQ ID NO: 8554386 - DNA, 22 bp, Homo sapiens
cagaaagacctgggctcaagag

SEQ ID NO: 8554387 - DNA, 22 bp, Homo sapiens
cagaaagacctgggctcaagag

SEQ ID NO: 8554388 - DNA, 22 bp, Homo sapiens
agccaaaggcaccagagacact

SEQ ID NO: 8554389 - DNA, 22 bp, Homo sapiens
agccaaagatcagtgtgcaagt

SEQ ID NO: 8554390 - DNA, 20 bp, Homo sapiens
agccaaaggagaacagtgct

SEQ ID NO: 8554391 - DNA, 23 bp, Homo sapiens
cactgggcccagggtgtggaggc

SEQ ID NO: 8554392 - DNA, 22 bp, Homo sapiens
cactgggcgtgtcctgggtgag

SEQ ID NO: 8554393 - DNA, 22 bp, Homo sapiens
cactgggctttgtagttagcat

SEQ ID NO: 8554394 - DNA, 22 bp, Homo sapiens
cactggggaaaacaggcttctt

SEQ ID NO: 8554395 - DNA, 22 bp, Homo sapiens
cactggggaaaacaggcttctt

SEQ ID NO: 8554396 - DNA, 20 bp, Homo sapiens
agcattttatggtaggaaac

SEQ ID NO: 8554397 - DNA, 17 bp, Homo sapiens
agcatttgtgttaacag

SEQ ID NO: 8554398 - DNA, 19 bp, Homo sapiens
agcatttggaattctacac

SEQ ID NO: 8554399 - DNA, 17 bp, Homo sapiens
agcatttgtgttaacag

SEQ ID NO: 8554400 - DNA, 17 bp, Homo sapiens
agcatttgtgttaacag

SEQ ID NO: 8554401 - DNA, 22 bp, Homo sapiens
agccaaaacatgtgagttttga

SEQ ID NO: 8554402 - DNA, 22 bp, Homo sapiens
agcattttctgagagtatagat

SEQ ID NO: 8554403 - DNA, 22 bp, Homo sapiens
cactttgatgcagggctcagta

SEQ ID NO: 8554404 - DNA, 22 bp, Homo sapiens
cactttgaagagctttttgaca

SEQ ID NO: 8554405 - DNA, 22 bp, Homo sapiens
cactggggtgggcctggtagag

SEQ ID NO: 8554406 - DNA, 22 bp, Homo sapiens
cactggggtgggcctggtagag

SEQ ID NO: 8554407 - DNA, 22 bp, Homo sapiens
agcatttagttagtaaatgttt

SEQ ID NO: 8554408 - DNA, 22 bp, Homo sapiens
agcatttagttagtaaatgttt

SEQ ID NO: 8554409 - DNA, 22 bp, Homo sapiens
agcatttaggagaatttgagaa

SEQ ID NO: 8554410 - DNA, 22 bp, Homo sapiens
agcatttagtctttattgcagc

SEQ ID NO: 8554411 - DNA, 22 bp, Homo sapiens
agcatttcttggcccattgtag

SEQ ID NO: 8554412 - DNA, 22 bp, Homo sapiens
agcatttgaaaactatttaatt

SEQ ID NO: 8554413 - DNA, 22 bp, Homo sapiens
agcatttgatatgtttaaaaag

SEQ ID NO: 8554414 - DNA, 22 bp, Homo sapiens
agcatttatttcttagaaattg

SEQ ID NO: 8554415 - DNA, 22 bp, Homo sapiens
agcatttccgccctcttctgcc

SEQ ID NO: 8554416 - DNA, 22 bp, Homo sapiens
agcatttcttggcccattgtag

SEQ ID NO: 8554417 - DNA, 22 bp, Homo sapiens
agcatttatttcttagaaattg

SEQ ID NO: 8554418 - DNA, 22 bp, Homo sapiens
agcatttatttcttagaaattg

SEQ ID NO: 8554419 - DNA, 22 bp, Homo sapiens
agcatttatttcttagaaattg

SEQ ID NO: 8554420 - DNA, 22 bp, Homo sapiens
agcatttatgactaatgtaaaa

SEQ ID NO: 8554421 - DNA, 22 bp, Homo sapiens
agcattatgtccatgctaaatt

SEQ ID NO: 8554422 - DNA, 22 bp, Homo sapiens
cactgcacttcagcctgggtga

SEQ ID NO: 8554423 - DNA, 22 bp, Homo sapiens
cactgcacttcagcctgggtga

SEQ ID NO: 8554424 - DNA, 22 bp, Homo sapiens
cactgcacttcagcctgggtga

SEQ ID NO: 8554425 - DNA, 21 bp, Homo sapiens
agcattcaaaagatgccataa

SEQ ID NO: 8554426 - DNA, 21 bp, Homo sapiens
agcattcaaaagatgccataa

SEQ ID NO: 8554427 - DNA, 22 bp, Homo sapiens
cactgcacttcagcctgggtga

SEQ ID NO: 8554428 - DNA, 22 bp, Homo sapiens
cactgcacttcagcctgggtga

SEQ ID NO: 8554429 - DNA, 22 bp, Homo sapiens
cactgcacttcagcctgggtga

SEQ ID NO: 8554430 - DNA, 22 bp, Homo sapiens
cactgcacttcagcctgggtga

SEQ ID NO: 8554431 - DNA, 22 bp, Homo sapiens
cactgcactccagcactccagc

SEQ ID NO: 8554432 - DNA, 22 bp, Homo sapiens
cactgcactccagcccgggcaa

SEQ ID NO: 8554433 - DNA, 22 bp, Homo sapiens
cactgcacaggtgagatgtggg

SEQ ID NO: 8554434 - DNA, 22 bp, Homo sapiens
cactgcaacctccgcctcttgg

SEQ ID NO: 8554435 - DNA, 22 bp, Homo sapiens
cactgcaacctccacctcctgg

SEQ ID NO: 8554436 - DNA, 22 bp, Homo sapiens
cactgaactggtcttaggaggt

SEQ ID NO: 8554437 - DNA, 22 bp, Homo sapiens
cactgaacctgaaccaatactc

SEQ ID NO: 8554438 - DNA, 22 bp, Homo sapiens
cactgaactccttgtttgtcct

SEQ ID NO: 8554439 - DNA, 22 bp, Homo sapiens
cactgaactccttgtttgtcct

SEQ ID NO: 8554440 - DNA, 22 bp, Homo sapiens
cactgaactggtcttaggaggt

SEQ ID NO: 8554441 - DNA, 22 bp, Homo sapiens
cactgcactccagcccgggcaa

SEQ ID NO: 8554442 - DNA, 22 bp, Homo sapiens
cactgcactccagcccgggcaa

SEQ ID NO: 8554443 - DNA, 22 bp, Homo sapiens
cactgcactccagcccgggcaa

SEQ ID NO: 8554444 - DNA, 22 bp, Homo sapiens
cactgcactccagcccgggcaa

SEQ ID NO: 8554445 - DNA, 22 bp, Homo sapiens
cactgcactccagcccgggcaa

SEQ ID NO: 8554446 - DNA, 22 bp, Homo sapiens
cactgcactccagcccgggcaa

SEQ ID NO: 8554447 - DNA, 22 bp, Homo sapiens
cactgcactccagcccgggcaa

SEQ ID NO: 8554448 - DNA, 22 bp, Homo sapiens
cactgcactccagcctcggtga

SEQ ID NO: 8554449 - DNA, 22 bp, Homo sapiens
cactgcactccatcctgggaaa

SEQ ID NO: 8554450 - DNA, 22 bp, Homo sapiens
cactgcactccatcctgggaaa

SEQ ID NO: 8554451 - DNA, 22 bp, Homo sapiens
cactgcactccatcctgggaaa

SEQ ID NO: 8554452 - DNA, 22 bp, Homo sapiens
cactgcactccatcctgggaaa

SEQ ID NO: 8554453 - DNA, 22 bp, Homo sapiens
cactgcactccatcctgggaaa

SEQ ID NO: 8554454 - DNA, 22 bp, Homo sapiens
cactgcactccatcctgggaaa

SEQ ID NO: 8554455 - DNA, 22 bp, Homo sapiens
cactgcactccatcctgggaaa

SEQ ID NO: 8554456 - DNA, 22 bp, Homo sapiens
cacaggctctccagggcctgga

SEQ ID NO: 8554457 - DNA, 22 bp, Homo sapiens
cacaggctctccagggcctgga

SEQ ID NO: 8554458 - DNA, 22 bp, Homo sapiens
cacaggctcttctcacttgatt

SEQ ID NO: 8554459 - DNA, 22 bp, Homo sapiens
cacaggctctccagggcctgga

SEQ ID NO: 8554460 - DNA, 22 bp, Homo sapiens
cacatgaacatgctggaaaagc

SEQ ID NO: 8554461 - DNA, 22 bp, Homo sapiens
cacatgaacatgctggaaaagc

SEQ ID NO: 8554462 - DNA, 22 bp, Homo sapiens
cacaggctgcccgcagctggga

SEQ ID NO: 8554463 - DNA, 22 bp, Homo sapiens
cacatgaagagagtctagtaat

SEQ ID NO: 8554464 - DNA, 22 bp, Homo sapiens
cacatggaagagatacagtgag

SEQ ID NO: 8554465 - DNA, 22 bp, Homo sapiens
cacatgcttcttttgattatga

SEQ ID NO: 8554466 - DNA, 22 bp, Homo sapiens
cacatgaagacctaattggatt

SEQ ID NO: 8554467 - DNA, 22 bp, Homo sapiens
cacatgcttcttttgattatga

SEQ ID NO: 8554468 - DNA, 23 bp, Homo sapiens
cacatggattaaatgagaccaca

SEQ ID NO: 8554469 - DNA, 23 bp, Homo sapiens
cacatggaggaccgttcttataa

SEQ ID NO: 8554470 - DNA, 22 bp, Homo sapiens
cacatgggcgtaatgtccatgg

SEQ ID NO: 8554471 - DNA, 22 bp, Homo sapiens
cacatggcagaatcatgcatct

SEQ ID NO: 8554472 - DNA, 22 bp, Homo sapiens
cacatgggtggatggatgcatg

SEQ ID NO: 8554473 - DNA, 22 bp, Homo sapiens
cacatggggcgctgcattggcc

SEQ ID NO: 8554474 - DNA, 22 bp, Homo sapiens
cacatggggcgctgcattggcc

SEQ ID NO: 8554475 - DNA, 22 bp, Homo sapiens
cacatggggcgctgcattggcc

SEQ ID NO: 8554476 - DNA, 22 bp, Homo sapiens
cacatgtcctgggaaaataact

SEQ ID NO: 8554477 - DNA, 22 bp, Homo sapiens
cacattctttcacagttctgaa

SEQ ID NO: 8554478 - DNA, 22 bp, Homo sapiens
cacatgggtgtgcctggaggaa

SEQ ID NO: 8554479 - DNA, 22 bp, Homo sapiens
cacatgtagtaagcaggcaatg

SEQ ID NO: 8554480 - DNA, 22 bp, Homo sapiens
cacatggtggtgcttgataagc

SEQ ID NO: 8554481 - DNA, 22 bp, Homo sapiens
cacatgtacagaagcaggctgg

SEQ ID NO: 8554482 - DNA, 19 bp, Homo sapiens
agcaggccaggcaggtggc

SEQ ID NO: 8554483 - DNA, 22 bp, Homo sapiens
agcaggctaagggacctgttta

SEQ ID NO: 8554484 - DNA, 20 bp, Homo sapiens
cacaggctatatgagagcca

SEQ ID NO: 8554485 - DNA, 20 bp, Homo sapiens
cacaggctatatgagagcca

SEQ ID NO: 8554486 - DNA, 19 bp, Homo sapiens
agcaggctaggctgcctct

SEQ ID NO: 8554487 - DNA, 18 bp, Homo sapiens
cacaggctcccagtgagg

SEQ ID NO: 8554488 - DNA, 22 bp, Homo sapiens
cacaggctccggccttgcagcc

SEQ ID NO: 8554489 - DNA, 18 bp, Homo sapiens
cacaggctcccagtgagg

SEQ ID NO: 8554490 - DNA, 22 bp, Homo sapiens
cacattgtagagattagaaaga

SEQ ID NO: 8554491 - DNA, 22 bp, Homo sapiens
cacattgtattgtggaaagtta

SEQ ID NO: 8554492 - DNA, 21 bp, Homo sapiens
cacattgaatacagagatgga

SEQ ID NO: 8554493 - DNA, 22 bp, Homo sapiens
cacattgataattaaggcctcc

SEQ ID NO: 8554494 - DNA, 22 bp, Homo sapiens
cacattgaaccatatattagtg

SEQ ID NO: 8554495 - DNA, 22 bp, Homo sapiens
cacatttaaaggttgaagctga

SEQ ID NO: 8554496 - DNA, 22 bp, Homo sapiens
cacatttaaaggttgaagctga

SEQ ID NO: 8554497 - DNA, 22 bp, Homo sapiens
cacatttaagcagatgtggacc

SEQ ID NO: 8554498 - DNA, 22 bp, Homo sapiens
cacatttaagcagatgtggacc

SEQ ID NO: 8554499 - DNA, 22 bp, Homo sapiens
cacatttaagcagatgtggacc

SEQ ID NO: 8554500 - DNA, 22 bp, Homo sapiens
cacatttaaaaaatccacgatc

SEQ ID NO: 8554501 - DNA, 22 bp, Homo sapiens
cacatttaaaaaatccacgatc

SEQ ID NO: 8554502 - DNA, 22 bp, Homo sapiens
cacatttaaaggttgaagctga

SEQ ID NO: 8554503 - DNA, 22 bp, Homo sapiens
cacatttaaaggttgaagctga

SEQ ID NO: 8554504 - DNA, 22 bp, Homo sapiens
cacatttaaaaaatccacgatc

SEQ ID NO: 8554505 - DNA, 22 bp, Homo sapiens
cacgggctgtttccatgcaaaa

SEQ ID NO: 8554506 - DNA, 22 bp, Homo sapiens
cacgggtggaatcagggactcc

SEQ ID NO: 8554507 - DNA, 22 bp, Homo sapiens
cacgggagacgtgatcttggac

SEQ ID NO: 8554508 - DNA, 22 bp, Homo sapiens
cactaaaactacattggaaaca

SEQ ID NO: 8554509 - DNA, 22 bp, Homo sapiens
cactaaaactacattggaaaca

SEQ ID NO: 8554510 - DNA, 22 bp, Homo sapiens
cactaaatgtttcaatgtggga

SEQ ID NO: 8554511 - DNA, 22 bp, Homo sapiens
cacatttaagtgcttgttcaga

SEQ ID NO: 8554512 - DNA, 22 bp, Homo sapiens
cacatttaagtgcttgttcaga

SEQ ID NO: 8554513 - DNA, 22 bp, Homo sapiens
cacatttaagtgcttgttcaga

SEQ ID NO: 8554514 - DNA, 22 bp, Homo sapiens
cacctgccaaatggggatgctg

SEQ ID NO: 8554515 - DNA, 22 bp, Homo sapiens
cacctgcaaggagctttcattt

SEQ ID NO: 8554516 - DNA, 22 bp, Homo sapiens
cacctgagtgtcagtattctca

SEQ ID NO: 8554517 - DNA, 22 bp, Homo sapiens
cacctgagtgtcagtattctca

SEQ ID NO: 8554518 - DNA, 22 bp, Homo sapiens
cactagaaaggtacagattatg

SEQ ID NO: 8554519 - DNA, 22 bp, Homo sapiens
cactacttgaaagaattacaga

SEQ ID NO: 8554520 - DNA, 22 bp, Homo sapiens
cactaggctggagtgcagtggc

SEQ ID NO: 8554521 - DNA, 22 bp, Homo sapiens
agcaggtggacagaggaagaaa

SEQ ID NO: 8554522 - DNA, 19 bp, Homo sapiens
cactaagatgagatatagc

SEQ ID NO: 8554523 - DNA, 22 bp, Homo sapiens
cactaagatttaaagtattagt

SEQ ID NO: 8554524 - DNA, 22 bp, Homo sapiens
cactaagatttaaagtattagt

SEQ ID NO: 8554525 - DNA, 22 bp, Homo sapiens
cactaagtcaacagcctctctt

SEQ ID NO: 8554526 - DNA, 22 bp, Homo sapiens
cactacaggggtccacagctga

SEQ ID NO: 8554527 - DNA, 22 bp, Homo sapiens
cactacagaatcaaatacgggc

SEQ ID NO: 8554528 - DNA, 22 bp, Homo sapiens
cactacaggggtccacagctga

SEQ ID NO: 8554529 - DNA, 22 bp, Homo sapiens
agcaggtggccacgaggaggag

SEQ ID NO: 8554530 - DNA, 22 bp, Homo sapiens
cactgaaatcgaaaaatgtagg

SEQ ID NO: 8554531 - DNA, 22 bp, Homo sapiens
cactgaacaacaaatagtgaat

SEQ ID NO: 8554532 - DNA, 22 bp, Homo sapiens
cactgaaccgtaaatgatttag

SEQ ID NO: 8554533 - DNA, 22 bp, Homo sapiens
cactgaaatcgaaaaatgtagg

SEQ ID NO: 8554534 - DNA, 22 bp, Homo sapiens
caatttcttgttaattctcagg

SEQ ID NO: 8554535 - DNA, 18 bp, Homo sapiens
caattttacccagtccct

SEQ ID NO: 8554536 - DNA, 22 bp, Homo sapiens
caatttctggaactaattctga

SEQ ID NO: 8554537 - DNA, 22 bp, Homo sapiens
cacacatcttatcccagttatt

SEQ ID NO: 8554538 - DNA, 22 bp, Homo sapiens
cacacatcttatcccagttatt

SEQ ID NO: 8554539 - DNA, 22 bp, Homo sapiens
cacacatcaacctagacattgt

SEQ ID NO: 8554540 - DNA, 22 bp, Homo sapiens
cacacagaaccgctcgccactt

SEQ ID NO: 8554541 - DNA, 22 bp, Homo sapiens
caatttttgtacttatagtact

SEQ ID NO: 8554542 - DNA, 22 bp, Homo sapiens
cacacagaaccgctcgccactt

SEQ ID NO: 8554543 - DNA, 22 bp, Homo sapiens
cacacagaaccgctcgccactt

SEQ ID NO: 8554544 - DNA, 22 bp, Homo sapiens
cacacagaaccgctcgccactt

SEQ ID NO: 8554545 - DNA, 22 bp, Homo sapiens
caattttattggtccaaataca

SEQ ID NO: 8554546 - DNA, 22 bp, Homo sapiens
cacacatggttccgcaggatgc

SEQ ID NO: 8554547 - DNA, 22 bp, Homo sapiens
cacacatggttccgcaggatgc

SEQ ID NO: 8554548 - DNA, 22 bp, Homo sapiens
cacacatgtctctccatgctct

SEQ ID NO: 8554549 - DNA, 22 bp, Homo sapiens
cacacatgtctctccatgctct

SEQ ID NO: 8554550 - DNA, 22 bp, Homo sapiens
cacacatggtagcaggtacaag

SEQ ID NO: 8554551 - DNA, 22 bp, Homo sapiens
cacacatggtagcaggtacaag

SEQ ID NO: 8554552 - DNA, 22 bp, Homo sapiens
cacacatggtcagtggctactc

SEQ ID NO: 8554553 - DNA, 22 bp, Homo sapiens
cacacatggtagcaggtacaag

SEQ ID NO: 8554554 - DNA, 22 bp, Homo sapiens
cacacatggtagcaggtacaag

SEQ ID NO: 8554555 - DNA, 22 bp, Homo sapiens
cacacatggctgccagggaggt

SEQ ID NO: 8554556 - DNA, 22 bp, Homo sapiens
cacacatgaagttgctgagcta

SEQ ID NO: 8554557 - DNA, 22 bp, Homo sapiens
cacacatgaagttgctgagcta

SEQ ID NO: 8554558 - DNA, 22 bp, Homo sapiens
cacacatgaagttgctgagcta

SEQ ID NO: 8554559 - DNA, 22 bp, Homo sapiens
cacacatgaatccctagtacct

SEQ ID NO: 8554560 - DNA, 22 bp, Homo sapiens
cacacatgaatccctagtacct

SEQ ID NO: 8554561 - DNA, 22 bp, Homo sapiens
cacacatgaatccctagtacct

SEQ ID NO: 8554562 - DNA, 22 bp, Homo sapiens
cacacatgcatgtaagacctct

SEQ ID NO: 8554563 - DNA, 22 bp, Homo sapiens
cacacatgcatgtaagacctct

SEQ ID NO: 8554564 - DNA, 22 bp, Homo sapiens
cacacatgacccacttttaccg

SEQ ID NO: 8554565 - DNA, 22 bp, Homo sapiens
cacacatgagtctccccattgg

SEQ ID NO: 8554566 - DNA, 22 bp, Homo sapiens
cacacatgcatgtaagacctct

SEQ ID NO: 8554567 - DNA, 22 bp, Homo sapiens
cacacatgagtctccccattgg

SEQ ID NO: 8554568 - DNA, 22 bp, Homo sapiens
cacacatgacccacttttaccg

SEQ ID NO: 8554569 - DNA, 22 bp, Homo sapiens
cacacatgtgggatccgcaggg

SEQ ID NO: 8554570 - DNA, 22 bp, Homo sapiens
cacacatgtgagcagagaggcg

SEQ ID NO: 8554571 - DNA, 22 bp, Homo sapiens
cacacatgtctctccatgctct

SEQ ID NO: 8554572 - DNA, 22 bp, Homo sapiens
cacacatgtctctccatgctct

SEQ ID NO: 8554573 - DNA, 22 bp, Homo sapiens
cacacatgtctctccatgctct

SEQ ID NO: 8554574 - DNA, 22 bp, Homo sapiens
cacacatgtgagcagagaggcg

SEQ ID NO: 8554575 - DNA, 22 bp, Homo sapiens
cacacatgtgggatccgcaggg

SEQ ID NO: 8554576 - DNA, 22 bp, Homo sapiens
cacacttgtgaccgatataatg

SEQ ID NO: 8554577 - DNA, 22 bp, Homo sapiens
cacactgttgaggacgagatgt

SEQ ID NO: 8554578 - DNA, 22 bp, Homo sapiens
cacacatgtgtgcagcttagaa

SEQ ID NO: 8554579 - DNA, 22 bp, Homo sapiens
cacacatgtgtgcagcttagaa

SEQ ID NO: 8554580 - DNA, 22 bp, Homo sapiens
cacacatgtgtgcagcttagaa

SEQ ID NO: 8554581 - DNA, 22 bp, Homo sapiens
cacagaaaaaggcttgaaaatc

SEQ ID NO: 8554582 - DNA, 22 bp, Homo sapiens
cacagaaaaaggcttgaaaatc

SEQ ID NO: 8554583 - DNA, 22 bp, Homo sapiens
cacagaaaaaggcttgaaaatc

SEQ ID NO: 8554584 - DNA, 22 bp, Homo sapiens
cacagaaaaaggcttgaaaatc

SEQ ID NO: 8554585 - DNA, 22 bp, Homo sapiens
cacactttgttgaagttttcat

SEQ ID NO: 8554586 - DNA, 22 bp, Homo sapiens
cacactttgtgctaatctattt

SEQ ID NO: 8554587 - DNA, 22 bp, Homo sapiens
cacactttgtgctaatctattt

SEQ ID NO: 8554588 - DNA, 22 bp, Homo sapiens
cacagctgccctaactgtactc

SEQ ID NO: 8554589 - DNA, 22 bp, Homo sapiens
cacagctgccctactccatgtg

SEQ ID NO: 8554590 - DNA, 22 bp, Homo sapiens
cacagctgccccctctctaact

SEQ ID NO: 8554591 - DNA, 22 bp, Homo sapiens
cacagctgccctactccatgtg

SEQ ID NO: 8554592 - DNA, 22 bp, Homo sapiens
cacagctgccctactccatgtg

SEQ ID NO: 8554593 - DNA, 22 bp, Homo sapiens
cacagctgccctactccatgtg

SEQ ID NO: 8554594 - DNA, 22 bp, Homo sapiens
cacagctgccctactccatgtg

SEQ ID NO: 8554595 - DNA, 22 bp, Homo sapiens
cacagctgccatgcagtcagtg

SEQ ID NO: 8554596 - DNA, 22 bp, Homo sapiens
cacagctgaccaccctgctccc

SEQ ID NO: 8554597 - DNA, 22 bp, Homo sapiens
cacagctgccatggctgcactt

SEQ ID NO: 8554598 - DNA, 22 bp, Homo sapiens
cacagctgccatggctgcactt

SEQ ID NO: 8554599 - DNA, 22 bp, Homo sapiens
cacagctgccatggctgcactt

SEQ ID NO: 8554600 - DNA, 22 bp, Homo sapiens
cacagaacaccaaagaaccttc

SEQ ID NO: 8554601 - DNA, 22 bp, Homo sapiens
cacagaacaccaaagaaccttc

SEQ ID NO: 8554602 - DNA, 22 bp, Homo sapiens
cacagaacaccaaagaaccttc

SEQ ID NO: 8554603 - DNA, 22 bp, Homo sapiens
cacagcagccagaacatttttg

SEQ ID NO: 8554604 - DNA, 22 bp, Homo sapiens
cacagcagccagaacatttttg

SEQ ID NO: 8554605 - DNA, 22 bp, Homo sapiens
cacagctgaccaccctgctccc

SEQ ID NO: 8554606 - DNA, 22 bp, Homo sapiens
cacagcaggcactatacagggc

SEQ ID NO: 8554607 - DNA, 22 bp, Homo sapiens
cacagaaaaaggcttgaaaatc

SEQ ID NO: 8554608 - DNA, 22 bp, Homo sapiens
cacagaaatattgtgtcccttg

SEQ ID NO: 8554609 - DNA, 22 bp, Homo sapiens
cacagaaatattgtgtcccttg

SEQ ID NO: 8554610 - DNA, 22 bp, Homo sapiens
cacagaaatattgtgtcccttg

SEQ ID NO: 8554611 - DNA, 22 bp, Homo sapiens
cacagaaattattaggatgctt

SEQ ID NO: 8554612 - DNA, 22 bp, Homo sapiens
cacagaaattattaggatgctt

SEQ ID NO: 8554613 - DNA, 22 bp, Homo sapiens
cacagaaattattaggatgctt

SEQ ID NO: 8554614 - DNA, 22 bp, Homo sapiens
agcaggcaggcccagcggctgg

SEQ ID NO: 8554615 - DNA, 22 bp, Homo sapiens
cacaggaagatctcccagaggt

SEQ ID NO: 8554616 - DNA, 22 bp, Homo sapiens
cacaggaagatctcccagaggt

SEQ ID NO: 8554617 - DNA, 22 bp, Homo sapiens
cacaggaagaggtatacaattc

SEQ ID NO: 8554618 - DNA, 22 bp, Homo sapiens
cacaggaaatattaggagggat

SEQ ID NO: 8554619 - DNA, 22 bp, Homo sapiens
cacaggaaatgattctgcagca

SEQ ID NO: 8554620 - DNA, 22 bp, Homo sapiens
cacaggaaatgattctgcagca

SEQ ID NO: 8554621 - DNA, 22 bp, Homo sapiens
cacaggaacttactggccactt

SEQ ID NO: 8554622 - DNA, 22 bp, Homo sapiens
cacaggaacaaagaagacaatt

SEQ ID NO: 8554623 - DNA, 22 bp, Homo sapiens
cacagctggaatggggtacctg

SEQ ID NO: 8554624 - DNA, 19 bp, Homo sapiens
cacagctggcgctgaccgc

SEQ ID NO: 8554625 - DNA, 19 bp, Homo sapiens
cacagctggcgctgaccgc

SEQ ID NO: 8554626 - DNA, 22 bp, Homo sapiens
cacagctgggaaaatttgtaca

SEQ ID NO: 8554627 - DNA, 22 bp, Homo sapiens
cacagctggggaagctgaggcc

SEQ ID NO: 8554628 - DNA, 22 bp, Homo sapiens
cacaggaaaaatgggtccttta

SEQ ID NO: 8554629 - DNA, 20 bp, Homo sapiens
cacaggaaagctactcagtt

SEQ ID NO: 8554630 - DNA, 22 bp, Homo sapiens
cacaggaaagtcagccagaaga

SEQ ID NO: 8554631 - DNA, 20 bp, Homo sapiens
cacaggaaagctactcagtt

SEQ ID NO: 8554632 - DNA, 20 bp, Homo sapiens
cacaggaaagctactcagtt

SEQ ID NO: 8554633 - DNA, 22 bp, Homo sapiens
cacaggaaaataaaagatctaa

SEQ ID NO: 8554634 - DNA, 21 bp, Homo sapiens
agcagacagatgcacgcacac

SEQ ID NO: 8554635 - DNA, 22 bp, Homo sapiens
caaggaaacatgaaatgcattg

SEQ ID NO: 8554636 - DNA, 22 bp, Homo sapiens
caaggaaggagagatgatgggt

SEQ ID NO: 8554637 - DNA, 22 bp, Homo sapiens
agcagacatatctcatgtcaca

SEQ ID NO: 8554638 - DNA, 22 bp, Homo sapiens
agcagacaggtaggaggataaa

SEQ ID NO: 8554639 - DNA, 21 bp, Homo sapiens
agcagacagcccaagaaaatc

SEQ ID NO: 8554640 - DNA, 22 bp, Homo sapiens
agcagacaggtaggaggataaa

SEQ ID NO: 8554641 - DNA, 22 bp, Homo sapiens
caagggaaggctaagggcaaca

SEQ ID NO: 8554642 - DNA, 22 bp, Homo sapiens
caagggaagaggacagggacct

SEQ ID NO: 8554643 - DNA, 22 bp, Homo sapiens
agcagagaccatatagcccaga

SEQ ID NO: 8554644 - DNA, 22 bp, Homo sapiens
agcagagacatgaaatatgctt

SEQ ID NO: 8554645 - DNA, 22 bp, Homo sapiens
caaggcattcttgcaggtaggg

SEQ ID NO: 8554646 - DNA, 22 bp, Homo sapiens
caaggcattaccatggctagag

SEQ ID NO: 8554647 - DNA, 22 bp, Homo sapiens
agcagacatggcttggatgtgg

SEQ ID NO: 8554648 - DNA, 22 bp, Homo sapiens
agcagaccaggagtgcacaggt

SEQ ID NO: 8554649 - DNA, 22 bp, Homo sapiens
agcagagaagacacaggcttca

SEQ ID NO: 8554650 - DNA, 21 bp, Homo sapiens
agcagactgaatacattctta

SEQ ID NO: 8554651 - DNA, 22 bp, Homo sapiens
agcagactcttctcctggggct

SEQ ID NO: 8554652 - DNA, 22 bp, Homo sapiens
agcagactccattgagtgagtc

SEQ ID NO: 8554653 - DNA, 22 bp, Homo sapiens
agcagactccattgagtgagtc

SEQ ID NO: 8554654 - DNA, 22 bp, Homo sapiens
agcagagacatgaaatatgctt

SEQ ID NO: 8554655 - DNA, 22 bp, Homo sapiens
agcagagacatgaaatatgctt

SEQ ID NO: 8554656 - DNA, 22 bp, Homo sapiens
agcagagaagacacaggcttca

SEQ ID NO: 8554657 - DNA, 22 bp, Homo sapiens
agcagagaagacacaggcttca

SEQ ID NO: 8554658 - DNA, 22 bp, Homo sapiens
caagctggagttcctcagagtg

SEQ ID NO: 8554659 - DNA, 22 bp, Homo sapiens
caagctggctgggagaggcacg

SEQ ID NO: 8554660 - DNA, 22 bp, Homo sapiens
caagcagagaggttagaacaca

SEQ ID NO: 8554661 - DNA, 22 bp, Homo sapiens
caagcagagaggttagaacaca

SEQ ID NO: 8554662 - DNA, 22 bp, Homo sapiens
caagcagaggtttatgtattag

SEQ ID NO: 8554663 - DNA, 22 bp, Homo sapiens
caagcagatattttagtcaaga

SEQ ID NO: 8554664 - DNA, 22 bp, Homo sapiens
caagcagaggtttatgtattag

SEQ ID NO: 8554665 - DNA, 22 bp, Homo sapiens
agcaattattgtataagaacaa

SEQ ID NO: 8554666 - DNA, 22 bp, Homo sapiens
agcaattattgtataagaacaa

SEQ ID NO: 8554667 - DNA, 22 bp, Homo sapiens
agcaatttcccatctcttctgc

SEQ ID NO: 8554668 - DNA, 22 bp, Homo sapiens
agcaattttcccttagtctttg

SEQ ID NO: 8554669 - DNA, 22 bp, Homo sapiens
caagctttccattacacacatt

SEQ ID NO: 8554670 - DNA, 22 bp, Homo sapiens
caagctggtatcagctagagcg

SEQ ID NO: 8554671 - DNA, 22 bp, Homo sapiens
caagcttgtttctcctgggggt

SEQ ID NO: 8554672 - DNA, 22 bp, Homo sapiens
caagctttatccgccatgtagg

SEQ ID NO: 8554673 - DNA, 22 bp, Homo sapiens
caaggaaaacagatgatcaaca

SEQ ID NO: 8554674 - DNA, 22 bp, Homo sapiens
caaggaaaacagatgatcaaca

SEQ ID NO: 8554675 - DNA, 22 bp, Homo sapiens
caaggaaaagaagtatttcaga

SEQ ID NO: 8554676 - DNA, 22 bp, Homo sapiens
caaggaaaagaagtatttcaga

SEQ ID NO: 8554677 - DNA, 22 bp, Homo sapiens
caaggaaaagaagtatttcaga

SEQ ID NO: 8554678 - DNA, 22 bp, Homo sapiens
caagggaaggctaagggcaaca

SEQ ID NO: 8554679 - DNA, 22 bp, Homo sapiens
caagggaattgtgtgtgagagg

SEQ ID NO: 8554680 - DNA, 22 bp, Homo sapiens
caagggaattgtgtgtgagagg

SEQ ID NO: 8554681 - DNA, 22 bp, Homo sapiens
caagggacctgagatggtctct

SEQ ID NO: 8554682 - DNA, 22 bp, Homo sapiens
caagggagttactgagggcggg

SEQ ID NO: 8554683 - DNA, 22 bp, Homo sapiens
caagggcaggagaggatggatg

SEQ ID NO: 8554684 - DNA, 22 bp, Homo sapiens
caagggctcacggtctgctggg

SEQ ID NO: 8554685 - DNA, 22 bp, Homo sapiens
caagggctcacggtctgctggg

SEQ ID NO: 8554686 - DNA, 22 bp, Homo sapiens
caagggcctccaccttgctcgt

SEQ ID NO: 8554687 - DNA, 22 bp, Homo sapiens
caagtccaacagtttttcagac

SEQ ID NO: 8554688 - DNA, 22 bp, Homo sapiens
caagtccaggtgggcaaataaa

SEQ ID NO: 8554689 - DNA, 22 bp, Homo sapiens
caagggctcttttgaggaatgt

SEQ ID NO: 8554690 - DNA, 22 bp, Homo sapiens
caagggctgaacacaggtttca

SEQ ID NO: 8554691 - DNA, 22 bp, Homo sapiens
caagggcttcaagtggccaaga

SEQ ID NO: 8554692 - DNA, 22 bp, Homo sapiens
caagggctgctatcagctactg

SEQ ID NO: 8554693 - DNA, 20 bp, Homo sapiens
caaggggagtagtatgggcc

SEQ ID NO: 8554694 - DNA, 22 bp, Homo sapiens
caagtcacttatgtgcagatat

SEQ ID NO: 8554695 - DNA, 22 bp, Homo sapiens
caagtcattactgaaatgtcac

SEQ ID NO: 8554696 - DNA, 22 bp, Homo sapiens
caagtctgacctctgggtgaag

SEQ ID NO: 8554697 - DNA, 22 bp, Homo sapiens
caagtctgacctctgggtgaag

SEQ ID NO: 8554698 - DNA, 22 bp, Homo sapiens
caagtctgacctctgggtgaag

SEQ ID NO: 8554699 - DNA, 22 bp, Homo sapiens
caagtctgtctgctcctgtgtg

SEQ ID NO: 8554700 - DNA, 19 bp, Homo sapiens
caagtgaagcctgggatgg

SEQ ID NO: 8554701 - DNA, 22 bp, Homo sapiens
caatgtttttccttccttaata

SEQ ID NO: 8554702 - DNA, 22 bp, Homo sapiens
caatgattctgcaactgtgtgc

SEQ ID NO: 8554703 - DNA, 22 bp, Homo sapiens
caattagctggtactgacagga

SEQ ID NO: 8554704 - DNA, 22 bp, Homo sapiens
caattatatttagaatgataca

SEQ ID NO: 8554705 - DNA, 22 bp, Homo sapiens
caattaaagaagacctgcctca

SEQ ID NO: 8554706 - DNA, 22 bp, Homo sapiens
caattacatttattgagcattc

SEQ ID NO: 8554707 - DNA, 22 bp, Homo sapiens
caattacatttattgagcattc

SEQ ID NO: 8554708 - DNA, 21 bp, Homo sapiens
caattacagatggctcagggg

SEQ ID NO: 8554709 - DNA, 22 bp, Homo sapiens
caattacatttattgagcattc

SEQ ID NO: 8554710 - DNA, 22 bp, Homo sapiens
cagcatcaccgccatttctgat

SEQ ID NO: 8554711 - DNA, 22 bp, Homo sapiens
cagcatggacaggggtggcgtt

SEQ ID NO: 8554712 - DNA, 22 bp, Homo sapiens
cagcagaaacccagcaaagcca

SEQ ID NO: 8554713 - DNA, 22 bp, Homo sapiens
cagcagaaaatgtgggtgattt

SEQ ID NO: 8554714 - DNA, 22 bp, Homo sapiens
cagcatggcttgagtgtttcct

SEQ ID NO: 8554715 - DNA, 22 bp, Homo sapiens
cagcatggcttgagtgtttcct

SEQ ID NO: 8554716 - DNA, 22 bp, Homo sapiens
cagcatggggatcactgtaggc

SEQ ID NO: 8554717 - DNA, 22 bp, Homo sapiens
cagcatggggatcactgtaggc

SEQ ID NO: 8554718 - DNA, 22 bp, Homo sapiens
cagcatggggatcactgtaggc

SEQ ID NO: 8554719 - DNA, 22 bp, Homo sapiens
cagcatggagacaaagtgggca

SEQ ID NO: 8554720 - DNA, 22 bp, Homo sapiens
cagcatggagacaaagtgggca

SEQ ID NO: 8554721 - DNA, 22 bp, Homo sapiens
cagcactgcttcgcagccaggg

SEQ ID NO: 8554722 - DNA, 22 bp, Homo sapiens
cagcactgcttcgcagccaggg

SEQ ID NO: 8554723 - DNA, 22 bp, Homo sapiens
cagcacttggtgccattgagtg

SEQ ID NO: 8554724 - DNA, 22 bp, Homo sapiens
cagcactttagcggaggcatca

SEQ ID NO: 8554725 - DNA, 22 bp, Homo sapiens
cagcactgtgataactgagcca

SEQ ID NO: 8554726 - DNA, 22 bp, Homo sapiens
cagcactgttcccagaccactg

SEQ ID NO: 8554727 - DNA, 22 bp, Homo sapiens
cagcatggtgccagtgagtcca

SEQ ID NO: 8554728 - DNA, 22 bp, Homo sapiens
cagcatggtggagctgctcttt

SEQ ID NO: 8554729 - DNA, 22 bp, Homo sapiens
agcgagggaggtctgaggacag

SEQ ID NO: 8554730 - DNA, 22 bp, Homo sapiens
cagcatgtatctttcaggtgtg

SEQ ID NO: 8554731 - DNA, 22 bp, Homo sapiens
cagcatggggcttggagtcagc

SEQ ID NO: 8554732 - DNA, 22 bp, Homo sapiens
cagcatggggcttggagtcagc

SEQ ID NO: 8554733 - DNA, 22 bp, Homo sapiens
cagcatggggcttggagtcagc

SEQ ID NO: 8554734 - DNA, 22 bp, Homo sapiens
cagcatggtgccagtgagtcca

SEQ ID NO: 8554735 - DNA, 22 bp, Homo sapiens
cagcatggtgccagtgagtcca

SEQ ID NO: 8554736 - DNA, 22 bp, Homo sapiens
agcgccactgcactccagcctg

SEQ ID NO: 8554737 - DNA, 22 bp, Homo sapiens
agcgccactgcactccagcctg

SEQ ID NO: 8554738 - DNA, 22 bp, Homo sapiens
agcgattcacacactgggctgt

SEQ ID NO: 8554739 - DNA, 22 bp, Homo sapiens
agcgattctaattggagattaa

SEQ ID NO: 8554740 - DNA, 22 bp, Homo sapiens
agcgaggttttgcagatacagc

SEQ ID NO: 8554741 - DNA, 22 bp, Homo sapiens
agcgccactgcactccagcctg

SEQ ID NO: 8554742 - DNA, 22 bp, Homo sapiens
agcgcaggaacacgtctgcctt

SEQ ID NO: 8554743 - DNA, 22 bp, Homo sapiens
cagcctcctgggacactcaccg

SEQ ID NO: 8554744 - DNA, 22 bp, Homo sapiens
cagcctcctgggacactcaccg

SEQ ID NO: 8554745 - DNA, 22 bp, Homo sapiens
cagcctctctgtatctcaggat

SEQ ID NO: 8554746 - DNA, 22 bp, Homo sapiens
cagcctctaagcacagcctctc

SEQ ID NO: 8554747 - DNA, 22 bp, Homo sapiens
cagcctctaagcacagcctctc

SEQ ID NO: 8554748 - DNA, 22 bp, Homo sapiens
cagccctggtgaggttggctat

SEQ ID NO: 8554749 - DNA, 22 bp, Homo sapiens
cagccctggtgaggttggctat

SEQ ID NO: 8554750 - DNA, 22 bp, Homo sapiens
cagccctggtgaggttggctat

SEQ ID NO: 8554751 - DNA, 22 bp, Homo sapiens
cagcctcctgggacactcaccg

SEQ ID NO: 8554752 - DNA, 22 bp, Homo sapiens
cagccccacacggtctagctct

SEQ ID NO: 8554753 - DNA, 22 bp, Homo sapiens
cagccccacacggtctagctct

SEQ ID NO: 8554754 - DNA, 22 bp, Homo sapiens
cagcccatttctgggacctgag

SEQ ID NO: 8554755 - DNA, 22 bp, Homo sapiens
cagcccagtaccaagcagttgg

SEQ ID NO: 8554756 - DNA, 22 bp, Homo sapiens
cagcccagtgcacgcccgtttc

SEQ ID NO: 8554757 - DNA, 22 bp, Homo sapiens
cagcccagtgcacgcccgtttc

SEQ ID NO: 8554758 - DNA, 22 bp, Homo sapiens
cagcccagtgcatttgtgtact

SEQ ID NO: 8554759 - DNA, 22 bp, Homo sapiens
cagcccagtgcatttgtgtact

SEQ ID NO: 8554760 - DNA, 19 bp, Homo sapiens
cagcccagggtgctaccaa

SEQ ID NO: 8554761 - DNA, 19 bp, Homo sapiens
cagcccagggtgctaccaa

SEQ ID NO: 8554762 - DNA, 22 bp, Homo sapiens
cagcccaggtctctcttccagt

SEQ ID NO: 8554763 - DNA, 22 bp, Homo sapiens
cagcccaggtggcggaggttgc

SEQ ID NO: 8554764 - DNA, 22 bp, Homo sapiens
cagcccaggtctctcttccagt

SEQ ID NO: 8554765 - DNA, 22 bp, Homo sapiens
cagcccaggtctctcttccagt

SEQ ID NO: 8554766 - DNA, 22 bp, Homo sapiens
cagcccaggtctctcttccagt

SEQ ID NO: 8554767 - DNA, 22 bp, Homo sapiens
cagccatcagtaaagacagctt

SEQ ID NO: 8554768 - DNA, 22 bp, Homo sapiens
cagccatgagtctaagcagttt

SEQ ID NO: 8554769 - DNA, 22 bp, Homo sapiens
cagcccaaagccccaggctaga

SEQ ID NO: 8554770 - DNA, 22 bp, Homo sapiens
cagcccacgtcagggccactca

SEQ ID NO: 8554771 - DNA, 22 bp, Homo sapiens
cagcccacgtcagggccactca

SEQ ID NO: 8554772 - DNA, 22 bp, Homo sapiens
cagcccaaagccccaggctaga

SEQ ID NO: 8554773 - DNA, 22 bp, Homo sapiens
agcgctgtgggcgtgcgaggag

SEQ ID NO: 8554774 - DNA, 22 bp, Homo sapiens
cagccagctggcactgtgagta

SEQ ID NO: 8554775 - DNA, 22 bp, Homo sapiens
cagccagctggcactgtgagta

SEQ ID NO: 8554776 - DNA, 22 bp, Homo sapiens
cagccagtgtgaccgaggagga

SEQ ID NO: 8554777 - DNA, 22 bp, Homo sapiens
cagccagctggcactgtgagta

SEQ ID NO: 8554778 - DNA, 22 bp, Homo sapiens
cagcccactgcctctgtggtag

SEQ ID NO: 8554779 - DNA, 22 bp, Homo sapiens
cagcccagaactcacgtctcca

SEQ ID NO: 8554780 - DNA, 22 bp, Homo sapiens
cagcccacttcccagcacctac

SEQ ID NO: 8554781 - DNA, 22 bp, Homo sapiens
cagcccacttcccagcacctac

SEQ ID NO: 8554782 - DNA, 22 bp, Homo sapiens
cagcccacttcccagcacctac

SEQ ID NO: 8554783 - DNA, 22 bp, Homo sapiens
cagcccagagatgttatctagt

SEQ ID NO: 8554784 - DNA, 22 bp, Homo sapiens
cagcccagagaaggggcccgtg

SEQ ID NO: 8554785 - DNA, 22 bp, Homo sapiens
cagcccagagaaggggcccgtg

SEQ ID NO: 8554786 - DNA, 16 bp, Homo sapiens
cagcccaggggcgggc

SEQ ID NO: 8554787 - DNA, 21 bp, Homo sapiens
cagcccagagcagtggggcca

SEQ ID NO: 8554788 - DNA, 22 bp, Homo sapiens
cagctgagagtagaaatggagg

SEQ ID NO: 8554789 - DNA, 22 bp, Homo sapiens
cagcctctgagccttggcagat

SEQ ID NO: 8554790 - DNA, 22 bp, Homo sapiens
cagcctctgacaccacagtcgt

SEQ ID NO: 8554791 - DNA, 22 bp, Homo sapiens
cagcctctgtggctgccacacc

SEQ ID NO: 8554792 - DNA, 22 bp, Homo sapiens
cagccttcgacagttggagtag

SEQ ID NO: 8554793 - DNA, 22 bp, Homo sapiens
cagccttctgaatgaacgtact

SEQ ID NO: 8554794 - DNA, 22 bp, Homo sapiens
cagccttgatggatgaggaagt

SEQ ID NO: 8554795 - DNA, 18 bp, Homo sapiens
cagctgccagctcatgga

SEQ ID NO: 8554796 - DNA, 18 bp, Homo sapiens
cagctgccagctcatgga

SEQ ID NO: 8554797 - DNA, 18 bp, Homo sapiens
cagctgccagctcatgga

SEQ ID NO: 8554798 - DNA, 22 bp, Homo sapiens
cagctgccagcttctctccatc

SEQ ID NO: 8554799 - DNA, 22 bp, Homo sapiens
cagctgccagcttctctccatc

SEQ ID NO: 8554800 - DNA, 22 bp, Homo sapiens
cagctgagcatcactagtctgg

SEQ ID NO: 8554801 - DNA, 22 bp, Homo sapiens
cagctgagagtagaaatggagg

SEQ ID NO: 8554802 - DNA, 18 bp, Homo sapiens
cagctgccagctcatgga

SEQ ID NO: 8554803 - DNA, 22 bp, Homo sapiens
cagctgccatgacatgtcctgc

SEQ ID NO: 8554804 - DNA, 22 bp, Homo sapiens
cagctgccagcttctctccatc

SEQ ID NO: 8554805 - DNA, 22 bp, Homo sapiens
cagctgcccaggccacctggag

SEQ ID NO: 8554806 - DNA, 22 bp, Homo sapiens
cagctgcccaggccacctggag

SEQ ID NO: 8554807 - DNA, 22 bp, Homo sapiens
cagctgcccaggccacctggag

SEQ ID NO: 8554808 - DNA, 22 bp, Homo sapiens
cagctgcccaagccccagatgt

SEQ ID NO: 8554809 - DNA, 22 bp, Homo sapiens
cagctgccatgacatgtcctgc

SEQ ID NO: 8554810 - DNA, 22 bp, Homo sapiens
cagctgcccaagccccagatgt

SEQ ID NO: 8554811 - DNA, 22 bp, Homo sapiens
cagctgccccgctggctgacca

SEQ ID NO: 8554812 - DNA, 22 bp, Homo sapiens
cagctgccccgctggctgacca

SEQ ID NO: 8554813 - DNA, 22 bp, Homo sapiens
cagctgccccgctggctgacca

SEQ ID NO: 8554814 - DNA, 22 bp, Homo sapiens
cagctgcccaggccacctggag

SEQ ID NO: 8554815 - DNA, 22 bp, Homo sapiens
cagctgcccaggccacctggag

SEQ ID NO: 8554816 - DNA, 22 bp, Homo sapiens
cagctgcccatcctgggaaatg

SEQ ID NO: 8554817 - DNA, 22 bp, Homo sapiens
cagctgcccaggccacctggag

SEQ ID NO: 8554818 - DNA, 22 bp, Homo sapiens
cagctgccccataaatcacagt

SEQ ID NO: 8554819 - DNA, 22 bp, Homo sapiens
cagctgccccataaatcacagt

SEQ ID NO: 8554820 - DNA, 22 bp, Homo sapiens
agctctggaataatgatgtgat

SEQ ID NO: 8554821 - DNA, 22 bp, Homo sapiens
agctctggaataatgatgtgat

SEQ ID NO: 8554822 - DNA, 21 bp, Homo sapiens
agctctggagcagcaatcaag

SEQ ID NO: 8554823 - DNA, 22 bp, Homo sapiens
agctctgggagtagttccacct

SEQ ID NO: 8554824 - DNA, 22 bp, Homo sapiens
agctctgggagtagttccacct

SEQ ID NO: 8554825 - DNA, 22 bp, Homo sapiens
agctgagccagcagcaacagga

SEQ ID NO: 8554826 - DNA, 22 bp, Homo sapiens
agctgagccagcagcaacagga

SEQ ID NO: 8554827 - DNA, 22 bp, Homo sapiens
agctgagcatttgatccacctc

SEQ ID NO: 8554828 - DNA, 21 bp, Homo sapiens
agctgagcccagaagactggt

SEQ ID NO: 8554829 - DNA, 22 bp, Homo sapiens
agctgagctcaggctgatgtaa

SEQ ID NO: 8554830 - DNA, 22 bp, Homo sapiens
agctgagctcaggctgatgtaa

SEQ ID NO: 8554831 - DNA, 22 bp, Homo sapiens
agctgagctagtagttccagtg

SEQ ID NO: 8554832 - DNA, 17 bp, Homo sapiens
agctgagctggccaggg

SEQ ID NO: 8554833 - DNA, 17 bp, Homo sapiens
agctgagctggccaggg

SEQ ID NO: 8554834 - DNA, 17 bp, Homo sapiens
agctgagctggccaggg

SEQ ID NO: 8554835 - DNA, 22 bp, Homo sapiens
agctgagctgcagatgactgta

SEQ ID NO: 8554836 - DNA, 22 bp, Homo sapiens
agctgagctgcagatgactgta

SEQ ID NO: 8554837 - DNA, 22 bp, Homo sapiens
agctgaggaataataacaaggt

SEQ ID NO: 8554838 - DNA, 22 bp, Homo sapiens
agctgaggaataataacaaggt

SEQ ID NO: 8554839 - DNA, 22 bp, Homo sapiens
agctgaggacgtgaagggcggc

SEQ ID NO: 8554840 - DNA, 22 bp, Homo sapiens
agctgaggaggaatgatgggta

SEQ ID NO: 8554841 - DNA, 22 bp, Homo sapiens
agctgaggaggaatgatgggta

SEQ ID NO: 8554842 - DNA, 22 bp, Homo sapiens
cagctggatccctgcagaactt

SEQ ID NO: 8554843 - DNA, 22 bp, Homo sapiens
cagctggatctgcctcgagcca

SEQ ID NO: 8554844 - DNA, 22 bp, Homo sapiens
cagctggatccctgcagaactt

SEQ ID NO: 8554845 - DNA, 22 bp, Homo sapiens
cagctggacttttgatagaagt

SEQ ID NO: 8554846 - DNA, 22 bp, Homo sapiens
cagctgctttcagcaggaggga

SEQ ID NO: 8554847 - DNA, 19 bp, Homo sapiens
cagctggaatcatctgagg

SEQ ID NO: 8554848 - DNA, 19 bp, Homo sapiens
cagctggaatcatctgagg

SEQ ID NO: 8554849 - DNA, 22 bp, Homo sapiens
cagctgctttcagcaggaggga

SEQ ID NO: 8554850 - DNA, 22 bp, Homo sapiens
cagctgctttcagcaggaggga

SEQ ID NO: 8554851 - DNA, 22 bp, Homo sapiens
cagctgctttagttttccatcc

SEQ ID NO: 8554852 - DNA, 20 bp, Homo sapiens
agctgaggcacctgaggtta

SEQ ID NO: 8554853 - DNA, 20 bp, Homo sapiens
agctgaggcacctgaggtta

SEQ ID NO: 8554854 - DNA, 20 bp, Homo sapiens
agctgaggcacctgaggtta

SEQ ID NO: 8554855 - DNA, 22 bp, Homo sapiens
cagctggcagaacctgcatcca

SEQ ID NO: 8554856 - DNA, 22 bp, Homo sapiens
cagctggcaagtggagcagggt

SEQ ID NO: 8554857 - DNA, 22 bp, Homo sapiens
cagctggcaagtggagcagggt

SEQ ID NO: 8554858 - DNA, 22 bp, Homo sapiens
cagctggatgggagaccatgtt

SEQ ID NO: 8554859 - DNA, 22 bp, Homo sapiens
cagctggcaagtggagcagggt

SEQ ID NO: 8554860 - DNA, 22 bp, Homo sapiens
cagctggcaagtggagcagggt

SEQ ID NO: 8554861 - DNA, 22 bp, Homo sapiens
cagctggatgggagaccatgtt

SEQ ID NO: 8554862 - DNA, 22 bp, Homo sapiens
cagctggatgggagaccatgtt

SEQ ID NO: 8554863 - DNA, 22 bp, Homo sapiens
cagctggatgggagaccatgtt

SEQ ID NO: 8554864 - DNA, 22 bp, Homo sapiens
cagctgggtggctcttctgctc

SEQ ID NO: 8554865 - DNA, 22 bp, Homo sapiens
cagctgggtggctcttctgctc

SEQ ID NO: 8554866 - DNA, 22 bp, Homo sapiens
cagctgggtggctcttctgctc

SEQ ID NO: 8554867 - DNA, 22 bp, Homo sapiens
cagctgggtggctcttctgctc

SEQ ID NO: 8554868 - DNA, 22 bp, Homo sapiens
cagctggcagccctggccctgc

SEQ ID NO: 8554869 - DNA, 22 bp, Homo sapiens
cagctggcagccctggccctgc

SEQ ID NO: 8554870 - DNA, 22 bp, Homo sapiens
cagctggcagccctggccctgc

SEQ ID NO: 8554871 - DNA, 22 bp, Homo sapiens
cagagcagggtgcaccttgggc

SEQ ID NO: 8554872 - DNA, 22 bp, Homo sapiens
cagagcaggggtttcccaggtt

SEQ ID NO: 8554873 - DNA, 22 bp, Homo sapiens
cagagcacccaaggagcatttg

SEQ ID NO: 8554874 - DNA, 22 bp, Homo sapiens
cagagcaccagtgggagacaag

SEQ ID NO: 8554875 - DNA, 22 bp, Homo sapiens
cagagcaccagtgggagacaag

SEQ ID NO: 8554876 - DNA, 22 bp, Homo sapiens
cagagcaccagtgggagacaag

SEQ ID NO: 8554877 - DNA, 22 bp, Homo sapiens
agccaggggagtcagctgctgg

SEQ ID NO: 8554878 - DNA, 22 bp, Homo sapiens
agccagggctgcgagcagacag

SEQ ID NO: 8554879 - DNA, 22 bp, Homo sapiens
agccaggggagtcagctgctgg

SEQ ID NO: 8554880 - DNA, 22 bp, Homo sapiens
agccagggctgcgagcagacag

SEQ ID NO: 8554881 - DNA, 22 bp, Homo sapiens
agccagggctgcgagcagacag

SEQ ID NO: 8554882 - DNA, 22 bp, Homo sapiens
agccagggatggcagtgcccag

SEQ ID NO: 8554883 - DNA, 22 bp, Homo sapiens
agccagggatgcagcacagtga

SEQ ID NO: 8554884 - DNA, 22 bp, Homo sapiens
agccagggatgcagcacagtga

SEQ ID NO: 8554885 - DNA, 22 bp, Homo sapiens
agccagggatgcagcacagtga

SEQ ID NO: 8554886 - DNA, 23 bp, Homo sapiens
agccagggcactggtggagattg

SEQ ID NO: 8554887 - DNA, 23 bp, Homo sapiens
agccagggcactggtggagattg

SEQ ID NO: 8554888 - DNA, 23 bp, Homo sapiens
agccagggcactggtggagattg

SEQ ID NO: 8554889 - DNA, 22 bp, Homo sapiens
agccagggatggcagtgcccag

SEQ ID NO: 8554890 - DNA, 22 bp, Homo sapiens
agccagggaggattacacccca

SEQ ID NO: 8554891 - DNA, 22 bp, Homo sapiens
agccagggacgctgcaggctac

SEQ ID NO: 8554892 - DNA, 22 bp, Homo sapiens
agccagggacgctgcaggctac

SEQ ID NO: 8554893 - DNA, 22 bp, Homo sapiens
agccagggaggtggaggttgca

SEQ ID NO: 8554894 - DNA, 22 bp, Homo sapiens
agccagggaggtggaggttgca

SEQ ID NO: 8554895 - DNA, 22 bp, Homo sapiens
agccagggaggtggaggttgca

SEQ ID NO: 8554896 - DNA, 16 bp, Homo sapiens
agccaggctgcctcgg

SEQ ID NO: 8554897 - DNA, 16 bp, Homo sapiens
agccaggctgcctcgg

SEQ ID NO: 8554898 - DNA, 22 bp, Homo sapiens
agccaggctgcagttggctggc

SEQ ID NO: 8554899 - DNA, 22 bp, Homo sapiens
agccaggctgcagttggctggc

SEQ ID NO: 8554900 - DNA, 22 bp, Homo sapiens
agccagggaagaggcctacctc

SEQ ID NO: 8554901 - DNA, 22 bp, Homo sapiens
agccagggaagaggcctacctc

SEQ ID NO: 8554902 - DNA, 22 bp, Homo sapiens
agccagggaaggataacaagaa

SEQ ID NO: 8554903 - DNA, 22 bp, Homo sapiens
agccagggaaggataacaagaa

SEQ ID NO: 8554904 - DNA, 22 bp, Homo sapiens
agccagggacgctgcaggctac

SEQ ID NO: 8554905 - DNA, 22 bp, Homo sapiens
agccagggacgctgcaggctac

SEQ ID NO: 8554906 - DNA, 22 bp, Homo sapiens
agccagggacgctgcaggctac

SEQ ID NO: 8554907 - DNA, 22 bp, Homo sapiens
agccaactccagcccctgcagc

SEQ ID NO: 8554908 - DNA, 22 bp, Homo sapiens
agccaactaggagattaaggta

SEQ ID NO: 8554909 - DNA, 22 bp, Homo sapiens
agccaagaatcatgagctaata

SEQ ID NO: 8554910 - DNA, 22 bp, Homo sapiens
agccaagcaccactggcactcg

SEQ ID NO: 8554911 - DNA, 22 bp, Homo sapiens
agccaagcactcaactcctgga

SEQ ID NO: 8554912 - DNA, 22 bp, Homo sapiens
agccaggctcaaggcctgctcc

SEQ ID NO: 8554913 - DNA, 22 bp, Homo sapiens
agccaggctcaaggcctgctcc

SEQ ID NO: 8554914 - DNA, 22 bp, Homo sapiens
agccaggccttttctcaaggtt

SEQ ID NO: 8554915 - DNA, 22 bp, Homo sapiens
cagagcagtccttgtcaatcag

SEQ ID NO: 8554916 - DNA, 22 bp, Homo sapiens
cagagcagtccttgtcaatcag

SEQ ID NO: 8554917 - DNA, 22 bp, Homo sapiens
cagagcagtctggagatccagc

SEQ ID NO: 8554918 - DNA, 22 bp, Homo sapiens
cagagcagtctggagatccagc

SEQ ID NO: 8554919 - DNA, 18 bp, Homo sapiens
cagagcagtatgaatgtt

SEQ ID NO: 8554920 - DNA, 22 bp, Homo sapiens
cagagcagtaaatctggggcac

SEQ ID NO: 8554921 - DNA, 22 bp, Homo sapiens
cagagcagtagaaaacagcctt

SEQ ID NO: 8554922 - DNA, 22 bp, Homo sapiens
cagagcagtaaatctggggcac

SEQ ID NO: 8554923 - DNA, 22 bp, Homo sapiens
cagagcagtaaatctggggcac

SEQ ID NO: 8554924 - DNA, 22 bp, Homo sapiens
cagagcaggtatctttggtgaa

SEQ ID NO: 8554925 - DNA, 22 bp, Homo sapiens
cagagcaggtatctttggtgaa

SEQ ID NO: 8554926 - DNA, 22 bp, Homo sapiens
cagagccagtcagtcagaaact

SEQ ID NO: 8554927 - DNA, 22 bp, Homo sapiens
cagagccagggttgcacccctg

SEQ ID NO: 8554928 - DNA, 22 bp, Homo sapiens
cagagccaggtctaggagtctc

SEQ ID NO: 8554929 - DNA, 22 bp, Homo sapiens
cagagccaggcctgccctcttt

SEQ ID NO: 8554930 - DNA, 22 bp, Homo sapiens
cagagccagggttgcacccctg

SEQ ID NO: 8554931 - DNA, 22 bp, Homo sapiens
cagagcagtctggagatccagc

SEQ ID NO: 8554932 - DNA, 22 bp, Homo sapiens
cagagcagtctggagatccagc

SEQ ID NO: 8554933 - DNA, 22 bp, Homo sapiens
cagagccaggcctgccctcttt

SEQ ID NO: 8554934 - DNA, 22 bp, Homo sapiens
cagagcagtctggagatccagc

SEQ ID NO: 8554935 - DNA, 22 bp, Homo sapiens
cagagccatcccagcctgtggt

SEQ ID NO: 8554936 - DNA, 22 bp, Homo sapiens
cagagccatcccagcctgtggt

SEQ ID NO: 8554937 - DNA, 22 bp, Homo sapiens
cagagccatccaggtgcctgtt

SEQ ID NO: 8554938 - DNA, 22 bp, Homo sapiens
cagagccatcatgatatggagt

SEQ ID NO: 8554939 - DNA, 22 bp, Homo sapiens
cagagccatcatgatatggagt

SEQ ID NO: 8554940 - DNA, 22 bp, Homo sapiens
cagagccatccaggtgcctgtt

SEQ ID NO: 8554941 - DNA, 22 bp, Homo sapiens
cagagccatcatgatatggagt

SEQ ID NO: 8554942 - DNA, 21 bp, Homo sapiens
cagagctgtccaaaccctgac

SEQ ID NO: 8554943 - DNA, 21 bp, Homo sapiens
cagagctgtccaaaccctgac

SEQ ID NO: 8554944 - DNA, 21 bp, Homo sapiens
cagagctgtccaaaccctgac

SEQ ID NO: 8554945 - DNA, 21 bp, Homo sapiens
cagagctgtccaaaccctgac

SEQ ID NO: 8554946 - DNA, 22 bp, Homo sapiens
cagagccatggtatgggcttgt

SEQ ID NO: 8554947 - DNA, 22 bp, Homo sapiens
cagagccattatggagacttgc

SEQ ID NO: 8554948 - DNA, 23 bp, Homo sapiens
cagagctggctcagagctgcctg

SEQ ID NO: 8554949 - DNA, 23 bp, Homo sapiens
cagagctggctcagagctgcctg

SEQ ID NO: 8554950 - DNA, 23 bp, Homo sapiens
cagagctggctcagagctgcctg

SEQ ID NO: 8554951 - DNA, 23 bp, Homo sapiens
cagagctggctcagagctgcctg

SEQ ID NO: 8554952 - DNA, 23 bp, Homo sapiens
cagagctggctcagagctgcctg

SEQ ID NO: 8554953 - DNA, 22 bp, Homo sapiens
cagagctgttactattcatgaa

SEQ ID NO: 8554954 - DNA, 22 bp, Homo sapiens
cagagctgttactattcatgaa

SEQ ID NO: 8554955 - DNA, 22 bp, Homo sapiens
cagagctgtgataaatagatat

SEQ ID NO: 8554956 - DNA, 22 bp, Homo sapiens
cagagctgtgataaatagatat

SEQ ID NO: 8554957 - DNA, 22 bp, Homo sapiens
cagagctgtgataaatagatat

SEQ ID NO: 8554958 - DNA, 22 bp, Homo sapiens
cagagctgtccaaaccctgaca

SEQ ID NO: 8554959 - DNA, 22 bp, Homo sapiens
cagagctgtccaaaccctgaca

SEQ ID NO: 8554960 - DNA, 22 bp, Homo sapiens
cagagctgtccaaaccctgaca

SEQ ID NO: 8554961 - DNA, 22 bp, Homo sapiens
cagagctgtccaaaccctgaca

SEQ ID NO: 8554962 - DNA, 22 bp, Homo sapiens
cagagctgtccaaaccctgaca

SEQ ID NO: 8554963 - DNA, 22 bp, Homo sapiens
cagagctgtccaaaccctgaca

SEQ ID NO: 8554964 - DNA, 21 bp, Homo sapiens
cagagctgtccaaaccctgac

SEQ ID NO: 8554965 - DNA, 20 bp, Homo sapiens
cagagctgttatggatgatg

SEQ ID NO: 8554966 - DNA, 20 bp, Homo sapiens
cagagctgttatggatgatg

SEQ ID NO: 8554967 - DNA, 20 bp, Homo sapiens
cagagctgttatggatgatg

SEQ ID NO: 8554968 - DNA, 20 bp, Homo sapiens
cagagctgttatggatgatg

SEQ ID NO: 8554969 - DNA, 22 bp, Homo sapiens
cagagctgttgcggggcttggc

SEQ ID NO: 8554970 - DNA, 22 bp, Homo sapiens
cagagctgttgcggggcttggc

SEQ ID NO: 8554971 - DNA, 22 bp, Homo sapiens
cagagctgttgcggggcttggc

SEQ ID NO: 8554972 - DNA, 22 bp, Homo sapiens
cagagctgttgcggggcttggc

SEQ ID NO: 8554973 - DNA, 22 bp, Homo sapiens
cagagtgatggcacctgctggg

SEQ ID NO: 8554974 - DNA, 22 bp, Homo sapiens
cagagtgatggcacctgctggg

SEQ ID NO: 8554975 - DNA, 22 bp, Homo sapiens
cagagtgaacagtgggatgtgc

SEQ ID NO: 8554976 - DNA, 22 bp, Homo sapiens
cagagtgataaatatagaaatt

SEQ ID NO: 8554977 - DNA, 22 bp, Homo sapiens
cagagtgaaataggggatcaag

SEQ ID NO: 8554978 - DNA, 22 bp, Homo sapiens
cagagtgaaataggggatcaag

SEQ ID NO: 8554979 - DNA, 22 bp, Homo sapiens
cagaggagttcagtacacagcc

SEQ ID NO: 8554980 - DNA, 22 bp, Homo sapiens
cagaggtgctggagtgagtcct

SEQ ID NO: 8554981 - DNA, 21 bp, Homo sapiens
cagaggtggcctgacctctga

SEQ ID NO: 8554982 - DNA, 20 bp, Homo sapiens
cagaggagtacatatgttca

SEQ ID NO: 8554983 - DNA, 22 bp, Homo sapiens
cagaggagtgggccgttatggt

SEQ ID NO: 8554984 - DNA, 22 bp, Homo sapiens
cagaggagaattgcgggatcat

SEQ ID NO: 8554985 - DNA, 17 bp, Homo sapiens
cagaggagctttggggg

SEQ ID NO: 8554986 - DNA, 18 bp, Homo sapiens
cagaggagagacattcag

SEQ ID NO: 8554987 - DNA, 17 bp, Homo sapiens
cagaggagctttggggg

SEQ ID NO: 8554988 - DNA, 22 bp, Homo sapiens
cagaggaggccaccgcataggc

SEQ ID NO: 8554989 - DNA, 22 bp, Homo sapiens
cagaggaggccaccgcataggc

SEQ ID NO: 8554990 - DNA, 22 bp, Homo sapiens
cagaggaggcggtatacactgc

SEQ ID NO: 8554991 - DNA, 22 bp, Homo sapiens
cagaggaggcggtatacactgc

SEQ ID NO: 8554992 - DNA, 22 bp, Homo sapiens
agccctgagccagcctggtcag

SEQ ID NO: 8554993 - DNA, 22 bp, Homo sapiens
agcccttagtacatttctcaag

SEQ ID NO: 8554994 - DNA, 22 bp, Homo sapiens
cagagtggcactctgctggatg

SEQ ID NO: 8554995 - DNA, 22 bp, Homo sapiens
cagagtggagatgtgtgtggaa

SEQ ID NO: 8554996 - DNA, 22 bp, Homo sapiens
cagagtggcagtcccaggccca

SEQ ID NO: 8554997 - DNA, 22 bp, Homo sapiens
cagagtggcagtcccaggccca

SEQ ID NO: 8554998 - DNA, 22 bp, Homo sapiens
cagagtggcatgaatgaagcct

SEQ ID NO: 8554999 - DNA, 22 bp, Homo sapiens
agccctcctttgttcatgctgc

SEQ ID NO: 8555000 - DNA, 22 bp, Homo sapiens
agccctcctcacatcagcgtcc

SEQ ID NO: 8555001 - DNA, 18 bp, Homo sapiens
cagagtgggccaagagac

SEQ ID NO: 8555002 - DNA, 22 bp, Homo sapiens
cagagtggcgaccccctcagct

SEQ ID NO: 8555003 - DNA, 22 bp, Homo sapiens
cagatgaactaggctgcacttg

SEQ ID NO: 8555004 - DNA, 22 bp, Homo sapiens
cagatcttgtactcattattga

SEQ ID NO: 8555005 - DNA, 22 bp, Homo sapiens
cagatctgtttgccagatcagc

SEQ ID NO: 8555006 - DNA, 22 bp, Homo sapiens
cagatgaactgtgactgaaaat

SEQ ID NO: 8555007 - DNA, 22 bp, Homo sapiens
cagatgaactgtgactgaaaat

SEQ ID NO: 8555008 - DNA, 22 bp, Homo sapiens
cagatgaactgtgactgaaaat

SEQ ID NO: 8555009 - DNA, 22 bp, Homo sapiens
cagatgaactctatcctgtggc

SEQ ID NO: 8555010 - DNA, 22 bp, Homo sapiens
cagatctgctcctctgtccatg

SEQ ID NO: 8555011 - DNA, 22 bp, Homo sapiens
cagatctgtggtatctctattt

SEQ ID NO: 8555012 - DNA, 21 bp, Homo sapiens
cagatctgtaggtactaccat

SEQ ID NO: 8555013 - DNA, 22 bp, Homo sapiens
cagatctgctcctctgtccatg

SEQ ID NO: 8555014 - DNA, 22 bp, Homo sapiens
agcctgcttgagagtcctggct

SEQ ID NO: 8555015 - DNA, 22 bp, Homo sapiens
agcctggaagaacctgaagtct

SEQ ID NO: 8555016 - DNA, 22 bp, Homo sapiens
agcctggaagaacctgaagtct

SEQ ID NO: 8555017 - DNA, 22 bp, Homo sapiens
agcctgagtgcttaggactgtt

SEQ ID NO: 8555018 - DNA, 22 bp, Homo sapiens
cagatgaagatcatagaatagt

SEQ ID NO: 8555019 - DNA, 22 bp, Homo sapiens
agcctggacagctacggagaac

SEQ ID NO: 8555020 - DNA, 22 bp, Homo sapiens
agcctggaccaggggcctcaga

SEQ ID NO: 8555021 - DNA, 22 bp, Homo sapiens
agcctggagaagatgtgtattg

SEQ ID NO: 8555022 - DNA, 22 bp, Homo sapiens
agcctggacagctacggagaac

SEQ ID NO: 8555023 - DNA, 22 bp, Homo sapiens
agcctggaattaaggaaatgca

SEQ ID NO: 8555024 - DNA, 22 bp, Homo sapiens
agcctggagaggcgccatacac

SEQ ID NO: 8555025 - DNA, 22 bp, Homo sapiens
agcctggagaggcgccatacac

SEQ ID NO: 8555026 - DNA, 22 bp, Homo sapiens
agcctggagcttgagttatgag

SEQ ID NO: 8555027 - DNA, 22 bp, Homo sapiens
agcctggaggaggagttgagca

SEQ ID NO: 8555028 - DNA, 18 bp, Homo sapiens
agcctggagggttgaagt

SEQ ID NO: 8555029 - DNA, 22 bp, Homo sapiens
agcctggaggccaggagacagt

SEQ ID NO: 8555030 - DNA, 19 bp, Homo sapiens
agcctggagggctggtcac

SEQ ID NO: 8555031 - DNA, 18 bp, Homo sapiens
cagatccaggcagctatt

SEQ ID NO: 8555032 - DNA, 22 bp, Homo sapiens
cagatccacccttgtagtgaca

SEQ ID NO: 8555033 - DNA, 23 bp, Homo sapiens
cagatcatatatccagctgtaag

SEQ ID NO: 8555034 - DNA, 22 bp, Homo sapiens
cagatcatgggactgtctcagc

SEQ ID NO: 8555035 - DNA, 22 bp, Homo sapiens
cagatcataacagatacataga

SEQ ID NO: 8555036 - DNA, 23 bp, Homo sapiens
cagatcatatatccagctgtaag

SEQ ID NO: 8555037 - DNA, 22 bp, Homo sapiens
cagatcataacagatacataga

SEQ ID NO: 8555038 - DNA, 22 bp, Homo sapiens
cagatcatgaatgactgacaga

SEQ ID NO: 8555039 - DNA, 22 bp, Homo sapiens
agcctattccaggatgagctca

SEQ ID NO: 8555040 - DNA, 22 bp, Homo sapiens
cagatcaagctgtatggtcaga

SEQ ID NO: 8555041 - DNA, 22 bp, Homo sapiens
cagatcaagctgtatggtcaga

SEQ ID NO: 8555042 - DNA, 22 bp, Homo sapiens
agcctagggttctgatgtcact

SEQ ID NO: 8555043 - DNA, 22 bp, Homo sapiens
agcctaggtctgggtctagcag

SEQ ID NO: 8555044 - DNA, 22 bp, Homo sapiens
agcccttcaagagctctgtcct

SEQ ID NO: 8555045 - DNA, 22 bp, Homo sapiens
agcccttagtacatttctcaag

SEQ ID NO: 8555046 - DNA, 22 bp, Homo sapiens
agcccttcaacctgcctactcc

SEQ ID NO: 8555047 - DNA, 22 bp, Homo sapiens
agcctagggggtcctgggccac

SEQ ID NO: 8555048 - DNA, 22 bp, Homo sapiens
agcctagggggtcctgggccac

SEQ ID NO: 8555049 - DNA, 22 bp, Homo sapiens
agcctaggaggttggggctgca

SEQ ID NO: 8555050 - DNA, 22 bp, Homo sapiens
agcctaggaggttggggctgca

SEQ ID NO: 8555051 - DNA, 22 bp, Homo sapiens
agccggccatgtggtcttgtgc

SEQ ID NO: 8555052 - DNA, 22 bp, Homo sapiens
agataatttgagtaaattaatt

SEQ ID NO: 8555053 - DNA, 22 bp, Homo sapiens
agatacaaaagataagatttag

SEQ ID NO: 8555054 - DNA, 22 bp, Homo sapiens
agatacaaaagataagatttag

SEQ ID NO: 8555055 - DNA, 22 bp, Homo sapiens
agatacaaaggcctacagagca

SEQ ID NO: 8555056 - DNA, 22 bp, Homo sapiens
agatacaactcagaagtgtggt

SEQ ID NO: 8555057 - DNA, 22 bp, Homo sapiens
agataattatttacttcaaagt

SEQ ID NO: 8555058 - DNA, 22 bp, Homo sapiens
agataattatgtcaatttcttg

SEQ ID NO: 8555059 - DNA, 22 bp, Homo sapiens
agataaattcctaagatttcag

SEQ ID NO: 8555060 - DNA, 22 bp, Homo sapiens
attgttaataactattacattg

SEQ ID NO: 8555061 - DNA, 22 bp, Homo sapiens
agatacagcctgccaggttctt

SEQ ID NO: 8555062 - DNA, 22 bp, Homo sapiens
atttacagatgatgctatttga

SEQ ID NO: 8555063 - DNA, 22 bp, Homo sapiens
atttacagacgtggattagtgc

SEQ ID NO: 8555064 - DNA, 22 bp, Homo sapiens
agatacacagaggtaaagatga

SEQ ID NO: 8555065 - DNA, 22 bp, Homo sapiens
agatacacagaggtaaagatga

SEQ ID NO: 8555066 - DNA, 22 bp, Homo sapiens
agatacacagccctgccatcac

SEQ ID NO: 8555067 - DNA, 22 bp, Homo sapiens
agatacaccggaacctgaggct

SEQ ID NO: 8555068 - DNA, 22 bp, Homo sapiens
agatacaactgtttaaacatta

SEQ ID NO: 8555069 - DNA, 22 bp, Homo sapiens
agatacaactgtttaaacatta

SEQ ID NO: 8555070 - DNA, 22 bp, Homo sapiens
agatacaactgtttaaacatta

SEQ ID NO: 8555071 - DNA, 22 bp, Homo sapiens
agatacaagttaagagaaagga

SEQ ID NO: 8555072 - DNA, 22 bp, Homo sapiens
agatacaagttaagagaaagga

SEQ ID NO: 8555073 - DNA, 22 bp, Homo sapiens
agatacaaggcagagatgtgca

SEQ ID NO: 8555074 - DNA, 22 bp, Homo sapiens
attgtggctagacagtcacaat

SEQ ID NO: 8555075 - DNA, 22 bp, Homo sapiens
attgtggtgtcagttataggca

SEQ ID NO: 8555076 - DNA, 22 bp, Homo sapiens
attgtgtcctcattgaccttca

SEQ ID NO: 8555077 - DNA, 22 bp, Homo sapiens
attgttaaagtaataaccatgg

SEQ ID NO: 8555078 - DNA, 22 bp, Homo sapiens
attgttaataactattacattg

SEQ ID NO: 8555079 - DNA, 22 bp, Homo sapiens
attgttaactatagcatctggt

SEQ ID NO: 8555080 - DNA, 22 bp, Homo sapiens
attgttaaactgaagcattact

SEQ ID NO: 8555081 - DNA, 22 bp, Homo sapiens
attgttaaactgaagcattact

SEQ ID NO: 8555082 - DNA, 22 bp, Homo sapiens
attgttaaagtaataaccatgg

SEQ ID NO: 8555083 - DNA, 22 bp, Homo sapiens
attgttaaaaaggtggaaatgc

SEQ ID NO: 8555084 - DNA, 22 bp, Homo sapiens
attgttaaactgaagcattact

SEQ ID NO: 8555085 - DNA, 22 bp, Homo sapiens
attgttaaactgaagcattact

SEQ ID NO: 8555086 - DNA, 22 bp, Homo sapiens
attgtattataattaggccaaa

SEQ ID NO: 8555087 - DNA, 22 bp, Homo sapiens
attgtatttaggagaaaagggt

SEQ ID NO: 8555088 - DNA, 22 bp, Homo sapiens
attgtatttccagcttgaatgt

SEQ ID NO: 8555089 - DNA, 22 bp, Homo sapiens
attgtattagcacaatacaatt

SEQ ID NO: 8555090 - DNA, 22 bp, Homo sapiens
attgtattagcacaatacaatt

SEQ ID NO: 8555091 - DNA, 22 bp, Homo sapiens
attgtattagcacaatacaatt

SEQ ID NO: 8555092 - DNA, 22 bp, Homo sapiens
attgtatttccagcttgaatgt

SEQ ID NO: 8555093 - DNA, 22 bp, Homo sapiens
attgtatttccagcttgaatgt

SEQ ID NO: 8555094 - DNA, 22 bp, Homo sapiens
attgtgctttgcatcttgttcc

SEQ ID NO: 8555095 - DNA, 22 bp, Homo sapiens
attgaggagcagagatggggta

SEQ ID NO: 8555096 - DNA, 22 bp, Homo sapiens
attgagcacctacagtattacc

SEQ ID NO: 8555097 - DNA, 22 bp, Homo sapiens
attgagaatccatttgagatga

SEQ ID NO: 8555098 - DNA, 22 bp, Homo sapiens
attgagaatccatttgagatga

SEQ ID NO: 8555099 - DNA, 22 bp, Homo sapiens
attgagaatccatttgagatga

SEQ ID NO: 8555100 - DNA, 22 bp, Homo sapiens
attgagaatgcaatctactatg

SEQ ID NO: 8555101 - DNA, 22 bp, Homo sapiens
attgagaatctgagagcctagg

SEQ ID NO: 8555102 - DNA, 22 bp, Homo sapiens
attgagaatgaagggacatttt

SEQ ID NO: 8555103 - DNA, 22 bp, Homo sapiens
attgtataagtctatttacaat

SEQ ID NO: 8555104 - DNA, 22 bp, Homo sapiens
attgtataattgtattgccaaa

SEQ ID NO: 8555105 - DNA, 22 bp, Homo sapiens
attgtatcttgtcattatgcat

SEQ ID NO: 8555106 - DNA, 22 bp, Homo sapiens
attgtataagtctatttacaat

SEQ ID NO: 8555107 - DNA, 22 bp, Homo sapiens
attgtataagtctatttacaat

SEQ ID NO: 8555108 - DNA, 22 bp, Homo sapiens
attggtggtgaggacatgccag

SEQ ID NO: 8555109 - DNA, 22 bp, Homo sapiens
attgtataacagcatgtatttt

SEQ ID NO: 8555110 - DNA, 22 bp, Homo sapiens
attgaaaatgacatttgtgccc

SEQ ID NO: 8555111 - DNA, 22 bp, Homo sapiens
attgaaaatataattctaggag

SEQ ID NO: 8555112 - DNA, 22 bp, Homo sapiens
attgaaaatataattctaggag

SEQ ID NO: 8555113 - DNA, 22 bp, Homo sapiens
attgaaaatataattctaggag

SEQ ID NO: 8555114 - DNA, 22 bp, Homo sapiens
attgaaacaagttgctttctat

SEQ ID NO: 8555115 - DNA, 22 bp, Homo sapiens
attgaaagagaatgtagctctt

SEQ ID NO: 8555116 - DNA, 22 bp, Homo sapiens
attgaaagataggctactgtgg

SEQ ID NO: 8555117 - DNA, 22 bp, Homo sapiens
attgaaagataggctactgtgg

SEQ ID NO: 8555118 - DNA, 22 bp, Homo sapiens
attgaaaaattcacaattctgg

SEQ ID NO: 8555119 - DNA, 22 bp, Homo sapiens
attgaaaaattcacaattctgg

SEQ ID NO: 8555120 - DNA, 22 bp, Homo sapiens
attgaaaataaggccagaaaca

SEQ ID NO: 8555121 - DNA, 22 bp, Homo sapiens
attgaaaataaggccagaaaca

SEQ ID NO: 8555122 - DNA, 22 bp, Homo sapiens
attgaaaataaggccagaaaca

SEQ ID NO: 8555123 - DNA, 22 bp, Homo sapiens
attgaaaaattcacaattctgg

SEQ ID NO: 8555124 - DNA, 22 bp, Homo sapiens
attgaaagtcctatctaaggga

SEQ ID NO: 8555125 - DNA, 22 bp, Homo sapiens
attgaaaggcaaagtaggaagc

SEQ ID NO: 8555126 - DNA, 22 bp, Homo sapiens
attgaaaggcaaagtaggaagc

SEQ ID NO: 8555127 - DNA, 22 bp, Homo sapiens
attgaaaggttttgagcagata

SEQ ID NO: 8555128 - DNA, 22 bp, Homo sapiens
attgaaaggttttgagcagata

SEQ ID NO: 8555129 - DNA, 22 bp, Homo sapiens
attgaaagattttgggctcatg

SEQ ID NO: 8555130 - DNA, 22 bp, Homo sapiens
attgaaagatatactgttctca

SEQ ID NO: 8555131 - DNA, 22 bp, Homo sapiens
attgaaagcatggatttggatt

SEQ ID NO: 8555132 - DNA, 22 bp, Homo sapiens
attgaaagcatggatttggatt

SEQ ID NO: 8555133 - DNA, 22 bp, Homo sapiens
attgaaattgatgaaattcttg

SEQ ID NO: 8555134 - DNA, 22 bp, Homo sapiens
attgaaatccctacctcagagg

SEQ ID NO: 8555135 - DNA, 22 bp, Homo sapiens
attgaaatccctacctcagagg

SEQ ID NO: 8555136 - DNA, 22 bp, Homo sapiens
attgagaaaattcgagcaagtt

SEQ ID NO: 8555137 - DNA, 22 bp, Homo sapiens
attgagaaatataatctggaaa

SEQ ID NO: 8555138 - DNA, 22 bp, Homo sapiens
attgagaaatataatctggaaa

SEQ ID NO: 8555139 - DNA, 22 bp, Homo sapiens
attgagaagaaaatctaatata

SEQ ID NO: 8555140 - DNA, 22 bp, Homo sapiens
agaggccagggacactgctcaa

SEQ ID NO: 8555141 - DNA, 22 bp, Homo sapiens
agaggccagggacactgctcaa

SEQ ID NO: 8555142 - DNA, 22 bp, Homo sapiens
agaggaagccattgcttactga

SEQ ID NO: 8555143 - DNA, 22 bp, Homo sapiens
agaggaagccattgcttactga

SEQ ID NO: 8555144 - DNA, 22 bp, Homo sapiens
agaggaagccattgcttactga

SEQ ID NO: 8555145 - DNA, 22 bp, Homo sapiens
agaggaagattttattaaccag

SEQ ID NO: 8555146 - DNA, 21 bp, Homo sapiens
agaggaagaagagtgtattat

SEQ ID NO: 8555147 - DNA, 23 bp, Homo sapiens
agagctttctaaaatgtaaatct

SEQ ID NO: 8555148 - DNA, 22 bp, Homo sapiens
agagctttgggacatttgctag

SEQ ID NO: 8555149 - DNA, 22 bp, Homo sapiens
agagcttttacttacattctat

SEQ ID NO: 8555150 - DNA, 22 bp, Homo sapiens
agagcttttctgtaataacatc

SEQ ID NO: 8555151 - DNA, 22 bp, Homo sapiens
attaataaaataccactttgtt

SEQ ID NO: 8555152 - DNA, 22 bp, Homo sapiens
agagcttagaatttcagatgat

SEQ ID NO: 8555153 - DNA, 22 bp, Homo sapiens
attaatacattatagggattgt

SEQ ID NO: 8555154 - DNA, 22 bp, Homo sapiens
attaatacattatagggattgt

SEQ ID NO: 8555155 - DNA, 22 bp, Homo sapiens
agagcttcactggagagcacat

SEQ ID NO: 8555156 - DNA, 22 bp, Homo sapiens
agagcttatatcttggccatcc

SEQ ID NO: 8555157 - DNA, 23 bp, Homo sapiens
agagcttagggaattcacatgag

SEQ ID NO: 8555158 - DNA, 22 bp, Homo sapiens
agaggcctctagggcccctcag

SEQ ID NO: 8555159 - DNA, 22 bp, Homo sapiens
agaggcctccgaaaggtgggct

SEQ ID NO: 8555160 - DNA, 22 bp, Homo sapiens
agaggcctctagggcccctcag

SEQ ID NO: 8555161 - DNA, 22 bp, Homo sapiens
agaggcctccgaaaggtgggct

SEQ ID NO: 8555162 - DNA, 22 bp, Homo sapiens
attatttctcactcacataata

SEQ ID NO: 8555163 - DNA, 22 bp, Homo sapiens
attattttatgtgcggcctgat

SEQ ID NO: 8555164 - DNA, 22 bp, Homo sapiens
attattttatgtgcggcctgat

SEQ ID NO: 8555165 - DNA, 22 bp, Homo sapiens
attattttatgtgcggcctgat

SEQ ID NO: 8555166 - DNA, 22 bp, Homo sapiens
attattttatgtgcggcctgat

SEQ ID NO: 8555167 - DNA, 15 bp, Homo sapiens
attatttgtgctcag

SEQ ID NO: 8555168 - DNA, 22 bp, Homo sapiens
attatttgtgtccacagaatac

SEQ ID NO: 8555169 - DNA, 22 bp, Homo sapiens
attatttgtgtccacagaatac

SEQ ID NO: 8555170 - DNA, 22 bp, Homo sapiens
attatttggaataggcattgca

SEQ ID NO: 8555171 - DNA, 22 bp, Homo sapiens
attatttggaataggcattgca

SEQ ID NO: 8555172 - DNA, 15 bp, Homo sapiens
attatttgtgctcag

SEQ ID NO: 8555173 - DNA, 22 bp, Homo sapiens
attatttgcttggctcatctaa

SEQ ID NO: 8555174 - DNA, 22 bp, Homo sapiens
attatttgcttggctcatctaa

SEQ ID NO: 8555175 - DNA, 22 bp, Homo sapiens
attatttgacttgagaacaggt

SEQ ID NO: 8555176 - DNA, 22 bp, Homo sapiens
attatttgacttgagaacaggt

SEQ ID NO: 8555177 - DNA, 22 bp, Homo sapiens
attatttgagttcctctctacc

SEQ ID NO: 8555178 - DNA, 22 bp, Homo sapiens
attatttgagttcctctctacc

SEQ ID NO: 8555179 - DNA, 22 bp, Homo sapiens
agaggcctccctcccagctggt

SEQ ID NO: 8555180 - DNA, 19 bp, Homo sapiens
agaggcctcagcagctggc

SEQ ID NO: 8555181 - DNA, 22 bp, Homo sapiens
agaggcctaattgctacccttt

SEQ ID NO: 8555182 - DNA, 22 bp, Homo sapiens
agaggcctaaccaagatgtcct

SEQ ID NO: 8555183 - DNA, 19 bp, Homo sapiens
agaggcctcagcagctggc

SEQ ID NO: 8555184 - DNA, 22 bp, Homo sapiens
agaggccggccgagcccatggg

SEQ ID NO: 8555185 - DNA, 22 bp, Homo sapiens
agaggccgggtgcctgctcaga

SEQ ID NO: 8555186 - DNA, 22 bp, Homo sapiens
agaggccggccgagcccatggg

SEQ ID NO: 8555187 - DNA, 22 bp, Homo sapiens
agaggccggccgagcccatggg

SEQ ID NO: 8555188 - DNA, 22 bp, Homo sapiens
agaggccctgggctggtgtgct

SEQ ID NO: 8555189 - DNA, 22 bp, Homo sapiens
attctacaacccaataataatt

SEQ ID NO: 8555190 - DNA, 22 bp, Homo sapiens
attctacaaaagaactggatct

SEQ ID NO: 8555191 - DNA, 22 bp, Homo sapiens
attctacaaaagaactggatct

SEQ ID NO: 8555192 - DNA, 22 bp, Homo sapiens
attctaattagttctacatgtt

SEQ ID NO: 8555193 - DNA, 22 bp, Homo sapiens
attctaattagttctacatgtt

SEQ ID NO: 8555194 - DNA, 22 bp, Homo sapiens
attctaattagttctacatgtt

SEQ ID NO: 8555195 - DNA, 22 bp, Homo sapiens
attctacaaaagaactggatct

SEQ ID NO: 8555196 - DNA, 22 bp, Homo sapiens
attctaatgccctggccccagc

SEQ ID NO: 8555197 - DNA, 22 bp, Homo sapiens
attctaatggcagagactcctg

SEQ ID NO: 8555198 - DNA, 22 bp, Homo sapiens
attctaattagttctacatgtt

SEQ ID NO: 8555199 - DNA, 22 bp, Homo sapiens
attctaatgccctggccccagc

SEQ ID NO: 8555200 - DNA, 22 bp, Homo sapiens
attctaatggcagagactcctg

SEQ ID NO: 8555201 - DNA, 20 bp, Homo sapiens
attctaaagctctgctcttt

SEQ ID NO: 8555202 - DNA, 22 bp, Homo sapiens
attcaaacaggaagaaatcatt

SEQ ID NO: 8555203 - DNA, 22 bp, Homo sapiens
attcaaactgtgttaggcagca

SEQ ID NO: 8555204 - DNA, 22 bp, Homo sapiens
attcaaacctcatttattgttc

SEQ ID NO: 8555205 - DNA, 22 bp, Homo sapiens
attcaaacaggccaattgacct

SEQ ID NO: 8555206 - DNA, 22 bp, Homo sapiens
attcaaaccccatagacaactt

SEQ ID NO: 8555207 - DNA, 22 bp, Homo sapiens
attcaaaagaccatgcagactc

SEQ ID NO: 8555208 - DNA, 22 bp, Homo sapiens
attcccaccaagcaggccatgc

SEQ ID NO: 8555209 - DNA, 22 bp, Homo sapiens
attcccactagctctttataga

SEQ ID NO: 8555210 - DNA, 22 bp, Homo sapiens
attcccacctgaaaaaggtagg

SEQ ID NO: 8555211 - DNA, 22 bp, Homo sapiens
attcttctgcctactttcatcc

SEQ ID NO: 8555212 - DNA, 22 bp, Homo sapiens
attctctgtagatggcttgaga

SEQ ID NO: 8555213 - DNA, 22 bp, Homo sapiens
attctctgtgcagatttaagac

SEQ ID NO: 8555214 - DNA, 22 bp, Homo sapiens
attgaaaaatgactattgctta

SEQ ID NO: 8555215 - DNA, 22 bp, Homo sapiens
attgaaaaatgactattgctta

SEQ ID NO: 8555216 - DNA, 22 bp, Homo sapiens
attcttctgcctactttcatcc

SEQ ID NO: 8555217 - DNA, 22 bp, Homo sapiens
attcttctgcctactttcatcc

SEQ ID NO: 8555218 - DNA, 20 bp, Homo sapiens
attctctgctcaagtggcac

SEQ ID NO: 8555219 - DNA, 22 bp, Homo sapiens
attctctggctaaaacctgaag

SEQ ID NO: 8555220 - DNA, 22 bp, Homo sapiens
attctctgccattgcggtggat

SEQ ID NO: 8555221 - DNA, 22 bp, Homo sapiens
attctctgaagtctttcagggc

SEQ ID NO: 8555222 - DNA, 22 bp, Homo sapiens
attctctggtcattgagtataa

SEQ ID NO: 8555223 - DNA, 22 bp, Homo sapiens
attctctggtcattgagcatat

SEQ ID NO: 8555224 - DNA, 19 bp, Homo sapiens
attctctggtttgctggct

SEQ ID NO: 8555225 - DNA, 22 bp, Homo sapiens
attctctgggttccagtaaatg

SEQ ID NO: 8555226 - DNA, 22 bp, Homo sapiens
attctctggctaaaacctgaag

SEQ ID NO: 8555227 - DNA, 20 bp, Homo sapiens
attctacaagaataagcatg

SEQ ID NO: 8555228 - DNA, 22 bp, Homo sapiens
attctacaacccaataataatt

SEQ ID NO: 8555229 - DNA, 20 bp, Homo sapiens
attctacaagaataagcatg

SEQ ID NO: 8555230 - DNA, 20 bp, Homo sapiens
attctacaagaataagcatg

SEQ ID NO: 8555231 - DNA, 22 bp, Homo sapiens
attctccactgtaaggttatta

SEQ ID NO: 8555232 - DNA, 22 bp, Homo sapiens
attctccagtagtcattctatc

SEQ ID NO: 8555233 - DNA, 22 bp, Homo sapiens
attctctcttctgctgcccgtg

SEQ ID NO: 8555234 - DNA, 22 bp, Homo sapiens
attctctctctatgaaaactga

SEQ ID NO: 8555235 - DNA, 22 bp, Homo sapiens
attctctctagaagctgagatg

SEQ ID NO: 8555236 - DNA, 22 bp, Homo sapiens
attctctcatttatctgtccta

SEQ ID NO: 8555237 - DNA, 22 bp, Homo sapiens
agcaataacagaaaactttcct

SEQ ID NO: 8555238 - DNA, 22 bp, Homo sapiens
agcaagtgtaagaatgcagaat

SEQ ID NO: 8555239 - DNA, 22 bp, Homo sapiens
agcaataaatgtaaaggttaag

SEQ ID NO: 8555240 - DNA, 22 bp, Homo sapiens
agcaataaatgtaaaggttaag

SEQ ID NO: 8555241 - DNA, 22 bp, Homo sapiens
agcaagtgtaagaatgcagaat

SEQ ID NO: 8555242 - DNA, 22 bp, Homo sapiens
agcaagtgtaagaatgcagaat

SEQ ID NO: 8555243 - DNA, 23 bp, Homo sapiens
agcaataagaagggatacatgtg

SEQ ID NO: 8555244 - DNA, 22 bp, Homo sapiens
agcaataaccactctaatttat

SEQ ID NO: 8555245 - DNA, 23 bp, Homo sapiens
agcaataagaagggatacatgtg

SEQ ID NO: 8555246 - DNA, 22 bp, Homo sapiens
agcaataacagaaaactttcct

SEQ ID NO: 8555247 - DNA, 22 bp, Homo sapiens
agcaaggctgggtctaatgggg

SEQ ID NO: 8555248 - DNA, 22 bp, Homo sapiens
agcaaggggcagtgaaagtgtg

SEQ ID NO: 8555249 - DNA, 22 bp, Homo sapiens
agcaaggctcggtcagggtgat

SEQ ID NO: 8555250 - DNA, 22 bp, Homo sapiens
agcaaggctcttaatgcccaaa

SEQ ID NO: 8555251 - DNA, 22 bp, Homo sapiens
agcaaggctgggtctaatgggg

SEQ ID NO: 8555252 - DNA, 22 bp, Homo sapiens
agcaaggcttcagagctgtctg

SEQ ID NO: 8555253 - DNA, 22 bp, Homo sapiens
agcaaggggcagtgaaagtgtg

SEQ ID NO: 8555254 - DNA, 22 bp, Homo sapiens
agcaaggggcagtgaaagtgtg

SEQ ID NO: 8555255 - DNA, 23 bp, Homo sapiens
attttttgtctttgtaactagat

SEQ ID NO: 8555256 - DNA, 22 bp, Homo sapiens
attttttctgtaaactggcctt

SEQ ID NO: 8555257 - DNA, 22 bp, Homo sapiens
attttttcccagttagccagga

SEQ ID NO: 8555258 - DNA, 22 bp, Homo sapiens
attttttcccagttagccagga

SEQ ID NO: 8555259 - DNA, 22 bp, Homo sapiens
agcaaggccgagaggatgctat

SEQ ID NO: 8555260 - DNA, 22 bp, Homo sapiens
agcaaggctaaatttcagttat

SEQ ID NO: 8555261 - DNA, 20 bp, Homo sapiens
agcaaggctaaatcatgatt

SEQ ID NO: 8555262 - DNA, 22 bp, Homo sapiens
agcaaggcctacagagaggggc

SEQ ID NO: 8555263 - DNA, 22 bp, Homo sapiens
agcaaggctcggtcagggtgat

SEQ ID NO: 8555264 - DNA, 22 bp, Homo sapiens
agcaaggctcttaatgcccaaa

SEQ ID NO: 8555265 - DNA, 22 bp, Homo sapiens
attttttagaacctggcctgat

SEQ ID NO: 8555266 - DNA, 20 bp, Homo sapiens
attttgtttatgttcctctc

SEQ ID NO: 8555267 - DNA, 22 bp, Homo sapiens
attttgttgatggtggagtagc

SEQ ID NO: 8555268 - DNA, 22 bp, Homo sapiens
attttttagccaagactctgca

SEQ ID NO: 8555269 - DNA, 22 bp, Homo sapiens
attttttagccaagactctgca

SEQ ID NO: 8555270 - DNA, 22 bp, Homo sapiens
attttttcagattgagtgttaa

SEQ ID NO: 8555271 - DNA, 22 bp, Homo sapiens
attttttcagattgagtgttaa

SEQ ID NO: 8555272 - DNA, 22 bp, Homo sapiens
attttttcagattgagtgttaa

SEQ ID NO: 8555273 - DNA, 22 bp, Homo sapiens
attttttatataccaaggtggg

SEQ ID NO: 8555274 - DNA, 22 bp, Homo sapiens
attttttatataccaaggtggg

SEQ ID NO: 8555275 - DNA, 22 bp, Homo sapiens
attttgtggcagatgcagaacc

SEQ ID NO: 8555276 - DNA, 22 bp, Homo sapiens
attttgtgaaccctcaagcaat

SEQ ID NO: 8555277 - DNA, 22 bp, Homo sapiens
attttgtgaaccctcaagcaat

SEQ ID NO: 8555278 - DNA, 22 bp, Homo sapiens
attttgtggcagatgcagaacc

SEQ ID NO: 8555279 - DNA, 22 bp, Homo sapiens
attttgttatagaactctgtga

SEQ ID NO: 8555280 - DNA, 22 bp, Homo sapiens
attttgttgaggtaattgtcaa

SEQ ID NO: 8555281 - DNA, 22 bp, Homo sapiens
attttgttataggagctgaaat

SEQ ID NO: 8555282 - DNA, 22 bp, Homo sapiens
attttgttatcagggctttgca

SEQ ID NO: 8555283 - DNA, 22 bp, Homo sapiens
attttgttataggagctgaaat

SEQ ID NO: 8555284 - DNA, 22 bp, Homo sapiens
caaagttatgaatgataagatt

SEQ ID NO: 8555285 - DNA, 22 bp, Homo sapiens
caaagttatgaatgataagatt

SEQ ID NO: 8555286 - DNA, 22 bp, Homo sapiens
caaagtttaaagtagatttcag

SEQ ID NO: 8555287 - DNA, 22 bp, Homo sapiens
caaagttatcaactgcaacatt

SEQ ID NO: 8555288 - DNA, 22 bp, Homo sapiens
caaagttatcaactgcaacatt

SEQ ID NO: 8555289 - DNA, 22 bp, Homo sapiens
caaataagcaattccattcttc

SEQ ID NO: 8555290 - DNA, 22 bp, Homo sapiens
caaataagaaccacaggggagt

SEQ ID NO: 8555291 - DNA, 22 bp, Homo sapiens
caaagtttggctctcatgacat

SEQ ID NO: 8555292 - DNA, 22 bp, Homo sapiens
caaagtttggctctcatgacat

SEQ ID NO: 8555293 - DNA, 22 bp, Homo sapiens
agcaatgtaaaccctgaagttg

SEQ ID NO: 8555294 - DNA, 22 bp, Homo sapiens
agcaatgttggcctatatacct

SEQ ID NO: 8555295 - DNA, 22 bp, Homo sapiens
agcaatgcttattgctgactat

SEQ ID NO: 8555296 - DNA, 23 bp, Homo sapiens
agcaatgctgggagactctgtaa

SEQ ID NO: 8555297 - DNA, 22 bp, Homo sapiens
agcaatgcaatcttaaccttga

SEQ ID NO: 8555298 - DNA, 22 bp, Homo sapiens
agcaatgcaatcttaaccttga

SEQ ID NO: 8555299 - DNA, 22 bp, Homo sapiens
agcaatgctaccgggtgattcg

SEQ ID NO: 8555300 - DNA, 22 bp, Homo sapiens
caaataattactatcctcactt

SEQ ID NO: 8555301 - DNA, 22 bp, Homo sapiens
caaataattactatcctcactt

SEQ ID NO: 8555302 - DNA, 22 bp, Homo sapiens
caaataattactatcctcactt

SEQ ID NO: 8555303 - DNA, 22 bp, Homo sapiens
agcaatgaccagtgatcttgta

SEQ ID NO: 8555304 - DNA, 22 bp, Homo sapiens
caaagtgctgggattacaggtg

SEQ ID NO: 8555305 - DNA, 22 bp, Homo sapiens
caaagtgctgggattacaggtg

SEQ ID NO: 8555306 - DNA, 22 bp, Homo sapiens
caaagtgctgggattacaggtg

SEQ ID NO: 8555307 - DNA, 22 bp, Homo sapiens
caaagtgctgggattagtgctg

SEQ ID NO: 8555308 - DNA, 22 bp, Homo sapiens
caaagtgctgggattataggca

SEQ ID NO: 8555309 - DNA, 22 bp, Homo sapiens
caaagtgctgggattacaggct

SEQ ID NO: 8555310 - DNA, 22 bp, Homo sapiens
caaagtgctgggattacaggct

SEQ ID NO: 8555311 - DNA, 22 bp, Homo sapiens
caaagtgctgggattacaggct

SEQ ID NO: 8555312 - DNA, 22 bp, Homo sapiens
caaaggtagtatatatattgtt

SEQ ID NO: 8555313 - DNA, 22 bp, Homo sapiens
caaaggtataagttaatataca

SEQ ID NO: 8555314 - DNA, 22 bp, Homo sapiens
caaagggctctagactcagcag

SEQ ID NO: 8555315 - DNA, 22 bp, Homo sapiens
caaaggtaaagatctgctgtgg

SEQ ID NO: 8555316 - DNA, 22 bp, Homo sapiens
caaagggctctagactcagcag

SEQ ID NO: 8555317 - DNA, 22 bp, Homo sapiens
caaacattttgagtggtttctg

SEQ ID NO: 8555318 - DNA, 22 bp, Homo sapiens
caaacattttgagtggtttctg

SEQ ID NO: 8555319 - DNA, 22 bp, Homo sapiens
caaacatttgttggaacccctg

SEQ ID NO: 8555320 - DNA, 22 bp, Homo sapiens
caaacattgctaccagaggttt

SEQ ID NO: 8555321 - DNA, 22 bp, Homo sapiens
caaacattgggggcttcaacac

SEQ ID NO: 8555322 - DNA, 22 bp, Homo sapiens
caaacattgggggcttcaacac

SEQ ID NO: 8555323 - DNA, 22 bp, Homo sapiens
caaacatttgacttctctcagg

SEQ ID NO: 8555324 - DNA, 22 bp, Homo sapiens
caaacattgctaccagaggttt

SEQ ID NO: 8555325 - DNA, 22 bp, Homo sapiens
agcaatcagcttctttgtgttt

SEQ ID NO: 8555326 - DNA, 22 bp, Homo sapiens
agcaatcaccacctctatattt

SEQ ID NO: 8555327 - DNA, 22 bp, Homo sapiens
agcaatagacacaagatggata

SEQ ID NO: 8555328 - DNA, 22 bp, Homo sapiens
agatgatggccatgtcctctcc

SEQ ID NO: 8555329 - DNA, 22 bp, Homo sapiens
agatgagtaggtagcattagta

SEQ ID NO: 8555330 - DNA, 22 bp, Homo sapiens
agatgatatactacatggcttc

SEQ ID NO: 8555331 - DNA, 22 bp, Homo sapiens
agattcattattaatgtgatct

SEQ ID NO: 8555332 - DNA, 22 bp, Homo sapiens
agattcattatcttctttgtac

SEQ ID NO: 8555333 - DNA, 22 bp, Homo sapiens
agattcattgtggatattttct

SEQ ID NO: 8555334 - DNA, 22 bp, Homo sapiens
agattcattatcttctttgtac

SEQ ID NO: 8555335 - DNA, 22 bp, Homo sapiens
agattcattaggagacattcag

SEQ ID NO: 8555336 - DNA, 21 bp, Homo sapiens
agattcataatctgtaaaatg

SEQ ID NO: 8555337 - DNA, 22 bp, Homo sapiens
agattcatgggaaagctttagg

SEQ ID NO: 8555338 - DNA, 21 bp, Homo sapiens
agattcataatctgtaaaatg

SEQ ID NO: 8555339 - DNA, 22 bp, Homo sapiens
agatgtttgtgttatctccatt

SEQ ID NO: 8555340 - DNA, 22 bp, Homo sapiens
agattcaggactggccacagcc

SEQ ID NO: 8555341 - DNA, 22 bp, Homo sapiens
agattggatcaagcagcagttg

SEQ ID NO: 8555342 - DNA, 23 bp, Homo sapiens
agattgaagtattgaccagagct

SEQ ID NO: 8555343 - DNA, 22 bp, Homo sapiens
agattgaagactggtggagctg

SEQ ID NO: 8555344 - DNA, 21 bp, Homo sapiens
attttctgtgatagctgtctc

SEQ ID NO: 8555345 - DNA, 22 bp, Homo sapiens
attttctgtaactatttctata

SEQ ID NO: 8555346 - DNA, 22 bp, Homo sapiens
attttctgtgtgcagataaata

SEQ ID NO: 8555347 - DNA, 21 bp, Homo sapiens
attttgtacatagaatttgtc

SEQ ID NO: 8555348 - DNA, 20 bp, Homo sapiens
attttggtgaacacagcttc

SEQ ID NO: 8555349 - DNA, 22 bp, Homo sapiens
agatttatgtggtcacactcag

SEQ ID NO: 8555350 - DNA, 22 bp, Homo sapiens
agatttacaaaggatttgcttt

SEQ ID NO: 8555351 - DNA, 22 bp, Homo sapiens
agatttagtggtggaattttgg

SEQ ID NO: 8555352 - DNA, 22 bp, Homo sapiens
agatttagactgccttaatcat

SEQ ID NO: 8555353 - DNA, 18 bp, Homo sapiens
agattgtgtctacaaatc

SEQ ID NO: 8555354 - DNA, 21 bp, Homo sapiens
agattgtatggaggtgagagg

SEQ ID NO: 8555355 - DNA, 22 bp, Homo sapiens
agattgtagaaactgtagcatt

SEQ ID NO: 8555356 - DNA, 22 bp, Homo sapiens
agattgtgtcaatttctcttta

SEQ ID NO: 8555357 - DNA, 22 bp, Homo sapiens
atttgaagaaagttttctagat

SEQ ID NO: 8555358 - DNA, 22 bp, Homo sapiens
agatgacaatgaaggaaaatgt

SEQ ID NO: 8555359 - DNA, 22 bp, Homo sapiens
atttgaatggcttaacacaacg

SEQ ID NO: 8555360 - DNA, 22 bp, Homo sapiens
atttgaatggcttaacacaacg

SEQ ID NO: 8555361 - DNA, 19 bp, Homo sapiens
atttgaaagctgtgcttgc

SEQ ID NO: 8555362 - DNA, 19 bp, Homo sapiens
atttgaaagctgtgcttgc

SEQ ID NO: 8555363 - DNA, 22 bp, Homo sapiens
atttgaaatcccttctactgta

SEQ ID NO: 8555364 - DNA, 19 bp, Homo sapiens
atttgaaagctgtgcttgc

SEQ ID NO: 8555365 - DNA, 19 bp, Homo sapiens
atttgaaagctgtgcttgc

SEQ ID NO: 8555366 - DNA, 22 bp, Homo sapiens
atttgaaatctgggttactctg

SEQ ID NO: 8555367 - DNA, 22 bp, Homo sapiens
atttgaaatcccttctactgta

SEQ ID NO: 8555368 - DNA, 22 bp, Homo sapiens
atttgaaatcccttctactgta

SEQ ID NO: 8555369 - DNA, 22 bp, Homo sapiens
agatgagaatttttagagtgct

SEQ ID NO: 8555370 - DNA, 22 bp, Homo sapiens
agatgaggggtagaaaggactt

SEQ ID NO: 8555371 - DNA, 22 bp, Homo sapiens
agatgagtaaatggagtcttcc

SEQ ID NO: 8555372 - DNA, 23 bp, Homo sapiens
agatgaggcttctccatgttggt

SEQ ID NO: 8555373 - DNA, 22 bp, Homo sapiens
agatgaggggtagaaaggactt

SEQ ID NO: 8555374 - DNA, 23 bp, Homo sapiens
agatgaggcttctccatgttggt

SEQ ID NO: 8555375 - DNA, 21 bp, Homo sapiens
agatgaggatactgaggccta

SEQ ID NO: 8555376 - DNA, 21 bp, Homo sapiens
agatgaggatactgaggccta

SEQ ID NO: 8555377 - DNA, 21 bp, Homo sapiens
agatgaggatactgaggccta

SEQ ID NO: 8555378 - DNA, 21 bp, Homo sapiens
agatgaggatactgaggccta

SEQ ID NO: 8555379 - DNA, 22 bp, Homo sapiens
atttcttgtgggaaatgcagca

SEQ ID NO: 8555380 - DNA, 22 bp, Homo sapiens
atttcttgtgggaaatgcagca

SEQ ID NO: 8555381 - DNA, 22 bp, Homo sapiens
atttcttgcccctgctccctga

SEQ ID NO: 8555382 - DNA, 22 bp, Homo sapiens
atttctttctggccacggtttt

SEQ ID NO: 8555383 - DNA, 22 bp, Homo sapiens
atttctttctggccacggtttt

SEQ ID NO: 8555384 - DNA, 22 bp, Homo sapiens
atttcttgattccaccagtgaa

SEQ ID NO: 8555385 - DNA, 22 bp, Homo sapiens
atttctcttcctcctagggttg

SEQ ID NO: 8555386 - DNA, 22 bp, Homo sapiens
atttacaggtagaattttaagt

SEQ ID NO: 8555387 - DNA, 22 bp, Homo sapiens
atttacaggtagaattttaagt

SEQ ID NO: 8555388 - DNA, 22 bp, Homo sapiens
atttctcttagcaagacattac

SEQ ID NO: 8555389 - DNA, 22 bp, Homo sapiens
atttctcttagcaagacattac

SEQ ID NO: 8555390 - DNA, 22 bp, Homo sapiens
atttcttttcaagagggtgctt

SEQ ID NO: 8555391 - DNA, 22 bp, Homo sapiens
atttcttttcaagagggtgctt

SEQ ID NO: 8555392 - DNA, 22 bp, Homo sapiens
atttcttttcaagagggtgctt

SEQ ID NO: 8555393 - DNA, 22 bp, Homo sapiens
atttgaaaacctgagcctcccg

SEQ ID NO: 8555394 - DNA, 22 bp, Homo sapiens
atttcttttcaagagggtgctt

SEQ ID NO: 8555395 - DNA, 23 bp, Homo sapiens
atttgaaactttcttgtttccag

SEQ ID NO: 8555396 - DNA, 23 bp, Homo sapiens
atttgaaactttcttgtttccag

SEQ ID NO: 8555397 - DNA, 23 bp, Homo sapiens
atttacagctgtgtgagcaagtt

SEQ ID NO: 8555398 - DNA, 23 bp, Homo sapiens
atttacagctgtgtgagcaagtt

SEQ ID NO: 8555399 - DNA, 22 bp, Homo sapiens
atttacaggtagaattttaagt

SEQ ID NO: 8555400 - DNA, 22 bp, Homo sapiens
atttacaggtagaattttaagt

SEQ ID NO: 8555401 - DNA, 22 bp, Homo sapiens
atttacaggacagcttggcatt

SEQ ID NO: 8555402 - DNA, 22 bp, Homo sapiens
atttacaggacagcttggcatt

SEQ ID NO: 8555403 - DNA, 22 bp, Homo sapiens
atttacagccttgaaaacagca

SEQ ID NO: 8555404 - DNA, 22 bp, Homo sapiens
atttacagccttgaaaacagca

SEQ ID NO: 8555405 - DNA, 22 bp, Homo sapiens
atttacagatgatgctatttga

SEQ ID NO: 8555406 - DNA, 22 bp, Homo sapiens
atttacagatgatgctatttga

SEQ ID NO: 8555407 - DNA, 22 bp, Homo sapiens
atttacagatgatgctatttga

SEQ ID NO: 8555408 - DNA, 23 bp, Homo sapiens
atttacagctgtgtgagcaagtt

SEQ ID NO: 8555409 - DNA, 22 bp, Homo sapiens
atttacagccttgccatctata

SEQ ID NO: 8555410 - DNA, 22 bp, Homo sapiens
atttacagccttgaaaacagca

SEQ ID NO: 8555411 - DNA, 22 bp, Homo sapiens
atgttctacagatggaaagggg

SEQ ID NO: 8555412 - DNA, 22 bp, Homo sapiens
atgttctatatcattattgtga

SEQ ID NO: 8555413 - DNA, 19 bp, Homo sapiens
atgttctatcctccaagtt

SEQ ID NO: 8555414 - DNA, 22 bp, Homo sapiens
agagccttgaagatctggaaaa

SEQ ID NO: 8555415 - DNA, 22 bp, Homo sapiens
agagcctgttttgtgggagatg

SEQ ID NO: 8555416 - DNA, 22 bp, Homo sapiens
agagctaagaaacagaattgct

SEQ ID NO: 8555417 - DNA, 22 bp, Homo sapiens
agagcggggatagttaatattc

SEQ ID NO: 8555418 - DNA, 22 bp, Homo sapiens
agagctaagaaacagaattgct

SEQ ID NO: 8555419 - DNA, 22 bp, Homo sapiens
agagccttgctctaaatttctc

SEQ ID NO: 8555420 - DNA, 22 bp, Homo sapiens
agagccttgaagatctggaaaa

SEQ ID NO: 8555421 - DNA, 20 bp, Homo sapiens
agagccttgaggaagatgat

SEQ ID NO: 8555422 - DNA, 22 bp, Homo sapiens
agagccttcagagattatttta

SEQ ID NO: 8555423 - DNA, 22 bp, Homo sapiens
agagcctttggagctgctatta

SEQ ID NO: 8555424 - DNA, 22 bp, Homo sapiens
atgttcattagtcaacatttct

SEQ ID NO: 8555425 - DNA, 22 bp, Homo sapiens
atgttcatttgacaagtagtga

SEQ ID NO: 8555426 - DNA, 22 bp, Homo sapiens
atgttcattttcttaatgtgcc

SEQ ID NO: 8555427 - DNA, 22 bp, Homo sapiens
atgttcctggtatatcatgacc

SEQ ID NO: 8555428 - DNA, 22 bp, Homo sapiens
atgttcctgatcctcgttctat

SEQ ID NO: 8555429 - DNA, 18 bp, Homo sapiens
atgttcatatttttaggg

SEQ ID NO: 8555430 - DNA, 22 bp, Homo sapiens
atgttcagcattctataaatat

SEQ ID NO: 8555431 - DNA, 22 bp, Homo sapiens
atgttcaaactttttacacacc

SEQ ID NO: 8555432 - DNA, 21 bp, Homo sapiens
agagctcaaggcaaaaataat

SEQ ID NO: 8555433 - DNA, 22 bp, Homo sapiens
agagctcaagacgctcacagta

SEQ ID NO: 8555434 - DNA, 22 bp, Homo sapiens
agagctataacagcactgtaca

SEQ ID NO: 8555435 - DNA, 22 bp, Homo sapiens
attaaatactgcaggctaagca

SEQ ID NO: 8555436 - DNA, 22 bp, Homo sapiens
attaaggaacaaagccttttga

SEQ ID NO: 8555437 - DNA, 22 bp, Homo sapiens
attaaatactgcaggctaagca

SEQ ID NO: 8555438 - DNA, 22 bp, Homo sapiens
attaaatactgcaggctaagca

SEQ ID NO: 8555439 - DNA, 22 bp, Homo sapiens
attaaatactgcaggctaagca

SEQ ID NO: 8555440 - DNA, 22 bp, Homo sapiens
attaaatactgcaggctaagca

SEQ ID NO: 8555441 - DNA, 22 bp, Homo sapiens
agagctctgcagctggcctcag

SEQ ID NO: 8555442 - DNA, 22 bp, Homo sapiens
agagctctgcagctggcctcag

SEQ ID NO: 8555443 - DNA, 22 bp, Homo sapiens
attaagtgtattgctgagggta

SEQ ID NO: 8555444 - DNA, 22 bp, Homo sapiens
attaagtgactaaagtaatgct

SEQ ID NO: 8555445 - DNA, 22 bp, Homo sapiens
attaagtgactaaagtaatgct

SEQ ID NO: 8555446 - DNA, 22 bp, Homo sapiens
attaagtgactaaagtaatgct

SEQ ID NO: 8555447 - DNA, 22 bp, Homo sapiens
attaaggctgcactggccttaa

SEQ ID NO: 8555448 - DNA, 18 bp, Homo sapiens
attaaggaattctttaga

SEQ ID NO: 8555449 - DNA, 22 bp, Homo sapiens
attaaggaatgtaggcaagaag

SEQ ID NO: 8555450 - DNA, 22 bp, Homo sapiens
attaaggaagcctattctctcc

SEQ ID NO: 8555451 - DNA, 22 bp, Homo sapiens
attaaggagggctgggcatgat

SEQ ID NO: 8555452 - DNA, 22 bp, Homo sapiens
attaaggaggtaaactatggtt

SEQ ID NO: 8555453 - DNA, 22 bp, Homo sapiens
attaaggattatactctccttt

SEQ ID NO: 8555454 - DNA, 22 bp, Homo sapiens
agagatggtagaacagtcataa

SEQ ID NO: 8555455 - DNA, 18 bp, Homo sapiens
agagatggtgtagagttt

SEQ ID NO: 8555456 - DNA, 22 bp, Homo sapiens
agagatgttcattcagcatgtt

SEQ ID NO: 8555457 - DNA, 22 bp, Homo sapiens
agagatgtcgccttgcccaggg

SEQ ID NO: 8555458 - DNA, 22 bp, Homo sapiens
agagatgtatgcatttgtcaca

SEQ ID NO: 8555459 - DNA, 18 bp, Homo sapiens
agagatggtgtagagttt

SEQ ID NO: 8555460 - DNA, 22 bp, Homo sapiens
atgtcttgggtttcagtttact

SEQ ID NO: 8555461 - DNA, 22 bp, Homo sapiens
atgtcttgatattttactgttt

SEQ ID NO: 8555462 - DNA, 22 bp, Homo sapiens
atgtcttctgtggagacaggta

SEQ ID NO: 8555463 - DNA, 22 bp, Homo sapiens
atgtcttctctgtaggtaaatt

SEQ ID NO: 8555464 - DNA, 22 bp, Homo sapiens
agagattcatgtttactgtagg

SEQ ID NO: 8555465 - DNA, 22 bp, Homo sapiens
agagattctgtgtcaaaacgaa

SEQ ID NO: 8555466 - DNA, 22 bp, Homo sapiens
atgtcttctctgtaggtaaatt

SEQ ID NO: 8555467 - DNA, 22 bp, Homo sapiens
atgtcttctctgtaggtaaatt

SEQ ID NO: 8555468 - DNA, 22 bp, Homo sapiens
atgtgattcccactgaatcact

SEQ ID NO: 8555469 - DNA, 22 bp, Homo sapiens
atgtgattcccactgaatcact

SEQ ID NO: 8555470 - DNA, 22 bp, Homo sapiens
atgtgagtgctatgatagacag

SEQ ID NO: 8555471 - DNA, 22 bp, Homo sapiens
atgtgcagttggtggccaggag

SEQ ID NO: 8555472 - DNA, 22 bp, Homo sapiens
atgtgcaggatccaggctccta

SEQ ID NO: 8555473 - DNA, 23 bp, Homo sapiens
atgtgcacatctccttgtccacc

SEQ ID NO: 8555474 - DNA, 22 bp, Homo sapiens
atgtgcagcttttctagagaag

SEQ ID NO: 8555475 - DNA, 21 bp, Homo sapiens
atgtgcagcaagcagcatgct

SEQ ID NO: 8555476 - DNA, 21 bp, Homo sapiens
atgtgcagcaagcagcatgct

SEQ ID NO: 8555477 - DNA, 22 bp, Homo sapiens
atgtgcaatggtgtcaccacat

SEQ ID NO: 8555478 - DNA, 22 bp, Homo sapiens
atgtgcaattattaagaagaga

SEQ ID NO: 8555479 - DNA, 22 bp, Homo sapiens
atgtgcaattattaagaagaga

SEQ ID NO: 8555480 - DNA, 22 bp, Homo sapiens
atgtgcacacagtgtcatgcaa

SEQ ID NO: 8555481 - DNA, 22 bp, Homo sapiens
agagccaggactgtgtctcact

SEQ ID NO: 8555482 - DNA, 22 bp, Homo sapiens
agagccaggactgtgtctcact

SEQ ID NO: 8555483 - DNA, 22 bp, Homo sapiens
agagccaggatctgttttgggg

SEQ ID NO: 8555484 - DNA, 22 bp, Homo sapiens
agagccaggatgtcttctgggg

SEQ ID NO: 8555485 - DNA, 22 bp, Homo sapiens
agagccaggactgtgtctcact

SEQ ID NO: 8555486 - DNA, 22 bp, Homo sapiens
agagccaggaagtggcgtgggg

SEQ ID NO: 8555487 - DNA, 22 bp, Homo sapiens
agagccaggaagtggcgtgggg

SEQ ID NO: 8555488 - DNA, 22 bp, Homo sapiens
agagccaggaagtggcgtgggg

SEQ ID NO: 8555489 - DNA, 22 bp, Homo sapiens
agagccaggcaggcaatgttga

SEQ ID NO: 8555490 - DNA, 22 bp, Homo sapiens
agagccaggatgtcttctgggg

SEQ ID NO: 8555491 - DNA, 22 bp, Homo sapiens
atgttattttggaaaatacaaa

SEQ ID NO: 8555492 - DNA, 22 bp, Homo sapiens
atgttattttggaaaatacaaa

SEQ ID NO: 8555493 - DNA, 22 bp, Homo sapiens
atgttattttggaaaatacaaa

SEQ ID NO: 8555494 - DNA, 22 bp, Homo sapiens
atgttacagaaagcaaagatga

SEQ ID NO: 8555495 - DNA, 22 bp, Homo sapiens
atgtgcatgcacttacatgtgt

SEQ ID NO: 8555496 - DNA, 22 bp, Homo sapiens
atgtgcatgcacttacatgtgt

SEQ ID NO: 8555497 - DNA, 22 bp, Homo sapiens
atgtgcattaaatgtcaatgtt

SEQ ID NO: 8555498 - DNA, 22 bp, Homo sapiens
agagccagcatttgacactggc

SEQ ID NO: 8555499 - DNA, 22 bp, Homo sapiens
agagccagcatttgacactggc

SEQ ID NO: 8555500 - DNA, 22 bp, Homo sapiens
agagccagcatttgacactggc

SEQ ID NO: 8555501 - DNA, 22 bp, Homo sapiens
agagccagcatttgacactggc

SEQ ID NO: 8555502 - DNA, 22 bp, Homo sapiens
agagccagcatttgggccctgc

SEQ ID NO: 8555503 - DNA, 22 bp, Homo sapiens
agagccagcatttgggccctgc

SEQ ID NO: 8555504 - DNA, 22 bp, Homo sapiens
agagccagcatttgggccctgc

SEQ ID NO: 8555505 - DNA, 22 bp, Homo sapiens
agagccagccttctcagcttac

SEQ ID NO: 8555506 - DNA, 22 bp, Homo sapiens
agagccaggaagtggcgtgggg

SEQ ID NO: 8555507 - DNA, 22 bp, Homo sapiens
agagccaggaagtggcgtgggg

SEQ ID NO: 8555508 - DNA, 22 bp, Homo sapiens
agagccaggaagtggcgtgggg

SEQ ID NO: 8555509 - DNA, 22 bp, Homo sapiens
atggacagcaactggaagcttc

SEQ ID NO: 8555510 - DNA, 22 bp, Homo sapiens
atggacagcaactggaagcttc

SEQ ID NO: 8555511 - DNA, 22 bp, Homo sapiens
atggaattaaaagtcaagtaat

SEQ ID NO: 8555512 - DNA, 22 bp, Homo sapiens
atggaattaataggggaatact

SEQ ID NO: 8555513 - DNA, 22 bp, Homo sapiens
atggaattgaagacagcatagg

SEQ ID NO: 8555514 - DNA, 21 bp, Homo sapiens
atggacaattgagtgtctgtc

SEQ ID NO: 8555515 - DNA, 22 bp, Homo sapiens
atggaatttgcaataacaggat

SEQ ID NO: 8555516 - DNA, 22 bp, Homo sapiens
atggaatttctccggctccacc

SEQ ID NO: 8555517 - DNA, 22 bp, Homo sapiens
atggaattgagcatcagttgtt

SEQ ID NO: 8555518 - DNA, 22 bp, Homo sapiens
atggaatttggagattaggcat

SEQ ID NO: 8555519 - DNA, 22 bp, Homo sapiens
atggaatttggactggaagtcc

SEQ ID NO: 8555520 - DNA, 22 bp, Homo sapiens
agagaacatattttgtatgatt

SEQ ID NO: 8555521 - DNA, 22 bp, Homo sapiens
agagaacagcctcctagagaaa

SEQ ID NO: 8555522 - DNA, 22 bp, Homo sapiens
agagaacagcctcctagagaaa

SEQ ID NO: 8555523 - DNA, 22 bp, Homo sapiens
agagaacatgacgtaatagtgg

SEQ ID NO: 8555524 - DNA, 22 bp, Homo sapiens
agagaacatgacgtaatagtgg

SEQ ID NO: 8555525 - DNA, 22 bp, Homo sapiens
agagaacttctcctaaatctca

SEQ ID NO: 8555526 - DNA, 22 bp, Homo sapiens
agagaagacttacagccacagt

SEQ ID NO: 8555527 - DNA, 22 bp, Homo sapiens
agagaagacttacagccacagt

SEQ ID NO: 8555528 - DNA, 22 bp, Homo sapiens
atggacagggcacaggcgcaga

SEQ ID NO: 8555529 - DNA, 22 bp, Homo sapiens
atggacaggtactgcagtgggt

SEQ ID NO: 8555530 - DNA, 22 bp, Homo sapiens
atgggcagtaacagtggcagtc

SEQ ID NO: 8555531 - DNA, 22 bp, Homo sapiens
atgggcagtaacagtggcagtc

SEQ ID NO: 8555532 - DNA, 18 bp, Homo sapiens
atgggaggggccaagaga

SEQ ID NO: 8555533 - DNA, 18 bp, Homo sapiens
atgggaggggccaagaga

SEQ ID NO: 8555534 - DNA, 18 bp, Homo sapiens
atgggaggggccaagaga

SEQ ID NO: 8555535 - DNA, 18 bp, Homo sapiens
atgggaggggccaagaga

SEQ ID NO: 8555536 - DNA, 22 bp, Homo sapiens
atgggaggcaggctcagaaccg

SEQ ID NO: 8555537 - DNA, 22 bp, Homo sapiens
atgggcagttaggaggccagga

SEQ ID NO: 8555538 - DNA, 22 bp, Homo sapiens
atgggcatgatattagtaccta

SEQ ID NO: 8555539 - DNA, 21 bp, Homo sapiens
atgggccagggatacagagag

SEQ ID NO: 8555540 - DNA, 22 bp, Homo sapiens
atgggcagtgtattggaaggaa

SEQ ID NO: 8555541 - DNA, 22 bp, Homo sapiens
atgggcagttaggaggccagga

SEQ ID NO: 8555542 - DNA, 22 bp, Homo sapiens
atgggcagtgtattggaaggaa

SEQ ID NO: 8555543 - DNA, 16 bp, Homo sapiens
atgggcagtgaggaag

SEQ ID NO: 8555544 - DNA, 22 bp, Homo sapiens
atgggcagtaacagtggcagtc

SEQ ID NO: 8555545 - DNA, 22 bp, Homo sapiens
agagacttctgccttagcaaga

SEQ ID NO: 8555546 - DNA, 17 bp, Homo sapiens
agagagaaaagggccat

SEQ ID NO: 8555547 - DNA, 22 bp, Homo sapiens
agagactgtgtccatcgtgcct

SEQ ID NO: 8555548 - DNA, 22 bp, Homo sapiens
agagactgtggctctttgaagg

SEQ ID NO: 8555549 - DNA, 22 bp, Homo sapiens
agagactgtgtccatcgtgcct

SEQ ID NO: 8555550 - DNA, 21 bp, Homo sapiens
agagactgtcactgcagtacc

SEQ ID NO: 8555551 - DNA, 21 bp, Homo sapiens
agagactgtcactgcagtacc

SEQ ID NO: 8555552 - DNA, 21 bp, Homo sapiens
agagactgtcactgcagtacc

SEQ ID NO: 8555553 - DNA, 21 bp, Homo sapiens
agagactgtcactgcagtacc

SEQ ID NO: 8555554 - DNA, 22 bp, Homo sapiens
agagactgtcacataacagagg

SEQ ID NO: 8555555 - DNA, 22 bp, Homo sapiens
agagactgtcacataacagagg

SEQ ID NO: 8555556 - DNA, 22 bp, Homo sapiens
agagactgtacgtggcaagtat

SEQ ID NO: 8555557 - DNA, 22 bp, Homo sapiens
atgtaggattgagtgatagagg

SEQ ID NO: 8555558 - DNA, 22 bp, Homo sapiens
agagagaagcaatcagtggcca

SEQ ID NO: 8555559 - DNA, 22 bp, Homo sapiens
atgtacatactgcattttcaaa

SEQ ID NO: 8555560 - DNA, 22 bp, Homo sapiens
atgggctctatgtctaggagat

SEQ ID NO: 8555561 - DNA, 22 bp, Homo sapiens
agagactgatggatcaccaaat

SEQ ID NO: 8555562 - DNA, 22 bp, Homo sapiens
agagactgatggatcaccaaat

SEQ ID NO: 8555563 - DNA, 22 bp, Homo sapiens
agagactgcaatgagtggtagg

SEQ ID NO: 8555564 - DNA, 22 bp, Homo sapiens
agagactgcaatgagtggtagg

SEQ ID NO: 8555565 - DNA, 22 bp, Homo sapiens
agagactgcaaatcataagaat

SEQ ID NO: 8555566 - DNA, 22 bp, Homo sapiens
agagactgctttatattgtact

SEQ ID NO: 8555567 - DNA, 22 bp, Homo sapiens
agagactgcgtgtcagcgctgg

SEQ ID NO: 8555568 - DNA, 19 bp, Homo sapiens
agagactgccaccagctgt

SEQ ID NO: 8555569 - DNA, 22 bp, Homo sapiens
agagactggagttacgagttca

SEQ ID NO: 8555570 - DNA, 22 bp, Homo sapiens
agagactggagttacgagttca

SEQ ID NO: 8555571 - DNA, 22 bp, Homo sapiens
agagactggcttctaaaatggc

SEQ ID NO: 8555572 - DNA, 22 bp, Homo sapiens
agagactgtacgtggcaagtat

SEQ ID NO: 8555573 - DNA, 22 bp, Homo sapiens
agagactgtaatgagaggtaca

SEQ ID NO: 8555574 - DNA, 22 bp, Homo sapiens
agagactgtaatgagaggtaca

SEQ ID NO: 8555575 - DNA, 22 bp, Homo sapiens
agagatggtagaacagtcataa

SEQ ID NO: 8555576 - DNA, 20 bp, Homo sapiens
atgtatattactggctgtga

SEQ ID NO: 8555577 - DNA, 22 bp, Homo sapiens
atgtatatgcatgcattcaaag

SEQ ID NO: 8555578 - DNA, 21 bp, Homo sapiens
atgtagtgacttcattccttc

SEQ ID NO: 8555579 - DNA, 22 bp, Homo sapiens
atgtagtatttggaaatgtaaa

SEQ ID NO: 8555580 - DNA, 22 bp, Homo sapiens
atgtagtgtagagattagtctc

SEQ ID NO: 8555581 - DNA, 22 bp, Homo sapiens
atgtagtgccctttgtcatcta

SEQ ID NO: 8555582 - DNA, 22 bp, Homo sapiens
atgtagtttggggctagattta

SEQ ID NO: 8555583 - DNA, 22 bp, Homo sapiens
atgtataatgctaattagctag

SEQ ID NO: 8555584 - DNA, 22 bp, Homo sapiens
atgtagtgtagagattagtctc

SEQ ID NO: 8555585 - DNA, 22 bp, Homo sapiens
atgtatatacttacatgtgtgg

SEQ ID NO: 8555586 - DNA, 22 bp, Homo sapiens
atgtatatgaagctagtatttt

SEQ ID NO: 8555587 - DNA, 22 bp, Homo sapiens
atgtataatgctaattagctag

SEQ ID NO: 8555588 - DNA, 22 bp, Homo sapiens
atgtatagtggtgatgattaca

SEQ ID NO: 8555589 - DNA, 22 bp, Homo sapiens
atcttaatcgagtccatgaaaa

SEQ ID NO: 8555590 - DNA, 18 bp, Homo sapiens
atcttaacttgatggagt

SEQ ID NO: 8555591 - DNA, 22 bp, Homo sapiens
atcttacacgataactgttagt

SEQ ID NO: 8555592 - DNA, 22 bp, Homo sapiens
atcttacactgttgggtttctc

SEQ ID NO: 8555593 - DNA, 19 bp, Homo sapiens
atcttacagagcagagtac

SEQ ID NO: 8555594 - DNA, 22 bp, Homo sapiens
atgacaatacttcaataagctg

SEQ ID NO: 8555595 - DNA, 22 bp, Homo sapiens
atgacaatacttcaataagctg

SEQ ID NO: 8555596 - DNA, 22 bp, Homo sapiens
atgacaatatagctttgatttt

SEQ ID NO: 8555597 - DNA, 22 bp, Homo sapiens
atcttagagagtcgtgttttgt

SEQ ID NO: 8555598 - DNA, 22 bp, Homo sapiens
atgacaatacttcaataagctg

SEQ ID NO: 8555599 - DNA, 22 bp, Homo sapiens
atcttacattccctcaccattt

SEQ ID NO: 8555600 - DNA, 23 bp, Homo sapiens
atcttacatatttagcacctgaa

SEQ ID NO: 8555601 - DNA, 22 bp, Homo sapiens
atgacctgaggccttactctag

SEQ ID NO: 8555602 - DNA, 22 bp, Homo sapiens
atgacccctaaaatttactgtc

SEQ ID NO: 8555603 - DNA, 22 bp, Homo sapiens
atgacccttactgcatcataca

SEQ ID NO: 8555604 - DNA, 22 bp, Homo sapiens
atgaccagtgttgctggccccg

SEQ ID NO: 8555605 - DNA, 22 bp, Homo sapiens
atgacatttatacagtgagctt

SEQ ID NO: 8555606 - DNA, 22 bp, Homo sapiens
atgacattgacagacctgctgc

SEQ ID NO: 8555607 - DNA, 17 bp, Homo sapiens
atctggctgcttctaga

SEQ ID NO: 8555608 - DNA, 22 bp, Homo sapiens
atctggcttttactgaattgct

SEQ ID NO: 8555609 - DNA, 22 bp, Homo sapiens
atctgggagtcttggctctgct

SEQ ID NO: 8555610 - DNA, 22 bp, Homo sapiens
atctgggtagtgcaagacatga

SEQ ID NO: 8555611 - DNA, 22 bp, Homo sapiens
atctgggtcacagtggcatcta

SEQ ID NO: 8555612 - DNA, 22 bp, Homo sapiens
atctgggtctgaagataatgat

SEQ ID NO: 8555613 - DNA, 22 bp, Homo sapiens
atctgttgtttttcaccaccca

SEQ ID NO: 8555614 - DNA, 22 bp, Homo sapiens
atctgttgtttgtttgctaaag

SEQ ID NO: 8555615 - DNA, 22 bp, Homo sapiens
atctgttgtttgtttgctaaag

SEQ ID NO: 8555616 - DNA, 22 bp, Homo sapiens
atctgggttcaccatgctcctg

SEQ ID NO: 8555617 - DNA, 21 bp, Homo sapiens
atcttaaaaggtcttaacttt

SEQ ID NO: 8555618 - DNA, 22 bp, Homo sapiens
atgaggcaatcatggtccagtt

SEQ ID NO: 8555619 - DNA, 22 bp, Homo sapiens
atgatatagagagtagattaaa

SEQ ID NO: 8555620 - DNA, 22 bp, Homo sapiens
atgatatatgtgttgagcttgc

SEQ ID NO: 8555621 - DNA, 22 bp, Homo sapiens
atgaggagtcaaggagtcggag

SEQ ID NO: 8555622 - DNA, 22 bp, Homo sapiens
atgaggatgttagtggactgga

SEQ ID NO: 8555623 - DNA, 22 bp, Homo sapiens
atgacttcgttttctctctgca

SEQ ID NO: 8555624 - DNA, 22 bp, Homo sapiens
atgacttctgcaaggtcatttg

SEQ ID NO: 8555625 - DNA, 22 bp, Homo sapiens
atgacttattacaagtcatatt

SEQ ID NO: 8555626 - DNA, 22 bp, Homo sapiens
atgactttcctggcaaaagttg

SEQ ID NO: 8555627 - DNA, 22 bp, Homo sapiens
atgactttgttgttttccagcg

SEQ ID NO: 8555628 - DNA, 22 bp, Homo sapiens
atgagaaaattcattccatcca

SEQ ID NO: 8555629 - DNA, 22 bp, Homo sapiens
atgaggaggccagtaagagcct

SEQ ID NO: 8555630 - DNA, 22 bp, Homo sapiens
atgagaaagagttgtatctaga

SEQ ID NO: 8555631 - DNA, 22 bp, Homo sapiens
atgatttaaagtcattgtgaac

SEQ ID NO: 8555632 - DNA, 22 bp, Homo sapiens
atgattgcagccctacagctgt

SEQ ID NO: 8555633 - DNA, 20 bp, Homo sapiens
atgattctgggctacactgg

SEQ ID NO: 8555634 - DNA, 22 bp, Homo sapiens
atgattgaaaatgacattgcca

SEQ ID NO: 8555635 - DNA, 22 bp, Homo sapiens
atgattgaccatctgctgggct

SEQ ID NO: 8555636 - DNA, 22 bp, Homo sapiens
atgattgaaaatgacattgcca

SEQ ID NO: 8555637 - DNA, 22 bp, Homo sapiens
atgattcagggagttttcagga

SEQ ID NO: 8555638 - DNA, 22 bp, Homo sapiens
atgattctctgctactctaaat

SEQ ID NO: 8555639 - DNA, 22 bp, Homo sapiens
atgattctggcaaatttattat

SEQ ID NO: 8555640 - DNA, 22 bp, Homo sapiens
atgattctcattttataaactt

SEQ ID NO: 8555641 - DNA, 22 bp, Homo sapiens
atgattctcattttataaactt

SEQ ID NO: 8555642 - DNA, 22 bp, Homo sapiens
atgccacttcattccagcctcg

SEQ ID NO: 8555643 - DNA, 22 bp, Homo sapiens
atgccacttcattccagcctcg

SEQ ID NO: 8555644 - DNA, 22 bp, Homo sapiens
atgcaacagttcatagttttat

SEQ ID NO: 8555645 - DNA, 22 bp, Homo sapiens
atgccactgcactccagcctag

SEQ ID NO: 8555646 - DNA, 22 bp, Homo sapiens
atgccaggccccacgctgggca

SEQ ID NO: 8555647 - DNA, 22 bp, Homo sapiens
atgccagcctctaagcacttta

SEQ ID NO: 8555648 - DNA, 22 bp, Homo sapiens
atgccagctatagacttgttat

SEQ ID NO: 8555649 - DNA, 22 bp, Homo sapiens
atgccaggaacaaacagtggtg

SEQ ID NO: 8555650 - DNA, 22 bp, Homo sapiens
atgcaacagctgggaatatgta

SEQ ID NO: 8555651 - DNA, 22 bp, Homo sapiens
atgcaacagggttgggaggcgg

SEQ ID NO: 8555652 - DNA, 22 bp, Homo sapiens
atgcaacaggtcagccaggaag

SEQ ID NO: 8555653 - DNA, 22 bp, Homo sapiens
atgcaacagttcatagttttat

SEQ ID NO: 8555654 - DNA, 22 bp, Homo sapiens
atgcaacagtcagtacatccgg

SEQ ID NO: 8555655 - DNA, 22 bp, Homo sapiens
atgcaacagtcagtacatccgg

SEQ ID NO: 8555656 - DNA, 22 bp, Homo sapiens
atgcaacagggttgggaggcgg

SEQ ID NO: 8555657 - DNA, 22 bp, Homo sapiens
atgcaacagtcagtacatccgg

SEQ ID NO: 8555658 - DNA, 22 bp, Homo sapiens
atgcaacacatttgatgagcga

SEQ ID NO: 8555659 - DNA, 22 bp, Homo sapiens
atgcaacacccctatggatgga

SEQ ID NO: 8555660 - DNA, 22 bp, Homo sapiens
atgcaacacatttgatgagcga

SEQ ID NO: 8555661 - DNA, 22 bp, Homo sapiens
atgcaacaatgtatttatgtat

SEQ ID NO: 8555662 - DNA, 22 bp, Homo sapiens
atgcaacagaaaattgcctggg

SEQ ID NO: 8555663 - DNA, 22 bp, Homo sapiens
atgcaacagaaaattgcctggg

SEQ ID NO: 8555664 - DNA, 22 bp, Homo sapiens
atgcaacagagaaaatattgag

SEQ ID NO: 8555665 - DNA, 22 bp, Homo sapiens
atgcaacagagaaaatattgag

SEQ ID NO: 8555666 - DNA, 22 bp, Homo sapiens
atgcaaattctttgcttcttct

SEQ ID NO: 8555667 - DNA, 19 bp, Homo sapiens
atgcaacaaaagtgtaaga

SEQ ID NO: 8555668 - DNA, 22 bp, Homo sapiens
atgcaaattgccataaagtggg

SEQ ID NO: 8555669 - DNA, 19 bp, Homo sapiens
atgcaacaaaagtgtaaga

SEQ ID NO: 8555670 - DNA, 22 bp, Homo sapiens
atgcaacaaatgctacgaatcg

SEQ ID NO: 8555671 - DNA, 19 bp, Homo sapiens
atgcaacaaaagtgtaaga

SEQ ID NO: 8555672 - DNA, 22 bp, Homo sapiens
atgcaacaaattgtgtgcaata

SEQ ID NO: 8555673 - DNA, 22 bp, Homo sapiens
atgcaacaaattgtgtgcaata

SEQ ID NO: 8555674 - DNA, 22 bp, Homo sapiens
atgcaacaaatgctacgaatcg

SEQ ID NO: 8555675 - DNA, 20 bp, Homo sapiens
agacagtggggagctcctag

SEQ ID NO: 8555676 - DNA, 22 bp, Homo sapiens
agacagtggctcagccccagtc

SEQ ID NO: 8555677 - DNA, 20 bp, Homo sapiens
agacagtggggagctcctag

SEQ ID NO: 8555678 - DNA, 22 bp, Homo sapiens
agacataaacttactgaaatac

SEQ ID NO: 8555679 - DNA, 19 bp, Homo sapiens
agacataaagagtttgcaa

SEQ ID NO: 8555680 - DNA, 22 bp, Homo sapiens
agacagtgtgtgtatatatggt

SEQ ID NO: 8555681 - DNA, 22 bp, Homo sapiens
agacagtgtggttggtggttcc

SEQ ID NO: 8555682 - DNA, 22 bp, Homo sapiens
agacagtgtgtgtatatatggt

SEQ ID NO: 8555683 - DNA, 22 bp, Homo sapiens
agacatagaaaatcattaggaa

SEQ ID NO: 8555684 - DNA, 22 bp, Homo sapiens
agacatagaaaatcattaggaa

SEQ ID NO: 8555685 - DNA, 22 bp, Homo sapiens
agacatagataggcactgattg

SEQ ID NO: 8555686 - DNA, 22 bp, Homo sapiens
agacataggattccacatagca

SEQ ID NO: 8555687 - DNA, 22 bp, Homo sapiens
agacatagataggcactgattg

SEQ ID NO: 8555688 - DNA, 22 bp, Homo sapiens
agacataagccagtcactcact

SEQ ID NO: 8555689 - DNA, 22 bp, Homo sapiens
agacataagtgctatgacattg

SEQ ID NO: 8555690 - DNA, 22 bp, Homo sapiens
agacataagtgctatgacattg

SEQ ID NO: 8555691 - DNA, 22 bp, Homo sapiens
agacataagtgctatgacattg

SEQ ID NO: 8555692 - DNA, 22 bp, Homo sapiens
atgccagggtcatcccctgggt

SEQ ID NO: 8555693 - DNA, 22 bp, Homo sapiens
atgccagtaagtctcagctagg

SEQ ID NO: 8555694 - DNA, 22 bp, Homo sapiens
atgccattgctttaaaattaag

SEQ ID NO: 8555695 - DNA, 22 bp, Homo sapiens
agacagtgctatcccatctgtg

SEQ ID NO: 8555696 - DNA, 22 bp, Homo sapiens
agacagtgctatcccatctgtg

SEQ ID NO: 8555697 - DNA, 22 bp, Homo sapiens
agacagtgctatcccatctgtg

SEQ ID NO: 8555698 - DNA, 22 bp, Homo sapiens
agacagtggatcgggatgcact

SEQ ID NO: 8555699 - DNA, 22 bp, Homo sapiens
agacagtggatcgggatgcact

SEQ ID NO: 8555700 - DNA, 19 bp, Homo sapiens
agacagtggctaggactta

SEQ ID NO: 8555701 - DNA, 22 bp, Homo sapiens
atgctgaagagttcatgattat

SEQ ID NO: 8555702 - DNA, 22 bp, Homo sapiens
atgctgaagagttcatgattat

SEQ ID NO: 8555703 - DNA, 22 bp, Homo sapiens
atgctgaagagtgcacaggcta

SEQ ID NO: 8555704 - DNA, 22 bp, Homo sapiens
atgctgaaggccatcctgcatc

SEQ ID NO: 8555705 - DNA, 22 bp, Homo sapiens
atgctgaaggtgaattgacaat

SEQ ID NO: 8555706 - DNA, 22 bp, Homo sapiens
atgctgaatagttcactcttct

SEQ ID NO: 8555707 - DNA, 22 bp, Homo sapiens
atgctgaaggtgaattgacaat

SEQ ID NO: 8555708 - DNA, 22 bp, Homo sapiens
atgctgaatattagcctcatga

SEQ ID NO: 8555709 - DNA, 22 bp, Homo sapiens
atgctgaatattagcctcatga

SEQ ID NO: 8555710 - DNA, 22 bp, Homo sapiens
atgctgacttctctctgcagtg

SEQ ID NO: 8555711 - DNA, 22 bp, Homo sapiens
atgctgacagactattaactat

SEQ ID NO: 8555712 - DNA, 22 bp, Homo sapiens
atgctaaaaacttgatcattat

SEQ ID NO: 8555713 - DNA, 22 bp, Homo sapiens
atgctgaagaatcacagggact

SEQ ID NO: 8555714 - DNA, 22 bp, Homo sapiens
agacataggattccacatagca

SEQ ID NO: 8555715 - DNA, 22 bp, Homo sapiens
agacatagggaggcatataaat

SEQ ID NO: 8555716 - DNA, 22 bp, Homo sapiens
agacatatattgcaattcactg

SEQ ID NO: 8555717 - DNA, 22 bp, Homo sapiens
atgcgtgcaggggtcctcctgg

SEQ ID NO: 8555718 - DNA, 22 bp, Homo sapiens
atgcgtgtttgtatacacacaa

SEQ ID NO: 8555719 - DNA, 22 bp, Homo sapiens
atgcgtgtaggaacagtgtcta

SEQ ID NO: 8555720 - DNA, 22 bp, Homo sapiens
atgcgtgtgtgcaaaccattgc

SEQ ID NO: 8555721 - DNA, 22 bp, Homo sapiens
atgcttaatgagggtatatatg

SEQ ID NO: 8555722 - DNA, 22 bp, Homo sapiens
atgctgcagctgcaggatcaga

SEQ ID NO: 8555723 - DNA, 22 bp, Homo sapiens
atgctgcacaagccacatgtag

SEQ ID NO: 8555724 - DNA, 22 bp, Homo sapiens
atgctgcacaagccacatgtag

SEQ ID NO: 8555725 - DNA, 22 bp, Homo sapiens
atgctgagataaggctttagtc

SEQ ID NO: 8555726 - DNA, 22 bp, Homo sapiens
atgctgagatcctcaggccaga

SEQ ID NO: 8555727 - DNA, 22 bp, Homo sapiens
atgctgagactggagcagctgg

SEQ ID NO: 8555728 - DNA, 22 bp, Homo sapiens
atgctgagactggagcagctgg

SEQ ID NO: 8555729 - DNA, 22 bp, Homo sapiens
atgctgaggacaaagagatcaa

SEQ ID NO: 8555730 - DNA, 22 bp, Homo sapiens
atgctgaggtgtgtttaattta

SEQ ID NO: 8555731 - DNA, 22 bp, Homo sapiens
agagaacagcattgcagctttg

SEQ ID NO: 8555732 - DNA, 22 bp, Homo sapiens
agagaacagacagatgcaatga

SEQ ID NO: 8555733 - DNA, 22 bp, Homo sapiens
agagaacaaattaaaggtggtt

SEQ ID NO: 8555734 - DNA, 22 bp, Homo sapiens
agagaacacgtgcatctgcaat

SEQ ID NO: 8555735 - DNA, 22 bp, Homo sapiens
agagaacacgtgcatctgcaat

SEQ ID NO: 8555736 - DNA, 22 bp, Homo sapiens
agagaacacgtgcatctgcaat

SEQ ID NO: 8555737 - DNA, 22 bp, Homo sapiens
agagaaatttccctgccttctg

SEQ ID NO: 8555738 - DNA, 22 bp, Homo sapiens
agagaaacaggtcagctgggag

SEQ ID NO: 8555739 - DNA, 22 bp, Homo sapiens
agagaaaagccatcccagccaa

SEQ ID NO: 8555740 - DNA, 22 bp, Homo sapiens
atgcttgaaaaccccatgaata

SEQ ID NO: 8555741 - DNA, 22 bp, Homo sapiens
atgcttctgtgtatgtttcagg

SEQ ID NO: 8555742 - DNA, 22 bp, Homo sapiens
atgcttcttgagatagaaacac

SEQ ID NO: 8555743 - DNA, 22 bp, Homo sapiens
atgcttcttgtatttggctgac

SEQ ID NO: 8555744 - DNA, 18 bp, Homo sapiens
atgcttctgatagaagca

SEQ ID NO: 8555745 - DNA, 18 bp, Homo sapiens
atgcttctgatagaagca

SEQ ID NO: 8555746 - DNA, 22 bp, Homo sapiens
atgcttctcagctcaaggcaaa

SEQ ID NO: 8555747 - DNA, 22 bp, Homo sapiens
atgcttctcctgaacatccctg

SEQ ID NO: 8555748 - DNA, 22 bp, Homo sapiens
atgcttctcctgaacatccctg

SEQ ID NO: 8555749 - DNA, 22 bp, Homo sapiens
atgcttcctcccttccactcaa

SEQ ID NO: 8555750 - DNA, 22 bp, Homo sapiens
atgcttccttaccagaagatga

SEQ ID NO: 8555751 - DNA, 22 bp, Homo sapiens
atgcttccttaccagaagatga

SEQ ID NO: 8555752 - DNA, 22 bp, Homo sapiens
atgcttcagtgctaccttcaaa

SEQ ID NO: 8555753 - DNA, 22 bp, Homo sapiens
atgcttcatgatttggccatgt

SEQ ID NO: 8555754 - DNA, 22 bp, Homo sapiens
atgcttccctttgctccacatg

SEQ ID NO: 8555755 - DNA, 22 bp, Homo sapiens
ataaatttataattgtttcctg

SEQ ID NO: 8555756 - DNA, 22 bp, Homo sapiens
ataaatttataattgtttcctg

SEQ ID NO: 8555757 - DNA, 22 bp, Homo sapiens
ataaattttcttgctgtactta

SEQ ID NO: 8555758 - DNA, 22 bp, Homo sapiens
ataacaatagtggtagtgctgg

SEQ ID NO: 8555759 - DNA, 22 bp, Homo sapiens
ataacactaaatgtatgtaaca

SEQ ID NO: 8555760 - DNA, 22 bp, Homo sapiens
ataacagaataagtcattaccg

SEQ ID NO: 8555761 - DNA, 22 bp, Homo sapiens
ataacactaaatgtatgtaaca

SEQ ID NO: 8555762 - DNA, 22 bp, Homo sapiens
ataacactaaatgtatgtaaca

SEQ ID NO: 8555763 - DNA, 22 bp, Homo sapiens
ataacactaaatgtatgtaaca

SEQ ID NO: 8555764 - DNA, 22 bp, Homo sapiens
ataacagacttagagttacaag

SEQ ID NO: 8555765 - DNA, 22 bp, Homo sapiens
ataacagacttagagttacaag

SEQ ID NO: 8555766 - DNA, 22 bp, Homo sapiens
ataacagactgatttttaaatg

SEQ ID NO: 8555767 - DNA, 19 bp, Homo sapiens
ataaataaaaagtgggaga

SEQ ID NO: 8555768 - DNA, 19 bp, Homo sapiens
ataaataaaaagtgggaga

SEQ ID NO: 8555769 - DNA, 22 bp, Homo sapiens
ataaattatgaatggccctttt

SEQ ID NO: 8555770 - DNA, 22 bp, Homo sapiens
ataaattatgaatggccctttt

SEQ ID NO: 8555771 - DNA, 22 bp, Homo sapiens
ataaattatgaatggccctttt

SEQ ID NO: 8555772 - DNA, 22 bp, Homo sapiens
ataaattctctgatgtatagta

SEQ ID NO: 8555773 - DNA, 22 bp, Homo sapiens
ataaattctctgatgtatagta

SEQ ID NO: 8555774 - DNA, 21 bp, Homo sapiens
ataaattctgagaggctctgc

SEQ ID NO: 8555775 - DNA, 22 bp, Homo sapiens
agttctttgtcatctctggagt

SEQ ID NO: 8555776 - DNA, 22 bp, Homo sapiens
agttcagtagtccttcattgta

SEQ ID NO: 8555777 - DNA, 22 bp, Homo sapiens
agttcagtagtccttcattgta

SEQ ID NO: 8555778 - DNA, 22 bp, Homo sapiens
agttctttgtaaaaggtctcta

SEQ ID NO: 8555779 - DNA, 22 bp, Homo sapiens
agttcttttgtgaacatatgct

SEQ ID NO: 8555780 - DNA, 22 bp, Homo sapiens
agttcttttgtgaacatatgct

SEQ ID NO: 8555781 - DNA, 22 bp, Homo sapiens
agttgaaaattaagtgaatttc

SEQ ID NO: 8555782 - DNA, 22 bp, Homo sapiens
agttcttttctagattctggat

SEQ ID NO: 8555783 - DNA, 22 bp, Homo sapiens
agttgacaataaatttaattgg

SEQ ID NO: 8555784 - DNA, 22 bp, Homo sapiens
agttgacatccagagacattct

SEQ ID NO: 8555785 - DNA, 22 bp, Homo sapiens
agttgaaagccttatttctctg

SEQ ID NO: 8555786 - DNA, 22 bp, Homo sapiens
agttgaaattagagtcctggct

SEQ ID NO: 8555787 - DNA, 22 bp, Homo sapiens
agttgaaattaagagagagttt

SEQ ID NO: 8555788 - DNA, 22 bp, Homo sapiens
agttgaacagtatttgcttctg

SEQ ID NO: 8555789 - DNA, 22 bp, Homo sapiens
agttcacagcaaagtggggacc

SEQ ID NO: 8555790 - DNA, 22 bp, Homo sapiens
agttcacagaatggccagaact

SEQ ID NO: 8555791 - DNA, 22 bp, Homo sapiens
agttcacaccaaagttaggtag

SEQ ID NO: 8555792 - DNA, 22 bp, Homo sapiens
agttcacaagtgcatttcagga

SEQ ID NO: 8555793 - DNA, 22 bp, Homo sapiens
agttcacaagtgcatttcagga

SEQ ID NO: 8555794 - DNA, 20 bp, Homo sapiens
agttcacaggccaaatttct

SEQ ID NO: 8555795 - DNA, 22 bp, Homo sapiens
agttcacatatctgttttattt

SEQ ID NO: 8555796 - DNA, 22 bp, Homo sapiens
agttcacattccgaggtactgg

SEQ ID NO: 8555797 - DNA, 22 bp, Homo sapiens
agttcacattccgaggtactgg

SEQ ID NO: 8555798 - DNA, 21 bp, Homo sapiens
agttcacaggaacaagcaggg

SEQ ID NO: 8555799 - DNA, 22 bp, Homo sapiens
agttcacagggaaggttattgt

SEQ ID NO: 8555800 - DNA, 23 bp, Homo sapiens
agttcactgaggttgaccactgg

SEQ ID NO: 8555801 - DNA, 22 bp, Homo sapiens
agttcactgcttaagcctttga

SEQ ID NO: 8555802 - DNA, 22 bp, Homo sapiens
agttcaggcataaggcatgaac

SEQ ID NO: 8555803 - DNA, 22 bp, Homo sapiens
ataaggaatgatgtatcagttt

SEQ ID NO: 8555804 - DNA, 22 bp, Homo sapiens
ataaggaatgatgtatcagttt

SEQ ID NO: 8555805 - DNA, 22 bp, Homo sapiens
ataacagagagctactgaactg

SEQ ID NO: 8555806 - DNA, 22 bp, Homo sapiens
ataacagagagctactgaactg

SEQ ID NO: 8555807 - DNA, 22 bp, Homo sapiens
ataaggaacctgggcttaagag

SEQ ID NO: 8555808 - DNA, 22 bp, Homo sapiens
atacaagttgtgataatgtaaa

SEQ ID NO: 8555809 - DNA, 22 bp, Homo sapiens
atacaagttgtgataatgtaaa

SEQ ID NO: 8555810 - DNA, 22 bp, Homo sapiens
atacaagttgtgataatgtaaa

SEQ ID NO: 8555811 - DNA, 22 bp, Homo sapiens
atacaagttgtgataatgtaaa

SEQ ID NO: 8555812 - DNA, 22 bp, Homo sapiens
atacaaagacaaatctcaatct

SEQ ID NO: 8555813 - DNA, 20 bp, Homo sapiens
atacaaagagattgatgtat

SEQ ID NO: 8555814 - DNA, 22 bp, Homo sapiens
atacacacaatcaggttttgta

SEQ ID NO: 8555815 - DNA, 22 bp, Homo sapiens
atacacacgtgcacgtgggaaa

SEQ ID NO: 8555816 - DNA, 20 bp, Homo sapiens
atacaatcatgaggaaaaag

SEQ ID NO: 8555817 - DNA, 22 bp, Homo sapiens
atacacacatatgtgagttttg

SEQ ID NO: 8555818 - DNA, 22 bp, Homo sapiens
atacaatgggtgcaaagatgtg

SEQ ID NO: 8555819 - DNA, 22 bp, Homo sapiens
atacaatgattggttctcaccc

SEQ ID NO: 8555820 - DNA, 22 bp, Homo sapiens
atacaattattctgcagatatt

SEQ ID NO: 8555821 - DNA, 22 bp, Homo sapiens
atacaattattctgcagatatt

SEQ ID NO: 8555822 - DNA, 22 bp, Homo sapiens
atacaattattctgcagatatt

SEQ ID NO: 8555823 - DNA, 20 bp, Homo sapiens
atacaatcatgaggaaaaag

SEQ ID NO: 8555824 - DNA, 22 bp, Homo sapiens
atacaatccagccattgccaca

SEQ ID NO: 8555825 - DNA, 22 bp, Homo sapiens
atacaatagtgtttgttttgag

SEQ ID NO: 8555826 - DNA, 22 bp, Homo sapiens
atacaatctagtctgtcagcaa

SEQ ID NO: 8555827 - DNA, 22 bp, Homo sapiens
atacaatgaagtatagatgaaa

SEQ ID NO: 8555828 - DNA, 22 bp, Homo sapiens
atacaatgaagtatagatgaaa

SEQ ID NO: 8555829 - DNA, 22 bp, Homo sapiens
atacaatgaagtatagatgaaa

SEQ ID NO: 8555830 - DNA, 22 bp, Homo sapiens
atacaatgataatagtacttta

SEQ ID NO: 8555831 - DNA, 22 bp, Homo sapiens
atacaatgataatagtacttta

SEQ ID NO: 8555832 - DNA, 22 bp, Homo sapiens
atacaatgagtgagtgaatggg

SEQ ID NO: 8555833 - DNA, 22 bp, Homo sapiens
atacacatttgctagagatggg

SEQ ID NO: 8555834 - DNA, 22 bp, Homo sapiens
atacacatttgctagagatggg

SEQ ID NO: 8555835 - DNA, 22 bp, Homo sapiens
atacacatttgctagagatggg

SEQ ID NO: 8555836 - DNA, 22 bp, Homo sapiens
atacacatttgctagagatggg

SEQ ID NO: 8555837 - DNA, 22 bp, Homo sapiens
atacacagcgatgagaggaggc

SEQ ID NO: 8555838 - DNA, 22 bp, Homo sapiens
atacacagcgatgagaggaggc

SEQ ID NO: 8555839 - DNA, 22 bp, Homo sapiens
atacacagcgatgagaggaggc

SEQ ID NO: 8555840 - DNA, 22 bp, Homo sapiens
atacacagcgatgagaggaggc

SEQ ID NO: 8555841 - DNA, 22 bp, Homo sapiens
atacacactgctatcctttttt

SEQ ID NO: 8555842 - DNA, 22 bp, Homo sapiens
atacacactgctatcctttttt

SEQ ID NO: 8555843 - DNA, 22 bp, Homo sapiens
atacactgagtccttttctcat

SEQ ID NO: 8555844 - DNA, 22 bp, Homo sapiens
atacactactaagcacagattg

SEQ ID NO: 8555845 - DNA, 22 bp, Homo sapiens
atacaccaccttggatctttca

SEQ ID NO: 8555846 - DNA, 22 bp, Homo sapiens
atagcatataagttataaaact

SEQ ID NO: 8555847 - DNA, 22 bp, Homo sapiens
atagcatggcctgtgacacttt

SEQ ID NO: 8555848 - DNA, 22 bp, Homo sapiens
actttagatattcctctgtaca

SEQ ID NO: 8555849 - DNA, 23 bp, Homo sapiens
actttagataaattatgtgcaca

SEQ ID NO: 8555850 - DNA, 22 bp, Homo sapiens
atagatggtatttagactagcg

SEQ ID NO: 8555851 - DNA, 22 bp, Homo sapiens
actttagatattcctctgtaca

SEQ ID NO: 8555852 - DNA, 20 bp, Homo sapiens
atagatcctggttctttgca

SEQ ID NO: 8555853 - DNA, 22 bp, Homo sapiens
atagatccagaaaatttattat

SEQ ID NO: 8555854 - DNA, 22 bp, Homo sapiens
actttactccccaacataaatg

SEQ ID NO: 8555855 - DNA, 22 bp, Homo sapiens
actttagaaaagcatccataga

SEQ ID NO: 8555856 - DNA, 22 bp, Homo sapiens
actttacagatggtttcctgac

SEQ ID NO: 8555857 - DNA, 22 bp, Homo sapiens
actttacaggcacttcaagtat

SEQ ID NO: 8555858 - DNA, 22 bp, Homo sapiens
atagaatagcatagaaaattga

SEQ ID NO: 8555859 - DNA, 22 bp, Homo sapiens
actttacaggcacttcaagtat

SEQ ID NO: 8555860 - DNA, 22 bp, Homo sapiens
actttactacatccacagatgg

SEQ ID NO: 8555861 - DNA, 22 bp, Homo sapiens
actttacccgcactcagacaca

SEQ ID NO: 8555862 - DNA, 22 bp, Homo sapiens
actttacatttgatctctctaa

SEQ ID NO: 8555863 - DNA, 22 bp, Homo sapiens
actttactccccaacataaatg

SEQ ID NO: 8555864 - DNA, 22 bp, Homo sapiens
atagaatagcatagaaaattga

SEQ ID NO: 8555865 - DNA, 22 bp, Homo sapiens
atagaatagcatagaaaattga

SEQ ID NO: 8555866 - DNA, 22 bp, Homo sapiens
atagaatagcatagaaaattga

SEQ ID NO: 8555867 - DNA, 22 bp, Homo sapiens
atagaacagggcactgtcatga

SEQ ID NO: 8555868 - DNA, 22 bp, Homo sapiens
atagaacagaaacagatgcaca

SEQ ID NO: 8555869 - DNA, 22 bp, Homo sapiens
atagaacagaaacagatgcaca

SEQ ID NO: 8555870 - DNA, 21 bp, Homo sapiens
atagaacaccaggcatatata

SEQ ID NO: 8555871 - DNA, 20 bp, Homo sapiens
atagaagtattatgtaatgt

SEQ ID NO: 8555872 - DNA, 22 bp, Homo sapiens
atagaagcaagaacagaatgga

SEQ ID NO: 8555873 - DNA, 23 bp, Homo sapiens
atagaagattattgcaacagtcc

SEQ ID NO: 8555874 - DNA, 22 bp, Homo sapiens
atagaactcgggctttggaatc

SEQ ID NO: 8555875 - DNA, 22 bp, Homo sapiens
atagaactccatccctctgacc

SEQ ID NO: 8555876 - DNA, 22 bp, Homo sapiens
atacactgttcactagatcttc

SEQ ID NO: 8555877 - DNA, 22 bp, Homo sapiens
atacactgttcactagatcttc

SEQ ID NO: 8555878 - DNA, 22 bp, Homo sapiens
atacactggacatcattgcatt

SEQ ID NO: 8555879 - DNA, 22 bp, Homo sapiens
atacactggcctttgcagagcc

SEQ ID NO: 8555880 - DNA, 22 bp, Homo sapiens
atacactggtttatgatattgt

SEQ ID NO: 8555881 - DNA, 22 bp, Homo sapiens
atacactggcctttgcagagcc

SEQ ID NO: 8555882 - DNA, 22 bp, Homo sapiens
atactgttttgtgacttatctt

SEQ ID NO: 8555883 - DNA, 22 bp, Homo sapiens
atacttaactgtggagtcattg

SEQ ID NO: 8555884 - DNA, 22 bp, Homo sapiens
atactgtttctcttctacatga

SEQ ID NO: 8555885 - DNA, 22 bp, Homo sapiens
atacacttgacctggagtgaag

SEQ ID NO: 8555886 - DNA, 22 bp, Homo sapiens
atagttgagatcagattcaact

SEQ ID NO: 8555887 - DNA, 22 bp, Homo sapiens
agaaaaatcttggcgcttgtct

SEQ ID NO: 8555888 - DNA, 22 bp, Homo sapiens
agaaaacttgtcacagctctca

SEQ ID NO: 8555889 - DNA, 22 bp, Homo sapiens
agaaaacttgtcacagctctca

SEQ ID NO: 8555890 - DNA, 17 bp, Homo sapiens
agaaaagagaccagcag

SEQ ID NO: 8555891 - DNA, 22 bp, Homo sapiens
agaaaagaggctttctaagcat

SEQ ID NO: 8555892 - DNA, 22 bp, Homo sapiens
agaaaagaggctttctaagcat

SEQ ID NO: 8555893 - DNA, 22 bp, Homo sapiens
atagccaggagatgatggggga

SEQ ID NO: 8555894 - DNA, 22 bp, Homo sapiens
atagccagcatatagcagggag

SEQ ID NO: 8555895 - DNA, 19 bp, Homo sapiens
atagcttgtcagctgctcc

SEQ ID NO: 8555896 - DNA, 22 bp, Homo sapiens
atagcttcagaattgagatatc

SEQ ID NO: 8555897 - DNA, 22 bp, Homo sapiens
atagctgttagattggggtcga

SEQ ID NO: 8555898 - DNA, 22 bp, Homo sapiens
atagcttacaggtgatatcagc

SEQ ID NO: 8555899 - DNA, 22 bp, Homo sapiens
ataggaaagaaaattatgtagg

SEQ ID NO: 8555900 - DNA, 20 bp, Homo sapiens
ataggaaagggaggggcttt

SEQ ID NO: 8555901 - DNA, 22 bp, Homo sapiens
atagctttttgtcatagagtct

SEQ ID NO: 8555902 - DNA, 22 bp, Homo sapiens
atagctttttgtcatagagtct

SEQ ID NO: 8555903 - DNA, 22 bp, Homo sapiens
ataggaatgtgatttataaatg

SEQ ID NO: 8555904 - DNA, 22 bp, Homo sapiens
ataggaatttcttcagcactga

SEQ ID NO: 8555905 - DNA, 22 bp, Homo sapiens
ataggaatttcttcagcactga

SEQ ID NO: 8555906 - DNA, 22 bp, Homo sapiens
ataggaaatcgctattaaccta

SEQ ID NO: 8555907 - DNA, 22 bp, Homo sapiens
ataggatgataaaattagaaac

SEQ ID NO: 8555908 - DNA, 22 bp, Homo sapiens
atagtggttggatatgtcagag

SEQ ID NO: 8555909 - DNA, 22 bp, Homo sapiens
ataggcaaattaataagtcata

SEQ ID NO: 8555910 - DNA, 22 bp, Homo sapiens
atagtgtctttcttcacaggca

SEQ ID NO: 8555911 - DNA, 22 bp, Homo sapiens
atagtgtcagaaaatcataaga

SEQ ID NO: 8555912 - DNA, 22 bp, Homo sapiens
atagtgtgtaaagtgcagtgat

SEQ ID NO: 8555913 - DNA, 22 bp, Homo sapiens
atagtgtgactgaggagttgaa

SEQ ID NO: 8555914 - DNA, 22 bp, Homo sapiens
atagttatgctctagacaagaa

SEQ ID NO: 8555915 - DNA, 22 bp, Homo sapiens
atagtgtgttagtgacataggc

SEQ ID NO: 8555916 - DNA, 22 bp, Homo sapiens
atagtgtgtggtataggtagag

SEQ ID NO: 8555917 - DNA, 22 bp, Homo sapiens
atagtgtgttagtgacataggc

SEQ ID NO: 8555918 - DNA, 23 bp, Homo sapiens
atcaagtcatcagcaaaatacat

SEQ ID NO: 8555919 - DNA, 18 bp, Homo sapiens
atcaaggaggggaaggtc

SEQ ID NO: 8555920 - DNA, 18 bp, Homo sapiens
atcaaggaggggaaggtc

SEQ ID NO: 8555921 - DNA, 22 bp, Homo sapiens
atcaagttctgtcacatttgtc

SEQ ID NO: 8555922 - DNA, 22 bp, Homo sapiens
atcaatgacagttgaattctac

SEQ ID NO: 8555923 - DNA, 22 bp, Homo sapiens
atcaagagttatatttcatagt

SEQ ID NO: 8555924 - DNA, 22 bp, Homo sapiens
atcaagagaaggggaagatgaa

SEQ ID NO: 8555925 - DNA, 22 bp, Homo sapiens
atcaagcagtgaaaaatgctag

SEQ ID NO: 8555926 - DNA, 22 bp, Homo sapiens
atcaagcacttctacatgacat

SEQ ID NO: 8555927 - DNA, 22 bp, Homo sapiens
atcaagcatatataaaactgca

SEQ ID NO: 8555928 - DNA, 22 bp, Homo sapiens
atcaattcttaggaaaatagct

SEQ ID NO: 8555929 - DNA, 22 bp, Homo sapiens
atcaattttgaggatacaagaa

SEQ ID NO: 8555930 - DNA, 22 bp, Homo sapiens
agaaatctttgaagtgtaatgt

SEQ ID NO: 8555931 - DNA, 22 bp, Homo sapiens
agaaatgctcttcctgaccaga

SEQ ID NO: 8555932 - DNA, 22 bp, Homo sapiens
agaaatgcattagcacatatag

SEQ ID NO: 8555933 - DNA, 22 bp, Homo sapiens
agaaatcaatatctatatgttg

SEQ ID NO: 8555934 - DNA, 22 bp, Homo sapiens
agaaatatgctgattagatgaa

SEQ ID NO: 8555935 - DNA, 22 bp, Homo sapiens
agaaatatgctgattagatgaa

SEQ ID NO: 8555936 - DNA, 22 bp, Homo sapiens
agaaatcacaggaggcagaagg

SEQ ID NO: 8555937 - DNA, 22 bp, Homo sapiens
agaaatcagaaccctgaagttc

SEQ ID NO: 8555938 - DNA, 20 bp, Homo sapiens
agaaatcagcatgtcctctg

SEQ ID NO: 8555939 - DNA, 22 bp, Homo sapiens
agaaatcagaaccctgaagttc

SEQ ID NO: 8555940 - DNA, 22 bp, Homo sapiens
agaaatagtcacattggaggaa

SEQ ID NO: 8555941 - DNA, 22 bp, Homo sapiens
agaaagttttgtgctatatatg

SEQ ID NO: 8555942 - DNA, 19 bp, Homo sapiens
agaaatagccttccttgtc

SEQ ID NO: 8555943 - DNA, 22 bp, Homo sapiens
agaaatatgctgattagatgaa

SEQ ID NO: 8555944 - DNA, 22 bp, Homo sapiens
agaaagtttgtttttatccata

SEQ ID NO: 8555945 - DNA, 22 bp, Homo sapiens
agaaagtttgtttttatccata

SEQ ID NO: 8555946 - DNA, 19 bp, Homo sapiens
agaaatagccttccttgtc

SEQ ID NO: 8555947 - DNA, 22 bp, Homo sapiens
agaaatagcagagtcaggcggg

SEQ ID NO: 8555948 - DNA, 22 bp, Homo sapiens
agaaagttttgtgctatatatg

SEQ ID NO: 8555949 - DNA, 22 bp, Homo sapiens
agaaacttcagctattcttttg

SEQ ID NO: 8555950 - DNA, 22 bp, Homo sapiens
agaaacttcagctattcttttg

SEQ ID NO: 8555951 - DNA, 20 bp, Homo sapiens
agaaacatttcttgagaact

SEQ ID NO: 8555952 - DNA, 21 bp, Homo sapiens
agaaactgactcctagaggca

SEQ ID NO: 8555953 - DNA, 17 bp, Homo sapiens
agaaactgaggctcagt

SEQ ID NO: 8555954 - DNA, 22 bp, Homo sapiens
agaaactgcagctcagagaagt

SEQ ID NO: 8555955 - DNA, 22 bp, Homo sapiens
agaaactgtgttactagaatgt

SEQ ID NO: 8555956 - DNA, 22 bp, Homo sapiens
agaaactgcagctcagagaagt

SEQ ID NO: 8555957 - DNA, 20 bp, Homo sapiens
agaaacatttcttgagaact

SEQ ID NO: 8555958 - DNA, 20 bp, Homo sapiens
agaaacatttcttgagaact

SEQ ID NO: 8555959 - DNA, 20 bp, Homo sapiens
agaaacatttcttgagaact

SEQ ID NO: 8555960 - DNA, 22 bp, Homo sapiens
atatagtttaagaaagtacagt

SEQ ID NO: 8555961 - DNA, 22 bp, Homo sapiens
atatagtcaaacatatatgtgt

SEQ ID NO: 8555962 - DNA, 22 bp, Homo sapiens
atatagtcaaacatatatgtgt

SEQ ID NO: 8555963 - DNA, 22 bp, Homo sapiens
atatagtaagcagtctgtaaat

SEQ ID NO: 8555964 - DNA, 22 bp, Homo sapiens
atataggcttcatgacagaggg

SEQ ID NO: 8555965 - DNA, 19 bp, Homo sapiens
atataggctgaaccatgct

SEQ ID NO: 8555966 - DNA, 22 bp, Homo sapiens
atatagtaagcagtctgtaaat

SEQ ID NO: 8555967 - DNA, 22 bp, Homo sapiens
atataggctaacaactattgag

SEQ ID NO: 8555968 - DNA, 20 bp, Homo sapiens
atataggcatagtaaaatga

SEQ ID NO: 8555969 - DNA, 22 bp, Homo sapiens
atataggttatcatatttgccc

SEQ ID NO: 8555970 - DNA, 22 bp, Homo sapiens
atatagatcaaatgatgctaat

SEQ ID NO: 8555971 - DNA, 19 bp, Homo sapiens
atatagcattattcaattt

SEQ ID NO: 8555972 - DNA, 22 bp, Homo sapiens
atataggcagaaaggaaggcaa

SEQ ID NO: 8555973 - DNA, 22 bp, Homo sapiens
atatagctgaggggtattataa

SEQ ID NO: 8555974 - DNA, 22 bp, Homo sapiens
atatagaaggtgctatttacat

SEQ ID NO: 8555975 - DNA, 22 bp, Homo sapiens
atatagaatacacagggaaagt

SEQ ID NO: 8555976 - DNA, 22 bp, Homo sapiens
atatagaaggtgctatttacat

SEQ ID NO: 8555977 - DNA, 22 bp, Homo sapiens
atatagaatacacagggaaagt

SEQ ID NO: 8555978 - DNA, 20 bp, Homo sapiens
atatagagtcaaaatggctt

SEQ ID NO: 8555979 - DNA, 22 bp, Homo sapiens
atatagacagatgacagggata

SEQ ID NO: 8555980 - DNA, 22 bp, Homo sapiens
atatagaaggtgctatttacat

SEQ ID NO: 8555981 - DNA, 22 bp, Homo sapiens
agaaaagggcaggagggataca

SEQ ID NO: 8555982 - DNA, 22 bp, Homo sapiens
agaaaagggcaggagggataca

SEQ ID NO: 8555983 - DNA, 22 bp, Homo sapiens
atatagaaggtgctatttacat

SEQ ID NO: 8555984 - DNA, 22 bp, Homo sapiens
agaaagagctcgggattaacag

SEQ ID NO: 8555985 - DNA, 22 bp, Homo sapiens
agaaagagctcgggattaacag

SEQ ID NO: 8555986 - DNA, 17 bp, Homo sapiens
agaaagaggatccacag

SEQ ID NO: 8555987 - DNA, 17 bp, Homo sapiens
agaaagaggatccacag

SEQ ID NO: 8555988 - DNA, 17 bp, Homo sapiens
agaaagaggatccacag

SEQ ID NO: 8555989 - DNA, 17 bp, Homo sapiens
agaaagaggatccacag

SEQ ID NO: 8555990 - DNA, 22 bp, Homo sapiens
agaaagaacgttggttatctta

SEQ ID NO: 8555991 - DNA, 22 bp, Homo sapiens
agaaagaacgcacttgtgctgc

SEQ ID NO: 8555992 - DNA, 22 bp, Homo sapiens
agaaagacgtgatgaagaagta

SEQ ID NO: 8555993 - DNA, 22 bp, Homo sapiens
agaaagacgtgatgaagaagta

SEQ ID NO: 8555994 - DNA, 22 bp, Homo sapiens
agaaagaacgttggttatctta

SEQ ID NO: 8555995 - DNA, 22 bp, Homo sapiens
agaaagacaaaatgcagtggct

SEQ ID NO: 8555996 - DNA, 22 bp, Homo sapiens
agaaagaacgttggttatctta

SEQ ID NO: 8555997 - DNA, 22 bp, Homo sapiens
atattaaaactatggttttcag

SEQ ID NO: 8555998 - DNA, 22 bp, Homo sapiens
atattaaaactatggttttcag

SEQ ID NO: 8555999 - DNA, 22 bp, Homo sapiens
atattaaatggattttgggagc

SEQ ID NO: 8556000 - DNA, 22 bp, Homo sapiens
atattaaatggattttgggagc

SEQ ID NO: 8556001 - DNA, 22 bp, Homo sapiens
atattaaatggattttgggagc

SEQ ID NO: 8556002 - DNA, 22 bp, Homo sapiens
atattaatgggatttagtcagg

SEQ ID NO: 8556003 - DNA, 22 bp, Homo sapiens
atattaatgggatttagtcagg

SEQ ID NO: 8556004 - DNA, 22 bp, Homo sapiens
atattaatgggatttagtcagg

SEQ ID NO: 8556005 - DNA, 22 bp, Homo sapiens
atctggaaaacacagtgtagac

SEQ ID NO: 8556006 - DNA, 22 bp, Homo sapiens
agaagctgcgtttatttaaatc

SEQ ID NO: 8556007 - DNA, 22 bp, Homo sapiens
agaagctggaggaagactaagc

SEQ ID NO: 8556008 - DNA, 20 bp, Homo sapiens
agaagctgatactgatggaa

SEQ ID NO: 8556009 - DNA, 22 bp, Homo sapiens
agaagctgcctacatgaccagc

SEQ ID NO: 8556010 - DNA, 22 bp, Homo sapiens
agaagctgcctacatgaccagc

SEQ ID NO: 8556011 - DNA, 22 bp, Homo sapiens
agaagctgcgtttatttaaatc

SEQ ID NO: 8556012 - DNA, 22 bp, Homo sapiens
agaagctgacagatgcagcagg

SEQ ID NO: 8556013 - DNA, 22 bp, Homo sapiens
agaagctgagaatgaattaaga

SEQ ID NO: 8556014 - DNA, 20 bp, Homo sapiens
agaagctgagactgggtttt

SEQ ID NO: 8556015 - DNA, 20 bp, Homo sapiens
agaagctgatactgatggaa

SEQ ID NO: 8556016 - DNA, 20 bp, Homo sapiens
agaagctgagactgggtttt

SEQ ID NO: 8556017 - DNA, 22 bp, Homo sapiens
agaagcgttccatttgatgggt

SEQ ID NO: 8556018 - DNA, 22 bp, Homo sapiens
agaagctcgggtaagctccatt

SEQ ID NO: 8556019 - DNA, 22 bp, Homo sapiens
agaagcctcatcctctctagtg

SEQ ID NO: 8556020 - DNA, 21 bp, Homo sapiens
agaagcctgggtggaggtggg

SEQ ID NO: 8556021 - DNA, 21 bp, Homo sapiens
agaagccatttgttaggactt

SEQ ID NO: 8556022 - DNA, 21 bp, Homo sapiens
agaagccatttgttaggactt

SEQ ID NO: 8556023 - DNA, 22 bp, Homo sapiens
agaagccattgaagcagacctc

SEQ ID NO: 8556024 - DNA, 22 bp, Homo sapiens
agaagccattgaagcagacctc

SEQ ID NO: 8556025 - DNA, 22 bp, Homo sapiens
agaagccattctcagttcctga

SEQ ID NO: 8556026 - DNA, 22 bp, Homo sapiens
agaagccattccctgtaggctc

SEQ ID NO: 8556027 - DNA, 22 bp, Homo sapiens
agaagccattccctgtaggctc

SEQ ID NO: 8556028 - DNA, 22 bp, Homo sapiens
agaagccattccctgtaggctc

SEQ ID NO: 8556029 - DNA, 22 bp, Homo sapiens
agaagccatgtttagtaggatg

SEQ ID NO: 8556030 - DNA, 22 bp, Homo sapiens
agaagccatgtttagtaggatg

SEQ ID NO: 8556031 - DNA, 22 bp, Homo sapiens
agaagccaccagctgaggaaga

SEQ ID NO: 8556032 - DNA, 22 bp, Homo sapiens
agaagccatggtatgcaactac

SEQ ID NO: 8556033 - DNA, 21 bp, Homo sapiens
agaagccatgtggtggagaac

SEQ ID NO: 8556034 - DNA, 21 bp, Homo sapiens
agaagccatgtggtggagaac

SEQ ID NO: 8556035 - DNA, 22 bp, Homo sapiens
agaagccatagtctgggaggca

SEQ ID NO: 8556036 - DNA, 22 bp, Homo sapiens
agaagccatagtctgggaggca

SEQ ID NO: 8556037 - DNA, 22 bp, Homo sapiens
atcctgggaagctgacattgaa

SEQ ID NO: 8556038 - DNA, 22 bp, Homo sapiens
atcctggacagtttcccctatt

SEQ ID NO: 8556039 - DNA, 20 bp, Homo sapiens
atcctggaatccaaatggag

SEQ ID NO: 8556040 - DNA, 22 bp, Homo sapiens
atcctgcttgttacttatagag

SEQ ID NO: 8556041 - DNA, 22 bp, Homo sapiens
atcctgcttgttacttatagag

SEQ ID NO: 8556042 - DNA, 22 bp, Homo sapiens
atcctggaggctggaggcttgc

SEQ ID NO: 8556043 - DNA, 22 bp, Homo sapiens
atcctggacagtttcccctatt

SEQ ID NO: 8556044 - DNA, 22 bp, Homo sapiens
atcctgagctacacctgctcct

SEQ ID NO: 8556045 - DNA, 22 bp, Homo sapiens
atcctgaagcatgaatgtcaaa

SEQ ID NO: 8556046 - DNA, 22 bp, Homo sapiens
atcctgctgctgtggacttctc

SEQ ID NO: 8556047 - DNA, 22 bp, Homo sapiens
atcctgagttctcagagtctcc

SEQ ID NO: 8556048 - DNA, 22 bp, Homo sapiens
atcctgagttctcagagtctcc

SEQ ID NO: 8556049 - DNA, 22 bp, Homo sapiens
atcctgagttctcagagtctcc

SEQ ID NO: 8556050 - DNA, 22 bp, Homo sapiens
atcctgagttcctgcctctaaa

SEQ ID NO: 8556051 - DNA, 22 bp, Homo sapiens
atcctgagttcctgcctctaaa

SEQ ID NO: 8556052 - DNA, 22 bp, Homo sapiens
atcctgaggtactgcagggccg

SEQ ID NO: 8556053 - DNA, 22 bp, Homo sapiens
agaagcagggcagggaaaagca

SEQ ID NO: 8556054 - DNA, 22 bp, Homo sapiens
agaagcactagagggtatggaa

SEQ ID NO: 8556055 - DNA, 22 bp, Homo sapiens
agaagcacggttttgtctagca

SEQ ID NO: 8556056 - DNA, 22 bp, Homo sapiens
agaaatgtttatggctgcctat

SEQ ID NO: 8556057 - DNA, 22 bp, Homo sapiens
agaaatgtttactcaccccctt

SEQ ID NO: 8556058 - DNA, 22 bp, Homo sapiens
agaaatgttgtgggttttgtta

SEQ ID NO: 8556059 - DNA, 22 bp, Homo sapiens
agaaatgttgaatacatcagga

SEQ ID NO: 8556060 - DNA, 22 bp, Homo sapiens
agaaatgttgaatacacaaaat

SEQ ID NO: 8556061 - DNA, 22 bp, Homo sapiens
agaagccaaatgccagtgacct

SEQ ID NO: 8556062 - DNA, 22 bp, Homo sapiens
agaagccaaaggggccagatat

SEQ ID NO: 8556063 - DNA, 22 bp, Homo sapiens
agaagccaaaggggccagatat

SEQ ID NO: 8556064 - DNA, 22 bp, Homo sapiens
agaagccaaatgccagtgacct

SEQ ID NO: 8556065 - DNA, 22 bp, Homo sapiens
agaagccaaaggggccagatat

SEQ ID NO: 8556066 - DNA, 22 bp, Homo sapiens
agaagcattggaccaggggccc

SEQ ID NO: 8556067 - DNA, 20 bp, Homo sapiens
agaagcattcaaagaaaact

SEQ ID NO: 8556068 - DNA, 20 bp, Homo sapiens
agaagcattcaaagaaaact

SEQ ID NO: 8556069 - DNA, 20 bp, Homo sapiens
agaagcattcaaagaaaact

SEQ ID NO: 8556070 - DNA, 22 bp, Homo sapiens
agaagcattataacatgcaagg

SEQ ID NO: 8556071 - DNA, 22 bp, Homo sapiens
agaagcattatttaattttact

SEQ ID NO: 8556072 - DNA, 22 bp, Homo sapiens
agaagcattatttaattttact

SEQ ID NO: 8556073 - DNA, 20 bp, Homo sapiens
agaagcatcattctgatgtc

SEQ ID NO: 8556074 - DNA, 20 bp, Homo sapiens
agaagcatcattctgatgtc

SEQ ID NO: 8556075 - DNA, 22 bp, Homo sapiens
agaagcagttattttttgcaca

SEQ ID NO: 8556076 - DNA, 22 bp, Homo sapiens
agaaatgtccagggctaggatc

SEQ ID NO: 8556077 - DNA, 20 bp, Homo sapiens
agaaatgtgaaaggctgagt

SEQ ID NO: 8556078 - DNA, 22 bp, Homo sapiens
agaaatgtggaggaacagggct

SEQ ID NO: 8556079 - DNA, 22 bp, Homo sapiens
agaaatgtgagccccttatcaa

SEQ ID NO: 8556080 - DNA, 22 bp, Homo sapiens
agaaatgtgaatttcatttcct

SEQ ID NO: 8556081 - DNA, 22 bp, Homo sapiens
agaaatgtgagccccttatcaa

SEQ ID NO: 8556082 - DNA, 22 bp, Homo sapiens
agaaatgttacagttgttattt

SEQ ID NO: 8556083 - DNA, 22 bp, Homo sapiens
agaaatgtggatcgttttaaaa

SEQ ID NO: 8556084 - DNA, 22 bp, Homo sapiens
agaaatgttacagttgttattt

SEQ ID NO: 8556085 - DNA, 22 bp, Homo sapiens
agaaatgttacagttgttattt

SEQ ID NO: 8556086 - DNA, 22 bp, Homo sapiens
agaaatgtcaggaaagaagtcc

SEQ ID NO: 8556087 - DNA, 22 bp, Homo sapiens
agaaatgtcaggaaagaagtcc

SEQ ID NO: 8556088 - DNA, 21 bp, Homo sapiens
agaaatgtatcattcttttcc

SEQ ID NO: 8556089 - DNA, 21 bp, Homo sapiens
agaaatgtatcattcttttcc

SEQ ID NO: 8556090 - DNA, 22 bp, Homo sapiens
agaaatgtatagtgaatttttc

SEQ ID NO: 8556091 - DNA, 22 bp, Homo sapiens
agaaatgtattctgtatgtttt

SEQ ID NO: 8556092 - DNA, 22 bp, Homo sapiens
agaaatgtaattgcaactgtct

SEQ ID NO: 8556093 - DNA, 22 bp, Homo sapiens
agaaatgtacacgacacccaga

SEQ ID NO: 8556094 - DNA, 22 bp, Homo sapiens
agaaatgtacgatgttatgcag

SEQ ID NO: 8556095 - DNA, 22 bp, Homo sapiens
agtgcaatagcaaagaacaaca

SEQ ID NO: 8556096 - DNA, 22 bp, Homo sapiens
agtgctgaagactggctaggga

SEQ ID NO: 8556097 - DNA, 22 bp, Homo sapiens
agtgcaatagcaaagaacaaca

SEQ ID NO: 8556098 - DNA, 22 bp, Homo sapiens
agtgctgtcagttttatagata

SEQ ID NO: 8556099 - DNA, 22 bp, Homo sapiens
agtgctgtctccttcccccggg

SEQ ID NO: 8556100 - DNA, 22 bp, Homo sapiens
agtgctgtccagtttcacaggt

SEQ ID NO: 8556101 - DNA, 22 bp, Homo sapiens
agtgctgtcccgacaactgagg

SEQ ID NO: 8556102 - DNA, 20 bp, Homo sapiens
agtgcaagaaagcacagctg

SEQ ID NO: 8556103 - DNA, 22 bp, Homo sapiens
agtgcaaagggatcagattggg

SEQ ID NO: 8556104 - DNA, 22 bp, Homo sapiens
agtgcaaagcagcctgtacacc

SEQ ID NO: 8556105 - DNA, 22 bp, Homo sapiens
agtgcaaagcagcctgtacacc

SEQ ID NO: 8556106 - DNA, 22 bp, Homo sapiens
agtgcaaagaaatcagctttgt

SEQ ID NO: 8556107 - DNA, 22 bp, Homo sapiens
agtgcaaagaaatcagctttgt

SEQ ID NO: 8556108 - DNA, 22 bp, Homo sapiens
agtgcaaaattcagaagcaatt

SEQ ID NO: 8556109 - DNA, 22 bp, Homo sapiens
agtgcaaactttattgtgacct

SEQ ID NO: 8556110 - DNA, 17 bp, Homo sapiens
agtgagaatgtcatgta

SEQ ID NO: 8556111 - DNA, 22 bp, Homo sapiens
agtgagacagtatactgagcag

SEQ ID NO: 8556112 - DNA, 22 bp, Homo sapiens
agtgagacagtggactctgcat

SEQ ID NO: 8556113 - DNA, 23 bp, Homo sapiens
agtgaattcagtttaaaacagag

SEQ ID NO: 8556114 - DNA, 17 bp, Homo sapiens
agtgagaatgtcatgta

SEQ ID NO: 8556115 - DNA, 22 bp, Homo sapiens
agtcctttgggaaaaatgacta

SEQ ID NO: 8556116 - DNA, 22 bp, Homo sapiens
agtcctttgggaaaaatgacta

SEQ ID NO: 8556117 - DNA, 22 bp, Homo sapiens
agtgaatgtccccgcgggtcag

SEQ ID NO: 8556118 - DNA, 21 bp, Homo sapiens
agtccttgaaactctttcttg

SEQ ID NO: 8556119 - DNA, 18 bp, Homo sapiens
agtccttcttggttttac

SEQ ID NO: 8556120 - DNA, 18 bp, Homo sapiens
agtccttcttggttttac

SEQ ID NO: 8556121 - DNA, 22 bp, Homo sapiens
agtccttccggcagatttcact

SEQ ID NO: 8556122 - DNA, 21 bp, Homo sapiens
agtccttgaaactctttcttg

SEQ ID NO: 8556123 - DNA, 22 bp, Homo sapiens
agtccttcttttagttgcttgg

SEQ ID NO: 8556124 - DNA, 22 bp, Homo sapiens
agtccttcttttagttgcttgg

SEQ ID NO: 8556125 - DNA, 19 bp, Homo sapiens
agtgagcatccagagaggt

SEQ ID NO: 8556126 - DNA, 20 bp, Homo sapiens
agtgagattgctgctctagc

SEQ ID NO: 8556127 - DNA, 22 bp, Homo sapiens
agtgaggcaaagtgagaggcag

SEQ ID NO: 8556128 - DNA, 20 bp, Homo sapiens
agtgaggcagttcagtgggc

SEQ ID NO: 8556129 - DNA, 22 bp, Homo sapiens
agtgagctatgatcatgttact

SEQ ID NO: 8556130 - DNA, 22 bp, Homo sapiens
agtgaggaaatccattatcaag

SEQ ID NO: 8556131 - DNA, 22 bp, Homo sapiens
agtgctttagcatccaactgtc

SEQ ID NO: 8556132 - DNA, 22 bp, Homo sapiens
agtgctttagagaaatggtgct

SEQ ID NO: 8556133 - DNA, 22 bp, Homo sapiens
agtgctttatgttgttgtgcaa

SEQ ID NO: 8556134 - DNA, 22 bp, Homo sapiens
agtgctttccctgaaaccttcc

SEQ ID NO: 8556135 - DNA, 22 bp, Homo sapiens
agtgctttccttcttgtgacat

SEQ ID NO: 8556136 - DNA, 22 bp, Homo sapiens
agtgctgttaggttaatatagt

SEQ ID NO: 8556137 - DNA, 22 bp, Homo sapiens
agtgctgttggataatgctgtc

SEQ ID NO: 8556138 - DNA, 22 bp, Homo sapiens
agtgctgttaggttaatatagt

SEQ ID NO: 8556139 - DNA, 22 bp, Homo sapiens
agtgcttataccaaagactctt

SEQ ID NO: 8556140 - DNA, 22 bp, Homo sapiens
agtgcttaatagatgtccagca

SEQ ID NO: 8556141 - DNA, 22 bp, Homo sapiens
agtgcttaaaaccctgcactag

SEQ ID NO: 8556142 - DNA, 22 bp, Homo sapiens
agtgctttacctagataatgtt

SEQ ID NO: 8556143 - DNA, 22 bp, Homo sapiens
agtggcagagaccccagccagc

SEQ ID NO: 8556144 - DNA, 22 bp, Homo sapiens
agtggcagagcaggtgctggaa

SEQ ID NO: 8556145 - DNA, 22 bp, Homo sapiens
agtggcagagcaggtgctggaa

SEQ ID NO: 8556146 - DNA, 22 bp, Homo sapiens
agtggcagacagagacagtacc

SEQ ID NO: 8556147 - DNA, 22 bp, Homo sapiens
agtggcagacacaatgtgggca

SEQ ID NO: 8556148 - DNA, 22 bp, Homo sapiens
agtgctttgagcgtttgaaaag

SEQ ID NO: 8556149 - DNA, 22 bp, Homo sapiens
agtgctttgaacgaaaggctga

SEQ ID NO: 8556150 - DNA, 22 bp, Homo sapiens
agtgctttcttgctccatcagt

SEQ ID NO: 8556151 - DNA, 22 bp, Homo sapiens
agtgctttggtatagaactatt

SEQ ID NO: 8556152 - DNA, 22 bp, Homo sapiens
agtggcagaagtcactgggtag

SEQ ID NO: 8556153 - DNA, 22 bp, Homo sapiens
agtggcagaagtcactgggtag

SEQ ID NO: 8556154 - DNA, 22 bp, Homo sapiens
agtggcagaagtcactgggtag

SEQ ID NO: 8556155 - DNA, 22 bp, Homo sapiens
agtgggaggcggctgacgggcg

SEQ ID NO: 8556156 - DNA, 16 bp, Homo sapiens
agtgggaggagaaaga

SEQ ID NO: 8556157 - DNA, 22 bp, Homo sapiens
agtgggaggaagtggtgatatt

SEQ ID NO: 8556158 - DNA, 22 bp, Homo sapiens
agtgggaggaagtggtgatatt

SEQ ID NO: 8556159 - DNA, 22 bp, Homo sapiens
agtggggccgcggtcctgccct

SEQ ID NO: 8556160 - DNA, 22 bp, Homo sapiens
agtggggccgcggtcctgccct

SEQ ID NO: 8556161 - DNA, 22 bp, Homo sapiens
agtggggccgcggtcctgccct

SEQ ID NO: 8556162 - DNA, 22 bp, Homo sapiens
agtgggaggcggctgacgggcg

SEQ ID NO: 8556163 - DNA, 22 bp, Homo sapiens
agtgggagcggcagtcggggac

SEQ ID NO: 8556164 - DNA, 22 bp, Homo sapiens
agtgggagccagcagcttgggg

SEQ ID NO: 8556165 - DNA, 22 bp, Homo sapiens
agtgggagcggcagtcggggac

SEQ ID NO: 8556166 - DNA, 22 bp, Homo sapiens
agtgggagccagcagcttgggg

SEQ ID NO: 8556167 - DNA, 22 bp, Homo sapiens
agtgggagcggcagtcggggac

SEQ ID NO: 8556168 - DNA, 22 bp, Homo sapiens
agtgggagcggcagtcggggac

SEQ ID NO: 8556169 - DNA, 22 bp, Homo sapiens
agtgggaggaagtggtgatatt

SEQ ID NO: 8556170 - DNA, 23 bp, Homo sapiens
agtggctggacagactttcctgg

SEQ ID NO: 8556171 - DNA, 20 bp, Homo sapiens
agtgggagagggcagactgc

SEQ ID NO: 8556172 - DNA, 22 bp, Homo sapiens
agtgggagccagcagcttgggg

SEQ ID NO: 8556173 - DNA, 20 bp, Homo sapiens
agtgggagagggcagactgc

SEQ ID NO: 8556174 - DNA, 22 bp, Homo sapiens
agtggctggaattgcaggtgcg

SEQ ID NO: 8556175 - DNA, 22 bp, Homo sapiens
agtggcagagccaagatatgat

SEQ ID NO: 8556176 - DNA, 22 bp, Homo sapiens
agtggcagagccaagtagagcc

SEQ ID NO: 8556177 - DNA, 22 bp, Homo sapiens
agtggcagagccaagtagagcc

SEQ ID NO: 8556178 - DNA, 22 bp, Homo sapiens
agtggcagagccaagatatgat

SEQ ID NO: 8556179 - DNA, 20 bp, Homo sapiens
agtgtctggtgcagggcctc

SEQ ID NO: 8556180 - DNA, 20 bp, Homo sapiens
agtgtctggtgcagggcctc

SEQ ID NO: 8556181 - DNA, 20 bp, Homo sapiens
agtgtctggtgcagggcctc

SEQ ID NO: 8556182 - DNA, 22 bp, Homo sapiens
agtgtctgtgaggggaattcct

SEQ ID NO: 8556183 - DNA, 22 bp, Homo sapiens
agtgtctgtgatgaggtcagga

SEQ ID NO: 8556184 - DNA, 22 bp, Homo sapiens
agtgtctgaaccaccggggcat

SEQ ID NO: 8556185 - DNA, 22 bp, Homo sapiens
agtgtctgaaccaccggggcat

SEQ ID NO: 8556186 - DNA, 22 bp, Homo sapiens
agtgtctggtgagggctctctc

SEQ ID NO: 8556187 - DNA, 22 bp, Homo sapiens
agtgtctgaacctgcagtggga

SEQ ID NO: 8556188 - DNA, 22 bp, Homo sapiens
agtgtctgttacgcttgcagaa

SEQ ID NO: 8556189 - DNA, 22 bp, Homo sapiens
agtgtctgttgagtttcaaaag

SEQ ID NO: 8556190 - DNA, 22 bp, Homo sapiens
agtgtctgttacgcttgcagaa

SEQ ID NO: 8556191 - DNA, 22 bp, Homo sapiens
agtgtctgtgttttctattgct

SEQ ID NO: 8556192 - DNA, 22 bp, Homo sapiens
agtgtctgtgctttgcagcaaa

SEQ ID NO: 8556193 - DNA, 22 bp, Homo sapiens
agtgggggccaacgagggcagc

SEQ ID NO: 8556194 - DNA, 22 bp, Homo sapiens
agtgggggccaacgagggcagc

SEQ ID NO: 8556195 - DNA, 21 bp, Homo sapiens
agtggggtctctgtggaggcc

SEQ ID NO: 8556196 - DNA, 22 bp, Homo sapiens
agtggggtcctcagtatggttc

SEQ ID NO: 8556197 - DNA, 22 bp, Homo sapiens
agtgggggctggctctgtctgt

SEQ ID NO: 8556198 - DNA, 22 bp, Homo sapiens
agtggggcggacaggaccagga

SEQ ID NO: 8556199 - DNA, 22 bp, Homo sapiens
agtggggcggacaggaccagga

SEQ ID NO: 8556200 - DNA, 22 bp, Homo sapiens
agtgggggcagagcctctctcg

SEQ ID NO: 8556201 - DNA, 22 bp, Homo sapiens
agtgggggcagagcctctctcg

SEQ ID NO: 8556202 - DNA, 22 bp, Homo sapiens
agtggggccggtgaggccgagg

SEQ ID NO: 8556203 - DNA, 22 bp, Homo sapiens
agtggggccggtgaggccgagg

SEQ ID NO: 8556204 - DNA, 19 bp, Homo sapiens
agtgtgtactgaaagcact

SEQ ID NO: 8556205 - DNA, 22 bp, Homo sapiens
agtgtgtactcatatacttcca

SEQ ID NO: 8556206 - DNA, 22 bp, Homo sapiens
agtgtgtactcatatacttcca

SEQ ID NO: 8556207 - DNA, 22 bp, Homo sapiens
agtgtgtacatttggtgcagtt

SEQ ID NO: 8556208 - DNA, 19 bp, Homo sapiens
agtgtgtactgaaagcact

SEQ ID NO: 8556209 - DNA, 22 bp, Homo sapiens
agtgtgtagcaatatgctggca

SEQ ID NO: 8556210 - DNA, 22 bp, Homo sapiens
agtgtgtagcacatggtaagca

SEQ ID NO: 8556211 - DNA, 22 bp, Homo sapiens
agtgtgtcagttgaaagagatt

SEQ ID NO: 8556212 - DNA, 22 bp, Homo sapiens
agtgtgtagcatttggcaggca

SEQ ID NO: 8556213 - DNA, 22 bp, Homo sapiens
agtgtgtcgagggagggtccag

SEQ ID NO: 8556214 - DNA, 20 bp, Homo sapiens
agtgtgtctcggaggtaagt

SEQ ID NO: 8556215 - DNA, 22 bp, Homo sapiens
agtgtgtctgatcacttgtgag

SEQ ID NO: 8556216 - DNA, 23 bp, Homo sapiens
agtgtgtattgctgagggcagct

SEQ ID NO: 8556217 - DNA, 22 bp, Homo sapiens
agtgtgtccagaaatctgtatt

SEQ ID NO: 8556218 - DNA, 22 bp, Homo sapiens
agtgtgtccaggaagcagatgg

SEQ ID NO: 8556219 - DNA, 22 bp, Homo sapiens
agtgtgtcgagggagggtccag

SEQ ID NO: 8556220 - DNA, 17 bp, Homo sapiens
agtgtgtgaaatggtgg

SEQ ID NO: 8556221 - DNA, 17 bp, Homo sapiens
agtgtgtgaaatggtgg

SEQ ID NO: 8556222 - DNA, 22 bp, Homo sapiens
agtgtgtcttatcctgggagaa

SEQ ID NO: 8556223 - DNA, 17 bp, Homo sapiens
agtgtgtgaaatggtgg

SEQ ID NO: 8556224 - DNA, 22 bp, Homo sapiens
agtgtgtgaccttttaatttaa

SEQ ID NO: 8556225 - DNA, 17 bp, Homo sapiens
agtgtgtaacttgtgta

SEQ ID NO: 8556226 - DNA, 22 bp, Homo sapiens
agtgtgtaagggatcaaagagt

SEQ ID NO: 8556227 - DNA, 22 bp, Homo sapiens
agtgtgtacataattgtacgcc

SEQ ID NO: 8556228 - DNA, 22 bp, Homo sapiens
agtgtgtaattcagtgcccagc

SEQ ID NO: 8556229 - DNA, 22 bp, Homo sapiens
agtgtgtacataattgtacgcc

SEQ ID NO: 8556230 - DNA, 22 bp, Homo sapiens
agtgtgtaatgccaggggctgc

SEQ ID NO: 8556231 - DNA, 23 bp, Homo sapiens
agtgtgtaaggtactttgctgct

SEQ ID NO: 8556232 - DNA, 22 bp, Homo sapiens
agtgtgggttttatggagccct

SEQ ID NO: 8556233 - DNA, 22 bp, Homo sapiens
agtgtggtcgggagcgcggggc

SEQ ID NO: 8556234 - DNA, 22 bp, Homo sapiens
agtgtgggtgagggaggccctc

SEQ ID NO: 8556235 - DNA, 22 bp, Homo sapiens
agtgtggggtcaccggcccagg

SEQ ID NO: 8556236 - DNA, 22 bp, Homo sapiens
agtgtggggtcaccggcccagg

SEQ ID NO: 8556237 - DNA, 22 bp, Homo sapiens
agtgtgggttttatggagccct

SEQ ID NO: 8556238 - DNA, 22 bp, Homo sapiens
agtgtgggttttatggagccct

SEQ ID NO: 8556239 - DNA, 22 bp, Homo sapiens
agtgtgggttttatggagccct

SEQ ID NO: 8556240 - DNA, 22 bp, Homo sapiens
agtgtgggtgagggaggccctc

SEQ ID NO: 8556241 - DNA, 22 bp, Homo sapiens
agtgtgggtgagggaggccctc

SEQ ID NO: 8556242 - DNA, 22 bp, Homo sapiens
agtgtgggtgagggaggccctc

SEQ ID NO: 8556243 - DNA, 22 bp, Homo sapiens
agtgtcttacatgaattgattt

SEQ ID NO: 8556244 - DNA, 22 bp, Homo sapiens
agtgtctgttgttcagaactct

SEQ ID NO: 8556245 - DNA, 22 bp, Homo sapiens
agtgtctgttgagtttcaaaag

SEQ ID NO: 8556246 - DNA, 22 bp, Homo sapiens
agtgtctgttgcttttgcagtg

SEQ ID NO: 8556247 - DNA, 22 bp, Homo sapiens
agtgtctgttgttcagaactct

SEQ ID NO: 8556248 - DNA, 22 bp, Homo sapiens
agtgtctttcatatcctccatc

SEQ ID NO: 8556249 - DNA, 22 bp, Homo sapiens
agtgtctttatagactgacaat

SEQ ID NO: 8556250 - DNA, 22 bp, Homo sapiens
agtgtctttcatatcctccatc

SEQ ID NO: 8556251 - DNA, 22 bp, Homo sapiens
agtgtcttcatgatgtggcagc

SEQ ID NO: 8556252 - DNA, 22 bp, Homo sapiens
agtgtctttagcaagtttagtc

SEQ ID NO: 8556253 - DNA, 19 bp, Homo sapiens
agttatttctaaatttacc

SEQ ID NO: 8556254 - DNA, 22 bp, Homo sapiens
agttattttggaaaatgagtca

SEQ ID NO: 8556255 - DNA, 22 bp, Homo sapiens
agttatttggctatagatggta

SEQ ID NO: 8556256 - DNA, 22 bp, Homo sapiens
agttacatgtgaatagaaagta

SEQ ID NO: 8556257 - DNA, 23 bp, Homo sapiens
agttcaaaatcaaccaggacact

SEQ ID NO: 8556258 - DNA, 22 bp, Homo sapiens
agttcacaagcgtaggtgctga

SEQ ID NO: 8556259 - DNA, 22 bp, Homo sapiens
agttacaaccatgacacaagca

SEQ ID NO: 8556260 - DNA, 22 bp, Homo sapiens
agttacaaccatgacacaagca

SEQ ID NO: 8556261 - DNA, 22 bp, Homo sapiens
agttacaagctattttacttaa

SEQ ID NO: 8556262 - DNA, 21 bp, Homo sapiens
agttacaagtttattcagagg

SEQ ID NO: 8556263 - DNA, 22 bp, Homo sapiens
agttacacaacttatcacatct

SEQ ID NO: 8556264 - DNA, 21 bp, Homo sapiens
agttacatgtatagataaagt

SEQ ID NO: 8556265 - DNA, 21 bp, Homo sapiens
agttacatgtatagataaagt

SEQ ID NO: 8556266 - DNA, 22 bp, Homo sapiens
actggggcctcctccatgctct

SEQ ID NO: 8556267 - DNA, 22 bp, Homo sapiens
actggggcctcctccatgctct

SEQ ID NO: 8556268 - DNA, 22 bp, Homo sapiens
actggggcctcctccatgctct

SEQ ID NO: 8556269 - DNA, 22 bp, Homo sapiens
actggggtttaggcctgggcaa

SEQ ID NO: 8556270 - DNA, 22 bp, Homo sapiens
actggggcagtgggcagtggtt

SEQ ID NO: 8556271 - DNA, 22 bp, Homo sapiens
actggggcagtgggcagtggtt

SEQ ID NO: 8556272 - DNA, 22 bp, Homo sapiens
actggggcagtgggcagtggtt

SEQ ID NO: 8556273 - DNA, 22 bp, Homo sapiens
actggggattagggactcagtg

SEQ ID NO: 8556274 - DNA, 22 bp, Homo sapiens
actggggcaggaaagtatgctg

SEQ ID NO: 8556275 - DNA, 22 bp, Homo sapiens
actggtggctttcagacagaaa

SEQ ID NO: 8556276 - DNA, 22 bp, Homo sapiens
agttacaaacactatcagttct

SEQ ID NO: 8556277 - DNA, 22 bp, Homo sapiens
agttacaaacactatcagttct

SEQ ID NO: 8556278 - DNA, 22 bp, Homo sapiens
agttacaaccatgacacaagca

SEQ ID NO: 8556279 - DNA, 19 bp, Homo sapiens
agttaatgagcttttgatc

SEQ ID NO: 8556280 - DNA, 22 bp, Homo sapiens
agttaatgagcattttggaatg

SEQ ID NO: 8556281 - DNA, 17 bp, Homo sapiens
agttaaggctctttgct

SEQ ID NO: 8556282 - DNA, 22 bp, Homo sapiens
agttaagggggttcatctgtaa

SEQ ID NO: 8556283 - DNA, 22 bp, Homo sapiens
agggtgcaaaagcaaggacagt

SEQ ID NO: 8556284 - DNA, 22 bp, Homo sapiens
agggtgcagaacaaattaagac

SEQ ID NO: 8556285 - DNA, 23 bp, Homo sapiens
agggtgagcaagctatggagacc

SEQ ID NO: 8556286 - DNA, 22 bp, Homo sapiens
agggtgcagtcacaggaaatgt

SEQ ID NO: 8556287 - DNA, 22 bp, Homo sapiens
agggtgcagtcacaggaaatgt

SEQ ID NO: 8556288 - DNA, 22 bp, Homo sapiens
agggtgcaggtgtggagtctag

SEQ ID NO: 8556289 - DNA, 22 bp, Homo sapiens
agggtgcaggggaagctgccct

SEQ ID NO: 8556290 - DNA, 22 bp, Homo sapiens
agggtgcagggacaggtgtgca

SEQ ID NO: 8556291 - DNA, 22 bp, Homo sapiens
agggtgcagaaggagcctagga

SEQ ID NO: 8556292 - DNA, 22 bp, Homo sapiens
agggtgcagaaggagcctagga

SEQ ID NO: 8556293 - DNA, 22 bp, Homo sapiens
agggtccatgtttccagttaat

SEQ ID NO: 8556294 - DNA, 22 bp, Homo sapiens
agggtccatcaaggactgcaca

SEQ ID NO: 8556295 - DNA, 22 bp, Homo sapiens
agggtcccgaaggagacagcaa

SEQ ID NO: 8556296 - DNA, 22 bp, Homo sapiens
agggtcccgaaggagacagcaa

SEQ ID NO: 8556297 - DNA, 22 bp, Homo sapiens
agggtccagtaacagatgccag

SEQ ID NO: 8556298 - DNA, 23 bp, Homo sapiens
agggtccagggatcaccaggtgt

SEQ ID NO: 8556299 - DNA, 22 bp, Homo sapiens
agggtccagtaacagatgccag

SEQ ID NO: 8556300 - DNA, 22 bp, Homo sapiens
agggtccatcaaggactgcaca

SEQ ID NO: 8556301 - DNA, 19 bp, Homo sapiens
agggtccagggagcggctc

SEQ ID NO: 8556302 - DNA, 19 bp, Homo sapiens
agggtccagggagcggctc

SEQ ID NO: 8556303 - DNA, 19 bp, Homo sapiens
agggtccaggccctgtgga

SEQ ID NO: 8556304 - DNA, 22 bp, Homo sapiens
agggtcagttctgtgaggtgtt

SEQ ID NO: 8556305 - DNA, 22 bp, Homo sapiens
agggtcagttctgtgaggtgtt

SEQ ID NO: 8556306 - DNA, 22 bp, Homo sapiens
agggtcagtgatgagggagccc

SEQ ID NO: 8556307 - DNA, 22 bp, Homo sapiens
agggtcagtgatgagggagccc

SEQ ID NO: 8556308 - DNA, 22 bp, Homo sapiens
agggtcagttctgtgaggtgtt

SEQ ID NO: 8556309 - DNA, 18 bp, Homo sapiens
agggtcagtgtcactggc

SEQ ID NO: 8556310 - DNA, 22 bp, Homo sapiens
aggtgcaggagctgtgcaggga

SEQ ID NO: 8556311 - DNA, 22 bp, Homo sapiens
aggtgcaggagctgtgcaggga

SEQ ID NO: 8556312 - DNA, 21 bp, Homo sapiens
aggtgcaggcctcaagcccca

SEQ ID NO: 8556313 - DNA, 19 bp, Homo sapiens
aggtgcaggtcacagggga

SEQ ID NO: 8556314 - DNA, 19 bp, Homo sapiens
aggtgcaggtcacagggga

SEQ ID NO: 8556315 - DNA, 19 bp, Homo sapiens
aggtgcaggtcacagggga

SEQ ID NO: 8556316 - DNA, 22 bp, Homo sapiens
agggtgcatgtttgcaagagtg

SEQ ID NO: 8556317 - DNA, 22 bp, Homo sapiens
agggtgcatgtttgcaagagtg

SEQ ID NO: 8556318 - DNA, 22 bp, Homo sapiens
aggtgaggataggtggccaagg

SEQ ID NO: 8556319 - DNA, 22 bp, Homo sapiens
aggtgaggataggtggccaagg

SEQ ID NO: 8556320 - DNA, 22 bp, Homo sapiens
agggtgcctgctgcaggttcag

SEQ ID NO: 8556321 - DNA, 22 bp, Homo sapiens
aggtgaggataggtggccaagg

SEQ ID NO: 8556322 - DNA, 22 bp, Homo sapiens
aggtgccacctctggtgctgtc

SEQ ID NO: 8556323 - DNA, 22 bp, Homo sapiens
aggtgccactctcatgggctac

SEQ ID NO: 8556324 - DNA, 21 bp, Homo sapiens
aggtgccaaggagaagcaggc

SEQ ID NO: 8556325 - DNA, 22 bp, Homo sapiens
aggtgccaattttcagtgaaca

SEQ ID NO: 8556326 - DNA, 22 bp, Homo sapiens
aggtggaaatggctttcctagg

SEQ ID NO: 8556327 - DNA, 22 bp, Homo sapiens
aggtgccagatgcacagctgaa

SEQ ID NO: 8556328 - DNA, 21 bp, Homo sapiens
aggtgccaaggagaagcaggc

SEQ ID NO: 8556329 - DNA, 22 bp, Homo sapiens
aggtgccaagatgtcacagaca

SEQ ID NO: 8556330 - DNA, 23 bp, Homo sapiens
aggtgccaactgagagctgagag

SEQ ID NO: 8556331 - DNA, 22 bp, Homo sapiens
aggtgcagtgaaggaaaaggaa

SEQ ID NO: 8556332 - DNA, 17 bp, Homo sapiens
aggtgggtggatcacct

SEQ ID NO: 8556333 - DNA, 17 bp, Homo sapiens
aggtgggtggatcacct

SEQ ID NO: 8556334 - DNA, 19 bp, Homo sapiens
aggtggtctaggctggaga

SEQ ID NO: 8556335 - DNA, 21 bp, Homo sapiens
aggtggtctgcagcagctgaa

SEQ ID NO: 8556336 - DNA, 22 bp, Homo sapiens
aggtggtcttggcccacccagg

SEQ ID NO: 8556337 - DNA, 22 bp, Homo sapiens
aggtggggttcagtctcagccg

SEQ ID NO: 8556338 - DNA, 22 bp, Homo sapiens
aggtgggtcctggctctgccat

SEQ ID NO: 8556339 - DNA, 22 bp, Homo sapiens
aggtgggtgcctatgtatgtat

SEQ ID NO: 8556340 - DNA, 19 bp, Homo sapiens
aggtgggtaagcagttctc

SEQ ID NO: 8556341 - DNA, 19 bp, Homo sapiens
aggtgggtaagcagttctc

SEQ ID NO: 8556342 - DNA, 22 bp, Homo sapiens
aggtgggtatcatgagagatta

SEQ ID NO: 8556343 - DNA, 22 bp, Homo sapiens
aggtggagaagagatgggcagt

SEQ ID NO: 8556344 - DNA, 22 bp, Homo sapiens
aggtggagaagagatgggcagt

SEQ ID NO: 8556345 - DNA, 22 bp, Homo sapiens
aggtggagaagagatgggcagt

SEQ ID NO: 8556346 - DNA, 22 bp, Homo sapiens
aggtggagaagagatgggcagt

SEQ ID NO: 8556347 - DNA, 22 bp, Homo sapiens
aggtggaacgttcaggtgctag

SEQ ID NO: 8556348 - DNA, 22 bp, Homo sapiens
aggtggagaagagatgggcagt

SEQ ID NO: 8556349 - DNA, 22 bp, Homo sapiens
aggtggagacccagagaaggcg

SEQ ID NO: 8556350 - DNA, 22 bp, Homo sapiens
aggtggagacccagagaaggcg

SEQ ID NO: 8556351 - DNA, 22 bp, Homo sapiens
aggtggagacccagagaaggcg

SEQ ID NO: 8556352 - DNA, 22 bp, Homo sapiens
aggtggagacccagagaaggcg

SEQ ID NO: 8556353 - DNA, 22 bp, Homo sapiens
aggtggagacccagagaaggcg

SEQ ID NO: 8556354 - DNA, 22 bp, Homo sapiens
aggtggagacccagagaaggcg

SEQ ID NO: 8556355 - DNA, 22 bp, Homo sapiens
aggtggagacccagagaaggcg

SEQ ID NO: 8556356 - DNA, 22 bp, Homo sapiens
aggtggagacccagagaaggcg

SEQ ID NO: 8556357 - DNA, 16 bp, Homo sapiens
aggtggagaagttcac

SEQ ID NO: 8556358 - DNA, 21 bp, Homo sapiens
aggttcctgagtcatgcctta

SEQ ID NO: 8556359 - DNA, 23 bp, Homo sapiens
aggtggtcttgtggatgctgcaa

SEQ ID NO: 8556360 - DNA, 22 bp, Homo sapiens
aggtgtctggacttgtgaagca

SEQ ID NO: 8556361 - DNA, 23 bp, Homo sapiens
aggttctcttatcatctctgccc

SEQ ID NO: 8556362 - DNA, 22 bp, Homo sapiens
aggttctggagaacttggaggt

SEQ ID NO: 8556363 - DNA, 22 bp, Homo sapiens
aggttctcacacgtctacaccc

SEQ ID NO: 8556364 - DNA, 22 bp, Homo sapiens
aggttcgggcacttacaaatgg

SEQ ID NO: 8556365 - DNA, 22 bp, Homo sapiens
aggttccttatggggatggcta

SEQ ID NO: 8556366 - DNA, 22 bp, Homo sapiens
actcacaggactctgcatatag

SEQ ID NO: 8556367 - DNA, 22 bp, Homo sapiens
actcagagcctcgagggactgc

SEQ ID NO: 8556368 - DNA, 22 bp, Homo sapiens
actcagctaaactcagtctatg

SEQ ID NO: 8556369 - DNA, 22 bp, Homo sapiens
actcagcacagcactgggaacc

SEQ ID NO: 8556370 - DNA, 22 bp, Homo sapiens
actcagctcaggagctggctgg

SEQ ID NO: 8556371 - DNA, 22 bp, Homo sapiens
actcagctaaactcagtctatg

SEQ ID NO: 8556372 - DNA, 22 bp, Homo sapiens
actcagctcaggagctggctgg

SEQ ID NO: 8556373 - DNA, 22 bp, Homo sapiens
actcagctgatgaagcacaagt

SEQ ID NO: 8556374 - DNA, 22 bp, Homo sapiens
actcagctgatgaagcacaagt

SEQ ID NO: 8556375 - DNA, 22 bp, Homo sapiens
actcagagtgcatctcctattt

SEQ ID NO: 8556376 - DNA, 22 bp, Homo sapiens
actcagaggcagctgctcaccc

SEQ ID NO: 8556377 - DNA, 22 bp, Homo sapiens
actcagagcttggctccttgct

SEQ ID NO: 8556378 - DNA, 22 bp, Homo sapiens
agtaagcaccgggatggtcaag

SEQ ID NO: 8556379 - DNA, 22 bp, Homo sapiens
agtaagcaccgggatggtcaag

SEQ ID NO: 8556380 - DNA, 22 bp, Homo sapiens
agtaacttaggagatacatggg

SEQ ID NO: 8556381 - DNA, 22 bp, Homo sapiens
agtaactatgcttgagaatcag

SEQ ID NO: 8556382 - DNA, 22 bp, Homo sapiens
agtaacatctttgacatttgtt

SEQ ID NO: 8556383 - DNA, 22 bp, Homo sapiens
actcagcttcctacagctagaa

SEQ ID NO: 8556384 - DNA, 22 bp, Homo sapiens
actcagcttcctacagctagaa

SEQ ID NO: 8556385 - DNA, 22 bp, Homo sapiens
actcagcttcctacagctagaa

SEQ ID NO: 8556386 - DNA, 22 bp, Homo sapiens
agtaacagtaacatcttcctag

SEQ ID NO: 8556387 - DNA, 23 bp, Homo sapiens
agtaacatgcaaataacagtctg

SEQ ID NO: 8556388 - DNA, 22 bp, Homo sapiens
agtaacatctttgacatttgtt

SEQ ID NO: 8556389 - DNA, 22 bp, Homo sapiens
agtaacatgagtttttctaatg

SEQ ID NO: 8556390 - DNA, 22 bp, Homo sapiens
agtcagtggctccgagcctggt

SEQ ID NO: 8556391 - DNA, 23 bp, Homo sapiens
agtcagtgtaagtttggaatgca

SEQ ID NO: 8556392 - DNA, 22 bp, Homo sapiens
agtcagtgtagaaagcccaggc

SEQ ID NO: 8556393 - DNA, 22 bp, Homo sapiens
agtcagtgacttttgctgagag

SEQ ID NO: 8556394 - DNA, 22 bp, Homo sapiens
agtcagtgaaggcattgctcaa

SEQ ID NO: 8556395 - DNA, 22 bp, Homo sapiens
agtcagtgaatggtgtatgcta

SEQ ID NO: 8556396 - DNA, 22 bp, Homo sapiens
agtcagtcaccatttaagaaca

SEQ ID NO: 8556397 - DNA, 22 bp, Homo sapiens
agtcagtgaaaactagaatgtt

SEQ ID NO: 8556398 - DNA, 22 bp, Homo sapiens
agtcagtcaaaatataaattgt

SEQ ID NO: 8556399 - DNA, 22 bp, Homo sapiens
agtcagtatttattacttagct

SEQ ID NO: 8556400 - DNA, 22 bp, Homo sapiens
agtcaggtggttctgctccact

SEQ ID NO: 8556401 - DNA, 19 bp, Homo sapiens
agtcaggtggctggtgcca

SEQ ID NO: 8556402 - DNA, 22 bp, Homo sapiens
agtaataatagctgtaaagtgc

SEQ ID NO: 8556403 - DNA, 22 bp, Homo sapiens
agtaaggcatttttcatgttta

SEQ ID NO: 8556404 - DNA, 22 bp, Homo sapiens
agtaataaactctttttatctc

SEQ ID NO: 8556405 - DNA, 22 bp, Homo sapiens
agtcctgtctctcccagggcca

SEQ ID NO: 8556406 - DNA, 22 bp, Homo sapiens
agtccttcaagaaatctggaaa

SEQ ID NO: 8556407 - DNA, 22 bp, Homo sapiens
agtccttcccatctgacaccct

SEQ ID NO: 8556408 - DNA, 22 bp, Homo sapiens
agtccttcccatctgacaccct

SEQ ID NO: 8556409 - DNA, 22 bp, Homo sapiens
agtccttcacgtcctgcttatt

SEQ ID NO: 8556410 - DNA, 22 bp, Homo sapiens
agtcctggtgacactcctcttc

SEQ ID NO: 8556411 - DNA, 22 bp, Homo sapiens
agtcctggttctgattctgaca

SEQ ID NO: 8556412 - DNA, 22 bp, Homo sapiens
agtcctgggttctggtgttttg

SEQ ID NO: 8556413 - DNA, 22 bp, Homo sapiens
agtcctgggtgtgcaaggcaga

SEQ ID NO: 8556414 - DNA, 22 bp, Homo sapiens
actctgtaattctatatgcagt

SEQ ID NO: 8556415 - DNA, 22 bp, Homo sapiens
actctggggtgatgtctctgag

SEQ ID NO: 8556416 - DNA, 22 bp, Homo sapiens
actctgggccccaggtggagct

SEQ ID NO: 8556417 - DNA, 22 bp, Homo sapiens
actctgggctgttaggagctgt

SEQ ID NO: 8556418 - DNA, 22 bp, Homo sapiens
actctgggctttgatttgttac

SEQ ID NO: 8556419 - DNA, 22 bp, Homo sapiens
agtccaggagttgggtgacatt

SEQ ID NO: 8556420 - DNA, 22 bp, Homo sapiens
agtccagccttcaatcttagtg

SEQ ID NO: 8556421 - DNA, 22 bp, Homo sapiens
agtccagatcatgcagcaaacc

SEQ ID NO: 8556422 - DNA, 22 bp, Homo sapiens
actctgggagaggacaaacaaa

SEQ ID NO: 8556423 - DNA, 22 bp, Homo sapiens
actctgggatcttgaaaagagt

SEQ ID NO: 8556424 - DNA, 22 bp, Homo sapiens
actctgggcccaccctcagagt

SEQ ID NO: 8556425 - DNA, 22 bp, Homo sapiens
acatttctcaggtaagtcattt

SEQ ID NO: 8556426 - DNA, 22 bp, Homo sapiens
acatttctcaggtaagtcattt

SEQ ID NO: 8556427 - DNA, 22 bp, Homo sapiens
acatttctcaggtaagtcattt

SEQ ID NO: 8556428 - DNA, 22 bp, Homo sapiens
acatttctcatctagtagagta

SEQ ID NO: 8556429 - DNA, 22 bp, Homo sapiens
acatttctcattctcccctaac

SEQ ID NO: 8556430 - DNA, 22 bp, Homo sapiens
acatttctcatctagtagagta

SEQ ID NO: 8556431 - DNA, 22 bp, Homo sapiens
acatttctcaggtaagtcattt

SEQ ID NO: 8556432 - DNA, 22 bp, Homo sapiens
acatttctcataggagagccac

SEQ ID NO: 8556433 - DNA, 22 bp, Homo sapiens
acatttctcataggagagccac

SEQ ID NO: 8556434 - DNA, 22 bp, Homo sapiens
acatttctccctgcatgcctgc

SEQ ID NO: 8556435 - DNA, 22 bp, Homo sapiens
acatttctcattctcccctaac

SEQ ID NO: 8556436 - DNA, 22 bp, Homo sapiens
acatttctcattctcccctaac

SEQ ID NO: 8556437 - DNA, 22 bp, Homo sapiens
acatttctccctgcatgcctgc

SEQ ID NO: 8556438 - DNA, 22 bp, Homo sapiens
acatttctccctgcatgcctgc

SEQ ID NO: 8556439 - DNA, 22 bp, Homo sapiens
acatttctccctgcatgcctgc

SEQ ID NO: 8556440 - DNA, 18 bp, Homo sapiens
acatttctccttctgacc

SEQ ID NO: 8556441 - DNA, 18 bp, Homo sapiens
acatttctccttctgacc

SEQ ID NO: 8556442 - DNA, 22 bp, Homo sapiens
acatttctcctacttgttattt

SEQ ID NO: 8556443 - DNA, 22 bp, Homo sapiens
acatttctccttgcaggagtca

SEQ ID NO: 8556444 - DNA, 18 bp, Homo sapiens
acatttctccttctgacc

SEQ ID NO: 8556445 - DNA, 22 bp, Homo sapiens
acatttctccttgcaggagtca

SEQ ID NO: 8556446 - DNA, 18 bp, Homo sapiens
acatttctctctgcgtga

SEQ ID NO: 8556447 - DNA, 18 bp, Homo sapiens
acatttctctctgcgtga

SEQ ID NO: 8556448 - DNA, 22 bp, Homo sapiens
aggctggctggggatgcgtctt

SEQ ID NO: 8556449 - DNA, 22 bp, Homo sapiens
aggctggccagtgctgcagtgg

SEQ ID NO: 8556450 - DNA, 22 bp, Homo sapiens
aggctggcttggctctcctgtg

SEQ ID NO: 8556451 - DNA, 23 bp, Homo sapiens
aggctggcttcaggagcctctcc

SEQ ID NO: 8556452 - DNA, 23 bp, Homo sapiens
aggctggcttcaggagcctctcc

SEQ ID NO: 8556453 - DNA, 22 bp, Homo sapiens
aggctgcagaacagtcaggtgc

SEQ ID NO: 8556454 - DNA, 22 bp, Homo sapiens
aggctgctctgcgaagtcagct

SEQ ID NO: 8556455 - DNA, 23 bp, Homo sapiens
aggctgcagaagaatagggtcat

SEQ ID NO: 8556456 - DNA, 22 bp, Homo sapiens
aggctgcagaacagtcaggtgc

SEQ ID NO: 8556457 - DNA, 22 bp, Homo sapiens
acatttctcagggagttttgct

SEQ ID NO: 8556458 - DNA, 22 bp, Homo sapiens
acatttctcagggagttttgct

SEQ ID NO: 8556459 - DNA, 22 bp, Homo sapiens
aggctgctggcaggcgtggacg

SEQ ID NO: 8556460 - DNA, 19 bp, Homo sapiens
aggctgtgagggaggactc

SEQ ID NO: 8556461 - DNA, 19 bp, Homo sapiens
aggctgtgagggaggactc

SEQ ID NO: 8556462 - DNA, 19 bp, Homo sapiens
aggctgtgaggggaaggaa

SEQ ID NO: 8556463 - DNA, 22 bp, Homo sapiens
aggctgtgatctcatgatttgt

SEQ ID NO: 8556464 - DNA, 22 bp, Homo sapiens
aggctgtgagttttgtctcaga

SEQ ID NO: 8556465 - DNA, 22 bp, Homo sapiens
aggctgtgaggggcccgcatgc

SEQ ID NO: 8556466 - DNA, 22 bp, Homo sapiens
aggctgtgagtagttcttgttg

SEQ ID NO: 8556467 - DNA, 19 bp, Homo sapiens
aggctgtgagggaggactc

SEQ ID NO: 8556468 - DNA, 22 bp, Homo sapiens
aggctgtgagcaagaacaccta

SEQ ID NO: 8556469 - DNA, 22 bp, Homo sapiens
aggctgtgagaggtggctccca

SEQ ID NO: 8556470 - DNA, 22 bp, Homo sapiens
aggctgtgagaagtccttcagt

SEQ ID NO: 8556471 - DNA, 22 bp, Homo sapiens
aggctgtgagaagtccttcagt

SEQ ID NO: 8556472 - DNA, 22 bp, Homo sapiens
aggctgggaaacctgaagttgt

SEQ ID NO: 8556473 - DNA, 22 bp, Homo sapiens
aggctgggaaacctgaagttgt

SEQ ID NO: 8556474 - DNA, 22 bp, Homo sapiens
aggctgggaaacctgaagttgt

SEQ ID NO: 8556475 - DNA, 22 bp, Homo sapiens
aggctggctttggtagcatggt

SEQ ID NO: 8556476 - DNA, 22 bp, Homo sapiens
aggctgggaaatgtattccagc

SEQ ID NO: 8556477 - DNA, 22 bp, Homo sapiens
aggctgggaaatgtattccagc

SEQ ID NO: 8556478 - DNA, 22 bp, Homo sapiens
aggctgggaaatgtagtcttcc

SEQ ID NO: 8556479 - DNA, 22 bp, Homo sapiens
aggctgggaaatgtagtcttcc

SEQ ID NO: 8556480 - DNA, 22 bp, Homo sapiens
aggctgggaaacctgaagttgt

SEQ ID NO: 8556481 - DNA, 22 bp, Homo sapiens
aggctgggaaatgtagtcttcc

SEQ ID NO: 8556482 - DNA, 22 bp, Homo sapiens
accagacactgtgaagacaggc

SEQ ID NO: 8556483 - DNA, 22 bp, Homo sapiens
accagaagctggagcacaagga

SEQ ID NO: 8556484 - DNA, 22 bp, Homo sapiens
accagaaaggaataatagaatt

SEQ ID NO: 8556485 - DNA, 22 bp, Homo sapiens
accactgggcgggcagcctgct

SEQ ID NO: 8556486 - DNA, 22 bp, Homo sapiens
accactgggcgggcagcctgct

SEQ ID NO: 8556487 - DNA, 22 bp, Homo sapiens
accactggttttgcagaggcgc

SEQ ID NO: 8556488 - DNA, 22 bp, Homo sapiens
accactgtacagcagatatagt

SEQ ID NO: 8556489 - DNA, 22 bp, Homo sapiens
accactttacagaaatggaaag

SEQ ID NO: 8556490 - DNA, 22 bp, Homo sapiens
accactttggtatttcaatttt

SEQ ID NO: 8556491 - DNA, 22 bp, Homo sapiens
accacaggacccatgagtcagt

SEQ ID NO: 8556492 - DNA, 22 bp, Homo sapiens
accacaggacccatgagtcagt

SEQ ID NO: 8556493 - DNA, 22 bp, Homo sapiens
aggctgtgattccaccactctc

SEQ ID NO: 8556494 - DNA, 22 bp, Homo sapiens
aggctgtgatgagcctcatgga

SEQ ID NO: 8556495 - DNA, 22 bp, Homo sapiens
aggctgtgatgagcctcatgga

SEQ ID NO: 8556496 - DNA, 22 bp, Homo sapiens
aggctgtgatgagcctcatgga

SEQ ID NO: 8556497 - DNA, 22 bp, Homo sapiens
aggctgtgatggatgtaaagga

SEQ ID NO: 8556498 - DNA, 22 bp, Homo sapiens
accactgcccatggtgaaaact

SEQ ID NO: 8556499 - DNA, 22 bp, Homo sapiens
accactgcccatggtgaaaact

SEQ ID NO: 8556500 - DNA, 22 bp, Homo sapiens
accactgcccatggtgaaaact

SEQ ID NO: 8556501 - DNA, 22 bp, Homo sapiens
accactggctcaggagctggga

SEQ ID NO: 8556502 - DNA, 22 bp, Homo sapiens
accactgggcgggcagcctgct

SEQ ID NO: 8556503 - DNA, 22 bp, Homo sapiens
accactgggcgggcagcctgct

SEQ ID NO: 8556504 - DNA, 22 bp, Homo sapiens
accactggatatcagagatgta

SEQ ID NO: 8556505 - DNA, 22 bp, Homo sapiens
acatgtaagactagcttaaagt

SEQ ID NO: 8556506 - DNA, 21 bp, Homo sapiens
acatgtaagagagtttcaaga

SEQ ID NO: 8556507 - DNA, 22 bp, Homo sapiens
acatgtaagactagcttaaagt

SEQ ID NO: 8556508 - DNA, 22 bp, Homo sapiens
acatgtaacatatatgtagcat

SEQ ID NO: 8556509 - DNA, 22 bp, Homo sapiens
acatgtaaaaggaacatgcatg

SEQ ID NO: 8556510 - DNA, 22 bp, Homo sapiens
acatgtaaacatttacagtatt

SEQ ID NO: 8556511 - DNA, 22 bp, Homo sapiens
acatgtaaacatttacagtatt

SEQ ID NO: 8556512 - DNA, 22 bp, Homo sapiens
acatggctaaagcaagtctaga

SEQ ID NO: 8556513 - DNA, 22 bp, Homo sapiens
acatggctaaagcaagtctaga

SEQ ID NO: 8556514 - DNA, 22 bp, Homo sapiens
acatgtaaaagataaattaaca

SEQ ID NO: 8556515 - DNA, 22 bp, Homo sapiens
acatgtaaaagataaattaaca

SEQ ID NO: 8556516 - DNA, 22 bp, Homo sapiens
acatgtattgacattatattct

SEQ ID NO: 8556517 - DNA, 22 bp, Homo sapiens
acatgtatacaatgtgtaatga

SEQ ID NO: 8556518 - DNA, 22 bp, Homo sapiens
acatgtcaatttagtactctta

SEQ ID NO: 8556519 - DNA, 22 bp, Homo sapiens
acatgtctccacccatcttaaa

SEQ ID NO: 8556520 - DNA, 20 bp, Homo sapiens
acatgtactaatgaatacag

SEQ ID NO: 8556521 - DNA, 20 bp, Homo sapiens
acatgtactaatgaatacag

SEQ ID NO: 8556522 - DNA, 20 bp, Homo sapiens
acatgtactaatgaatacag

SEQ ID NO: 8556523 - DNA, 22 bp, Homo sapiens
acatgtacatacacatatgtaa

SEQ ID NO: 8556524 - DNA, 21 bp, Homo sapiens
acatgtaagagagtttcaaga

SEQ ID NO: 8556525 - DNA, 21 bp, Homo sapiens
acatgtaagagagtttcaaga

SEQ ID NO: 8556526 - DNA, 22 bp, Homo sapiens
acatgtacatacacatatgtaa

SEQ ID NO: 8556527 - DNA, 20 bp, Homo sapiens
acatgtactaatgaatacag

SEQ ID NO: 8556528 - DNA, 20 bp, Homo sapiens
aggctcagctgagctcttgg

SEQ ID NO: 8556529 - DNA, 22 bp, Homo sapiens
aggctcagctggtggtgatcgc

SEQ ID NO: 8556530 - DNA, 22 bp, Homo sapiens
aggctcaggaggagctgccgga

SEQ ID NO: 8556531 - DNA, 20 bp, Homo sapiens
aggctcagctgagctcttgg

SEQ ID NO: 8556532 - DNA, 20 bp, Homo sapiens
aggctcagctgagctcttgg

SEQ ID NO: 8556533 - DNA, 22 bp, Homo sapiens
acatgtgaaatctcatagttag

SEQ ID NO: 8556534 - DNA, 22 bp, Homo sapiens
acatgtcttttaaagtctaata

SEQ ID NO: 8556535 - DNA, 22 bp, Homo sapiens
acatgtcttgtggctttgatct

SEQ ID NO: 8556536 - DNA, 22 bp, Homo sapiens
acatgtcttttaaagtctaata

SEQ ID NO: 8556537 - DNA, 22 bp, Homo sapiens
acatgtcttttaaagtctaata

SEQ ID NO: 8556538 - DNA, 22 bp, Homo sapiens
acatgtctcttctgaaagacaa

SEQ ID NO: 8556539 - DNA, 21 bp, Homo sapiens
acatgtctctaatctcagtga

SEQ ID NO: 8556540 - DNA, 21 bp, Homo sapiens
acatgtctctaatctcagtga

SEQ ID NO: 8556541 - DNA, 22 bp, Homo sapiens
acatgtctccacccatcttaaa

SEQ ID NO: 8556542 - DNA, 21 bp, Homo sapiens
acatgtctctaatctcagtga

SEQ ID NO: 8556543 - DNA, 22 bp, Homo sapiens
acatgtgctcttgctgtacagc

SEQ ID NO: 8556544 - DNA, 22 bp, Homo sapiens
acatgtggtcaatctgtgtagg

SEQ ID NO: 8556545 - DNA, 22 bp, Homo sapiens
aggctcaggtctcaggtctggc

SEQ ID NO: 8556546 - DNA, 22 bp, Homo sapiens
aggctcaggtctcaggtctggc

SEQ ID NO: 8556547 - DNA, 22 bp, Homo sapiens
aggctcaggtctcaggtctggc

SEQ ID NO: 8556548 - DNA, 22 bp, Homo sapiens
aggctcaggtctcaggtctggc

SEQ ID NO: 8556549 - DNA, 20 bp, Homo sapiens
aggctcagggtgtttaggaa

SEQ ID NO: 8556550 - DNA, 22 bp, Homo sapiens
acattaaaatggagaattttga

SEQ ID NO: 8556551 - DNA, 22 bp, Homo sapiens
acattaaaaaatgttgcatgaa

SEQ ID NO: 8556552 - DNA, 22 bp, Homo sapiens
acattaacaccgtgagtttggt

SEQ ID NO: 8556553 - DNA, 22 bp, Homo sapiens
acattaacaccataagtgtgtt

SEQ ID NO: 8556554 - DNA, 22 bp, Homo sapiens
acattaacaccataagtgtgtt

SEQ ID NO: 8556555 - DNA, 22 bp, Homo sapiens
aggctccagtctcctctggcag

SEQ ID NO: 8556556 - DNA, 22 bp, Homo sapiens
acattaacactggtgctggtgt

SEQ ID NO: 8556557 - DNA, 22 bp, Homo sapiens
aggctccagtctcctctggcag

SEQ ID NO: 8556558 - DNA, 22 bp, Homo sapiens
aggctccttgttcatcatccat

SEQ ID NO: 8556559 - DNA, 22 bp, Homo sapiens
acattaaagagtaaggttagtt

SEQ ID NO: 8556560 - DNA, 22 bp, Homo sapiens
acattaaacttgcttggctgta

SEQ ID NO: 8556561 - DNA, 22 bp, Homo sapiens
acattaaatttcatagtgatta

SEQ ID NO: 8556562 - DNA, 22 bp, Homo sapiens
acattaaatttcatagtgatta

SEQ ID NO: 8556563 - DNA, 22 bp, Homo sapiens
acattaaatttcatagtgatta

SEQ ID NO: 8556564 - DNA, 22 bp, Homo sapiens
acattaaatttcatagtgatta

SEQ ID NO: 8556565 - DNA, 22 bp, Homo sapiens
aggctctctctgcccctgggac

SEQ ID NO: 8556566 - DNA, 22 bp, Homo sapiens
aggctctcctccccaggaccat

SEQ ID NO: 8556567 - DNA, 22 bp, Homo sapiens
aggctctctagaaactgtgcct

SEQ ID NO: 8556568 - DNA, 22 bp, Homo sapiens
aggctctcaccctctgaccaga

SEQ ID NO: 8556569 - DNA, 22 bp, Homo sapiens
aggctctcagatcagccacatt

SEQ ID NO: 8556570 - DNA, 22 bp, Homo sapiens
aggctctggagttagccaggca

SEQ ID NO: 8556571 - DNA, 22 bp, Homo sapiens
aggctctgacccatgggaccca

SEQ ID NO: 8556572 - DNA, 22 bp, Homo sapiens
agggctcagcatctcattctgt

SEQ ID NO: 8556573 - DNA, 22 bp, Homo sapiens
agggctcagccagcctgtgtgc

SEQ ID NO: 8556574 - DNA, 22 bp, Homo sapiens
agggctcagcctcctcctcagc

SEQ ID NO: 8556575 - DNA, 22 bp, Homo sapiens
agggctcaggggccccaagctg

SEQ ID NO: 8556576 - DNA, 22 bp, Homo sapiens
agggctcagggcacgtcatcca

SEQ ID NO: 8556577 - DNA, 22 bp, Homo sapiens
agggctcagaaagcaggttttc

SEQ ID NO: 8556578 - DNA, 22 bp, Homo sapiens
agggctcagaaatgtctacggg

SEQ ID NO: 8556579 - DNA, 22 bp, Homo sapiens
agggctcagaacaatgagtgta

SEQ ID NO: 8556580 - DNA, 22 bp, Homo sapiens
agggctcagagcaaaagggcac

SEQ ID NO: 8556581 - DNA, 22 bp, Homo sapiens
agggctgacaaatggcagtgac

SEQ ID NO: 8556582 - DNA, 22 bp, Homo sapiens
agggctgacaaatggcagtgac

SEQ ID NO: 8556583 - DNA, 22 bp, Homo sapiens
agggctgacaaatggcagtgac

SEQ ID NO: 8556584 - DNA, 23 bp, Homo sapiens
agggctgaatgcagagaagcaga

SEQ ID NO: 8556585 - DNA, 22 bp, Homo sapiens
agggctgaagggaggtgctcat

SEQ ID NO: 8556586 - DNA, 22 bp, Homo sapiens
agggctcagtaaacggtggatt

SEQ ID NO: 8556587 - DNA, 22 bp, Homo sapiens
agggctcagggtcaccatctgt

SEQ ID NO: 8556588 - DNA, 22 bp, Homo sapiens
agggctcagttgcctggagccc

SEQ ID NO: 8556589 - DNA, 22 bp, Homo sapiens
aggggagccgaggggcatctgt

SEQ ID NO: 8556590 - DNA, 22 bp, Homo sapiens
aggggagccgaggggcatctgt

SEQ ID NO: 8556591 - DNA, 22 bp, Homo sapiens
aggggagccgaggggcatctgt

SEQ ID NO: 8556592 - DNA, 22 bp, Homo sapiens
aggggagcccctggtcctggtg

SEQ ID NO: 8556593 - DNA, 22 bp, Homo sapiens
aggggagcccctggtcctggtg

SEQ ID NO: 8556594 - DNA, 22 bp, Homo sapiens
aggggagcccctggtcctggtg

SEQ ID NO: 8556595 - DNA, 22 bp, Homo sapiens
aggggagccgaggggcatctgt

SEQ ID NO: 8556596 - DNA, 22 bp, Homo sapiens
aggggagccagggctgcgagtt

SEQ ID NO: 8556597 - DNA, 22 bp, Homo sapiens
aggggagccagggctgcgagtt

SEQ ID NO: 8556598 - DNA, 22 bp, Homo sapiens
aggggagcaaggccgtggtgta

SEQ ID NO: 8556599 - DNA, 22 bp, Homo sapiens
aggggagcaaggccgtggtgta

SEQ ID NO: 8556600 - DNA, 22 bp, Homo sapiens
aggggagcaacatagtcactct

SEQ ID NO: 8556601 - DNA, 22 bp, Homo sapiens
aggggcagttccaagttttgtg

SEQ ID NO: 8556602 - DNA, 22 bp, Homo sapiens
aggggcagttccaagttttgtg

SEQ ID NO: 8556603 - DNA, 22 bp, Homo sapiens
aggggcaggtgctgcacttaga

SEQ ID NO: 8556604 - DNA, 22 bp, Homo sapiens
aggggcaggtgctgcacttaga

SEQ ID NO: 8556605 - DNA, 22 bp, Homo sapiens
aggggagcgacattccgtgccg

SEQ ID NO: 8556606 - DNA, 22 bp, Homo sapiens
aggggagctaacaccagagccc

SEQ ID NO: 8556607 - DNA, 22 bp, Homo sapiens
aggggagctaacaccagagccc

SEQ ID NO: 8556608 - DNA, 22 bp, Homo sapiens
aggggagctaacaccagagccc

SEQ ID NO: 8556609 - DNA, 22 bp, Homo sapiens
aggggagctaacaccagagccc

SEQ ID NO: 8556610 - DNA, 22 bp, Homo sapiens
aggggagcttgaggcatggcct

SEQ ID NO: 8556611 - DNA, 22 bp, Homo sapiens
aggggagcttgcctggtcaccc

SEQ ID NO: 8556612 - DNA, 22 bp, Homo sapiens
aggggagcttgcctggtcaccc

SEQ ID NO: 8556613 - DNA, 22 bp, Homo sapiens
aggggagcttgcctggtcaccc

SEQ ID NO: 8556614 - DNA, 22 bp, Homo sapiens
aggggtgtgcatcctggaggat

SEQ ID NO: 8556615 - DNA, 22 bp, Homo sapiens
aggggttggatttggcctagag

SEQ ID NO: 8556616 - DNA, 23 bp, Homo sapiens
aggggtggtcagtacccgcagtg

SEQ ID NO: 8556617 - DNA, 23 bp, Homo sapiens
aggggtggtcagtacccgcagtg

SEQ ID NO: 8556618 - DNA, 23 bp, Homo sapiens
aggggtggtcagtacccgcagtg

SEQ ID NO: 8556619 - DNA, 23 bp, Homo sapiens
aggggtggtcagtacccgcagtg

SEQ ID NO: 8556620 - DNA, 20 bp, Homo sapiens
agggtcagtagcacagagct

SEQ ID NO: 8556621 - DNA, 22 bp, Homo sapiens
aggggttggatttggcctagag

SEQ ID NO: 8556622 - DNA, 22 bp, Homo sapiens
agggtcagtgatgagggagccc

SEQ ID NO: 8556623 - DNA, 22 bp, Homo sapiens
agggtcagtgatgagggagccc

SEQ ID NO: 8556624 - DNA, 22 bp, Homo sapiens
agggtcagtagtgatgcgtgaa

SEQ ID NO: 8556625 - DNA, 22 bp, Homo sapiens
aggggtggagagtgttgccagt

SEQ ID NO: 8556626 - DNA, 22 bp, Homo sapiens
aggggtggagagtgttgccagt

SEQ ID NO: 8556627 - DNA, 22 bp, Homo sapiens
aggggtggagagtgttgccagt

SEQ ID NO: 8556628 - DNA, 22 bp, Homo sapiens
aggggtgatttgggacaggaca

SEQ ID NO: 8556629 - DNA, 22 bp, Homo sapiens
aggggtgatttgggacaggaca

SEQ ID NO: 8556630 - DNA, 22 bp, Homo sapiens
aggggtggagagtgttgccagt

SEQ ID NO: 8556631 - DNA, 22 bp, Homo sapiens
aggggtggagagtgttgccagt

SEQ ID NO: 8556632 - DNA, 22 bp, Homo sapiens
aggggtggcctgccttactccc

SEQ ID NO: 8556633 - DNA, 22 bp, Homo sapiens
aggggtggcctgccttactccc

SEQ ID NO: 8556634 - DNA, 22 bp, Homo sapiens
aggggtgatttgggacaggaca

SEQ ID NO: 8556635 - DNA, 20 bp, Homo sapiens
aggggtgatcgggtgacact

SEQ ID NO: 8556636 - DNA, 22 bp, Homo sapiens
acctccagctttttagagacat

SEQ ID NO: 8556637 - DNA, 22 bp, Homo sapiens
acctccatggctcagtttcaga

SEQ ID NO: 8556638 - DNA, 22 bp, Homo sapiens
acctcccagaaagttttgcagg

SEQ ID NO: 8556639 - DNA, 22 bp, Homo sapiens
aggggtgacacatatcagtgca

SEQ ID NO: 8556640 - DNA, 22 bp, Homo sapiens
acctcccagctctgagcttggg

SEQ ID NO: 8556641 - DNA, 22 bp, Homo sapiens
acctcccagaaagttttgcagg

SEQ ID NO: 8556642 - DNA, 22 bp, Homo sapiens
accctttcttactcacacgctc

SEQ ID NO: 8556643 - DNA, 18 bp, Homo sapiens
accctttccaaactgcag

SEQ ID NO: 8556644 - DNA, 22 bp, Homo sapiens
accctttcttactcacacgctc

SEQ ID NO: 8556645 - DNA, 20 bp, Homo sapiens
aggggcctggaacaggcctt

SEQ ID NO: 8556646 - DNA, 22 bp, Homo sapiens
aggggcctggacatggacgcgc

SEQ ID NO: 8556647 - DNA, 20 bp, Homo sapiens
aggggcctggaacaggcctt

SEQ ID NO: 8556648 - DNA, 22 bp, Homo sapiens
aggggcctcgcaggaccgctcc

SEQ ID NO: 8556649 - DNA, 22 bp, Homo sapiens
aggggcctcgcaggaccgctcc

SEQ ID NO: 8556650 - DNA, 22 bp, Homo sapiens
aggggcctcgcaggaccgctcc

SEQ ID NO: 8556651 - DNA, 22 bp, Homo sapiens
aggggcctcctcattggagtgt

SEQ ID NO: 8556652 - DNA, 22 bp, Homo sapiens
aggggcctcagcctcctggtca

SEQ ID NO: 8556653 - DNA, 22 bp, Homo sapiens
aggggcctcagcctcctggtca

SEQ ID NO: 8556654 - DNA, 22 bp, Homo sapiens
aggggcctcctcattggagtgt

SEQ ID NO: 8556655 - DNA, 22 bp, Homo sapiens
aggggccaccaccaaggaaggt

SEQ ID NO: 8556656 - DNA, 21 bp, Homo sapiens
aggggcccttgccaggacgcc

SEQ ID NO: 8556657 - DNA, 21 bp, Homo sapiens
aggggcccttgccaggacgcc

SEQ ID NO: 8556658 - DNA, 22 bp, Homo sapiens
aggggccatgtaagtgtatcac

SEQ ID NO: 8556659 - DNA, 22 bp, Homo sapiens
aggggccattgttctgcccgct

SEQ ID NO: 8556660 - DNA, 22 bp, Homo sapiens
accctttgtcaagcacagaaga

SEQ ID NO: 8556661 - DNA, 21 bp, Homo sapiens
acctcaagcaacaaccaaggt

SEQ ID NO: 8556662 - DNA, 21 bp, Homo sapiens
acctcaagcaacaaccaaggt

SEQ ID NO: 8556663 - DNA, 22 bp, Homo sapiens
acctcacaagtctctgtcagct

SEQ ID NO: 8556664 - DNA, 22 bp, Homo sapiens
acctcagagatacaaaccatgg

SEQ ID NO: 8556665 - DNA, 22 bp, Homo sapiens
acctcacaagtctctgtcagct

SEQ ID NO: 8556666 - DNA, 22 bp, Homo sapiens
acctcacaagtctctgtcagct

SEQ ID NO: 8556667 - DNA, 22 bp, Homo sapiens
acctcaggatgtggacacagaa

SEQ ID NO: 8556668 - DNA, 22 bp, Homo sapiens
acctcagttcaattcagttaga

SEQ ID NO: 8556669 - DNA, 22 bp, Homo sapiens
acctccagctttttagagacat

SEQ ID NO: 8556670 - DNA, 22 bp, Homo sapiens
acctcagctatttcaaaacaga

SEQ ID NO: 8556671 - DNA, 22 bp, Homo sapiens
acctcaggatgtggacacagaa

SEQ ID NO: 8556672 - DNA, 22 bp, Homo sapiens
agggccagcactcctggcagga

SEQ ID NO: 8556673 - DNA, 22 bp, Homo sapiens
agggccagcactcctggcagga

SEQ ID NO: 8556674 - DNA, 22 bp, Homo sapiens
agggccagcactcctggcagga

SEQ ID NO: 8556675 - DNA, 22 bp, Homo sapiens
agggccagcactcctggcagga

SEQ ID NO: 8556676 - DNA, 22 bp, Homo sapiens
agggccagcagcttggccaacc

SEQ ID NO: 8556677 - DNA, 22 bp, Homo sapiens
agggccagcccataatgccaaa

SEQ ID NO: 8556678 - DNA, 22 bp, Homo sapiens
agggccagcccataatgccaaa

SEQ ID NO: 8556679 - DNA, 22 bp, Homo sapiens
agggccagcccataatgccaaa

SEQ ID NO: 8556680 - DNA, 22 bp, Homo sapiens
agggccagccaggccctacaaa

SEQ ID NO: 8556681 - DNA, 22 bp, Homo sapiens
agggccagccaggccctacaaa

SEQ ID NO: 8556682 - DNA, 22 bp, Homo sapiens
agggccagcagcttggccaacc

SEQ ID NO: 8556683 - DNA, 22 bp, Homo sapiens
agggcatgctggaggagagaca

SEQ ID NO: 8556684 - DNA, 22 bp, Homo sapiens
agggcatgctggaggagagaca

SEQ ID NO: 8556685 - DNA, 22 bp, Homo sapiens
agggccagatgaagccacaagc

SEQ ID NO: 8556686 - DNA, 22 bp, Homo sapiens
agggccagatgaagccacaagc

SEQ ID NO: 8556687 - DNA, 22 bp, Homo sapiens
agggccagtaccaggtgggtgg

SEQ ID NO: 8556688 - DNA, 22 bp, Homo sapiens
agggccagtattaaggtaatta

SEQ ID NO: 8556689 - DNA, 22 bp, Homo sapiens
agggccagtgggttgaaaggca

SEQ ID NO: 8556690 - DNA, 22 bp, Homo sapiens
agggccagtcgtgtattactgt

SEQ ID NO: 8556691 - DNA, 22 bp, Homo sapiens
agggccagttcagaggacatgg

SEQ ID NO: 8556692 - DNA, 22 bp, Homo sapiens
agggccagtgggttgaaaggca

SEQ ID NO: 8556693 - DNA, 22 bp, Homo sapiens
agggccagtgggttgaaaggca

SEQ ID NO: 8556694 - DNA, 22 bp, Homo sapiens
agggccagtaaatgtttcctca

SEQ ID NO: 8556695 - DNA, 22 bp, Homo sapiens
agggccagccccaccctctctg

SEQ ID NO: 8556696 - DNA, 22 bp, Homo sapiens
agggccagtaccaggtgggtgg

SEQ ID NO: 8556697 - DNA, 22 bp, Homo sapiens
agggccagtaccaggtgggtgg

SEQ ID NO: 8556698 - DNA, 22 bp, Homo sapiens
agggccagtaccaggtgggtgg

SEQ ID NO: 8556699 - DNA, 22 bp, Homo sapiens
agggccagtaccaggtgggtgg

SEQ ID NO: 8556700 - DNA, 22 bp, Homo sapiens
agggcctgtcagcggtgtcctg

SEQ ID NO: 8556701 - DNA, 22 bp, Homo sapiens
agggctcaagggcatgctacgt

SEQ ID NO: 8556702 - DNA, 22 bp, Homo sapiens
agggctcaatggtgggcatgta

SEQ ID NO: 8556703 - DNA, 22 bp, Homo sapiens
agggctcaccactgtgcactcc

SEQ ID NO: 8556704 - DNA, 22 bp, Homo sapiens
agggccagttctacctctgaat

SEQ ID NO: 8556705 - DNA, 22 bp, Homo sapiens
agggccagttctacctctgaat

SEQ ID NO: 8556706 - DNA, 22 bp, Homo sapiens
agggccagttctacctctgaat

SEQ ID NO: 8556707 - DNA, 22 bp, Homo sapiens
agggccagttcagaggacatgg

SEQ ID NO: 8556708 - DNA, 22 bp, Homo sapiens
agggccagttcagaggacatgg

SEQ ID NO: 8556709 - DNA, 22 bp, Homo sapiens
agggaggcattagctactgcga

SEQ ID NO: 8556710 - DNA, 22 bp, Homo sapiens
agggaggtaggagcttctagct

SEQ ID NO: 8556711 - DNA, 22 bp, Homo sapiens
agggaggtccatccctgcagag

SEQ ID NO: 8556712 - DNA, 20 bp, Homo sapiens
agggaggtgctgggcctgag

SEQ ID NO: 8556713 - DNA, 22 bp, Homo sapiens
agggaggtctggctgccctgag

SEQ ID NO: 8556714 - DNA, 22 bp, Homo sapiens
agggaggtctggctgccctgag

SEQ ID NO: 8556715 - DNA, 20 bp, Homo sapiens
agggaggtgctgggcctgag

SEQ ID NO: 8556716 - DNA, 22 bp, Homo sapiens
agggaggtggttccccagtgga

SEQ ID NO: 8556717 - DNA, 22 bp, Homo sapiens
agggagtcaacacagtaatgtt

SEQ ID NO: 8556718 - DNA, 22 bp, Homo sapiens
agggcaagggttgaagataaga

SEQ ID NO: 8556719 - DNA, 22 bp, Homo sapiens
agggcaatggactacaaaaggt

SEQ ID NO: 8556720 - DNA, 22 bp, Homo sapiens
agggcaagttgagtgtgcgtgg

SEQ ID NO: 8556721 - DNA, 22 bp, Homo sapiens
agggcaatccagccagctgatc

SEQ ID NO: 8556722 - DNA, 22 bp, Homo sapiens
agggcacaagactctgagcccc

SEQ ID NO: 8556723 - DNA, 22 bp, Homo sapiens
agggcacagcctaaagcctatg

SEQ ID NO: 8556724 - DNA, 22 bp, Homo sapiens
agggcacatctgctgggaatgg

SEQ ID NO: 8556725 - DNA, 22 bp, Homo sapiens
agggcacatctgctgggaatgg

SEQ ID NO: 8556726 - DNA, 19 bp, Homo sapiens
agggcacagggacagaagg

SEQ ID NO: 8556727 - DNA, 22 bp, Homo sapiens
accagagatggggcttctctgt

SEQ ID NO: 8556728 - DNA, 22 bp, Homo sapiens
accagagatgtctaataggggc

SEQ ID NO: 8556729 - DNA, 22 bp, Homo sapiens
accagagcagactactggaggt

SEQ ID NO: 8556730 - DNA, 22 bp, Homo sapiens
accagagcagactactggaggt

SEQ ID NO: 8556731 - DNA, 22 bp, Homo sapiens
accagagagcctaggctgggca

SEQ ID NO: 8556732 - DNA, 22 bp, Homo sapiens
accagagagcctaggctgggca

SEQ ID NO: 8556733 - DNA, 20 bp, Homo sapiens
accagagacctgaatcagtt

SEQ ID NO: 8556734 - DNA, 20 bp, Homo sapiens
accagagacctgaatcagtt

SEQ ID NO: 8556735 - DNA, 22 bp, Homo sapiens
accagagaaaacacagcaggct

SEQ ID NO: 8556736 - DNA, 22 bp, Homo sapiens
accagagaaaacacagcaggct

SEQ ID NO: 8556737 - DNA, 22 bp, Homo sapiens
agggaggatctgctccttgtct

SEQ ID NO: 8556738 - DNA, 22 bp, Homo sapiens
agggaggatagtagtcagttta

SEQ ID NO: 8556739 - DNA, 22 bp, Homo sapiens
agggaggatagtagtcagttta

SEQ ID NO: 8556740 - DNA, 22 bp, Homo sapiens
agggagctgactggctgccatt

SEQ ID NO: 8556741 - DNA, 20 bp, Homo sapiens
accagagctctcagtatgtg

SEQ ID NO: 8556742 - DNA, 22 bp, Homo sapiens
accagagcccatctgctcctag

SEQ ID NO: 8556743 - DNA, 22 bp, Homo sapiens
accagagcagactactggaggt

SEQ ID NO: 8556744 - DNA, 22 bp, Homo sapiens
accagagcgctcaagccttccc

SEQ ID NO: 8556745 - DNA, 22 bp, Homo sapiens
acaggcctgtgtgcacacgagg

SEQ ID NO: 8556746 - DNA, 22 bp, Homo sapiens
acaggccttaggagagatgggg

SEQ ID NO: 8556747 - DNA, 22 bp, Homo sapiens
acaggccttggcaggcatgtga

SEQ ID NO: 8556748 - DNA, 22 bp, Homo sapiens
acaggccttggcaggcatgtga

SEQ ID NO: 8556749 - DNA, 18 bp, Homo sapiens
acaggctattgcaggaga

SEQ ID NO: 8556750 - DNA, 22 bp, Homo sapiens
aggaaataagggcacttcagat

SEQ ID NO: 8556751 - DNA, 22 bp, Homo sapiens
aggaaataagggacaagacaaa

SEQ ID NO: 8556752 - DNA, 22 bp, Homo sapiens
acaggcctgtgtgcacacgagg

SEQ ID NO: 8556753 - DNA, 22 bp, Homo sapiens
aggaaataggaccagacaaagc

SEQ ID NO: 8556754 - DNA, 22 bp, Homo sapiens
aggaaataagggcacttcagat

SEQ ID NO: 8556755 - DNA, 19 bp, Homo sapiens
acagggcagcaataggata

SEQ ID NO: 8556756 - DNA, 22 bp, Homo sapiens
acagggcacctgaggtaggaag

SEQ ID NO: 8556757 - DNA, 21 bp, Homo sapiens
acaggctctggggatgctggg

SEQ ID NO: 8556758 - DNA, 22 bp, Homo sapiens
acagggcacctgaggtaggaag

SEQ ID NO: 8556759 - DNA, 22 bp, Homo sapiens
acagggcacctgaggtaggaag

SEQ ID NO: 8556760 - DNA, 22 bp, Homo sapiens
acagggcagtgtcttgaaaaat

SEQ ID NO: 8556761 - DNA, 22 bp, Homo sapiens
acagggcaggtggctactggtc

SEQ ID NO: 8556762 - DNA, 22 bp, Homo sapiens
acagggcaggtggctactggtc

SEQ ID NO: 8556763 - DNA, 22 bp, Homo sapiens
acagggcaggtggctactggtc

SEQ ID NO: 8556764 - DNA, 21 bp, Homo sapiens
acaggctcacgatccatttct

SEQ ID NO: 8556765 - DNA, 22 bp, Homo sapiens
acaggctctcagccagttggca

SEQ ID NO: 8556766 - DNA, 22 bp, Homo sapiens
acagggcagtgtcttgaaaaat

SEQ ID NO: 8556767 - DNA, 21 bp, Homo sapiens
acagggcatgcagctggctgt

SEQ ID NO: 8556768 - DNA, 21 bp, Homo sapiens
acagggcatgcagctggctgt

SEQ ID NO: 8556769 - DNA, 21 bp, Homo sapiens
acagggcatgcagctggctgt

SEQ ID NO: 8556770 - DNA, 22 bp, Homo sapiens
acagggcatgtgcaagagacat

SEQ ID NO: 8556771 - DNA, 22 bp, Homo sapiens
acagggcatgtgcaagagacat

SEQ ID NO: 8556772 - DNA, 22 bp, Homo sapiens
acagggcatgtgcaagagacat

SEQ ID NO: 8556773 - DNA, 21 bp, Homo sapiens
acagggcatgcagctggctgt

SEQ ID NO: 8556774 - DNA, 21 bp, Homo sapiens
acagggcatgcagctggctgt

SEQ ID NO: 8556775 - DNA, 23 bp, Homo sapiens
acagggcattgctggcctcgagg

SEQ ID NO: 8556776 - DNA, 23 bp, Homo sapiens
acagggcattgctggcctcgagg

SEQ ID NO: 8556777 - DNA, 22 bp, Homo sapiens
acagggcatttcctctatgtgt

SEQ ID NO: 8556778 - DNA, 22 bp, Homo sapiens
acagggcatttcctctatgtgt

SEQ ID NO: 8556779 - DNA, 22 bp, Homo sapiens
acagggcatttcctctatgtgt

SEQ ID NO: 8556780 - DNA, 22 bp, Homo sapiens
acagggccattggaggattata

SEQ ID NO: 8556781 - DNA, 22 bp, Homo sapiens
acagggccattatctgttctag

SEQ ID NO: 8556782 - DNA, 22 bp, Homo sapiens
acagggccaggtgagaggtgct

SEQ ID NO: 8556783 - DNA, 22 bp, Homo sapiens
acagggccagcctgggacctgg

SEQ ID NO: 8556784 - DNA, 22 bp, Homo sapiens
acagggcctcagccagggcaga

SEQ ID NO: 8556785 - DNA, 22 bp, Homo sapiens
acagggcctcagctgattctgg

SEQ ID NO: 8556786 - DNA, 22 bp, Homo sapiens
acagggcccttgccagcacaag

SEQ ID NO: 8556787 - DNA, 23 bp, Homo sapiens
acagggctagctgacagtggtat

SEQ ID NO: 8556788 - DNA, 23 bp, Homo sapiens
acagggctagctgacagtggtat

SEQ ID NO: 8556789 - DNA, 23 bp, Homo sapiens
acagggctagctgacagtggtat

SEQ ID NO: 8556790 - DNA, 22 bp, Homo sapiens
acagggctatattcctcagagc

SEQ ID NO: 8556791 - DNA, 22 bp, Homo sapiens
acagggctatattcctcagagc

SEQ ID NO: 8556792 - DNA, 22 bp, Homo sapiens
acagggctatattcctcagagc

SEQ ID NO: 8556793 - DNA, 22 bp, Homo sapiens
aggacagggattcaaactccca

SEQ ID NO: 8556794 - DNA, 22 bp, Homo sapiens
aggacaggtgtagtgggctctg

SEQ ID NO: 8556795 - DNA, 22 bp, Homo sapiens
aggacacaggtaagccagtgga

SEQ ID NO: 8556796 - DNA, 22 bp, Homo sapiens
aggacacaggtaagccagtgga

SEQ ID NO: 8556797 - DNA, 22 bp, Homo sapiens
acagggctatattcctcagagc

SEQ ID NO: 8556798 - DNA, 22 bp, Homo sapiens
aggacacaggtaagccagtgga

SEQ ID NO: 8556799 - DNA, 22 bp, Homo sapiens
aggactgatgatggtgctgaca

SEQ ID NO: 8556800 - DNA, 22 bp, Homo sapiens
aggacatgtaaatggagaggga

SEQ ID NO: 8556801 - DNA, 22 bp, Homo sapiens
aggactggcagtgtgaggggtc

SEQ ID NO: 8556802 - DNA, 22 bp, Homo sapiens
aggactggccctgaggggaggc

SEQ ID NO: 8556803 - DNA, 22 bp, Homo sapiens
aggactggcggtcggtggggat

SEQ ID NO: 8556804 - DNA, 22 bp, Homo sapiens
aggactggtgtgtgatcagcat

SEQ ID NO: 8556805 - DNA, 22 bp, Homo sapiens
aggactggtgccagacaaggta

SEQ ID NO: 8556806 - DNA, 22 bp, Homo sapiens
aggactggtgccagacaaggta

SEQ ID NO: 8556807 - DNA, 22 bp, Homo sapiens
aggactggtgccagacaaggta

SEQ ID NO: 8556808 - DNA, 22 bp, Homo sapiens
aggactgggtgcagagggcatc

SEQ ID NO: 8556809 - DNA, 22 bp, Homo sapiens
aggactgggtgcagagggcatc

SEQ ID NO: 8556810 - DNA, 22 bp, Homo sapiens
aggactgggtgcagagggcatc

SEQ ID NO: 8556811 - DNA, 22 bp, Homo sapiens
aggactgggtgcagagggcatc

SEQ ID NO: 8556812 - DNA, 22 bp, Homo sapiens
aggacaggtgtagtgggctctg

SEQ ID NO: 8556813 - DNA, 22 bp, Homo sapiens
aggacaggtgtagtgggctctg

SEQ ID NO: 8556814 - DNA, 22 bp, Homo sapiens
aggacaggtgtagtgggctctg

SEQ ID NO: 8556815 - DNA, 22 bp, Homo sapiens
aggacatgaagaaagggcaagg

SEQ ID NO: 8556816 - DNA, 22 bp, Homo sapiens
aggacagttagttaggaagttt

SEQ ID NO: 8556817 - DNA, 22 bp, Homo sapiens
aggacatgaagaaagggcaagg

SEQ ID NO: 8556818 - DNA, 22 bp, Homo sapiens
acaggaagtttggaaagcctca

SEQ ID NO: 8556819 - DNA, 22 bp, Homo sapiens
acaggacaggctgggctagact

SEQ ID NO: 8556820 - DNA, 22 bp, Homo sapiens
acaggacaaggggaagaagata

SEQ ID NO: 8556821 - DNA, 22 bp, Homo sapiens
acaggacaactcagcagccagc

SEQ ID NO: 8556822 - DNA, 22 bp, Homo sapiens
acaggacaactcagcagccagc

SEQ ID NO: 8556823 - DNA, 22 bp, Homo sapiens
acaggacaactcagcagccagc

SEQ ID NO: 8556824 - DNA, 22 bp, Homo sapiens
acaggacaactcagcagccagc

SEQ ID NO: 8556825 - DNA, 22 bp, Homo sapiens
acaggaagctggagacccttga

SEQ ID NO: 8556826 - DNA, 22 bp, Homo sapiens
acaggaagaaagtgcagtagat

SEQ ID NO: 8556827 - DNA, 22 bp, Homo sapiens
acaggaagaaagtgcagtagat

SEQ ID NO: 8556828 - DNA, 22 bp, Homo sapiens
acaggaagtgctggcacttaca

SEQ ID NO: 8556829 - DNA, 22 bp, Homo sapiens
acaggaagtgctggcacttaca

SEQ ID NO: 8556830 - DNA, 22 bp, Homo sapiens
acaggaagtgggaagaaacagg

SEQ ID NO: 8556831 - DNA, 22 bp, Homo sapiens
acaggaagaaagtgcagtagat

SEQ ID NO: 8556832 - DNA, 22 bp, Homo sapiens
acaggaacgaatgtacattgtt

SEQ ID NO: 8556833 - DNA, 22 bp, Homo sapiens
acaggaactgttatctcagatg

SEQ ID NO: 8556834 - DNA, 20 bp, Homo sapiens
acagccagaggaggcagaca

SEQ ID NO: 8556835 - DNA, 22 bp, Homo sapiens
acagcatctagtacagtctagt

SEQ ID NO: 8556836 - DNA, 22 bp, Homo sapiens
acagcatgagagtagcaaaagg

SEQ ID NO: 8556837 - DNA, 22 bp, Homo sapiens
acagcatgagagatgaacattc

SEQ ID NO: 8556838 - DNA, 22 bp, Homo sapiens
acagcatgagagtagcaaaagg

SEQ ID NO: 8556839 - DNA, 22 bp, Homo sapiens
acagcatggataacaaggcact

SEQ ID NO: 8556840 - DNA, 22 bp, Homo sapiens
acagcatgtctagttaaatact

SEQ ID NO: 8556841 - DNA, 22 bp, Homo sapiens
acagcatgtctagttaaatact

SEQ ID NO: 8556842 - DNA, 22 bp, Homo sapiens
acagcatcatatagtggaagaa

SEQ ID NO: 8556843 - DNA, 22 bp, Homo sapiens
acagcataatcacttctttctt

SEQ ID NO: 8556844 - DNA, 22 bp, Homo sapiens
acagcataatcacttctttctt

SEQ ID NO: 8556845 - DNA, 22 bp, Homo sapiens
acagcatccctgaagataacca

SEQ ID NO: 8556846 - DNA, 22 bp, Homo sapiens
acagcatccttctaaagtagct

SEQ ID NO: 8556847 - DNA, 22 bp, Homo sapiens
acagcatccttctaaagtagct

SEQ ID NO: 8556848 - DNA, 22 bp, Homo sapiens
acagcagttactgaaataaagt

SEQ ID NO: 8556849 - DNA, 22 bp, Homo sapiens
acagcagttaacgatcagactc

SEQ ID NO: 8556850 - DNA, 22 bp, Homo sapiens
acagcagttaacgatcagactc

SEQ ID NO: 8556851 - DNA, 22 bp, Homo sapiens
acagcagttactgaaataaagt

SEQ ID NO: 8556852 - DNA, 22 bp, Homo sapiens
acagcagtttagaggacagcca

SEQ ID NO: 8556853 - DNA, 22 bp, Homo sapiens
acagcagttcaggccgcagagg

SEQ ID NO: 8556854 - DNA, 22 bp, Homo sapiens
acagcagtggtgcactgagcca

SEQ ID NO: 8556855 - DNA, 22 bp, Homo sapiens
acagcagtgtctggtactgagt

SEQ ID NO: 8556856 - DNA, 22 bp, Homo sapiens
acagcagtgggttgccagtggg

SEQ ID NO: 8556857 - DNA, 22 bp, Homo sapiens
acagcagtgggttgccagtggg

SEQ ID NO: 8556858 - DNA, 22 bp, Homo sapiens
acagccaaggaattaggaaggg

SEQ ID NO: 8556859 - DNA, 22 bp, Homo sapiens
acagccagaggagccaggctgg

SEQ ID NO: 8556860 - DNA, 22 bp, Homo sapiens
acagccagaggagccaggctgg

SEQ ID NO: 8556861 - DNA, 22 bp, Homo sapiens
acagcattccctttggctgctt

SEQ ID NO: 8556862 - DNA, 21 bp, Homo sapiens
acagcatgtttgtgtgtttgc

SEQ ID NO: 8556863 - DNA, 21 bp, Homo sapiens
acagcatgtttgtgtgtttgc

SEQ ID NO: 8556864 - DNA, 21 bp, Homo sapiens
acagcatgtttgtgtgtttgc

SEQ ID NO: 8556865 - DNA, 22 bp, Homo sapiens
acagcatttaaagaaaatgaac

SEQ ID NO: 8556866 - DNA, 22 bp, Homo sapiens
agcttctttaattcagcatgat

SEQ ID NO: 8556867 - DNA, 19 bp, Homo sapiens
agcttctttggaaacattt

SEQ ID NO: 8556868 - DNA, 22 bp, Homo sapiens
agcttcttttacagctcatgct

SEQ ID NO: 8556869 - DNA, 22 bp, Homo sapiens
agcttctttgtgggctccagaa

SEQ ID NO: 8556870 - DNA, 22 bp, Homo sapiens
acaggatgataaaggatggcca

SEQ ID NO: 8556871 - DNA, 22 bp, Homo sapiens
acaggatggccagctgatattg

SEQ ID NO: 8556872 - DNA, 22 bp, Homo sapiens
acaggcaattagcaagctgtta

SEQ ID NO: 8556873 - DNA, 21 bp, Homo sapiens
acaggcaatttcatatggttc

SEQ ID NO: 8556874 - DNA, 22 bp, Homo sapiens
acaggcacaactgagtagactc

SEQ ID NO: 8556875 - DNA, 22 bp, Homo sapiens
acaggcacaactgagtagactc

SEQ ID NO: 8556876 - DNA, 22 bp, Homo sapiens
acaggcaatatataaattatga

SEQ ID NO: 8556877 - DNA, 22 bp, Homo sapiens
acaggcaagtcacacaacttgt

SEQ ID NO: 8556878 - DNA, 22 bp, Homo sapiens
acaggcaagtcacacaacttgt

SEQ ID NO: 8556879 - DNA, 18 bp, Homo sapiens
aggaaagaaaggcaggtg

SEQ ID NO: 8556880 - DNA, 22 bp, Homo sapiens
aggaaaggggtaggtgtggacg

SEQ ID NO: 8556881 - DNA, 22 bp, Homo sapiens
acaggcaacttcaaatctcact

SEQ ID NO: 8556882 - DNA, 21 bp, Homo sapiens
acaggcaaattttagacaatg

SEQ ID NO: 8556883 - DNA, 21 bp, Homo sapiens
acaggcaaattttagacaatg

SEQ ID NO: 8556884 - DNA, 22 bp, Homo sapiens
acaggcaaagggtcagtagcag

SEQ ID NO: 8556885 - DNA, 22 bp, Homo sapiens
acaggcaaacacagaaagtagg

SEQ ID NO: 8556886 - DNA, 22 bp, Homo sapiens
acaggcaagaggaaagcaagta

SEQ ID NO: 8556887 - DNA, 22 bp, Homo sapiens
acaggcaaggccagtgagaaat

SEQ ID NO: 8556888 - DNA, 22 bp, Homo sapiens
acaggcaaggccagtgagaaat

SEQ ID NO: 8556889 - DNA, 22 bp, Homo sapiens
agcttcttagttcacttttaat

SEQ ID NO: 8556890 - DNA, 22 bp, Homo sapiens
agcttcttgaccaagcctgtaa

SEQ ID NO: 8556891 - DNA, 22 bp, Homo sapiens
agcttcttctgatttgtcagtc

SEQ ID NO: 8556892 - DNA, 22 bp, Homo sapiens
agcttcttctgatttgtcagtc

SEQ ID NO: 8556893 - DNA, 22 bp, Homo sapiens
agcttcttcttggtctttccca

SEQ ID NO: 8556894 - DNA, 22 bp, Homo sapiens
agcttcttggctcagcacttgg

SEQ ID NO: 8556895 - DNA, 22 bp, Homo sapiens
agcttcttgggctttacacaaa

SEQ ID NO: 8556896 - DNA, 22 bp, Homo sapiens
agcttcttgacggatgttctgg

SEQ ID NO: 8556897 - DNA, 22 bp, Homo sapiens
acaggacatggcttctgtgacg

SEQ ID NO: 8556898 - DNA, 22 bp, Homo sapiens
acaggacagtctagtaacagta

SEQ ID NO: 8556899 - DNA, 22 bp, Homo sapiens
acaggacagtctagtaacagta

SEQ ID NO: 8556900 - DNA, 22 bp, Homo sapiens
acaggacagtctagtaacagta

SEQ ID NO: 8556901 - DNA, 22 bp, Homo sapiens
acaggacaggtaggattcgcag

SEQ ID NO: 8556902 - DNA, 22 bp, Homo sapiens
acaggacaggctgggctagact

SEQ ID NO: 8556903 - DNA, 22 bp, Homo sapiens
acaggacaggctgggctagact

SEQ ID NO: 8556904 - DNA, 22 bp, Homo sapiens
acaggacatgtaccaggtggtc

SEQ ID NO: 8556905 - DNA, 22 bp, Homo sapiens
acaggacatgtaccaggtggtc

SEQ ID NO: 8556906 - DNA, 22 bp, Homo sapiens
acaggacatggcttctgtgacg

SEQ ID NO: 8556907 - DNA, 22 bp, Homo sapiens
acagtgaaaattctattgattt

SEQ ID NO: 8556908 - DNA, 22 bp, Homo sapiens
acagtgaaaagaatattagaat

SEQ ID NO: 8556909 - DNA, 23 bp, Homo sapiens
acagtgaaacacgcagtaagagt

SEQ ID NO: 8556910 - DNA, 23 bp, Homo sapiens
acagtgaaacacgcagtaagagt

SEQ ID NO: 8556911 - DNA, 23 bp, Homo sapiens
acagtgaaacacgcagtaagagt

SEQ ID NO: 8556912 - DNA, 22 bp, Homo sapiens
acagtctggaagcagggggcaa

SEQ ID NO: 8556913 - DNA, 22 bp, Homo sapiens
acagtctggaagcagggggcaa

SEQ ID NO: 8556914 - DNA, 22 bp, Homo sapiens
acagtctggaggctgcttcatt

SEQ ID NO: 8556915 - DNA, 22 bp, Homo sapiens
acagtctggcaggtgttgaaag

SEQ ID NO: 8556916 - DNA, 22 bp, Homo sapiens
acagtctgtcccccaggtgcta

SEQ ID NO: 8556917 - DNA, 22 bp, Homo sapiens
acagtctgtcccccaggtgcta

SEQ ID NO: 8556918 - DNA, 22 bp, Homo sapiens
acagtctggaggctgcttcatt

SEQ ID NO: 8556919 - DNA, 22 bp, Homo sapiens
acagtgaggaagcagctgtgct

SEQ ID NO: 8556920 - DNA, 22 bp, Homo sapiens
acagtgaggaagcagctgtgct

SEQ ID NO: 8556921 - DNA, 22 bp, Homo sapiens
acagtgaggaagcagctgtgct

SEQ ID NO: 8556922 - DNA, 22 bp, Homo sapiens
aggaggcaggaagtctatggga

SEQ ID NO: 8556923 - DNA, 22 bp, Homo sapiens
acagtgagatccaagggcaggc

SEQ ID NO: 8556924 - DNA, 22 bp, Homo sapiens
acagtgagatccaagggcaggc

SEQ ID NO: 8556925 - DNA, 22 bp, Homo sapiens
acagtgagatccaagggcaggc

SEQ ID NO: 8556926 - DNA, 22 bp, Homo sapiens
acagtgagcggtagtgattgct

SEQ ID NO: 8556927 - DNA, 22 bp, Homo sapiens
acagtgagcccactccaggaga

SEQ ID NO: 8556928 - DNA, 22 bp, Homo sapiens
acagtgagcccactccaggaga

SEQ ID NO: 8556929 - DNA, 22 bp, Homo sapiens
acagtgaatgcccaagaaaagt

SEQ ID NO: 8556930 - DNA, 22 bp, Homo sapiens
acagtgaatgagaatggagaaa

SEQ ID NO: 8556931 - DNA, 22 bp, Homo sapiens
acagtgaatgcccaagaaaagt

SEQ ID NO: 8556932 - DNA, 22 bp, Homo sapiens
acagtgacactcaggtgggatg

SEQ ID NO: 8556933 - DNA, 17 bp, Homo sapiens
acagtgagaagtcatct

SEQ ID NO: 8556934 - DNA, 21 bp, Homo sapiens
acagtgagaaataaatggaaa

SEQ ID NO: 8556935 - DNA, 22 bp, Homo sapiens
acagtgacgtttatttgagacg

SEQ ID NO: 8556936 - DNA, 22 bp, Homo sapiens
aggaggccaggccctcaagcct

SEQ ID NO: 8556937 - DNA, 22 bp, Homo sapiens
aggaggccaggccctcaagcct

SEQ ID NO: 8556938 - DNA, 22 bp, Homo sapiens
aggaggcccctcctgggttgct

SEQ ID NO: 8556939 - DNA, 22 bp, Homo sapiens
aggaggccctagagctctagag

SEQ ID NO: 8556940 - DNA, 22 bp, Homo sapiens
aggaggccctagagctctagag

SEQ ID NO: 8556941 - DNA, 21 bp, Homo sapiens
aggaggccagtactgctgaac

SEQ ID NO: 8556942 - DNA, 19 bp, Homo sapiens
acagtgcttctgagtgagg

SEQ ID NO: 8556943 - DNA, 22 bp, Homo sapiens
acagtggaaagaacatggattt

SEQ ID NO: 8556944 - DNA, 22 bp, Homo sapiens
aggaggccgatttcagaggtcg

SEQ ID NO: 8556945 - DNA, 22 bp, Homo sapiens
aggaggccgatttcagaggtcg

SEQ ID NO: 8556946 - DNA, 22 bp, Homo sapiens
aggaggccctagagctctagag

SEQ ID NO: 8556947 - DNA, 17 bp, Homo sapiens
aggaggccctggcgttt

SEQ ID NO: 8556948 - DNA, 22 bp, Homo sapiens
acagtggatgtgatgtccaggt

SEQ ID NO: 8556949 - DNA, 22 bp, Homo sapiens
acagtggatgtgatgtccaggt

SEQ ID NO: 8556950 - DNA, 22 bp, Homo sapiens
acagtggatgtgatgtccaggt

SEQ ID NO: 8556951 - DNA, 22 bp, Homo sapiens
acagtggatatattaaatgaga

SEQ ID NO: 8556952 - DNA, 22 bp, Homo sapiens
acagtggagaaggcatgaggct

SEQ ID NO: 8556953 - DNA, 22 bp, Homo sapiens
acagtggaggccatatggtcct

SEQ ID NO: 8556954 - DNA, 20 bp, Homo sapiens
acagtggaaattgatgtctg

SEQ ID NO: 8556955 - DNA, 22 bp, Homo sapiens
acagtggaaatgtgggagggga

SEQ ID NO: 8556956 - DNA, 22 bp, Homo sapiens
acagtggagaaggcatgaggct

SEQ ID NO: 8556957 - DNA, 22 bp, Homo sapiens
acagtggaatggtgggcctgca

SEQ ID NO: 8556958 - DNA, 22 bp, Homo sapiens
aggcaccaggttgtggtttgtc

SEQ ID NO: 8556959 - DNA, 22 bp, Homo sapiens
aggcaccagtaagagtagaact

SEQ ID NO: 8556960 - DNA, 22 bp, Homo sapiens
aggcaccagtaagagtagaact

SEQ ID NO: 8556961 - DNA, 22 bp, Homo sapiens
aggcaccaggatcagttagaga

SEQ ID NO: 8556962 - DNA, 22 bp, Homo sapiens
acagtggcttttgtgtctgcag

SEQ ID NO: 8556963 - DNA, 22 bp, Homo sapiens
acagtggctcatgcctgtcatc

SEQ ID NO: 8556964 - DNA, 21 bp, Homo sapiens
aggcaccacatctccctcccc

SEQ ID NO: 8556965 - DNA, 21 bp, Homo sapiens
aggcaccacatctccctcccc

SEQ ID NO: 8556966 - DNA, 22 bp, Homo sapiens
aggcactgaaaggtggccagag

SEQ ID NO: 8556967 - DNA, 20 bp, Homo sapiens
acagtgttaggtttttcctt

SEQ ID NO: 8556968 - DNA, 22 bp, Homo sapiens
aggcaccttgagagcaggagct

SEQ ID NO: 8556969 - DNA, 22 bp, Homo sapiens
aggcaccttgagagcaggagct

SEQ ID NO: 8556970 - DNA, 22 bp, Homo sapiens
aggcaccttgagagcaggagct

SEQ ID NO: 8556971 - DNA, 22 bp, Homo sapiens
acagtgttctcttcctgtatag

SEQ ID NO: 8556972 - DNA, 22 bp, Homo sapiens
acagtgttctgaaagttgaggg

SEQ ID NO: 8556973 - DNA, 22 bp, Homo sapiens
aggcactttttgcattttagaa

SEQ ID NO: 8556974 - DNA, 22 bp, Homo sapiens
aggcagaaaatagtcatccaaa

SEQ ID NO: 8556975 - DNA, 22 bp, Homo sapiens
aggcagaaaatagtcatccaaa

SEQ ID NO: 8556976 - DNA, 22 bp, Homo sapiens
acagtgttcctttgttgtgact

SEQ ID NO: 8556977 - DNA, 22 bp, Homo sapiens
acagtgttcacttaacaatgga

SEQ ID NO: 8556978 - DNA, 22 bp, Homo sapiens
acagtgttcacttaacaatgga

SEQ ID NO: 8556979 - DNA, 22 bp, Homo sapiens
acagtgttcactaaggttagct

SEQ ID NO: 8556980 - DNA, 22 bp, Homo sapiens
acagtgttcaaaccactaggct

SEQ ID NO: 8556981 - DNA, 20 bp, Homo sapiens
acagtgttagttatcatctc

SEQ ID NO: 8556982 - DNA, 22 bp, Homo sapiens
acagtgttatttctgagtaatg

SEQ ID NO: 8556983 - DNA, 22 bp, Homo sapiens
aggcagcaaagaaatgatgctg

SEQ ID NO: 8556984 - DNA, 22 bp, Homo sapiens
aggcagcaaatgtctggaacag

SEQ ID NO: 8556985 - DNA, 22 bp, Homo sapiens
aggcagcaaagaaatgatgctg

SEQ ID NO: 8556986 - DNA, 22 bp, Homo sapiens
aggcagcaaatgtctggaacag

SEQ ID NO: 8556987 - DNA, 22 bp, Homo sapiens
aggcagcaagattatttaatcc

SEQ ID NO: 8556988 - DNA, 22 bp, Homo sapiens
aggcagcaagattatttaatcc

SEQ ID NO: 8556989 - DNA, 22 bp, Homo sapiens
aggcaggggagctggaagggta

SEQ ID NO: 8556990 - DNA, 18 bp, Homo sapiens
aggcaggtgctggaagtc

SEQ ID NO: 8556991 - DNA, 18 bp, Homo sapiens
aggcaggtgctggaagtc

SEQ ID NO: 8556992 - DNA, 22 bp, Homo sapiens
aggcagcaatgaatgaaatgga

SEQ ID NO: 8556993 - DNA, 22 bp, Homo sapiens
aggcagcaatgaatgaaatgga

SEQ ID NO: 8556994 - DNA, 22 bp, Homo sapiens
aggcaggtgttgggagacacca

SEQ ID NO: 8556995 - DNA, 22 bp, Homo sapiens
aggcaggtgggtcacttgagtc

SEQ ID NO: 8556996 - DNA, 22 bp, Homo sapiens
aggcaggtgggagtgattcctt

SEQ ID NO: 8556997 - DNA, 20 bp, Homo sapiens
aggcagacaaggagtctgtt

SEQ ID NO: 8556998 - DNA, 22 bp, Homo sapiens
aggcagaatgttggaaaggaag

SEQ ID NO: 8556999 - DNA, 22 bp, Homo sapiens
aggcagaatgttggaaaggaag

SEQ ID NO: 8557000 - DNA, 22 bp, Homo sapiens
aggcagaagccagccagggtcc

SEQ ID NO: 8557001 - DNA, 21 bp, Homo sapiens
aggcagaaagagcccaggctg

SEQ ID NO: 8557002 - DNA, 22 bp, Homo sapiens
aggcagagaaaaaccagatatg

SEQ ID NO: 8557003 - DNA, 22 bp, Homo sapiens
aggcagagaaaaaccagatatg

SEQ ID NO: 8557004 - DNA, 22 bp, Homo sapiens
aggcagagaaaaaccagatatg

SEQ ID NO: 8557005 - DNA, 22 bp, Homo sapiens
aggcagagaaaaaccagatatg

SEQ ID NO: 8557006 - DNA, 22 bp, Homo sapiens
aggcagatggtaactgtgatat

SEQ ID NO: 8557007 - DNA, 22 bp, Homo sapiens
aggcagatgggagctggaagtt

SEQ ID NO: 8557008 - DNA, 22 bp, Homo sapiens
aggcagtgtggagggctgttgc

SEQ ID NO: 8557009 - DNA, 22 bp, Homo sapiens
aggcagtgtgggccaagcttcc

SEQ ID NO: 8557010 - DNA, 22 bp, Homo sapiens
aggcagtgtgtagctggaagag

SEQ ID NO: 8557011 - DNA, 22 bp, Homo sapiens
aggcagtgtgtagctggaagag

SEQ ID NO: 8557012 - DNA, 22 bp, Homo sapiens
aggcagtgtgtagctggaagag

SEQ ID NO: 8557013 - DNA, 20 bp, Homo sapiens
aggcagtgtagagatgagta

SEQ ID NO: 8557014 - DNA, 22 bp, Homo sapiens
aggcagtgtattgctagcggct

SEQ ID NO: 8557015 - DNA, 22 bp, Homo sapiens
aggcagtgtattgctagcggct

SEQ ID NO: 8557016 - DNA, 23 bp, Homo sapiens
aggcagtgtctcttatcctgtcc

SEQ ID NO: 8557017 - DNA, 22 bp, Homo sapiens
acatctgtcctctgcagagctc

SEQ ID NO: 8557018 - DNA, 22 bp, Homo sapiens
acatctgtaatctagtcaaccc

SEQ ID NO: 8557019 - DNA, 22 bp, Homo sapiens
acatctgggcctaaggctatat

SEQ ID NO: 8557020 - DNA, 22 bp, Homo sapiens
acatctgttcttctcttgtccc

SEQ ID NO: 8557021 - DNA, 22 bp, Homo sapiens
acatctgtttaacgaaggcatt

SEQ ID NO: 8557022 - DNA, 22 bp, Homo sapiens
acatctgtttgagaaaaagaag

SEQ ID NO: 8557023 - DNA, 22 bp, Homo sapiens
aggcagtggtgtttgctggtgg

SEQ ID NO: 8557024 - DNA, 22 bp, Homo sapiens
acatcttcactggtttctggaa

SEQ ID NO: 8557025 - DNA, 22 bp, Homo sapiens
acatctttatactagtccttga

SEQ ID NO: 8557026 - DNA, 22 bp, Homo sapiens
acatctttgctcttatagagct

SEQ ID NO: 8557027 - DNA, 22 bp, Homo sapiens
acatatatgtaaagtactttgt

SEQ ID NO: 8557028 - DNA, 22 bp, Homo sapiens
acatatatgtgcacatgtgcag

SEQ ID NO: 8557029 - DNA, 22 bp, Homo sapiens
acatatatgtgcacatgtgcag

SEQ ID NO: 8557030 - DNA, 22 bp, Homo sapiens
acatatatgtgcacatgtgcag

SEQ ID NO: 8557031 - DNA, 22 bp, Homo sapiens
acatatattactagtaaagaca

SEQ ID NO: 8557032 - DNA, 22 bp, Homo sapiens
acatatattactagtaaagaca

SEQ ID NO: 8557033 - DNA, 22 bp, Homo sapiens
acatatattactagtaaagaca

SEQ ID NO: 8557034 - DNA, 22 bp, Homo sapiens
acatatattactagtaaagaca

SEQ ID NO: 8557035 - DNA, 22 bp, Homo sapiens
acatataagggatcagtgacag

SEQ ID NO: 8557036 - DNA, 22 bp, Homo sapiens
acatatatgcgtgggctcatgg

SEQ ID NO: 8557037 - DNA, 22 bp, Homo sapiens
acatatatgctgggactgtgac

SEQ ID NO: 8557038 - DNA, 22 bp, Homo sapiens
acatatatgtaaagtactttgt

SEQ ID NO: 8557039 - DNA, 22 bp, Homo sapiens
acatatatgtaaagtactttgt

SEQ ID NO: 8557040 - DNA, 22 bp, Homo sapiens
acatatatgctgggactgtgac

SEQ ID NO: 8557041 - DNA, 22 bp, Homo sapiens
acatctcttataaactctctga

SEQ ID NO: 8557042 - DNA, 22 bp, Homo sapiens
acatctcatgaatgataaatca

SEQ ID NO: 8557043 - DNA, 22 bp, Homo sapiens
acatctcatgaatgataaatca

SEQ ID NO: 8557044 - DNA, 22 bp, Homo sapiens
acatatattactagtaaagaca

SEQ ID NO: 8557045 - DNA, 22 bp, Homo sapiens
acatatattactagtaaagaca

SEQ ID NO: 8557046 - DNA, 22 bp, Homo sapiens
acatccatgttgtaatgttcct

SEQ ID NO: 8557047 - DNA, 22 bp, Homo sapiens
acatccatgcatgtctgtgcac

SEQ ID NO: 8557048 - DNA, 22 bp, Homo sapiens
acatccatcttctgcctgtgaa

SEQ ID NO: 8557049 - DNA, 23 bp, Homo sapiens
acatccatgaatcatctgctttc

SEQ ID NO: 8557050 - DNA, 22 bp, Homo sapiens
acatctgaaagggattgcagaa

SEQ ID NO: 8557051 - DNA, 22 bp, Homo sapiens
acatctgaccattacaagacat

SEQ ID NO: 8557052 - DNA, 22 bp, Homo sapiens
acatctgacatgatcttcagta

SEQ ID NO: 8557053 - DNA, 22 bp, Homo sapiens
acatctgacatgatcttcagta

SEQ ID NO: 8557054 - DNA, 22 bp, Homo sapiens
acatctgattacatgagaatat

SEQ ID NO: 8557055 - DNA, 22 bp, Homo sapiens
acatctgaggagaccagcctct

SEQ ID NO: 8557056 - DNA, 22 bp, Homo sapiens
acatctgaggagaccagcctct

SEQ ID NO: 8557057 - DNA, 22 bp, Homo sapiens
acatctgagcaacagaacacta

SEQ ID NO: 8557058 - DNA, 20 bp, Homo sapiens
acatctgagaaacacttaaa

SEQ ID NO: 8557059 - DNA, 22 bp, Homo sapiens
aggcaagaacagacatgggagt

SEQ ID NO: 8557060 - DNA, 22 bp, Homo sapiens
aggcaagattaggaccagaaga

SEQ ID NO: 8557061 - DNA, 22 bp, Homo sapiens
aggcaagaacagacatgggagt

SEQ ID NO: 8557062 - DNA, 22 bp, Homo sapiens
aggcaagaacagacatgggagt

SEQ ID NO: 8557063 - DNA, 22 bp, Homo sapiens
aggcaagcattgggaacagggc

SEQ ID NO: 8557064 - DNA, 22 bp, Homo sapiens
aggcaagattaggaccagaaga

SEQ ID NO: 8557065 - DNA, 20 bp, Homo sapiens
aggcaaggtagatgtctgct

SEQ ID NO: 8557066 - DNA, 22 bp, Homo sapiens
aggcaagggggcgccaccttcc

SEQ ID NO: 8557067 - DNA, 22 bp, Homo sapiens
aggcaagggggcgccaccttcc

SEQ ID NO: 8557068 - DNA, 22 bp, Homo sapiens
cattgcacttctgcttttcctc

SEQ ID NO: 8557069 - DNA, 22 bp, Homo sapiens
cattgcttcctatgtcccttct

SEQ ID NO: 8557070 - DNA, 22 bp, Homo sapiens
cattgcttgatagctgaaaatt

SEQ ID NO: 8557071 - DNA, 22 bp, Homo sapiens
cattgcttgatagctgaaaatt

SEQ ID NO: 8557072 - DNA, 22 bp, Homo sapiens
cattgctttgtgcatatttaaa

SEQ ID NO: 8557073 - DNA, 22 bp, Homo sapiens
cattgcttgatagctgaaaatt

SEQ ID NO: 8557074 - DNA, 22 bp, Homo sapiens
cattggaaaatgcatgcttttt

SEQ ID NO: 8557075 - DNA, 22 bp, Homo sapiens
cattgctgttaattgtctctag

SEQ ID NO: 8557076 - DNA, 22 bp, Homo sapiens
cattgctgttaattgtctctag

SEQ ID NO: 8557077 - DNA, 22 bp, Homo sapiens
cattgcttatttcagctaaagt

SEQ ID NO: 8557078 - DNA, 22 bp, Homo sapiens
cattgctgtgggcatttgctgc

SEQ ID NO: 8557079 - DNA, 22 bp, Homo sapiens
cattgctgcttccaggcacagg

SEQ ID NO: 8557080 - DNA, 22 bp, Homo sapiens
aggcaaggtgctcttgctctat

SEQ ID NO: 8557081 - DNA, 22 bp, Homo sapiens
aggcaaggtgctacagacagtg

SEQ ID NO: 8557082 - DNA, 22 bp, Homo sapiens
aggcaaggtgctacagacagtg

SEQ ID NO: 8557083 - DNA, 22 bp, Homo sapiens
aggcaatcccctgaggatactt

SEQ ID NO: 8557084 - DNA, 22 bp, Homo sapiens
aggcaatcccctgaggatactt

SEQ ID NO: 8557085 - DNA, 17 bp, Homo sapiens
aggcaatgactgtggtt

SEQ ID NO: 8557086 - DNA, 22 bp, Homo sapiens
aggcaatcctcttacagatggg

SEQ ID NO: 8557087 - DNA, 22 bp, Homo sapiens
cattccttaacgtggggagtct

SEQ ID NO: 8557088 - DNA, 22 bp, Homo sapiens
cattccttaacgtggggagtct

SEQ ID NO: 8557089 - DNA, 22 bp, Homo sapiens
cattggcacaagtagcttcatc

SEQ ID NO: 8557090 - DNA, 22 bp, Homo sapiens
cattggaagacatatcatgcta

SEQ ID NO: 8557091 - DNA, 22 bp, Homo sapiens
cattggcacctcacaggataga

SEQ ID NO: 8557092 - DNA, 22 bp, Homo sapiens
cattggcacaagtagcttcatc

SEQ ID NO: 8557093 - DNA, 22 bp, Homo sapiens
cattggtcttctaacagagaga

SEQ ID NO: 8557094 - DNA, 20 bp, Homo sapiens
cattggcattcacagaagct

SEQ ID NO: 8557095 - DNA, 22 bp, Homo sapiens
cattgtaagctgttgaatcctc

SEQ ID NO: 8557096 - DNA, 21 bp, Homo sapiens
aggcactgtttgtggtttggg

SEQ ID NO: 8557097 - DNA, 22 bp, Homo sapiens
aggcacttcatgggttcaagga

SEQ ID NO: 8557098 - DNA, 22 bp, Homo sapiens
aggcacttgcattgatgaggtc

SEQ ID NO: 8557099 - DNA, 22 bp, Homo sapiens
aggcacttgcattgatgaggtc

SEQ ID NO: 8557100 - DNA, 22 bp, Homo sapiens
aggcacttgaattgatgatgtt

SEQ ID NO: 8557101 - DNA, 22 bp, Homo sapiens
catttactgttgaatccctagc

SEQ ID NO: 8557102 - DNA, 22 bp, Homo sapiens
catttacatttaaggttaatat

SEQ ID NO: 8557103 - DNA, 22 bp, Homo sapiens
aggcacttgtaattgcagtcat

SEQ ID NO: 8557104 - DNA, 22 bp, Homo sapiens
aggcactttacaatgtgtgaca

SEQ ID NO: 8557105 - DNA, 22 bp, Homo sapiens
catttcaattatttgctcttct

SEQ ID NO: 8557106 - DNA, 22 bp, Homo sapiens
catttcaattatttgctcttct

SEQ ID NO: 8557107 - DNA, 22 bp, Homo sapiens
catttcaatgccttcaacatag

SEQ ID NO: 8557108 - DNA, 22 bp, Homo sapiens
catttcaatgccttcaacatag

SEQ ID NO: 8557109 - DNA, 22 bp, Homo sapiens
catttcaatactatctgagaat

SEQ ID NO: 8557110 - DNA, 22 bp, Homo sapiens
catttcaatgccttcaacatag

SEQ ID NO: 8557111 - DNA, 22 bp, Homo sapiens
catttcaatacagtttgtaaat

SEQ ID NO: 8557112 - DNA, 22 bp, Homo sapiens
catttcacaaatggccacatca

SEQ ID NO: 8557113 - DNA, 22 bp, Homo sapiens
catttcacacataaacttgggt

SEQ ID NO: 8557114 - DNA, 22 bp, Homo sapiens
catttctccgccgagatcactg

SEQ ID NO: 8557115 - DNA, 22 bp, Homo sapiens
catttctcataatattagcact

SEQ ID NO: 8557116 - DNA, 22 bp, Homo sapiens
catttctcataatattagcact

SEQ ID NO: 8557117 - DNA, 22 bp, Homo sapiens
catttctgattacagaatacta

SEQ ID NO: 8557118 - DNA, 22 bp, Homo sapiens
catttctgattacagaatacta

SEQ ID NO: 8557119 - DNA, 22 bp, Homo sapiens
catttctcctgggtgataaatt

SEQ ID NO: 8557120 - DNA, 22 bp, Homo sapiens
catttctccgccgagatcactg

SEQ ID NO: 8557121 - DNA, 22 bp, Homo sapiens
catttcaagcattgacttctat

SEQ ID NO: 8557122 - DNA, 21 bp, Homo sapiens
catttcaaagagctggaaatc

SEQ ID NO: 8557123 - DNA, 23 bp, Homo sapiens
catttcaacgaattttccttctg

SEQ ID NO: 8557124 - DNA, 22 bp, Homo sapiens
catttcaagtaacagattgctt

SEQ ID NO: 8557125 - DNA, 22 bp, Homo sapiens
catttcaagcattgacttctat

SEQ ID NO: 8557126 - DNA, 22 bp, Homo sapiens
catttattggttaggccagcag

SEQ ID NO: 8557127 - DNA, 22 bp, Homo sapiens
catttattggttaggccagcag

SEQ ID NO: 8557128 - DNA, 22 bp, Homo sapiens
catttcaaaagaattgccagaa

SEQ ID NO: 8557129 - DNA, 22 bp, Homo sapiens
catttcaaaagaattgccagaa

SEQ ID NO: 8557130 - DNA, 22 bp, Homo sapiens
catttcaaacagttacagctgc

SEQ ID NO: 8557131 - DNA, 22 bp, Homo sapiens
ccacgagggaaccaggtggggt

SEQ ID NO: 8557132 - DNA, 22 bp, Homo sapiens
ccacgtccagctaattttcgta

SEQ ID NO: 8557133 - DNA, 22 bp, Homo sapiens
ccacgctcatcctctctgagag

SEQ ID NO: 8557134 - DNA, 22 bp, Homo sapiens
ccacgcatccctccacagagag

SEQ ID NO: 8557135 - DNA, 21 bp, Homo sapiens
ccactcatgactccactcacc

SEQ ID NO: 8557136 - DNA, 20 bp, Homo sapiens
ccacctggccaaggctgtgc

SEQ ID NO: 8557137 - DNA, 22 bp, Homo sapiens
ccacccagccagatgcaggaag

SEQ ID NO: 8557138 - DNA, 22 bp, Homo sapiens
ccacccagccagatgcaggaag

SEQ ID NO: 8557139 - DNA, 22 bp, Homo sapiens
ccacccagccagatgcaggaag

SEQ ID NO: 8557140 - DNA, 22 bp, Homo sapiens
ccacctgtgcttggtactccat

SEQ ID NO: 8557141 - DNA, 22 bp, Homo sapiens
ccacctggggctgtggcccctt

SEQ ID NO: 8557142 - DNA, 20 bp, Homo sapiens
ccacctggccaaggctgtgc

SEQ ID NO: 8557143 - DNA, 22 bp, Homo sapiens
ccacctggggcctctgagtctc

SEQ ID NO: 8557144 - DNA, 22 bp, Homo sapiens
ccacccagaccagggatctggg

SEQ ID NO: 8557145 - DNA, 22 bp, Homo sapiens
ccacccagaccagggatctggg

SEQ ID NO: 8557146 - DNA, 22 bp, Homo sapiens
ccacccagaccagggatctggg

SEQ ID NO: 8557147 - DNA, 22 bp, Homo sapiens
ccacccagccagatgcaggaag

SEQ ID NO: 8557148 - DNA, 22 bp, Homo sapiens
ccacccagcagaggaggcaaga

SEQ ID NO: 8557149 - DNA, 22 bp, Homo sapiens
ccacccagcagaggaggcaaga

SEQ ID NO: 8557150 - DNA, 22 bp, Homo sapiens
ccacagtggttgtggcatgtgg

SEQ ID NO: 8557151 - DNA, 22 bp, Homo sapiens
ccacagtgggcacagcaggact

SEQ ID NO: 8557152 - DNA, 22 bp, Homo sapiens
ccacagtgggcacagcaggact

SEQ ID NO: 8557153 - DNA, 22 bp, Homo sapiens
ccacagtgggcacagcaggact

SEQ ID NO: 8557154 - DNA, 22 bp, Homo sapiens
ccacagtggttctcaaccaggg

SEQ ID NO: 8557155 - DNA, 22 bp, Homo sapiens
ccacatcatggatacagttatg

SEQ ID NO: 8557156 - DNA, 22 bp, Homo sapiens
ccaccaggctctgtccgagcgg

SEQ ID NO: 8557157 - DNA, 22 bp, Homo sapiens
ccaccaggcactcacagggaag

SEQ ID NO: 8557158 - DNA, 22 bp, Homo sapiens
ccacatcatggatacagttatg

SEQ ID NO: 8557159 - DNA, 22 bp, Homo sapiens
ccacatacaaatggggtgctgt

SEQ ID NO: 8557160 - DNA, 22 bp, Homo sapiens
ccacatcagaaatgtttactca

SEQ ID NO: 8557161 - DNA, 21 bp, Homo sapiens
ccaccaggtcttctgctcggg

SEQ ID NO: 8557162 - DNA, 21 bp, Homo sapiens
ccaccaggtcttctgctcggg

SEQ ID NO: 8557163 - DNA, 22 bp, Homo sapiens
ccaccatgggaagagagactaa

SEQ ID NO: 8557164 - DNA, 20 bp, Homo sapiens
ccacccacgcgggctctgcc

SEQ ID NO: 8557165 - DNA, 22 bp, Homo sapiens
ccacccacaaccagctggctgt

SEQ ID NO: 8557166 - DNA, 23 bp, Homo sapiens
ccacaggcacagaggcttgcatc

SEQ ID NO: 8557167 - DNA, 23 bp, Homo sapiens
ccacaggcacagaggcttgcatc

SEQ ID NO: 8557168 - DNA, 22 bp, Homo sapiens
aggcaggaggatcatggatgca

SEQ ID NO: 8557169 - DNA, 22 bp, Homo sapiens
aggcaggaggatcatggatgca

SEQ ID NO: 8557170 - DNA, 22 bp, Homo sapiens
aggcaggaggatcatggatgca

SEQ ID NO: 8557171 - DNA, 22 bp, Homo sapiens
aggcaggaggatcatggatgca

SEQ ID NO: 8557172 - DNA, 22 bp, Homo sapiens
aggcaggagtgaccctgacagg

SEQ ID NO: 8557173 - DNA, 22 bp, Homo sapiens
aggcaggaaccctgtgtgcgcc

SEQ ID NO: 8557174 - DNA, 23 bp, Homo sapiens
ccacagagctgccaattcctgtg

SEQ ID NO: 8557175 - DNA, 19 bp, Homo sapiens
ccacagagcatgctgaggc

SEQ ID NO: 8557176 - DNA, 22 bp, Homo sapiens
ccacagagcattagatttcaga

SEQ ID NO: 8557177 - DNA, 17 bp, Homo sapiens
aggcaggagattggaga

SEQ ID NO: 8557178 - DNA, 22 bp, Homo sapiens
aggcaggagcaagccctacaag

SEQ ID NO: 8557179 - DNA, 17 bp, Homo sapiens
aggcaggagattggaga

SEQ ID NO: 8557180 - DNA, 22 bp, Homo sapiens
aggcaggaaccctgtgtgcgcc

SEQ ID NO: 8557181 - DNA, 22 bp, Homo sapiens
aggcaggaaccctgtgtgcgcc

SEQ ID NO: 8557182 - DNA, 22 bp, Homo sapiens
ccacagagagtgtcagcctttg

SEQ ID NO: 8557183 - DNA, 22 bp, Homo sapiens
ccacagagactctgcaggactg

SEQ ID NO: 8557184 - DNA, 22 bp, Homo sapiens
ccacagagagtgtcagcctttg

SEQ ID NO: 8557185 - DNA, 22 bp, Homo sapiens
ccacagagactctgcaggactg

SEQ ID NO: 8557186 - DNA, 22 bp, Homo sapiens
ccacagagactctgcaggactg

SEQ ID NO: 8557187 - DNA, 22 bp, Homo sapiens
ccacagagactctgcaggactg

SEQ ID NO: 8557188 - DNA, 19 bp, Homo sapiens
ccacagagactagaagaca

SEQ ID NO: 8557189 - DNA, 19 bp, Homo sapiens
ccacagagactagaagaca

SEQ ID NO: 8557190 - DNA, 22 bp, Homo sapiens
ccacagaattctgtctccagga

SEQ ID NO: 8557191 - DNA, 22 bp, Homo sapiens
ccacagaatgatgacacttcag

SEQ ID NO: 8557192 - DNA, 22 bp, Homo sapiens
ccacagaccttggcttccacct

SEQ ID NO: 8557193 - DNA, 22 bp, Homo sapiens
ccacagaccttggcttccacct

SEQ ID NO: 8557194 - DNA, 22 bp, Homo sapiens
ccacagagacagggtccttgct

SEQ ID NO: 8557195 - DNA, 22 bp, Homo sapiens
ccacagagacagggtccttgct

SEQ ID NO: 8557196 - DNA, 22 bp, Homo sapiens
ccacagagacagagcccagggt

SEQ ID NO: 8557197 - DNA, 22 bp, Homo sapiens
ccacagagacagagcccagggt

SEQ ID NO: 8557198 - DNA, 23 bp, Homo sapiens
catttctgggagatttataaaat

SEQ ID NO: 8557199 - DNA, 22 bp, Homo sapiens
catttctgcagaattgctcttc

SEQ ID NO: 8557200 - DNA, 22 bp, Homo sapiens
catttctgggagacatgctaga

SEQ ID NO: 8557201 - DNA, 22 bp, Homo sapiens
catttctgggagacatgctaga

SEQ ID NO: 8557202 - DNA, 22 bp, Homo sapiens
catttctgtgacacttccatct

SEQ ID NO: 8557203 - DNA, 22 bp, Homo sapiens
catttctgtcacgttcttttat

SEQ ID NO: 8557204 - DNA, 22 bp, Homo sapiens
catttctgttctcttcctgtac

SEQ ID NO: 8557205 - DNA, 22 bp, Homo sapiens
catttctgtgacacttccatct

SEQ ID NO: 8557206 - DNA, 22 bp, Homo sapiens
catttctgtcacgttcttttat

SEQ ID NO: 8557207 - DNA, 22 bp, Homo sapiens
catttctgtacatgttttggtg

SEQ ID NO: 8557208 - DNA, 22 bp, Homo sapiens
catttctgttctcttcctgtac

SEQ ID NO: 8557209 - DNA, 22 bp, Homo sapiens
catttgaaaatactcttttcca

SEQ ID NO: 8557210 - DNA, 22 bp, Homo sapiens
catttgaaaatactcttttcca

SEQ ID NO: 8557211 - DNA, 22 bp, Homo sapiens
catttgaaacctggaatctacc

SEQ ID NO: 8557212 - DNA, 22 bp, Homo sapiens
ccaatgagacagaaagagcctc

SEQ ID NO: 8557213 - DNA, 22 bp, Homo sapiens
ccacagaatgatgacacttcag

SEQ ID NO: 8557214 - DNA, 22 bp, Homo sapiens
ccaatgatggtgcccacgatga

SEQ ID NO: 8557215 - DNA, 22 bp, Homo sapiens
ccaatcttgttttctacatcca

SEQ ID NO: 8557216 - DNA, 22 bp, Homo sapiens
ccaatcttgctgtccacttggt

SEQ ID NO: 8557217 - DNA, 22 bp, Homo sapiens
cataacatgtacatataaatgc

SEQ ID NO: 8557218 - DNA, 22 bp, Homo sapiens
cataacatgtacatataaatgc

SEQ ID NO: 8557219 - DNA, 22 bp, Homo sapiens
cagttttattggttgaaatctg

SEQ ID NO: 8557220 - DNA, 22 bp, Homo sapiens
cataacatccttgctactttga

SEQ ID NO: 8557221 - DNA, 22 bp, Homo sapiens
cataacattaagcctctatttc

SEQ ID NO: 8557222 - DNA, 22 bp, Homo sapiens
cataacattaagcctctatttc

SEQ ID NO: 8557223 - DNA, 22 bp, Homo sapiens
cataacattaagcctctatttc

SEQ ID NO: 8557224 - DNA, 22 bp, Homo sapiens
cataacattattttctgaagat

SEQ ID NO: 8557225 - DNA, 22 bp, Homo sapiens
cataacattaagcctctatttc

SEQ ID NO: 8557226 - DNA, 22 bp, Homo sapiens
cataacatgtacatataaatgc

SEQ ID NO: 8557227 - DNA, 22 bp, Homo sapiens
cagttttatgtcgaatgtatac

SEQ ID NO: 8557228 - DNA, 22 bp, Homo sapiens
cagttttattggttgaaatctg

SEQ ID NO: 8557229 - DNA, 22 bp, Homo sapiens
aggagccatccccatgagaggt

SEQ ID NO: 8557230 - DNA, 22 bp, Homo sapiens
aggagccagtggagttcctgcc

SEQ ID NO: 8557231 - DNA, 22 bp, Homo sapiens
aggagccatccccatgagaggt

SEQ ID NO: 8557232 - DNA, 19 bp, Homo sapiens
cataatacagtggatctga

SEQ ID NO: 8557233 - DNA, 22 bp, Homo sapiens
cataagttgcagagggtgcatt

SEQ ID NO: 8557234 - DNA, 22 bp, Homo sapiens
cataagaaggtaacatccttaa

SEQ ID NO: 8557235 - DNA, 22 bp, Homo sapiens
cataagaatattccatcctttg

SEQ ID NO: 8557236 - DNA, 22 bp, Homo sapiens
cataactggggacacttctcta

SEQ ID NO: 8557237 - DNA, 22 bp, Homo sapiens
cataactggggacacttctcta

SEQ ID NO: 8557238 - DNA, 22 bp, Homo sapiens
cataactagagtgaaatgttga

SEQ ID NO: 8557239 - DNA, 22 bp, Homo sapiens
cataactagagtgaaatgttga

SEQ ID NO: 8557240 - DNA, 22 bp, Homo sapiens
cataactgggagatccaagggt

SEQ ID NO: 8557241 - DNA, 22 bp, Homo sapiens
cataactttaaagacagtgtgg

SEQ ID NO: 8557242 - DNA, 22 bp, Homo sapiens
cataagaaatttaacagaactt

SEQ ID NO: 8557243 - DNA, 22 bp, Homo sapiens
cataagaaataatgatgatgac

SEQ ID NO: 8557244 - DNA, 22 bp, Homo sapiens
aggaggcctacgcacatgtcta

SEQ ID NO: 8557245 - DNA, 22 bp, Homo sapiens
aggaggccgggattctggagat

SEQ ID NO: 8557246 - DNA, 22 bp, Homo sapiens
aggaggccgctgatgggctccc

SEQ ID NO: 8557247 - DNA, 22 bp, Homo sapiens
aggaggccgggattctggagat

SEQ ID NO: 8557248 - DNA, 23 bp, Homo sapiens
aggaggcctgaaactgaggctga

SEQ ID NO: 8557249 - DNA, 23 bp, Homo sapiens
aggaggcctgaaactgaggctga

SEQ ID NO: 8557250 - DNA, 22 bp, Homo sapiens
aggagctgtgaatgggaggggt

SEQ ID NO: 8557251 - DNA, 22 bp, Homo sapiens
aggagctgtcagagtgccagag

SEQ ID NO: 8557252 - DNA, 22 bp, Homo sapiens
aggagctgtcagagtgccagag

SEQ ID NO: 8557253 - DNA, 22 bp, Homo sapiens
aggagctgtcagagtgccagag

SEQ ID NO: 8557254 - DNA, 22 bp, Homo sapiens
aggagctgtcatttgattcaca

SEQ ID NO: 8557255 - DNA, 22 bp, Homo sapiens
aggagctgggttcctttggtgg

SEQ ID NO: 8557256 - DNA, 17 bp, Homo sapiens
aggagctgggggtggtg

SEQ ID NO: 8557257 - DNA, 16 bp, Homo sapiens
aggagctgggtaggag

SEQ ID NO: 8557258 - DNA, 22 bp, Homo sapiens
aggagctgggttcctttggtgg

SEQ ID NO: 8557259 - DNA, 22 bp, Homo sapiens
cagtgtgggtttgggaggagta

SEQ ID NO: 8557260 - DNA, 22 bp, Homo sapiens
cagtgtgggtgaaatacaaagt

SEQ ID NO: 8557261 - DNA, 22 bp, Homo sapiens
cagtgtggcttagggaataggc

SEQ ID NO: 8557262 - DNA, 22 bp, Homo sapiens
cagtgtggagggagagagcctg

SEQ ID NO: 8557263 - DNA, 22 bp, Homo sapiens
cagtgtggagggagagagcctg

SEQ ID NO: 8557264 - DNA, 22 bp, Homo sapiens
cagtgtggcttagggaataggc

SEQ ID NO: 8557265 - DNA, 22 bp, Homo sapiens
cagtgtggctgagacagaggct

SEQ ID NO: 8557266 - DNA, 22 bp, Homo sapiens
cagtgtggctgagacagaggct

SEQ ID NO: 8557267 - DNA, 22 bp, Homo sapiens
cagtggttctcaatcaggaatg

SEQ ID NO: 8557268 - DNA, 22 bp, Homo sapiens
cagtggttcctgttcttctggg

SEQ ID NO: 8557269 - DNA, 22 bp, Homo sapiens
cagtccagctcatcagtggcac

SEQ ID NO: 8557270 - DNA, 22 bp, Homo sapiens
cagtccaggcctggaggagcca

SEQ ID NO: 8557271 - DNA, 22 bp, Homo sapiens
cagtccaggcctggaggagcca

SEQ ID NO: 8557272 - DNA, 22 bp, Homo sapiens
cagtccaggcctggaggagcca

SEQ ID NO: 8557273 - DNA, 22 bp, Homo sapiens
cagtccaggcctggaggagcca

SEQ ID NO: 8557274 - DNA, 22 bp, Homo sapiens
cagtccagccagtagggtgtgg

SEQ ID NO: 8557275 - DNA, 22 bp, Homo sapiens
cagtccagccccctgctaaaag

SEQ ID NO: 8557276 - DNA, 22 bp, Homo sapiens
cagtccagagcccaccagagga

SEQ ID NO: 8557277 - DNA, 22 bp, Homo sapiens
cagtccagagtaccccaagaag

SEQ ID NO: 8557278 - DNA, 22 bp, Homo sapiens
cagtccagagcccaccagagga

SEQ ID NO: 8557279 - DNA, 22 bp, Homo sapiens
aggagccaggccccatggggct

SEQ ID NO: 8557280 - DNA, 23 bp, Homo sapiens
aggagccaggtgcagcccttgtg

SEQ ID NO: 8557281 - DNA, 22 bp, Homo sapiens
aggagccaggaaacctgctctg

SEQ ID NO: 8557282 - DNA, 22 bp, Homo sapiens
aggagccaggaaacctgctctg

SEQ ID NO: 8557283 - DNA, 22 bp, Homo sapiens
aggagccagaatccagactcgg

SEQ ID NO: 8557284 - DNA, 22 bp, Homo sapiens
aggagccacttaggtgagataa

SEQ ID NO: 8557285 - DNA, 22 bp, Homo sapiens
aggagccagattctctcacttt

SEQ ID NO: 8557286 - DNA, 22 bp, Homo sapiens
aggagccacctaggagctgttt

SEQ ID NO: 8557287 - DNA, 22 bp, Homo sapiens
aggagccacttaggtgagataa

SEQ ID NO: 8557288 - DNA, 22 bp, Homo sapiens
aggagccacttaggtgagataa

SEQ ID NO: 8557289 - DNA, 22 bp, Homo sapiens
cagtgttccctgaacatatgtt

SEQ ID NO: 8557290 - DNA, 21 bp, Homo sapiens
cagtgtggtgaccagggtctc

SEQ ID NO: 8557291 - DNA, 21 bp, Homo sapiens
cagtgtggtgaccagggtctc

SEQ ID NO: 8557292 - DNA, 22 bp, Homo sapiens
cagtgtggtgagattccaggtg

SEQ ID NO: 8557293 - DNA, 22 bp, Homo sapiens
cagtgtggtgagattccaggtg

SEQ ID NO: 8557294 - DNA, 22 bp, Homo sapiens
cagtgtggtgtgcacagcttag

SEQ ID NO: 8557295 - DNA, 22 bp, Homo sapiens
cagtgtgtggatcctcccagga

SEQ ID NO: 8557296 - DNA, 22 bp, Homo sapiens
cagtgtgtgactctgggggtac

SEQ ID NO: 8557297 - DNA, 22 bp, Homo sapiens
cagtgtgtgactctgggggtac

SEQ ID NO: 8557298 - DNA, 22 bp, Homo sapiens
catcttgatgctttgacaggtt

SEQ ID NO: 8557299 - DNA, 22 bp, Homo sapiens
catcttgagacatgaaaggtgt

SEQ ID NO: 8557300 - DNA, 22 bp, Homo sapiens
catcttgactgggataagggat

SEQ ID NO: 8557301 - DNA, 22 bp, Homo sapiens
catcttctgggacttctcagtt

SEQ ID NO: 8557302 - DNA, 22 bp, Homo sapiens
catcttctgggacttctcagtt

SEQ ID NO: 8557303 - DNA, 20 bp, Homo sapiens
catcttgaaggtcttccaca

SEQ ID NO: 8557304 - DNA, 22 bp, Homo sapiens
catcttgaaggtttctttagct

SEQ ID NO: 8557305 - DNA, 22 bp, Homo sapiens
catcttgactgggataagggat

SEQ ID NO: 8557306 - DNA, 22 bp, Homo sapiens
catcttcattttgtccagtact

SEQ ID NO: 8557307 - DNA, 22 bp, Homo sapiens
aggatgagaagattggaatctt

SEQ ID NO: 8557308 - DNA, 22 bp, Homo sapiens
aggatgagagatacatggagca

SEQ ID NO: 8557309 - DNA, 22 bp, Homo sapiens
aggatggcttgcaggaggctgt

SEQ ID NO: 8557310 - DNA, 22 bp, Homo sapiens
aggatgggcctgggatatgctt

SEQ ID NO: 8557311 - DNA, 22 bp, Homo sapiens
aggatgggcctgggatatgctt

SEQ ID NO: 8557312 - DNA, 22 bp, Homo sapiens
aggatggggtctgcagcctggt

SEQ ID NO: 8557313 - DNA, 22 bp, Homo sapiens
aggatgggcctgggatatgctt

SEQ ID NO: 8557314 - DNA, 22 bp, Homo sapiens
aggatgggcctgggatatgctt

SEQ ID NO: 8557315 - DNA, 23 bp, Homo sapiens
aggatgtaggatgtatggcagag

SEQ ID NO: 8557316 - DNA, 23 bp, Homo sapiens
aggatgtaggatgtatggcagag

SEQ ID NO: 8557317 - DNA, 23 bp, Homo sapiens
aggatgggtggcaatagaaagac

SEQ ID NO: 8557318 - DNA, 23 bp, Homo sapiens
aggatgggtggcaatagaaagac

SEQ ID NO: 8557319 - DNA, 22 bp, Homo sapiens
aggatggggtctgcagcctggt

SEQ ID NO: 8557320 - DNA, 22 bp, Homo sapiens
aggatgggtcagctagagtcca

SEQ ID NO: 8557321 - DNA, 22 bp, Homo sapiens
catgagcataaatcagtcacga

SEQ ID NO: 8557322 - DNA, 22 bp, Homo sapiens
catgagcattttggtctagttt

SEQ ID NO: 8557323 - DNA, 22 bp, Homo sapiens
catgagcataaatcagtcacga

SEQ ID NO: 8557324 - DNA, 22 bp, Homo sapiens
catgagcataaatcagtcacga

SEQ ID NO: 8557325 - DNA, 22 bp, Homo sapiens
catgaggatccaggtgacaggc

SEQ ID NO: 8557326 - DNA, 22 bp, Homo sapiens
catgaggatccaggtgacaggc

SEQ ID NO: 8557327 - DNA, 18 bp, Homo sapiens
catgagctgcccctagac

SEQ ID NO: 8557328 - DNA, 22 bp, Homo sapiens
aggatttggggaagaaaacact

SEQ ID NO: 8557329 - DNA, 22 bp, Homo sapiens
aggatttggccatggcttcggg

SEQ ID NO: 8557330 - DNA, 22 bp, Homo sapiens
aggatttgcactggtgtttgag

SEQ ID NO: 8557331 - DNA, 22 bp, Homo sapiens
aggatttgtatagctttctttt

SEQ ID NO: 8557332 - DNA, 22 bp, Homo sapiens
catgagaatgaagaagacttaa

SEQ ID NO: 8557333 - DNA, 22 bp, Homo sapiens
catgagaatgaagaagacttaa

SEQ ID NO: 8557334 - DNA, 22 bp, Homo sapiens
catgagatctgcagggatgggc

SEQ ID NO: 8557335 - DNA, 22 bp, Homo sapiens
catgagataatttttctccagt

SEQ ID NO: 8557336 - DNA, 22 bp, Homo sapiens
aggatgtgagtggacacagtcc

SEQ ID NO: 8557337 - DNA, 22 bp, Homo sapiens
catctcatcagtgagagtcagc

SEQ ID NO: 8557338 - DNA, 22 bp, Homo sapiens
catctcatcagtgagagtcagc

SEQ ID NO: 8557339 - DNA, 22 bp, Homo sapiens
catctcatcctgccctaaaaca

SEQ ID NO: 8557340 - DNA, 22 bp, Homo sapiens
catctcatagtgcagtgctgta

SEQ ID NO: 8557341 - DNA, 22 bp, Homo sapiens
catctcatagtgcagtgctgta

SEQ ID NO: 8557342 - DNA, 22 bp, Homo sapiens
catacatatgtggatgtcatat

SEQ ID NO: 8557343 - DNA, 22 bp, Homo sapiens
catacatatgtggatgtcatat

SEQ ID NO: 8557344 - DNA, 22 bp, Homo sapiens
catacatatgtggatgtcatat

SEQ ID NO: 8557345 - DNA, 22 bp, Homo sapiens
catacatatgcatgtgtgtata

SEQ ID NO: 8557346 - DNA, 22 bp, Homo sapiens
catccaaactctcattatctgt

SEQ ID NO: 8557347 - DNA, 22 bp, Homo sapiens
catccaaagcaaatatcttaaa

SEQ ID NO: 8557348 - DNA, 22 bp, Homo sapiens
catctctccacggcagctctcg

SEQ ID NO: 8557349 - DNA, 19 bp, Homo sapiens
catctctgcaaggagctgc

SEQ ID NO: 8557350 - DNA, 22 bp, Homo sapiens
catctctgagacctcagctggg

SEQ ID NO: 8557351 - DNA, 19 bp, Homo sapiens
catctctgcaaggagctgc

SEQ ID NO: 8557352 - DNA, 22 bp, Homo sapiens
catctctggttcagtctctgtg

SEQ ID NO: 8557353 - DNA, 19 bp, Homo sapiens
catctctgcaaggagctgc

SEQ ID NO: 8557354 - DNA, 19 bp, Homo sapiens
catctctgcaaggagctgc

SEQ ID NO: 8557355 - DNA, 22 bp, Homo sapiens
catcttataggcagagttcagt

SEQ ID NO: 8557356 - DNA, 22 bp, Homo sapiens
catcttattttcttctagtgct

SEQ ID NO: 8557357 - DNA, 22 bp, Homo sapiens
catcttcaccagagacaagcaa

SEQ ID NO: 8557358 - DNA, 22 bp, Homo sapiens
catctcttcattagcattattg

SEQ ID NO: 8557359 - DNA, 21 bp, Homo sapiens
catcttaggttgtacatatat

SEQ ID NO: 8557360 - DNA, 22 bp, Homo sapiens
catcttaatttctaacaggcac

SEQ ID NO: 8557361 - DNA, 22 bp, Homo sapiens
cataatttttttaagtcagaac

SEQ ID NO: 8557362 - DNA, 22 bp, Homo sapiens
aggaggctgaactagggtctgg

SEQ ID NO: 8557363 - DNA, 22 bp, Homo sapiens
catacaaatgtgtccaggctct

SEQ ID NO: 8557364 - DNA, 22 bp, Homo sapiens
aggaggctctcaggtcctcccc

SEQ ID NO: 8557365 - DNA, 22 bp, Homo sapiens
aggaggctgaactagggtctgg

SEQ ID NO: 8557366 - DNA, 22 bp, Homo sapiens
aggaggcctggctggggagatc

SEQ ID NO: 8557367 - DNA, 23 bp, Homo sapiens
aggaggcctgaaactgaggctga

SEQ ID NO: 8557368 - DNA, 20 bp, Homo sapiens
aggaggcctgcagatagttc

SEQ ID NO: 8557369 - DNA, 22 bp, Homo sapiens
aggaggcctgttttctcctgga

SEQ ID NO: 8557370 - DNA, 22 bp, Homo sapiens
aggaggctctcaggtcctcccc

SEQ ID NO: 8557371 - DNA, 19 bp, Homo sapiens
catacaattaccataggat

SEQ ID NO: 8557372 - DNA, 22 bp, Homo sapiens
catacaagcgttcaatagatgt

SEQ ID NO: 8557373 - DNA, 22 bp, Homo sapiens
catacaatcaagttctttatta

SEQ ID NO: 8557374 - DNA, 22 bp, Homo sapiens
catacaagcgttcaatagatgt

SEQ ID NO: 8557375 - DNA, 22 bp, Homo sapiens
catacagttttccctagatgtg

SEQ ID NO: 8557376 - DNA, 22 bp, Homo sapiens
catacatactgagtggactgat

SEQ ID NO: 8557377 - DNA, 22 bp, Homo sapiens
catacagagaaggataataaag

SEQ ID NO: 8557378 - DNA, 22 bp, Homo sapiens
agctggttgcttaacctctctg

SEQ ID NO: 8557379 - DNA, 22 bp, Homo sapiens
agctggttcattcattcatggt

SEQ ID NO: 8557380 - DNA, 22 bp, Homo sapiens
agctgtatgcccaagatgctat

SEQ ID NO: 8557381 - DNA, 22 bp, Homo sapiens
agctgtatttgtgaatatttaa

SEQ ID NO: 8557382 - DNA, 22 bp, Homo sapiens
agctgtcaccaggagccggacc

SEQ ID NO: 8557383 - DNA, 22 bp, Homo sapiens
agctgtaatataagcaatgaaa

SEQ ID NO: 8557384 - DNA, 22 bp, Homo sapiens
agctgtctctctggtgtccata

SEQ ID NO: 8557385 - DNA, 19 bp, Homo sapiens
agctgtctgctgcttttgt

SEQ ID NO: 8557386 - DNA, 22 bp, Homo sapiens
agctgtctacctgcagagtcct

SEQ ID NO: 8557387 - DNA, 22 bp, Homo sapiens
agctgtctccagatacaggatt

SEQ ID NO: 8557388 - DNA, 22 bp, Homo sapiens
agctgtctacctgcagagtcct

SEQ ID NO: 8557389 - DNA, 22 bp, Homo sapiens
agctgtcctgtgggagggagtg

SEQ ID NO: 8557390 - DNA, 22 bp, Homo sapiens
agctgtcctggctcaggctgtg

SEQ ID NO: 8557391 - DNA, 22 bp, Homo sapiens
agctgtcctggctcaggctgtg

SEQ ID NO: 8557392 - DNA, 22 bp, Homo sapiens
agctgtcctggctcaggctgtg

SEQ ID NO: 8557393 - DNA, 22 bp, Homo sapiens
agctgtcagtgctgtgcctgta

SEQ ID NO: 8557394 - DNA, 22 bp, Homo sapiens
caggcaggtgcagattcctctt

SEQ ID NO: 8557395 - DNA, 22 bp, Homo sapiens
agctggtggagaagcagacctc

SEQ ID NO: 8557396 - DNA, 22 bp, Homo sapiens
agctggtggaagggagcccaaa

SEQ ID NO: 8557397 - DNA, 22 bp, Homo sapiens
caggcagcgtcctgcttcctgt

SEQ ID NO: 8557398 - DNA, 22 bp, Homo sapiens
caggcagcgtcctgcttcctgt

SEQ ID NO: 8557399 - DNA, 22 bp, Homo sapiens
caggcagcgctcgtggcctggc

SEQ ID NO: 8557400 - DNA, 22 bp, Homo sapiens
caggcagcgctcgtggcctggc

SEQ ID NO: 8557401 - DNA, 22 bp, Homo sapiens
caggcagccttctcgtctcaca

SEQ ID NO: 8557402 - DNA, 22 bp, Homo sapiens
caggcagcctgcggtctgcaca

SEQ ID NO: 8557403 - DNA, 22 bp, Homo sapiens
caggcagcctgcggtctgcaca

SEQ ID NO: 8557404 - DNA, 22 bp, Homo sapiens
caggcagcctgcggtctgcaca

SEQ ID NO: 8557405 - DNA, 22 bp, Homo sapiens
caggcagcctgcggtctgcaca

SEQ ID NO: 8557406 - DNA, 22 bp, Homo sapiens
caggcagctagatttataacaa

SEQ ID NO: 8557407 - DNA, 22 bp, Homo sapiens
caggcagggagctggaaaggat

SEQ ID NO: 8557408 - DNA, 22 bp, Homo sapiens
caggcagctcgatgccttgttg

SEQ ID NO: 8557409 - DNA, 22 bp, Homo sapiens
caggcagctcgatgccttgttg

SEQ ID NO: 8557410 - DNA, 18 bp, Homo sapiens
agcttccctctgagaggg

SEQ ID NO: 8557411 - DNA, 22 bp, Homo sapiens
agcttcctacaaccatctcaga

SEQ ID NO: 8557412 - DNA, 22 bp, Homo sapiens
agcttcctacaaccatctcaga

SEQ ID NO: 8557413 - DNA, 22 bp, Homo sapiens
agcttcctgactggtgctctta

SEQ ID NO: 8557414 - DNA, 22 bp, Homo sapiens
agcttcctcacctcagaggtct

SEQ ID NO: 8557415 - DNA, 22 bp, Homo sapiens
agcttcctcacctcagaggtct

SEQ ID NO: 8557416 - DNA, 22 bp, Homo sapiens
agcttcctcacctcagaggtct

SEQ ID NO: 8557417 - DNA, 23 bp, Homo sapiens
agcttcctagtgacctggagtct

SEQ ID NO: 8557418 - DNA, 22 bp, Homo sapiens
agcttcctacaaccatctcaga

SEQ ID NO: 8557419 - DNA, 22 bp, Homo sapiens
agcttcctacaaccatctcaga

SEQ ID NO: 8557420 - DNA, 22 bp, Homo sapiens
agcttcctacaaccatctcaga

SEQ ID NO: 8557421 - DNA, 22 bp, Homo sapiens
agcttcctgtcttctgcacaaa

SEQ ID NO: 8557422 - DNA, 22 bp, Homo sapiens
agcttcctgttgagagagggag

SEQ ID NO: 8557423 - DNA, 22 bp, Homo sapiens
agcttcctgttgagagagggag

SEQ ID NO: 8557424 - DNA, 22 bp, Homo sapiens
agcttcctgttgagagagggag

SEQ ID NO: 8557425 - DNA, 22 bp, Homo sapiens
agcttccttgaattctgtagaa

SEQ ID NO: 8557426 - DNA, 22 bp, Homo sapiens
agcttccttgaattctgtagaa

SEQ ID NO: 8557427 - DNA, 22 bp, Homo sapiens
agcttccttggcgctgaggcct

SEQ ID NO: 8557428 - DNA, 22 bp, Homo sapiens
agcttccttggcgctgaggcct

SEQ ID NO: 8557429 - DNA, 22 bp, Homo sapiens
agcttcctgtcttctgcacaaa

SEQ ID NO: 8557430 - DNA, 22 bp, Homo sapiens
agcttcctgtcttctgcacaaa

SEQ ID NO: 8557431 - DNA, 21 bp, Homo sapiens
agcttcctgcagtgggaggtc

SEQ ID NO: 8557432 - DNA, 22 bp, Homo sapiens
agcttcctgatgcaagagggct

SEQ ID NO: 8557433 - DNA, 21 bp, Homo sapiens
agcttcctgcagtgggaggtc

SEQ ID NO: 8557434 - DNA, 22 bp, Homo sapiens
agcttcctgatgcaagagggct

SEQ ID NO: 8557435 - DNA, 22 bp, Homo sapiens
agcttcctgatgcaagagggct

SEQ ID NO: 8557436 - DNA, 22 bp, Homo sapiens
caggctctgctgctacagctgt

SEQ ID NO: 8557437 - DNA, 22 bp, Homo sapiens
caggctctgctgctacagctgt

SEQ ID NO: 8557438 - DNA, 22 bp, Homo sapiens
caggctctgctgctacagctgt

SEQ ID NO: 8557439 - DNA, 22 bp, Homo sapiens
agcttctagcccatccagcagg

SEQ ID NO: 8557440 - DNA, 23 bp, Homo sapiens
agcttcgccttcctttctctgca

SEQ ID NO: 8557441 - DNA, 23 bp, Homo sapiens
agcttcgccttcctttctctgca

SEQ ID NO: 8557442 - DNA, 22 bp, Homo sapiens
agcttctcagcttcagaactgt

SEQ ID NO: 8557443 - DNA, 21 bp, Homo sapiens
caggctctgctagaggagcct

SEQ ID NO: 8557444 - DNA, 19 bp, Homo sapiens
agcttccatattctctagt

SEQ ID NO: 8557445 - DNA, 19 bp, Homo sapiens
agcttccatattctctagt

SEQ ID NO: 8557446 - DNA, 22 bp, Homo sapiens
agcttactgggcagtaaagatt

SEQ ID NO: 8557447 - DNA, 22 bp, Homo sapiens
caggcccatttgtagccacttt

SEQ ID NO: 8557448 - DNA, 22 bp, Homo sapiens
caggcccattctaggcttgcta

SEQ ID NO: 8557449 - DNA, 22 bp, Homo sapiens
caggcccatgagggcagccaca

SEQ ID NO: 8557450 - DNA, 22 bp, Homo sapiens
caggcccatctgctcccaggct

SEQ ID NO: 8557451 - DNA, 22 bp, Homo sapiens
caggcccatctgctcccaggct

SEQ ID NO: 8557452 - DNA, 22 bp, Homo sapiens
caggcccagtgatcagggctct

SEQ ID NO: 8557453 - DNA, 22 bp, Homo sapiens
agctgtctggaagttcctcatg

SEQ ID NO: 8557454 - DNA, 22 bp, Homo sapiens
agctgtctgtgaacacagcatt

SEQ ID NO: 8557455 - DNA, 22 bp, Homo sapiens
agctgtctgtctcctgaggaga

SEQ ID NO: 8557456 - DNA, 22 bp, Homo sapiens
agctgtctttggagagggagag

SEQ ID NO: 8557457 - DNA, 22 bp, Homo sapiens
agctgtctttctgcctcctgat

SEQ ID NO: 8557458 - DNA, 22 bp, Homo sapiens
agctgtctttctgcctcctgat

SEQ ID NO: 8557459 - DNA, 22 bp, Homo sapiens
agctgtctttcattacctcatt

SEQ ID NO: 8557460 - DNA, 22 bp, Homo sapiens
agctgtctttaagtgagctttg

SEQ ID NO: 8557461 - DNA, 22 bp, Homo sapiens
agctgtctttcattacctcatt

SEQ ID NO: 8557462 - DNA, 22 bp, Homo sapiens
caggagcatgctgatgccagaa

SEQ ID NO: 8557463 - DNA, 22 bp, Homo sapiens
caggagcaggcccaaggacaca

SEQ ID NO: 8557464 - DNA, 22 bp, Homo sapiens
caggagcaggcccaaggacaca

SEQ ID NO: 8557465 - DNA, 22 bp, Homo sapiens
caggagcagagggtggtcagca

SEQ ID NO: 8557466 - DNA, 22 bp, Homo sapiens
caggagcagagggtggtcagca

SEQ ID NO: 8557467 - DNA, 18 bp, Homo sapiens
caggagcaggagttgaac

SEQ ID NO: 8557468 - DNA, 18 bp, Homo sapiens
caggagcaggagttgaac

SEQ ID NO: 8557469 - DNA, 18 bp, Homo sapiens
caggagcaggagttgaac

SEQ ID NO: 8557470 - DNA, 22 bp, Homo sapiens
caggatggccccggggctgtgc

SEQ ID NO: 8557471 - DNA, 22 bp, Homo sapiens
caggatggcagagaaaagggtg

SEQ ID NO: 8557472 - DNA, 22 bp, Homo sapiens
caggatggccccggggctgtgc

SEQ ID NO: 8557473 - DNA, 22 bp, Homo sapiens
caggatggccccggggctgtgc

SEQ ID NO: 8557474 - DNA, 22 bp, Homo sapiens
caggatggccccggggctgtgc

SEQ ID NO: 8557475 - DNA, 22 bp, Homo sapiens
caggatggagagttgttggttg

SEQ ID NO: 8557476 - DNA, 22 bp, Homo sapiens
caggatggagggagggctgtta

SEQ ID NO: 8557477 - DNA, 22 bp, Homo sapiens
caggatggagggagggctgtta

SEQ ID NO: 8557478 - DNA, 22 bp, Homo sapiens
caggatggagggagggctgtta

SEQ ID NO: 8557479 - DNA, 22 bp, Homo sapiens
caggatggagggagggctgtta

SEQ ID NO: 8557480 - DNA, 22 bp, Homo sapiens
caggagcccagagtcctcagct

SEQ ID NO: 8557481 - DNA, 22 bp, Homo sapiens
caggagcccagagtcctcagct

SEQ ID NO: 8557482 - DNA, 22 bp, Homo sapiens
caggagtctgttcctcatttgt

SEQ ID NO: 8557483 - DNA, 22 bp, Homo sapiens
caggcagagtgaggtggtctaa

SEQ ID NO: 8557484 - DNA, 20 bp, Homo sapiens
caggcacactcattcctgct

SEQ ID NO: 8557485 - DNA, 20 bp, Homo sapiens
caggcacactcattcctgct

SEQ ID NO: 8557486 - DNA, 22 bp, Homo sapiens
caggcacacccactggtgcaga

SEQ ID NO: 8557487 - DNA, 22 bp, Homo sapiens
caggcacacccactggtgcaga

SEQ ID NO: 8557488 - DNA, 22 bp, Homo sapiens
caggcacacatccgtgagagat

SEQ ID NO: 8557489 - DNA, 22 bp, Homo sapiens
caggcacacatccgtgagagat

SEQ ID NO: 8557490 - DNA, 22 bp, Homo sapiens
caggcacacatccgtgagagat

SEQ ID NO: 8557491 - DNA, 22 bp, Homo sapiens
caggcacacagcacatggcctg

SEQ ID NO: 8557492 - DNA, 22 bp, Homo sapiens
caggatggtcagatgcattgtc

SEQ ID NO: 8557493 - DNA, 22 bp, Homo sapiens
caggatggtcagatgcattgtc

SEQ ID NO: 8557494 - DNA, 22 bp, Homo sapiens
caggatggtcagatgcattgtc

SEQ ID NO: 8557495 - DNA, 22 bp, Homo sapiens
caggcacaattatttccctttc

SEQ ID NO: 8557496 - DNA, 22 bp, Homo sapiens
caggcacacagcacatggcctg

SEQ ID NO: 8557497 - DNA, 22 bp, Homo sapiens
caggatgggatgtagtgggccc

SEQ ID NO: 8557498 - DNA, 22 bp, Homo sapiens
caggatgggatgtagtgggccc

SEQ ID NO: 8557499 - DNA, 22 bp, Homo sapiens
caggatgggatgtagtgggccc

SEQ ID NO: 8557500 - DNA, 22 bp, Homo sapiens
caggatgggatgtagtgggccc

SEQ ID NO: 8557501 - DNA, 22 bp, Homo sapiens
caggatgggatgtagtgggccc

SEQ ID NO: 8557502 - DNA, 22 bp, Homo sapiens
caggatgggatgtagtgggccc

SEQ ID NO: 8557503 - DNA, 22 bp, Homo sapiens
cagctgttcttgggacagacag

SEQ ID NO: 8557504 - DNA, 22 bp, Homo sapiens
cagctgttgactggtacatgaa

SEQ ID NO: 8557505 - DNA, 22 bp, Homo sapiens
cagctgttcttgggacagacag

SEQ ID NO: 8557506 - DNA, 22 bp, Homo sapiens
cagctgttgcagcactgagaga

SEQ ID NO: 8557507 - DNA, 22 bp, Homo sapiens
cagctgttgatctcttaagcct

SEQ ID NO: 8557508 - DNA, 20 bp, Homo sapiens
caggacagcgcaatcggagg

SEQ ID NO: 8557509 - DNA, 20 bp, Homo sapiens
caggacagcgcaatcggagg

SEQ ID NO: 8557510 - DNA, 22 bp, Homo sapiens
caggacctggaatgcttgtgaa

SEQ ID NO: 8557511 - DNA, 22 bp, Homo sapiens
caggacgggcaaacaggatggt

SEQ ID NO: 8557512 - DNA, 22 bp, Homo sapiens
caggacctgaagacaggcaggt

SEQ ID NO: 8557513 - DNA, 22 bp, Homo sapiens
caggagaaggtttggagtgcag

SEQ ID NO: 8557514 - DNA, 22 bp, Homo sapiens
caggagcaaggagcagtgggat

SEQ ID NO: 8557515 - DNA, 22 bp, Homo sapiens
caggagcaaggagcagtgggat

SEQ ID NO: 8557516 - DNA, 22 bp, Homo sapiens
caggactggctcgcagtgggtg

SEQ ID NO: 8557517 - DNA, 22 bp, Homo sapiens
caggactggctcgcagtgggtg

SEQ ID NO: 8557518 - DNA, 22 bp, Homo sapiens
caggactggctcgcagtgggtg

SEQ ID NO: 8557519 - DNA, 22 bp, Homo sapiens
caggactgaagggcacagggaa

SEQ ID NO: 8557520 - DNA, 22 bp, Homo sapiens
caggactgaagggcacagggaa

SEQ ID NO: 8557521 - DNA, 22 bp, Homo sapiens
caggactgatgttcctccagcc

SEQ ID NO: 8557522 - DNA, 22 bp, Homo sapiens
cagctggttatcagagaggcct

SEQ ID NO: 8557523 - DNA, 22 bp, Homo sapiens
cagctggttatcagagaggcct

SEQ ID NO: 8557524 - DNA, 22 bp, Homo sapiens
cagctggtgtccagggaagtgg

SEQ ID NO: 8557525 - DNA, 22 bp, Homo sapiens
cagctggttggaagggagctga

SEQ ID NO: 8557526 - DNA, 22 bp, Homo sapiens
cagctggttggaagggagctga

SEQ ID NO: 8557527 - DNA, 23 bp, Homo sapiens
cagctggttgtgggagtggctgc

SEQ ID NO: 8557528 - DNA, 22 bp, Homo sapiens
cagctggtcaactgaatgaaca

SEQ ID NO: 8557529 - DNA, 22 bp, Homo sapiens
cagctgggtttagtggggtgtg

SEQ ID NO: 8557530 - DNA, 22 bp, Homo sapiens
cagctgggtttagtggggtgtg

SEQ ID NO: 8557531 - DNA, 22 bp, Homo sapiens
cagctgggtttagtggggtgtg

SEQ ID NO: 8557532 - DNA, 22 bp, Homo sapiens
cagctgtgtctaattatggctg

SEQ ID NO: 8557533 - DNA, 22 bp, Homo sapiens
cagctgttactctgagtaaatg

SEQ ID NO: 8557534 - DNA, 22 bp, Homo sapiens
cagctgtccaaacacattaact

SEQ ID NO: 8557535 - DNA, 22 bp, Homo sapiens
cagctgtccaaacacattaact

SEQ ID NO: 8557536 - DNA, 22 bp, Homo sapiens
cagctgttcagcaactcgcaga

SEQ ID NO: 8557537 - DNA, 22 bp, Homo sapiens
cagctgttcattgttgccaccc

SEQ ID NO: 8557538 - DNA, 22 bp, Homo sapiens
cagctgttcggggctggcatgt

SEQ ID NO: 8557539 - DNA, 22 bp, Homo sapiens
cagctgttcctggaaggagacc

SEQ ID NO: 8557540 - DNA, 22 bp, Homo sapiens
cagctgttcacatttccaaaac

SEQ ID NO: 8557541 - DNA, 22 bp, Homo sapiens
cagctgttatgaggtgtacatg

SEQ ID NO: 8557542 - DNA, 22 bp, Homo sapiens
cagctgttcacatttccaaaac

SEQ ID NO: 8557543 - DNA, 22 bp, Homo sapiens
aggaagtgaaagggaaggagtt

SEQ ID NO: 8557544 - DNA, 21 bp, Homo sapiens
aggaagtggccagattgggaa

SEQ ID NO: 8557545 - DNA, 22 bp, Homo sapiens
aggaagtgctaagagaacatca

SEQ ID NO: 8557546 - DNA, 22 bp, Homo sapiens
aggaagtgctaagagaacatca

SEQ ID NO: 8557547 - DNA, 22 bp, Homo sapiens
caggtgggccatgaaaaatgac

SEQ ID NO: 8557548 - DNA, 22 bp, Homo sapiens
cagggctgttagctgctgctct

SEQ ID NO: 8557549 - DNA, 22 bp, Homo sapiens
cagggcttactggaggctgctt

SEQ ID NO: 8557550 - DNA, 22 bp, Homo sapiens
cagggcttcgctcctggtgcac

SEQ ID NO: 8557551 - DNA, 22 bp, Homo sapiens
cagggcttcgctcctggtgcac

SEQ ID NO: 8557552 - DNA, 22 bp, Homo sapiens
aggacagagcctgtgcagaccg

SEQ ID NO: 8557553 - DNA, 22 bp, Homo sapiens
aggacagagcctgtgcagaccg

SEQ ID NO: 8557554 - DNA, 22 bp, Homo sapiens
aggacagacctaggactggagc

SEQ ID NO: 8557555 - DNA, 22 bp, Homo sapiens
aggacagagccctagtttcata

SEQ ID NO: 8557556 - DNA, 22 bp, Homo sapiens
aggacacatgcacaccctgcgt

SEQ ID NO: 8557557 - DNA, 22 bp, Homo sapiens
aggaatagaccacttcactgag

SEQ ID NO: 8557558 - DNA, 22 bp, Homo sapiens
aggaagttggcattttgtttca

SEQ ID NO: 8557559 - DNA, 23 bp, Homo sapiens
aggaagttatgaagggagaatag

SEQ ID NO: 8557560 - DNA, 22 bp, Homo sapiens
aggaatatgagctgctgcagtg

SEQ ID NO: 8557561 - DNA, 22 bp, Homo sapiens
aggaatagaccacttcactgag

SEQ ID NO: 8557562 - DNA, 23 bp, Homo sapiens
aggaagttaaggcagacagacag

SEQ ID NO: 8557563 - DNA, 23 bp, Homo sapiens
aggaagttatgaagggagaatag

SEQ ID NO: 8557564 - DNA, 22 bp, Homo sapiens
aggaagttagtaaattatgtgc

SEQ ID NO: 8557565 - DNA, 23 bp, Homo sapiens
aggaagttaaggcagacagacag

SEQ ID NO: 8557566 - DNA, 22 bp, Homo sapiens
aggaagttagtaaattatgtgc

SEQ ID NO: 8557567 - DNA, 22 bp, Homo sapiens
aggacaagacaaggaccagaga

SEQ ID NO: 8557568 - DNA, 22 bp, Homo sapiens
aggacaagacaaggaccagaga

SEQ ID NO: 8557569 - DNA, 22 bp, Homo sapiens
aggaatgaactcgagtgatctg

SEQ ID NO: 8557570 - DNA, 22 bp, Homo sapiens
aggaatctgtggttttaacagg

SEQ ID NO: 8557571 - DNA, 22 bp, Homo sapiens
aggaatcccgcaccagctgctg

SEQ ID NO: 8557572 - DNA, 22 bp, Homo sapiens
aggaatcaggagatgagcacgg

SEQ ID NO: 8557573 - DNA, 22 bp, Homo sapiens
cagtatgtgatgcaacggaata

SEQ ID NO: 8557574 - DNA, 22 bp, Homo sapiens
cagtatgtctactggacaaagt

SEQ ID NO: 8557575 - DNA, 22 bp, Homo sapiens
cagtatgtctactggacaaagt

SEQ ID NO: 8557576 - DNA, 22 bp, Homo sapiens
cagtatgtactcttatcatgta

SEQ ID NO: 8557577 - DNA, 22 bp, Homo sapiens
cagtatgtactcttatcatgta

SEQ ID NO: 8557578 - DNA, 22 bp, Homo sapiens
cagtatgtactcttatcatgta

SEQ ID NO: 8557579 - DNA, 22 bp, Homo sapiens
cagtatgtccttcctcgttggc

SEQ ID NO: 8557580 - DNA, 22 bp, Homo sapiens
cagtatcttgcttatagacaca

SEQ ID NO: 8557581 - DNA, 22 bp, Homo sapiens
cagtatgactacaaacagcttt

SEQ ID NO: 8557582 - DNA, 22 bp, Homo sapiens
cagtatgactacaaacagcttt

SEQ ID NO: 8557583 - DNA, 22 bp, Homo sapiens
cagtatgattgccagttctatc

SEQ ID NO: 8557584 - DNA, 22 bp, Homo sapiens
cagtatgcagttgaaaataagc

SEQ ID NO: 8557585 - DNA, 22 bp, Homo sapiens
cagtatgagagttgaatcaagg

SEQ ID NO: 8557586 - DNA, 22 bp, Homo sapiens
cagtaagtcaacaaacatgggg

SEQ ID NO: 8557587 - DNA, 22 bp, Homo sapiens
cagtaataaagctaagtatttc

SEQ ID NO: 8557588 - DNA, 22 bp, Homo sapiens
cagtaatagatttgagagtggt

SEQ ID NO: 8557589 - DNA, 22 bp, Homo sapiens
cagtaatagaggctttgagtct

SEQ ID NO: 8557590 - DNA, 22 bp, Homo sapiens
cagtaataagctggagggtgtg

SEQ ID NO: 8557591 - DNA, 22 bp, Homo sapiens
cagtatttatggcttgagtatt

SEQ ID NO: 8557592 - DNA, 22 bp, Homo sapiens
cagtatttcattcagaattgtt

SEQ ID NO: 8557593 - DNA, 22 bp, Homo sapiens
cagtatttcattcagaattgtt

SEQ ID NO: 8557594 - DNA, 22 bp, Homo sapiens
cagtatgtttgggagacatgac

SEQ ID NO: 8557595 - DNA, 22 bp, Homo sapiens
cagtatgtttgggagacatgac

SEQ ID NO: 8557596 - DNA, 22 bp, Homo sapiens
cagtatgtttattagaactgca

SEQ ID NO: 8557597 - DNA, 22 bp, Homo sapiens
cagtatgtttgggagacatgac

SEQ ID NO: 8557598 - DNA, 22 bp, Homo sapiens
cagtatttcctcttcttaactt

SEQ ID NO: 8557599 - DNA, 22 bp, Homo sapiens
cagtatttggaatatagctaag

SEQ ID NO: 8557600 - DNA, 22 bp, Homo sapiens
cagtatttggaatatagctaag

SEQ ID NO: 8557601 - DNA, 22 bp, Homo sapiens
cagtatttggtaattggctacc

SEQ ID NO: 8557602 - DNA, 22 bp, Homo sapiens
cagtatttgttccctatcaatg

SEQ ID NO: 8557603 - DNA, 22 bp, Homo sapiens
aggacagagggaccagagccca

SEQ ID NO: 8557604 - DNA, 22 bp, Homo sapiens
aggacagagggaccagagccca

SEQ ID NO: 8557605 - DNA, 22 bp, Homo sapiens
aggacagagggaccagagccca

SEQ ID NO: 8557606 - DNA, 22 bp, Homo sapiens
aggacagagggaccagagccca

SEQ ID NO: 8557607 - DNA, 22 bp, Homo sapiens
aggacagagggaccagagccca

SEQ ID NO: 8557608 - DNA, 22 bp, Homo sapiens
cagtaaatagtggagatgtggg

SEQ ID NO: 8557609 - DNA, 22 bp, Homo sapiens
cagtaacagtgatcacctgtgg

SEQ ID NO: 8557610 - DNA, 22 bp, Homo sapiens
cagtaacagtgatcacctgtgg

SEQ ID NO: 8557611 - DNA, 22 bp, Homo sapiens
cagtaacaggctctgtggtata

SEQ ID NO: 8557612 - DNA, 22 bp, Homo sapiens
cagtaacatttcaaggtagagg

SEQ ID NO: 8557613 - DNA, 22 bp, Homo sapiens
cagtaacatttcaaggtagagg

SEQ ID NO: 8557614 - DNA, 18 bp, Homo sapiens
cagtaactatgttgttac

SEQ ID NO: 8557615 - DNA, 22 bp, Homo sapiens
cagtaacatgtctgttaagaaa

SEQ ID NO: 8557616 - DNA, 22 bp, Homo sapiens
cagtaacatgaagagacatgga

SEQ ID NO: 8557617 - DNA, 22 bp, Homo sapiens
cagtaacatgtctgttaagaaa

SEQ ID NO: 8557618 - DNA, 22 bp, Homo sapiens
cagtaaatgagaagctagtaat

SEQ ID NO: 8557619 - DNA, 22 bp, Homo sapiens
cagtaaatggtacgtatatttt

SEQ ID NO: 8557620 - DNA, 22 bp, Homo sapiens
cagtaaattttatttgtgggtg

SEQ ID NO: 8557621 - DNA, 22 bp, Homo sapiens
cagtaacacaaccactccgtga

SEQ ID NO: 8557622 - DNA, 22 bp, Homo sapiens
cagtaaatgtgatttttcttgt

SEQ ID NO: 8557623 - DNA, 22 bp, Homo sapiens
aggaagagcccgggtgacataa

SEQ ID NO: 8557624 - DNA, 22 bp, Homo sapiens
aggaagagcccgggtgacataa

SEQ ID NO: 8557625 - DNA, 22 bp, Homo sapiens
aggaagagcccgggtgacataa

SEQ ID NO: 8557626 - DNA, 22 bp, Homo sapiens
aggaagagcccgggtgacataa

SEQ ID NO: 8557627 - DNA, 22 bp, Homo sapiens
aggaagagcccgggtgacataa

SEQ ID NO: 8557628 - DNA, 22 bp, Homo sapiens
aggaagagcccgggtgacataa

SEQ ID NO: 8557629 - DNA, 22 bp, Homo sapiens
aggaagagcccgggtgacataa

SEQ ID NO: 8557630 - DNA, 22 bp, Homo sapiens
aggaagagctggaccagaggac

SEQ ID NO: 8557631 - DNA, 22 bp, Homo sapiens
aggaagagctggaccagaggac

SEQ ID NO: 8557632 - DNA, 22 bp, Homo sapiens
aggaagagctggaccagaggac

SEQ ID NO: 8557633 - DNA, 22 bp, Homo sapiens
aggaagagctggaccagaggac

SEQ ID NO: 8557634 - DNA, 22 bp, Homo sapiens
aggaagagctggaccagaggac

SEQ ID NO: 8557635 - DNA, 22 bp, Homo sapiens
aggaagagggtggcagataatc

SEQ ID NO: 8557636 - DNA, 18 bp, Homo sapiens
cagggctgtggggtcact

SEQ ID NO: 8557637 - DNA, 18 bp, Homo sapiens
cagggctgtggggtcact

SEQ ID NO: 8557638 - DNA, 18 bp, Homo sapiens
cagggctgtggggtcact

SEQ ID NO: 8557639 - DNA, 18 bp, Homo sapiens
cagggctgtggggtcact

SEQ ID NO: 8557640 - DNA, 18 bp, Homo sapiens
cagggctgtggggtcact

SEQ ID NO: 8557641 - DNA, 18 bp, Homo sapiens
cagggctgtggggtcact

SEQ ID NO: 8557642 - DNA, 18 bp, Homo sapiens
cagggctgtggggtcact

SEQ ID NO: 8557643 - DNA, 22 bp, Homo sapiens
cagggctgttagctgctgctct

SEQ ID NO: 8557644 - DNA, 22 bp, Homo sapiens
aggaagaaaactaattagatgg

SEQ ID NO: 8557645 - DNA, 22 bp, Homo sapiens
cagggctgggttaaaagcaggg

SEQ ID NO: 8557646 - DNA, 22 bp, Homo sapiens
cagggctggctgtggcaatctc

SEQ ID NO: 8557647 - DNA, 23 bp, Homo sapiens
cagggctgggcttggtgttaggc

SEQ ID NO: 8557648 - DNA, 23 bp, Homo sapiens
cagggctgggcttggtgttaggc

SEQ ID NO: 8557649 - DNA, 22 bp, Homo sapiens
caggctgaagtgcagtggtgtg

SEQ ID NO: 8557650 - DNA, 22 bp, Homo sapiens
caggctgaagtgcagtggtgtg

SEQ ID NO: 8557651 - DNA, 22 bp, Homo sapiens
caggctcttccatcctgctgag

SEQ ID NO: 8557652 - DNA, 22 bp, Homo sapiens
caggctcttccatcctgctgag

SEQ ID NO: 8557653 - DNA, 22 bp, Homo sapiens
caggctcttccatcctgctgag

SEQ ID NO: 8557654 - DNA, 22 bp, Homo sapiens
cagggatgtgatgagctgagcc

SEQ ID NO: 8557655 - DNA, 22 bp, Homo sapiens
caggctgacaactgagcatttt

SEQ ID NO: 8557656 - DNA, 22 bp, Homo sapiens
caggctgacaactgagcatttt

SEQ ID NO: 8557657 - DNA, 22 bp, Homo sapiens
cagggcaggatgctgtgattat

SEQ ID NO: 8557658 - DNA, 22 bp, Homo sapiens
cagggcaggatgctgtgattat

SEQ ID NO: 8557659 - DNA, 22 bp, Homo sapiens
cagggcagggatgttgcggcag

SEQ ID NO: 8557660 - DNA, 22 bp, Homo sapiens
cagggcagggatgttgcggcag

SEQ ID NO: 8557661 - DNA, 22 bp, Homo sapiens
cagggcagggatgttgcggcag

SEQ ID NO: 8557662 - DNA, 22 bp, Homo sapiens
cagggcagggagcttagaatga

SEQ ID NO: 8557663 - DNA, 22 bp, Homo sapiens
cagggcagggagcttagaatga

SEQ ID NO: 8557664 - DNA, 22 bp, Homo sapiens
cagggcagggagcttagaatga

SEQ ID NO: 8557665 - DNA, 22 bp, Homo sapiens
cagggcagggccacaccccctg

SEQ ID NO: 8557666 - DNA, 22 bp, Homo sapiens
cagggcagggccacaccccctg

SEQ ID NO: 8557667 - DNA, 22 bp, Homo sapiens
cagggcagtaacgggaacatct

SEQ ID NO: 8557668 - DNA, 22 bp, Homo sapiens
cagggcagtaacgggaacatct

SEQ ID NO: 8557669 - DNA, 22 bp, Homo sapiens
cagggcagtaacgggaacatct

SEQ ID NO: 8557670 - DNA, 22 bp, Homo sapiens
cagggcagtaacgggaacatct

SEQ ID NO: 8557671 - DNA, 22 bp, Homo sapiens
agctttgaatgagtgcattgca

SEQ ID NO: 8557672 - DNA, 19 bp, Homo sapiens
agctttggacttgcatttc

SEQ ID NO: 8557673 - DNA, 19 bp, Homo sapiens
agctttgccaaaaacttag

SEQ ID NO: 8557674 - DNA, 22 bp, Homo sapiens
agctttcttctagttgtacagt

SEQ ID NO: 8557675 - DNA, 22 bp, Homo sapiens
cagggcagtaacgggaacatct

SEQ ID NO: 8557676 - DNA, 22 bp, Homo sapiens
agctttgggcagaagaggattc

SEQ ID NO: 8557677 - DNA, 22 bp, Homo sapiens
agctttgggccactggctggat

SEQ ID NO: 8557678 - DNA, 22 bp, Homo sapiens
agctttgggattcaggcaggaa

SEQ ID NO: 8557679 - DNA, 22 bp, Homo sapiens
agctttgggattcaggcaggaa

SEQ ID NO: 8557680 - DNA, 22 bp, Homo sapiens
agctttggccctggaggttact

SEQ ID NO: 8557681 - DNA, 22 bp, Homo sapiens
agctttggctgtgttgctctgt

SEQ ID NO: 8557682 - DNA, 22 bp, Homo sapiens
agctttggatttcttatagccc

SEQ ID NO: 8557683 - DNA, 22 bp, Homo sapiens
cagggctggctgtggcaatctc

SEQ ID NO: 8557684 - DNA, 22 bp, Homo sapiens
cagggctggctcatgaaaagtt

SEQ ID NO: 8557685 - DNA, 22 bp, Homo sapiens
cagggctggctcatgaaaagtt

SEQ ID NO: 8557686 - DNA, 22 bp, Homo sapiens
cctacacatctcacctcacagg

SEQ ID NO: 8557687 - DNA, 22 bp, Homo sapiens
cctacagttatattcttgattg

SEQ ID NO: 8557688 - DNA, 22 bp, Homo sapiens
cctacaggaaattgtatcaaaa

SEQ ID NO: 8557689 - DNA, 21 bp, Homo sapiens
cctacagatggatatatattc

SEQ ID NO: 8557690 - DNA, 22 bp, Homo sapiens
agggcctgtgctgagtagacga

SEQ ID NO: 8557691 - DNA, 22 bp, Homo sapiens
agggcctgtgaattctccctgc

SEQ ID NO: 8557692 - DNA, 21 bp, Homo sapiens
agggcctgtgctctccaggtc

SEQ ID NO: 8557693 - DNA, 21 bp, Homo sapiens
agggcctgtgctctccaggtc

SEQ ID NO: 8557694 - DNA, 22 bp, Homo sapiens
agggcctgtcagcggtgtcctg

SEQ ID NO: 8557695 - DNA, 22 bp, Homo sapiens
agggcctggcttcactttctca

SEQ ID NO: 8557696 - DNA, 22 bp, Homo sapiens
agggcccagtggagagctgagc

SEQ ID NO: 8557697 - DNA, 22 bp, Homo sapiens
agggcccagtggagagctgagc

SEQ ID NO: 8557698 - DNA, 22 bp, Homo sapiens
agggcccaggacagcatcaggg

SEQ ID NO: 8557699 - DNA, 22 bp, Homo sapiens
agggcccatagatcgtcagctt

SEQ ID NO: 8557700 - DNA, 22 bp, Homo sapiens
agggcccatagatcgtcagctt

SEQ ID NO: 8557701 - DNA, 22 bp, Homo sapiens
agggcccatagatcgtcagctt

SEQ ID NO: 8557702 - DNA, 22 bp, Homo sapiens
agggcccatgtgggagcacttg

SEQ ID NO: 8557703 - DNA, 22 bp, Homo sapiens
agggcccatgtgggagcacttg

SEQ ID NO: 8557704 - DNA, 22 bp, Homo sapiens
ccctggcaaaatccctggtaca

SEQ ID NO: 8557705 - DNA, 22 bp, Homo sapiens
agggccccagtaagattacatg

SEQ ID NO: 8557706 - DNA, 22 bp, Homo sapiens
ccctggcactagcgacggccat

SEQ ID NO: 8557707 - DNA, 22 bp, Homo sapiens
ccctggccagctcatgtctgag

SEQ ID NO: 8557708 - DNA, 22 bp, Homo sapiens
ccctggcatgcatgtccctggc

SEQ ID NO: 8557709 - DNA, 22 bp, Homo sapiens
ccctggcatgcatgtccctggc

SEQ ID NO: 8557710 - DNA, 22 bp, Homo sapiens
ccctggccagctcatgtctgag

SEQ ID NO: 8557711 - DNA, 22 bp, Homo sapiens
ccctggcataaaacttctccag

SEQ ID NO: 8557712 - DNA, 22 bp, Homo sapiens
ccctggcatgcatgtccctggc

SEQ ID NO: 8557713 - DNA, 22 bp, Homo sapiens
ccctggcagaatgtctctgggc

SEQ ID NO: 8557714 - DNA, 22 bp, Homo sapiens
ccctggcagaatgtctctgggc

SEQ ID NO: 8557715 - DNA, 22 bp, Homo sapiens
ccctggcagaatgtctctgggc

SEQ ID NO: 8557716 - DNA, 22 bp, Homo sapiens
ccctggcagagggggcaggtgc

SEQ ID NO: 8557717 - DNA, 22 bp, Homo sapiens
ccctggcagcaatcactggtgt

SEQ ID NO: 8557718 - DNA, 19 bp, Homo sapiens
ccctggcaggcaagcctgg

SEQ ID NO: 8557719 - DNA, 19 bp, Homo sapiens
ccctggcaggcaagcctgg

SEQ ID NO: 8557720 - DNA, 22 bp, Homo sapiens
ccctggcagcaatcactggtgt

SEQ ID NO: 8557721 - DNA, 22 bp, Homo sapiens
ccctggcagtgctcctttagac

SEQ ID NO: 8557722 - DNA, 22 bp, Homo sapiens
ccctggcataaaacttctccag

SEQ ID NO: 8557723 - DNA, 22 bp, Homo sapiens
cctcagggtctctcacagcacc

SEQ ID NO: 8557724 - DNA, 22 bp, Homo sapiens
cctcagggtggcatcagatctt

SEQ ID NO: 8557725 - DNA, 22 bp, Homo sapiens
cctcagggtggcatcagatctt

SEQ ID NO: 8557726 - DNA, 22 bp, Homo sapiens
cctcagggtctgaggagaccgt

SEQ ID NO: 8557727 - DNA, 22 bp, Homo sapiens
cctcagggtctgaggagaccgt

SEQ ID NO: 8557728 - DNA, 22 bp, Homo sapiens
cctcagggtctgaggagaccgt

SEQ ID NO: 8557729 - DNA, 23 bp, Homo sapiens
cctcaggggacctgtgagcctga

SEQ ID NO: 8557730 - DNA, 18 bp, Homo sapiens
cctcaggggacctggcag

SEQ ID NO: 8557731 - DNA, 18 bp, Homo sapiens
cctcaggggacctggcag

SEQ ID NO: 8557732 - DNA, 22 bp, Homo sapiens
cctcagggaggcctctgtggct

SEQ ID NO: 8557733 - DNA, 22 bp, Homo sapiens
cctcagggccatctctgtccct

SEQ ID NO: 8557734 - DNA, 22 bp, Homo sapiens
cctcaggggtgcccacagctgc

SEQ ID NO: 8557735 - DNA, 22 bp, Homo sapiens
cctcaggggtgcccacagctgc

SEQ ID NO: 8557736 - DNA, 22 bp, Homo sapiens
cctcaggggcttttcgttgttg

SEQ ID NO: 8557737 - DNA, 22 bp, Homo sapiens
cctcaggtgtgggccagctgtc

SEQ ID NO: 8557738 - DNA, 22 bp, Homo sapiens
cctcagtcattggcctacactt

SEQ ID NO: 8557739 - DNA, 22 bp, Homo sapiens
agggctgggctgcttgttgtca

SEQ ID NO: 8557740 - DNA, 22 bp, Homo sapiens
agggctcttcctttgcctctca

SEQ ID NO: 8557741 - DNA, 22 bp, Homo sapiens
agggctgacagtggcgtggcgt

SEQ ID NO: 8557742 - DNA, 22 bp, Homo sapiens
cctaccagtaggaggccagaga

SEQ ID NO: 8557743 - DNA, 22 bp, Homo sapiens
cctactctgagcgcctccgcat

SEQ ID NO: 8557744 - DNA, 22 bp, Homo sapiens
cctacagttatattcttgattg

SEQ ID NO: 8557745 - DNA, 18 bp, Homo sapiens
cctacatcattgtgagag

SEQ ID NO: 8557746 - DNA, 22 bp, Homo sapiens
agggctgagaatgacagggccg

SEQ ID NO: 8557747 - DNA, 22 bp, Homo sapiens
agggctgagaatgacagggccg

SEQ ID NO: 8557748 - DNA, 22 bp, Homo sapiens
agggctgagactaaggccagat

SEQ ID NO: 8557749 - DNA, 22 bp, Homo sapiens
agggctgagaatgacagggccg

SEQ ID NO: 8557750 - DNA, 20 bp, Homo sapiens
agggctgagaagggactagc

SEQ ID NO: 8557751 - DNA, 20 bp, Homo sapiens
agggctgagaagggactagc

SEQ ID NO: 8557752 - DNA, 20 bp, Homo sapiens
agggctgagaagggactagc

SEQ ID NO: 8557753 - DNA, 22 bp, Homo sapiens
agggctgaggcgagggagatgc

SEQ ID NO: 8557754 - DNA, 22 bp, Homo sapiens
cctcagggaggcctctgtggct

SEQ ID NO: 8557755 - DNA, 22 bp, Homo sapiens
cctcagggaggcctctgtggct

SEQ ID NO: 8557756 - DNA, 18 bp, Homo sapiens
cctcagggagatccagtg

SEQ ID NO: 8557757 - DNA, 22 bp, Homo sapiens
agggctgagactaaggccagat

SEQ ID NO: 8557758 - DNA, 22 bp, Homo sapiens
agggctgagactaaggccagat

SEQ ID NO: 8557759 - DNA, 22 bp, Homo sapiens
agggctgagcccaggcatgtag

SEQ ID NO: 8557760 - DNA, 22 bp, Homo sapiens
agggctgagactaaggccagat

SEQ ID NO: 8557761 - DNA, 22 bp, Homo sapiens
cctctgtgtcctggtcattgaa

SEQ ID NO: 8557762 - DNA, 20 bp, Homo sapiens
cctctgtgtcctgtgtcata

SEQ ID NO: 8557763 - DNA, 20 bp, Homo sapiens
cctctgtgtcctgtgtcata

SEQ ID NO: 8557764 - DNA, 20 bp, Homo sapiens
cctctgtgtcctgtgtcata

SEQ ID NO: 8557765 - DNA, 22 bp, Homo sapiens
cctctgtggtctgtctaatgca

SEQ ID NO: 8557766 - DNA, 22 bp, Homo sapiens
cctctgtggtctgtctaatgca

SEQ ID NO: 8557767 - DNA, 22 bp, Homo sapiens
cctctgtgggccgggcctgctg

SEQ ID NO: 8557768 - DNA, 22 bp, Homo sapiens
cctctgtgtcctggtcattgaa

SEQ ID NO: 8557769 - DNA, 22 bp, Homo sapiens
cctctgtgtcagggaagagact

SEQ ID NO: 8557770 - DNA, 22 bp, Homo sapiens
cctctgtgtgtgcatgcatgcg

SEQ ID NO: 8557771 - DNA, 22 bp, Homo sapiens
cctctgtgtgtgcatgcatgcg

SEQ ID NO: 8557772 - DNA, 22 bp, Homo sapiens
cctctgtgtctccaagaggcct

SEQ ID NO: 8557773 - DNA, 22 bp, Homo sapiens
cctctgtgtcctggtcattgaa

SEQ ID NO: 8557774 - DNA, 22 bp, Homo sapiens
cctctgtgtgatgcgcaaagta

SEQ ID NO: 8557775 - DNA, 22 bp, Homo sapiens
agggggtgaatgtctgtctaca

SEQ ID NO: 8557776 - DNA, 22 bp, Homo sapiens
agggggtgaatgtctgtctaca

SEQ ID NO: 8557777 - DNA, 22 bp, Homo sapiens
agggggctggagacacctcctc

SEQ ID NO: 8557778 - DNA, 22 bp, Homo sapiens
agggggctgccaaggaatgtaa

SEQ ID NO: 8557779 - DNA, 22 bp, Homo sapiens
agggggctcctccggtgcttcc

SEQ ID NO: 8557780 - DNA, 22 bp, Homo sapiens
agggggctccttggtgtgcaga

SEQ ID NO: 8557781 - DNA, 22 bp, Homo sapiens
agggggctccttggtgtgcaga

SEQ ID NO: 8557782 - DNA, 22 bp, Homo sapiens
agggggagacatgtgtgtgttt

SEQ ID NO: 8557783 - DNA, 22 bp, Homo sapiens
cctcttcagcaaagttcggccc

SEQ ID NO: 8557784 - DNA, 22 bp, Homo sapiens
cctcttcacctcgggcacactg

SEQ ID NO: 8557785 - DNA, 22 bp, Homo sapiens
agggggtgcccagatgaaggat

SEQ ID NO: 8557786 - DNA, 22 bp, Homo sapiens
agggggtgcccagatgaaggat

SEQ ID NO: 8557787 - DNA, 22 bp, Homo sapiens
agggggtgcatttgtgaatgaa

SEQ ID NO: 8557788 - DNA, 22 bp, Homo sapiens
agggggtgcatttgtgaatgaa

SEQ ID NO: 8557789 - DNA, 22 bp, Homo sapiens
agggggtgatcaaggtgcggcg

SEQ ID NO: 8557790 - DNA, 22 bp, Homo sapiens
agggggtgggaagtctagaatc

SEQ ID NO: 8557791 - DNA, 22 bp, Homo sapiens
agggggtgggaagtctagaatc

SEQ ID NO: 8557792 - DNA, 22 bp, Homo sapiens
agggggtgctacttccagagtt

SEQ ID NO: 8557793 - DNA, 22 bp, Homo sapiens
agggggtgctacttccagagtt

SEQ ID NO: 8557794 - DNA, 22 bp, Homo sapiens
agggggtgctacttccagagtt

SEQ ID NO: 8557795 - DNA, 22 bp, Homo sapiens
agggggtgtctctgattgggtt

SEQ ID NO: 8557796 - DNA, 22 bp, Homo sapiens
agggggtgtctctgattgggtt

SEQ ID NO: 8557797 - DNA, 20 bp, Homo sapiens
aggggtctagcagcagtgct

SEQ ID NO: 8557798 - DNA, 22 bp, Homo sapiens
aggggtctatcctgagatggtc

SEQ ID NO: 8557799 - DNA, 22 bp, Homo sapiens
aggggtctatcctgagatggtc

SEQ ID NO: 8557800 - DNA, 22 bp, Homo sapiens
aggggtagagattgctggtgta

SEQ ID NO: 8557801 - DNA, 22 bp, Homo sapiens
aggggtgaaggcccgataggag

SEQ ID NO: 8557802 - DNA, 22 bp, Homo sapiens
cctgcagaccacactcagtcct

SEQ ID NO: 8557803 - DNA, 22 bp, Homo sapiens
aggggtcttgggagtcctggct

SEQ ID NO: 8557804 - DNA, 22 bp, Homo sapiens
aggggtcttgaggactccagca

SEQ ID NO: 8557805 - DNA, 22 bp, Homo sapiens
aggggtctttaggaacgtcggg

SEQ ID NO: 8557806 - DNA, 22 bp, Homo sapiens
aggggtgaaagagggccctcaa

SEQ ID NO: 8557807 - DNA, 18 bp, Homo sapiens
aggggcagcttgtgtgga

SEQ ID NO: 8557808 - DNA, 22 bp, Homo sapiens
aggggcctggttggcctctgtt

SEQ ID NO: 8557809 - DNA, 22 bp, Homo sapiens
aggggcctggttggcctctgtt

SEQ ID NO: 8557810 - DNA, 22 bp, Homo sapiens
aggggcctggttggcctctgtt

SEQ ID NO: 8557811 - DNA, 22 bp, Homo sapiens
aggggcctggttggcctctgtt

SEQ ID NO: 8557812 - DNA, 22 bp, Homo sapiens
aggggctcaaagtgtgcaggga

SEQ ID NO: 8557813 - DNA, 22 bp, Homo sapiens
aggggctcaaagtgtgcaggga

SEQ ID NO: 8557814 - DNA, 22 bp, Homo sapiens
aggggctcaaagtgtgcaggga

SEQ ID NO: 8557815 - DNA, 22 bp, Homo sapiens
aggggcgtctgtaggcagtggg

SEQ ID NO: 8557816 - DNA, 22 bp, Homo sapiens
aggggctccaaggaagtttggg

SEQ ID NO: 8557817 - DNA, 22 bp, Homo sapiens
aggggctcagttactttggcag

SEQ ID NO: 8557818 - DNA, 22 bp, Homo sapiens
aggggctcaagcagtgtggtct

SEQ ID NO: 8557819 - DNA, 22 bp, Homo sapiens
aggggctcctttgtgctgcgtc

SEQ ID NO: 8557820 - DNA, 22 bp, Homo sapiens
aggggctcctttgtgctgcgtc

SEQ ID NO: 8557821 - DNA, 22 bp, Homo sapiens
aggggctctaaagatcatggaa

SEQ ID NO: 8557822 - DNA, 22 bp, Homo sapiens
aggggctctaaagatcatggaa

SEQ ID NO: 8557823 - DNA, 22 bp, Homo sapiens
aggggctcctctctgagagtag

SEQ ID NO: 8557824 - DNA, 22 bp, Homo sapiens
aggggctcctctctgagagtag

SEQ ID NO: 8557825 - DNA, 22 bp, Homo sapiens
aggggctcctctctgagagtag

SEQ ID NO: 8557826 - DNA, 22 bp, Homo sapiens
aggggctcctggcctggagagc

SEQ ID NO: 8557827 - DNA, 22 bp, Homo sapiens
aggggctcctggcctggagagc

SEQ ID NO: 8557828 - DNA, 22 bp, Homo sapiens
aggggctgcctggcttggcact

SEQ ID NO: 8557829 - DNA, 22 bp, Homo sapiens
cctctgtgggccgggcctgctg

SEQ ID NO: 8557830 - DNA, 22 bp, Homo sapiens
cctctgtgggccgggcctgctg

SEQ ID NO: 8557831 - DNA, 22 bp, Homo sapiens
aggggctctgagtgggccagga

SEQ ID NO: 8557832 - DNA, 22 bp, Homo sapiens
aggggctctgagtgggccagga

SEQ ID NO: 8557833 - DNA, 22 bp, Homo sapiens
aggggctctaaagatcatggaa

SEQ ID NO: 8557834 - DNA, 22 bp, Homo sapiens
aggggctgactggaaagtgcca

SEQ ID NO: 8557835 - DNA, 22 bp, Homo sapiens
aggggctgactggaaagtgcca

SEQ ID NO: 8557836 - DNA, 22 bp, Homo sapiens
cctccttctggggccttctgct

SEQ ID NO: 8557837 - DNA, 22 bp, Homo sapiens
cctccttcctgggacagagctg

SEQ ID NO: 8557838 - DNA, 22 bp, Homo sapiens
cctcgacctccccaggctcagg

SEQ ID NO: 8557839 - DNA, 22 bp, Homo sapiens
cctcctttcctgttttcctgag

SEQ ID NO: 8557840 - DNA, 22 bp, Homo sapiens
cctccttctggggccttctgct

SEQ ID NO: 8557841 - DNA, 22 bp, Homo sapiens
cctcctggtgggcgcttctggc

SEQ ID NO: 8557842 - DNA, 22 bp, Homo sapiens
cctcctggtgggcgcttctggc

SEQ ID NO: 8557843 - DNA, 22 bp, Homo sapiens
cctcctggtgggcgcttctggc

SEQ ID NO: 8557844 - DNA, 22 bp, Homo sapiens
cctcctggtgggcgcttctggc

SEQ ID NO: 8557845 - DNA, 22 bp, Homo sapiens
aggggaagagccctttacatgg

SEQ ID NO: 8557846 - DNA, 22 bp, Homo sapiens
aggggaaatgccttggtggtac

SEQ ID NO: 8557847 - DNA, 22 bp, Homo sapiens
aggggaagattatacttttgaa

SEQ ID NO: 8557848 - DNA, 22 bp, Homo sapiens
aggggaagattatacttttgaa

SEQ ID NO: 8557849 - DNA, 22 bp, Homo sapiens
aggggaaggccagcctgtagag

SEQ ID NO: 8557850 - DNA, 22 bp, Homo sapiens
aggggaaggccagcctgtagag

SEQ ID NO: 8557851 - DNA, 21 bp, Homo sapiens
aggggaagtagagttttgatt

SEQ ID NO: 8557852 - DNA, 21 bp, Homo sapiens
aggggaagtagagttttgatt

SEQ ID NO: 8557853 - DNA, 22 bp, Homo sapiens
aggggaatgggtagactgttga

SEQ ID NO: 8557854 - DNA, 22 bp, Homo sapiens
cctcctggtgacaaggcaaagc

SEQ ID NO: 8557855 - DNA, 22 bp, Homo sapiens
cctcctggtgacaaggcaaagc

SEQ ID NO: 8557856 - DNA, 22 bp, Homo sapiens
agggcagactaggatggaagtg

SEQ ID NO: 8557857 - DNA, 22 bp, Homo sapiens
agggcagactaggatggaagtg

SEQ ID NO: 8557858 - DNA, 22 bp, Homo sapiens
agggcagactaggatggaagtg

SEQ ID NO: 8557859 - DNA, 22 bp, Homo sapiens
agggcagaccacgtgcaaggat

SEQ ID NO: 8557860 - DNA, 22 bp, Homo sapiens
agggcagaccacgtgcaaggat

SEQ ID NO: 8557861 - DNA, 22 bp, Homo sapiens
agggcagaccacgtgcaaggat

SEQ ID NO: 8557862 - DNA, 22 bp, Homo sapiens
agggcagactaggatggaagtg

SEQ ID NO: 8557863 - DNA, 22 bp, Homo sapiens
agggcagaaatattgatactgt

SEQ ID NO: 8557864 - DNA, 22 bp, Homo sapiens
agggcagaaatcgattacacct

SEQ ID NO: 8557865 - DNA, 22 bp, Homo sapiens
agggcagaagtacagacactta

SEQ ID NO: 8557866 - DNA, 22 bp, Homo sapiens
agggcagaagtacagacactta

SEQ ID NO: 8557867 - DNA, 22 bp, Homo sapiens
cccctgccagctatccctgaac

SEQ ID NO: 8557868 - DNA, 22 bp, Homo sapiens
cccctgagattctggcttggga

SEQ ID NO: 8557869 - DNA, 22 bp, Homo sapiens
cccctgaagacaatggagaggt

SEQ ID NO: 8557870 - DNA, 22 bp, Homo sapiens
agggcagagaaatgtagttgag

SEQ ID NO: 8557871 - DNA, 22 bp, Homo sapiens
cccctcttgtgggctcaggtca

SEQ ID NO: 8557872 - DNA, 22 bp, Homo sapiens
agggcagagaaatgtagttgag

SEQ ID NO: 8557873 - DNA, 22 bp, Homo sapiens
cccctgccatagtcaaatctaa

SEQ ID NO: 8557874 - DNA, 21 bp, Homo sapiens
cccctgggagccctgtcagta

SEQ ID NO: 8557875 - DNA, 21 bp, Homo sapiens
cccctgggagccctgtcagta

SEQ ID NO: 8557876 - DNA, 21 bp, Homo sapiens
cccctgggagccctgtcagta

SEQ ID NO: 8557877 - DNA, 22 bp, Homo sapiens
cccaggtctgtgccagctctga

SEQ ID NO: 8557878 - DNA, 22 bp, Homo sapiens
cccaggtgggttggcctctgtc

SEQ ID NO: 8557879 - DNA, 22 bp, Homo sapiens
cccaggtgggttggcctctgtc

SEQ ID NO: 8557880 - DNA, 21 bp, Homo sapiens
cccaggtgggatggttgcctc

SEQ ID NO: 8557881 - DNA, 22 bp, Homo sapiens
cccaggtgggcacctcgaggaa

SEQ ID NO: 8557882 - DNA, 22 bp, Homo sapiens
cccaggtggcagaagctgcagt

SEQ ID NO: 8557883 - DNA, 22 bp, Homo sapiens
cccaggtggcagaagctgcagt

SEQ ID NO: 8557884 - DNA, 22 bp, Homo sapiens
agggcagaaaccaccttgatgg

SEQ ID NO: 8557885 - DNA, 22 bp, Homo sapiens
agggatggtggaggttgcaagt

SEQ ID NO: 8557886 - DNA, 22 bp, Homo sapiens
cccaggtgtttgtggcagaggt

SEQ ID NO: 8557887 - DNA, 19 bp, Homo sapiens
cccaggtgtttgaggctgc

SEQ ID NO: 8557888 - DNA, 20 bp, Homo sapiens
cccaggtgtctgaagctctg

SEQ ID NO: 8557889 - DNA, 23 bp, Homo sapiens
cccaggtgtggaggcggtggcag

SEQ ID NO: 8557890 - DNA, 22 bp, Homo sapiens
ccctgatgacacgggcatcagg

SEQ ID NO: 8557891 - DNA, 22 bp, Homo sapiens
agggccagggaagctgtatttt

SEQ ID NO: 8557892 - DNA, 23 bp, Homo sapiens
agggccaggtgcggaaacagctc

SEQ ID NO: 8557893 - DNA, 23 bp, Homo sapiens
agggccaggtgcggaaacagctc

SEQ ID NO: 8557894 - DNA, 23 bp, Homo sapiens
agggccaggtgcggaaacagctc

SEQ ID NO: 8557895 - DNA, 23 bp, Homo sapiens
agggcccaagcctggacagcagg

SEQ ID NO: 8557896 - DNA, 23 bp, Homo sapiens
agggcccaagcctggacagcagg

SEQ ID NO: 8557897 - DNA, 23 bp, Homo sapiens
agggcccaagcctggacagcagg

SEQ ID NO: 8557898 - DNA, 23 bp, Homo sapiens
agggcccaagcctggacagcagg

SEQ ID NO: 8557899 - DNA, 22 bp, Homo sapiens
agggcccacagttcctatggcc

SEQ ID NO: 8557900 - DNA, 22 bp, Homo sapiens
agggcccaggacagcatcaggg

SEQ ID NO: 8557901 - DNA, 22 bp, Homo sapiens
agggcccaggacagcatcaggg

SEQ ID NO: 8557902 - DNA, 20 bp, Homo sapiens
agggcccaggaagagagtta

SEQ ID NO: 8557903 - DNA, 20 bp, Homo sapiens
agggcccaggaagagagtta

SEQ ID NO: 8557904 - DNA, 22 bp, Homo sapiens
ccctgaggcaaaggctagagtt

SEQ ID NO: 8557905 - DNA, 19 bp, Homo sapiens
ccctgaggcaaaagccttt

SEQ ID NO: 8557906 - DNA, 19 bp, Homo sapiens
ccctgaggcaaaagccttt

SEQ ID NO: 8557907 - DNA, 22 bp, Homo sapiens
ccctgaggcagtaggagctttt

SEQ ID NO: 8557908 - DNA, 22 bp, Homo sapiens
ccctgaggcagtaggagctttt

SEQ ID NO: 8557909 - DNA, 22 bp, Homo sapiens
ccctgaggcctcaggttcattg

SEQ ID NO: 8557910 - DNA, 22 bp, Homo sapiens
ccctgaggccctcctggggtct

SEQ ID NO: 8557911 - DNA, 22 bp, Homo sapiens
ccctgaggggagtggtgaggtg

SEQ ID NO: 8557912 - DNA, 22 bp, Homo sapiens
ccctgaggggagtggtgaggtg

SEQ ID NO: 8557913 - DNA, 22 bp, Homo sapiens
ccctgagttagtacagttgagt

SEQ ID NO: 8557914 - DNA, 22 bp, Homo sapiens
ccctgagtcatcattgcggaag

SEQ ID NO: 8557915 - DNA, 22 bp, Homo sapiens
ccctgaggggcttactttgccc

SEQ ID NO: 8557916 - DNA, 18 bp, Homo sapiens
ccctgaggctagcatgct

SEQ ID NO: 8557917 - DNA, 22 bp, Homo sapiens
ccctgaggctgaggataggtgg

SEQ ID NO: 8557918 - DNA, 22 bp, Homo sapiens
ccctgaggggagtggtgaggtg

SEQ ID NO: 8557919 - DNA, 22 bp, Homo sapiens
cccctggggatcagctggaatt

SEQ ID NO: 8557920 - DNA, 22 bp, Homo sapiens
cccctgtgttgttcaagggtca

SEQ ID NO: 8557921 - DNA, 22 bp, Homo sapiens
cccctgggtccaggcttctctg

SEQ ID NO: 8557922 - DNA, 22 bp, Homo sapiens
agggcatgtgggagaggagcct

SEQ ID NO: 8557923 - DNA, 22 bp, Homo sapiens
agggcatgtgggagaggagcct

SEQ ID NO: 8557924 - DNA, 22 bp, Homo sapiens
agggcagcttccatagtctggc

SEQ ID NO: 8557925 - DNA, 22 bp, Homo sapiens
ccctgaggatagggcaggaccc

SEQ ID NO: 8557926 - DNA, 22 bp, Homo sapiens
ccctgaggatagggcaggaccc

SEQ ID NO: 8557927 - DNA, 22 bp, Homo sapiens
ccctgaggatagggcaggaccc

SEQ ID NO: 8557928 - DNA, 22 bp, Homo sapiens
ccctgaggatagggcaggaccc

SEQ ID NO: 8557929 - DNA, 22 bp, Homo sapiens
agggccacagtggggcctgaga

SEQ ID NO: 8557930 - DNA, 22 bp, Homo sapiens
agggccaccagagcagggcagt

SEQ ID NO: 8557931 - DNA, 22 bp, Homo sapiens
agggcattggcacagatctgct

SEQ ID NO: 8557932 - DNA, 22 bp, Homo sapiens
agggagcttctggcctcagcct

SEQ ID NO: 8557933 - DNA, 22 bp, Homo sapiens
agggagcttctacttcaaggca

SEQ ID NO: 8557934 - DNA, 22 bp, Homo sapiens
agggagcttccgaactacagct

SEQ ID NO: 8557935 - DNA, 22 bp, Homo sapiens
agggagctgtggtcagctcagt

SEQ ID NO: 8557936 - DNA, 22 bp, Homo sapiens
agggagctgctctgcttccgtg

SEQ ID NO: 8557937 - DNA, 22 bp, Homo sapiens
agggagctgctctgcttccgtg

SEQ ID NO: 8557938 - DNA, 22 bp, Homo sapiens
agggagctgagctgtgagcagc

SEQ ID NO: 8557939 - DNA, 17 bp, Homo sapiens
cccaggccgccgggagc

SEQ ID NO: 8557940 - DNA, 17 bp, Homo sapiens
cccaggccgccgggagc

SEQ ID NO: 8557941 - DNA, 22 bp, Homo sapiens
cccaggcctggtctgggccagt

SEQ ID NO: 8557942 - DNA, 22 bp, Homo sapiens
cccaggcctggtctgggccagt

SEQ ID NO: 8557943 - DNA, 22 bp, Homo sapiens
cccaggccctggcagagcttgt

SEQ ID NO: 8557944 - DNA, 22 bp, Homo sapiens
cccaggccccagggcttgtcag

SEQ ID NO: 8557945 - DNA, 22 bp, Homo sapiens
cccaggcctggtctgggccagt

SEQ ID NO: 8557946 - DNA, 22 bp, Homo sapiens
cccaggcctggtctgggccagt

SEQ ID NO: 8557947 - DNA, 22 bp, Homo sapiens
cccaggaatgagcaggcagggg

SEQ ID NO: 8557948 - DNA, 22 bp, Homo sapiens
agggaatggatgatggcaggtt

SEQ ID NO: 8557949 - DNA, 22 bp, Homo sapiens
agggacagtctactgttcactg

SEQ ID NO: 8557950 - DNA, 22 bp, Homo sapiens
agggacagtctactgttcactg

SEQ ID NO: 8557951 - DNA, 22 bp, Homo sapiens
agggacagtctactgttcactg

SEQ ID NO: 8557952 - DNA, 22 bp, Homo sapiens
agggacatgaggatgatctaga

SEQ ID NO: 8557953 - DNA, 22 bp, Homo sapiens
agggacagttacatcatcagac

SEQ ID NO: 8557954 - DNA, 22 bp, Homo sapiens
cccaggccccagggcttgtcag

SEQ ID NO: 8557955 - DNA, 22 bp, Homo sapiens
cccaggccccagggcttgtcag

SEQ ID NO: 8557956 - DNA, 22 bp, Homo sapiens
cccaggccagaacttggttgct

SEQ ID NO: 8557957 - DNA, 22 bp, Homo sapiens
cccaggccagaacttggttgct

SEQ ID NO: 8557958 - DNA, 22 bp, Homo sapiens
cccaggccagaacttggttgct

SEQ ID NO: 8557959 - DNA, 22 bp, Homo sapiens
agggacgccgtgcgggaccgtg

SEQ ID NO: 8557960 - DNA, 22 bp, Homo sapiens
agggactatttacccatctcac

SEQ ID NO: 8557961 - DNA, 22 bp, Homo sapiens
agggacccatagagagaccagt

SEQ ID NO: 8557962 - DNA, 22 bp, Homo sapiens
cccaggaacagggctcagaccc

SEQ ID NO: 8557963 - DNA, 22 bp, Homo sapiens
cccaggaaatgggctcttgcct

SEQ ID NO: 8557964 - DNA, 23 bp, Homo sapiens
agggaaagtagtaatggcctttg

SEQ ID NO: 8557965 - DNA, 22 bp, Homo sapiens
agggaaagtaagcatttcatta

SEQ ID NO: 8557966 - DNA, 22 bp, Homo sapiens
cccaggaagggatgccaaggaa

SEQ ID NO: 8557967 - DNA, 19 bp, Homo sapiens
cccaggaagcggaggttgc

SEQ ID NO: 8557968 - DNA, 22 bp, Homo sapiens
aggctttggggcattctgtgtt

SEQ ID NO: 8557969 - DNA, 21 bp, Homo sapiens
agggaaaaggctgagtgaggg

SEQ ID NO: 8557970 - DNA, 21 bp, Homo sapiens
agggaaagaaaatgagctaat

SEQ ID NO: 8557971 - DNA, 21 bp, Homo sapiens
agggaaagaaaatgagctaat

SEQ ID NO: 8557972 - DNA, 22 bp, Homo sapiens
agggaaaggctgatgctgtggg

SEQ ID NO: 8557973 - DNA, 22 bp, Homo sapiens
cccagagttggtcaggggaccc

SEQ ID NO: 8557974 - DNA, 22 bp, Homo sapiens
cccagagtggagggtgcagaat

SEQ ID NO: 8557975 - DNA, 22 bp, Homo sapiens
cccagagtcacatggggtgttc

SEQ ID NO: 8557976 - DNA, 20 bp, Homo sapiens
cccagaggttgcggcaggag

SEQ ID NO: 8557977 - DNA, 20 bp, Homo sapiens
cccagaggttgcggcaggag

SEQ ID NO: 8557978 - DNA, 22 bp, Homo sapiens
cccagatgcaggttcaagagta

SEQ ID NO: 8557979 - DNA, 22 bp, Homo sapiens
cccagatgcaggttcaagagta

SEQ ID NO: 8557980 - DNA, 22 bp, Homo sapiens
aggctgtgacagggtcatggag

SEQ ID NO: 8557981 - DNA, 21 bp, Homo sapiens
aggctgtgacttacactatct

SEQ ID NO: 8557982 - DNA, 22 bp, Homo sapiens
aggctgtgactacgcagggaag

SEQ ID NO: 8557983 - DNA, 22 bp, Homo sapiens
aggctgtgactacgcagggaag

SEQ ID NO: 8557984 - DNA, 22 bp, Homo sapiens
aggctgtgcacagggcacctgc

SEQ ID NO: 8557985 - DNA, 22 bp, Homo sapiens
aggctgtgcacagggcacctgc

SEQ ID NO: 8557986 - DNA, 22 bp, Homo sapiens
aggctgtgcattttggagggcc

SEQ ID NO: 8557987 - DNA, 22 bp, Homo sapiens
aggctgtgcattttggagggcc

SEQ ID NO: 8557988 - DNA, 22 bp, Homo sapiens
cccactgctgctctccatggca

SEQ ID NO: 8557989 - DNA, 22 bp, Homo sapiens
cccactgagggttaatgcctgc

SEQ ID NO: 8557990 - DNA, 22 bp, Homo sapiens
cccactgagcctatacaaacag

SEQ ID NO: 8557991 - DNA, 22 bp, Homo sapiens
cccactcctggagctagggctc

SEQ ID NO: 8557992 - DNA, 22 bp, Homo sapiens
cccactcctggagctagggctc

SEQ ID NO: 8557993 - DNA, 18 bp, Homo sapiens
cccaccctggctcttagt

SEQ ID NO: 8557994 - DNA, 22 bp, Homo sapiens
cccaccctgggctacacatcca

SEQ ID NO: 8557995 - DNA, 22 bp, Homo sapiens
cccaccctgggctacacatcca

SEQ ID NO: 8557996 - DNA, 22 bp, Homo sapiens
cccacgtcgaacttgctccaga

SEQ ID NO: 8557997 - DNA, 22 bp, Homo sapiens
cccactccctacgacacgctcc

SEQ ID NO: 8557998 - DNA, 22 bp, Homo sapiens
cccactccctacgacacgctcc

SEQ ID NO: 8557999 - DNA, 22 bp, Homo sapiens
cccactccctgcacgcctgccg

SEQ ID NO: 8558000 - DNA, 22 bp, Homo sapiens
cccactccctgcacgcctgccg

SEQ ID NO: 8558001 - DNA, 22 bp, Homo sapiens
aggctgtgggacagttaggaga

SEQ ID NO: 8558002 - DNA, 22 bp, Homo sapiens
aggctgtgggacagttaggaga

SEQ ID NO: 8558003 - DNA, 22 bp, Homo sapiens
aggctgtgggagttgagagtct

SEQ ID NO: 8558004 - DNA, 22 bp, Homo sapiens
aggctgtgggaatggctgcttg

SEQ ID NO: 8558005 - DNA, 22 bp, Homo sapiens
aggctgtgggaatggctgcttg

SEQ ID NO: 8558006 - DNA, 22 bp, Homo sapiens
aggctgtggccctggtctagca

SEQ ID NO: 8558007 - DNA, 22 bp, Homo sapiens
aggctgtggccctggtctagca

SEQ ID NO: 8558008 - DNA, 22 bp, Homo sapiens
aggctgtggccctggtctagca

SEQ ID NO: 8558009 - DNA, 22 bp, Homo sapiens
aggctgtgcgaggtctcagagt

SEQ ID NO: 8558010 - DNA, 22 bp, Homo sapiens
aggctgtgcgaggtctcagagt

SEQ ID NO: 8558011 - DNA, 22 bp, Homo sapiens
aggctgtggatgcttaacaaat

SEQ ID NO: 8558012 - DNA, 22 bp, Homo sapiens
aggctgtgctcagccaatggga

SEQ ID NO: 8558013 - DNA, 22 bp, Homo sapiens
aggctgtggcatcacatcagga

SEQ ID NO: 8558014 - DNA, 22 bp, Homo sapiens
aggctgtggcatcacatcagga

SEQ ID NO: 8558015 - DNA, 22 bp, Homo sapiens
aggctgtggcatcacatcagga

SEQ ID NO: 8558016 - DNA, 22 bp, Homo sapiens
aggctgtggccctggtctagca

SEQ ID NO: 8558017 - DNA, 22 bp, Homo sapiens
aggctgtggcattaaacgtttg

SEQ ID NO: 8558018 - DNA, 22 bp, Homo sapiens
cccagaggtgcttcagaggtgc

SEQ ID NO: 8558019 - DNA, 22 bp, Homo sapiens
cccagaggtgcttcagaggtgc

SEQ ID NO: 8558020 - DNA, 22 bp, Homo sapiens
cccagaggtgcttcagaggtgc

SEQ ID NO: 8558021 - DNA, 22 bp, Homo sapiens
cccagaggttccttagggacca

SEQ ID NO: 8558022 - DNA, 22 bp, Homo sapiens
cccagaggttccttagggacca

SEQ ID NO: 8558023 - DNA, 20 bp, Homo sapiens
cccagaggttgcggcaggag

SEQ ID NO: 8558024 - DNA, 22 bp, Homo sapiens
cccagaggtgacatcccattct

SEQ ID NO: 8558025 - DNA, 22 bp, Homo sapiens
cccagaggtgacatcccattct

SEQ ID NO: 8558026 - DNA, 22 bp, Homo sapiens
cccagaggtgcttcagaggtgc

SEQ ID NO: 8558027 - DNA, 22 bp, Homo sapiens
cccagaggtgaaggaggtggga

SEQ ID NO: 8558028 - DNA, 22 bp, Homo sapiens
cccagaggtgaaggaggtggga

SEQ ID NO: 8558029 - DNA, 22 bp, Homo sapiens
cccagaggtgaaggaggtggga

SEQ ID NO: 8558030 - DNA, 22 bp, Homo sapiens
aggctgtggtgctgaaggaggg

SEQ ID NO: 8558031 - DNA, 22 bp, Homo sapiens
aggctgtggtgctgaaggaggg

SEQ ID NO: 8558032 - DNA, 22 bp, Homo sapiens
aggctgtggtgatgattgggtc

SEQ ID NO: 8558033 - DNA, 22 bp, Homo sapiens
aggctgtggggttctgctttca

SEQ ID NO: 8558034 - DNA, 22 bp, Homo sapiens
aggctgtgggtgatttactgtg

SEQ ID NO: 8558035 - DNA, 22 bp, Homo sapiens
aggctgtggtgctgaaggaggg

SEQ ID NO: 8558036 - DNA, 22 bp, Homo sapiens
ccagtgggtaggccatggtgag

SEQ ID NO: 8558037 - DNA, 22 bp, Homo sapiens
ccagtgggtaggccatggtgag

SEQ ID NO: 8558038 - DNA, 20 bp, Homo sapiens
ccagtgggaagtgattaggt

SEQ ID NO: 8558039 - DNA, 22 bp, Homo sapiens
ccagtgggagggagctaggcca

SEQ ID NO: 8558040 - DNA, 22 bp, Homo sapiens
ccagtgggtgctgggctctgcc

SEQ ID NO: 8558041 - DNA, 20 bp, Homo sapiens
aggctgccaggtctcacatc

SEQ ID NO: 8558042 - DNA, 22 bp, Homo sapiens
aggctgccctgccgccagtggg

SEQ ID NO: 8558043 - DNA, 22 bp, Homo sapiens
aggctgccgcagccaatggttg

SEQ ID NO: 8558044 - DNA, 23 bp, Homo sapiens
aggctgcagaagaatagggtcat

SEQ ID NO: 8558045 - DNA, 23 bp, Homo sapiens
aggctgcagaagaatagggtcat

SEQ ID NO: 8558046 - DNA, 22 bp, Homo sapiens
aggctgcagtgcaggtaggatt

SEQ ID NO: 8558047 - DNA, 22 bp, Homo sapiens
aggctgcagtgcaggtaggatt

SEQ ID NO: 8558048 - DNA, 22 bp, Homo sapiens
aggctgcaggtctgggtcatgt

SEQ ID NO: 8558049 - DNA, 21 bp, Homo sapiens
aggctgcatgcatgagtgtgg

SEQ ID NO: 8558050 - DNA, 22 bp, Homo sapiens
aggctgccaaagcttctgtctc

SEQ ID NO: 8558051 - DNA, 22 bp, Homo sapiens
aggctgccaaagcttctgtctc

SEQ ID NO: 8558052 - DNA, 23 bp, Homo sapiens
aggctgccagaaattgggtaagg

SEQ ID NO: 8558053 - DNA, 20 bp, Homo sapiens
aggctgccaggtctcacatc

SEQ ID NO: 8558054 - DNA, 22 bp, Homo sapiens
cccacacaaatcatggggagaa

SEQ ID NO: 8558055 - DNA, 22 bp, Homo sapiens
cccacacaaatcatggggagaa

SEQ ID NO: 8558056 - DNA, 22 bp, Homo sapiens
cccacacaaatcatggggagaa

SEQ ID NO: 8558057 - DNA, 22 bp, Homo sapiens
cccaatggctggatggagggat

SEQ ID NO: 8558058 - DNA, 22 bp, Homo sapiens
cccaataaaattcattttcatt

SEQ ID NO: 8558059 - DNA, 22 bp, Homo sapiens
cccacacactggctgctgccaa

SEQ ID NO: 8558060 - DNA, 22 bp, Homo sapiens
cccacacacatttatgatagga

SEQ ID NO: 8558061 - DNA, 22 bp, Homo sapiens
cccacacacatttatgatagga

SEQ ID NO: 8558062 - DNA, 18 bp, Homo sapiens
cccacacagcagtagctc

SEQ ID NO: 8558063 - DNA, 18 bp, Homo sapiens
cccacacagcagtagctc

SEQ ID NO: 8558064 - DNA, 18 bp, Homo sapiens
cccacacagcagtagctc

SEQ ID NO: 8558065 - DNA, 22 bp, Homo sapiens
cccacacatttttcacttaccg

SEQ ID NO: 8558066 - DNA, 22 bp, Homo sapiens
cccacacatttttcacttaccg

SEQ ID NO: 8558067 - DNA, 22 bp, Homo sapiens
cccacacatttttcacttaccg

SEQ ID NO: 8558068 - DNA, 20 bp, Homo sapiens
cccacacccttcccacttgg

SEQ ID NO: 8558069 - DNA, 22 bp, Homo sapiens
cccacacatttttcacttaccg

SEQ ID NO: 8558070 - DNA, 22 bp, Homo sapiens
ccagtgtgaaaggtcatttatc

SEQ ID NO: 8558071 - DNA, 22 bp, Homo sapiens
ccagtgtatttttgggacctgc

SEQ ID NO: 8558072 - DNA, 22 bp, Homo sapiens
cccaagtattcctcctctgccc

SEQ ID NO: 8558073 - DNA, 22 bp, Homo sapiens
ccagtgtgcaatctctggctta

SEQ ID NO: 8558074 - DNA, 22 bp, Homo sapiens
ccattttattagtgacatttag

SEQ ID NO: 8558075 - DNA, 22 bp, Homo sapiens
ccagtgtgaccatctgttagct

SEQ ID NO: 8558076 - DNA, 22 bp, Homo sapiens
ccagtgtgaccatctgttagct

SEQ ID NO: 8558077 - DNA, 22 bp, Homo sapiens
ccagtgtgattgttgcaagaat

SEQ ID NO: 8558078 - DNA, 22 bp, Homo sapiens
ccagtgtgaacctcaccaccct

SEQ ID NO: 8558079 - DNA, 22 bp, Homo sapiens
ccagtacacctcacttcccttt

SEQ ID NO: 8558080 - DNA, 22 bp, Homo sapiens
ccagtacatcgcatggtgacca

SEQ ID NO: 8558081 - DNA, 18 bp, Homo sapiens
ccagtacctcctcctctc

SEQ ID NO: 8558082 - DNA, 22 bp, Homo sapiens
ccagtaaaccaagtgtttacta

SEQ ID NO: 8558083 - DNA, 21 bp, Homo sapiens
ccagtattatttctctatgta

SEQ ID NO: 8558084 - DNA, 22 bp, Homo sapiens
ccagtcaaaaggaagtcaatgt

SEQ ID NO: 8558085 - DNA, 22 bp, Homo sapiens
ccagtcaagttgacacaccaag

SEQ ID NO: 8558086 - DNA, 22 bp, Homo sapiens
aggctgagtcgggaggatcact

SEQ ID NO: 8558087 - DNA, 19 bp, Homo sapiens
ccagtagagacagctgcag

SEQ ID NO: 8558088 - DNA, 22 bp, Homo sapiens
ccaggtggttcaggtcaccata

SEQ ID NO: 8558089 - DNA, 22 bp, Homo sapiens
ccaggtggttcaggtcaccata

SEQ ID NO: 8558090 - DNA, 20 bp, Homo sapiens
ccaggtggtgcctggagagg

SEQ ID NO: 8558091 - DNA, 20 bp, Homo sapiens
ccaggtggtgcctggagagg

SEQ ID NO: 8558092 - DNA, 18 bp, Homo sapiens
ccaggtggtgacagagat

SEQ ID NO: 8558093 - DNA, 20 bp, Homo sapiens
ccaggtggtgcctggagagg

SEQ ID NO: 8558094 - DNA, 20 bp, Homo sapiens
ccaggtggtgcctggagagg

SEQ ID NO: 8558095 - DNA, 22 bp, Homo sapiens
ccaggtggtgcctctgttcgca

SEQ ID NO: 8558096 - DNA, 22 bp, Homo sapiens
ccaggtggtgcctctgttcgca

SEQ ID NO: 8558097 - DNA, 22 bp, Homo sapiens
ccaggtggtgaaagtgggccct

SEQ ID NO: 8558098 - DNA, 22 bp, Homo sapiens
ccaggtggtgaaagtgggccct

SEQ ID NO: 8558099 - DNA, 22 bp, Homo sapiens
ccaggtgcctccagtcacagtg

SEQ ID NO: 8558100 - DNA, 22 bp, Homo sapiens
ccagggcagcgcccctccacgc

SEQ ID NO: 8558101 - DNA, 22 bp, Homo sapiens
ccagggcagccaacccagatgc

SEQ ID NO: 8558102 - DNA, 22 bp, Homo sapiens
ccagggcagccaacccagatgc

SEQ ID NO: 8558103 - DNA, 22 bp, Homo sapiens
ccagggcagcagaattggggca

SEQ ID NO: 8558104 - DNA, 22 bp, Homo sapiens
ccagggcagcagaattggggca

SEQ ID NO: 8558105 - DNA, 22 bp, Homo sapiens
ccagggcagccaacccagatgc

SEQ ID NO: 8558106 - DNA, 22 bp, Homo sapiens
ccagggcacttaggcccagccc

SEQ ID NO: 8558107 - DNA, 22 bp, Homo sapiens
ccagggcacttaggcccagccc

SEQ ID NO: 8558108 - DNA, 22 bp, Homo sapiens
ccagggcagaaaaagagggaat

SEQ ID NO: 8558109 - DNA, 22 bp, Homo sapiens
ccagggcagaaaaagagggaat

SEQ ID NO: 8558110 - DNA, 22 bp, Homo sapiens
ccagggcacttaggcccagccc

SEQ ID NO: 8558111 - DNA, 22 bp, Homo sapiens
aggctcagcccaaggtggagag

SEQ ID NO: 8558112 - DNA, 22 bp, Homo sapiens
aggctcagcccaaggtggagag

SEQ ID NO: 8558113 - DNA, 22 bp, Homo sapiens
aggctcagcccaaggtggagag

SEQ ID NO: 8558114 - DNA, 22 bp, Homo sapiens
aggctcagcatctgattcatat

SEQ ID NO: 8558115 - DNA, 22 bp, Homo sapiens
aggctcagcccctgggaggaga

SEQ ID NO: 8558116 - DNA, 22 bp, Homo sapiens
aggctcagcccaaggtggagag

SEQ ID NO: 8558117 - DNA, 22 bp, Homo sapiens
aggctcagcccctgggaggaga

SEQ ID NO: 8558118 - DNA, 22 bp, Homo sapiens
aggctcagcctgggcctagagc

SEQ ID NO: 8558119 - DNA, 22 bp, Homo sapiens
aggctctggttggcaagtaaag

SEQ ID NO: 8558120 - DNA, 22 bp, Homo sapiens
aggctctggttggcaagtaaag

SEQ ID NO: 8558121 - DNA, 22 bp, Homo sapiens
aggctctgggctctagattttg

SEQ ID NO: 8558122 - DNA, 22 bp, Homo sapiens
ccaggcctttcttcttggtctg

SEQ ID NO: 8558123 - DNA, 22 bp, Homo sapiens
aggctcagatccttgtgtcctg

SEQ ID NO: 8558124 - DNA, 22 bp, Homo sapiens
aggctcagatccttgtgtcctg

SEQ ID NO: 8558125 - DNA, 22 bp, Homo sapiens
aggctcagatccttgtgtcctg

SEQ ID NO: 8558126 - DNA, 22 bp, Homo sapiens
ccaggccttctgaggacactct

SEQ ID NO: 8558127 - DNA, 22 bp, Homo sapiens
ccaggccttctgaggacactct

SEQ ID NO: 8558128 - DNA, 20 bp, Homo sapiens
ccaggcctgggcctgctcta

SEQ ID NO: 8558129 - DNA, 20 bp, Homo sapiens
ccaggcctgggcctgctcta

SEQ ID NO: 8558130 - DNA, 20 bp, Homo sapiens
ccaggcctgggcctgctcta

SEQ ID NO: 8558131 - DNA, 22 bp, Homo sapiens
ccaggcctcccttttccagcca

SEQ ID NO: 8558132 - DNA, 22 bp, Homo sapiens
ccaggcctgtgttgtgtggagg

SEQ ID NO: 8558133 - DNA, 22 bp, Homo sapiens
ccaggccttccagtacgcagaa

SEQ ID NO: 8558134 - DNA, 22 bp, Homo sapiens
ccagaggtgctgggagaggtct

SEQ ID NO: 8558135 - DNA, 20 bp, Homo sapiens
ccagaggctgacagactttg

SEQ ID NO: 8558136 - DNA, 22 bp, Homo sapiens
ccagaggctggcaagggctcct

SEQ ID NO: 8558137 - DNA, 20 bp, Homo sapiens
ccagaggctgacagactttg

SEQ ID NO: 8558138 - DNA, 22 bp, Homo sapiens
ccagaggcggaggtttgcagtg

SEQ ID NO: 8558139 - DNA, 20 bp, Homo sapiens
ccagaggctgacagactttg

SEQ ID NO: 8558140 - DNA, 21 bp, Homo sapiens
ccagaggcctctcttggccac

SEQ ID NO: 8558141 - DNA, 21 bp, Homo sapiens
ccagaggcctctcttggccac

SEQ ID NO: 8558142 - DNA, 21 bp, Homo sapiens
ccagaggcctctcttggccac

SEQ ID NO: 8558143 - DNA, 18 bp, Homo sapiens
ccagaggcccgggcaggc

SEQ ID NO: 8558144 - DNA, 18 bp, Homo sapiens
ccagaggcccgggcaggc

SEQ ID NO: 8558145 - DNA, 18 bp, Homo sapiens
ccagaggcccgggcaggc

SEQ ID NO: 8558146 - DNA, 21 bp, Homo sapiens
ccagaggcctctcttggccac

SEQ ID NO: 8558147 - DNA, 21 bp, Homo sapiens
ccagaggcctctcttggccac

SEQ ID NO: 8558148 - DNA, 16 bp, Homo sapiens
ccagaggcctggcctc

SEQ ID NO: 8558149 - DNA, 22 bp, Homo sapiens
ccagaggcggaggtttgcagtg

SEQ ID NO: 8558150 - DNA, 19 bp, Homo sapiens
ccagagtcatgtctccccc

SEQ ID NO: 8558151 - DNA, 22 bp, Homo sapiens
ccagagtcaggagctcatgtga

SEQ ID NO: 8558152 - DNA, 22 bp, Homo sapiens
ccagagtcaggagctcatgtga

SEQ ID NO: 8558153 - DNA, 21 bp, Homo sapiens
ccagaggttctgggcctccct

SEQ ID NO: 8558154 - DNA, 22 bp, Homo sapiens
ccagaggtggtggtgtctagaa

SEQ ID NO: 8558155 - DNA, 22 bp, Homo sapiens
ccagaggttacaccctcagccc

SEQ ID NO: 8558156 - DNA, 22 bp, Homo sapiens
ccagaggtggtggtgtctagaa

SEQ ID NO: 8558157 - DNA, 22 bp, Homo sapiens
ccagaggtgggagtgatctggt

SEQ ID NO: 8558158 - DNA, 22 bp, Homo sapiens
ccagaggcatgttcaaagcaat

SEQ ID NO: 8558159 - DNA, 19 bp, Homo sapiens
ccagaggcagcttctgtaa

SEQ ID NO: 8558160 - DNA, 18 bp, Homo sapiens
ccagaggcccgggcaggc

SEQ ID NO: 8558161 - DNA, 22 bp, Homo sapiens
ccagaggcatgttcaaagcaat

SEQ ID NO: 8558162 - DNA, 22 bp, Homo sapiens
ccagaggcagacttacactcca

SEQ ID NO: 8558163 - DNA, 22 bp, Homo sapiens
ccagaggcagacttacactcca

SEQ ID NO: 8558164 - DNA, 22 bp, Homo sapiens
ccagaggcagacttacactcca

SEQ ID NO: 8558165 - DNA, 22 bp, Homo sapiens
ccagaggatgctggtcagcctc

SEQ ID NO: 8558166 - DNA, 22 bp, Homo sapiens
ccagaggatgctggtcagcctc

SEQ ID NO: 8558167 - DNA, 20 bp, Homo sapiens
ccagagctgatggctgcccg

SEQ ID NO: 8558168 - DNA, 22 bp, Homo sapiens
ccagaggatcagtactggctgg

SEQ ID NO: 8558169 - DNA, 20 bp, Homo sapiens
ccagagctgatggctgcccg

SEQ ID NO: 8558170 - DNA, 20 bp, Homo sapiens
ccagagctgatggctgcccg

SEQ ID NO: 8558171 - DNA, 22 bp, Homo sapiens
ccactcccttccggtccagggc

SEQ ID NO: 8558172 - DNA, 21 bp, Homo sapiens
ccactcatgactccactcacc

SEQ ID NO: 8558173 - DNA, 20 bp, Homo sapiens
ccactccaggtgattctgat

SEQ ID NO: 8558174 - DNA, 22 bp, Homo sapiens
ccactccccacgtgctgtcaga

SEQ ID NO: 8558175 - DNA, 22 bp, Homo sapiens
aggcaggtcacatgcttggcga

SEQ ID NO: 8558176 - DNA, 22 bp, Homo sapiens
aggcaggtcccctggaaggcac

SEQ ID NO: 8558177 - DNA, 22 bp, Homo sapiens
aggcaggtcccctggaaggcac

SEQ ID NO: 8558178 - DNA, 22 bp, Homo sapiens
aggccctgcccagtgccacaag

SEQ ID NO: 8558179 - DNA, 23 bp, Homo sapiens
aggccctgcctgtccctcttttt

SEQ ID NO: 8558180 - DNA, 22 bp, Homo sapiens
aggccctgcccagtgccacaag

SEQ ID NO: 8558181 - DNA, 23 bp, Homo sapiens
aggccctgcctgtccctcttttt

SEQ ID NO: 8558182 - DNA, 22 bp, Homo sapiens
aggccctgcggaaatgatcatt

SEQ ID NO: 8558183 - DNA, 22 bp, Homo sapiens
aggccctgcccagagctcctcg

SEQ ID NO: 8558184 - DNA, 22 bp, Homo sapiens
aggccctgcccagagctcctcg

SEQ ID NO: 8558185 - DNA, 22 bp, Homo sapiens
aggccctgacctgggagatcta

SEQ ID NO: 8558186 - DNA, 22 bp, Homo sapiens
ccagccctcggtagtcccatag

SEQ ID NO: 8558187 - DNA, 22 bp, Homo sapiens
ccagccctgaaccctgctgcat

SEQ ID NO: 8558188 - DNA, 22 bp, Homo sapiens
ccagccctgaaccctgctgcat

SEQ ID NO: 8558189 - DNA, 22 bp, Homo sapiens
ccagccctgattagagaatgtc

SEQ ID NO: 8558190 - DNA, 22 bp, Homo sapiens
ccagccctgattagagaatgtc

SEQ ID NO: 8558191 - DNA, 22 bp, Homo sapiens
ccagccctcctccatcagagga

SEQ ID NO: 8558192 - DNA, 17 bp, Homo sapiens
ccagccctcgcgctttt

SEQ ID NO: 8558193 - DNA, 22 bp, Homo sapiens
ccagccctcctccatcagagga

SEQ ID NO: 8558194 - DNA, 23 bp, Homo sapiens
ccagccctccaccagctctaggc

SEQ ID NO: 8558195 - DNA, 23 bp, Homo sapiens
ccagccctccaccagctctaggc

SEQ ID NO: 8558196 - DNA, 22 bp, Homo sapiens
ccagccaggctggctgtggagg

SEQ ID NO: 8558197 - DNA, 22 bp, Homo sapiens
ccagccaggctggctgtggagg

SEQ ID NO: 8558198 - DNA, 22 bp, Homo sapiens
ccagccaggcattgcaaactga

SEQ ID NO: 8558199 - DNA, 22 bp, Homo sapiens
ccagccaggcattgcaaactga

SEQ ID NO: 8558200 - DNA, 22 bp, Homo sapiens
ccagccaggcattgcaaactga

SEQ ID NO: 8558201 - DNA, 22 bp, Homo sapiens
ccagccagccttgatctgagta

SEQ ID NO: 8558202 - DNA, 22 bp, Homo sapiens
ccagccagccttgatctgagta

SEQ ID NO: 8558203 - DNA, 22 bp, Homo sapiens
ccagccagctggttggacgcct

SEQ ID NO: 8558204 - DNA, 22 bp, Homo sapiens
ccagccagctgcccttggggcc

SEQ ID NO: 8558205 - DNA, 22 bp, Homo sapiens
ccagccagctgcccttggggcc

SEQ ID NO: 8558206 - DNA, 22 bp, Homo sapiens
ccagagtctgtgtgtgtcatcc

SEQ ID NO: 8558207 - DNA, 22 bp, Homo sapiens
ccagagtctttatattcctgaa

SEQ ID NO: 8558208 - DNA, 22 bp, Homo sapiens
ccagcaggcagtcatatccttt

SEQ ID NO: 8558209 - DNA, 22 bp, Homo sapiens
ccagagtcccttgcagctcagt

SEQ ID NO: 8558210 - DNA, 22 bp, Homo sapiens
ccagagtccctgttctcggcct

SEQ ID NO: 8558211 - DNA, 22 bp, Homo sapiens
ccagagtcattttgagtcataa

SEQ ID NO: 8558212 - DNA, 22 bp, Homo sapiens
ccagagtcattttgagtcataa

SEQ ID NO: 8558213 - DNA, 22 bp, Homo sapiens
ccagagtcattttgagtcataa

SEQ ID NO: 8558214 - DNA, 22 bp, Homo sapiens
ccagagtctatgagtcctcatt

SEQ ID NO: 8558215 - DNA, 22 bp, Homo sapiens
ccagagtcccttgcagctcagt

SEQ ID NO: 8558216 - DNA, 22 bp, Homo sapiens
ccagccagaagtccgggcttct

SEQ ID NO: 8558217 - DNA, 22 bp, Homo sapiens
ccagccagaagtccgggcttct

SEQ ID NO: 8558218 - DNA, 22 bp, Homo sapiens
ccagccagcaagctcccagttc

SEQ ID NO: 8558219 - DNA, 22 bp, Homo sapiens
ccagccagatgataagctctat

SEQ ID NO: 8558220 - DNA, 22 bp, Homo sapiens
ccagctcccctcagcaggtaat

SEQ ID NO: 8558221 - DNA, 22 bp, Homo sapiens
ccagctcccgcaggctgcacag

SEQ ID NO: 8558222 - DNA, 23 bp, Homo sapiens
ccagctcccaggtctgaggactg

SEQ ID NO: 8558223 - DNA, 23 bp, Homo sapiens
ccagctcccaggtctgaggactg

SEQ ID NO: 8558224 - DNA, 23 bp, Homo sapiens
ccagctcccaggtctgaggactg

SEQ ID NO: 8558225 - DNA, 23 bp, Homo sapiens
ccagctcccaggtctgaggactg

SEQ ID NO: 8558226 - DNA, 22 bp, Homo sapiens
ccagctcccgcaggctgcacag

SEQ ID NO: 8558227 - DNA, 22 bp, Homo sapiens
ccagctccctgaagcctggtct

SEQ ID NO: 8558228 - DNA, 22 bp, Homo sapiens
ccagctccgggagttgctgctg

SEQ ID NO: 8558229 - DNA, 22 bp, Homo sapiens
ccagctccctgaagcctggtct

SEQ ID NO: 8558230 - DNA, 21 bp, Homo sapiens
aggccctggaggtcagagaaa

SEQ ID NO: 8558231 - DNA, 22 bp, Homo sapiens
ccagctccaggtagatgggcag

SEQ ID NO: 8558232 - DNA, 22 bp, Homo sapiens
ccagctccaggtagatgggcag

SEQ ID NO: 8558233 - DNA, 22 bp, Homo sapiens
aggccctgctgaggcctccctc

SEQ ID NO: 8558234 - DNA, 22 bp, Homo sapiens
aggccctggacactcaagccgg

SEQ ID NO: 8558235 - DNA, 22 bp, Homo sapiens
aggccctgctttccagagctca

SEQ ID NO: 8558236 - DNA, 22 bp, Homo sapiens
aggccctgctttccagagctca

SEQ ID NO: 8558237 - DNA, 22 bp, Homo sapiens
ccaggaggtgctggaagaaagc

SEQ ID NO: 8558238 - DNA, 22 bp, Homo sapiens
ccaggaggtgctggaagaaagc

SEQ ID NO: 8558239 - DNA, 22 bp, Homo sapiens
ccaggaggtggagattgcagtg

SEQ ID NO: 8558240 - DNA, 22 bp, Homo sapiens
ccaggaggtggagattgcagtg

SEQ ID NO: 8558241 - DNA, 22 bp, Homo sapiens
ccaggaggtggcaggacttgcc

SEQ ID NO: 8558242 - DNA, 22 bp, Homo sapiens
ccaggaggtggaggttgcggtg

SEQ ID NO: 8558243 - DNA, 22 bp, Homo sapiens
ccaggaggtggaggttgcggtg

SEQ ID NO: 8558244 - DNA, 22 bp, Homo sapiens
ccaggaggtggcaggacttgcc

SEQ ID NO: 8558245 - DNA, 22 bp, Homo sapiens
ccaggaggtggcaggacttgcc

SEQ ID NO: 8558246 - DNA, 22 bp, Homo sapiens
ccaggaggtggcaggacttgcc

SEQ ID NO: 8558247 - DNA, 22 bp, Homo sapiens
aggcctgggacgggagccgtga

SEQ ID NO: 8558248 - DNA, 22 bp, Homo sapiens
ccaggaggtctgagtgtggaca

SEQ ID NO: 8558249 - DNA, 22 bp, Homo sapiens
ccaggaggggtctctgtctccc

SEQ ID NO: 8558250 - DNA, 22 bp, Homo sapiens
ccaggaggggtctctgtctccc

SEQ ID NO: 8558251 - DNA, 22 bp, Homo sapiens
aggctcagagagctgtgtccat

SEQ ID NO: 8558252 - DNA, 22 bp, Homo sapiens
aggctcagagagctgtgtccat

SEQ ID NO: 8558253 - DNA, 21 bp, Homo sapiens
aggctcagagagaaactcttg

SEQ ID NO: 8558254 - DNA, 22 bp, Homo sapiens
aggctagatagagggtcatctt

SEQ ID NO: 8558255 - DNA, 22 bp, Homo sapiens
aggctagaggcttctggcttca

SEQ ID NO: 8558256 - DNA, 22 bp, Homo sapiens
aggctagaggcttctggcttca

SEQ ID NO: 8558257 - DNA, 22 bp, Homo sapiens
aggcctggtgtgccggatgcag

SEQ ID NO: 8558258 - DNA, 22 bp, Homo sapiens
aggcctggtgtgccggatgcag

SEQ ID NO: 8558259 - DNA, 22 bp, Homo sapiens
aggctcagagatgagtaagcac

SEQ ID NO: 8558260 - DNA, 22 bp, Homo sapiens
aggctcagagatgagtaagcac

SEQ ID NO: 8558261 - DNA, 21 bp, Homo sapiens
aggctcagagatcaaacagta

SEQ ID NO: 8558262 - DNA, 22 bp, Homo sapiens
aggctcagagagctgtgtccat

SEQ ID NO: 8558263 - DNA, 22 bp, Homo sapiens
aggcctgggtgttcaccagaag

SEQ ID NO: 8558264 - DNA, 22 bp, Homo sapiens
aggcctggtgtgccggatgcag

SEQ ID NO: 8558265 - DNA, 22 bp, Homo sapiens
aggcctggtgaatgaagtatct

SEQ ID NO: 8558266 - DNA, 22 bp, Homo sapiens
aggcctgggtgttcaccagaag

SEQ ID NO: 8558267 - DNA, 22 bp, Homo sapiens
aggcctgggtgttcaccagaag

SEQ ID NO: 8558268 - DNA, 22 bp, Homo sapiens
aggcctgggtgttcaccagaag

SEQ ID NO: 8558269 - DNA, 22 bp, Homo sapiens
aggcctgggtctcgtgcctacc

SEQ ID NO: 8558270 - DNA, 22 bp, Homo sapiens
aggcctgggcaagaaggggcgt

SEQ ID NO: 8558271 - DNA, 22 bp, Homo sapiens
aggcctgggcaagaaggggcgt

SEQ ID NO: 8558272 - DNA, 22 bp, Homo sapiens
aggcctgggtctcgtgcctacc

SEQ ID NO: 8558273 - DNA, 19 bp, Homo sapiens
aggcctggggttttgcact

SEQ ID NO: 8558274 - DNA, 22 bp, Homo sapiens
aggcctgggtctcgtgcctacc

SEQ ID NO: 8558275 - DNA, 16 bp, Homo sapiens
aggctcagaggctgga

SEQ ID NO: 8558276 - DNA, 22 bp, Homo sapiens
aggctcagaggtgagcatctgc

SEQ ID NO: 8558277 - DNA, 20 bp, Homo sapiens
aggctcagagcagtagtaca

SEQ ID NO: 8558278 - DNA, 20 bp, Homo sapiens
aggctcagagcagtagtaca

SEQ ID NO: 8558279 - DNA, 16 bp, Homo sapiens
aggctcagaggctgga

SEQ ID NO: 8558280 - DNA, 22 bp, Homo sapiens
aggctcagaggtgagcatctgc

SEQ ID NO: 8558281 - DNA, 22 bp, Homo sapiens
aggctcagaggtgagcatctgc

SEQ ID NO: 8558282 - DNA, 22 bp, Homo sapiens
ccaggcacaggtgggcctcaga

SEQ ID NO: 8558283 - DNA, 20 bp, Homo sapiens
aggctcagatacccagggaa

SEQ ID NO: 8558284 - DNA, 22 bp, Homo sapiens
ccaggcaccaaagtatgcttta

SEQ ID NO: 8558285 - DNA, 22 bp, Homo sapiens
ccaggcacggtggctcatgcct

SEQ ID NO: 8558286 - DNA, 20 bp, Homo sapiens
ccaggcactgtcccatgcag

SEQ ID NO: 8558287 - DNA, 22 bp, Homo sapiens
ataacagatgtgaagtgctaat

SEQ ID NO: 8558288 - DNA, 22 bp, Homo sapiens
ataacagatgtgaagtgctaat

SEQ ID NO: 8558289 - DNA, 22 bp, Homo sapiens
ataacagatgcttcagcataaa

SEQ ID NO: 8558290 - DNA, 22 bp, Homo sapiens
ataacagatgcttcagcataaa

SEQ ID NO: 8558291 - DNA, 22 bp, Homo sapiens
ataacatgacctgtgcttcaca

SEQ ID NO: 8558292 - DNA, 22 bp, Homo sapiens
ataacatgacctgtgcttcaca

SEQ ID NO: 8558293 - DNA, 22 bp, Homo sapiens
ataacagtgacctctcagcacc

SEQ ID NO: 8558294 - DNA, 22 bp, Homo sapiens
ataacctggatataaacagatg

SEQ ID NO: 8558295 - DNA, 22 bp, Homo sapiens
ataacctgagattgagctgcct

SEQ ID NO: 8558296 - DNA, 20 bp, Homo sapiens
ataacctgcccagaggatga

SEQ ID NO: 8558297 - DNA, 20 bp, Homo sapiens
ataacctgcccagaggatga

SEQ ID NO: 8558298 - DNA, 22 bp, Homo sapiens
ataaccatgattaatctaagaa

SEQ ID NO: 8558299 - DNA, 22 bp, Homo sapiens
ataaccctctggataggacagg

SEQ ID NO: 8558300 - DNA, 22 bp, Homo sapiens
ataacatggagtttgtcattta

SEQ ID NO: 8558301 - DNA, 22 bp, Homo sapiens
ataacattttgacaactggtga

SEQ ID NO: 8558302 - DNA, 22 bp, Homo sapiens
ataacctggtagtattaaatgt

SEQ ID NO: 8558303 - DNA, 22 bp, Homo sapiens
ataacctggtagtattaaatgt

SEQ ID NO: 8558304 - DNA, 22 bp, Homo sapiens
ataacctgtttcagacatttgt

SEQ ID NO: 8558305 - DNA, 22 bp, Homo sapiens
ataactctgtttttttcatgca

SEQ ID NO: 8558306 - DNA, 19 bp, Homo sapiens
ataactacattggctcagt

SEQ ID NO: 8558307 - DNA, 22 bp, Homo sapiens
ataactctgtttttttcatgca

SEQ ID NO: 8558308 - DNA, 22 bp, Homo sapiens
ataactgagagcaatctttctt

SEQ ID NO: 8558309 - DNA, 23 bp, Homo sapiens
ataaattactatctccctagagc

SEQ ID NO: 8558310 - DNA, 22 bp, Homo sapiens
ataaattaggatctggggttcc

SEQ ID NO: 8558311 - DNA, 22 bp, Homo sapiens
ataaattaggatctggggttcc

SEQ ID NO: 8558312 - DNA, 22 bp, Homo sapiens
ataacagagttgggaagtgaaa

SEQ ID NO: 8558313 - DNA, 22 bp, Homo sapiens
ataacagagttgggaagtgaaa

SEQ ID NO: 8558314 - DNA, 22 bp, Homo sapiens
ataacagatactctctgtgagg

SEQ ID NO: 8558315 - DNA, 22 bp, Homo sapiens
ataacagatactctctgtgagg

SEQ ID NO: 8558316 - DNA, 22 bp, Homo sapiens
ataacagatactctctgtgagg

SEQ ID NO: 8558317 - DNA, 22 bp, Homo sapiens
ataacagatactctctgtgagg

SEQ ID NO: 8558318 - DNA, 22 bp, Homo sapiens
ataacagagttgggaagtgaaa

SEQ ID NO: 8558319 - DNA, 22 bp, Homo sapiens
ataacagatactctctgtgagg

SEQ ID NO: 8558320 - DNA, 22 bp, Homo sapiens
ataaatgtgaaatgagcagtta

SEQ ID NO: 8558321 - DNA, 22 bp, Homo sapiens
ataaatgtgaattagagctttg

SEQ ID NO: 8558322 - DNA, 22 bp, Homo sapiens
ataaatgtgaattagagctttg

SEQ ID NO: 8558323 - DNA, 23 bp, Homo sapiens
ataaattactatctccctagagc

SEQ ID NO: 8558324 - DNA, 22 bp, Homo sapiens
ataaatgtttgttgaatgaata

SEQ ID NO: 8558325 - DNA, 22 bp, Homo sapiens
ataaatgaacattcacagagct

SEQ ID NO: 8558326 - DNA, 22 bp, Homo sapiens
ataaatctcttaagactcaaca

SEQ ID NO: 8558327 - DNA, 22 bp, Homo sapiens
ctgcctctgcgtcccacagagt

SEQ ID NO: 8558328 - DNA, 22 bp, Homo sapiens
ctgcctctccccagagtggccc

SEQ ID NO: 8558329 - DNA, 22 bp, Homo sapiens
ataaatgattcagcaggaaata

SEQ ID NO: 8558330 - DNA, 22 bp, Homo sapiens
ataaatgattcagcaggaaata

SEQ ID NO: 8558331 - DNA, 22 bp, Homo sapiens
ataaatgattcagcaggaaata

SEQ ID NO: 8558332 - DNA, 22 bp, Homo sapiens
ataaatgaacattcacagagct

SEQ ID NO: 8558333 - DNA, 22 bp, Homo sapiens
ataaatgaacattcacagagct

SEQ ID NO: 8558334 - DNA, 22 bp, Homo sapiens
ctgcctctccccagagtggccc

SEQ ID NO: 8558335 - DNA, 22 bp, Homo sapiens
ctgcctctccccagagtggccc

SEQ ID NO: 8558336 - DNA, 22 bp, Homo sapiens
ctgcctctcaggtccctgagat

SEQ ID NO: 8558337 - DNA, 22 bp, Homo sapiens
ctgcctctcaggtccctgagat

SEQ ID NO: 8558338 - DNA, 22 bp, Homo sapiens
ctgcctctcaggtccctgagat

SEQ ID NO: 8558339 - DNA, 22 bp, Homo sapiens
ctgcctctcagcctgaccgcca

SEQ ID NO: 8558340 - DNA, 22 bp, Homo sapiens
ctgcctctcagcctgaccgcca

SEQ ID NO: 8558341 - DNA, 22 bp, Homo sapiens
ctgcctctcagcctgaccgcca

SEQ ID NO: 8558342 - DNA, 22 bp, Homo sapiens
ctgcctctcagcctgaccgcca

SEQ ID NO: 8558343 - DNA, 23 bp, Homo sapiens
ctgcattgtctcctgggagcatg

SEQ ID NO: 8558344 - DNA, 22 bp, Homo sapiens
atacaaagctttctgtctggta

SEQ ID NO: 8558345 - DNA, 22 bp, Homo sapiens
atacaaaggaacacaggcatgt

SEQ ID NO: 8558346 - DNA, 22 bp, Homo sapiens
atacaaagtattaatcctggat

SEQ ID NO: 8558347 - DNA, 22 bp, Homo sapiens
atacaaaggaacacaggcatgt

SEQ ID NO: 8558348 - DNA, 22 bp, Homo sapiens
atacaaaggaacacaggcatgt

SEQ ID NO: 8558349 - DNA, 22 bp, Homo sapiens
atacaaatttatagatgcattt

SEQ ID NO: 8558350 - DNA, 22 bp, Homo sapiens
atacaacagaaaatgattattc

SEQ ID NO: 8558351 - DNA, 22 bp, Homo sapiens
ctgctgaggtccttgctcagac

SEQ ID NO: 8558352 - DNA, 22 bp, Homo sapiens
ctgctgcaactctttagagggt

SEQ ID NO: 8558353 - DNA, 22 bp, Homo sapiens
atacaactgctctcagataagt

SEQ ID NO: 8558354 - DNA, 22 bp, Homo sapiens
atacaactgccttagaaggaaa

SEQ ID NO: 8558355 - DNA, 22 bp, Homo sapiens
atacaactgctctcagataagt

SEQ ID NO: 8558356 - DNA, 22 bp, Homo sapiens
atacaactgccttagaaggaaa

SEQ ID NO: 8558357 - DNA, 22 bp, Homo sapiens
atacaactttatctgtaatgag

SEQ ID NO: 8558358 - DNA, 22 bp, Homo sapiens
atacaactttacatgcaattcc

SEQ ID NO: 8558359 - DNA, 22 bp, Homo sapiens
atacaactttacatgcaattcc

SEQ ID NO: 8558360 - DNA, 22 bp, Homo sapiens
ataatttactaagctctacctt

SEQ ID NO: 8558361 - DNA, 21 bp, Homo sapiens
ataagcatgctgattacattt

SEQ ID NO: 8558362 - DNA, 22 bp, Homo sapiens
ataagcatgttagaatatttga

SEQ ID NO: 8558363 - DNA, 22 bp, Homo sapiens
ataagcatgttagaatatttga

SEQ ID NO: 8558364 - DNA, 22 bp, Homo sapiens
ataagcatgttagaatatttga

SEQ ID NO: 8558365 - DNA, 22 bp, Homo sapiens
atacaaagctaaatatggtttc

SEQ ID NO: 8558366 - DNA, 17 bp, Homo sapiens
atacaaagccataaacc

SEQ ID NO: 8558367 - DNA, 21 bp, Homo sapiens
ataagcatgctgattacattt

SEQ ID NO: 8558368 - DNA, 22 bp, Homo sapiens
ataagcatgattaccgggagca

SEQ ID NO: 8558369 - DNA, 22 bp, Homo sapiens
ataagcagggtcaaatgcctac

SEQ ID NO: 8558370 - DNA, 22 bp, Homo sapiens
ataagaggaattacagaagagg

SEQ ID NO: 8558371 - DNA, 22 bp, Homo sapiens
ataagaggaattacagaagagg

SEQ ID NO: 8558372 - DNA, 22 bp, Homo sapiens
ataagagtcttgttttcttatt

SEQ ID NO: 8558373 - DNA, 22 bp, Homo sapiens
ataagagtcttgttttcttatt

SEQ ID NO: 8558374 - DNA, 22 bp, Homo sapiens
ataagacacgccccactcactc

SEQ ID NO: 8558375 - DNA, 22 bp, Homo sapiens
ataagaaacattattctttcca

SEQ ID NO: 8558376 - DNA, 22 bp, Homo sapiens
ataacttaatgggtcatgctct

SEQ ID NO: 8558377 - DNA, 23 bp, Homo sapiens
ataactgagccgaggcttaagaa

SEQ ID NO: 8558378 - DNA, 22 bp, Homo sapiens
ataacttaatgggtcatgctct

SEQ ID NO: 8558379 - DNA, 22 bp, Homo sapiens
ataacttaatgggtcatgctct

SEQ ID NO: 8558380 - DNA, 22 bp, Homo sapiens
ataacttagagtaggcaaaagt

SEQ ID NO: 8558381 - DNA, 22 bp, Homo sapiens
ataacttattagattggagctg

SEQ ID NO: 8558382 - DNA, 22 bp, Homo sapiens
ataacttcagtttctgtgtcct

SEQ ID NO: 8558383 - DNA, 22 bp, Homo sapiens
ataacttgatgttatttgtcca

SEQ ID NO: 8558384 - DNA, 22 bp, Homo sapiens
ataactttcttcacccttgctg

SEQ ID NO: 8558385 - DNA, 22 bp, Homo sapiens
ataacttcatcaaataggcaca

SEQ ID NO: 8558386 - DNA, 22 bp, Homo sapiens
ctgcagagacctaggtcaggtt

SEQ ID NO: 8558387 - DNA, 22 bp, Homo sapiens
ctgcagagacctaggtcaggtt

SEQ ID NO: 8558388 - DNA, 22 bp, Homo sapiens
ctgcagagagtaactgaaatat

SEQ ID NO: 8558389 - DNA, 22 bp, Homo sapiens
ctgcagagatgaagaaggtggc

SEQ ID NO: 8558390 - DNA, 22 bp, Homo sapiens
ctgcagagagtgccgggcagcc

SEQ ID NO: 8558391 - DNA, 22 bp, Homo sapiens
ctgcagagagtgccgggcagcc

SEQ ID NO: 8558392 - DNA, 22 bp, Homo sapiens
ctgcagagagtgccgggcagcc

SEQ ID NO: 8558393 - DNA, 22 bp, Homo sapiens
ctgcagagaattgtggggcttc

SEQ ID NO: 8558394 - DNA, 22 bp, Homo sapiens
ctgcagagaattgtggggcttc

SEQ ID NO: 8558395 - DNA, 23 bp, Homo sapiens
ctgcagagaactgagggacagcc

SEQ ID NO: 8558396 - DNA, 22 bp, Homo sapiens
ctgcagagacctaggtcaggtt

SEQ ID NO: 8558397 - DNA, 22 bp, Homo sapiens
ctgcagagaattgtggggcttc

SEQ ID NO: 8558398 - DNA, 22 bp, Homo sapiens
ctgcagagaattgtggggcttc

SEQ ID NO: 8558399 - DNA, 23 bp, Homo sapiens
ctgcagagaactgagggacagcc

SEQ ID NO: 8558400 - DNA, 23 bp, Homo sapiens
ctgcagagaactgagggacagcc

SEQ ID NO: 8558401 - DNA, 23 bp, Homo sapiens
ctgcaattgcctgatctcattgg

SEQ ID NO: 8558402 - DNA, 22 bp, Homo sapiens
ctgcagggagaggggacagcct

SEQ ID NO: 8558403 - DNA, 22 bp, Homo sapiens
ctgcagagatgaagaaggtggc

SEQ ID NO: 8558404 - DNA, 22 bp, Homo sapiens
ctgcagagatgaagaaggtggc

SEQ ID NO: 8558405 - DNA, 22 bp, Homo sapiens
ctgcagagatgaagaaggtggc

SEQ ID NO: 8558406 - DNA, 22 bp, Homo sapiens
ctgcagagcaagtaacatcctc

SEQ ID NO: 8558407 - DNA, 22 bp, Homo sapiens
ctgcagagcaagtaacatcctc

SEQ ID NO: 8558408 - DNA, 22 bp, Homo sapiens
ctgcagagatgaagaaggtggc

SEQ ID NO: 8558409 - DNA, 20 bp, Homo sapiens
ctgcagggtgagtgggcgat

SEQ ID NO: 8558410 - DNA, 20 bp, Homo sapiens
ctgcagggtgagtgggcgat

SEQ ID NO: 8558411 - DNA, 22 bp, Homo sapiens
ctgcaggggtgtcctgtattgg

SEQ ID NO: 8558412 - DNA, 22 bp, Homo sapiens
ctgcatgtcactctgctgtccc

SEQ ID NO: 8558413 - DNA, 22 bp, Homo sapiens
ctgcatgtgttatatttggttc

SEQ ID NO: 8558414 - DNA, 23 bp, Homo sapiens
ctgcatgtccactggtgtaaatg

SEQ ID NO: 8558415 - DNA, 22 bp, Homo sapiens
ctgcatgtgtttctgctgggtt

SEQ ID NO: 8558416 - DNA, 22 bp, Homo sapiens
ctgcatgtgttatatttggttc

SEQ ID NO: 8558417 - DNA, 22 bp, Homo sapiens
ctgcatgtttacatttttgaga

SEQ ID NO: 8558418 - DNA, 22 bp, Homo sapiens
ctgcatgtgtttctgctgggtt

SEQ ID NO: 8558419 - DNA, 22 bp, Homo sapiens
ctgcattgatcaggcagaatct

SEQ ID NO: 8558420 - DNA, 20 bp, Homo sapiens
ctgcatgttggaggtgtacc

SEQ ID NO: 8558421 - DNA, 22 bp, Homo sapiens
ctgcatgttttcttaattgtga

SEQ ID NO: 8558422 - DNA, 22 bp, Homo sapiens
ctgcatctgttagattatcacc

SEQ ID NO: 8558423 - DNA, 22 bp, Homo sapiens
ctgcatgagctgtcagtggagg

SEQ ID NO: 8558424 - DNA, 22 bp, Homo sapiens
ctgcatgctgagccaacagtga

SEQ ID NO: 8558425 - DNA, 22 bp, Homo sapiens
ctgcatggttcaaatgagctaa

SEQ ID NO: 8558426 - DNA, 20 bp, Homo sapiens
ctgcatctgtgacttgcaaa

SEQ ID NO: 8558427 - DNA, 22 bp, Homo sapiens
ctgcatctgcataatcaacttc

SEQ ID NO: 8558428 - DNA, 20 bp, Homo sapiens
ctgcatctgtgacttgcaaa

SEQ ID NO: 8558429 - DNA, 21 bp, Homo sapiens
ctgcatctgagtcattatgcc

SEQ ID NO: 8558430 - DNA, 21 bp, Homo sapiens
ctgcatctcatagaacatgtc

SEQ ID NO: 8558431 - DNA, 22 bp, Homo sapiens
ctgcatctctgctagtcagtca

SEQ ID NO: 8558432 - DNA, 20 bp, Homo sapiens
ctgcagggttagaggctcca

SEQ ID NO: 8558433 - DNA, 20 bp, Homo sapiens
ctgcagggttagaggctcca

SEQ ID NO: 8558434 - DNA, 22 bp, Homo sapiens
ctgcagggttcggagagttccc

SEQ ID NO: 8558435 - DNA, 22 bp, Homo sapiens
ctgcatcctaacctccatgcag

SEQ ID NO: 8558436 - DNA, 21 bp, Homo sapiens
ctgcatctcatagaacatgtc

SEQ ID NO: 8558437 - DNA, 22 bp, Homo sapiens
ctgcatctcaggagacgggtct

SEQ ID NO: 8558438 - DNA, 22 bp, Homo sapiens
ctgcatcctggaaatagctaag

SEQ ID NO: 8558439 - DNA, 23 bp, Homo sapiens
ctgcaactcagtctggagcagtt

SEQ ID NO: 8558440 - DNA, 22 bp, Homo sapiens
ctgcaaatcaagttcttataat

SEQ ID NO: 8558441 - DNA, 22 bp, Homo sapiens
ctgcaaataggggtgtgaataa

SEQ ID NO: 8558442 - DNA, 22 bp, Homo sapiens
ctgatcccattggcagtccagt

SEQ ID NO: 8558443 - DNA, 22 bp, Homo sapiens
ctgatcccattggcagtccagt

SEQ ID NO: 8558444 - DNA, 22 bp, Homo sapiens
agttatttactcctttgtctct

SEQ ID NO: 8558445 - DNA, 22 bp, Homo sapiens
ctgcaaggctggggtgagctgg

SEQ ID NO: 8558446 - DNA, 22 bp, Homo sapiens
ctgcaatatgatgtctgagaaa

SEQ ID NO: 8558447 - DNA, 22 bp, Homo sapiens
ctgcaatagtttagaataattg

SEQ ID NO: 8558448 - DNA, 22 bp, Homo sapiens
ctgcaatatgatgtctgagaaa

SEQ ID NO: 8558449 - DNA, 22 bp, Homo sapiens
ctgcaagattggaagatgcaat

SEQ ID NO: 8558450 - DNA, 22 bp, Homo sapiens
agttatatgtgaaaacacgtat

SEQ ID NO: 8558451 - DNA, 22 bp, Homo sapiens
agttatattccatagattcaga

SEQ ID NO: 8558452 - DNA, 22 bp, Homo sapiens
ctgaggagcgttggtcacgtgt

SEQ ID NO: 8558453 - DNA, 22 bp, Homo sapiens
ctgaggagccccctctcagcat

SEQ ID NO: 8558454 - DNA, 22 bp, Homo sapiens
ctgaggagccccctctcagcat

SEQ ID NO: 8558455 - DNA, 22 bp, Homo sapiens
agttattgagtatctataatgt

SEQ ID NO: 8558456 - DNA, 22 bp, Homo sapiens
agttattcatttattctgtaca

SEQ ID NO: 8558457 - DNA, 19 bp, Homo sapiens
agttattgatctattcagg

SEQ ID NO: 8558458 - DNA, 22 bp, Homo sapiens
agttattactctttaacatatt

SEQ ID NO: 8558459 - DNA, 22 bp, Homo sapiens
agttatcatcccttacactttg

SEQ ID NO: 8558460 - DNA, 22 bp, Homo sapiens
agttatcaggtgttttcatgga

SEQ ID NO: 8558461 - DNA, 22 bp, Homo sapiens
agttatattccatagattcaga

SEQ ID NO: 8558462 - DNA, 22 bp, Homo sapiens
atacctgtgtatccacaagcgt

SEQ ID NO: 8558463 - DNA, 22 bp, Homo sapiens
atacctttaggcattttgcatc

SEQ ID NO: 8558464 - DNA, 22 bp, Homo sapiens
atacgggttgttaaaaaatcat

SEQ ID NO: 8558465 - DNA, 22 bp, Homo sapiens
ataccttttagacatgtagttg

SEQ ID NO: 8558466 - DNA, 22 bp, Homo sapiens
atacctgtgtatccacaagcgt

SEQ ID NO: 8558467 - DNA, 22 bp, Homo sapiens
atacctgtgtatccacaagcgt

SEQ ID NO: 8558468 - DNA, 22 bp, Homo sapiens
atacctctggcactcaagactt

SEQ ID NO: 8558469 - DNA, 22 bp, Homo sapiens
atacctgatcaaggcaaaaatg

SEQ ID NO: 8558470 - DNA, 22 bp, Homo sapiens
ataccatggcagtttattcacg

SEQ ID NO: 8558471 - DNA, 22 bp, Homo sapiens
ataccataggaaaggatcagcc

SEQ ID NO: 8558472 - DNA, 22 bp, Homo sapiens
ataccaccatctatgaaaggta

SEQ ID NO: 8558473 - DNA, 22 bp, Homo sapiens
ataccctttacaggaacagcaa

SEQ ID NO: 8558474 - DNA, 22 bp, Homo sapiens
atacatgttcgtgtacatgttc

SEQ ID NO: 8558475 - DNA, 22 bp, Homo sapiens
atacatgtgtgtgcatacatgt

SEQ ID NO: 8558476 - DNA, 22 bp, Homo sapiens
atacattcaaaggaaggataga

SEQ ID NO: 8558477 - DNA, 22 bp, Homo sapiens
atacatatatggtacttcctgg

SEQ ID NO: 8558478 - DNA, 22 bp, Homo sapiens
atacatagtaccacatttgaca

SEQ ID NO: 8558479 - DNA, 17 bp, Homo sapiens
atacattgttaaagtat

SEQ ID NO: 8558480 - DNA, 22 bp, Homo sapiens
atacattcagcagtgctcatga

SEQ ID NO: 8558481 - DNA, 21 bp, Homo sapiens
atacattctattaagcattta

SEQ ID NO: 8558482 - DNA, 22 bp, Homo sapiens
atacattcctactgactagcta

SEQ ID NO: 8558483 - DNA, 22 bp, Homo sapiens
atacatagcagagtcaattaat

SEQ ID NO: 8558484 - DNA, 22 bp, Homo sapiens
atacatacgtacatacgtatgt

SEQ ID NO: 8558485 - DNA, 22 bp, Homo sapiens
atacatacgtacatacgtatgt

SEQ ID NO: 8558486 - DNA, 22 bp, Homo sapiens
atacatacgtacatacgtatgt

SEQ ID NO: 8558487 - DNA, 22 bp, Homo sapiens
atacatacatgtatgcacatac

SEQ ID NO: 8558488 - DNA, 22 bp, Homo sapiens
atacatacatgtatgcacatac

SEQ ID NO: 8558489 - DNA, 22 bp, Homo sapiens
atacatacatgtacacataaat

SEQ ID NO: 8558490 - DNA, 22 bp, Homo sapiens
atacatacatgtacacataaat

SEQ ID NO: 8558491 - DNA, 22 bp, Homo sapiens
atacatacatgtacacataaat

SEQ ID NO: 8558492 - DNA, 23 bp, Homo sapiens
atacatacagtcttactgacttt

SEQ ID NO: 8558493 - DNA, 23 bp, Homo sapiens
atacatacagtcttactgacttt

SEQ ID NO: 8558494 - DNA, 22 bp, Homo sapiens
atacagtatgtaggcttttcag

SEQ ID NO: 8558495 - DNA, 22 bp, Homo sapiens
atacagtatgtaggcttttcag

SEQ ID NO: 8558496 - DNA, 22 bp, Homo sapiens
atacagtattacctgttcagga

SEQ ID NO: 8558497 - DNA, 22 bp, Homo sapiens
atacagtattacctgttcagga

SEQ ID NO: 8558498 - DNA, 22 bp, Homo sapiens
atacagtattacctgttcagga

SEQ ID NO: 8558499 - DNA, 22 bp, Homo sapiens
atacagtataactaataaaccc

SEQ ID NO: 8558500 - DNA, 22 bp, Homo sapiens
atacagtataactaataaaccc

SEQ ID NO: 8558501 - DNA, 22 bp, Homo sapiens
atacagtataactaataaaccc

SEQ ID NO: 8558502 - DNA, 20 bp, Homo sapiens
atacagtaggtgctcaatat

SEQ ID NO: 8558503 - DNA, 22 bp, Homo sapiens
atacagtgtactatttagcagt

SEQ ID NO: 8558504 - DNA, 22 bp, Homo sapiens
atacagtgccccttttcacatg

SEQ ID NO: 8558505 - DNA, 22 bp, Homo sapiens
atacagtgccccttttcacatg

SEQ ID NO: 8558506 - DNA, 22 bp, Homo sapiens
atacagtgaatacttacagtgt

SEQ ID NO: 8558507 - DNA, 22 bp, Homo sapiens
atacagtcagactttagccatt

SEQ ID NO: 8558508 - DNA, 22 bp, Homo sapiens
ctggaatgtagagacagcttag

SEQ ID NO: 8558509 - DNA, 22 bp, Homo sapiens
ctggaatgtatgtatcttaaga

SEQ ID NO: 8558510 - DNA, 22 bp, Homo sapiens
ctggaatgggtttcaggcactg

SEQ ID NO: 8558511 - DNA, 19 bp, Homo sapiens
ctggaatgatagagacctc

SEQ ID NO: 8558512 - DNA, 22 bp, Homo sapiens
ctggaatgcctccctgtcagag

SEQ ID NO: 8558513 - DNA, 22 bp, Homo sapiens
ctggaatgcctccctgtcagag

SEQ ID NO: 8558514 - DNA, 22 bp, Homo sapiens
ctggaatgcctccctgtcagag

SEQ ID NO: 8558515 - DNA, 22 bp, Homo sapiens
ctggaatgagcagggcttatgg

SEQ ID NO: 8558516 - DNA, 22 bp, Homo sapiens
ctggaatgagcagggcttatgg

SEQ ID NO: 8558517 - DNA, 19 bp, Homo sapiens
ctggaatgagaacatgccc

SEQ ID NO: 8558518 - DNA, 22 bp, Homo sapiens
ctggaagagcatttgcataggg

SEQ ID NO: 8558519 - DNA, 22 bp, Homo sapiens
ctggaagagcatttgcataggg

SEQ ID NO: 8558520 - DNA, 22 bp, Homo sapiens
ctggaagaggaagccagctgga

SEQ ID NO: 8558521 - DNA, 22 bp, Homo sapiens
ctggaagaggaagccagctgga

SEQ ID NO: 8558522 - DNA, 22 bp, Homo sapiens
ctggaagagcatttgcataggg

SEQ ID NO: 8558523 - DNA, 22 bp, Homo sapiens
ctggaagtggggttggcttgaa

SEQ ID NO: 8558524 - DNA, 22 bp, Homo sapiens
ctggaataaacgatcttcagca

SEQ ID NO: 8558525 - DNA, 22 bp, Homo sapiens
ctggaagtttccttcctggtca

SEQ ID NO: 8558526 - DNA, 22 bp, Homo sapiens
ctgctgccaagggtgccacagg

SEQ ID NO: 8558527 - DNA, 22 bp, Homo sapiens
ctgctgccaagggtgccacagg

SEQ ID NO: 8558528 - DNA, 22 bp, Homo sapiens
ctgctgcattactcttctcaag

SEQ ID NO: 8558529 - DNA, 22 bp, Homo sapiens
ctgctgcattcctctttatgag

SEQ ID NO: 8558530 - DNA, 22 bp, Homo sapiens
ctgctgccaagggtgccacagg

SEQ ID NO: 8558531 - DNA, 22 bp, Homo sapiens
atacagtagggaccatgtctga

SEQ ID NO: 8558532 - DNA, 22 bp, Homo sapiens
atacagtagggaccatgtctga

SEQ ID NO: 8558533 - DNA, 22 bp, Homo sapiens
atacagtagacaatctcatgaa

SEQ ID NO: 8558534 - DNA, 22 bp, Homo sapiens
atacagtagacaatctcatgaa

SEQ ID NO: 8558535 - DNA, 22 bp, Homo sapiens
atacagtagacaatctcatgaa

SEQ ID NO: 8558536 - DNA, 22 bp, Homo sapiens
atacagtagacaatctcatgaa

SEQ ID NO: 8558537 - DNA, 22 bp, Homo sapiens
atacagtaattgccctgcaatg

SEQ ID NO: 8558538 - DNA, 22 bp, Homo sapiens
atacagtaagtgtccctgaaac

SEQ ID NO: 8558539 - DNA, 22 bp, Homo sapiens
atacagtaagtgtccctgaaac

SEQ ID NO: 8558540 - DNA, 22 bp, Homo sapiens
atacagtaattgcataggcttc

SEQ ID NO: 8558541 - DNA, 22 bp, Homo sapiens
atacagtaatttgtaactcatc

SEQ ID NO: 8558542 - DNA, 22 bp, Homo sapiens
atacagtaatttgtaactcatc

SEQ ID NO: 8558543 - DNA, 19 bp, Homo sapiens
atacagtaaggtgtttgcc

SEQ ID NO: 8558544 - DNA, 19 bp, Homo sapiens
atacagtaaggtgtttgcc

SEQ ID NO: 8558545 - DNA, 22 bp, Homo sapiens
ctggagagaatgttcattgcag

SEQ ID NO: 8558546 - DNA, 22 bp, Homo sapiens
ctggagagaatgttcattgcag

SEQ ID NO: 8558547 - DNA, 22 bp, Homo sapiens
ctggagagaatgtggaatgatt

SEQ ID NO: 8558548 - DNA, 22 bp, Homo sapiens
ctggagagaatgttcattgcag

SEQ ID NO: 8558549 - DNA, 22 bp, Homo sapiens
ctggagagaatgttcattgcag

SEQ ID NO: 8558550 - DNA, 22 bp, Homo sapiens
ctggagagaatgttcattgcag

SEQ ID NO: 8558551 - DNA, 22 bp, Homo sapiens
ctggagacctctcctgagagtg

SEQ ID NO: 8558552 - DNA, 22 bp, Homo sapiens
ctggagacctctcctgagagtg

SEQ ID NO: 8558553 - DNA, 22 bp, Homo sapiens
ctggagagaaatgacaaagcta

SEQ ID NO: 8558554 - DNA, 22 bp, Homo sapiens
ctggagagaatgtggaatgatt

SEQ ID NO: 8558555 - DNA, 22 bp, Homo sapiens
ctggagagaatgtggaatgatt

SEQ ID NO: 8558556 - DNA, 22 bp, Homo sapiens
ctggagagaatgtggaatgatt

SEQ ID NO: 8558557 - DNA, 22 bp, Homo sapiens
ctggagagaaatgacaaagcta

SEQ ID NO: 8558558 - DNA, 22 bp, Homo sapiens
ctggagagaaatgacaaagcta

SEQ ID NO: 8558559 - DNA, 22 bp, Homo sapiens
ctggagagaaatgacaaagcta

SEQ ID NO: 8558560 - DNA, 22 bp, Homo sapiens
ctggagagaatgtggaatgatt

SEQ ID NO: 8558561 - DNA, 22 bp, Homo sapiens
ctggagaagaggtagtatgtag

SEQ ID NO: 8558562 - DNA, 22 bp, Homo sapiens
ctggaatgtctgctcaatgttt

SEQ ID NO: 8558563 - DNA, 22 bp, Homo sapiens
ctggaatgtctgctcaatgttt

SEQ ID NO: 8558564 - DNA, 22 bp, Homo sapiens
ctggagaagtactgagacattt

SEQ ID NO: 8558565 - DNA, 22 bp, Homo sapiens
ctggagaagccaaactagtcac

SEQ ID NO: 8558566 - DNA, 22 bp, Homo sapiens
atagcagaaaccaagcttcttc

SEQ ID NO: 8558567 - DNA, 22 bp, Homo sapiens
atagcaatttgcccaattacct

SEQ ID NO: 8558568 - DNA, 22 bp, Homo sapiens
atagcacaatattacctttatg

SEQ ID NO: 8558569 - DNA, 22 bp, Homo sapiens
atagcaattaagctccagaatt

SEQ ID NO: 8558570 - DNA, 22 bp, Homo sapiens
atagcaattaagctccagaatt

SEQ ID NO: 8558571 - DNA, 22 bp, Homo sapiens
atagcaatggcaacaactaagc

SEQ ID NO: 8558572 - DNA, 22 bp, Homo sapiens
atagcaattaagctccagaatt

SEQ ID NO: 8558573 - DNA, 22 bp, Homo sapiens
atagcaatgatcaagacagaca

SEQ ID NO: 8558574 - DNA, 22 bp, Homo sapiens
atagcaatggcaacaactaagc

SEQ ID NO: 8558575 - DNA, 22 bp, Homo sapiens
atagcaaatattttaatgagca

SEQ ID NO: 8558576 - DNA, 22 bp, Homo sapiens
atagcaaatattttaatgagca

SEQ ID NO: 8558577 - DNA, 22 bp, Homo sapiens
atagcaaattctttaggtgctt

SEQ ID NO: 8558578 - DNA, 22 bp, Homo sapiens
ctggctggcaagtagaacacaa

SEQ ID NO: 8558579 - DNA, 22 bp, Homo sapiens
ctggctggccggagcgaggcgg

SEQ ID NO: 8558580 - DNA, 22 bp, Homo sapiens
ctggctggccatgtagagatga

SEQ ID NO: 8558581 - DNA, 22 bp, Homo sapiens
ctggctggccatgcagcgccag

SEQ ID NO: 8558582 - DNA, 22 bp, Homo sapiens
ctggctggccatgcagcgccag

SEQ ID NO: 8558583 - DNA, 22 bp, Homo sapiens
ctggctccatccttgagctctg

SEQ ID NO: 8558584 - DNA, 22 bp, Homo sapiens
ctggctccatctttgcttcctg

SEQ ID NO: 8558585 - DNA, 22 bp, Homo sapiens
ctggctcacaggtgagatgcat

SEQ ID NO: 8558586 - DNA, 22 bp, Homo sapiens
ctggctccatcactgggtgatg

SEQ ID NO: 8558587 - DNA, 22 bp, Homo sapiens
ctggctcccgaagccctcagtg

SEQ ID NO: 8558588 - DNA, 22 bp, Homo sapiens
ctggctcccgtctggtggccat

SEQ ID NO: 8558589 - DNA, 22 bp, Homo sapiens
ctggctcccggggatcgagcac

SEQ ID NO: 8558590 - DNA, 22 bp, Homo sapiens
ctggctcccgaagccctcagtg

SEQ ID NO: 8558591 - DNA, 22 bp, Homo sapiens
ctggctcccagctttcagggag

SEQ ID NO: 8558592 - DNA, 22 bp, Homo sapiens
ctggctcccatgagctctcacg

SEQ ID NO: 8558593 - DNA, 22 bp, Homo sapiens
atactaagctcattacattttg

SEQ ID NO: 8558594 - DNA, 22 bp, Homo sapiens
atactaaagtatagaacttagt

SEQ ID NO: 8558595 - DNA, 22 bp, Homo sapiens
atactaagctcattacattttg

SEQ ID NO: 8558596 - DNA, 22 bp, Homo sapiens
atactacattattagagcctgg

SEQ ID NO: 8558597 - DNA, 21 bp, Homo sapiens
atactacatttctctgacttt

SEQ ID NO: 8558598 - DNA, 22 bp, Homo sapiens
atactacacattgactatattt

SEQ ID NO: 8558599 - DNA, 22 bp, Homo sapiens
atactacacattgactatattt

SEQ ID NO: 8558600 - DNA, 22 bp, Homo sapiens
atactacactatgcatggatgt

SEQ ID NO: 8558601 - DNA, 22 bp, Homo sapiens
atactacatactatgtaaacat

SEQ ID NO: 8558602 - DNA, 22 bp, Homo sapiens
atagattgctagttttaaaatt

SEQ ID NO: 8558603 - DNA, 22 bp, Homo sapiens
atagattcattctatttctccg

SEQ ID NO: 8558604 - DNA, 22 bp, Homo sapiens
atagattatttgctcattactt

SEQ ID NO: 8558605 - DNA, 22 bp, Homo sapiens
atagattagccctatagtttta

SEQ ID NO: 8558606 - DNA, 22 bp, Homo sapiens
atagattagccctatagtttta

SEQ ID NO: 8558607 - DNA, 22 bp, Homo sapiens
atagatgtgtgtaagtacataa

SEQ ID NO: 8558608 - DNA, 22 bp, Homo sapiens
atagagatgggtttagttataa

SEQ ID NO: 8558609 - DNA, 22 bp, Homo sapiens
atactagactgttctgttatca

SEQ ID NO: 8558610 - DNA, 22 bp, Homo sapiens
ctggccccatctggagtctgag

SEQ ID NO: 8558611 - DNA, 22 bp, Homo sapiens
ctggcccccacacctgtcaggg

SEQ ID NO: 8558612 - DNA, 22 bp, Homo sapiens
ctggcccatggtgagctctggg

SEQ ID NO: 8558613 - DNA, 22 bp, Homo sapiens
atagcaaagatgtcaattcccc

SEQ ID NO: 8558614 - DNA, 22 bp, Homo sapiens
atagcaaaggacaatagtcagt

SEQ ID NO: 8558615 - DNA, 22 bp, Homo sapiens
atagcaaaggacaatagtcagt

SEQ ID NO: 8558616 - DNA, 22 bp, Homo sapiens
atagcaaaggacaatagtcagt

SEQ ID NO: 8558617 - DNA, 22 bp, Homo sapiens
atagcaaaggacaatagtcagt

SEQ ID NO: 8558618 - DNA, 22 bp, Homo sapiens
atagcaaaacccactgcattac

SEQ ID NO: 8558619 - DNA, 22 bp, Homo sapiens
atagcaaactggcagcttgtgg

SEQ ID NO: 8558620 - DNA, 22 bp, Homo sapiens
atagcaaaaggcaccagagtga

SEQ ID NO: 8558621 - DNA, 22 bp, Homo sapiens
atatgctattgctgtaatttaa

SEQ ID NO: 8558622 - DNA, 22 bp, Homo sapiens
atattaaaactatggttttcag

SEQ ID NO: 8558623 - DNA, 22 bp, Homo sapiens
atatgccattagctagaaataa

SEQ ID NO: 8558624 - DNA, 22 bp, Homo sapiens
atatgctatgtatgtaaatgag

SEQ ID NO: 8558625 - DNA, 22 bp, Homo sapiens
atatgctagtgtgcttatactt

SEQ ID NO: 8558626 - DNA, 22 bp, Homo sapiens
atatgcatgcatgcttgtgaga

SEQ ID NO: 8558627 - DNA, 22 bp, Homo sapiens
atattacataaacatgagtgaa

SEQ ID NO: 8558628 - DNA, 22 bp, Homo sapiens
atattacataaacatgagtgaa

SEQ ID NO: 8558629 - DNA, 22 bp, Homo sapiens
atattataagttatttcaagtt

SEQ ID NO: 8558630 - DNA, 22 bp, Homo sapiens
atattataagttatttcaagtt

SEQ ID NO: 8558631 - DNA, 22 bp, Homo sapiens
atattataagttatttcaagtt

SEQ ID NO: 8558632 - DNA, 22 bp, Homo sapiens
atattagtgtaggtagctaata

SEQ ID NO: 8558633 - DNA, 22 bp, Homo sapiens
atattagtgtaggtagctaata

SEQ ID NO: 8558634 - DNA, 22 bp, Homo sapiens
ctgggctgaaagtgttccttga

SEQ ID NO: 8558635 - DNA, 22 bp, Homo sapiens
ctgggctctgtgtttcagtttc

SEQ ID NO: 8558636 - DNA, 22 bp, Homo sapiens
ctgggctctgtgtttcagtttc

SEQ ID NO: 8558637 - DNA, 22 bp, Homo sapiens
ctgggctcttcccagatccaga

SEQ ID NO: 8558638 - DNA, 22 bp, Homo sapiens
ctgggctcttcccagatccaga

SEQ ID NO: 8558639 - DNA, 22 bp, Homo sapiens
ctgggctctgcggtgtcgctct

SEQ ID NO: 8558640 - DNA, 22 bp, Homo sapiens
atattatgctaagggaaataag

SEQ ID NO: 8558641 - DNA, 22 bp, Homo sapiens
atattataagttatttcaagtt

SEQ ID NO: 8558642 - DNA, 22 bp, Homo sapiens
atattatagacagagtcttctg

SEQ ID NO: 8558643 - DNA, 22 bp, Homo sapiens
atattatagacagagtcttctg

SEQ ID NO: 8558644 - DNA, 19 bp, Homo sapiens
ctgggctgaggtctgcctt

SEQ ID NO: 8558645 - DNA, 22 bp, Homo sapiens
atattcatcgtgtagaaatact

SEQ ID NO: 8558646 - DNA, 22 bp, Homo sapiens
atattcttcttgttcagactat

SEQ ID NO: 8558647 - DNA, 19 bp, Homo sapiens
ctgggctgaggtctgcctt

SEQ ID NO: 8558648 - DNA, 22 bp, Homo sapiens
ctgggctgagcctgggctgtgt

SEQ ID NO: 8558649 - DNA, 22 bp, Homo sapiens
ctgggctgagcctgggctgtgt

SEQ ID NO: 8558650 - DNA, 22 bp, Homo sapiens
ctgggctgagcctgggctgtgt

SEQ ID NO: 8558651 - DNA, 22 bp, Homo sapiens
atatgcagtctcttgcccttct

SEQ ID NO: 8558652 - DNA, 22 bp, Homo sapiens
atatgcatatgtcaaaacttat

SEQ ID NO: 8558653 - DNA, 22 bp, Homo sapiens
atatgcagagagcatgaatagg

SEQ ID NO: 8558654 - DNA, 22 bp, Homo sapiens
atatgcacatacatacataggt

SEQ ID NO: 8558655 - DNA, 22 bp, Homo sapiens
atatgcacatacatacataggt

SEQ ID NO: 8558656 - DNA, 22 bp, Homo sapiens
atatgcacactctgcccacaga

SEQ ID NO: 8558657 - DNA, 20 bp, Homo sapiens
ctgggctcaagtgatcctcc

SEQ ID NO: 8558658 - DNA, 20 bp, Homo sapiens
ctgggctcaagtgatcctcc

SEQ ID NO: 8558659 - DNA, 22 bp, Homo sapiens
ctgggctcagatgagaggaagg

SEQ ID NO: 8558660 - DNA, 22 bp, Homo sapiens
ctgggctcagatgagaggaagg

SEQ ID NO: 8558661 - DNA, 22 bp, Homo sapiens
ctgggctcagaaccttgttaag

SEQ ID NO: 8558662 - DNA, 20 bp, Homo sapiens
ctgggctcaagtgatcctcc

SEQ ID NO: 8558663 - DNA, 20 bp, Homo sapiens
ctgggctcaagtgatcctcc

SEQ ID NO: 8558664 - DNA, 22 bp, Homo sapiens
ctgggctcaagtgatccaccca

SEQ ID NO: 8558665 - DNA, 20 bp, Homo sapiens
ctgggctcaagtgagcctcc

SEQ ID NO: 8558666 - DNA, 22 bp, Homo sapiens
ctgggctcaagaagtcttccct

SEQ ID NO: 8558667 - DNA, 21 bp, Homo sapiens
ctgggctcaagcaatcctttc

SEQ ID NO: 8558668 - DNA, 21 bp, Homo sapiens
ctgggctcaagcaatcctttc

SEQ ID NO: 8558669 - DNA, 22 bp, Homo sapiens
ctgggctcaagaagtcttccct

SEQ ID NO: 8558670 - DNA, 22 bp, Homo sapiens
ctgggcctggggctgttgagag

SEQ ID NO: 8558671 - DNA, 22 bp, Homo sapiens
ctgggcctggtagggcttgaaa

SEQ ID NO: 8558672 - DNA, 22 bp, Homo sapiens
ctggctgtgtcttggaggagct

SEQ ID NO: 8558673 - DNA, 22 bp, Homo sapiens
ctggctgtgtgcccccggcacc

SEQ ID NO: 8558674 - DNA, 22 bp, Homo sapiens
ctggctgtgtcttggaggagct

SEQ ID NO: 8558675 - DNA, 22 bp, Homo sapiens
ctggctgtttcaggcagtgtcc

SEQ ID NO: 8558676 - DNA, 22 bp, Homo sapiens
ctggctgtttcaggcagtgtcc

SEQ ID NO: 8558677 - DNA, 22 bp, Homo sapiens
ctggctgtgtgtcttcattcag

SEQ ID NO: 8558678 - DNA, 22 bp, Homo sapiens
ctggctgtttcaaatgtataga

SEQ ID NO: 8558679 - DNA, 19 bp, Homo sapiens
ctggcttcaagcagtcctc

SEQ ID NO: 8558680 - DNA, 22 bp, Homo sapiens
ctggcttcagctgccatcaatg

SEQ ID NO: 8558681 - DNA, 22 bp, Homo sapiens
ctggctgtttctcctttgtcta

SEQ ID NO: 8558682 - DNA, 22 bp, Homo sapiens
ctggctgttttcaatgttgatg

SEQ ID NO: 8558683 - DNA, 19 bp, Homo sapiens
ctggcttcaagcagtcctc

SEQ ID NO: 8558684 - DNA, 22 bp, Homo sapiens
ctggcttccaccatggcccctg

SEQ ID NO: 8558685 - DNA, 22 bp, Homo sapiens
ctggcttccatgctgtagtggc

SEQ ID NO: 8558686 - DNA, 22 bp, Homo sapiens
ctggcttccatgctgtagtggc

SEQ ID NO: 8558687 - DNA, 22 bp, Homo sapiens
ctggcttccatgctgtagtggc

SEQ ID NO: 8558688 - DNA, 22 bp, Homo sapiens
ctggcttccatgctgtagtggc

SEQ ID NO: 8558689 - DNA, 22 bp, Homo sapiens
ctggcttcctcaggagcagtgg

SEQ ID NO: 8558690 - DNA, 22 bp, Homo sapiens
ctggcttccctgtcttatggaa

SEQ ID NO: 8558691 - DNA, 22 bp, Homo sapiens
ctggcttccctgtcttatggaa

SEQ ID NO: 8558692 - DNA, 22 bp, Homo sapiens
ctggctgggagcgagctgctca

SEQ ID NO: 8558693 - DNA, 22 bp, Homo sapiens
ctggctgggagcgagctgctca

SEQ ID NO: 8558694 - DNA, 22 bp, Homo sapiens
ctggctgtggtcacaggtaact

SEQ ID NO: 8558695 - DNA, 22 bp, Homo sapiens
ctggctgtgtccacagagtaag

SEQ ID NO: 8558696 - DNA, 22 bp, Homo sapiens
ctggctgtggattatcacaggc

SEQ ID NO: 8558697 - DNA, 22 bp, Homo sapiens
ctggctggccggaggcatccct

SEQ ID NO: 8558698 - DNA, 22 bp, Homo sapiens
ctggctggccggaggcatccct

SEQ ID NO: 8558699 - DNA, 22 bp, Homo sapiens
ctggctggccggagcgaggcgg

SEQ ID NO: 8558700 - DNA, 22 bp, Homo sapiens
atattgaaccctacagactgta

SEQ ID NO: 8558701 - DNA, 22 bp, Homo sapiens
atattgatcttggaactgattt

SEQ ID NO: 8558702 - DNA, 22 bp, Homo sapiens
atattgaaccctacagactgta

SEQ ID NO: 8558703 - DNA, 22 bp, Homo sapiens
atattcttgtgattataaagta

SEQ ID NO: 8558704 - DNA, 22 bp, Homo sapiens
atattcttgtgattataaagta

SEQ ID NO: 8558705 - DNA, 22 bp, Homo sapiens
atattcttgtgattataaagta

SEQ ID NO: 8558706 - DNA, 22 bp, Homo sapiens
atattcttgtgattataaagta

SEQ ID NO: 8558707 - DNA, 22 bp, Homo sapiens
atattcttgtgattataaagta

SEQ ID NO: 8558708 - DNA, 21 bp, Homo sapiens
atattgtaggtaaagtgcagg

SEQ ID NO: 8558709 - DNA, 22 bp, Homo sapiens
atattgtactagggttacatgt

SEQ ID NO: 8558710 - DNA, 22 bp, Homo sapiens
atattgtactagggttacatgt

SEQ ID NO: 8558711 - DNA, 22 bp, Homo sapiens
atattgtactagggttacatgt

SEQ ID NO: 8558712 - DNA, 22 bp, Homo sapiens
atattgttgactataagagtaa

SEQ ID NO: 8558713 - DNA, 22 bp, Homo sapiens
atattgtgtgtacaagtagtta

SEQ ID NO: 8558714 - DNA, 22 bp, Homo sapiens
atattgttagtaatatttcgaa

SEQ ID NO: 8558715 - DNA, 22 bp, Homo sapiens
atattgtgtgtacaagtagtta

SEQ ID NO: 8558716 - DNA, 21 bp, Homo sapiens
atattgtaggtaaagtgcagg

SEQ ID NO: 8558717 - DNA, 22 bp, Homo sapiens
atatttaaacagggtaccaata

SEQ ID NO: 8558718 - DNA, 22 bp, Homo sapiens
atatttaaacagggtaccaata

SEQ ID NO: 8558719 - DNA, 22 bp, Homo sapiens
atattgttgactataagagtaa

SEQ ID NO: 8558720 - DNA, 22 bp, Homo sapiens
atatttaaacagggtaccaata

SEQ ID NO: 8558721 - DNA, 20 bp, Homo sapiens
atcaaaggctgattcagtcc

SEQ ID NO: 8558722 - DNA, 20 bp, Homo sapiens
atcaaaggctgattcagtcc

SEQ ID NO: 8558723 - DNA, 23 bp, Homo sapiens
atcaaaggatgtagagaagaagc

SEQ ID NO: 8558724 - DNA, 23 bp, Homo sapiens
atcaaaggatgtagagaagaagc

SEQ ID NO: 8558725 - DNA, 22 bp, Homo sapiens
atcaaagagcttgacaatccta

SEQ ID NO: 8558726 - DNA, 22 bp, Homo sapiens
atcaaagtaattaacactgaga

SEQ ID NO: 8558727 - DNA, 22 bp, Homo sapiens
atcaaaggtatctatgctgtct

SEQ ID NO: 8558728 - DNA, 22 bp, Homo sapiens
atcaaagtaggcatatgttttt

SEQ ID NO: 8558729 - DNA, 22 bp, Homo sapiens
atcaaagtatctcaatatggta

SEQ ID NO: 8558730 - DNA, 22 bp, Homo sapiens
atcaaagtccatcagaaggtag

SEQ ID NO: 8558731 - DNA, 22 bp, Homo sapiens
atcaaagtccatcagaaggtag

SEQ ID NO: 8558732 - DNA, 22 bp, Homo sapiens
atcaaagtggaagtttactagg

SEQ ID NO: 8558733 - DNA, 22 bp, Homo sapiens
atcaaagttcgtaactgataac

SEQ ID NO: 8558734 - DNA, 23 bp, Homo sapiens
atcaaagtggaaatcaattatct

SEQ ID NO: 8558735 - DNA, 22 bp, Homo sapiens
atatttaactggtcccaatata

SEQ ID NO: 8558736 - DNA, 22 bp, Homo sapiens
atatttaactggtcccaatata

SEQ ID NO: 8558737 - DNA, 22 bp, Homo sapiens
atatttaactggtcccaatata

SEQ ID NO: 8558738 - DNA, 22 bp, Homo sapiens
atatttaactggtcccaatata

SEQ ID NO: 8558739 - DNA, 22 bp, Homo sapiens
atattttggcaaatgtctagat

SEQ ID NO: 8558740 - DNA, 22 bp, Homo sapiens
atattttggcaaatgtctagat

SEQ ID NO: 8558741 - DNA, 22 bp, Homo sapiens
atatttactgctgtggtgaagg

SEQ ID NO: 8558742 - DNA, 23 bp, Homo sapiens
atcaaactggtgagaatgtcagt

SEQ ID NO: 8558743 - DNA, 23 bp, Homo sapiens
atcaaactggtgagaatgtcagt

SEQ ID NO: 8558744 - DNA, 22 bp, Homo sapiens
atcaaagaatgtgactgaaata

SEQ ID NO: 8558745 - DNA, 22 bp, Homo sapiens
atattttggggtgatgtgcatc

SEQ ID NO: 8558746 - DNA, 22 bp, Homo sapiens
atcagaaaaacataatgttatt

SEQ ID NO: 8558747 - DNA, 22 bp, Homo sapiens
atcagaaaaatgagaagagctg

SEQ ID NO: 8558748 - DNA, 22 bp, Homo sapiens
atcagaaaaatgagaagagctg

SEQ ID NO: 8558749 - DNA, 21 bp, Homo sapiens
atcagaaaatgtaatggagca

SEQ ID NO: 8558750 - DNA, 22 bp, Homo sapiens
atcagaaaatacccagtgttta

SEQ ID NO: 8558751 - DNA, 21 bp, Homo sapiens
atcagaaaatgtaatggagca

SEQ ID NO: 8558752 - DNA, 21 bp, Homo sapiens
atcagaaaatgtaatggagca

SEQ ID NO: 8558753 - DNA, 22 bp, Homo sapiens
atcagaaactcttagagcaggg

SEQ ID NO: 8558754 - DNA, 22 bp, Homo sapiens
atcagaaactcttagagcaggg

SEQ ID NO: 8558755 - DNA, 22 bp, Homo sapiens
atcagaaatagtcatgttactt

SEQ ID NO: 8558756 - DNA, 22 bp, Homo sapiens
atcagaaatagtcatgttactt

SEQ ID NO: 8558757 - DNA, 22 bp, Homo sapiens
atcagaaatagtcatgttactt

SEQ ID NO: 8558758 - DNA, 22 bp, Homo sapiens
atcagaaatctaggattcagaa

SEQ ID NO: 8558759 - DNA, 22 bp, Homo sapiens
atcagaaagttcatcatgtttg

SEQ ID NO: 8558760 - DNA, 22 bp, Homo sapiens
atcagaaaggtgggcaagcaga

SEQ ID NO: 8558761 - DNA, 22 bp, Homo sapiens
atcagaaaggtgggcaagcaga

SEQ ID NO: 8558762 - DNA, 22 bp, Homo sapiens
atcagaaaggtgggcaagcaga

SEQ ID NO: 8558763 - DNA, 21 bp, Homo sapiens
atcagaatctctagatttgga

SEQ ID NO: 8558764 - DNA, 22 bp, Homo sapiens
atcagaataattagatttcaga

SEQ ID NO: 8558765 - DNA, 22 bp, Homo sapiens
atcagaagttgtgcatgcatgg

SEQ ID NO: 8558766 - DNA, 22 bp, Homo sapiens
atcagaagtgatgtgtgttatt

SEQ ID NO: 8558767 - DNA, 22 bp, Homo sapiens
atcagaagtgatgtgtgttatt

SEQ ID NO: 8558768 - DNA, 20 bp, Homo sapiens
atcagaagtgatattaacca

SEQ ID NO: 8558769 - DNA, 22 bp, Homo sapiens
atcagaaattgcccagctgttt

SEQ ID NO: 8558770 - DNA, 22 bp, Homo sapiens
atcagaaattgctaccagtgga

SEQ ID NO: 8558771 - DNA, 22 bp, Homo sapiens
atcagaacaaaagaacagttta

SEQ ID NO: 8558772 - DNA, 22 bp, Homo sapiens
atcagaagcaggaggaatgaag

SEQ ID NO: 8558773 - DNA, 22 bp, Homo sapiens
atcagaagaaatggatgtgact

SEQ ID NO: 8558774 - DNA, 22 bp, Homo sapiens
atcagaaggggaggtaaagaag

SEQ ID NO: 8558775 - DNA, 22 bp, Homo sapiens
atcacattgccagtgattaccc

SEQ ID NO: 8558776 - DNA, 22 bp, Homo sapiens
atcacattatgtagtgaaaagg

SEQ ID NO: 8558777 - DNA, 22 bp, Homo sapiens
atcacattctttcaaagcagtc

SEQ ID NO: 8558778 - DNA, 22 bp, Homo sapiens
atcacattctttcaaagcagtc

SEQ ID NO: 8558779 - DNA, 22 bp, Homo sapiens
atcactttggtaccaattcagc

SEQ ID NO: 8558780 - DNA, 22 bp, Homo sapiens
atcactttggtaccaattcagc

SEQ ID NO: 8558781 - DNA, 22 bp, Homo sapiens
atcagaaaaacataatgttatt

SEQ ID NO: 8558782 - DNA, 22 bp, Homo sapiens
atcagaaaaacataatgttatt

SEQ ID NO: 8558783 - DNA, 22 bp, Homo sapiens
atcaacatgaatttctctgaag

SEQ ID NO: 8558784 - DNA, 22 bp, Homo sapiens
atcaacatgtcataaagtgaaa

SEQ ID NO: 8558785 - DNA, 22 bp, Homo sapiens
atcaaagtttcccagaagttgt

SEQ ID NO: 8558786 - DNA, 22 bp, Homo sapiens
atcaaagtttcccagaagttgt

SEQ ID NO: 8558787 - DNA, 22 bp, Homo sapiens
atcaaagttcgtaactgataac

SEQ ID NO: 8558788 - DNA, 22 bp, Homo sapiens
atcaaatacaaagggcataagg

SEQ ID NO: 8558789 - DNA, 22 bp, Homo sapiens
atcaaatcattgcattaatgtt

SEQ ID NO: 8558790 - DNA, 22 bp, Homo sapiens
atcaaattatgtgctacaagaa

SEQ ID NO: 8558791 - DNA, 22 bp, Homo sapiens
atcaacaggtatggatgagatt

SEQ ID NO: 8558792 - DNA, 22 bp, Homo sapiens
atcaacaggtatggatgagatt

SEQ ID NO: 8558793 - DNA, 22 bp, Homo sapiens
cttagatgaagtcacagaaccc

SEQ ID NO: 8558794 - DNA, 22 bp, Homo sapiens
cttcattaaccaaaatgcaata

SEQ ID NO: 8558795 - DNA, 22 bp, Homo sapiens
cttcattaactattggaatgca

SEQ ID NO: 8558796 - DNA, 22 bp, Homo sapiens
cttagagatgggttttacttag

SEQ ID NO: 8558797 - DNA, 22 bp, Homo sapiens
cttagagatgggttttacttag

SEQ ID NO: 8558798 - DNA, 22 bp, Homo sapiens
cttagaaattgttactcattca

SEQ ID NO: 8558799 - DNA, 22 bp, Homo sapiens
cttagaaattgttactcattca

SEQ ID NO: 8558800 - DNA, 22 bp, Homo sapiens
cttagaaattgttactcattca

SEQ ID NO: 8558801 - DNA, 22 bp, Homo sapiens
cttagaaattgttactcattca

SEQ ID NO: 8558802 - DNA, 20 bp, Homo sapiens
cttagaaatttttaccctgg

SEQ ID NO: 8558803 - DNA, 22 bp, Homo sapiens
atcctgtggctccagggagccg

SEQ ID NO: 8558804 - DNA, 20 bp, Homo sapiens
atccttaaagagaatttcta

SEQ ID NO: 8558805 - DNA, 23 bp, Homo sapiens
atcctgttgtaggcagtaattag

SEQ ID NO: 8558806 - DNA, 22 bp, Homo sapiens
atcctgttagcaccttcaaact

SEQ ID NO: 8558807 - DNA, 22 bp, Homo sapiens
atccttaaaggaattctgattt

SEQ ID NO: 8558808 - DNA, 22 bp, Homo sapiens
atcctgtttgtcactagaaaat

SEQ ID NO: 8558809 - DNA, 22 bp, Homo sapiens
atcctgttttagataagcttat

SEQ ID NO: 8558810 - DNA, 22 bp, Homo sapiens
atccttaagaaagttttctata

SEQ ID NO: 8558811 - DNA, 22 bp, Homo sapiens
cttcctaaaagcttcaagagaa

SEQ ID NO: 8558812 - DNA, 22 bp, Homo sapiens
cttcccactagtatcacagagc

SEQ ID NO: 8558813 - DNA, 22 bp, Homo sapiens
cttcccactagtatcacagagc

SEQ ID NO: 8558814 - DNA, 22 bp, Homo sapiens
cttcccactagtatcacagagc

SEQ ID NO: 8558815 - DNA, 22 bp, Homo sapiens
cttcccactagtatcacagagc

SEQ ID NO: 8558816 - DNA, 22 bp, Homo sapiens
cttcctcaggcattagctggac

SEQ ID NO: 8558817 - DNA, 22 bp, Homo sapiens
cttcctcacggtgcaacaggaa

SEQ ID NO: 8558818 - DNA, 22 bp, Homo sapiens
cttcctcacggtgcaacaggaa

SEQ ID NO: 8558819 - DNA, 22 bp, Homo sapiens
cttcctagtgtctactttggag

SEQ ID NO: 8558820 - DNA, 22 bp, Homo sapiens
cttcctagcttcagagtctgtt

SEQ ID NO: 8558821 - DNA, 18 bp, Homo sapiens
cttcctcatcgctctccc

SEQ ID NO: 8558822 - DNA, 18 bp, Homo sapiens
cttcctcatcgctctccc

SEQ ID NO: 8558823 - DNA, 18 bp, Homo sapiens
cttcctcatcgctctccc

SEQ ID NO: 8558824 - DNA, 22 bp, Homo sapiens
cttcctcatgtgcaatgcaagc

SEQ ID NO: 8558825 - DNA, 22 bp, Homo sapiens
cttcctcccccacacactcact

SEQ ID NO: 8558826 - DNA, 22 bp, Homo sapiens
cttcctcccccacacactcact

SEQ ID NO: 8558827 - DNA, 22 bp, Homo sapiens
cttcctcccggcccatgctctg

SEQ ID NO: 8558828 - DNA, 22 bp, Homo sapiens
cttcctcccggcccatgctctg

SEQ ID NO: 8558829 - DNA, 22 bp, Homo sapiens
cttcctcccggcccatgctctg

SEQ ID NO: 8558830 - DNA, 22 bp, Homo sapiens
cttcctcccggcccatgctctg

SEQ ID NO: 8558831 - DNA, 22 bp, Homo sapiens
cttcctcccggcccatgctctg

SEQ ID NO: 8558832 - DNA, 22 bp, Homo sapiens
cttccaggtgctggcctggcct

SEQ ID NO: 8558833 - DNA, 22 bp, Homo sapiens
cttccagtcttttcagtggagt

SEQ ID NO: 8558834 - DNA, 22 bp, Homo sapiens
cttccagtgcataggtagatca

SEQ ID NO: 8558835 - DNA, 22 bp, Homo sapiens
cttcccaagactgtattgcaag

SEQ ID NO: 8558836 - DNA, 22 bp, Homo sapiens
cttcccacagaattcaatcagt

SEQ ID NO: 8558837 - DNA, 22 bp, Homo sapiens
cttcccacagaattcaatcagt

SEQ ID NO: 8558838 - DNA, 22 bp, Homo sapiens
cttcccacagaattcaatcagt

SEQ ID NO: 8558839 - DNA, 22 bp, Homo sapiens
cttcccactaaagcccttgttg

SEQ ID NO: 8558840 - DNA, 17 bp, Homo sapiens
cttcccaccatctcctg

SEQ ID NO: 8558841 - DNA, 22 bp, Homo sapiens
cttcccaccaaagcccttgttg

SEQ ID NO: 8558842 - DNA, 22 bp, Homo sapiens
atctgacaaggccacatattct

SEQ ID NO: 8558843 - DNA, 22 bp, Homo sapiens
atctgacaaggccacatattct

SEQ ID NO: 8558844 - DNA, 22 bp, Homo sapiens
atctgacatctactagaacaga

SEQ ID NO: 8558845 - DNA, 22 bp, Homo sapiens
atctgacaagttgtgtgtatag

SEQ ID NO: 8558846 - DNA, 22 bp, Homo sapiens
atctgacaagttgtgtgtatag

SEQ ID NO: 8558847 - DNA, 22 bp, Homo sapiens
atctgacaagttgtgtgtatag

SEQ ID NO: 8558848 - DNA, 22 bp, Homo sapiens
atctgagtctctgacagcatgt

SEQ ID NO: 8558849 - DNA, 22 bp, Homo sapiens
atctgagtcaaatatttcattt

SEQ ID NO: 8558850 - DNA, 22 bp, Homo sapiens
atctgagtgttggatttattgt

SEQ ID NO: 8558851 - DNA, 22 bp, Homo sapiens
atctgagtgttggatttattgt

SEQ ID NO: 8558852 - DNA, 22 bp, Homo sapiens
atctgagtcaaatatttcattt

SEQ ID NO: 8558853 - DNA, 22 bp, Homo sapiens
atctgagggtttgggcatcagc

SEQ ID NO: 8558854 - DNA, 22 bp, Homo sapiens
cttcttggttggtttcattcca

SEQ ID NO: 8558855 - DNA, 22 bp, Homo sapiens
cttcttggtgatggcttacctg

SEQ ID NO: 8558856 - DNA, 22 bp, Homo sapiens
cttcttggtgatggcttacctg

SEQ ID NO: 8558857 - DNA, 21 bp, Homo sapiens
cttcttggggagcagctagac

SEQ ID NO: 8558858 - DNA, 21 bp, Homo sapiens
cttcttggggagcagctagac

SEQ ID NO: 8558859 - DNA, 22 bp, Homo sapiens
cttcttggactactcactagag

SEQ ID NO: 8558860 - DNA, 22 bp, Homo sapiens
cttcttggaagtcgtccttcca

SEQ ID NO: 8558861 - DNA, 22 bp, Homo sapiens
cttcttggaagtcgtccttcca

SEQ ID NO: 8558862 - DNA, 22 bp, Homo sapiens
cttcttggctgcaagtctctgt

SEQ ID NO: 8558863 - DNA, 22 bp, Homo sapiens
cttcttgggctgccagtttcag

SEQ ID NO: 8558864 - DNA, 22 bp, Homo sapiens
cttcttggctgcaagtctctgt

SEQ ID NO: 8558865 - DNA, 22 bp, Homo sapiens
cttcttaatgacagattaaaat

SEQ ID NO: 8558866 - DNA, 22 bp, Homo sapiens
cttcttaatgcataaactgtgt

SEQ ID NO: 8558867 - DNA, 22 bp, Homo sapiens
cttcttaatgcataaactgtgt

SEQ ID NO: 8558868 - DNA, 22 bp, Homo sapiens
atctgcatcagactttgcatga

SEQ ID NO: 8558869 - DNA, 22 bp, Homo sapiens
atctgcagtttgttttctcttg

SEQ ID NO: 8558870 - DNA, 22 bp, Homo sapiens
cttcttgcaattttcatcttat

SEQ ID NO: 8558871 - DNA, 22 bp, Homo sapiens
cttcttgctgggggcctcagtg

SEQ ID NO: 8558872 - DNA, 22 bp, Homo sapiens
cttcttggaagtcgtccttcca

SEQ ID NO: 8558873 - DNA, 22 bp, Homo sapiens
cttcttattaatccttctctgt

SEQ ID NO: 8558874 - DNA, 22 bp, Homo sapiens
cttcctcctccatctcgaaggc

SEQ ID NO: 8558875 - DNA, 22 bp, Homo sapiens
atctctgatttacagcatctct

SEQ ID NO: 8558876 - DNA, 22 bp, Homo sapiens
cttcctctagcctagtaatgcc

SEQ ID NO: 8558877 - DNA, 22 bp, Homo sapiens
cttcctctagcctagtaatgcc

SEQ ID NO: 8558878 - DNA, 22 bp, Homo sapiens
cttcctctagcctagtaatgcc

SEQ ID NO: 8558879 - DNA, 22 bp, Homo sapiens
atctgaaaaatctcctttgtca

SEQ ID NO: 8558880 - DNA, 22 bp, Homo sapiens
atctgaaaaatctcctttgtca

SEQ ID NO: 8558881 - DNA, 23 bp, Homo sapiens
atctgaaaagcatttgcagtttg

SEQ ID NO: 8558882 - DNA, 23 bp, Homo sapiens
atctgaaaagcatttgcagtttg

SEQ ID NO: 8558883 - DNA, 22 bp, Homo sapiens
atctgaaaagctttaatgagct

SEQ ID NO: 8558884 - DNA, 22 bp, Homo sapiens
atctgaaaagctttaatgagct

SEQ ID NO: 8558885 - DNA, 22 bp, Homo sapiens
atctgaaaagcctcttactcct

SEQ ID NO: 8558886 - DNA, 22 bp, Homo sapiens
atctgaaactctgacattgtct

SEQ ID NO: 8558887 - DNA, 22 bp, Homo sapiens
atctgaaactctgacattgtct

SEQ ID NO: 8558888 - DNA, 22 bp, Homo sapiens
atctgaaactctgacattgtct

SEQ ID NO: 8558889 - DNA, 22 bp, Homo sapiens
atctgaaactctgacattgtct

SEQ ID NO: 8558890 - DNA, 22 bp, Homo sapiens
atctgaaaagctttaatgagct

SEQ ID NO: 8558891 - DNA, 23 bp, Homo sapiens
atctgaaaaggcattttcttccc

SEQ ID NO: 8558892 - DNA, 21 bp, Homo sapiens
atctgaaatgtcaaagcagat

SEQ ID NO: 8558893 - DNA, 21 bp, Homo sapiens
atctgaaatgtcaaagcagat

SEQ ID NO: 8558894 - DNA, 21 bp, Homo sapiens
atctgaaatgtcaaagcagat

SEQ ID NO: 8558895 - DNA, 22 bp, Homo sapiens
atctgaaatagtcttatctgag

SEQ ID NO: 8558896 - DNA, 21 bp, Homo sapiens
atctgaaaggttagtgttgag

SEQ ID NO: 8558897 - DNA, 22 bp, Homo sapiens
atctgaaagctaggagttctca

SEQ ID NO: 8558898 - DNA, 22 bp, Homo sapiens
atctgaaagctaggagttctca

SEQ ID NO: 8558899 - DNA, 21 bp, Homo sapiens
atctgaaaggttagtgttgag

SEQ ID NO: 8558900 - DNA, 22 bp, Homo sapiens
atctgaaatagtcttatctgag

SEQ ID NO: 8558901 - DNA, 22 bp, Homo sapiens
atctgaaagtttagaattcttg

SEQ ID NO: 8558902 - DNA, 21 bp, Homo sapiens
atctgaagtttgagaggaaag

SEQ ID NO: 8558903 - DNA, 22 bp, Homo sapiens
atctgaagaggtcatggctgac

SEQ ID NO: 8558904 - DNA, 22 bp, Homo sapiens
atccactccctaacaccatgtt

SEQ ID NO: 8558905 - DNA, 22 bp, Homo sapiens
atccactcctggaggtgcccca

SEQ ID NO: 8558906 - DNA, 22 bp, Homo sapiens
atccaccctgtggtggctttct

SEQ ID NO: 8558907 - DNA, 22 bp, Homo sapiens
atccactcggagggaatgttta

SEQ ID NO: 8558908 - DNA, 22 bp, Homo sapiens
atccaggcgaatgcagaaggcc

SEQ ID NO: 8558909 - DNA, 22 bp, Homo sapiens
atccaggcgaatgcagaaggcc

SEQ ID NO: 8558910 - DNA, 22 bp, Homo sapiens
atccaggctgggtgtggctact

SEQ ID NO: 8558911 - DNA, 22 bp, Homo sapiens
atccaggctgctatgaggatga

SEQ ID NO: 8558912 - DNA, 22 bp, Homo sapiens
atccaggctgcgggtctcaagt

SEQ ID NO: 8558913 - DNA, 22 bp, Homo sapiens
atccaggctgtctaatgggaga

SEQ ID NO: 8558914 - DNA, 22 bp, Homo sapiens
atccaggcttaatgggagccac

SEQ ID NO: 8558915 - DNA, 22 bp, Homo sapiens
atccagggataaaagtaaggtt

SEQ ID NO: 8558916 - DNA, 22 bp, Homo sapiens
atccagtgagtgcagctgttgt

SEQ ID NO: 8558917 - DNA, 22 bp, Homo sapiens
atccagtcaaaattagtaaggt

SEQ ID NO: 8558918 - DNA, 22 bp, Homo sapiens
atccagggtgtggagagagctc

SEQ ID NO: 8558919 - DNA, 22 bp, Homo sapiens
atccagggataaaagtaaggtt

SEQ ID NO: 8558920 - DNA, 22 bp, Homo sapiens
atccagtatgaggtagggcttg

SEQ ID NO: 8558921 - DNA, 19 bp, Homo sapiens
atccaggtcatgtagttct

SEQ ID NO: 8558922 - DNA, 22 bp, Homo sapiens
ctgtgtgcaacttgcagttttg

SEQ ID NO: 8558923 - DNA, 22 bp, Homo sapiens
atccatataggcagatggcaca

SEQ ID NO: 8558924 - DNA, 22 bp, Homo sapiens
ctgtgtgcaacttgcagttttg

SEQ ID NO: 8558925 - DNA, 22 bp, Homo sapiens
ctgtgtgcagggcacaatggaa

SEQ ID NO: 8558926 - DNA, 22 bp, Homo sapiens
atccagttctcagtgcttacag

SEQ ID NO: 8558927 - DNA, 22 bp, Homo sapiens
atccagtttatgtcatattctt

SEQ ID NO: 8558928 - DNA, 22 bp, Homo sapiens
ctgtgtgcaggtgctgggtacc

SEQ ID NO: 8558929 - DNA, 22 bp, Homo sapiens
ctgtgtgcaggtgctgggtacc

SEQ ID NO: 8558930 - DNA, 22 bp, Homo sapiens
ctgtgtgcatagttgtgctcaa

SEQ ID NO: 8558931 - DNA, 22 bp, Homo sapiens
ctgtgtgcatagttgtgctcaa

SEQ ID NO: 8558932 - DNA, 22 bp, Homo sapiens
ctgtgtgcctagagggtggccg

SEQ ID NO: 8558933 - DNA, 22 bp, Homo sapiens
atcctgggcaagtcaatgtccc

SEQ ID NO: 8558934 - DNA, 22 bp, Homo sapiens
atcctgggcagtgtgtcactct

SEQ ID NO: 8558935 - DNA, 22 bp, Homo sapiens
atcctgggcaaagtatgctgtc

SEQ ID NO: 8558936 - DNA, 22 bp, Homo sapiens
atcctgaaaacttacgaagtgg

SEQ ID NO: 8558937 - DNA, 22 bp, Homo sapiens
atcctgaaaacttacgaagtgg

SEQ ID NO: 8558938 - DNA, 18 bp, Homo sapiens
atcctgggccagtctttc

SEQ ID NO: 8558939 - DNA, 19 bp, Homo sapiens
atcctgggtcctccagctg

SEQ ID NO: 8558940 - DNA, 22 bp, Homo sapiens
atcctgtctttgttttaaatat

SEQ ID NO: 8558941 - DNA, 22 bp, Homo sapiens
atcctgtctctacccatcggct

SEQ ID NO: 8558942 - DNA, 22 bp, Homo sapiens
atcctgtctatgagtagataat

SEQ ID NO: 8558943 - DNA, 22 bp, Homo sapiens
ctgtgtgtcctcggacgagttt

SEQ ID NO: 8558944 - DNA, 22 bp, Homo sapiens
ctgtgtgtcatttgtcaatcct

SEQ ID NO: 8558945 - DNA, 22 bp, Homo sapiens
ctgtgtgtcatttgtcaatcct

SEQ ID NO: 8558946 - DNA, 22 bp, Homo sapiens
ctgtgtggcctcaagccagcct

SEQ ID NO: 8558947 - DNA, 22 bp, Homo sapiens
ctgtgtgtcatttgtcaatcct

SEQ ID NO: 8558948 - DNA, 22 bp, Homo sapiens
ctgtgtgtcctcggacgagttt

SEQ ID NO: 8558949 - DNA, 22 bp, Homo sapiens
atcctgaaaacttacgaagtgg

SEQ ID NO: 8558950 - DNA, 22 bp, Homo sapiens
ctgtgtgcctcctgtgatcagg

SEQ ID NO: 8558951 - DNA, 22 bp, Homo sapiens
ctgtgtgctcggatggactcgt

SEQ ID NO: 8558952 - DNA, 22 bp, Homo sapiens
ctgtgtgcctcctgtgatcagg

SEQ ID NO: 8558953 - DNA, 22 bp, Homo sapiens
ctgtgtgctgaaatgcagtgag

SEQ ID NO: 8558954 - DNA, 22 bp, Homo sapiens
ctgtgtgctcggatggactcgt

SEQ ID NO: 8558955 - DNA, 22 bp, Homo sapiens
ctgtgtgctgaaatgcagtgag

SEQ ID NO: 8558956 - DNA, 22 bp, Homo sapiens
ctgtgtgctgaaatgcagtgag

SEQ ID NO: 8558957 - DNA, 22 bp, Homo sapiens
ctgtgtgctgttagggagctgc

SEQ ID NO: 8558958 - DNA, 22 bp, Homo sapiens
ctgtgtggactggttgaggccc

SEQ ID NO: 8558959 - DNA, 22 bp, Homo sapiens
ctgtgtggcctcaagccagcct

SEQ ID NO: 8558960 - DNA, 22 bp, Homo sapiens
ctgtgtggactggttgaggccc

SEQ ID NO: 8558961 - DNA, 19 bp, Homo sapiens
ctgtggcctccaggaggga

SEQ ID NO: 8558962 - DNA, 23 bp, Homo sapiens
ctgtggccctgcttcatgcagcc

SEQ ID NO: 8558963 - DNA, 22 bp, Homo sapiens
ctgtggagttccatcaggggag

SEQ ID NO: 8558964 - DNA, 21 bp, Homo sapiens
ctgtggcctggctagcaccgt

SEQ ID NO: 8558965 - DNA, 22 bp, Homo sapiens
ctgtggccttggaccagcatct

SEQ ID NO: 8558966 - DNA, 15 bp, Homo sapiens
ctgtggctaacctaa

SEQ ID NO: 8558967 - DNA, 22 bp, Homo sapiens
ctgtggctaataattagtattt

SEQ ID NO: 8558968 - DNA, 22 bp, Homo sapiens
ctgtggagtgtagatgctgggt

SEQ ID NO: 8558969 - DNA, 22 bp, Homo sapiens
atcagactctgcattgcagtct

SEQ ID NO: 8558970 - DNA, 22 bp, Homo sapiens
atcagagaccggtcaagtcatg

SEQ ID NO: 8558971 - DNA, 22 bp, Homo sapiens
atcagagacaaaaccagcactt

SEQ ID NO: 8558972 - DNA, 22 bp, Homo sapiens
atcagagaagtttcactggcat

SEQ ID NO: 8558973 - DNA, 20 bp, Homo sapiens
atcagacttgcatttcagga

SEQ ID NO: 8558974 - DNA, 22 bp, Homo sapiens
atcagaccatccagcgtggatg

SEQ ID NO: 8558975 - DNA, 22 bp, Homo sapiens
atcagacctgtctcctcttgcc

SEQ ID NO: 8558976 - DNA, 22 bp, Homo sapiens
atcagactcagaaatgacgtgg

SEQ ID NO: 8558977 - DNA, 22 bp, Homo sapiens
atcagacaattgttgagtactg

SEQ ID NO: 8558978 - DNA, 22 bp, Homo sapiens
atcagaatggagcccacatggt

SEQ ID NO: 8558979 - DNA, 22 bp, Homo sapiens
ctgtgggaacactgaggacttc

SEQ ID NO: 8558980 - DNA, 18 bp, Homo sapiens
ctgtgggaagagtttggg

SEQ ID NO: 8558981 - DNA, 22 bp, Homo sapiens
ctgtgggaatactgcgagtgta

SEQ ID NO: 8558982 - DNA, 21 bp, Homo sapiens
ctgtgggaccaagcactggga

SEQ ID NO: 8558983 - DNA, 22 bp, Homo sapiens
ctgtgggaatactgcgagtgta

SEQ ID NO: 8558984 - DNA, 21 bp, Homo sapiens
ctgtgggaccaagcactggga

SEQ ID NO: 8558985 - DNA, 22 bp, Homo sapiens
ctgtggctcaaaatcccatgat

SEQ ID NO: 8558986 - DNA, 22 bp, Homo sapiens
ctgtggctcaaaatcccatgat

SEQ ID NO: 8558987 - DNA, 22 bp, Homo sapiens
ctgtggctcaaaatcccatgat

SEQ ID NO: 8558988 - DNA, 22 bp, Homo sapiens
ctgtggctcaattgcctactga

SEQ ID NO: 8558989 - DNA, 22 bp, Homo sapiens
ctgtggctatggtgtacatact

SEQ ID NO: 8558990 - DNA, 22 bp, Homo sapiens
ctgtggctatggtgtacatact

SEQ ID NO: 8558991 - DNA, 22 bp, Homo sapiens
ctgtggctaggattattcctga

SEQ ID NO: 8558992 - DNA, 22 bp, Homo sapiens
ctgtggctaggaagctgtggga

SEQ ID NO: 8558993 - DNA, 22 bp, Homo sapiens
ctgtggctaggaagctgtggga

SEQ ID NO: 8558994 - DNA, 22 bp, Homo sapiens
ctgtggctcaggcctgtaagcc

SEQ ID NO: 8558995 - DNA, 22 bp, Homo sapiens
ctgtggctcagcacggggtcag

SEQ ID NO: 8558996 - DNA, 22 bp, Homo sapiens
ctgtggctcaggcctgtaagcc

SEQ ID NO: 8558997 - DNA, 22 bp, Homo sapiens
ctgtggctcaattgcctactga

SEQ ID NO: 8558998 - DNA, 22 bp, Homo sapiens
ctgtggctttgtgtctattgta

SEQ ID NO: 8558999 - DNA, 22 bp, Homo sapiens
ctgtggctttggggcggaggac

SEQ ID NO: 8559000 - DNA, 22 bp, Homo sapiens
ctgtggcttttccggggagcct

SEQ ID NO: 8559001 - DNA, 22 bp, Homo sapiens
ctccagctttttcccagttggc

SEQ ID NO: 8559002 - DNA, 22 bp, Homo sapiens
ctccagctttagctctccaggg

SEQ ID NO: 8559003 - DNA, 22 bp, Homo sapiens
ctccagctttagctctccaggg

SEQ ID NO: 8559004 - DNA, 22 bp, Homo sapiens
ctccagctttagctctccaggg

SEQ ID NO: 8559005 - DNA, 22 bp, Homo sapiens
ctccaggaaaatagggaatgag

SEQ ID NO: 8559006 - DNA, 22 bp, Homo sapiens
ctccagcttccctcagctgtgg

SEQ ID NO: 8559007 - DNA, 22 bp, Homo sapiens
ctccagcttccctcagctgtgg

SEQ ID NO: 8559008 - DNA, 22 bp, Homo sapiens
ctccagcttctgcccagagact

SEQ ID NO: 8559009 - DNA, 22 bp, Homo sapiens
ctccagcttctgcccagagact

SEQ ID NO: 8559010 - DNA, 22 bp, Homo sapiens
ctccagctttagctctccaggg

SEQ ID NO: 8559011 - DNA, 22 bp, Homo sapiens
ctccagctgccaccagatgttt

SEQ ID NO: 8559012 - DNA, 22 bp, Homo sapiens
ctccagctgctggtctgagact

SEQ ID NO: 8559013 - DNA, 22 bp, Homo sapiens
ctccagctgccaccagatgttt

SEQ ID NO: 8559014 - DNA, 22 bp, Homo sapiens
ctccagcttccctcagctgtgg

SEQ ID NO: 8559015 - DNA, 22 bp, Homo sapiens
ctccaggctggatccaagtcaa

SEQ ID NO: 8559016 - DNA, 22 bp, Homo sapiens
ctccaggctggatccaagtcaa

SEQ ID NO: 8559017 - DNA, 22 bp, Homo sapiens
ctccaggctggatccaagtcaa

SEQ ID NO: 8559018 - DNA, 22 bp, Homo sapiens
ctccaggctggggtgcaggttg

SEQ ID NO: 8559019 - DNA, 22 bp, Homo sapiens
ctccaggctggggtgcaggttg

SEQ ID NO: 8559020 - DNA, 22 bp, Homo sapiens
ctccaggcttcaagggccggcc

SEQ ID NO: 8559021 - DNA, 22 bp, Homo sapiens
ctccaggctggggtgcaggttg

SEQ ID NO: 8559022 - DNA, 22 bp, Homo sapiens
ctccagggaaaggggcgtccgc

SEQ ID NO: 8559023 - DNA, 22 bp, Homo sapiens
ctccaggaaagcctgaggcccg

SEQ ID NO: 8559024 - DNA, 22 bp, Homo sapiens
ctccaggcgggaggcggttcca

SEQ ID NO: 8559025 - DNA, 22 bp, Homo sapiens
ctccaggctggatccaagtcaa

SEQ ID NO: 8559026 - DNA, 22 bp, Homo sapiens
ctccaggctggatccaagtcaa

SEQ ID NO: 8559027 - DNA, 22 bp, Homo sapiens
ctccaggctcgtccaagatcga

SEQ ID NO: 8559028 - DNA, 22 bp, Homo sapiens
agtcttctcatttcacatgctt

SEQ ID NO: 8559029 - DNA, 22 bp, Homo sapiens
agtcttctcatttcacatgctt

SEQ ID NO: 8559030 - DNA, 22 bp, Homo sapiens
agtcttcccagaggaggtgcca

SEQ ID NO: 8559031 - DNA, 22 bp, Homo sapiens
agtcttccctgtgccagagtgt

SEQ ID NO: 8559032 - DNA, 22 bp, Homo sapiens
agtcttccctgtgccagagtgt

SEQ ID NO: 8559033 - DNA, 22 bp, Homo sapiens
agtcttctcatttcacatgctt

SEQ ID NO: 8559034 - DNA, 22 bp, Homo sapiens
agtcttctcatttcacatgctt

SEQ ID NO: 8559035 - DNA, 22 bp, Homo sapiens
agtcttctgaataagaatcact

SEQ ID NO: 8559036 - DNA, 22 bp, Homo sapiens
agtcttctgaataagaatcact

SEQ ID NO: 8559037 - DNA, 22 bp, Homo sapiens
ctccagagagtccagctctggg

SEQ ID NO: 8559038 - DNA, 22 bp, Homo sapiens
ctccagagagtccagctctggg

SEQ ID NO: 8559039 - DNA, 22 bp, Homo sapiens
ctccagctcgcgagctctgctc

SEQ ID NO: 8559040 - DNA, 22 bp, Homo sapiens
ctccagctcttaactgcggaag

SEQ ID NO: 8559041 - DNA, 22 bp, Homo sapiens
ctccagctgccaccagatgttt

SEQ ID NO: 8559042 - DNA, 22 bp, Homo sapiens
agtcttagaactacagtgccta

SEQ ID NO: 8559043 - DNA, 23 bp, Homo sapiens
agtcccctacatagttcctgggg

SEQ ID NO: 8559044 - DNA, 22 bp, Homo sapiens
agtcccctctcgcttggctgag

SEQ ID NO: 8559045 - DNA, 22 bp, Homo sapiens
agtcccctctaacccaacttta

SEQ ID NO: 8559046 - DNA, 22 bp, Homo sapiens
agtcccctggcaggagggacgt

SEQ ID NO: 8559047 - DNA, 21 bp, Homo sapiens
agtcccctgtccttacttcta

SEQ ID NO: 8559048 - DNA, 22 bp, Homo sapiens
agtccctggattgtctctgtca

SEQ ID NO: 8559049 - DNA, 22 bp, Homo sapiens
agtccctgtactttccactgcc

SEQ ID NO: 8559050 - DNA, 22 bp, Homo sapiens
agtccctgtactttccactgcc

SEQ ID NO: 8559051 - DNA, 22 bp, Homo sapiens
agtccctgtactttccactgcc

SEQ ID NO: 8559052 - DNA, 22 bp, Homo sapiens
agtcccttctcaaagtgtgcgg

SEQ ID NO: 8559053 - DNA, 22 bp, Homo sapiens
agtccctttagtctggagagct

SEQ ID NO: 8559054 - DNA, 22 bp, Homo sapiens
agtccctttagtctggagagct

SEQ ID NO: 8559055 - DNA, 22 bp, Homo sapiens
agtcccttgagggagtactgtt

SEQ ID NO: 8559056 - DNA, 20 bp, Homo sapiens
agtccctttggtcaggtatt

SEQ ID NO: 8559057 - DNA, 22 bp, Homo sapiens
agtccgtggccagactcaagag

SEQ ID NO: 8559058 - DNA, 22 bp, Homo sapiens
agtccgtttctccttgaaggca

SEQ ID NO: 8559059 - DNA, 18 bp, Homo sapiens
agtcctggagatcaccaa

SEQ ID NO: 8559060 - DNA, 22 bp, Homo sapiens
agtcctggacttggagtcaggg

SEQ ID NO: 8559061 - DNA, 22 bp, Homo sapiens
agtcctggcatataggtcctca

SEQ ID NO: 8559062 - DNA, 22 bp, Homo sapiens
agtcctggcatataggtcctca

SEQ ID NO: 8559063 - DNA, 22 bp, Homo sapiens
agtcctggcatataggtcctca

SEQ ID NO: 8559064 - DNA, 22 bp, Homo sapiens
agtcctggcatggaattgtccc

SEQ ID NO: 8559065 - DNA, 22 bp, Homo sapiens
agtcctgatgctctggcaggag

SEQ ID NO: 8559066 - DNA, 22 bp, Homo sapiens
agtcctggacttggagtcaggg

SEQ ID NO: 8559067 - DNA, 22 bp, Homo sapiens
agtcctggacttggagtcaggg

SEQ ID NO: 8559068 - DNA, 22 bp, Homo sapiens
agtcctctgctgtgcgtctttg

SEQ ID NO: 8559069 - DNA, 22 bp, Homo sapiens
agtcctctggagtatgccttat

SEQ ID NO: 8559070 - DNA, 22 bp, Homo sapiens
agtcctggccccaaggaaggat

SEQ ID NO: 8559071 - DNA, 19 bp, Homo sapiens
agtcctggcctgggggacc

SEQ ID NO: 8559072 - DNA, 22 bp, Homo sapiens
agtcctggctctacgggcttca

SEQ ID NO: 8559073 - DNA, 22 bp, Homo sapiens
agtcctgggtccagcaggtcct

SEQ ID NO: 8559074 - DNA, 18 bp, Homo sapiens
agtcctggctctaccacc

SEQ ID NO: 8559075 - DNA, 18 bp, Homo sapiens
agtcctggctctaccacc

SEQ ID NO: 8559076 - DNA, 22 bp, Homo sapiens
agtcctgggtccagcaggtcct

SEQ ID NO: 8559077 - DNA, 22 bp, Homo sapiens
ctcagtgttaaatataaggtat

SEQ ID NO: 8559078 - DNA, 22 bp, Homo sapiens
agtcctgggtccagcaggtcct

SEQ ID NO: 8559079 - DNA, 18 bp, Homo sapiens
ctcagtgtttgctgaaaa

SEQ ID NO: 8559080 - DNA, 22 bp, Homo sapiens
ctcatggagggagtgctcttcc

SEQ ID NO: 8559081 - DNA, 22 bp, Homo sapiens
ctcatggatataagaactgttt

SEQ ID NO: 8559082 - DNA, 22 bp, Homo sapiens
ctcatgtcaggggtgtcaatgt

SEQ ID NO: 8559083 - DNA, 22 bp, Homo sapiens
ctcatgtcttcacccattctaa

SEQ ID NO: 8559084 - DNA, 20 bp, Homo sapiens
ctcatgtggcaccaggcact

SEQ ID NO: 8559085 - DNA, 18 bp, Homo sapiens
ctcatgtgtggtcccagc

SEQ ID NO: 8559086 - DNA, 20 bp, Homo sapiens
ctcatgtggcaccaggcact

SEQ ID NO: 8559087 - DNA, 22 bp, Homo sapiens
ctcatgtgcaaaagtccaaatt

SEQ ID NO: 8559088 - DNA, 22 bp, Homo sapiens
ctcatgtgtctggtaggagctt

SEQ ID NO: 8559089 - DNA, 22 bp, Homo sapiens
ctcattagacaggtatacttta

SEQ ID NO: 8559090 - DNA, 22 bp, Homo sapiens
ctcattctttcacagtctgtgg

SEQ ID NO: 8559091 - DNA, 22 bp, Homo sapiens
ctcattgcaacctccgcctccc

SEQ ID NO: 8559092 - DNA, 22 bp, Homo sapiens
ctcattgattcagtgctgctct

SEQ ID NO: 8559093 - DNA, 22 bp, Homo sapiens
ctcattgcaacctccgcctccc

SEQ ID NO: 8559094 - DNA, 22 bp, Homo sapiens
ctcattgcaacctccgcctccc

SEQ ID NO: 8559095 - DNA, 22 bp, Homo sapiens
ctcattgcccagatccccacag

SEQ ID NO: 8559096 - DNA, 22 bp, Homo sapiens
ctcattgcccagatccccacag

SEQ ID NO: 8559097 - DNA, 22 bp, Homo sapiens
ctctcagactgaagggcctgtg

SEQ ID NO: 8559098 - DNA, 22 bp, Homo sapiens
ctctcagacacccatttggaaa

SEQ ID NO: 8559099 - DNA, 22 bp, Homo sapiens
ctctcagatggagtgtgaatgg

SEQ ID NO: 8559100 - DNA, 22 bp, Homo sapiens
ctctcagcaggaaagcatgcaa

SEQ ID NO: 8559101 - DNA, 22 bp, Homo sapiens
ctctcagcaggaaagcatgcaa

SEQ ID NO: 8559102 - DNA, 19 bp, Homo sapiens
agtggcagatctggaagta

SEQ ID NO: 8559103 - DNA, 19 bp, Homo sapiens
agtggcagatctggaagta

SEQ ID NO: 8559104 - DNA, 22 bp, Homo sapiens
ctctcagaagtagcacgtgggc

SEQ ID NO: 8559105 - DNA, 22 bp, Homo sapiens
ctctcagaagtttatgtcagaa

SEQ ID NO: 8559106 - DNA, 22 bp, Homo sapiens
ctctcagaagtagcacgtgggc

SEQ ID NO: 8559107 - DNA, 22 bp, Homo sapiens
agtggcagagtgcactcaggca

SEQ ID NO: 8559108 - DNA, 16 bp, Homo sapiens
agtggcagataatacc

SEQ ID NO: 8559109 - DNA, 22 bp, Homo sapiens
agtggcagagttgaataattga

SEQ ID NO: 8559110 - DNA, 22 bp, Homo sapiens
agtggcagatctctggtctgga

SEQ ID NO: 8559111 - DNA, 22 bp, Homo sapiens
agtggcagatctctggtctgga

SEQ ID NO: 8559112 - DNA, 19 bp, Homo sapiens
agtggcagatctggaagta

SEQ ID NO: 8559113 - DNA, 22 bp, Homo sapiens
agtggcagagtcagggtttgga

SEQ ID NO: 8559114 - DNA, 22 bp, Homo sapiens
agtggcagagtgcactcaggca

SEQ ID NO: 8559115 - DNA, 22 bp, Homo sapiens
agtggcagagtgcactcaggca

SEQ ID NO: 8559116 - DNA, 22 bp, Homo sapiens
agtggcagaggttgactgcagt

SEQ ID NO: 8559117 - DNA, 22 bp, Homo sapiens
agtggcagaagccaagtctgca

SEQ ID NO: 8559118 - DNA, 22 bp, Homo sapiens
agtggcagaggttgactgcagt

SEQ ID NO: 8559119 - DNA, 22 bp, Homo sapiens
ctcctgggtcattgccagcaaa

SEQ ID NO: 8559120 - DNA, 22 bp, Homo sapiens
agtggcagagctgtgtcttgaa

SEQ ID NO: 8559121 - DNA, 22 bp, Homo sapiens
agtggcagagctgtgtcttgaa

SEQ ID NO: 8559122 - DNA, 22 bp, Homo sapiens
agtggcagaagccaagtctgca

SEQ ID NO: 8559123 - DNA, 22 bp, Homo sapiens
ctcctgggtcattgccagcaaa

SEQ ID NO: 8559124 - DNA, 22 bp, Homo sapiens
ctcctgggtcattgccagcaaa

SEQ ID NO: 8559125 - DNA, 22 bp, Homo sapiens
ctcctgggggacagcggcaggg

SEQ ID NO: 8559126 - DNA, 22 bp, Homo sapiens
ctcctggggcacttagaagcaa

SEQ ID NO: 8559127 - DNA, 22 bp, Homo sapiens
ctcctggggccatggaaggaac

SEQ ID NO: 8559128 - DNA, 22 bp, Homo sapiens
ctcctggggcacttagaagcaa

SEQ ID NO: 8559129 - DNA, 20 bp, Homo sapiens
ctcctgggactgctggttat

SEQ ID NO: 8559130 - DNA, 22 bp, Homo sapiens
ctcctgggcttcgaaggctccc

SEQ ID NO: 8559131 - DNA, 22 bp, Homo sapiens
ctcctgggaatttagttgtgag

SEQ ID NO: 8559132 - DNA, 22 bp, Homo sapiens
ctcctgggaatttagttgtgag

SEQ ID NO: 8559133 - DNA, 22 bp, Homo sapiens
ctcctggctttcccagaccagg

SEQ ID NO: 8559134 - DNA, 22 bp, Homo sapiens
ctcctgggaaaggctggacaca

SEQ ID NO: 8559135 - DNA, 22 bp, Homo sapiens
ctcctgggaaaggctggacaca

SEQ ID NO: 8559136 - DNA, 22 bp, Homo sapiens
ctccctctcaccggagccctgg

SEQ ID NO: 8559137 - DNA, 22 bp, Homo sapiens
ctccctctcaccggagccctgg

SEQ ID NO: 8559138 - DNA, 22 bp, Homo sapiens
ctccctcatatacccagcgaga

SEQ ID NO: 8559139 - DNA, 22 bp, Homo sapiens
ctccctccctacgtgagctcac

SEQ ID NO: 8559140 - DNA, 22 bp, Homo sapiens
ctccctcatatacccagcgaga

SEQ ID NO: 8559141 - DNA, 22 bp, Homo sapiens
ctccctcaggccttagccctgc

SEQ ID NO: 8559142 - DNA, 22 bp, Homo sapiens
ctccctcaggccttagccctgc

SEQ ID NO: 8559143 - DNA, 22 bp, Homo sapiens
ctccctcaggccttagccctgc

SEQ ID NO: 8559144 - DNA, 18 bp, Homo sapiens
ctccagggaactcagtca

SEQ ID NO: 8559145 - DNA, 22 bp, Homo sapiens
ctccctcacacccttgcccaga

SEQ ID NO: 8559146 - DNA, 22 bp, Homo sapiens
ctccctcacacccttgcccaga

SEQ ID NO: 8559147 - DNA, 22 bp, Homo sapiens
ctccctcagaggagcacctgtt

SEQ ID NO: 8559148 - DNA, 22 bp, Homo sapiens
ctccctcagaggagcacctgtt

SEQ ID NO: 8559149 - DNA, 22 bp, Homo sapiens
ctccctcaccatgacccgctgt

SEQ ID NO: 8559150 - DNA, 22 bp, Homo sapiens
ctccctcaccatgacccgctgt

SEQ ID NO: 8559151 - DNA, 18 bp, Homo sapiens
ctccagggaactcagtca

SEQ ID NO: 8559152 - DNA, 20 bp, Homo sapiens
ctccagggaacagactggag

SEQ ID NO: 8559153 - DNA, 20 bp, Homo sapiens
ctccagggaacagactggag

SEQ ID NO: 8559154 - DNA, 20 bp, Homo sapiens
ctccagggaacagactggag

SEQ ID NO: 8559155 - DNA, 20 bp, Homo sapiens
ctccagggaacagactggag

SEQ ID NO: 8559156 - DNA, 22 bp, Homo sapiens
ctccagggaaaggggcgtccgc

SEQ ID NO: 8559157 - DNA, 22 bp, Homo sapiens
ctccagggaaaggggcgtccgc

SEQ ID NO: 8559158 - DNA, 22 bp, Homo sapiens
ctccagggaaaggggcgtccgc

SEQ ID NO: 8559159 - DNA, 22 bp, Homo sapiens
ctccagggaaaggggcgtccgc

SEQ ID NO: 8559160 - DNA, 22 bp, Homo sapiens
ctcctcagaagagggtaacaca

SEQ ID NO: 8559161 - DNA, 22 bp, Homo sapiens
ctcctcagaagagggtaacaca

SEQ ID NO: 8559162 - DNA, 22 bp, Homo sapiens
ctcctcagaacagccttggctg

SEQ ID NO: 8559163 - DNA, 19 bp, Homo sapiens
ctcctggctctgtcatttt

SEQ ID NO: 8559164 - DNA, 22 bp, Homo sapiens
ctcctggctcgcccccagctga

SEQ ID NO: 8559165 - DNA, 22 bp, Homo sapiens
ctcctgcccacgtgctacttct

SEQ ID NO: 8559166 - DNA, 22 bp, Homo sapiens
ctccctctgtccgaggccggct

SEQ ID NO: 8559167 - DNA, 22 bp, Homo sapiens
ctccctctgtccgaggccggct

SEQ ID NO: 8559168 - DNA, 22 bp, Homo sapiens
ctccctctctaaggcaaagaga

SEQ ID NO: 8559169 - DNA, 22 bp, Homo sapiens
ctccctctctaaggcaaagaga

SEQ ID NO: 8559170 - DNA, 22 bp, Homo sapiens
ctccctctctaaggcaaagaga

SEQ ID NO: 8559171 - DNA, 22 bp, Homo sapiens
ctccctctgaggctttgagcct

SEQ ID NO: 8559172 - DNA, 22 bp, Homo sapiens
ctccgttttgtgggacacggat

SEQ ID NO: 8559173 - DNA, 22 bp, Homo sapiens
ctccgtttttgaccggcactga

SEQ ID NO: 8559174 - DNA, 22 bp, Homo sapiens
ctccgtgctattttagtatcgc

SEQ ID NO: 8559175 - DNA, 22 bp, Homo sapiens
ctcctacagtgtttgagtccag

SEQ ID NO: 8559176 - DNA, 22 bp, Homo sapiens
ctcctaggtgctcactggggtc

SEQ ID NO: 8559177 - DNA, 22 bp, Homo sapiens
ctcctcactttccagactgggc

SEQ ID NO: 8559178 - DNA, 22 bp, Homo sapiens
ctcctcacacccactgcaacca

SEQ ID NO: 8559179 - DNA, 22 bp, Homo sapiens
ctgagaaaggacctcaaacagg

SEQ ID NO: 8559180 - DNA, 22 bp, Homo sapiens
ctgagaaaggacctcaaacagg

SEQ ID NO: 8559181 - DNA, 22 bp, Homo sapiens
ctgagaaaccaggtgctctgat

SEQ ID NO: 8559182 - DNA, 22 bp, Homo sapiens
ctgagaaaggacctcaaacagg

SEQ ID NO: 8559183 - DNA, 22 bp, Homo sapiens
ctgagaaaccaggtgctctgat

SEQ ID NO: 8559184 - DNA, 22 bp, Homo sapiens
ctgagaaaccaggtgctctgat

SEQ ID NO: 8559185 - DNA, 22 bp, Homo sapiens
ctgagaaacatatttccatcta

SEQ ID NO: 8559186 - DNA, 22 bp, Homo sapiens
ctgagaaaccaggtgctctgat

SEQ ID NO: 8559187 - DNA, 22 bp, Homo sapiens
agttagaatagtcagattgtag

SEQ ID NO: 8559188 - DNA, 22 bp, Homo sapiens
agttagaagtgtgtcatctgtg

SEQ ID NO: 8559189 - DNA, 22 bp, Homo sapiens
agttagaatagtcagattgtag

SEQ ID NO: 8559190 - DNA, 22 bp, Homo sapiens
agttactgctttcaggaagttt

SEQ ID NO: 8559191 - DNA, 22 bp, Homo sapiens
agttacttgagacgtttatgaa

SEQ ID NO: 8559192 - DNA, 22 bp, Homo sapiens
agttagaaagtaaatcatttga

SEQ ID NO: 8559193 - DNA, 22 bp, Homo sapiens
agttaagagtgtgaaaatgtta

SEQ ID NO: 8559194 - DNA, 22 bp, Homo sapiens
agttatataactatctagatgc

SEQ ID NO: 8559195 - DNA, 22 bp, Homo sapiens
agttatataactatctagatgc

SEQ ID NO: 8559196 - DNA, 22 bp, Homo sapiens
agttataccttatacacatatg

SEQ ID NO: 8559197 - DNA, 22 bp, Homo sapiens
agttataccttatacacatatg

SEQ ID NO: 8559198 - DNA, 22 bp, Homo sapiens
agttataatctgctactgatat

SEQ ID NO: 8559199 - DNA, 22 bp, Homo sapiens
agttagtgagctcttgggacct

SEQ ID NO: 8559200 - DNA, 20 bp, Homo sapiens
agttagtgagtaattgagct

SEQ ID NO: 8559201 - DNA, 22 bp, Homo sapiens
agttagtgaagctcatcacagc

SEQ ID NO: 8559202 - DNA, 22 bp, Homo sapiens
agttagtgagctcttgggacct

SEQ ID NO: 8559203 - DNA, 20 bp, Homo sapiens
agttagtgagtaattgagct

SEQ ID NO: 8559204 - DNA, 22 bp, Homo sapiens
agttagtggcaaagtggtttga

SEQ ID NO: 8559205 - DNA, 20 bp, Homo sapiens
agttagtgagtaattgagct

SEQ ID NO: 8559206 - DNA, 22 bp, Homo sapiens
agttagtgaagctcatcacagc

SEQ ID NO: 8559207 - DNA, 22 bp, Homo sapiens
agttagtgtgatggaggtacga

SEQ ID NO: 8559208 - DNA, 22 bp, Homo sapiens
agttagtgtgatggaggtacga

SEQ ID NO: 8559209 - DNA, 17 bp, Homo sapiens
agttagtgtagcagtgc

SEQ ID NO: 8559210 - DNA, 17 bp, Homo sapiens
agttagtgtagcagtgc

SEQ ID NO: 8559211 - DNA, 22 bp, Homo sapiens
agttataaaaggagcactgatt

SEQ ID NO: 8559212 - DNA, 22 bp, Homo sapiens
agttagcagcttattagaaaca

SEQ ID NO: 8559213 - DNA, 23 bp, Homo sapiens
agttaggtcaagttaggtcaatt

SEQ ID NO: 8559214 - DNA, 22 bp, Homo sapiens
agttagaatataattatgttaa

SEQ ID NO: 8559215 - DNA, 22 bp, Homo sapiens
agttagaatggatgttgagagc

SEQ ID NO: 8559216 - DNA, 22 bp, Homo sapiens
ctgagcagcaattgctggccca

SEQ ID NO: 8559217 - DNA, 22 bp, Homo sapiens
ctgagcagcacagggcgccagg

SEQ ID NO: 8559218 - DNA, 22 bp, Homo sapiens
ctgagcagcaacccagagcctc

SEQ ID NO: 8559219 - DNA, 22 bp, Homo sapiens
agttatataactatctagatgc

SEQ ID NO: 8559220 - DNA, 22 bp, Homo sapiens
ctgaggagagatcacgtggtgt

SEQ ID NO: 8559221 - DNA, 22 bp, Homo sapiens
ctgagctgggactcagtagcaa

SEQ ID NO: 8559222 - DNA, 22 bp, Homo sapiens
ctgagctgggactcagtagcaa

SEQ ID NO: 8559223 - DNA, 18 bp, Homo sapiens
agtgtctggatatttggg

SEQ ID NO: 8559224 - DNA, 20 bp, Homo sapiens
agtgtctggattttgtaacc

SEQ ID NO: 8559225 - DNA, 20 bp, Homo sapiens
agtgtctggattttgtaacc

SEQ ID NO: 8559226 - DNA, 20 bp, Homo sapiens
agtgtctgggcctcaggccc

SEQ ID NO: 8559227 - DNA, 18 bp, Homo sapiens
agtgtctggatatttggg

SEQ ID NO: 8559228 - DNA, 22 bp, Homo sapiens
agtgtctggaggcattcttggt

SEQ ID NO: 8559229 - DNA, 18 bp, Homo sapiens
agtgtctggatatttggg

SEQ ID NO: 8559230 - DNA, 22 bp, Homo sapiens
agtgtctgcttatcagttcttg

SEQ ID NO: 8559231 - DNA, 22 bp, Homo sapiens
agtgtctgctttgagtcaggtg

SEQ ID NO: 8559232 - DNA, 22 bp, Homo sapiens
ctgaatgaggaaaagagtgagg

SEQ ID NO: 8559233 - DNA, 22 bp, Homo sapiens
ctgaatgagggattctgagggc

SEQ ID NO: 8559234 - DNA, 22 bp, Homo sapiens
ctgaatccacacaaggtgatgg

SEQ ID NO: 8559235 - DNA, 22 bp, Homo sapiens
ctgaaggaagcaggtggcctgt

SEQ ID NO: 8559236 - DNA, 22 bp, Homo sapiens
ctgaagctttacttcaaataca

SEQ ID NO: 8559237 - DNA, 20 bp, Homo sapiens
agtgtctgggcctcaggccc

SEQ ID NO: 8559238 - DNA, 22 bp, Homo sapiens
agtgtctgcttatcagttcttg

SEQ ID NO: 8559239 - DNA, 22 bp, Homo sapiens
agtgtctgctaggttcatcaac

SEQ ID NO: 8559240 - DNA, 22 bp, Homo sapiens
agtgtctgctcagacagctaca

SEQ ID NO: 8559241 - DNA, 22 bp, Homo sapiens
agtgtctgcctgggaggagcat

SEQ ID NO: 8559242 - DNA, 22 bp, Homo sapiens
agtgtctgcggcggggaggcgg

SEQ ID NO: 8559243 - DNA, 22 bp, Homo sapiens
agtgtctgcgggcagaggagcg

SEQ ID NO: 8559244 - DNA, 22 bp, Homo sapiens
agtgtctgcgggcagaggagcg

SEQ ID NO: 8559245 - DNA, 22 bp, Homo sapiens
agtgtctgctaggttcatcaac

SEQ ID NO: 8559246 - DNA, 22 bp, Homo sapiens
ctgaaattattgtttaatcaaa

SEQ ID NO: 8559247 - DNA, 22 bp, Homo sapiens
ctgaaattctgcctctgcacaa

SEQ ID NO: 8559248 - DNA, 22 bp, Homo sapiens
agtgtctgcctgggaggagcat

SEQ ID NO: 8559249 - DNA, 20 bp, Homo sapiens
ctgacagaaaatatttcatc

SEQ ID NO: 8559250 - DNA, 22 bp, Homo sapiens
ctgagaaaagtatgagctctgg

SEQ ID NO: 8559251 - DNA, 22 bp, Homo sapiens
ctgagaaaagctttcttataca

SEQ ID NO: 8559252 - DNA, 22 bp, Homo sapiens
ctgagaaaagctttcttataca

SEQ ID NO: 8559253 - DNA, 22 bp, Homo sapiens
ctgagaaaagtatgagctctgg

SEQ ID NO: 8559254 - DNA, 22 bp, Homo sapiens
ctgagaaaatttcaggaagtgt

SEQ ID NO: 8559255 - DNA, 22 bp, Homo sapiens
ctgagaaaatttcaggaagtgt

SEQ ID NO: 8559256 - DNA, 22 bp, Homo sapiens
ctgaatgtcgatcagcttgggt

SEQ ID NO: 8559257 - DNA, 22 bp, Homo sapiens
ctgaatgcctgcagagccagag

SEQ ID NO: 8559258 - DNA, 22 bp, Homo sapiens
ctgaatgatataagatctttct

SEQ ID NO: 8559259 - DNA, 22 bp, Homo sapiens
ctgaattaagcattacatacat

SEQ ID NO: 8559260 - DNA, 22 bp, Homo sapiens
ctgaattctgccttgaggcctt

SEQ ID NO: 8559261 - DNA, 22 bp, Homo sapiens
ctgacaaaccactgctccagct

SEQ ID NO: 8559262 - DNA, 22 bp, Homo sapiens
ctgacaaacttaattttctgaa

SEQ ID NO: 8559263 - DNA, 22 bp, Homo sapiens
ctgacaaaccactgctccagct

SEQ ID NO: 8559264 - DNA, 22 bp, Homo sapiens
ctgacaaaggcaaggcaggggg

SEQ ID NO: 8559265 - DNA, 22 bp, Homo sapiens
ctgacaaaggcaaggcaggggg

SEQ ID NO: 8559266 - DNA, 20 bp, Homo sapiens
ctgacagaaaatatttcatc

SEQ ID NO: 8559267 - DNA, 22 bp, Homo sapiens
ctctggctttaaggatgccaca

SEQ ID NO: 8559268 - DNA, 22 bp, Homo sapiens
ctctggcttgttaatgcatatt

SEQ ID NO: 8559269 - DNA, 22 bp, Homo sapiens
ctctggcttgttaatgcatatt

SEQ ID NO: 8559270 - DNA, 22 bp, Homo sapiens
ctctggcttggtaaaaacttct

SEQ ID NO: 8559271 - DNA, 22 bp, Homo sapiens
ctctggctttgctcatgcatcc

SEQ ID NO: 8559272 - DNA, 22 bp, Homo sapiens
ctctggctttgctcatgcatcc

SEQ ID NO: 8559273 - DNA, 22 bp, Homo sapiens
ctctggctttgctcatgcatcc

SEQ ID NO: 8559274 - DNA, 22 bp, Homo sapiens
ctctgggaattctgagcaagca

SEQ ID NO: 8559275 - DNA, 22 bp, Homo sapiens
ctctgggaagtggagacttcag

SEQ ID NO: 8559276 - DNA, 22 bp, Homo sapiens
ctctgggaagggctgagcactg

SEQ ID NO: 8559277 - DNA, 22 bp, Homo sapiens
ctctggctttgctcatgcatcc

SEQ ID NO: 8559278 - DNA, 22 bp, Homo sapiens
ctctgggcttcaagtcagattt

SEQ ID NO: 8559279 - DNA, 22 bp, Homo sapiens
ctctgggcttcaagtcagattt

SEQ ID NO: 8559280 - DNA, 22 bp, Homo sapiens
ctctgggcttacctgcttcctg

SEQ ID NO: 8559281 - DNA, 22 bp, Homo sapiens
ctctgggcttgttgacctgcac

SEQ ID NO: 8559282 - DNA, 22 bp, Homo sapiens
ctctgggaccacgtgactctgc

SEQ ID NO: 8559283 - DNA, 22 bp, Homo sapiens
ctctgggacatcccttggccta

SEQ ID NO: 8559284 - DNA, 22 bp, Homo sapiens
ctctgggaattctgagcaagca

SEQ ID NO: 8559285 - DNA, 22 bp, Homo sapiens
ctctgggaccatggcaagtgcg

SEQ ID NO: 8559286 - DNA, 22 bp, Homo sapiens
ctctgggaccatggcaagtgcg

SEQ ID NO: 8559287 - DNA, 22 bp, Homo sapiens
ctctgggagaggacacttggag

SEQ ID NO: 8559288 - DNA, 22 bp, Homo sapiens
ctctgggagaggacacttggag

SEQ ID NO: 8559289 - DNA, 23 bp, Homo sapiens
ctgaaataccagaaaatcagtgt

SEQ ID NO: 8559290 - DNA, 23 bp, Homo sapiens
ctgaaataccagaaaatcagtgt

SEQ ID NO: 8559291 - DNA, 22 bp, Homo sapiens
ctgaaataaagttgctaaaatt

SEQ ID NO: 8559292 - DNA, 22 bp, Homo sapiens
ctgaaagggagaacaccaagag

SEQ ID NO: 8559293 - DNA, 22 bp, Homo sapiens
ctgaaagggttacatagtaagt

SEQ ID NO: 8559294 - DNA, 22 bp, Homo sapiens
ctgaaagggttacatagtaagt

SEQ ID NO: 8559295 - DNA, 22 bp, Homo sapiens
ctgaaaggtataaataagactt

SEQ ID NO: 8559296 - DNA, 22 bp, Homo sapiens
ctgaaaggtataaataagactt

SEQ ID NO: 8559297 - DNA, 22 bp, Homo sapiens
ctgaaaggcagtgggtagtgtg

SEQ ID NO: 8559298 - DNA, 22 bp, Homo sapiens
ctgaaagggagaacaccaagag

SEQ ID NO: 8559299 - DNA, 22 bp, Homo sapiens
ctgaaatattttaatctcagga

SEQ ID NO: 8559300 - DNA, 22 bp, Homo sapiens
ctgaaatattttaatctcagga

SEQ ID NO: 8559301 - DNA, 17 bp, Homo sapiens
ctgaaatattatgataa

SEQ ID NO: 8559302 - DNA, 22 bp, Homo sapiens
ctgaaatagtttcatagaactt

SEQ ID NO: 8559303 - DNA, 22 bp, Homo sapiens
ctgaaatagtttcatagaactt

SEQ ID NO: 8559304 - DNA, 17 bp, Homo sapiens
ctgaaatattatgataa

SEQ ID NO: 8559305 - DNA, 22 bp, Homo sapiens
ctctgggcttgttgacctgcac

SEQ ID NO: 8559306 - DNA, 22 bp, Homo sapiens
ctctggggaaatggatatgtac

SEQ ID NO: 8559307 - DNA, 17 bp, Homo sapiens
ctctggggacagttcta

SEQ ID NO: 8559308 - DNA, 22 bp, Homo sapiens
ctctggggttaagcttccatgg

SEQ ID NO: 8559309 - DNA, 22 bp, Homo sapiens
ctctggggttaagcttccatgg

SEQ ID NO: 8559310 - DNA, 22 bp, Homo sapiens
ctctggggtggaggaggctgac

SEQ ID NO: 8559311 - DNA, 22 bp, Homo sapiens
ctctgctagaaggtcaatctct

SEQ ID NO: 8559312 - DNA, 22 bp, Homo sapiens
ctctgctgagccagagtcccca

SEQ ID NO: 8559313 - DNA, 22 bp, Homo sapiens
ctctgcagtgtaacagcgcttg

SEQ ID NO: 8559314 - DNA, 22 bp, Homo sapiens
ctctgcatgccacatgagtgac

SEQ ID NO: 8559315 - DNA, 22 bp, Homo sapiens
ctctgcatgccttgctcagaca

SEQ ID NO: 8559316 - DNA, 22 bp, Homo sapiens
ctctgcatcagcttcattctgt

SEQ ID NO: 8559317 - DNA, 22 bp, Homo sapiens
ctctgcatcaggcattatggat

SEQ ID NO: 8559318 - DNA, 22 bp, Homo sapiens
ctctgcattttaacagatgatt

SEQ ID NO: 8559319 - DNA, 22 bp, Homo sapiens
ctctgcattttaacagatgatt

SEQ ID NO: 8559320 - DNA, 22 bp, Homo sapiens
ctctgcctgccactgttcaggc

SEQ ID NO: 8559321 - DNA, 22 bp, Homo sapiens
ctctgcctgccactgttcaggc

SEQ ID NO: 8559322 - DNA, 22 bp, Homo sapiens
ctctgcctgtgtcgccaccaca

SEQ ID NO: 8559323 - DNA, 22 bp, Homo sapiens
ctctgcctgtgtcgccaccaca

SEQ ID NO: 8559324 - DNA, 22 bp, Homo sapiens
ctctgcctgtgtcgccaccaca

SEQ ID NO: 8559325 - DNA, 22 bp, Homo sapiens
ctctgcctgcccaccgacccat

SEQ ID NO: 8559326 - DNA, 22 bp, Homo sapiens
ctctgcctgcccaccgacccat

SEQ ID NO: 8559327 - DNA, 22 bp, Homo sapiens
ctctgcctgtctcatcctgcaa

SEQ ID NO: 8559328 - DNA, 22 bp, Homo sapiens
ctctgcctgtctcatcctgcaa

SEQ ID NO: 8559329 - DNA, 22 bp, Homo sapiens
ctctgcctgtctcatcctgcaa

SEQ ID NO: 8559330 - DNA, 22 bp, Homo sapiens
ctctgagcccgctgcagcccca

SEQ ID NO: 8559331 - DNA, 22 bp, Homo sapiens
ctctgagcccgctgcagcccca

SEQ ID NO: 8559332 - DNA, 22 bp, Homo sapiens
ctctgagcagcggtgccgaagt

SEQ ID NO: 8559333 - DNA, 22 bp, Homo sapiens
ctctccaagttatcaagatgaa

SEQ ID NO: 8559334 - DNA, 22 bp, Homo sapiens
ctctgagcagaggccgtggcta

SEQ ID NO: 8559335 - DNA, 22 bp, Homo sapiens
ctctcagtgccacacagccatt

SEQ ID NO: 8559336 - DNA, 22 bp, Homo sapiens
ctctcagtgccacacagccatt

SEQ ID NO: 8559337 - DNA, 22 bp, Homo sapiens
ctctcaggcttgggtcgtggca

SEQ ID NO: 8559338 - DNA, 19 bp, Homo sapiens
ctctcagcctgtctccttg

SEQ ID NO: 8559339 - DNA, 22 bp, Homo sapiens
ctctcagcaggaaagcatgcaa

SEQ ID NO: 8559340 - DNA, 19 bp, Homo sapiens
ctctcagcctgtctccttg

SEQ ID NO: 8559341 - DNA, 22 bp, Homo sapiens
ctctgcaggccttgagtgtggt

SEQ ID NO: 8559342 - DNA, 22 bp, Homo sapiens
ctctgcaggggaggcatgcact

SEQ ID NO: 8559343 - DNA, 17 bp, Homo sapiens
ctctgcagtgcatggct

SEQ ID NO: 8559344 - DNA, 17 bp, Homo sapiens
ctctgcagtgcatggct

SEQ ID NO: 8559345 - DNA, 23 bp, Homo sapiens
ctctgcaggagagtgggcagggc

SEQ ID NO: 8559346 - DNA, 23 bp, Homo sapiens
ctctgcaggagagtgggcagggc

SEQ ID NO: 8559347 - DNA, 21 bp, Homo sapiens
ctctgcagccctgcttccagg

SEQ ID NO: 8559348 - DNA, 21 bp, Homo sapiens
ctctgcagccctgcttccagg

SEQ ID NO: 8559349 - DNA, 22 bp, Homo sapiens
agtcccagctactcaagaggct

SEQ ID NO: 8559350 - DNA, 22 bp, Homo sapiens
agtcccagctactcaagaggct

SEQ ID NO: 8559351 - DNA, 22 bp, Homo sapiens
agtcccagctactcaagaggct

SEQ ID NO: 8559352 - DNA, 22 bp, Homo sapiens
ctagtcactgtaataatctgct

SEQ ID NO: 8559353 - DNA, 22 bp, Homo sapiens
ctagtcactcagcactgacaaa

SEQ ID NO: 8559354 - DNA, 22 bp, Homo sapiens
ctagtctctggaggtcagggct

SEQ ID NO: 8559355 - DNA, 20 bp, Homo sapiens
ctagtctcacatccctggca

SEQ ID NO: 8559356 - DNA, 22 bp, Homo sapiens
ctagtccagtctcaaaatgcta

SEQ ID NO: 8559357 - DNA, 22 bp, Homo sapiens
ctagtccactgtcctgcctcca

SEQ ID NO: 8559358 - DNA, 22 bp, Homo sapiens
ctagtccactgtcctgcctcca

SEQ ID NO: 8559359 - DNA, 22 bp, Homo sapiens
ctagtccagtctcaaaatgcta

SEQ ID NO: 8559360 - DNA, 22 bp, Homo sapiens
ctagtatttaaaggctatgatt

SEQ ID NO: 8559361 - DNA, 22 bp, Homo sapiens
ctagtattacatttttgtgtgt

SEQ ID NO: 8559362 - DNA, 22 bp, Homo sapiens
ctagtcacgtctttcagttacc

SEQ ID NO: 8559363 - DNA, 22 bp, Homo sapiens
ctagtattaagtgtgagtaaaa

SEQ ID NO: 8559364 - DNA, 22 bp, Homo sapiens
ctaggtggtggtgggttgacat

SEQ ID NO: 8559365 - DNA, 22 bp, Homo sapiens
ctaggtgatccactgctctctt

SEQ ID NO: 8559366 - DNA, 22 bp, Homo sapiens
ctagtaaagctatgattctgcc

SEQ ID NO: 8559367 - DNA, 22 bp, Homo sapiens
agtcccaacagcttacaaggaa

SEQ ID NO: 8559368 - DNA, 22 bp, Homo sapiens
agtccatggttgtagttctctc

SEQ ID NO: 8559369 - DNA, 22 bp, Homo sapiens
agtcccaacagcttacaaggaa

SEQ ID NO: 8559370 - DNA, 19 bp, Homo sapiens
agtccatgaatggaggatg

SEQ ID NO: 8559371 - DNA, 22 bp, Homo sapiens
ctagggtcaggggcctgcgtcg

SEQ ID NO: 8559372 - DNA, 22 bp, Homo sapiens
ctagggtgtgcagattttgcct

SEQ ID NO: 8559373 - DNA, 22 bp, Homo sapiens
ctaggtgatccactgctctctt

SEQ ID NO: 8559374 - DNA, 22 bp, Homo sapiens
ctagggtgtgcagattttgcct

SEQ ID NO: 8559375 - DNA, 22 bp, Homo sapiens
ctagggtggatttgtgcagagt

SEQ ID NO: 8559376 - DNA, 22 bp, Homo sapiens
ctagggtggatttgtgcagagt

SEQ ID NO: 8559377 - DNA, 22 bp, Homo sapiens
agtccagggctctctgtgggat

SEQ ID NO: 8559378 - DNA, 22 bp, Homo sapiens
agtccagggctctctgtgggat

SEQ ID NO: 8559379 - DNA, 22 bp, Homo sapiens
agtccagggcttagtcagcggg

SEQ ID NO: 8559380 - DNA, 22 bp, Homo sapiens
agtccataacttcagagtgtca

SEQ ID NO: 8559381 - DNA, 20 bp, Homo sapiens
ctagaagcagaattgctgat

SEQ ID NO: 8559382 - DNA, 22 bp, Homo sapiens
ctagaatactcgtattattccc

SEQ ID NO: 8559383 - DNA, 22 bp, Homo sapiens
ctagaagcaactagatctgttt

SEQ ID NO: 8559384 - DNA, 22 bp, Homo sapiens
ctagaatatcatatgaagagac

SEQ ID NO: 8559385 - DNA, 22 bp, Homo sapiens
agtccagaacttcagctagttt

SEQ ID NO: 8559386 - DNA, 22 bp, Homo sapiens
agtatttagagacacaagatgg

SEQ ID NO: 8559387 - DNA, 22 bp, Homo sapiens
agtatttagctgactcgctaca

SEQ ID NO: 8559388 - DNA, 22 bp, Homo sapiens
agtatttagcatagtggttagt

SEQ ID NO: 8559389 - DNA, 22 bp, Homo sapiens
ctacagaatctacctcaagcca

SEQ ID NO: 8559390 - DNA, 22 bp, Homo sapiens
ctacagaatggagggtcagaga

SEQ ID NO: 8559391 - DNA, 22 bp, Homo sapiens
ctacagaatctacctcaagcca

SEQ ID NO: 8559392 - DNA, 22 bp, Homo sapiens
agtatgttgacttattcttgga

SEQ ID NO: 8559393 - DNA, 22 bp, Homo sapiens
agtatgttgagttttgctttag

SEQ ID NO: 8559394 - DNA, 21 bp, Homo sapiens
agtatgtgttagggataattt

SEQ ID NO: 8559395 - DNA, 22 bp, Homo sapiens
agtatgtggcacagaatttctt

SEQ ID NO: 8559396 - DNA, 22 bp, Homo sapiens
agtatttagagacacaagatgg

SEQ ID NO: 8559397 - DNA, 22 bp, Homo sapiens
agtatttagagacacaagacgg

SEQ ID NO: 8559398 - DNA, 22 bp, Homo sapiens
agtattgtaaacttcctaagga

SEQ ID NO: 8559399 - DNA, 22 bp, Homo sapiens
agtatgtattttatacttacag

SEQ ID NO: 8559400 - DNA, 22 bp, Homo sapiens
agtatgtagtgcaatcagtcag

SEQ ID NO: 8559401 - DNA, 19 bp, Homo sapiens
agtatgtctatgagtcttt

SEQ ID NO: 8559402 - DNA, 22 bp, Homo sapiens
agtatgtcagagtgaaaatggt

SEQ ID NO: 8559403 - DNA, 20 bp, Homo sapiens
agtatgatccactctgctct

SEQ ID NO: 8559404 - DNA, 22 bp, Homo sapiens
ctaaggaattggagcatgtgtt

SEQ ID NO: 8559405 - DNA, 22 bp, Homo sapiens
agtatgcatatttcaaagtaag

SEQ ID NO: 8559406 - DNA, 22 bp, Homo sapiens
ctaaggaaaggaaatacagtaa

SEQ ID NO: 8559407 - DNA, 22 bp, Homo sapiens
ctaagcttttcaaaaacatgtt

SEQ ID NO: 8559408 - DNA, 22 bp, Homo sapiens
ctaaggaagtgacagtgggatt

SEQ ID NO: 8559409 - DNA, 22 bp, Homo sapiens
ctaaggaaatatgtcacttgct

SEQ ID NO: 8559410 - DNA, 22 bp, Homo sapiens
ctacatttgttctatagctttt

SEQ ID NO: 8559411 - DNA, 22 bp, Homo sapiens
ctacattttaataagctgctta

SEQ ID NO: 8559412 - DNA, 22 bp, Homo sapiens
ctacattttgtgattatgaaat

SEQ ID NO: 8559413 - DNA, 22 bp, Homo sapiens
ctacattttaataagctgctta

SEQ ID NO: 8559414 - DNA, 22 bp, Homo sapiens
ctacattttgtgattatgaaat

SEQ ID NO: 8559415 - DNA, 22 bp, Homo sapiens
ctacatttggagagtataggaa

SEQ ID NO: 8559416 - DNA, 22 bp, Homo sapiens
ctacatttcccagctgccttcc

SEQ ID NO: 8559417 - DNA, 22 bp, Homo sapiens
ctacagaatggagggtcagaga

SEQ ID NO: 8559418 - DNA, 22 bp, Homo sapiens
ctacagaatggagggtcagaga

SEQ ID NO: 8559419 - DNA, 22 bp, Homo sapiens
ctacagaattcaacaaatggtt

SEQ ID NO: 8559420 - DNA, 22 bp, Homo sapiens
ctacagaattcaacaaatggtt

SEQ ID NO: 8559421 - DNA, 22 bp, Homo sapiens
ctacatttcccagctgccttcc

SEQ ID NO: 8559422 - DNA, 22 bp, Homo sapiens
ctacatttgttcaaataagctg

SEQ ID NO: 8559423 - DNA, 22 bp, Homo sapiens
ctacatttgttcaaataagctg

SEQ ID NO: 8559424 - DNA, 22 bp, Homo sapiens
ctacatttgttcaaataagctg

SEQ ID NO: 8559425 - DNA, 22 bp, Homo sapiens
ctacatttggagagtataggaa

SEQ ID NO: 8559426 - DNA, 22 bp, Homo sapiens
ctagaacagaaagtacaggaaa

SEQ ID NO: 8559427 - DNA, 22 bp, Homo sapiens
ctagaaatgctcaagagaaagt

SEQ ID NO: 8559428 - DNA, 22 bp, Homo sapiens
ctagaaatctctgtttacatca

SEQ ID NO: 8559429 - DNA, 22 bp, Homo sapiens
ctagaaatctctgtttacatca

SEQ ID NO: 8559430 - DNA, 22 bp, Homo sapiens
ctagaaatattttacagtcaag

SEQ ID NO: 8559431 - DNA, 22 bp, Homo sapiens
ctacatttttcaccgagcctct

SEQ ID NO: 8559432 - DNA, 22 bp, Homo sapiens
ctacatttttcaccgagcctct

SEQ ID NO: 8559433 - DNA, 22 bp, Homo sapiens
cgcaggctcggttcacagagca

SEQ ID NO: 8559434 - DNA, 22 bp, Homo sapiens
aggtttctgctgtcctccttct

SEQ ID NO: 8559435 - DNA, 22 bp, Homo sapiens
aggtttctgcaatgtgtgtaca

SEQ ID NO: 8559436 - DNA, 22 bp, Homo sapiens
cgcagggccgcgagcgggacca

SEQ ID NO: 8559437 - DNA, 22 bp, Homo sapiens
cgcagggccgcgagcgggacca

SEQ ID NO: 8559438 - DNA, 22 bp, Homo sapiens
aggtttcttcttaggaatatgt

SEQ ID NO: 8559439 - DNA, 22 bp, Homo sapiens
aggtttctttatgctgctagaa

SEQ ID NO: 8559440 - DNA, 22 bp, Homo sapiens
aggtttctggaaaggttttgct

SEQ ID NO: 8559441 - DNA, 22 bp, Homo sapiens
aggtttctggatttattatggc

SEQ ID NO: 8559442 - DNA, 22 bp, Homo sapiens
aggtttggtttgacaagactga

SEQ ID NO: 8559443 - DNA, 18 bp, Homo sapiens
aggtttggtggaaacata

SEQ ID NO: 8559444 - DNA, 22 bp, Homo sapiens
agtaaaaatatgcttgtggcta

SEQ ID NO: 8559445 - DNA, 22 bp, Homo sapiens
agtaaaaagttcagaatggttg

SEQ ID NO: 8559446 - DNA, 19 bp, Homo sapiens
cgcaggagccgaggtgacc

SEQ ID NO: 8559447 - DNA, 22 bp, Homo sapiens
cgcaggaagacaagggtggaaa

SEQ ID NO: 8559448 - DNA, 22 bp, Homo sapiens
cgaggccatgcatgctgaggac

SEQ ID NO: 8559449 - DNA, 17 bp, Homo sapiens
cctgttgttgcctttgc

SEQ ID NO: 8559450 - DNA, 17 bp, Homo sapiens
cctgttgttgcctttgc

SEQ ID NO: 8559451 - DNA, 22 bp, Homo sapiens
cgaggcggcggaagtgcccgta

SEQ ID NO: 8559452 - DNA, 22 bp, Homo sapiens
cgaggccatgcatgctgaggac

SEQ ID NO: 8559453 - DNA, 23 bp, Homo sapiens
cctgttgggacagctttaccaga

SEQ ID NO: 8559454 - DNA, 22 bp, Homo sapiens
cctgttgtcatggaataagtta

SEQ ID NO: 8559455 - DNA, 22 bp, Homo sapiens
cctgttgctctgcatgagttta

SEQ ID NO: 8559456 - DNA, 22 bp, Homo sapiens
cctgttccattcatatcctatt

SEQ ID NO: 8559457 - DNA, 18 bp, Homo sapiens
cctgtgtgtgttgcaggc

SEQ ID NO: 8559458 - DNA, 22 bp, Homo sapiens
cctgtgttagttatgggtctct

SEQ ID NO: 8559459 - DNA, 22 bp, Homo sapiens
cctgtgttctaatccatctcag

SEQ ID NO: 8559460 - DNA, 22 bp, Homo sapiens
cctgtgtttagatatgatgctg

SEQ ID NO: 8559461 - DNA, 19 bp, Homo sapiens
cctgtgttgggagtgtgag

SEQ ID NO: 8559462 - DNA, 17 bp, Homo sapiens
cctgtgtttgctccttc

SEQ ID NO: 8559463 - DNA, 22 bp, Homo sapiens
agtacaagtagaatgctacaag

SEQ ID NO: 8559464 - DNA, 21 bp, Homo sapiens
cgggctggccgggccctcacc

SEQ ID NO: 8559465 - DNA, 21 bp, Homo sapiens
cgggctggccgggccctcacc

SEQ ID NO: 8559466 - DNA, 22 bp, Homo sapiens
agtacaaattatagcgcttgga

SEQ ID NO: 8559467 - DNA, 22 bp, Homo sapiens
agtacaaattatagcgcttgga

SEQ ID NO: 8559468 - DNA, 23 bp, Homo sapiens
agtacaataagtataattctttc

SEQ ID NO: 8559469 - DNA, 20 bp, Homo sapiens
agtacaatgtatgattcaga

SEQ ID NO: 8559470 - DNA, 22 bp, Homo sapiens
agtacaatgtctgacacagtag

SEQ ID NO: 8559471 - DNA, 22 bp, Homo sapiens
agtacaatgtctgacacagtag

SEQ ID NO: 8559472 - DNA, 22 bp, Homo sapiens
cgggctccgggtctttgcagtc

SEQ ID NO: 8559473 - DNA, 22 bp, Homo sapiens
cgggctcaggaggaaacaggag

SEQ ID NO: 8559474 - DNA, 18 bp, Homo sapiens
cgggcgggcgcctggccc

SEQ ID NO: 8559475 - DNA, 18 bp, Homo sapiens
cgggcgggcgcctggccc

SEQ ID NO: 8559476 - DNA, 22 bp, Homo sapiens
cgggcgcactccgggcagctgt

SEQ ID NO: 8559477 - DNA, 22 bp, Homo sapiens
cgggcaaggcgagactaggccc

SEQ ID NO: 8559478 - DNA, 22 bp, Homo sapiens
cgggcagattgggaaggttcat

SEQ ID NO: 8559479 - DNA, 22 bp, Homo sapiens
cgggcagatcacacagggcttg

SEQ ID NO: 8559480 - DNA, 22 bp, Homo sapiens
cgggcagcggcgtggccatggt

SEQ ID NO: 8559481 - DNA, 17 bp, Homo sapiens
cgggcatggagggcagg

SEQ ID NO: 8559482 - DNA, 17 bp, Homo sapiens
cgggcccgcggccgctc

SEQ ID NO: 8559483 - DNA, 17 bp, Homo sapiens
cgggcatggagggcagg

SEQ ID NO: 8559484 - DNA, 17 bp, Homo sapiens
cgggcatggagggcagg

SEQ ID NO: 8559485 - DNA, 22 bp, Homo sapiens
agtacacagaattctacttgtt

SEQ ID NO: 8559486 - DNA, 22 bp, Homo sapiens
agtacacacagtagaatagagt

SEQ ID NO: 8559487 - DNA, 22 bp, Homo sapiens
agtacacacagtagaatagagt

SEQ ID NO: 8559488 - DNA, 22 bp, Homo sapiens
agtacacagtagactttctcat

SEQ ID NO: 8559489 - DNA, 22 bp, Homo sapiens
agtacacagagttattttgtgt

SEQ ID NO: 8559490 - DNA, 22 bp, Homo sapiens
agtacacagaattctacttgtt

SEQ ID NO: 8559491 - DNA, 22 bp, Homo sapiens
agtacaatttaatgaagatagc

SEQ ID NO: 8559492 - DNA, 22 bp, Homo sapiens
agtacaatttaatgaagatagc

SEQ ID NO: 8559493 - DNA, 22 bp, Homo sapiens
agtacaatttaatgaagatagc

SEQ ID NO: 8559494 - DNA, 22 bp, Homo sapiens
agtacaattatatttagatggt

SEQ ID NO: 8559495 - DNA, 22 bp, Homo sapiens
agtacactggcaaatgtggtgg

SEQ ID NO: 8559496 - DNA, 22 bp, Homo sapiens
agtacactcaagaaaccggtaa

SEQ ID NO: 8559497 - DNA, 22 bp, Homo sapiens
agtacactatggtaactggagt

SEQ ID NO: 8559498 - DNA, 22 bp, Homo sapiens
agtacactatggtaactggagt

SEQ ID NO: 8559499 - DNA, 22 bp, Homo sapiens
agtacagacctgtctcttcctg

SEQ ID NO: 8559500 - DNA, 22 bp, Homo sapiens
agtacagtagggtgctgttagt

SEQ ID NO: 8559501 - DNA, 22 bp, Homo sapiens
ctaaacttttataacattgaga

SEQ ID NO: 8559502 - DNA, 22 bp, Homo sapiens
ctaaacttcttggcaattttat

SEQ ID NO: 8559503 - DNA, 22 bp, Homo sapiens
ctaagaaatgttgtgaatgcca

SEQ ID NO: 8559504 - DNA, 22 bp, Homo sapiens
ctaagacatgccctgcatgata

SEQ ID NO: 8559505 - DNA, 22 bp, Homo sapiens
ctaagaaggaggaaaagtgcca

SEQ ID NO: 8559506 - DNA, 20 bp, Homo sapiens
ctaagaggaggactaggttt

SEQ ID NO: 8559507 - DNA, 22 bp, Homo sapiens
ctaagaggaagtactctgttat

SEQ ID NO: 8559508 - DNA, 22 bp, Homo sapiens
ctaagaggaagtactctgttat

SEQ ID NO: 8559509 - DNA, 18 bp, Homo sapiens
ctaagaggtcgtttctca

SEQ ID NO: 8559510 - DNA, 20 bp, Homo sapiens
ctaagaggtccttccacatc

SEQ ID NO: 8559511 - DNA, 20 bp, Homo sapiens
ctaagaggtccttccacatc

SEQ ID NO: 8559512 - DNA, 22 bp, Homo sapiens
cctgggctccactccaagagca

SEQ ID NO: 8559513 - DNA, 22 bp, Homo sapiens
cctgggctcacagccaaggctc

SEQ ID NO: 8559514 - DNA, 22 bp, Homo sapiens
cctgggctcaagtgatggtccc

SEQ ID NO: 8559515 - DNA, 22 bp, Homo sapiens
cctgggcataaatcactccaag

SEQ ID NO: 8559516 - DNA, 22 bp, Homo sapiens
cctgggcataaatcactccaag

SEQ ID NO: 8559517 - DNA, 22 bp, Homo sapiens
cctgggcataaatcactccaag

SEQ ID NO: 8559518 - DNA, 22 bp, Homo sapiens
cctggctctggttccctcagct

SEQ ID NO: 8559519 - DNA, 22 bp, Homo sapiens
cctggctctgtcctcgcgcaaa

SEQ ID NO: 8559520 - DNA, 22 bp, Homo sapiens
cctggctctgcgtgcagctccg

SEQ ID NO: 8559521 - DNA, 22 bp, Homo sapiens
cctggctctgggatcttcgctt

SEQ ID NO: 8559522 - DNA, 22 bp, Homo sapiens
cctgtcagttgctgtcagggat

SEQ ID NO: 8559523 - DNA, 22 bp, Homo sapiens
cctgtcagttgctgtcagggat

SEQ ID NO: 8559524 - DNA, 22 bp, Homo sapiens
cctgtcagggtttgcctcagaa

SEQ ID NO: 8559525 - DNA, 22 bp, Homo sapiens
cctgtcagctgatggctatgta

SEQ ID NO: 8559526 - DNA, 22 bp, Homo sapiens
cctgggctttcaaaaccagcct

SEQ ID NO: 8559527 - DNA, 22 bp, Homo sapiens
cctgggctttcaaaaccagcct

SEQ ID NO: 8559528 - DNA, 22 bp, Homo sapiens
cctgggctttcaaaaccagcct

SEQ ID NO: 8559529 - DNA, 22 bp, Homo sapiens
cctgggctttcggcggcttcct

SEQ ID NO: 8559530 - DNA, 22 bp, Homo sapiens
cctgggctttgagggcaggatg

SEQ ID NO: 8559531 - DNA, 22 bp, Homo sapiens
cctgggcttgcatctgtgctgg

SEQ ID NO: 8559532 - DNA, 22 bp, Homo sapiens
cctgggcttgcatctgtgctgg

SEQ ID NO: 8559533 - DNA, 22 bp, Homo sapiens
cctgggcttggttgttgagaac

SEQ ID NO: 8559534 - DNA, 22 bp, Homo sapiens
cctgggctcgcgcacttcaccc

SEQ ID NO: 8559535 - DNA, 22 bp, Homo sapiens
cctgggcttctgtctagatgtt

SEQ ID NO: 8559536 - DNA, 22 bp, Homo sapiens
cctgggcttctgtctagatgtt

SEQ ID NO: 8559537 - DNA, 22 bp, Homo sapiens
cctgggcttctgtctagatgtt

SEQ ID NO: 8559538 - DNA, 20 bp, Homo sapiens
cctgggctccaggagccccg

SEQ ID NO: 8559539 - DNA, 20 bp, Homo sapiens
cctgggctccaggagccccg

SEQ ID NO: 8559540 - DNA, 20 bp, Homo sapiens
cctgggctccaggagccccg

SEQ ID NO: 8559541 - DNA, 20 bp, Homo sapiens
cctgggctccaggagccccg

SEQ ID NO: 8559542 - DNA, 21 bp, Homo sapiens
aggtggggctgcacctctgct

SEQ ID NO: 8559543 - DNA, 21 bp, Homo sapiens
aggtggggctgcacctctgct

SEQ ID NO: 8559544 - DNA, 21 bp, Homo sapiens
aggtggggctgcacctctgct

SEQ ID NO: 8559545 - DNA, 22 bp, Homo sapiens
aggtggggcccaccaatttgca

SEQ ID NO: 8559546 - DNA, 22 bp, Homo sapiens
aggtggggagtatatgtaattg

SEQ ID NO: 8559547 - DNA, 22 bp, Homo sapiens
aggtggggagtatatgtaattg

SEQ ID NO: 8559548 - DNA, 22 bp, Homo sapiens
aggtggggccaaatgctacagt

SEQ ID NO: 8559549 - DNA, 22 bp, Homo sapiens
aggtggggccaaatgctacagt

SEQ ID NO: 8559550 - DNA, 22 bp, Homo sapiens
aggtggggaggagtgtctcttt

SEQ ID NO: 8559551 - DNA, 22 bp, Homo sapiens
aggtggggaggagtgtctcttt

SEQ ID NO: 8559552 - DNA, 22 bp, Homo sapiens
aggtggggaggagtgtctcttt

SEQ ID NO: 8559553 - DNA, 22 bp, Homo sapiens
aggtggggaggagtgtctcttt

SEQ ID NO: 8559554 - DNA, 22 bp, Homo sapiens
aggtgggcaatgaggcctgagt

SEQ ID NO: 8559555 - DNA, 22 bp, Homo sapiens
aggtgggcacacctcccttctc

SEQ ID NO: 8559556 - DNA, 22 bp, Homo sapiens
cctgtcctccaagagcacatct

SEQ ID NO: 8559557 - DNA, 22 bp, Homo sapiens
cctgtcctccaagagcacatct

SEQ ID NO: 8559558 - DNA, 22 bp, Homo sapiens
cctgtctacataactgtgtgaa

SEQ ID NO: 8559559 - DNA, 20 bp, Homo sapiens
cctgtctcacgttccgcccc

SEQ ID NO: 8559560 - DNA, 22 bp, Homo sapiens
cctgtctccctggcatggctca

SEQ ID NO: 8559561 - DNA, 20 bp, Homo sapiens
cctgtctcctcttacctggc

SEQ ID NO: 8559562 - DNA, 22 bp, Homo sapiens
cctgtctccctggcatggctca

SEQ ID NO: 8559563 - DNA, 22 bp, Homo sapiens
cctgtcccccaggcctgtacca

SEQ ID NO: 8559564 - DNA, 22 bp, Homo sapiens
cctgtcataatgtccgatgtca

SEQ ID NO: 8559565 - DNA, 22 bp, Homo sapiens
cctgtcatactaacgtagtggg

SEQ ID NO: 8559566 - DNA, 22 bp, Homo sapiens
cctgtgcatgccagggtacacc

SEQ ID NO: 8559567 - DNA, 22 bp, Homo sapiens
cctgtgcatccggtggtcattg

SEQ ID NO: 8559568 - DNA, 22 bp, Homo sapiens
cctgtgagtcaacccctccttg

SEQ ID NO: 8559569 - DNA, 20 bp, Homo sapiens
cctgtctcctcttacctggc

SEQ ID NO: 8559570 - DNA, 22 bp, Homo sapiens
cctgtgacgtgtctcctggcac

SEQ ID NO: 8559571 - DNA, 22 bp, Homo sapiens
cctgtgaggtcttgcatgtgaa

SEQ ID NO: 8559572 - DNA, 22 bp, Homo sapiens
cctgtgaggtcatctgtggtaa

SEQ ID NO: 8559573 - DNA, 22 bp, Homo sapiens
cctgtgaggtcatctgtggtaa

SEQ ID NO: 8559574 - DNA, 22 bp, Homo sapiens
cctgccagcgcttatctctcgg

SEQ ID NO: 8559575 - DNA, 22 bp, Homo sapiens
cctgccagcgcttatctctcgg

SEQ ID NO: 8559576 - DNA, 22 bp, Homo sapiens
cctgccagctgtgggccagcct

SEQ ID NO: 8559577 - DNA, 21 bp, Homo sapiens
cctgccaggaaactgagtgtc

SEQ ID NO: 8559578 - DNA, 21 bp, Homo sapiens
cctgccaggaaactgagtgtc

SEQ ID NO: 8559579 - DNA, 21 bp, Homo sapiens
cctgccaggaaactgagtgtc

SEQ ID NO: 8559580 - DNA, 22 bp, Homo sapiens
cctgccagctgtgggccagcct

SEQ ID NO: 8559581 - DNA, 22 bp, Homo sapiens
aggtacagcaatataagaggtc

SEQ ID NO: 8559582 - DNA, 22 bp, Homo sapiens
aggtacagcaatataagaggtc

SEQ ID NO: 8559583 - DNA, 22 bp, Homo sapiens
aggtacagggtgaaagtttatg

SEQ ID NO: 8559584 - DNA, 22 bp, Homo sapiens
aggtacagggtgaaagtttatg

SEQ ID NO: 8559585 - DNA, 21 bp, Homo sapiens
aggtacaggtcttgtgagtct

SEQ ID NO: 8559586 - DNA, 22 bp, Homo sapiens
aggtaggccctgagtgctgttg

SEQ ID NO: 8559587 - DNA, 19 bp, Homo sapiens
aggtaggcagtggcatgga

SEQ ID NO: 8559588 - DNA, 22 bp, Homo sapiens
aggtaggttaaatttctttatc

SEQ ID NO: 8559589 - DNA, 22 bp, Homo sapiens
aggtagggttaatggagatata

SEQ ID NO: 8559590 - DNA, 18 bp, Homo sapiens
cctgcagcccaggaggcc

SEQ ID NO: 8559591 - DNA, 18 bp, Homo sapiens
cctgcagcccaggaggcc

SEQ ID NO: 8559592 - DNA, 22 bp, Homo sapiens
cctgcagaggtcaggccagaaa

SEQ ID NO: 8559593 - DNA, 22 bp, Homo sapiens
cctgcagatgtgggacagctgt

SEQ ID NO: 8559594 - DNA, 21 bp, Homo sapiens
cctgcagcaccagaaggagat

SEQ ID NO: 8559595 - DNA, 22 bp, Homo sapiens
cctgcagagggactggcaggaa

SEQ ID NO: 8559596 - DNA, 22 bp, Homo sapiens
cctgcagagccacgtgccagcg

SEQ ID NO: 8559597 - DNA, 22 bp, Homo sapiens
cctgcagagccacgtgccagcg

SEQ ID NO: 8559598 - DNA, 22 bp, Homo sapiens
cctgcagagcaggagaggcatc

SEQ ID NO: 8559599 - DNA, 22 bp, Homo sapiens
cctgcagagccacgtgccagcg

SEQ ID NO: 8559600 - DNA, 22 bp, Homo sapiens
cctgccagatcccctgagctga

SEQ ID NO: 8559601 - DNA, 22 bp, Homo sapiens
cctgccagcatggcttatctcc

SEQ ID NO: 8559602 - DNA, 22 bp, Homo sapiens
cctgccagccagatcactcgcc

SEQ ID NO: 8559603 - DNA, 22 bp, Homo sapiens
cctgccagcccccatagagaca

SEQ ID NO: 8559604 - DNA, 22 bp, Homo sapiens
cctgccagcccgcgttcatgcc

SEQ ID NO: 8559605 - DNA, 22 bp, Homo sapiens
cctgccagcccgcgttcatgcc

SEQ ID NO: 8559606 - DNA, 22 bp, Homo sapiens
cctgccagcccgcgttcatgcc

SEQ ID NO: 8559607 - DNA, 23 bp, Homo sapiens
cctgcagctgccacgccctgctc

SEQ ID NO: 8559608 - DNA, 22 bp, Homo sapiens
cctgcagctccggatttctggg

SEQ ID NO: 8559609 - DNA, 22 bp, Homo sapiens
cctgccagatcccctgagctga

SEQ ID NO: 8559610 - DNA, 23 bp, Homo sapiens
cctgcagctgctggggctccacc

SEQ ID NO: 8559611 - DNA, 22 bp, Homo sapiens
aggtccagttttctgacaaggg

SEQ ID NO: 8559612 - DNA, 22 bp, Homo sapiens
aggtcattggggactatctccg

SEQ ID NO: 8559613 - DNA, 22 bp, Homo sapiens
aggtcattgaagttattttctt

SEQ ID NO: 8559614 - DNA, 22 bp, Homo sapiens
aggtcattccagccattcccct

SEQ ID NO: 8559615 - DNA, 22 bp, Homo sapiens
aggtcattccttgtcttcttgc

SEQ ID NO: 8559616 - DNA, 22 bp, Homo sapiens
cctggcacacggtggcattcaa

SEQ ID NO: 8559617 - DNA, 18 bp, Homo sapiens
cctggcacactggctcat

SEQ ID NO: 8559618 - DNA, 18 bp, Homo sapiens
cctggcacactggctcat

SEQ ID NO: 8559619 - DNA, 22 bp, Homo sapiens
cctggcacagagcggtggtcac

SEQ ID NO: 8559620 - DNA, 22 bp, Homo sapiens
aggtcatgatccattggtgagt

SEQ ID NO: 8559621 - DNA, 22 bp, Homo sapiens
cctggcacaagagcagcattgg

SEQ ID NO: 8559622 - DNA, 23 bp, Homo sapiens
cctggcacacagttgacatggaa

SEQ ID NO: 8559623 - DNA, 22 bp, Homo sapiens
cctggatgatccatgtcatgga

SEQ ID NO: 8559624 - DNA, 22 bp, Homo sapiens
cctggatgatccatgtcatgga

SEQ ID NO: 8559625 - DNA, 22 bp, Homo sapiens
cctggatgatccatgtcatgga

SEQ ID NO: 8559626 - DNA, 22 bp, Homo sapiens
cctggattcaagtctttctttc

SEQ ID NO: 8559627 - DNA, 22 bp, Homo sapiens
cctggagtgacaggtgtagcct

SEQ ID NO: 8559628 - DNA, 22 bp, Homo sapiens
cctggagtggggtccgtgcatg

SEQ ID NO: 8559629 - DNA, 22 bp, Homo sapiens
cctggagttgaaggaaggtggg

SEQ ID NO: 8559630 - DNA, 22 bp, Homo sapiens
cctggatgatccatgtcatgga

SEQ ID NO: 8559631 - DNA, 22 bp, Homo sapiens
cctggagtaccgtggccatcca

SEQ ID NO: 8559632 - DNA, 22 bp, Homo sapiens
cctggagtaccgtggccatcca

SEQ ID NO: 8559633 - DNA, 22 bp, Homo sapiens
cctggaggtggaggttgcagtg

SEQ ID NO: 8559634 - DNA, 23 bp, Homo sapiens
aggtaggttattgctgctacctg

SEQ ID NO: 8559635 - DNA, 19 bp, Homo sapiens
cctggagtcgcgctgcctc

SEQ ID NO: 8559636 - DNA, 22 bp, Homo sapiens
cctggagtctgtgactttcctc

SEQ ID NO: 8559637 - DNA, 22 bp, Homo sapiens
aggtccctgcagcagactgcca

SEQ ID NO: 8559638 - DNA, 19 bp, Homo sapiens
aggtccctccctcgaggct

SEQ ID NO: 8559639 - DNA, 22 bp, Homo sapiens
aggtcccaggcatagctggtct

SEQ ID NO: 8559640 - DNA, 21 bp, Homo sapiens
aggtcccaggtttgggcagca

SEQ ID NO: 8559641 - DNA, 22 bp, Homo sapiens
aggtcccagtgttagggtgaca

SEQ ID NO: 8559642 - DNA, 21 bp, Homo sapiens
aggtcccaggtttgggcagca

SEQ ID NO: 8559643 - DNA, 21 bp, Homo sapiens
aggtcccaggtttgggcagca

SEQ ID NO: 8559644 - DNA, 22 bp, Homo sapiens
aggtcccagtgttagggtgaca

SEQ ID NO: 8559645 - DNA, 22 bp, Homo sapiens
cctggctctgcagccactccag

SEQ ID NO: 8559646 - DNA, 22 bp, Homo sapiens
cctggctctgcagccactccag

SEQ ID NO: 8559647 - DNA, 22 bp, Homo sapiens
cctggctctgaggtatgcctgg

SEQ ID NO: 8559648 - DNA, 22 bp, Homo sapiens
aggtcctgagggttcgtctgca

SEQ ID NO: 8559649 - DNA, 22 bp, Homo sapiens
caagtcaaagactagaactagt

SEQ ID NO: 8559650 - DNA, 22 bp, Homo sapiens
caagtcaactcaaattgttatc

SEQ ID NO: 8559651 - DNA, 22 bp, Homo sapiens
gctgtggcctggcgcagagctg

SEQ ID NO: 8559652 - DNA, 22 bp, Homo sapiens
gctgtggcctggcgcagagctg

SEQ ID NO: 8559653 - DNA, 22 bp, Homo sapiens
caagtcaagcatgcccttattt

SEQ ID NO: 8559654 - DNA, 22 bp, Homo sapiens
gctgttcagggcactcatgggc

SEQ ID NO: 8559655 - DNA, 22 bp, Homo sapiens
gctgttcctgcttagaggtcgg

SEQ ID NO: 8559656 - DNA, 22 bp, Homo sapiens
gctgttcccatgtggggctcag

SEQ ID NO: 8559657 - DNA, 22 bp, Homo sapiens
gctgttctctgtaacatgcatt

SEQ ID NO: 8559658 - DNA, 22 bp, Homo sapiens
gctgttctgcgtcccaggctgg

SEQ ID NO: 8559659 - DNA, 21 bp, Homo sapiens
gctgttgcccgccgcctcttc

SEQ ID NO: 8559660 - DNA, 22 bp, Homo sapiens
gctgttctttgcatctctggtg

SEQ ID NO: 8559661 - DNA, 22 bp, Homo sapiens
caaggtttacattgggctatca

SEQ ID NO: 8559662 - DNA, 22 bp, Homo sapiens
caaggtgccatgctgggcgggg

SEQ ID NO: 8559663 - DNA, 22 bp, Homo sapiens
caaggtgccatgctgggcgggg

SEQ ID NO: 8559664 - DNA, 22 bp, Homo sapiens
caaggtttgaaaacgccatggc

SEQ ID NO: 8559665 - DNA, 22 bp, Homo sapiens
caaggttttgcttgtaagggaa

SEQ ID NO: 8559666 - DNA, 22 bp, Homo sapiens
caaggttttggaagattttcgt

SEQ ID NO: 8559667 - DNA, 22 bp, Homo sapiens
caaggtttcgagttcccaacca

SEQ ID NO: 8559668 - DNA, 22 bp, Homo sapiens
caaggtttctatgctcaaagga

SEQ ID NO: 8559669 - DNA, 22 bp, Homo sapiens
caaggtttactttatgatccag

SEQ ID NO: 8559670 - DNA, 22 bp, Homo sapiens
caaggtcacataacttgtcaaa

SEQ ID NO: 8559671 - DNA, 20 bp, Homo sapiens
caagggtttgcattggcttt

SEQ ID NO: 8559672 - DNA, 22 bp, Homo sapiens
caaggtgaacttgctgtacagc

SEQ ID NO: 8559673 - DNA, 22 bp, Homo sapiens
caatgtcagagaagctcatatc

SEQ ID NO: 8559674 - DNA, 22 bp, Homo sapiens
caatgtcagtcaagcagcaaat

SEQ ID NO: 8559675 - DNA, 22 bp, Homo sapiens
caatgtctgaccgttttgccca

SEQ ID NO: 8559676 - DNA, 22 bp, Homo sapiens
caatgtcagaattacagttgat

SEQ ID NO: 8559677 - DNA, 22 bp, Homo sapiens
caatgtcaaggagaccaaaacg

SEQ ID NO: 8559678 - DNA, 22 bp, Homo sapiens
caatgtatcaagaagcatcagt

SEQ ID NO: 8559679 - DNA, 22 bp, Homo sapiens
caatgtgtttgcatattaaaat

SEQ ID NO: 8559680 - DNA, 22 bp, Homo sapiens
caatgtttgtgatctactgact

SEQ ID NO: 8559681 - DNA, 21 bp, Homo sapiens
caatgtctgctctctgcctag

SEQ ID NO: 8559682 - DNA, 22 bp, Homo sapiens
caatgtgtgtgtttttctcaac

SEQ ID NO: 8559683 - DNA, 22 bp, Homo sapiens
caatgtgtttgcatattaaaat

SEQ ID NO: 8559684 - DNA, 22 bp, Homo sapiens
caatgtgtgcttacaggccagt

SEQ ID NO: 8559685 - DNA, 22 bp, Homo sapiens
caatgtgtcaggaaaagggcca

SEQ ID NO: 8559686 - DNA, 22 bp, Homo sapiens
caatgtcttctatagttactca

SEQ ID NO: 8559687 - DNA, 22 bp, Homo sapiens
gctttgaagacttttccagggt

SEQ ID NO: 8559688 - DNA, 22 bp, Homo sapiens
gctttgaagtctgtgtcttttg

SEQ ID NO: 8559689 - DNA, 22 bp, Homo sapiens
gctttgcctgtagcattggcct

SEQ ID NO: 8559690 - DNA, 22 bp, Homo sapiens
caataactgctgaggagaagca

SEQ ID NO: 8559691 - DNA, 22 bp, Homo sapiens
gcttggggagctcagtgtcctt

SEQ ID NO: 8559692 - DNA, 22 bp, Homo sapiens
gctttctgggctatagaacggg

SEQ ID NO: 8559693 - DNA, 22 bp, Homo sapiens
gctttctggagcctgggggaac

SEQ ID NO: 8559694 - DNA, 22 bp, Homo sapiens
gctttctgctctgtaaaatggg

SEQ ID NO: 8559695 - DNA, 22 bp, Homo sapiens
gctttctggttctcaaagcact

SEQ ID NO: 8559696 - DNA, 22 bp, Homo sapiens
gctttctggttctcaaagcact

SEQ ID NO: 8559697 - DNA, 22 bp, Homo sapiens
gctttctgtgcagtgaacacta

SEQ ID NO: 8559698 - DNA, 21 bp, Homo sapiens
gctttctgtggactctgcacc

SEQ ID NO: 8559699 - DNA, 21 bp, Homo sapiens
gctttctgtggactctgcacc

SEQ ID NO: 8559700 - DNA, 22 bp, Homo sapiens
gctttctgtggtgatgtaaagg

SEQ ID NO: 8559701 - DNA, 22 bp, Homo sapiens
gctttctgtaggtagttactgt

SEQ ID NO: 8559702 - DNA, 18 bp, Homo sapiens
gctttctgtgcagcggag

SEQ ID NO: 8559703 - DNA, 18 bp, Homo sapiens
gctttctgtgcagcggag

SEQ ID NO: 8559704 - DNA, 18 bp, Homo sapiens
gctttctgtagaaaaggg

SEQ ID NO: 8559705 - DNA, 22 bp, Homo sapiens
gctttctggtttgtgctacagg

SEQ ID NO: 8559706 - DNA, 18 bp, Homo sapiens
gctttctgtagaaaaggg

SEQ ID NO: 8559707 - DNA, 22 bp, Homo sapiens
caagttttagaaatatctggat

SEQ ID NO: 8559708 - DNA, 22 bp, Homo sapiens
caagttttagaaatatctggat

SEQ ID NO: 8559709 - DNA, 22 bp, Homo sapiens
caagttttagcaagtggaaagg

SEQ ID NO: 8559710 - DNA, 22 bp, Homo sapiens
caagtttgtgttctatcattct

SEQ ID NO: 8559711 - DNA, 22 bp, Homo sapiens
caagtttgctgatccttgtttt

SEQ ID NO: 8559712 - DNA, 21 bp, Homo sapiens
caataaactgcacattgagac

SEQ ID NO: 8559713 - DNA, 22 bp, Homo sapiens
caagttttgattttgcagtaaa

SEQ ID NO: 8559714 - DNA, 22 bp, Homo sapiens
caataactagtaattattccgg

SEQ ID NO: 8559715 - DNA, 22 bp, Homo sapiens
caataactgctaaattccctgt

SEQ ID NO: 8559716 - DNA, 22 bp, Homo sapiens
caataaagaagatttttgcaat

SEQ ID NO: 8559717 - DNA, 22 bp, Homo sapiens
caataaagaagatttttgcaat

SEQ ID NO: 8559718 - DNA, 22 bp, Homo sapiens
caagggaagaggacagggacct

SEQ ID NO: 8559719 - DNA, 22 bp, Homo sapiens
caagggggcaggatcacacttg

SEQ ID NO: 8559720 - DNA, 22 bp, Homo sapiens
caagggtgaaggcagaggacat

SEQ ID NO: 8559721 - DNA, 22 bp, Homo sapiens
caagggtggtattgggagcata

SEQ ID NO: 8559722 - DNA, 22 bp, Homo sapiens
caagggtggtattgggagcata

SEQ ID NO: 8559723 - DNA, 22 bp, Homo sapiens
caagggtggtattgggagcata

SEQ ID NO: 8559724 - DNA, 20 bp, Homo sapiens
caagggtttgcattggcttt

SEQ ID NO: 8559725 - DNA, 22 bp, Homo sapiens
gctggctgtatcacctggccag

SEQ ID NO: 8559726 - DNA, 22 bp, Homo sapiens
caaggcttcacgtccccagtgc

SEQ ID NO: 8559727 - DNA, 21 bp, Homo sapiens
gctggctgtcccagggaagca

SEQ ID NO: 8559728 - DNA, 22 bp, Homo sapiens
caaggcttgaattctgatgggt

SEQ ID NO: 8559729 - DNA, 22 bp, Homo sapiens
gctggctgtatcacctggccag

SEQ ID NO: 8559730 - DNA, 22 bp, Homo sapiens
gctggctgtatcacctggccag

SEQ ID NO: 8559731 - DNA, 22 bp, Homo sapiens
gctggctggtccagcaggggct

SEQ ID NO: 8559732 - DNA, 22 bp, Homo sapiens
gctggctgggtccctgagaggc

SEQ ID NO: 8559733 - DNA, 22 bp, Homo sapiens
gctggctgggtccctgagaggc

SEQ ID NO: 8559734 - DNA, 22 bp, Homo sapiens
gctggctgggtccctgagaggc

SEQ ID NO: 8559735 - DNA, 22 bp, Homo sapiens
gctggctgggtccctgagaggc

SEQ ID NO: 8559736 - DNA, 22 bp, Homo sapiens
gctggctgggacagattccatt

SEQ ID NO: 8559737 - DNA, 22 bp, Homo sapiens
gctggctggctgtgcaaaggca

SEQ ID NO: 8559738 - DNA, 22 bp, Homo sapiens
caaggccttcgtctcctagctt

SEQ ID NO: 8559739 - DNA, 22 bp, Homo sapiens
caaggccttcgtctcctagctt

SEQ ID NO: 8559740 - DNA, 22 bp, Homo sapiens
gctggctggctgtgcaaaggca

SEQ ID NO: 8559741 - DNA, 22 bp, Homo sapiens
caaggcctaatcatactgctaa

SEQ ID NO: 8559742 - DNA, 22 bp, Homo sapiens
caaggcctgcctctggcagaaa

SEQ ID NO: 8559743 - DNA, 22 bp, Homo sapiens
caaggcctcctgggcccagaga

SEQ ID NO: 8559744 - DNA, 22 bp, Homo sapiens
caaggcctatgcacacctagga

SEQ ID NO: 8559745 - DNA, 22 bp, Homo sapiens
caaggcaggaagcctgtcttat

SEQ ID NO: 8559746 - DNA, 22 bp, Homo sapiens
gctggaggcagttcagacacca

SEQ ID NO: 8559747 - DNA, 22 bp, Homo sapiens
gctggaggatggactggaagaa

SEQ ID NO: 8559748 - DNA, 22 bp, Homo sapiens
caagcagggatactgcagggag

SEQ ID NO: 8559749 - DNA, 22 bp, Homo sapiens
caagcatactcattccagactc

SEQ ID NO: 8559750 - DNA, 22 bp, Homo sapiens
caagcatgtcttcttaagcaat

SEQ ID NO: 8559751 - DNA, 21 bp, Homo sapiens
caagccagaccaatagcagcc

SEQ ID NO: 8559752 - DNA, 22 bp, Homo sapiens
caagccagtcagctcagtagat

SEQ ID NO: 8559753 - DNA, 22 bp, Homo sapiens
gctggaggatcacttgagccca

SEQ ID NO: 8559754 - DNA, 22 bp, Homo sapiens
gctggaggatggactggaagaa

SEQ ID NO: 8559755 - DNA, 22 bp, Homo sapiens
gctggagcttgagaggacaggg

SEQ ID NO: 8559756 - DNA, 22 bp, Homo sapiens
gctggaggaggaagtgtgaggg

SEQ ID NO: 8559757 - DNA, 19 bp, Homo sapiens
caaatgggacaggaaggca

SEQ ID NO: 8559758 - DNA, 20 bp, Homo sapiens
caaatggcttttatttcctt

SEQ ID NO: 8559759 - DNA, 22 bp, Homo sapiens
caaatgtaaattcttttgaagc

SEQ ID NO: 8559760 - DNA, 22 bp, Homo sapiens
caaatgtaaattcttttgaagc

SEQ ID NO: 8559761 - DNA, 22 bp, Homo sapiens
caaatgtaaattcttttgaagc

SEQ ID NO: 8559762 - DNA, 22 bp, Homo sapiens
caaatgtaataaggagtttccc

SEQ ID NO: 8559763 - DNA, 22 bp, Homo sapiens
caaatgtaatggcaggttttgc

SEQ ID NO: 8559764 - DNA, 22 bp, Homo sapiens
caaatgtaatggcaggttttgc

SEQ ID NO: 8559765 - DNA, 22 bp, Homo sapiens
caaatgtaataaggagtttccc

SEQ ID NO: 8559766 - DNA, 22 bp, Homo sapiens
caaatgtatcagcccagggatt

SEQ ID NO: 8559767 - DNA, 22 bp, Homo sapiens
caaatgtatgttttcctatgta

SEQ ID NO: 8559768 - DNA, 22 bp, Homo sapiens
caaatgtataaatgtactttct

SEQ ID NO: 8559769 - DNA, 23 bp, Homo sapiens
caaatgtagtgtgtccacccctg

SEQ ID NO: 8559770 - DNA, 22 bp, Homo sapiens
caaatgtaattgcggtttttgc

SEQ ID NO: 8559771 - DNA, 22 bp, Homo sapiens
caagcagggatactgcagggag

SEQ ID NO: 8559772 - DNA, 22 bp, Homo sapiens
caagcagggagcatcaagggag

SEQ ID NO: 8559773 - DNA, 22 bp, Homo sapiens
caagcagccccaacatgaggat

SEQ ID NO: 8559774 - DNA, 22 bp, Homo sapiens
caagcagccccaacatgaggat

SEQ ID NO: 8559775 - DNA, 22 bp, Homo sapiens
caaatgtattctcacttcaggg

SEQ ID NO: 8559776 - DNA, 22 bp, Homo sapiens
caaatgtattctcacttcaggg

SEQ ID NO: 8559777 - DNA, 22 bp, Homo sapiens
caaatgtgacttttgggcttct

SEQ ID NO: 8559778 - DNA, 22 bp, Homo sapiens
caaatgtggtttctcagcattc

SEQ ID NO: 8559779 - DNA, 22 bp, Homo sapiens
caaatgtggtttctcagcattc

SEQ ID NO: 8559780 - DNA, 22 bp, Homo sapiens
caaatgtgtaaggaagtgttag

SEQ ID NO: 8559781 - DNA, 22 bp, Homo sapiens
ggaaggggagctaaatctactg

SEQ ID NO: 8559782 - DNA, 22 bp, Homo sapiens
ggaaggggagctggaaagggta

SEQ ID NO: 8559783 - DNA, 22 bp, Homo sapiens
ggaaggggagctggaaagggta

SEQ ID NO: 8559784 - DNA, 22 bp, Homo sapiens
ggaaggggagctggaaagggta

SEQ ID NO: 8559785 - DNA, 22 bp, Homo sapiens
ggaaggggagctggaaagggta

SEQ ID NO: 8559786 - DNA, 22 bp, Homo sapiens
ggaaggggagctggaaagggta

SEQ ID NO: 8559787 - DNA, 22 bp, Homo sapiens
ggaaggggagctggaaagggta

SEQ ID NO: 8559788 - DNA, 20 bp, Homo sapiens
ggaaggggcaaagtgtgtga

SEQ ID NO: 8559789 - DNA, 20 bp, Homo sapiens
ggaaggggcaaagtgtgtga

SEQ ID NO: 8559790 - DNA, 22 bp, Homo sapiens
cacagaactggttaatagcaga

SEQ ID NO: 8559791 - DNA, 22 bp, Homo sapiens
cacactgtctttatgagctgta

SEQ ID NO: 8559792 - DNA, 22 bp, Homo sapiens
cacagaagaatcatgctgtgtt

SEQ ID NO: 8559793 - DNA, 22 bp, Homo sapiens
cacagaagaatcatgctgtgtt

SEQ ID NO: 8559794 - DNA, 22 bp, Homo sapiens
ggaaggggccttgagcaaactg

SEQ ID NO: 8559795 - DNA, 22 bp, Homo sapiens
cacactgtccccttctccccag

SEQ ID NO: 8559796 - DNA, 22 bp, Homo sapiens
cacactgtctttatgagctgta

SEQ ID NO: 8559797 - DNA, 22 bp, Homo sapiens
cacactgtctttcagaatggtt

SEQ ID NO: 8559798 - DNA, 22 bp, Homo sapiens
cacagaatctgtgactccaaga

SEQ ID NO: 8559799 - DNA, 22 bp, Homo sapiens
cacagaatctgtgactccaaga

SEQ ID NO: 8559800 - DNA, 22 bp, Homo sapiens
cacagaatcggccgatggtgct

SEQ ID NO: 8559801 - DNA, 22 bp, Homo sapiens
cacagaataattcacatggctc

SEQ ID NO: 8559802 - DNA, 22 bp, Homo sapiens
cacagaatcatattgtcagttt

SEQ ID NO: 8559803 - DNA, 21 bp, Homo sapiens
cacagaatatacattttagtt

SEQ ID NO: 8559804 - DNA, 22 bp, Homo sapiens
cacagaagtttcatagtctcga

SEQ ID NO: 8559805 - DNA, 22 bp, Homo sapiens
cacagaataaattggtatcaga

SEQ ID NO: 8559806 - DNA, 22 bp, Homo sapiens
cacagaataattcacatggctc

SEQ ID NO: 8559807 - DNA, 22 bp, Homo sapiens
cacagaataaattggtatcaga

SEQ ID NO: 8559808 - DNA, 22 bp, Homo sapiens
cacacagatggtaagggaggga

SEQ ID NO: 8559809 - DNA, 22 bp, Homo sapiens
cacacagatggtaagggaggga

SEQ ID NO: 8559810 - DNA, 22 bp, Homo sapiens
cacacagatggtaagggaggga

SEQ ID NO: 8559811 - DNA, 22 bp, Homo sapiens
cacacagatggtaagggaggga

SEQ ID NO: 8559812 - DNA, 22 bp, Homo sapiens
cacacagatggtaagggaggga

SEQ ID NO: 8559813 - DNA, 22 bp, Homo sapiens
cacacagatggtaagggaggga

SEQ ID NO: 8559814 - DNA, 22 bp, Homo sapiens
cacacagacagctctctgaaga

SEQ ID NO: 8559815 - DNA, 22 bp, Homo sapiens
cacacagacagctctctgaaga

SEQ ID NO: 8559816 - DNA, 15 bp, Homo sapiens
cacacagacagcttg

SEQ ID NO: 8559817 - DNA, 22 bp, Homo sapiens
cacacagacagctctctgaaga

SEQ ID NO: 8559818 - DNA, 22 bp, Homo sapiens
caatgttttcaactgacaagta

SEQ ID NO: 8559819 - DNA, 22 bp, Homo sapiens
cacaattttaatacacagtcaa

SEQ ID NO: 8559820 - DNA, 22 bp, Homo sapiens
cacacagacagctctctgaaga

SEQ ID NO: 8559821 - DNA, 22 bp, Homo sapiens
cacacagacagctctctgaaga

SEQ ID NO: 8559822 - DNA, 22 bp, Homo sapiens
cacacagctagtgacaggagaa

SEQ ID NO: 8559823 - DNA, 22 bp, Homo sapiens
cacacagctcaggggcactgcc

SEQ ID NO: 8559824 - DNA, 22 bp, Homo sapiens
cacacagctagtgacaggagaa

SEQ ID NO: 8559825 - DNA, 22 bp, Homo sapiens
cacacagctagtgacaggagaa

SEQ ID NO: 8559826 - DNA, 22 bp, Homo sapiens
cacacagctagtgacaggagaa

SEQ ID NO: 8559827 - DNA, 22 bp, Homo sapiens
cacacagcaacaagaatagcca

SEQ ID NO: 8559828 - DNA, 21 bp, Homo sapiens
cacacagctgcccttaggtag

SEQ ID NO: 8559829 - DNA, 22 bp, Homo sapiens
cacacaggagagtgctggaggt

SEQ ID NO: 8559830 - DNA, 22 bp, Homo sapiens
cacacaggagagtgctggaggt

SEQ ID NO: 8559831 - DNA, 22 bp, Homo sapiens
ggaagggcctcgggcgtgggac

SEQ ID NO: 8559832 - DNA, 22 bp, Homo sapiens
ggaagggcctcgggcgtgggac

SEQ ID NO: 8559833 - DNA, 22 bp, Homo sapiens
cacagaggaaatgactttctta

SEQ ID NO: 8559834 - DNA, 22 bp, Homo sapiens
cacagaggaatgcatcagcaga

SEQ ID NO: 8559835 - DNA, 22 bp, Homo sapiens
cacagaggaaatgactttctta

SEQ ID NO: 8559836 - DNA, 22 bp, Homo sapiens
cacagaggaaatgactttctta

SEQ ID NO: 8559837 - DNA, 22 bp, Homo sapiens
cacagaggactgtagcggggag

SEQ ID NO: 8559838 - DNA, 22 bp, Homo sapiens
cacagaggaatgcatcagcaga

SEQ ID NO: 8559839 - DNA, 22 bp, Homo sapiens
cacagaggactgtagcggggag

SEQ ID NO: 8559840 - DNA, 22 bp, Homo sapiens
cacagaggactgtagcggggag

SEQ ID NO: 8559841 - DNA, 22 bp, Homo sapiens
cacagagctgaacctgggtcat

SEQ ID NO: 8559842 - DNA, 22 bp, Homo sapiens
cacagagctgaacctgggtcat

SEQ ID NO: 8559843 - DNA, 22 bp, Homo sapiens
cacagagagctacgtgcagcgt

SEQ ID NO: 8559844 - DNA, 22 bp, Homo sapiens
cacagagagctacgtgcagcgt

SEQ ID NO: 8559845 - DNA, 22 bp, Homo sapiens
cacagagctggaaaggctgggc

SEQ ID NO: 8559846 - DNA, 22 bp, Homo sapiens
cacagaggaaaggcagttggta

SEQ ID NO: 8559847 - DNA, 22 bp, Homo sapiens
cacagaggaaaggcagttggta

SEQ ID NO: 8559848 - DNA, 22 bp, Homo sapiens
cacagaggagtgcacactctct

SEQ ID NO: 8559849 - DNA, 22 bp, Homo sapiens
cacagaggagtgcacactctct

SEQ ID NO: 8559850 - DNA, 22 bp, Homo sapiens
cacagaggatgcccaagcgatc

SEQ ID NO: 8559851 - DNA, 22 bp, Homo sapiens
cacagaggatgcccaagcgatc

SEQ ID NO: 8559852 - DNA, 22 bp, Homo sapiens
cacagaggatgcccaagcgatc

SEQ ID NO: 8559853 - DNA, 22 bp, Homo sapiens
cacagaggatttttagggcagt

SEQ ID NO: 8559854 - DNA, 22 bp, Homo sapiens
cacagaggatgcccaagcgatc

SEQ ID NO: 8559855 - DNA, 22 bp, Homo sapiens
cacagaggcaaccttctggggt

SEQ ID NO: 8559856 - DNA, 22 bp, Homo sapiens
cacagaggatttttagggcagt

SEQ ID NO: 8559857 - DNA, 22 bp, Homo sapiens
cacagaggatttttagggcagt

SEQ ID NO: 8559858 - DNA, 22 bp, Homo sapiens
cacagaggctcaaagccaggtg

SEQ ID NO: 8559859 - DNA, 22 bp, Homo sapiens
cacagaggctcaaagccaggtg

SEQ ID NO: 8559860 - DNA, 22 bp, Homo sapiens
cacagaggctcaaagccaggtg

SEQ ID NO: 8559861 - DNA, 22 bp, Homo sapiens
cacagaggctcaaagccaggtg

SEQ ID NO: 8559862 - DNA, 22 bp, Homo sapiens
cacagaggctcaaagccaggtg

SEQ ID NO: 8559863 - DNA, 22 bp, Homo sapiens
cacagaggcggaaaattctgaa

SEQ ID NO: 8559864 - DNA, 22 bp, Homo sapiens
cacagaggcatgaccctgccct

SEQ ID NO: 8559865 - DNA, 22 bp, Homo sapiens
cacagaggcatgaccctgccct

SEQ ID NO: 8559866 - DNA, 22 bp, Homo sapiens
cacagaggcaaccttctggggt

SEQ ID NO: 8559867 - DNA, 21 bp, Homo sapiens
cacagaggcgctgtatggctg

SEQ ID NO: 8559868 - DNA, 22 bp, Homo sapiens
ggactgggcatgggtgctctgc

SEQ ID NO: 8559869 - DNA, 22 bp, Homo sapiens
ggactgggcatgggtgctctgc

SEQ ID NO: 8559870 - DNA, 22 bp, Homo sapiens
ggactgggcatgggtgctctgc

SEQ ID NO: 8559871 - DNA, 22 bp, Homo sapiens
ggactgggattctggatctgct

SEQ ID NO: 8559872 - DNA, 22 bp, Homo sapiens
ggactgggattctggatctgct

SEQ ID NO: 8559873 - DNA, 22 bp, Homo sapiens
cacagagaccccttctggggcc

SEQ ID NO: 8559874 - DNA, 22 bp, Homo sapiens
ggactgggccaggggttggact

SEQ ID NO: 8559875 - DNA, 17 bp, Homo sapiens
ggactgggcggggcagg

SEQ ID NO: 8559876 - DNA, 22 bp, Homo sapiens
ggactgggagaatggaggcaag

SEQ ID NO: 8559877 - DNA, 22 bp, Homo sapiens
ggactgggagaatggaggcaag

SEQ ID NO: 8559878 - DNA, 22 bp, Homo sapiens
cacagacttgagaagcacctta

SEQ ID NO: 8559879 - DNA, 22 bp, Homo sapiens
cacagacttgagaagcacctta

SEQ ID NO: 8559880 - DNA, 22 bp, Homo sapiens
cacagacttgagaagcacctta

SEQ ID NO: 8559881 - DNA, 22 bp, Homo sapiens
cacagaatggaccagttttaga

SEQ ID NO: 8559882 - DNA, 22 bp, Homo sapiens
cacagaatggaccagttttaga

SEQ ID NO: 8559883 - DNA, 22 bp, Homo sapiens
cacagaattaagggagaaatat

SEQ ID NO: 8559884 - DNA, 22 bp, Homo sapiens
cacagaattaagggagaaatat

SEQ ID NO: 8559885 - DNA, 22 bp, Homo sapiens
cacagaattttctctttacaat

SEQ ID NO: 8559886 - DNA, 20 bp, Homo sapiens
cacagactgtatgggcacca

SEQ ID NO: 8559887 - DNA, 22 bp, Homo sapiens
cacagactccccgccatagtgg

SEQ ID NO: 8559888 - DNA, 22 bp, Homo sapiens
ggaggcagaatagagtgtgggt

SEQ ID NO: 8559889 - DNA, 22 bp, Homo sapiens
ggaggcaggaaagacaggttca

SEQ ID NO: 8559890 - DNA, 22 bp, Homo sapiens
cacaggagaaaggggaagctcg

SEQ ID NO: 8559891 - DNA, 22 bp, Homo sapiens
ggaggcagaatagagtgtgggt

SEQ ID NO: 8559892 - DNA, 22 bp, Homo sapiens
cacaggaatgaacagggaaaga

SEQ ID NO: 8559893 - DNA, 22 bp, Homo sapiens
cacaggaatgaacagggaaaga

SEQ ID NO: 8559894 - DNA, 22 bp, Homo sapiens
cacaggaatgaacagggaaaga

SEQ ID NO: 8559895 - DNA, 22 bp, Homo sapiens
cacaggaattagcagcctaaaa

SEQ ID NO: 8559896 - DNA, 22 bp, Homo sapiens
cacaggaccaattcacattcca

SEQ ID NO: 8559897 - DNA, 22 bp, Homo sapiens
cacagctttgctttccttaata

SEQ ID NO: 8559898 - DNA, 22 bp, Homo sapiens
cacaggaaggccttctcacaat

SEQ ID NO: 8559899 - DNA, 22 bp, Homo sapiens
cacaggaaggccttctcacaat

SEQ ID NO: 8559900 - DNA, 22 bp, Homo sapiens
cacaggaagtggtcagtgccag

SEQ ID NO: 8559901 - DNA, 18 bp, Homo sapiens
cacaggaaggggaatatc

SEQ ID NO: 8559902 - DNA, 22 bp, Homo sapiens
cacaggaatcagcattaatggc

SEQ ID NO: 8559903 - DNA, 22 bp, Homo sapiens
cacaggaataagtcaaacttca

SEQ ID NO: 8559904 - DNA, 22 bp, Homo sapiens
cacaggaagtggtcagtgccag

SEQ ID NO: 8559905 - DNA, 22 bp, Homo sapiens
ggaggccaaggcaggtggatca

SEQ ID NO: 8559906 - DNA, 22 bp, Homo sapiens
ggaggccaaggcaggcggatca

SEQ ID NO: 8559907 - DNA, 22 bp, Homo sapiens
ggaggccaaggcaggcggatca

SEQ ID NO: 8559908 - DNA, 22 bp, Homo sapiens
ggaggccaaggcaggcggatca

SEQ ID NO: 8559909 - DNA, 20 bp, Homo sapiens
cacaggccttgtgagcagac

SEQ ID NO: 8559910 - DNA, 22 bp, Homo sapiens
ggaggccaaggagggcggatca

SEQ ID NO: 8559911 - DNA, 22 bp, Homo sapiens
ggaggccaaggagggcggatca

SEQ ID NO: 8559912 - DNA, 22 bp, Homo sapiens
ggaggccaaggagggcggatca

SEQ ID NO: 8559913 - DNA, 22 bp, Homo sapiens
ggaggccaaggaggagcttgcc

SEQ ID NO: 8559914 - DNA, 22 bp, Homo sapiens
ggaggccaaggaggagcttgcc

SEQ ID NO: 8559915 - DNA, 22 bp, Homo sapiens
ggaggccaaggaggagcttgcc

SEQ ID NO: 8559916 - DNA, 22 bp, Homo sapiens
ggaggccaaagtgtgggcggct

SEQ ID NO: 8559917 - DNA, 22 bp, Homo sapiens
ggaggccaaagtgtgggcggct

SEQ ID NO: 8559918 - DNA, 22 bp, Homo sapiens
ggaggccaaggaggagcttgcc

SEQ ID NO: 8559919 - DNA, 22 bp, Homo sapiens
ggaggccaaggaggagcttgcc

SEQ ID NO: 8559920 - DNA, 22 bp, Homo sapiens
ggaggccaaagtgtgggcggct

SEQ ID NO: 8559921 - DNA, 22 bp, Homo sapiens
ggaggcaggaaagacaggttca

SEQ ID NO: 8559922 - DNA, 22 bp, Homo sapiens
ggaggcatctctgtggctgtct

SEQ ID NO: 8559923 - DNA, 22 bp, Homo sapiens
ggaggcattatggggaagactt

SEQ ID NO: 8559924 - DNA, 22 bp, Homo sapiens
ggaggcaggaaagacaggttca

SEQ ID NO: 8559925 - DNA, 22 bp, Homo sapiens
cacaggcttgtcagcatgaggc

SEQ ID NO: 8559926 - DNA, 22 bp, Homo sapiens
cacaggcttgtcagcatgaggc

SEQ ID NO: 8559927 - DNA, 22 bp, Homo sapiens
cacaggcttgtcagcatgaggc

SEQ ID NO: 8559928 - DNA, 22 bp, Homo sapiens
cacaggcttttctgacataggc

SEQ ID NO: 8559929 - DNA, 22 bp, Homo sapiens
cacaggcttttctgacataggc

SEQ ID NO: 8559930 - DNA, 22 bp, Homo sapiens
cacaggcttttctgacataggc

SEQ ID NO: 8559931 - DNA, 22 bp, Homo sapiens
cacaggcttgtcagcatgaggc

SEQ ID NO: 8559932 - DNA, 22 bp, Homo sapiens
cacaggcttgtcagcatgaggc

SEQ ID NO: 8559933 - DNA, 22 bp, Homo sapiens
cacaggctgggaagcctaggcc

SEQ ID NO: 8559934 - DNA, 20 bp, Homo sapiens
cacaggcttacagtttagat

SEQ ID NO: 8559935 - DNA, 22 bp, Homo sapiens
cacaggctgggaagcctaggcc

SEQ ID NO: 8559936 - DNA, 20 bp, Homo sapiens
cacaggctatatgagagcca

SEQ ID NO: 8559937 - DNA, 22 bp, Homo sapiens
cacaggcttccagtccccagct

SEQ ID NO: 8559938 - DNA, 22 bp, Homo sapiens
cacaggcttccagtccccagct

SEQ ID NO: 8559939 - DNA, 22 bp, Homo sapiens
ggagcctgcgggagctcccatt

SEQ ID NO: 8559940 - DNA, 22 bp, Homo sapiens
ggagcctgcgggagctcccatt

SEQ ID NO: 8559941 - DNA, 22 bp, Homo sapiens
ggagctgctcagagccagtccc

SEQ ID NO: 8559942 - DNA, 22 bp, Homo sapiens
ggagctgctccttcagccaagt

SEQ ID NO: 8559943 - DNA, 23 bp, Homo sapiens
ggagctgctgttgggggagctgc

SEQ ID NO: 8559944 - DNA, 23 bp, Homo sapiens
ggagcctccggtgtgtgagaggc

SEQ ID NO: 8559945 - DNA, 22 bp, Homo sapiens
ggagcctgacagtgcccagcat

SEQ ID NO: 8559946 - DNA, 22 bp, Homo sapiens
ggagcctgacagtgcccagcat

SEQ ID NO: 8559947 - DNA, 22 bp, Homo sapiens
ggagcctgacagtgcccagcat

SEQ ID NO: 8559948 - DNA, 22 bp, Homo sapiens
ggagcctgagcggcccagggcc

SEQ ID NO: 8559949 - DNA, 22 bp, Homo sapiens
ggagctggcagcgcaacccaga

SEQ ID NO: 8559950 - DNA, 22 bp, Homo sapiens
ggagctggagagtacagagttt

SEQ ID NO: 8559951 - DNA, 22 bp, Homo sapiens
ggagctggagagtacagagttt

SEQ ID NO: 8559952 - DNA, 22 bp, Homo sapiens
ggagctggagagctagcctagg

SEQ ID NO: 8559953 - DNA, 22 bp, Homo sapiens
ggagctgctttgatctgaagaa

SEQ ID NO: 8559954 - DNA, 22 bp, Homo sapiens
ggagcccttctattccatggag

SEQ ID NO: 8559955 - DNA, 22 bp, Homo sapiens
ggagcccttgctgaccttccaa

SEQ ID NO: 8559956 - DNA, 22 bp, Homo sapiens
ggagccctgccctaggcagctc

SEQ ID NO: 8559957 - DNA, 22 bp, Homo sapiens
ggagccctgctgacatgggtgt

SEQ ID NO: 8559958 - DNA, 22 bp, Homo sapiens
ggagcccttggcacctagtagg

SEQ ID NO: 8559959 - DNA, 22 bp, Homo sapiens
ggagccctgccctaggcagctc

SEQ ID NO: 8559960 - DNA, 22 bp, Homo sapiens
ggagccctgccctaggcagctc

SEQ ID NO: 8559961 - DNA, 22 bp, Homo sapiens
ggagccctccatcccttgcggc

SEQ ID NO: 8559962 - DNA, 22 bp, Homo sapiens
ggagccctgaagcaagaaagta

SEQ ID NO: 8559963 - DNA, 23 bp, Homo sapiens
ggagccctgagctgtccccatgc

SEQ ID NO: 8559964 - DNA, 22 bp, Homo sapiens
ggagcaggcagggccgtgtctg

SEQ ID NO: 8559965 - DNA, 22 bp, Homo sapiens
ggagcaggcagggccgtgtctg

SEQ ID NO: 8559966 - DNA, 22 bp, Homo sapiens
ggagcaggcagggccgtgtctg

SEQ ID NO: 8559967 - DNA, 22 bp, Homo sapiens
cacagcaaagacactctcaact

SEQ ID NO: 8559968 - DNA, 22 bp, Homo sapiens
cacagaggtgatagtggtcaag

SEQ ID NO: 8559969 - DNA, 22 bp, Homo sapiens
cacagagtggaggcttggcctg

SEQ ID NO: 8559970 - DNA, 22 bp, Homo sapiens
cacagataaggatgttaatttt

SEQ ID NO: 8559971 - DNA, 22 bp, Homo sapiens
cacagaggtctgggcccagcag

SEQ ID NO: 8559972 - DNA, 22 bp, Homo sapiens
cacagaggtctgggcccagcag

SEQ ID NO: 8559973 - DNA, 19 bp, Homo sapiens
cacagatgattgacacata

SEQ ID NO: 8559974 - DNA, 22 bp, Homo sapiens
cacagatgaagtaaacaactct

SEQ ID NO: 8559975 - DNA, 22 bp, Homo sapiens
cacagatgagctgaatagcttt

SEQ ID NO: 8559976 - DNA, 19 bp, Homo sapiens
cacagatgattgacacata

SEQ ID NO: 8559977 - DNA, 22 bp, Homo sapiens
cacagatacctagtgaaacata

SEQ ID NO: 8559978 - DNA, 22 bp, Homo sapiens
cacagatacctagtgaaacata

SEQ ID NO: 8559979 - DNA, 22 bp, Homo sapiens
cacagatacctagtgaaacata

SEQ ID NO: 8559980 - DNA, 22 bp, Homo sapiens
cacagatacctagtgaaacata

SEQ ID NO: 8559981 - DNA, 22 bp, Homo sapiens
cacagatagaccttatgagatt

SEQ ID NO: 8559982 - DNA, 22 bp, Homo sapiens
cacagatgaagtaaacaactct

SEQ ID NO: 8559983 - DNA, 22 bp, Homo sapiens
cacagatagaccttatgagatt

SEQ ID NO: 8559984 - DNA, 22 bp, Homo sapiens
ggcatttgactcagtgactggg

SEQ ID NO: 8559985 - DNA, 22 bp, Homo sapiens
ggcatttgactcagtgactggg

SEQ ID NO: 8559986 - DNA, 22 bp, Homo sapiens
ggcatttagttttcatattctg

SEQ ID NO: 8559987 - DNA, 22 bp, Homo sapiens
ggccaaaagcataatcctcaca

SEQ ID NO: 8559988 - DNA, 22 bp, Homo sapiens
ggccaagatggaaggagagatg

SEQ ID NO: 8559989 - DNA, 21 bp, Homo sapiens
ggccaacatggtctcatctct

SEQ ID NO: 8559990 - DNA, 23 bp, Homo sapiens
ggccactgaattttctgcatctt

SEQ ID NO: 8559991 - DNA, 22 bp, Homo sapiens
ggccactccgctgctactggaa

SEQ ID NO: 8559992 - DNA, 19 bp, Homo sapiens
ggccactcctggtgactgg

SEQ ID NO: 8559993 - DNA, 22 bp, Homo sapiens
ggccaaggatggtggctctggt

SEQ ID NO: 8559994 - DNA, 22 bp, Homo sapiens
ggcaggtgcacctgagccatct

SEQ ID NO: 8559995 - DNA, 22 bp, Homo sapiens
ggcaggtgatctagagtcaata

SEQ ID NO: 8559996 - DNA, 22 bp, Homo sapiens
ggcagggcaggaaagtcaggaa

SEQ ID NO: 8559997 - DNA, 22 bp, Homo sapiens
ggcagggcaggaaagtcaggaa

SEQ ID NO: 8559998 - DNA, 22 bp, Homo sapiens
ggcagggcaggaaagtcaggaa

SEQ ID NO: 8559999 - DNA, 22 bp, Homo sapiens
ggccggggcctccccgcgtcgc

SEQ ID NO: 8560000 - DNA, 22 bp, Homo sapiens
ggccggggcctgctcgcctgtg

SEQ ID NO: 8560001 - DNA, 22 bp, Homo sapiens
ggccggggcctgctcgcctgtg

SEQ ID NO: 8560002 - DNA, 22 bp, Homo sapiens
cacctgggtcattgctggtgtt

SEQ ID NO: 8560003 - DNA, 22 bp, Homo sapiens
cacctgtccacgcagtctgcct

SEQ ID NO: 8560004 - DNA, 22 bp, Homo sapiens
cacctgtacagggccgggctgg

SEQ ID NO: 8560005 - DNA, 22 bp, Homo sapiens
cacctgttagctctaattttct

SEQ ID NO: 8560006 - DNA, 21 bp, Homo sapiens
ggccgccgccttgtgctctgc

SEQ ID NO: 8560007 - DNA, 21 bp, Homo sapiens
ggccgccgccttgtgctctgc

SEQ ID NO: 8560008 - DNA, 21 bp, Homo sapiens
ggccgccgccttgtgctctgc

SEQ ID NO: 8560009 - DNA, 22 bp, Homo sapiens
ggccggggcctccccgcgtcgc

SEQ ID NO: 8560010 - DNA, 20 bp, Homo sapiens
ggccggggagctctccaggg

SEQ ID NO: 8560011 - DNA, 22 bp, Homo sapiens
ggccgggcaggtctcagccagc

SEQ ID NO: 8560012 - DNA, 22 bp, Homo sapiens
ggccgggcaggtctcagccagc

SEQ ID NO: 8560013 - DNA, 22 bp, Homo sapiens
cacgagggcacacgtgggaggg

SEQ ID NO: 8560014 - DNA, 22 bp, Homo sapiens
cacgacttgtggaggagcgcgg

SEQ ID NO: 8560015 - DNA, 22 bp, Homo sapiens
cacgaggccatctccttctgga

SEQ ID NO: 8560016 - DNA, 22 bp, Homo sapiens
ggcctctctccctggcttgcag

SEQ ID NO: 8560017 - DNA, 22 bp, Homo sapiens
ggcctctctccagtcagtgcag

SEQ ID NO: 8560018 - DNA, 22 bp, Homo sapiens
cacgcacgctgggtggaggcgc

SEQ ID NO: 8560019 - DNA, 22 bp, Homo sapiens
cacgcatgtggatcagatgaag

SEQ ID NO: 8560020 - DNA, 22 bp, Homo sapiens
cacctttgaccttgcagcgcac

SEQ ID NO: 8560021 - DNA, 22 bp, Homo sapiens
cacctttgcaaaccaaatctga

SEQ ID NO: 8560022 - DNA, 22 bp, Homo sapiens
caccttttgtgtctgcgtttgt

SEQ ID NO: 8560023 - DNA, 22 bp, Homo sapiens
ggccctgttagagctcccacaa

SEQ ID NO: 8560024 - DNA, 22 bp, Homo sapiens
ggcccttgcagcaggcgctggc

SEQ ID NO: 8560025 - DNA, 22 bp, Homo sapiens
ggcccttggagcctccacagtg

SEQ ID NO: 8560026 - DNA, 22 bp, Homo sapiens
ggccgccctttccacggtttct

SEQ ID NO: 8560027 - DNA, 22 bp, Homo sapiens
ggccctgttagagctcccacaa

SEQ ID NO: 8560028 - DNA, 22 bp, Homo sapiens
ggccctgtggttttgcaaagtc

SEQ ID NO: 8560029 - DNA, 22 bp, Homo sapiens
ggccctgtgatggatgtattag

SEQ ID NO: 8560030 - DNA, 22 bp, Homo sapiens
ggccctgtggttttgcaaagtc

SEQ ID NO: 8560031 - DNA, 22 bp, Homo sapiens
ggccctgtcctggctgtctccg

SEQ ID NO: 8560032 - DNA, 22 bp, Homo sapiens
ggccctgtccccttcagttttg

SEQ ID NO: 8560033 - DNA, 22 bp, Homo sapiens
ggccctgtcctggctgtctccg

SEQ ID NO: 8560034 - DNA, 22 bp, Homo sapiens
ggccctgtgatggatgtattag

SEQ ID NO: 8560035 - DNA, 22 bp, Homo sapiens
ggccactgctgctctggtggag

SEQ ID NO: 8560036 - DNA, 22 bp, Homo sapiens
ggccactgctgctctggtggag

SEQ ID NO: 8560037 - DNA, 22 bp, Homo sapiens
ggccactgctctccagcctggg

SEQ ID NO: 8560038 - DNA, 22 bp, Homo sapiens
ggccactgctctccagcctggg

SEQ ID NO: 8560039 - DNA, 22 bp, Homo sapiens
ggccactgctctccagcctggg

SEQ ID NO: 8560040 - DNA, 22 bp, Homo sapiens
ggccactgccctggctacaccg

SEQ ID NO: 8560041 - DNA, 22 bp, Homo sapiens
ggccactgcctccgccatggct

SEQ ID NO: 8560042 - DNA, 22 bp, Homo sapiens
cacatatatgaaatgaggaatt

SEQ ID NO: 8560043 - DNA, 22 bp, Homo sapiens
cacattctgtccttgaactgca

SEQ ID NO: 8560044 - DNA, 22 bp, Homo sapiens
cacatatatgaaatgaggaatt

SEQ ID NO: 8560045 - DNA, 23 bp, Homo sapiens
cacatatagcagccactaaggtc

SEQ ID NO: 8560046 - DNA, 22 bp, Homo sapiens
cacatataacctagacaaggcc

SEQ ID NO: 8560047 - DNA, 22 bp, Homo sapiens
cacatatacctcttcttgagtt

SEQ ID NO: 8560048 - DNA, 22 bp, Homo sapiens
cacatataccagccgcggtacg

SEQ ID NO: 8560049 - DNA, 22 bp, Homo sapiens
cacatacttgtgtgtacatatg

SEQ ID NO: 8560050 - DNA, 22 bp, Homo sapiens
cacatacttgtgtgtacatatg

SEQ ID NO: 8560051 - DNA, 18 bp, Homo sapiens
cacatttacctggctccc

SEQ ID NO: 8560052 - DNA, 18 bp, Homo sapiens
cacatttacctggctccc

SEQ ID NO: 8560053 - DNA, 22 bp, Homo sapiens
cacatttacatataaaactttc

SEQ ID NO: 8560054 - DNA, 22 bp, Homo sapiens
cacatttacatataaaactttc

SEQ ID NO: 8560055 - DNA, 22 bp, Homo sapiens
cacatttaattggtttagggtg

SEQ ID NO: 8560056 - DNA, 22 bp, Homo sapiens
cacattcttgagttacagtcta

SEQ ID NO: 8560057 - DNA, 22 bp, Homo sapiens
cacatttagaggttagcatggt

SEQ ID NO: 8560058 - DNA, 22 bp, Homo sapiens
cacatttagaggttagcatggt

SEQ ID NO: 8560059 - DNA, 22 bp, Homo sapiens
cacatttagaggttagcatggt

SEQ ID NO: 8560060 - DNA, 22 bp, Homo sapiens
cacatttacttttatcccttgg

SEQ ID NO: 8560061 - DNA, 22 bp, Homo sapiens
cacatttaggaggtggggaagc

SEQ ID NO: 8560062 - DNA, 22 bp, Homo sapiens
cacatttaggttcctatagcca

SEQ ID NO: 8560063 - DNA, 22 bp, Homo sapiens
cacatttaggttcctatagcca

SEQ ID NO: 8560064 - DNA, 22 bp, Homo sapiens
cacatttatctctctccggtga

SEQ ID NO: 8560065 - DNA, 22 bp, Homo sapiens
cacatttatctgttctttctag

SEQ ID NO: 8560066 - DNA, 22 bp, Homo sapiens
cacatttatctgttctttctag

SEQ ID NO: 8560067 - DNA, 22 bp, Homo sapiens
cacatttatgggctgggaggca

SEQ ID NO: 8560068 - DNA, 22 bp, Homo sapiens
cacatttatctgttctttctag

SEQ ID NO: 8560069 - DNA, 22 bp, Homo sapiens
ggcaggcatcatgtggtcatta

SEQ ID NO: 8560070 - DNA, 22 bp, Homo sapiens
ggcaggcatggggtctgccatt

SEQ ID NO: 8560071 - DNA, 22 bp, Homo sapiens
ggcaggcatggccactccctag

SEQ ID NO: 8560072 - DNA, 22 bp, Homo sapiens
ggcagggagagcatgctgataa

SEQ ID NO: 8560073 - DNA, 22 bp, Homo sapiens
ggcagggagagcatgctgataa

SEQ ID NO: 8560074 - DNA, 22 bp, Homo sapiens
ggcagggaggaggtgaaagtga

SEQ ID NO: 8560075 - DNA, 20 bp, Homo sapiens
ggcagggagggatactgagg

SEQ ID NO: 8560076 - DNA, 22 bp, Homo sapiens
ggcaggcaggagcgtgcttggg

SEQ ID NO: 8560077 - DNA, 22 bp, Homo sapiens
cacatttatttgaggctaattg

SEQ ID NO: 8560078 - DNA, 22 bp, Homo sapiens
ggcaggcaggtcttcatggccc

SEQ ID NO: 8560079 - DNA, 22 bp, Homo sapiens
ggcaggcagtgtggtgtgaaac

SEQ ID NO: 8560080 - DNA, 22 bp, Homo sapiens
ggaggtggagctggaagttcca

SEQ ID NO: 8560081 - DNA, 22 bp, Homo sapiens
ggaggtggagctggaagttcca

SEQ ID NO: 8560082 - DNA, 22 bp, Homo sapiens
ggaggtgctggcggccagctct

SEQ ID NO: 8560083 - DNA, 22 bp, Homo sapiens
ggaggtggagctggaagttcca

SEQ ID NO: 8560084 - DNA, 22 bp, Homo sapiens
ggaggtggaggttgcaatgagc

SEQ ID NO: 8560085 - DNA, 22 bp, Homo sapiens
ggaggtggaggttgcaatgagc

SEQ ID NO: 8560086 - DNA, 22 bp, Homo sapiens
cacagttttatcttatactgat

SEQ ID NO: 8560087 - DNA, 22 bp, Homo sapiens
cacagtttggttttgctgtaat

SEQ ID NO: 8560088 - DNA, 22 bp, Homo sapiens
cacagtgttccagagcagtggt

SEQ ID NO: 8560089 - DNA, 22 bp, Homo sapiens
ggaggtggaggttgcaatgagc

SEQ ID NO: 8560090 - DNA, 22 bp, Homo sapiens
ggaggtgaggccgtagggtgtg

SEQ ID NO: 8560091 - DNA, 22 bp, Homo sapiens
ggaggtgaggccgtagggtgtg

SEQ ID NO: 8560092 - DNA, 22 bp, Homo sapiens
ggaggtgcagagtagggttggt

SEQ ID NO: 8560093 - DNA, 22 bp, Homo sapiens
cacaggcttttttggctgatgt

SEQ ID NO: 8560094 - DNA, 22 bp, Homo sapiens
cacagggaacaactagaacaaa

SEQ ID NO: 8560095 - DNA, 22 bp, Homo sapiens
cacagggaaccaaggctgggcc

SEQ ID NO: 8560096 - DNA, 22 bp, Homo sapiens
cacagggaaccaaggctgggcc

SEQ ID NO: 8560097 - DNA, 21 bp, Homo sapiens
ggaggtcccttctggtttcag

SEQ ID NO: 8560098 - DNA, 22 bp, Homo sapiens
cacatacatgcacacctaaata

SEQ ID NO: 8560099 - DNA, 22 bp, Homo sapiens
cacatacatgcacacctaaata

SEQ ID NO: 8560100 - DNA, 22 bp, Homo sapiens
cacatacatgcacacctaaata

SEQ ID NO: 8560101 - DNA, 22 bp, Homo sapiens
cacatacttgtgtgtacatatg

SEQ ID NO: 8560102 - DNA, 22 bp, Homo sapiens
cacatactgagaatcacaccca

SEQ ID NO: 8560103 - DNA, 22 bp, Homo sapiens
cacatacattcatgttactcta

SEQ ID NO: 8560104 - DNA, 22 bp, Homo sapiens
cacatacattcatgttactcta

SEQ ID NO: 8560105 - DNA, 22 bp, Homo sapiens
cacatacatacgtatgtataca

SEQ ID NO: 8560106 - DNA, 22 bp, Homo sapiens
cacatacatacgtatgtataca

SEQ ID NO: 8560107 - DNA, 22 bp, Homo sapiens
cacatacaatggtgttatttgg

SEQ ID NO: 8560108 - DNA, 19 bp, Homo sapiens
cacatacagaaaagagtaa

SEQ ID NO: 8560109 - DNA, 19 bp, Homo sapiens
cacatacagaaaagagtaa

SEQ ID NO: 8560110 - DNA, 19 bp, Homo sapiens
cacatacagaaaagagtaa

SEQ ID NO: 8560111 - DNA, 22 bp, Homo sapiens
cacatacatacgtatgtataca

SEQ ID NO: 8560112 - DNA, 22 bp, Homo sapiens
cacagttttgcccagggcttct

SEQ ID NO: 8560113 - DNA, 22 bp, Homo sapiens
cacagttttgtcttggtttcca

SEQ ID NO: 8560114 - DNA, 22 bp, Homo sapiens
cacataaatggtgccatgtttt

SEQ ID NO: 8560115 - DNA, 22 bp, Homo sapiens
cacataagaaatgaatatgaga

SEQ ID NO: 8560116 - DNA, 22 bp, Homo sapiens
cacatacaatggtgttatttgg

SEQ ID NO: 8560117 - DNA, 22 bp, Homo sapiens
cacatacaaggcacactggagg

SEQ ID NO: 8560118 - DNA, 22 bp, Homo sapiens
cacatacaaggcacactggagg

SEQ ID NO: 8560119 - DNA, 22 bp, Homo sapiens
cacatacaagccatggggggat

SEQ ID NO: 8560120 - DNA, 22 bp, Homo sapiens
cacataataaatgttcctgatg

SEQ ID NO: 8560121 - DNA, 22 bp, Homo sapiens
ggcctgtgagccttagtttata

SEQ ID NO: 8560122 - DNA, 22 bp, Homo sapiens
ggcctgtgagccttagtttata

SEQ ID NO: 8560123 - DNA, 22 bp, Homo sapiens
ggcctgtgagaatcaaggaaaa

SEQ ID NO: 8560124 - DNA, 22 bp, Homo sapiens
ggcctgtgagcccttgcatgta

SEQ ID NO: 8560125 - DNA, 22 bp, Homo sapiens
ggcctgtgagaatcaaggaaaa

SEQ ID NO: 8560126 - DNA, 22 bp, Homo sapiens
ggcctgtctcacccccgggtgc

SEQ ID NO: 8560127 - DNA, 22 bp, Homo sapiens
ggcctgtaatcccagctactca

SEQ ID NO: 8560128 - DNA, 22 bp, Homo sapiens
ggcctgtccagcctgcctggct

SEQ ID NO: 8560129 - DNA, 22 bp, Homo sapiens
ggcctgggctccgggagttact

SEQ ID NO: 8560130 - DNA, 22 bp, Homo sapiens
ggcctgaggcaatagtcagaca

SEQ ID NO: 8560131 - DNA, 22 bp, Homo sapiens
ggcctgaggcaatagtcagaca

SEQ ID NO: 8560132 - DNA, 22 bp, Homo sapiens
ggcctgagcttgggcagcgtat

SEQ ID NO: 8560133 - DNA, 22 bp, Homo sapiens
ggcctgagcttgggcagcgtat

SEQ ID NO: 8560134 - DNA, 18 bp, Homo sapiens
ggcctgaggatttcagca

SEQ ID NO: 8560135 - DNA, 22 bp, Homo sapiens
ggcctgagctctggggaggcaa

SEQ ID NO: 8560136 - DNA, 22 bp, Homo sapiens
ggcctgagcttgggcagcgtat

SEQ ID NO: 8560137 - DNA, 22 bp, Homo sapiens
ggcctgagctctggggaggcaa

SEQ ID NO: 8560138 - DNA, 22 bp, Homo sapiens
ggcctgagcagacagcatgatg

SEQ ID NO: 8560139 - DNA, 22 bp, Homo sapiens
ggcctgagcagacagcatgatg

SEQ ID NO: 8560140 - DNA, 22 bp, Homo sapiens
ggcctctctccttggcttgcag

SEQ ID NO: 8560141 - DNA, 21 bp, Homo sapiens
ggcctgagcacctgtccacct

SEQ ID NO: 8560142 - DNA, 22 bp, Homo sapiens
ggcctgagcagacagcatgatg

SEQ ID NO: 8560143 - DNA, 20 bp, Homo sapiens
ggcctgagcatggctggcag

SEQ ID NO: 8560144 - DNA, 20 bp, Homo sapiens
ggcctgagcatggctggcag

SEQ ID NO: 8560145 - DNA, 20 bp, Homo sapiens
ggcctgagcatggctggcag

SEQ ID NO: 8560146 - DNA, 22 bp, Homo sapiens
ggcctgtgtcctccttgccctg

SEQ ID NO: 8560147 - DNA, 22 bp, Homo sapiens
ggcctgtgtctgtgcctgtcct

SEQ ID NO: 8560148 - DNA, 22 bp, Homo sapiens
ggctcaatgcaacttctgcctc

SEQ ID NO: 8560149 - DNA, 22 bp, Homo sapiens
ggctcaatgcaacttctgcctc

SEQ ID NO: 8560150 - DNA, 22 bp, Homo sapiens
ggcctgtgggaggacagctggg

SEQ ID NO: 8560151 - DNA, 22 bp, Homo sapiens
ggcctgtggctttggcgtctaa

SEQ ID NO: 8560152 - DNA, 22 bp, Homo sapiens
ggcctgtggcaaggtgagaatg

SEQ ID NO: 8560153 - DNA, 22 bp, Homo sapiens
ggcctgtgctgtcagccctagt

SEQ ID NO: 8560154 - DNA, 19 bp, Homo sapiens
ggctcagggcgctgccgcc

SEQ ID NO: 8560155 - DNA, 22 bp, Homo sapiens
ggctcagggaatgaggaagaat

SEQ ID NO: 8560156 - DNA, 22 bp, Homo sapiens
ggctcagggaatgaggaagaat

SEQ ID NO: 8560157 - DNA, 22 bp, Homo sapiens
ggctcaggctggagtgcagtgg

SEQ ID NO: 8560158 - DNA, 22 bp, Homo sapiens
ggctcaggctggagtgcagtgg

SEQ ID NO: 8560159 - DNA, 22 bp, Homo sapiens
ggctccagggtctctccttgtg

SEQ ID NO: 8560160 - DNA, 22 bp, Homo sapiens
ggctccagggtacccctggatg

SEQ ID NO: 8560161 - DNA, 22 bp, Homo sapiens
ggctccagggtctctccttgtg

SEQ ID NO: 8560162 - DNA, 22 bp, Homo sapiens
ggctccaggtacgtatgggagg

SEQ ID NO: 8560163 - DNA, 22 bp, Homo sapiens
ggctccaggtgcatgccaggct

SEQ ID NO: 8560164 - DNA, 22 bp, Homo sapiens
ggctccaggtacgtatgggagg

SEQ ID NO: 8560165 - DNA, 22 bp, Homo sapiens
ggctcaggttaccagtccctcc

SEQ ID NO: 8560166 - DNA, 22 bp, Homo sapiens
ggctccagggtacccctggatg

SEQ ID NO: 8560167 - DNA, 22 bp, Homo sapiens
ggctcaggttgggtcacatgac

SEQ ID NO: 8560168 - DNA, 22 bp, Homo sapiens
ggctctgggttctgcaatgcgt

SEQ ID NO: 8560169 - DNA, 22 bp, Homo sapiens
ggctctgggttctgcaatgcgt

SEQ ID NO: 8560170 - DNA, 22 bp, Homo sapiens
ggctccaggtgcatgccaggct

SEQ ID NO: 8560171 - DNA, 22 bp, Homo sapiens
ggctccaggtgcatgccaggct

SEQ ID NO: 8560172 - DNA, 22 bp, Homo sapiens
ggctccaggtttaagggtatgt

SEQ ID NO: 8560173 - DNA, 18 bp, Homo sapiens
ggctccagtcttcagtgg

SEQ ID NO: 8560174 - DNA, 18 bp, Homo sapiens
ggctccagtcttcagtgg

SEQ ID NO: 8560175 - DNA, 22 bp, Homo sapiens
ggctccaggtttaagggtatgt

SEQ ID NO: 8560176 - DNA, 22 bp, Homo sapiens
ggctccagtttccccttggggc

SEQ ID NO: 8560177 - DNA, 19 bp, Homo sapiens
ggctgagcgccttggctgc

SEQ ID NO: 8560178 - DNA, 22 bp, Homo sapiens
ggctgagctcaggggcagcagg

SEQ ID NO: 8560179 - DNA, 22 bp, Homo sapiens
ggctgagcctggagcatctggt

SEQ ID NO: 8560180 - DNA, 19 bp, Homo sapiens
ggctgagcgccttggctgc

SEQ ID NO: 8560181 - DNA, 22 bp, Homo sapiens
ggctgagcttatatatgtgctg

SEQ ID NO: 8560182 - DNA, 22 bp, Homo sapiens
ggctgagcttatatatgtgctg

SEQ ID NO: 8560183 - DNA, 22 bp, Homo sapiens
ggctgaggcggcgatgcccttg

SEQ ID NO: 8560184 - DNA, 22 bp, Homo sapiens
ggctgaggcggcgatgcccttg

SEQ ID NO: 8560185 - DNA, 22 bp, Homo sapiens
ggctgaggcggcgatgcccttg

SEQ ID NO: 8560186 - DNA, 22 bp, Homo sapiens
ggctgaggcggcgatgcccttg

SEQ ID NO: 8560187 - DNA, 22 bp, Homo sapiens
ggctctggtgccctggctccca

SEQ ID NO: 8560188 - DNA, 22 bp, Homo sapiens
ggctctggtgccctggctccca

SEQ ID NO: 8560189 - DNA, 22 bp, Homo sapiens
ggctgagccccctctgcgtagg

SEQ ID NO: 8560190 - DNA, 22 bp, Homo sapiens
ggctgagccccctctgcgtagg

SEQ ID NO: 8560191 - DNA, 22 bp, Homo sapiens
ggctctggtgagggtaggagat

SEQ ID NO: 8560192 - DNA, 22 bp, Homo sapiens
ggctctggtcagtgaggggcct

SEQ ID NO: 8560193 - DNA, 22 bp, Homo sapiens
ggctctggtgagggtaggagat

SEQ ID NO: 8560194 - DNA, 22 bp, Homo sapiens
ggctctggtgccctggctccca

SEQ ID NO: 8560195 - DNA, 22 bp, Homo sapiens
cagaaagcttggtacaatatgc

SEQ ID NO: 8560196 - DNA, 22 bp, Homo sapiens
cagaaaggacagagtgagggtg

SEQ ID NO: 8560197 - DNA, 22 bp, Homo sapiens
cagaaaggactttggttggctt

SEQ ID NO: 8560198 - DNA, 18 bp, Homo sapiens
cagaaagttatttactct

SEQ ID NO: 8560199 - DNA, 18 bp, Homo sapiens
cagaaagttatttactct

SEQ ID NO: 8560200 - DNA, 23 bp, Homo sapiens
cagaaagtttgagaagatacatc

SEQ ID NO: 8560201 - DNA, 23 bp, Homo sapiens
cagaaagtttgagaagatacatc

SEQ ID NO: 8560202 - DNA, 23 bp, Homo sapiens
cagaaagtttgagaagatacatc

SEQ ID NO: 8560203 - DNA, 22 bp, Homo sapiens
cagaaagtgatttgctattcca

SEQ ID NO: 8560204 - DNA, 22 bp, Homo sapiens
cagaaagtgatttgctattcca

SEQ ID NO: 8560205 - DNA, 18 bp, Homo sapiens
cagaaagttatttactct

SEQ ID NO: 8560206 - DNA, 22 bp, Homo sapiens
ggctgggaggatgacttgctac

SEQ ID NO: 8560207 - DNA, 22 bp, Homo sapiens
cagaaataaacttctcacatcg

SEQ ID NO: 8560208 - DNA, 22 bp, Homo sapiens
cagaaataaacttctcacatcg

SEQ ID NO: 8560209 - DNA, 23 bp, Homo sapiens
cagaaataaactggtttgtagat

SEQ ID NO: 8560210 - DNA, 23 bp, Homo sapiens
cagaaataaactggtttgtagat

SEQ ID NO: 8560211 - DNA, 22 bp, Homo sapiens
ggctgtagttacctgatgaaat

SEQ ID NO: 8560212 - DNA, 22 bp, Homo sapiens
ggctgtatatactgtatacagt

SEQ ID NO: 8560213 - DNA, 22 bp, Homo sapiens
ggctgtaggttggtgctggaca

SEQ ID NO: 8560214 - DNA, 22 bp, Homo sapiens
ggctgtaggttggtgctggaca

SEQ ID NO: 8560215 - DNA, 22 bp, Homo sapiens
ggctgtagttacctgatgaaat

SEQ ID NO: 8560216 - DNA, 22 bp, Homo sapiens
ggctgtccttggccaaggcact

SEQ ID NO: 8560217 - DNA, 22 bp, Homo sapiens
ggctgtccttggccaaggcact

SEQ ID NO: 8560218 - DNA, 22 bp, Homo sapiens
ggctgtccacctaccatgccgg

SEQ ID NO: 8560219 - DNA, 22 bp, Homo sapiens
ggctggtgttgagtgcctgtag

SEQ ID NO: 8560220 - DNA, 22 bp, Homo sapiens
ggctggtgttacagtcggcagc

SEQ ID NO: 8560221 - DNA, 21 bp, Homo sapiens
ggctggtgtttagctgtgata

SEQ ID NO: 8560222 - DNA, 21 bp, Homo sapiens
ggctggtgtttagctgtgata

SEQ ID NO: 8560223 - DNA, 22 bp, Homo sapiens
ggctgtgttccaagtgtcagga

SEQ ID NO: 8560224 - DNA, 22 bp, Homo sapiens
ggctgtgtttctgtttgacatt

SEQ ID NO: 8560225 - DNA, 22 bp, Homo sapiens
ggctgtgtttctgtttgacatt

SEQ ID NO: 8560226 - DNA, 22 bp, Homo sapiens
ggcttaaaaggaaaatgagagt

SEQ ID NO: 8560227 - DNA, 22 bp, Homo sapiens
ggctgtgaagtagcaggggcag

SEQ ID NO: 8560228 - DNA, 22 bp, Homo sapiens
ggctgtgttccaagtgtcagga

SEQ ID NO: 8560229 - DNA, 22 bp, Homo sapiens
ggctgtgaagtagcaggggcag

SEQ ID NO: 8560230 - DNA, 22 bp, Homo sapiens
ggctgtgaaccctggcagtgtg

SEQ ID NO: 8560231 - DNA, 22 bp, Homo sapiens
ggctgtctctgtgactgccacc

SEQ ID NO: 8560232 - DNA, 19 bp, Homo sapiens
ggctgtctggcgtgtggat

SEQ ID NO: 8560233 - DNA, 19 bp, Homo sapiens
ggctgtctggcgtgtggat

SEQ ID NO: 8560234 - DNA, 22 bp, Homo sapiens
ggctgtcttgggagctcccccg

SEQ ID NO: 8560235 - DNA, 22 bp, Homo sapiens
ggctgtctgtggtggagcgttg

SEQ ID NO: 8560236 - DNA, 19 bp, Homo sapiens
ggctgtctggcgtgtggat

SEQ ID NO: 8560237 - DNA, 22 bp, Homo sapiens
cagaaagctctttcaatcttgc

SEQ ID NO: 8560238 - DNA, 22 bp, Homo sapiens
cagaaagccgacttacaatgga

SEQ ID NO: 8560239 - DNA, 22 bp, Homo sapiens
cagaaagccgacttacaatgga

SEQ ID NO: 8560240 - DNA, 22 bp, Homo sapiens
ggctgccctcggggtcgcaggc

SEQ ID NO: 8560241 - DNA, 22 bp, Homo sapiens
ggctgccctcgtctactgccca

SEQ ID NO: 8560242 - DNA, 22 bp, Homo sapiens
ggctgccctcgtctactgccca

SEQ ID NO: 8560243 - DNA, 22 bp, Homo sapiens
ggctgcctactttcccagagtt

SEQ ID NO: 8560244 - DNA, 22 bp, Homo sapiens
ggctgccctctgctgactgcaa

SEQ ID NO: 8560245 - DNA, 22 bp, Homo sapiens
ggctgcctactttcccagagtt

SEQ ID NO: 8560246 - DNA, 22 bp, Homo sapiens
ggctgcctactttcccagagtt

SEQ ID NO: 8560247 - DNA, 22 bp, Homo sapiens
ggctgcctcaaagctcaagctc

SEQ ID NO: 8560248 - DNA, 22 bp, Homo sapiens
ggctgcctcaaagctcaagctc

SEQ ID NO: 8560249 - DNA, 22 bp, Homo sapiens
cagaaacatgtataaagttgta

SEQ ID NO: 8560250 - DNA, 20 bp, Homo sapiens
ggctgcccactccagagtac

SEQ ID NO: 8560251 - DNA, 22 bp, Homo sapiens
ggctgccataactgataccata

SEQ ID NO: 8560252 - DNA, 22 bp, Homo sapiens
ggctgccataacagagtaccac

SEQ ID NO: 8560253 - DNA, 22 bp, Homo sapiens
ggctgccccatgggctgggctg

SEQ ID NO: 8560254 - DNA, 22 bp, Homo sapiens
ggctgccccatgggctgggctg

SEQ ID NO: 8560255 - DNA, 22 bp, Homo sapiens
ggctgccccagtgctcatggct

SEQ ID NO: 8560256 - DNA, 22 bp, Homo sapiens
cagaaaataaacatttgtggaa

SEQ ID NO: 8560257 - DNA, 22 bp, Homo sapiens
cagaaaataaagtttctacgca

SEQ ID NO: 8560258 - DNA, 22 bp, Homo sapiens
cagaaaataaacatttgtggaa

SEQ ID NO: 8560259 - DNA, 22 bp, Homo sapiens
cagaaaataaagtttctacgca

SEQ ID NO: 8560260 - DNA, 22 bp, Homo sapiens
cagaaaataaacatttgtggaa

SEQ ID NO: 8560261 - DNA, 22 bp, Homo sapiens
cagaaaagggtgtttgttcagg

SEQ ID NO: 8560262 - DNA, 22 bp, Homo sapiens
cagaaaaggaagagctatgtaa

SEQ ID NO: 8560263 - DNA, 22 bp, Homo sapiens
cagaaaacctgactctagaact

SEQ ID NO: 8560264 - DNA, 22 bp, Homo sapiens
cagaaaacctgactctagaact

SEQ ID NO: 8560265 - DNA, 23 bp, Homo sapiens
cagaaaacccagagctcagtccc

SEQ ID NO: 8560266 - DNA, 22 bp, Homo sapiens
cagaaaacctgactctagaact

SEQ ID NO: 8560267 - DNA, 22 bp, Homo sapiens
cagaaaacaaacctatcctgag

SEQ ID NO: 8560268 - DNA, 22 bp, Homo sapiens
cagaaaacaaacctatcctgag

SEQ ID NO: 8560269 - DNA, 22 bp, Homo sapiens
cacttttaacaggagaattccc

SEQ ID NO: 8560270 - DNA, 22 bp, Homo sapiens
gtcccagagagcactagtccat

SEQ ID NO: 8560271 - DNA, 22 bp, Homo sapiens
gtcccagaggacagggtcacat

SEQ ID NO: 8560272 - DNA, 22 bp, Homo sapiens
gtcccagaggctttggccacag

SEQ ID NO: 8560273 - DNA, 22 bp, Homo sapiens
gtcccagatgtctggaactccc

SEQ ID NO: 8560274 - DNA, 22 bp, Homo sapiens
gtcccagcttcccactagcagc

SEQ ID NO: 8560275 - DNA, 22 bp, Homo sapiens
gtcccaggaacattctggctag

SEQ ID NO: 8560276 - DNA, 22 bp, Homo sapiens
gtcccaggcaggccactggcag

SEQ ID NO: 8560277 - DNA, 22 bp, Homo sapiens
gtcccaggctccatggcagcca

SEQ ID NO: 8560278 - DNA, 22 bp, Homo sapiens
gtcccaggcagagtcaggaggg

SEQ ID NO: 8560279 - DNA, 22 bp, Homo sapiens
gtcccaggagttgctgggcctt

SEQ ID NO: 8560280 - DNA, 22 bp, Homo sapiens
gtcccagaaacatattgctggt

SEQ ID NO: 8560281 - DNA, 22 bp, Homo sapiens
cagcaggctgcgattgctcatt

SEQ ID NO: 8560282 - DNA, 22 bp, Homo sapiens
cagcaggctgtggaaatcctgg

SEQ ID NO: 8560283 - DNA, 22 bp, Homo sapiens
cagcaggctgtggaaatcctgg

SEQ ID NO: 8560284 - DNA, 22 bp, Homo sapiens
cagcaggctggacttcagtccc

SEQ ID NO: 8560285 - DNA, 22 bp, Homo sapiens
cagcaggctgcgattgctcatt

SEQ ID NO: 8560286 - DNA, 22 bp, Homo sapiens
cagcaggctctgagtggctgcc

SEQ ID NO: 8560287 - DNA, 22 bp, Homo sapiens
cagcaggctgcgattgctcatt

SEQ ID NO: 8560288 - DNA, 22 bp, Homo sapiens
cagcaggctgcgattgctcatt

SEQ ID NO: 8560289 - DNA, 18 bp, Homo sapiens
gtcatgggtagtttagta

SEQ ID NO: 8560290 - DNA, 22 bp, Homo sapiens
gtcatgtgaataagtgtggggt

SEQ ID NO: 8560291 - DNA, 22 bp, Homo sapiens
gtcatgtgaataagtgtggggt

SEQ ID NO: 8560292 - DNA, 22 bp, Homo sapiens
cagcaggcgttgggagaaagac

SEQ ID NO: 8560293 - DNA, 22 bp, Homo sapiens
gtcatcttatcattgttgctgt

SEQ ID NO: 8560294 - DNA, 22 bp, Homo sapiens
gtcatcttaaggactgctatag

SEQ ID NO: 8560295 - DNA, 22 bp, Homo sapiens
gtcatcttaaggactgctatag

SEQ ID NO: 8560296 - DNA, 22 bp, Homo sapiens
gtcatattgaagaagactggca

SEQ ID NO: 8560297 - DNA, 21 bp, Homo sapiens
gtcatccacctctcgggctct

SEQ ID NO: 8560298 - DNA, 22 bp, Homo sapiens
gtcatattataaatgttctgtt

SEQ ID NO: 8560299 - DNA, 22 bp, Homo sapiens
gtcatattataaatgttctgtt

SEQ ID NO: 8560300 - DNA, 22 bp, Homo sapiens
cagcagcttctgttgatcagaa

SEQ ID NO: 8560301 - DNA, 22 bp, Homo sapiens
cagcagctttgccaagtcagcc

SEQ ID NO: 8560302 - DNA, 22 bp, Homo sapiens
cagcagctttgccaagtcagcc

SEQ ID NO: 8560303 - DNA, 20 bp, Homo sapiens
cagcaggaaaagtgcctcag

SEQ ID NO: 8560304 - DNA, 22 bp, Homo sapiens
cagcagcttttgcattctcatt

SEQ ID NO: 8560305 - DNA, 22 bp, Homo sapiens
cagcagctggtgagacacagcc

SEQ ID NO: 8560306 - DNA, 22 bp, Homo sapiens
cagcagctggtgagacacagcc

SEQ ID NO: 8560307 - DNA, 22 bp, Homo sapiens
gtcagcattgcagatatatggc

SEQ ID NO: 8560308 - DNA, 22 bp, Homo sapiens
gtcagcatgagcaagggctgac

SEQ ID NO: 8560309 - DNA, 22 bp, Homo sapiens
cagcaccttccttaactccagg

SEQ ID NO: 8560310 - DNA, 22 bp, Homo sapiens
cagcaccattttcctggtcagc

SEQ ID NO: 8560311 - DNA, 22 bp, Homo sapiens
cagcaccattttcctggtcagc

SEQ ID NO: 8560312 - DNA, 22 bp, Homo sapiens
cagcaccctcggaggctgccgt

SEQ ID NO: 8560313 - DNA, 22 bp, Homo sapiens
cagcacccctcctggctatgaa

SEQ ID NO: 8560314 - DNA, 22 bp, Homo sapiens
cagcacctaggacagtagtcag

SEQ ID NO: 8560315 - DNA, 22 bp, Homo sapiens
cagcaccctttccactgccttg

SEQ ID NO: 8560316 - DNA, 22 bp, Homo sapiens
cagcacctaggacagtagtcag

SEQ ID NO: 8560317 - DNA, 22 bp, Homo sapiens
cagcagctgggaaggaggctga

SEQ ID NO: 8560318 - DNA, 22 bp, Homo sapiens
cagcagctgcgtgcccaggccg

SEQ ID NO: 8560319 - DNA, 23 bp, Homo sapiens
cagcagctgcctggttttttggt

SEQ ID NO: 8560320 - DNA, 22 bp, Homo sapiens
cagcagctgcgtgcccaggccg

SEQ ID NO: 8560321 - DNA, 22 bp, Homo sapiens
cagcagctgatggggaagtgat

SEQ ID NO: 8560322 - DNA, 22 bp, Homo sapiens
gtctggaagtgtcttgttaagt

SEQ ID NO: 8560323 - DNA, 22 bp, Homo sapiens
gtctggaagggagtgcattttc

SEQ ID NO: 8560324 - DNA, 22 bp, Homo sapiens
gtctggacagcagcacctcggc

SEQ ID NO: 8560325 - DNA, 22 bp, Homo sapiens
gtctggacaggactatttctaa

SEQ ID NO: 8560326 - DNA, 22 bp, Homo sapiens
gtctggaagaactagggatgtt

SEQ ID NO: 8560327 - DNA, 22 bp, Homo sapiens
gtctggaagagcaggaataaac

SEQ ID NO: 8560328 - DNA, 22 bp, Homo sapiens
gtctggaaattcaatttaatgc

SEQ ID NO: 8560329 - DNA, 22 bp, Homo sapiens
gtctggaaaggggcttttatct

SEQ ID NO: 8560330 - DNA, 22 bp, Homo sapiens
gtctggaaaggggcttttatct

SEQ ID NO: 8560331 - DNA, 22 bp, Homo sapiens
gtctggaagaactagggatgtt

SEQ ID NO: 8560332 - DNA, 22 bp, Homo sapiens
gtctggaaatttaaggtatgag

SEQ ID NO: 8560333 - DNA, 22 bp, Homo sapiens
gtctggaaccaagacgtgtagc

SEQ ID NO: 8560334 - DNA, 22 bp, Homo sapiens
gtctggagccaccctaagcatt

SEQ ID NO: 8560335 - DNA, 22 bp, Homo sapiens
gtctggagagctgagcagagtt

SEQ ID NO: 8560336 - DNA, 22 bp, Homo sapiens
gtctggagacttgggtcatcaa

SEQ ID NO: 8560337 - DNA, 22 bp, Homo sapiens
gtctggagccactgctgctgct

SEQ ID NO: 8560338 - DNA, 22 bp, Homo sapiens
gtctggagccactgctgctgct

SEQ ID NO: 8560339 - DNA, 22 bp, Homo sapiens
cagccagggagcaaagagttga

SEQ ID NO: 8560340 - DNA, 22 bp, Homo sapiens
cagccaggcctggtgaccaaag

SEQ ID NO: 8560341 - DNA, 22 bp, Homo sapiens
cagccagggagggcaaatgaga

SEQ ID NO: 8560342 - DNA, 22 bp, Homo sapiens
cagccaggcctggtgaccaaag

SEQ ID NO: 8560343 - DNA, 22 bp, Homo sapiens
cagccaggcccccgagtcgttg

SEQ ID NO: 8560344 - DNA, 22 bp, Homo sapiens
gtcccttcctcattccacttta

SEQ ID NO: 8560345 - DNA, 22 bp, Homo sapiens
gtcccttggctcacaaacagct

SEQ ID NO: 8560346 - DNA, 22 bp, Homo sapiens
gtcccttggctcacaaacagct

SEQ ID NO: 8560347 - DNA, 19 bp, Homo sapiens
gtcccttcactcctgctgg

SEQ ID NO: 8560348 - DNA, 19 bp, Homo sapiens
gtcccttcactcctgctgg

SEQ ID NO: 8560349 - DNA, 22 bp, Homo sapiens
gtctgcttttgttttactggta

SEQ ID NO: 8560350 - DNA, 22 bp, Homo sapiens
gtccctggtctaccgtggcttc

SEQ ID NO: 8560351 - DNA, 22 bp, Homo sapiens
gtccctgggtctaaggcagtaa

SEQ ID NO: 8560352 - DNA, 22 bp, Homo sapiens
gtccctggggaatcagctggag

SEQ ID NO: 8560353 - DNA, 22 bp, Homo sapiens
gtccctggggaatcagctggag

SEQ ID NO: 8560354 - DNA, 22 bp, Homo sapiens
gtccctggggaatcagctggag

SEQ ID NO: 8560355 - DNA, 19 bp, Homo sapiens
gtccctgggcagaggcacc

SEQ ID NO: 8560356 - DNA, 22 bp, Homo sapiens
gtccctgggatgcccttctggg

SEQ ID NO: 8560357 - DNA, 22 bp, Homo sapiens
gtccctgggaaaggagagggca

SEQ ID NO: 8560358 - DNA, 19 bp, Homo sapiens
gtccctgggcagaggcacc

SEQ ID NO: 8560359 - DNA, 22 bp, Homo sapiens
gtccctggatctgggacagctg

SEQ ID NO: 8560360 - DNA, 22 bp, Homo sapiens
gtcccaggctccatggcagcca

SEQ ID NO: 8560361 - DNA, 22 bp, Homo sapiens
gtcccaggcttatgtggagctt

SEQ ID NO: 8560362 - DNA, 22 bp, Homo sapiens
cagcccctcacagagctgtcct

SEQ ID NO: 8560363 - DNA, 22 bp, Homo sapiens
cagcccctcacagagctgtcct

SEQ ID NO: 8560364 - DNA, 22 bp, Homo sapiens
cagcccctccctcaggcaggtg

SEQ ID NO: 8560365 - DNA, 22 bp, Homo sapiens
cagcccctccctcaggcaggtg

SEQ ID NO: 8560366 - DNA, 22 bp, Homo sapiens
cagcccctcacagagctgtcct

SEQ ID NO: 8560367 - DNA, 22 bp, Homo sapiens
cagccccatggtgtgctccagc

SEQ ID NO: 8560368 - DNA, 22 bp, Homo sapiens
cagccccttcctggcatctgga

SEQ ID NO: 8560369 - DNA, 22 bp, Homo sapiens
cagcccgtcacacgctagcatc

SEQ ID NO: 8560370 - DNA, 22 bp, Homo sapiens
cagccagggagggcaaatgaga

SEQ ID NO: 8560371 - DNA, 22 bp, Homo sapiens
cagccagggagggcaaatgaga

SEQ ID NO: 8560372 - DNA, 22 bp, Homo sapiens
cagccagggtcaggcagcttct

SEQ ID NO: 8560373 - DNA, 22 bp, Homo sapiens
cagccagggtcaggcagcttct

SEQ ID NO: 8560374 - DNA, 22 bp, Homo sapiens
cagccagggtcaggcagcttct

SEQ ID NO: 8560375 - DNA, 22 bp, Homo sapiens
cagccagggtcaggcagcttct

SEQ ID NO: 8560376 - DNA, 22 bp, Homo sapiens
cagccagggtcaggcagcttct

SEQ ID NO: 8560377 - DNA, 22 bp, Homo sapiens
cagcccaggctcagatgttggg

SEQ ID NO: 8560378 - DNA, 22 bp, Homo sapiens
cagcccaggctcagatgttggg

SEQ ID NO: 8560379 - DNA, 22 bp, Homo sapiens
cagccaggtatgggcgtgcggg

SEQ ID NO: 8560380 - DNA, 22 bp, Homo sapiens
cagccaggtatgggcgtgcggg

SEQ ID NO: 8560381 - DNA, 22 bp, Homo sapiens
gtctgtatcagaggagtgaatg

SEQ ID NO: 8560382 - DNA, 22 bp, Homo sapiens
gtctgtcatctgagatggagtg

SEQ ID NO: 8560383 - DNA, 22 bp, Homo sapiens
gtctgtccagcaacacaggagt

SEQ ID NO: 8560384 - DNA, 22 bp, Homo sapiens
gtctgtctccctgtgactgaga

SEQ ID NO: 8560385 - DNA, 22 bp, Homo sapiens
gtctgtccatcagcaaaggctt

SEQ ID NO: 8560386 - DNA, 22 bp, Homo sapiens
gtctgtccatcagcaaaggctt

SEQ ID NO: 8560387 - DNA, 22 bp, Homo sapiens
cagccctcaggtcctcagcagc

SEQ ID NO: 8560388 - DNA, 22 bp, Homo sapiens
cagccctcaggtcctcagcagc

SEQ ID NO: 8560389 - DNA, 22 bp, Homo sapiens
gtctgtaattattaaagaaagg

SEQ ID NO: 8560390 - DNA, 22 bp, Homo sapiens
cagccctcaggtcctcagcagc

SEQ ID NO: 8560391 - DNA, 22 bp, Homo sapiens
gtctgtgttttcaggcctttgt

SEQ ID NO: 8560392 - DNA, 18 bp, Homo sapiens
gtctgtgtggcttgggga

SEQ ID NO: 8560393 - DNA, 22 bp, Homo sapiens
gtctgtgtgcacagcgagtgcc

SEQ ID NO: 8560394 - DNA, 18 bp, Homo sapiens
gtctgtgtggcttgggga

SEQ ID NO: 8560395 - DNA, 19 bp, Homo sapiens
gtctgtgtatttgttgctg

SEQ ID NO: 8560396 - DNA, 22 bp, Homo sapiens
gtctgtgtgcacagcgagtgcc

SEQ ID NO: 8560397 - DNA, 22 bp, Homo sapiens
gtctgtgtgcacagagctttgg

SEQ ID NO: 8560398 - DNA, 22 bp, Homo sapiens
gtctgtgggccaaatacagccc

SEQ ID NO: 8560399 - DNA, 19 bp, Homo sapiens
gtctgtgtatttgttgctg

SEQ ID NO: 8560400 - DNA, 22 bp, Homo sapiens
gtctgtgtgcacagagctttgg

SEQ ID NO: 8560401 - DNA, 22 bp, Homo sapiens
gtctgtggtccctgctggggac

SEQ ID NO: 8560402 - DNA, 22 bp, Homo sapiens
gtctgtggcaggggagaagttt

SEQ ID NO: 8560403 - DNA, 22 bp, Homo sapiens
gtctgtggagttgcttgctgga

SEQ ID NO: 8560404 - DNA, 22 bp, Homo sapiens
gtctgtctctctccagagtgca

SEQ ID NO: 8560405 - DNA, 22 bp, Homo sapiens
gtctgtctctctccagagtgca

SEQ ID NO: 8560406 - DNA, 22 bp, Homo sapiens
gtctgtctctctccagagtgca

SEQ ID NO: 8560407 - DNA, 22 bp, Homo sapiens
gtctgtctgttgttgagaagca

SEQ ID NO: 8560408 - DNA, 22 bp, Homo sapiens
gtgctgtgtgatccatgctggc

SEQ ID NO: 8560409 - DNA, 22 bp, Homo sapiens
gtgctgtgtgatccatgctggc

SEQ ID NO: 8560410 - DNA, 22 bp, Homo sapiens
gtgctgtgtgatccatgctggc

SEQ ID NO: 8560411 - DNA, 22 bp, Homo sapiens
gtgctgtgtctatcaggaataa

SEQ ID NO: 8560412 - DNA, 18 bp, Homo sapiens
gtgctgtgggcagtggcc

SEQ ID NO: 8560413 - DNA, 18 bp, Homo sapiens
gtgctgtgggcagtggcc

SEQ ID NO: 8560414 - DNA, 18 bp, Homo sapiens
gtgctgtgggcagtggcc

SEQ ID NO: 8560415 - DNA, 22 bp, Homo sapiens
gtgctgtgcgctttttctgtat

SEQ ID NO: 8560416 - DNA, 22 bp, Homo sapiens
gtgctgtgcgctttttctgtat

SEQ ID NO: 8560417 - DNA, 18 bp, Homo sapiens
gtgctgtgggcagtggcc

SEQ ID NO: 8560418 - DNA, 22 bp, Homo sapiens
gtgctgtgcgctttttctgtat

SEQ ID NO: 8560419 - DNA, 22 bp, Homo sapiens
gtgctgtgcgctttttctgtat

SEQ ID NO: 8560420 - DNA, 22 bp, Homo sapiens
gtgctgagtagaatgaatgcct

SEQ ID NO: 8560421 - DNA, 22 bp, Homo sapiens
gtgctgagtagaatgaatgcct

SEQ ID NO: 8560422 - DNA, 22 bp, Homo sapiens
gtgccctcctgaagccatcaca

SEQ ID NO: 8560423 - DNA, 22 bp, Homo sapiens
gtgccctccgtgttcatagagc

SEQ ID NO: 8560424 - DNA, 22 bp, Homo sapiens
gtgccctcatgaaacgaaggat

SEQ ID NO: 8560425 - DNA, 22 bp, Homo sapiens
gtgccctcacaaagtggaaaga

SEQ ID NO: 8560426 - DNA, 22 bp, Homo sapiens
cagcctgcagggctgcctgttg

SEQ ID NO: 8560427 - DNA, 20 bp, Homo sapiens
cagcctgcatcatctgcagc

SEQ ID NO: 8560428 - DNA, 20 bp, Homo sapiens
cagcctgcatcatctgcagc

SEQ ID NO: 8560429 - DNA, 20 bp, Homo sapiens
cagcctgcatcatctgcagc

SEQ ID NO: 8560430 - DNA, 22 bp, Homo sapiens
cagcctgcagggctgcctgttg

SEQ ID NO: 8560431 - DNA, 22 bp, Homo sapiens
cagcctgccgtcagccaggtag

SEQ ID NO: 8560432 - DNA, 22 bp, Homo sapiens
cagcctgcatttgtatctgtat

SEQ ID NO: 8560433 - DNA, 22 bp, Homo sapiens
cagcctgccctggaagcccagc

SEQ ID NO: 8560434 - DNA, 22 bp, Homo sapiens
cagcctgcatttgtatctgtat

SEQ ID NO: 8560435 - DNA, 22 bp, Homo sapiens
cagcctgagccttctgtagcaa

SEQ ID NO: 8560436 - DNA, 22 bp, Homo sapiens
cagcctgcagggctgcctgttg

SEQ ID NO: 8560437 - DNA, 22 bp, Homo sapiens
cagcctgactatggctgcaggt

SEQ ID NO: 8560438 - DNA, 22 bp, Homo sapiens
cagcctctttccacatcaggca

SEQ ID NO: 8560439 - DNA, 22 bp, Homo sapiens
cagcctgacaccagctttgggc

SEQ ID NO: 8560440 - DNA, 22 bp, Homo sapiens
cagccctggaacagctgactca

SEQ ID NO: 8560441 - DNA, 22 bp, Homo sapiens
cagccctggaacagctgactca

SEQ ID NO: 8560442 - DNA, 22 bp, Homo sapiens
cagccctggaacagctgactca

SEQ ID NO: 8560443 - DNA, 23 bp, Homo sapiens
cagccctggagatgtgggaggca

SEQ ID NO: 8560444 - DNA, 23 bp, Homo sapiens
cagccctggagatgtgggaggca

SEQ ID NO: 8560445 - DNA, 23 bp, Homo sapiens
cagccctggagatgtgggaggca

SEQ ID NO: 8560446 - DNA, 23 bp, Homo sapiens
cagccctggagatgtgggaggca

SEQ ID NO: 8560447 - DNA, 20 bp, Homo sapiens
cagcctccactcactcagct

SEQ ID NO: 8560448 - DNA, 22 bp, Homo sapiens
cagccctggcccaggtgcctta

SEQ ID NO: 8560449 - DNA, 22 bp, Homo sapiens
cagccctggcagctttcagggt

SEQ ID NO: 8560450 - DNA, 23 bp, Homo sapiens
cagccctggagatgtgggaggca

SEQ ID NO: 8560451 - DNA, 20 bp, Homo sapiens
cagcctccactcactcagct

SEQ ID NO: 8560452 - DNA, 22 bp, Homo sapiens
cagccctgctcttagtgtctcc

SEQ ID NO: 8560453 - DNA, 22 bp, Homo sapiens
cagccctgctcttagtgtctcc

SEQ ID NO: 8560454 - DNA, 22 bp, Homo sapiens
cagccctgctcttagtgtctcc

SEQ ID NO: 8560455 - DNA, 22 bp, Homo sapiens
cagccctgctgacactgtctga

SEQ ID NO: 8560456 - DNA, 22 bp, Homo sapiens
cagccctgctgacactgtctga

SEQ ID NO: 8560457 - DNA, 22 bp, Homo sapiens
cagccctgctgacactgtctga

SEQ ID NO: 8560458 - DNA, 22 bp, Homo sapiens
cagccctgctgccttagtgcct

SEQ ID NO: 8560459 - DNA, 22 bp, Homo sapiens
cagccctgcttccccgctagtt

SEQ ID NO: 8560460 - DNA, 22 bp, Homo sapiens
cagccctgcttccccgctagtt

SEQ ID NO: 8560461 - DNA, 22 bp, Homo sapiens
cagccctgctggttttgggcaa

SEQ ID NO: 8560462 - DNA, 22 bp, Homo sapiens
cagccctgctggttttgggcaa

SEQ ID NO: 8560463 - DNA, 22 bp, Homo sapiens
cagccctgctggcaatgatgag

SEQ ID NO: 8560464 - DNA, 22 bp, Homo sapiens
cagccctgctggcaatgatgag

SEQ ID NO: 8560465 - DNA, 22 bp, Homo sapiens
cagccctgccatggagcctcct

SEQ ID NO: 8560466 - DNA, 22 bp, Homo sapiens
cagccctgccatggagcctcct

SEQ ID NO: 8560467 - DNA, 22 bp, Homo sapiens
cagccctgcagctggatctcac

SEQ ID NO: 8560468 - DNA, 17 bp, Homo sapiens
cagccctgccgttccca

SEQ ID NO: 8560469 - DNA, 22 bp, Homo sapiens
cagccctgcggaggtgtatact

SEQ ID NO: 8560470 - DNA, 22 bp, Homo sapiens
cagccctgaaacaacctcctct

SEQ ID NO: 8560471 - DNA, 22 bp, Homo sapiens
cagccctgcagctggatctcac

SEQ ID NO: 8560472 - DNA, 22 bp, Homo sapiens
cagccctgcagccatggcctgt

SEQ ID NO: 8560473 - DNA, 22 bp, Homo sapiens
cagccctgcagccatggcctgt

SEQ ID NO: 8560474 - DNA, 22 bp, Homo sapiens
cagcctggcctgggactgctga

SEQ ID NO: 8560475 - DNA, 22 bp, Homo sapiens
cagcctgggctccagagtccct

SEQ ID NO: 8560476 - DNA, 22 bp, Homo sapiens
cagcctgggctccagagtccct

SEQ ID NO: 8560477 - DNA, 22 bp, Homo sapiens
cagcctggtccccggctcaccc

SEQ ID NO: 8560478 - DNA, 22 bp, Homo sapiens
cagcctgtagaatacagtaaat

SEQ ID NO: 8560479 - DNA, 22 bp, Homo sapiens
cagcctgtagaatacagtaaat

SEQ ID NO: 8560480 - DNA, 22 bp, Homo sapiens
cagcctggagccacagcccagg

SEQ ID NO: 8560481 - DNA, 22 bp, Homo sapiens
cagcctggagccacagcccagg

SEQ ID NO: 8560482 - DNA, 22 bp, Homo sapiens
cagcctggagccacagcccagg

SEQ ID NO: 8560483 - DNA, 22 bp, Homo sapiens
cagcctggagccacagcccagg

SEQ ID NO: 8560484 - DNA, 22 bp, Homo sapiens
cagcctggattgcagaatgcta

SEQ ID NO: 8560485 - DNA, 22 bp, Homo sapiens
cagcctggacagcgaccagagt

SEQ ID NO: 8560486 - DNA, 22 bp, Homo sapiens
cagcctggacagcgaccagagt

SEQ ID NO: 8560487 - DNA, 22 bp, Homo sapiens
cagcctgctagggcaatgcctt

SEQ ID NO: 8560488 - DNA, 22 bp, Homo sapiens
cagctatattgttttctactgt

SEQ ID NO: 8560489 - DNA, 22 bp, Homo sapiens
cagctatagatggactgaagag

SEQ ID NO: 8560490 - DNA, 22 bp, Homo sapiens
cagctatattgttttctactgt

SEQ ID NO: 8560491 - DNA, 20 bp, Homo sapiens
cagctagtggtaggagtcgg

SEQ ID NO: 8560492 - DNA, 22 bp, Homo sapiens
cagctagggagtggcagagctt

SEQ ID NO: 8560493 - DNA, 22 bp, Homo sapiens
cagctaggaaaccagagggcag

SEQ ID NO: 8560494 - DNA, 22 bp, Homo sapiens
cagctagggagtggcagagctt

SEQ ID NO: 8560495 - DNA, 22 bp, Homo sapiens
cagctagggagtggcagagctt

SEQ ID NO: 8560496 - DNA, 22 bp, Homo sapiens
cagctagtaaatggcaagacta

SEQ ID NO: 8560497 - DNA, 22 bp, Homo sapiens
gtgcccagtcctgccttgacag

SEQ ID NO: 8560498 - DNA, 22 bp, Homo sapiens
cagctattctctgaaatgaata

SEQ ID NO: 8560499 - DNA, 22 bp, Homo sapiens
cagctattccaggagtagaatc

SEQ ID NO: 8560500 - DNA, 22 bp, Homo sapiens
cagctattattttctctaaatt

SEQ ID NO: 8560501 - DNA, 22 bp, Homo sapiens
cagctaccatggtttgttccag

SEQ ID NO: 8560502 - DNA, 22 bp, Homo sapiens
cagctaggaaaccagagggcag

SEQ ID NO: 8560503 - DNA, 22 bp, Homo sapiens
cagctacacttctgggtgtgtc

SEQ ID NO: 8560504 - DNA, 22 bp, Homo sapiens
cagctacagaggccacatggct

SEQ ID NO: 8560505 - DNA, 22 bp, Homo sapiens
cagctaatcctctctatccaag

SEQ ID NO: 8560506 - DNA, 22 bp, Homo sapiens
cagctacacaccagaactatta

SEQ ID NO: 8560507 - DNA, 22 bp, Homo sapiens
cagctacacaccagaactatta

SEQ ID NO: 8560508 - DNA, 22 bp, Homo sapiens
cagaggcacaagaaagcaaggc

SEQ ID NO: 8560509 - DNA, 22 bp, Homo sapiens
cagaggatgatctggcctctct

SEQ ID NO: 8560510 - DNA, 22 bp, Homo sapiens
cagaggattccctagtgacctg

SEQ ID NO: 8560511 - DNA, 22 bp, Homo sapiens
cagaggatatatggtttgtatg

SEQ ID NO: 8560512 - DNA, 22 bp, Homo sapiens
gggctgaggggtatctcatggg

SEQ ID NO: 8560513 - DNA, 22 bp, Homo sapiens
cagagctgggtttgggaaacct

SEQ ID NO: 8560514 - DNA, 22 bp, Homo sapiens
gggctgaggggtatctcatggg

SEQ ID NO: 8560515 - DNA, 22 bp, Homo sapiens
gggctgaggggtatctcatggg

SEQ ID NO: 8560516 - DNA, 22 bp, Homo sapiens
gggctgagtcatctggggcctc

SEQ ID NO: 8560517 - DNA, 22 bp, Homo sapiens
gggctgagtgacctcaggccaa

SEQ ID NO: 8560518 - DNA, 22 bp, Homo sapiens
gggctgagtgacctcaggccaa

SEQ ID NO: 8560519 - DNA, 22 bp, Homo sapiens
gggctgagtctgctgcctgtca

SEQ ID NO: 8560520 - DNA, 22 bp, Homo sapiens
cagagctgggcatggtgaaagg

SEQ ID NO: 8560521 - DNA, 22 bp, Homo sapiens
cagagctgggcatggtgaaagg

SEQ ID NO: 8560522 - DNA, 22 bp, Homo sapiens
cagagctgggcatggtgaaagg

SEQ ID NO: 8560523 - DNA, 20 bp, Homo sapiens
cagagctgggatttgaacac

SEQ ID NO: 8560524 - DNA, 20 bp, Homo sapiens
cagagctgggatttgaacac

SEQ ID NO: 8560525 - DNA, 22 bp, Homo sapiens
cagagctggggactgttggatg

SEQ ID NO: 8560526 - DNA, 22 bp, Homo sapiens
cagagctgggtttgggaaacct

SEQ ID NO: 8560527 - DNA, 22 bp, Homo sapiens
cagagctggggactgttggatg

SEQ ID NO: 8560528 - DNA, 22 bp, Homo sapiens
cagagctgggatcccatgggcg

SEQ ID NO: 8560529 - DNA, 22 bp, Homo sapiens
cagagctgggatcccatgggcg

SEQ ID NO: 8560530 - DNA, 22 bp, Homo sapiens
cagagctgggatcccatgggcg

SEQ ID NO: 8560531 - DNA, 22 bp, Homo sapiens
cagagctgggatcccatgggcg

SEQ ID NO: 8560532 - DNA, 22 bp, Homo sapiens
cagagctgggatcccatgggcg

SEQ ID NO: 8560533 - DNA, 23 bp, Homo sapiens
cagagctggcttcatgggtgtgc

SEQ ID NO: 8560534 - DNA, 23 bp, Homo sapiens
cagagctggcttcatgggtgtgc

SEQ ID NO: 8560535 - DNA, 23 bp, Homo sapiens
cagagctggcttcatgggtgtgc

SEQ ID NO: 8560536 - DNA, 23 bp, Homo sapiens
cagagctggcttcatgggtgtgc

SEQ ID NO: 8560537 - DNA, 22 bp, Homo sapiens
cagagcctgccacctttctccc

SEQ ID NO: 8560538 - DNA, 22 bp, Homo sapiens
cagagcctgcctctggctgtgg

SEQ ID NO: 8560539 - DNA, 22 bp, Homo sapiens
cagagcctctaaaatttctatc

SEQ ID NO: 8560540 - DNA, 22 bp, Homo sapiens
cagagcctctcagccccttggg

SEQ ID NO: 8560541 - DNA, 22 bp, Homo sapiens
cagagctgcttcccagtttgtg

SEQ ID NO: 8560542 - DNA, 22 bp, Homo sapiens
cagagctggctctgcatgtaca

SEQ ID NO: 8560543 - DNA, 22 bp, Homo sapiens
cagagcctgcctctggctgtgg

SEQ ID NO: 8560544 - DNA, 22 bp, Homo sapiens
cagagcctgctcacgtctctgt

SEQ ID NO: 8560545 - DNA, 19 bp, Homo sapiens
cagagctgctggcctcgtc

SEQ ID NO: 8560546 - DNA, 22 bp, Homo sapiens
cagagctgcttcccagtttgtg

SEQ ID NO: 8560547 - DNA, 22 bp, Homo sapiens
gggccagcctactgctagaccc

SEQ ID NO: 8560548 - DNA, 22 bp, Homo sapiens
gggccagcagtatcggaggcat

SEQ ID NO: 8560549 - DNA, 22 bp, Homo sapiens
gggccagcagtatcggaggcat

SEQ ID NO: 8560550 - DNA, 22 bp, Homo sapiens
gggccagagcacagaggatgtt

SEQ ID NO: 8560551 - DNA, 22 bp, Homo sapiens
gggccagagcacagaggatgtt

SEQ ID NO: 8560552 - DNA, 22 bp, Homo sapiens
gggccagacctcttctcaggga

SEQ ID NO: 8560553 - DNA, 22 bp, Homo sapiens
gggccagacctcttctcaggga

SEQ ID NO: 8560554 - DNA, 22 bp, Homo sapiens
gggccagagcttggcagctggg

SEQ ID NO: 8560555 - DNA, 22 bp, Homo sapiens
gggccagagcttggcagctggg

SEQ ID NO: 8560556 - DNA, 22 bp, Homo sapiens
gggccagagcttggcagctggg

SEQ ID NO: 8560557 - DNA, 22 bp, Homo sapiens
gggccagcagtatcggaggcat

SEQ ID NO: 8560558 - DNA, 22 bp, Homo sapiens
gggcagtgtcggggcccaggga

SEQ ID NO: 8560559 - DNA, 22 bp, Homo sapiens
gggcagtgtcggggcccaggga

SEQ ID NO: 8560560 - DNA, 22 bp, Homo sapiens
gggcagtgtcgaggtctggtcc

SEQ ID NO: 8560561 - DNA, 22 bp, Homo sapiens
gggcagtgtggtcgtgcctttg

SEQ ID NO: 8560562 - DNA, 22 bp, Homo sapiens
gggcagtgtctggcccccaggc

SEQ ID NO: 8560563 - DNA, 22 bp, Homo sapiens
gggcagtgtctggcccccaggc

SEQ ID NO: 8560564 - DNA, 22 bp, Homo sapiens
gggcagtgtctgcaaatgaaca

SEQ ID NO: 8560565 - DNA, 22 bp, Homo sapiens
gggccaccccactgcccacgct

SEQ ID NO: 8560566 - DNA, 22 bp, Homo sapiens
gggccaccccactgcccacgct

SEQ ID NO: 8560567 - DNA, 22 bp, Homo sapiens
cagagcctaaaacgactccact

SEQ ID NO: 8560568 - DNA, 22 bp, Homo sapiens
gggctgactctgcactgagcca

SEQ ID NO: 8560569 - DNA, 22 bp, Homo sapiens
cagagcctccctcctctgccat

SEQ ID NO: 8560570 - DNA, 19 bp, Homo sapiens
cagagcctcagagctagaa

SEQ ID NO: 8560571 - DNA, 22 bp, Homo sapiens
cagagcctcagaatcctgtgga

SEQ ID NO: 8560572 - DNA, 22 bp, Homo sapiens
cagagcctcagaatcctgtgga

SEQ ID NO: 8560573 - DNA, 22 bp, Homo sapiens
gggctgaaaggccgcctcagat

SEQ ID NO: 8560574 - DNA, 22 bp, Homo sapiens
gggctgacaccacccaggcgca

SEQ ID NO: 8560575 - DNA, 22 bp, Homo sapiens
cagagacagcctgggagggaca

SEQ ID NO: 8560576 - DNA, 22 bp, Homo sapiens
cagagacaggaatcagctgcag

SEQ ID NO: 8560577 - DNA, 22 bp, Homo sapiens
cagagacagaaaatggatctag

SEQ ID NO: 8560578 - DNA, 22 bp, Homo sapiens
gggcagcccagaactgctgcag

SEQ ID NO: 8560579 - DNA, 22 bp, Homo sapiens
gggcagcatgaggaccctcatc

SEQ ID NO: 8560580 - DNA, 22 bp, Homo sapiens
gggcagcatgtcactagcatgg

SEQ ID NO: 8560581 - DNA, 22 bp, Homo sapiens
gggcagcattctgtgggcaggt

SEQ ID NO: 8560582 - DNA, 22 bp, Homo sapiens
gggcagcattctgtgggcaggt

SEQ ID NO: 8560583 - DNA, 22 bp, Homo sapiens
gggcagcattctgtgggcaggt

SEQ ID NO: 8560584 - DNA, 22 bp, Homo sapiens
gggcagcagttgccctaatcaa

SEQ ID NO: 8560585 - DNA, 22 bp, Homo sapiens
gggcagcatcaggaggggcttt

SEQ ID NO: 8560586 - DNA, 22 bp, Homo sapiens
gggcagcatgaggaccctcatc

SEQ ID NO: 8560587 - DNA, 22 bp, Homo sapiens
gggcagcatcaggaggggcttt

SEQ ID NO: 8560588 - DNA, 22 bp, Homo sapiens
gggcagcatgaggaccctcatc

SEQ ID NO: 8560589 - DNA, 22 bp, Homo sapiens
gggcagcatcaggaggggcttt

SEQ ID NO: 8560590 - DNA, 22 bp, Homo sapiens
gggcagcatcaggaggggcttt

SEQ ID NO: 8560591 - DNA, 22 bp, Homo sapiens
gggcagcagcaggaggtctctg

SEQ ID NO: 8560592 - DNA, 22 bp, Homo sapiens
gggcagcagcaggaggtctctg

SEQ ID NO: 8560593 - DNA, 21 bp, Homo sapiens
gggcagcagcagcaacaaggg

SEQ ID NO: 8560594 - DNA, 22 bp, Homo sapiens
gggcagcagaggatcccttaat

SEQ ID NO: 8560595 - DNA, 22 bp, Homo sapiens
gggcagcagaggatcccttaat

SEQ ID NO: 8560596 - DNA, 22 bp, Homo sapiens
gggcagcagagccctgccgagt

SEQ ID NO: 8560597 - DNA, 22 bp, Homo sapiens
gggcagcagagccctgccgagt

SEQ ID NO: 8560598 - DNA, 22 bp, Homo sapiens
gggcagtgggtggctgcagcct

SEQ ID NO: 8560599 - DNA, 22 bp, Homo sapiens
gggcagtgggaccaggcaccag

SEQ ID NO: 8560600 - DNA, 22 bp, Homo sapiens
gggcagtgggaccaggcaccag

SEQ ID NO: 8560601 - DNA, 22 bp, Homo sapiens
gggcagtggctcacgcctgtaa

SEQ ID NO: 8560602 - DNA, 22 bp, Homo sapiens
gggcagtggctcacgcctgtaa

SEQ ID NO: 8560603 - DNA, 20 bp, Homo sapiens
gggcagtggcgctatctcag

SEQ ID NO: 8560604 - DNA, 20 bp, Homo sapiens
gggcagtggcgctatctcag

SEQ ID NO: 8560605 - DNA, 22 bp, Homo sapiens
gggcagtggtccaggctacagc

SEQ ID NO: 8560606 - DNA, 22 bp, Homo sapiens
gggcagtggtccaggctacagc

SEQ ID NO: 8560607 - DNA, 22 bp, Homo sapiens
gggcagtggtccaggctacagc

SEQ ID NO: 8560608 - DNA, 22 bp, Homo sapiens
gggcagtggtccaggctacagc

SEQ ID NO: 8560609 - DNA, 22 bp, Homo sapiens
gggcagtgggtggctgcagcct

SEQ ID NO: 8560610 - DNA, 22 bp, Homo sapiens
gggcagtgggtggctgcagcct

SEQ ID NO: 8560611 - DNA, 22 bp, Homo sapiens
gggcagtggttacacagctgag

SEQ ID NO: 8560612 - DNA, 22 bp, Homo sapiens
gggcagtggttacacagctgag

SEQ ID NO: 8560613 - DNA, 22 bp, Homo sapiens
cagagacaggcttgccctccac

SEQ ID NO: 8560614 - DNA, 22 bp, Homo sapiens
cagagacagggcagggagtgtg

SEQ ID NO: 8560615 - DNA, 22 bp, Homo sapiens
cagagacagggcagggagtgtg

SEQ ID NO: 8560616 - DNA, 22 bp, Homo sapiens
cagagacagtttcacagggtct

SEQ ID NO: 8560617 - DNA, 22 bp, Homo sapiens
cagagacagtttcacagggtct

SEQ ID NO: 8560618 - DNA, 22 bp, Homo sapiens
cagagacagggcagggagtgtg

SEQ ID NO: 8560619 - DNA, 22 bp, Homo sapiens
cagagacaggatctcgaagact

SEQ ID NO: 8560620 - DNA, 22 bp, Homo sapiens
cagagacaggatctcgaagact

SEQ ID NO: 8560621 - DNA, 22 bp, Homo sapiens
cagagacaggatctcgaagact

SEQ ID NO: 8560622 - DNA, 22 bp, Homo sapiens
cagagacaggaatcagctgcag

SEQ ID NO: 8560623 - DNA, 22 bp, Homo sapiens
cagagacaggaatcagctgcag

SEQ ID NO: 8560624 - DNA, 22 bp, Homo sapiens
cagagacaggagtgctcccagt

SEQ ID NO: 8560625 - DNA, 22 bp, Homo sapiens
cagactgagggcatcacatacg

SEQ ID NO: 8560626 - DNA, 22 bp, Homo sapiens
cagactggccacatctgcactg

SEQ ID NO: 8560627 - DNA, 22 bp, Homo sapiens
cagactggccacatctgcactg

SEQ ID NO: 8560628 - DNA, 22 bp, Homo sapiens
cagactggccacatctgcactg

SEQ ID NO: 8560629 - DNA, 22 bp, Homo sapiens
cagactggctgaaggccgagtg

SEQ ID NO: 8560630 - DNA, 22 bp, Homo sapiens
cagactggctgaaggccgagtg

SEQ ID NO: 8560631 - DNA, 22 bp, Homo sapiens
cagactggctgaaggccgagtg

SEQ ID NO: 8560632 - DNA, 22 bp, Homo sapiens
cagactgaaaatccctggtagt

SEQ ID NO: 8560633 - DNA, 22 bp, Homo sapiens
cagactctgatgcagccttgtg

SEQ ID NO: 8560634 - DNA, 22 bp, Homo sapiens
gggcagcagagccctgccgagt

SEQ ID NO: 8560635 - DNA, 22 bp, Homo sapiens
cagactggctgaaggccgagtg

SEQ ID NO: 8560636 - DNA, 22 bp, Homo sapiens
cagactgggagtcaggaagaag

SEQ ID NO: 8560637 - DNA, 22 bp, Homo sapiens
cagactgggctggtggaaagct

SEQ ID NO: 8560638 - DNA, 22 bp, Homo sapiens
cagactgtagagtttgagaagt

SEQ ID NO: 8560639 - DNA, 19 bp, Homo sapiens
cagacctgtccagcctgtg

SEQ ID NO: 8560640 - DNA, 19 bp, Homo sapiens
cagacctgtccagcctgtg

SEQ ID NO: 8560641 - DNA, 19 bp, Homo sapiens
cagacctgtccagcctgtg

SEQ ID NO: 8560642 - DNA, 19 bp, Homo sapiens
cagacctgtccagcctgtg

SEQ ID NO: 8560643 - DNA, 22 bp, Homo sapiens
cagacgggtggtctgcgaggcc

SEQ ID NO: 8560644 - DNA, 19 bp, Homo sapiens
cagacctgtccagcctgtg

SEQ ID NO: 8560645 - DNA, 22 bp, Homo sapiens
cagacctggggcctgggagccc

SEQ ID NO: 8560646 - DNA, 22 bp, Homo sapiens
cagacctgggtccctggcctgt

SEQ ID NO: 8560647 - DNA, 20 bp, Homo sapiens
cagacctgcacccacttcga

SEQ ID NO: 8560648 - DNA, 22 bp, Homo sapiens
cagacctggaaaacaggcttgc

SEQ ID NO: 8560649 - DNA, 20 bp, Homo sapiens
cagacctgcacccacttcga

SEQ ID NO: 8560650 - DNA, 23 bp, Homo sapiens
cagacctggcagtcatcctcaac

SEQ ID NO: 8560651 - DNA, 22 bp, Homo sapiens
cagacctggaaaacaggcttgc

SEQ ID NO: 8560652 - DNA, 22 bp, Homo sapiens
cagacctggaaaacaggcttgc

SEQ ID NO: 8560653 - DNA, 22 bp, Homo sapiens
cagacctgaggagcactgagcc

SEQ ID NO: 8560654 - DNA, 22 bp, Homo sapiens
cagacctgaggttgagtaccag

SEQ ID NO: 8560655 - DNA, 22 bp, Homo sapiens
cagacctgaggagcactgagcc

SEQ ID NO: 8560656 - DNA, 22 bp, Homo sapiens
cagacctgaggagcactgagcc

SEQ ID NO: 8560657 - DNA, 17 bp, Homo sapiens
cagacctctgtgaagcc

SEQ ID NO: 8560658 - DNA, 22 bp, Homo sapiens
cagaccagaaggaagccgacaa

SEQ ID NO: 8560659 - DNA, 22 bp, Homo sapiens
cagacccaggatccaaatgttg

SEQ ID NO: 8560660 - DNA, 22 bp, Homo sapiens
cagacccaggatccaaatgttg

SEQ ID NO: 8560661 - DNA, 22 bp, Homo sapiens
cagaccctcgggtgagttggcc

SEQ ID NO: 8560662 - DNA, 22 bp, Homo sapiens
cagacctcagtcctcagtagga

SEQ ID NO: 8560663 - DNA, 22 bp, Homo sapiens
cagacccttttctgagaggacc

SEQ ID NO: 8560664 - DNA, 22 bp, Homo sapiens
cagacctcaaagctgcagtgct

SEQ ID NO: 8560665 - DNA, 22 bp, Homo sapiens
cagaccctcgggtgagttggcc

SEQ ID NO: 8560666 - DNA, 22 bp, Homo sapiens
ggcttcaagtcgtatatttggg

SEQ ID NO: 8560667 - DNA, 22 bp, Homo sapiens
ggcttagtgtttctgctcagcc

SEQ ID NO: 8560668 - DNA, 22 bp, Homo sapiens
ggcttcagaagactggacaggt

SEQ ID NO: 8560669 - DNA, 22 bp, Homo sapiens
ggcttcacctgtgcactctacc

SEQ ID NO: 8560670 - DNA, 22 bp, Homo sapiens
ggcttcagaggggaggtagtgc

SEQ ID NO: 8560671 - DNA, 22 bp, Homo sapiens
ggcttcagatttctcagttgtt

SEQ ID NO: 8560672 - DNA, 22 bp, Homo sapiens
cagagggttgtcaggcgccttg

SEQ ID NO: 8560673 - DNA, 21 bp, Homo sapiens
cagagggtttctcaggtgttt

SEQ ID NO: 8560674 - DNA, 22 bp, Homo sapiens
cagagggttgatgtgaggctta

SEQ ID NO: 8560675 - DNA, 23 bp, Homo sapiens
cagagggttccatggagcatggt

SEQ ID NO: 8560676 - DNA, 21 bp, Homo sapiens
cagagggtttctcaggtgttt

SEQ ID NO: 8560677 - DNA, 21 bp, Homo sapiens
cagagggtttctcaggtgttt

SEQ ID NO: 8560678 - DNA, 22 bp, Homo sapiens
cagaggtacaagctaagttggg

SEQ ID NO: 8560679 - DNA, 21 bp, Homo sapiens
cagagggtttctcaggtgttt

SEQ ID NO: 8560680 - DNA, 22 bp, Homo sapiens
cagaggtacaagctaagttggg

SEQ ID NO: 8560681 - DNA, 22 bp, Homo sapiens
cagaggtacagccattgaagat

SEQ ID NO: 8560682 - DNA, 22 bp, Homo sapiens
cagaggtaccagcagcctctgg

SEQ ID NO: 8560683 - DNA, 22 bp, Homo sapiens
ggtcaggtagctctgacaggcc

SEQ ID NO: 8560684 - DNA, 22 bp, Homo sapiens
ggtcacaggggagaagagtgat

SEQ ID NO: 8560685 - DNA, 22 bp, Homo sapiens
cagaggtagaaggcatgcagtg

SEQ ID NO: 8560686 - DNA, 22 bp, Homo sapiens
cagaggtaccagcagcctctgg

SEQ ID NO: 8560687 - DNA, 22 bp, Homo sapiens
cagaggtagaactggccctcac

SEQ ID NO: 8560688 - DNA, 22 bp, Homo sapiens
cagaggtagaaggcatgcagtg

SEQ ID NO: 8560689 - DNA, 22 bp, Homo sapiens
cagaggtagcatgctgtggctt

SEQ ID NO: 8560690 - DNA, 22 bp, Homo sapiens
cagaggtagaaggcatgcagtg

SEQ ID NO: 8560691 - DNA, 22 bp, Homo sapiens
ggtcaggtttttaggagtgacc

SEQ ID NO: 8560692 - DNA, 22 bp, Homo sapiens
ggtcaggtggcttctgtcctct

SEQ ID NO: 8560693 - DNA, 22 bp, Homo sapiens
ggtcaggtttttaggagtgacc

SEQ ID NO: 8560694 - DNA, 21 bp, Homo sapiens
ggtcagtggctttcttgcacc

SEQ ID NO: 8560695 - DNA, 22 bp, Homo sapiens
ggtcagtgtacacatgtgcagg

SEQ ID NO: 8560696 - DNA, 22 bp, Homo sapiens
ggtcatctgcctccaaagcact

SEQ ID NO: 8560697 - DNA, 22 bp, Homo sapiens
ggtcattgaaatcagaagggtt

SEQ ID NO: 8560698 - DNA, 23 bp, Homo sapiens
ggtccacccgagcctgcagcttc

SEQ ID NO: 8560699 - DNA, 22 bp, Homo sapiens
ggtccagaagctggtagggtag

SEQ ID NO: 8560700 - DNA, 22 bp, Homo sapiens
ggtccacctccaagctggggac

SEQ ID NO: 8560701 - DNA, 23 bp, Homo sapiens
ggtccacccgagcctgcagcttc

SEQ ID NO: 8560702 - DNA, 22 bp, Homo sapiens
ggtcatgagggagcagtgcagg

SEQ ID NO: 8560703 - DNA, 22 bp, Homo sapiens
cagagtcatgggccgtcaggca

SEQ ID NO: 8560704 - DNA, 22 bp, Homo sapiens
cagagtcatgggccgtcaggca

SEQ ID NO: 8560705 - DNA, 22 bp, Homo sapiens
cagagtcatatcagagaatatg

SEQ ID NO: 8560706 - DNA, 22 bp, Homo sapiens
cagagtcagctagtcttgggat

SEQ ID NO: 8560707 - DNA, 22 bp, Homo sapiens
cagagtcagctagtcttgggat

SEQ ID NO: 8560708 - DNA, 22 bp, Homo sapiens
cagagtccaattgctcagagcg

SEQ ID NO: 8560709 - DNA, 22 bp, Homo sapiens
cagagtcccagatgcccctcct

SEQ ID NO: 8560710 - DNA, 22 bp, Homo sapiens
cagagtcctggacacagagaca

SEQ ID NO: 8560711 - DNA, 22 bp, Homo sapiens
cagagtcctggacacagagaca

SEQ ID NO: 8560712 - DNA, 19 bp, Homo sapiens
cagagtccttgaccagtcc

SEQ ID NO: 8560713 - DNA, 22 bp, Homo sapiens
cagagtcctgcaccagctccag

SEQ ID NO: 8560714 - DNA, 22 bp, Homo sapiens
cagagtcctggacacagagaca

SEQ ID NO: 8560715 - DNA, 22 bp, Homo sapiens
cagagtctggactgcaggctcc

SEQ ID NO: 8560716 - DNA, 22 bp, Homo sapiens
ggtctgagagccactgaatccc

SEQ ID NO: 8560717 - DNA, 22 bp, Homo sapiens
ggtctgagatatttgttcagct

SEQ ID NO: 8560718 - DNA, 22 bp, Homo sapiens
ggtcctgggaagatgctcatga

SEQ ID NO: 8560719 - DNA, 17 bp, Homo sapiens
cagagtctgtctgcatc

SEQ ID NO: 8560720 - DNA, 22 bp, Homo sapiens
cagaggcacaagaaagcaaggc

SEQ ID NO: 8560721 - DNA, 22 bp, Homo sapiens
cagaggcacagcttcttttaat

SEQ ID NO: 8560722 - DNA, 19 bp, Homo sapiens
cagaggcaccaggtataga

SEQ ID NO: 8560723 - DNA, 19 bp, Homo sapiens
cagaggcaccaggtataga

SEQ ID NO: 8560724 - DNA, 22 bp, Homo sapiens
ggggagagtcctttccagttcc

SEQ ID NO: 8560725 - DNA, 22 bp, Homo sapiens
ggggagcaggctgggctgtctg

SEQ ID NO: 8560726 - DNA, 22 bp, Homo sapiens
ggggagcaattgcccccttaga

SEQ ID NO: 8560727 - DNA, 22 bp, Homo sapiens
ggggagcagaagcagcaacaac

SEQ ID NO: 8560728 - DNA, 18 bp, Homo sapiens
ggggagcagactgaactc

SEQ ID NO: 8560729 - DNA, 22 bp, Homo sapiens
ggggagcaatagttgaggtgtg

SEQ ID NO: 8560730 - DNA, 22 bp, Homo sapiens
ggggagcaatagttgaggtgtg

SEQ ID NO: 8560731 - DNA, 21 bp, Homo sapiens
cagaggggctagcctggctgc

SEQ ID NO: 8560732 - DNA, 21 bp, Homo sapiens
cagaggggctagcctggctgc

SEQ ID NO: 8560733 - DNA, 21 bp, Homo sapiens
cagaggggctagcctggctgc

SEQ ID NO: 8560734 - DNA, 22 bp, Homo sapiens
cagaggggctgacacccttggc

SEQ ID NO: 8560735 - DNA, 22 bp, Homo sapiens
cagaggggataacaggtgtaga

SEQ ID NO: 8560736 - DNA, 22 bp, Homo sapiens
cagagggtgtgaaggggatgaa

SEQ ID NO: 8560737 - DNA, 22 bp, Homo sapiens
cagagggtggaggccaggctct

SEQ ID NO: 8560738 - DNA, 23 bp, Homo sapiens
cagagggttccatggagcatggt

SEQ ID NO: 8560739 - DNA, 23 bp, Homo sapiens
cagagggttccatggagcatggt

SEQ ID NO: 8560740 - DNA, 22 bp, Homo sapiens
cagaggggctgacacccttggc

SEQ ID NO: 8560741 - DNA, 22 bp, Homo sapiens
cagaggggtgtagagatcactg

SEQ ID NO: 8560742 - DNA, 22 bp, Homo sapiens
cagagggtcaccaggaagtgca

SEQ ID NO: 8560743 - DNA, 22 bp, Homo sapiens
cagagggtggaggccaggctct

SEQ ID NO: 8560744 - DNA, 22 bp, Homo sapiens
cagagggcttcaggttcaggat

SEQ ID NO: 8560745 - DNA, 22 bp, Homo sapiens
cagagggcttcaggttcaggat

SEQ ID NO: 8560746 - DNA, 22 bp, Homo sapiens
cagagggcttcaggttcaggat

SEQ ID NO: 8560747 - DNA, 22 bp, Homo sapiens
cagagggctgtgtaaggatgtt

SEQ ID NO: 8560748 - DNA, 22 bp, Homo sapiens
cagagggctgccctgagttcgt

SEQ ID NO: 8560749 - DNA, 22 bp, Homo sapiens
cagagggctcttggctgcctgc

SEQ ID NO: 8560750 - DNA, 22 bp, Homo sapiens
cagagggctcttggctgcctgc

SEQ ID NO: 8560751 - DNA, 22 bp, Homo sapiens
cagagggctcggcggccgctcc

SEQ ID NO: 8560752 - DNA, 22 bp, Homo sapiens
cagagggctcagtcctgctgga

SEQ ID NO: 8560753 - DNA, 22 bp, Homo sapiens
cagaggctttgccctggaaacc

SEQ ID NO: 8560754 - DNA, 22 bp, Homo sapiens
cagcacagtttcccccatgagc

SEQ ID NO: 8560755 - DNA, 22 bp, Homo sapiens
cagcacagtttcccccatgagc

SEQ ID NO: 8560756 - DNA, 22 bp, Homo sapiens
cagcacagtttctggcccgccg

SEQ ID NO: 8560757 - DNA, 22 bp, Homo sapiens
cagcacagtttgcttggcagag

SEQ ID NO: 8560758 - DNA, 22 bp, Homo sapiens
cagcacagtttctggcccgccg

SEQ ID NO: 8560759 - DNA, 22 bp, Homo sapiens
cagcacagtttctggcccgccg

SEQ ID NO: 8560760 - DNA, 22 bp, Homo sapiens
cagcacagtgttaggtaatttg

SEQ ID NO: 8560761 - DNA, 22 bp, Homo sapiens
cagcacagtttcccccatgagc

SEQ ID NO: 8560762 - DNA, 22 bp, Homo sapiens
cagcacagtttcccccatgagc

SEQ ID NO: 8560763 - DNA, 22 bp, Homo sapiens
cagcacagtgcagatgctgact

SEQ ID NO: 8560764 - DNA, 22 bp, Homo sapiens
cagcacagtgaccagacccact

SEQ ID NO: 8560765 - DNA, 22 bp, Homo sapiens
cagcacagtgaccagacccact

SEQ ID NO: 8560766 - DNA, 22 bp, Homo sapiens
cagcacagtgaccagacccact

SEQ ID NO: 8560767 - DNA, 22 bp, Homo sapiens
cagcacagtgaccagacccact

SEQ ID NO: 8560768 - DNA, 22 bp, Homo sapiens
cagcacagtgcagatgctgact

SEQ ID NO: 8560769 - DNA, 22 bp, Homo sapiens
cagcacagtagagtagttgtaa

SEQ ID NO: 8560770 - DNA, 22 bp, Homo sapiens
cagcacagtagagtagttgtaa

SEQ ID NO: 8560771 - DNA, 22 bp, Homo sapiens
cagcacagtcctttgcttactg

SEQ ID NO: 8560772 - DNA, 22 bp, Homo sapiens
cagcacagtgaccagacccact

SEQ ID NO: 8560773 - DNA, 22 bp, Homo sapiens
cagcacataagccgaagactgt

SEQ ID NO: 8560774 - DNA, 22 bp, Homo sapiens
cagcacagtttgcttggcagag

SEQ ID NO: 8560775 - DNA, 22 bp, Homo sapiens
cagcacagtttgcttggcagag

SEQ ID NO: 8560776 - DNA, 22 bp, Homo sapiens
cagcacagtttgcttggcagag

SEQ ID NO: 8560777 - DNA, 22 bp, Homo sapiens
cagcacatagcatgcttgtcag

SEQ ID NO: 8560778 - DNA, 19 bp, Homo sapiens
cagcacatgcttctctgag

SEQ ID NO: 8560779 - DNA, 22 bp, Homo sapiens
cagcacatgctcatcagggaag

SEQ ID NO: 8560780 - DNA, 22 bp, Homo sapiens
cagcacatagtaggtattcact

SEQ ID NO: 8560781 - DNA, 22 bp, Homo sapiens
cagcaccatttgcagcctcttt

SEQ ID NO: 8560782 - DNA, 22 bp, Homo sapiens
cagcaccatttgcagcctcttt

SEQ ID NO: 8560783 - DNA, 22 bp, Homo sapiens
cagcaccatttgcagcctcttt

SEQ ID NO: 8560784 - DNA, 22 bp, Homo sapiens
ggtgctgacttcacagtcttac

SEQ ID NO: 8560785 - DNA, 22 bp, Homo sapiens
ggtgctgatagtaacaataata

SEQ ID NO: 8560786 - DNA, 20 bp, Homo sapiens
ggtgctgataagaaagaagt

SEQ ID NO: 8560787 - DNA, 22 bp, Homo sapiens
cagcaaggactgggcatgtgaa

SEQ ID NO: 8560788 - DNA, 22 bp, Homo sapiens
cagcaaggactgggcatgtgaa

SEQ ID NO: 8560789 - DNA, 21 bp, Homo sapiens
cagcaaggaagtcgagtaggt

SEQ ID NO: 8560790 - DNA, 22 bp, Homo sapiens
cagcaaggactgggcatgtgaa

SEQ ID NO: 8560791 - DNA, 22 bp, Homo sapiens
cagcaaggactgggcatgtgaa

SEQ ID NO: 8560792 - DNA, 22 bp, Homo sapiens
ggtgctggacacgtggcactcc

SEQ ID NO: 8560793 - DNA, 22 bp, Homo sapiens
cagcacacagtgactcgcacct

SEQ ID NO: 8560794 - DNA, 22 bp, Homo sapiens
cagcacagtacaaggcacggat

SEQ ID NO: 8560795 - DNA, 22 bp, Homo sapiens
cagcacacagtgactcgcacct

SEQ ID NO: 8560796 - DNA, 22 bp, Homo sapiens
cagcacaattttcaggagtcca

SEQ ID NO: 8560797 - DNA, 22 bp, Homo sapiens
cagcacagtacaaggcacggat

SEQ ID NO: 8560798 - DNA, 22 bp, Homo sapiens
cagcacagtacaaggcacggat

SEQ ID NO: 8560799 - DNA, 21 bp, Homo sapiens
cagcacagtactgggtcttgc

SEQ ID NO: 8560800 - DNA, 21 bp, Homo sapiens
cagcacagtactgggtcttgc

SEQ ID NO: 8560801 - DNA, 21 bp, Homo sapiens
cagcacagtactgggtcttgc

SEQ ID NO: 8560802 - DNA, 23 bp, Homo sapiens
cagcacagtacatttcctgtctc

SEQ ID NO: 8560803 - DNA, 22 bp, Homo sapiens
ggtctgagtggggcctgagatt

SEQ ID NO: 8560804 - DNA, 22 bp, Homo sapiens
ggtctgagtggggcctgagatt

SEQ ID NO: 8560805 - DNA, 22 bp, Homo sapiens
ggtctgaggtgggacccaggaa

SEQ ID NO: 8560806 - DNA, 22 bp, Homo sapiens
ggtctgagtgccagggagagaa

SEQ ID NO: 8560807 - DNA, 22 bp, Homo sapiens
ggtctgagtggtgctgactcag

SEQ ID NO: 8560808 - DNA, 18 bp, Homo sapiens
ggtctgagatcgtttttc

SEQ ID NO: 8560809 - DNA, 22 bp, Homo sapiens
ggtctgagctctaaaactaact

SEQ ID NO: 8560810 - DNA, 22 bp, Homo sapiens
ggtctgagctctaaaactaact

SEQ ID NO: 8560811 - DNA, 18 bp, Homo sapiens
ggtctgagatcgtttttc

SEQ ID NO: 8560812 - DNA, 22 bp, Homo sapiens
ggtctgagcttgagcccatgct

SEQ ID NO: 8560813 - DNA, 22 bp, Homo sapiens
ggtctgagcttgagcccatgct

SEQ ID NO: 8560814 - DNA, 22 bp, Homo sapiens
ggtctgaggctccaaggaggtg

SEQ ID NO: 8560815 - DNA, 22 bp, Homo sapiens
ggtctgaggtttgggattcact

SEQ ID NO: 8560816 - DNA, 22 bp, Homo sapiens
ggtctgaggtgggacccaggaa

SEQ ID NO: 8560817 - DNA, 22 bp, Homo sapiens
ggtgacctcacctggtcccacc

SEQ ID NO: 8560818 - DNA, 19 bp, Homo sapiens
ggtgaccacctggtcagtg

SEQ ID NO: 8560819 - DNA, 19 bp, Homo sapiens
ggtgaccacctggtcagtg

SEQ ID NO: 8560820 - DNA, 22 bp, Homo sapiens
ggtctggaataaggtccaggaa

SEQ ID NO: 8560821 - DNA, 22 bp, Homo sapiens
ggtctggaagcgtcccaaaggt

SEQ ID NO: 8560822 - DNA, 22 bp, Homo sapiens
ggtgacagcgggtcaagaggag

SEQ ID NO: 8560823 - DNA, 22 bp, Homo sapiens
ggtctggaataaggtccaggaa

SEQ ID NO: 8560824 - DNA, 22 bp, Homo sapiens
ggtgacagtggttaaaatttgt

SEQ ID NO: 8560825 - DNA, 22 bp, Homo sapiens
ggtgacagtggttaaaatttgt

SEQ ID NO: 8560826 - DNA, 22 bp, Homo sapiens
ggtgacgaatccatagcatcga

SEQ ID NO: 8560827 - DNA, 22 bp, Homo sapiens
ggtgacggggcccaggtttcct

SEQ ID NO: 8560828 - DNA, 22 bp, Homo sapiens
ggtgactggtttatctggcagt

SEQ ID NO: 8560829 - DNA, 22 bp, Homo sapiens
ggtgactggagggacccaggcc

SEQ ID NO: 8560830 - DNA, 22 bp, Homo sapiens
ggtgagactttagaagagccag

SEQ ID NO: 8560831 - DNA, 22 bp, Homo sapiens
ggtgagagaaaagaaacactgt

SEQ ID NO: 8560832 - DNA, 22 bp, Homo sapiens
ggtgagactttagaagagccag

SEQ ID NO: 8560833 - DNA, 22 bp, Homo sapiens
ggtgagaaagggattcctgttc

SEQ ID NO: 8560834 - DNA, 17 bp, Homo sapiens
ggtgagacctcccactc

SEQ ID NO: 8560835 - DNA, 22 bp, Homo sapiens
cagcaaatactactagttttta

SEQ ID NO: 8560836 - DNA, 22 bp, Homo sapiens
cagcaaagtaagctgacatgta

SEQ ID NO: 8560837 - DNA, 22 bp, Homo sapiens
cagcaagattaagggcagaaaa

SEQ ID NO: 8560838 - DNA, 22 bp, Homo sapiens
cagcaagatttttaaagcaagg

SEQ ID NO: 8560839 - DNA, 22 bp, Homo sapiens
cagcaagatttttaaagcaagg

SEQ ID NO: 8560840 - DNA, 22 bp, Homo sapiens
cagcaagccaaatgtggcccga

SEQ ID NO: 8560841 - DNA, 21 bp, Homo sapiens
cagcaaggaagtcgagtaggt

SEQ ID NO: 8560842 - DNA, 21 bp, Homo sapiens
cagcaaggaagtcgagtaggt

SEQ ID NO: 8560843 - DNA, 22 bp, Homo sapiens
cagcaagagggtaaggttgaag

SEQ ID NO: 8560844 - DNA, 22 bp, Homo sapiens
cagcaagagaggcagggcaaat

SEQ ID NO: 8560845 - DNA, 22 bp, Homo sapiens
cagcaagatggtgaatgagacg

SEQ ID NO: 8560846 - DNA, 22 bp, Homo sapiens
gaacaaacacatcccagcagtg

SEQ ID NO: 8560847 - DNA, 22 bp, Homo sapiens
gaacaaacagtcaggacagtct

SEQ ID NO: 8560848 - DNA, 22 bp, Homo sapiens
gaacaaacatttttggcagtat

SEQ ID NO: 8560849 - DNA, 22 bp, Homo sapiens
gaacaactccaagggacatcat

SEQ ID NO: 8560850 - DNA, 22 bp, Homo sapiens
gaacaactttgaaacatgaaga

SEQ ID NO: 8560851 - DNA, 22 bp, Homo sapiens
gaacaactcttcttgagagatg

SEQ ID NO: 8560852 - DNA, 22 bp, Homo sapiens
gaacaactcttcttgagagatg

SEQ ID NO: 8560853 - DNA, 22 bp, Homo sapiens
gaacaaattggagaaatcagga

SEQ ID NO: 8560854 - DNA, 22 bp, Homo sapiens
gaacaaattggagaaatcagga

SEQ ID NO: 8560855 - DNA, 22 bp, Homo sapiens
gaacaaattctcatcaacttgt

SEQ ID NO: 8560856 - DNA, 22 bp, Homo sapiens
gaacaaattctcatcaacttgt

SEQ ID NO: 8560857 - DNA, 22 bp, Homo sapiens
gaacaaagacatggaggaggat

SEQ ID NO: 8560858 - DNA, 22 bp, Homo sapiens
gaacaaatcccttcctgtctcc

SEQ ID NO: 8560859 - DNA, 22 bp, Homo sapiens
gaacaaattctcatcaacttgt

SEQ ID NO: 8560860 - DNA, 22 bp, Homo sapiens
gaacaatagtggtaacaaagcc

SEQ ID NO: 8560861 - DNA, 22 bp, Homo sapiens
gaacaactttgaaacatgaaga

SEQ ID NO: 8560862 - DNA, 22 bp, Homo sapiens
gaacaaggattcccaaagaaga

SEQ ID NO: 8560863 - DNA, 22 bp, Homo sapiens
gaacaatacaggctttattcct

SEQ ID NO: 8560864 - DNA, 22 bp, Homo sapiens
gaacaatacaggctttattcct

SEQ ID NO: 8560865 - DNA, 22 bp, Homo sapiens
gaaggcaagatctcagtggagg

SEQ ID NO: 8560866 - DNA, 22 bp, Homo sapiens
gaaggcaagcagcataaatgtc

SEQ ID NO: 8560867 - DNA, 22 bp, Homo sapiens
gaaggctggctttctgagagca

SEQ ID NO: 8560868 - DNA, 22 bp, Homo sapiens
gaaggctggctttctgagagca

SEQ ID NO: 8560869 - DNA, 22 bp, Homo sapiens
gaaggctggaaggcaagtagga

SEQ ID NO: 8560870 - DNA, 22 bp, Homo sapiens
atgcacagaacaattttaagag

SEQ ID NO: 8560871 - DNA, 22 bp, Homo sapiens
atgcacagaacaattttaagag

SEQ ID NO: 8560872 - DNA, 22 bp, Homo sapiens
atgcacagaaaaattgcttact

SEQ ID NO: 8560873 - DNA, 22 bp, Homo sapiens
atgcacactgggattcaactgg

SEQ ID NO: 8560874 - DNA, 22 bp, Homo sapiens
atgcacacgtaccctacaaggc

SEQ ID NO: 8560875 - DNA, 22 bp, Homo sapiens
atgcacactgaatgcttacttt

SEQ ID NO: 8560876 - DNA, 19 bp, Homo sapiens
atgcacacattgaagagga

SEQ ID NO: 8560877 - DNA, 19 bp, Homo sapiens
atgcacacattgaagagga

SEQ ID NO: 8560878 - DNA, 22 bp, Homo sapiens
atgcacacaagcttatgtatta

SEQ ID NO: 8560879 - DNA, 22 bp, Homo sapiens
atgcacagacccaaaggccatc

SEQ ID NO: 8560880 - DNA, 22 bp, Homo sapiens
atgcacagacccaaaggccatc

SEQ ID NO: 8560881 - DNA, 22 bp, Homo sapiens
atgcacagacccaaaggccatc

SEQ ID NO: 8560882 - DNA, 22 bp, Homo sapiens
atgcacagatccccaggaccct

SEQ ID NO: 8560883 - DNA, 22 bp, Homo sapiens
atgcacagatcctggcacttag

SEQ ID NO: 8560884 - DNA, 22 bp, Homo sapiens
atgcacaggacagcctctactc

SEQ ID NO: 8560885 - DNA, 22 bp, Homo sapiens
atgcacaggaagtgtccccatt

SEQ ID NO: 8560886 - DNA, 22 bp, Homo sapiens
atgcacaggaagtgtccccatt

SEQ ID NO: 8560887 - DNA, 22 bp, Homo sapiens
atgcacagctgaacactctaaa

SEQ ID NO: 8560888 - DNA, 22 bp, Homo sapiens
atgcacagctgaacactctaaa

SEQ ID NO: 8560889 - DNA, 22 bp, Homo sapiens
atgcacagcagtgagttcagtg

SEQ ID NO: 8560890 - DNA, 22 bp, Homo sapiens
atgcacagcagtgagttcagtg

SEQ ID NO: 8560891 - DNA, 22 bp, Homo sapiens
gaaggctgtcagagaggagggc

SEQ ID NO: 8560892 - DNA, 22 bp, Homo sapiens
gaaggctgtggctggtctcagt

SEQ ID NO: 8560893 - DNA, 22 bp, Homo sapiens
atgcacaattaggatatagctt

SEQ ID NO: 8560894 - DNA, 22 bp, Homo sapiens
atgcacaggtgctgatgcacgc

SEQ ID NO: 8560895 - DNA, 22 bp, Homo sapiens
atgcacaggtgctgatgcacgc

SEQ ID NO: 8560896 - DNA, 22 bp, Homo sapiens
atgcacaggctgtgggctggtt

SEQ ID NO: 8560897 - DNA, 22 bp, Homo sapiens
atgcacaggctgtgggctggtt

SEQ ID NO: 8560898 - DNA, 22 bp, Homo sapiens
atgcacaggctgtgggctggtt

SEQ ID NO: 8560899 - DNA, 22 bp, Homo sapiens
atgcacaggaccacacataatg

SEQ ID NO: 8560900 - DNA, 22 bp, Homo sapiens
atgcacaggaccacacataatg

SEQ ID NO: 8560901 - DNA, 22 bp, Homo sapiens
atgcacagtaatgagctggttg

SEQ ID NO: 8560902 - DNA, 22 bp, Homo sapiens
gaataatagcagaaattagcag

SEQ ID NO: 8560903 - DNA, 22 bp, Homo sapiens
gaataagtgaagttggcagctt

SEQ ID NO: 8560904 - DNA, 22 bp, Homo sapiens
gaataacattttttcctttaca

SEQ ID NO: 8560905 - DNA, 22 bp, Homo sapiens
gaataacattttttcctttaca

SEQ ID NO: 8560906 - DNA, 22 bp, Homo sapiens
gaataatattgactttgcaggc

SEQ ID NO: 8560907 - DNA, 22 bp, Homo sapiens
gaataatagcagaaattagcag

SEQ ID NO: 8560908 - DNA, 17 bp, Homo sapiens
gaataagtggatggcac

SEQ ID NO: 8560909 - DNA, 22 bp, Homo sapiens
gaataattttgatcagaaggga

SEQ ID NO: 8560910 - DNA, 22 bp, Homo sapiens
gaatacaaacttaaggctttac

SEQ ID NO: 8560911 - DNA, 22 bp, Homo sapiens
gaatacaaacttaaggctttac

SEQ ID NO: 8560912 - DNA, 22 bp, Homo sapiens
gaataatattgactttgcaggc

SEQ ID NO: 8560913 - DNA, 22 bp, Homo sapiens
gaataatcatgaaattcagtga

SEQ ID NO: 8560914 - DNA, 22 bp, Homo sapiens
gaataatcatatcgtctcacat

SEQ ID NO: 8560915 - DNA, 22 bp, Homo sapiens
gaataattgtgatgcttgaagt

SEQ ID NO: 8560916 - DNA, 22 bp, Homo sapiens
gaataattgtgatgcttgaagt

SEQ ID NO: 8560917 - DNA, 22 bp, Homo sapiens
gaataatcatatcgtctcacat

SEQ ID NO: 8560918 - DNA, 22 bp, Homo sapiens
gaataatcatgaaattcagtga

SEQ ID NO: 8560919 - DNA, 22 bp, Homo sapiens
gaatacaaagcagaactcatac

SEQ ID NO: 8560920 - DNA, 22 bp, Homo sapiens
gaatacaaagcagaactcatac

SEQ ID NO: 8560921 - DNA, 23 bp, Homo sapiens
gaatacaaagcagatggtccagc

SEQ ID NO: 8560922 - DNA, 22 bp, Homo sapiens
gacaatgcagaagtacttgttc

SEQ ID NO: 8560923 - DNA, 21 bp, Homo sapiens
gacaatgcagtcttttttgga

SEQ ID NO: 8560924 - DNA, 22 bp, Homo sapiens
gacaatgcattgtgattgtgac

SEQ ID NO: 8560925 - DNA, 22 bp, Homo sapiens
gacaatggtggatacatgtcat

SEQ ID NO: 8560926 - DNA, 22 bp, Homo sapiens
gacaataaagtgatacatggga

SEQ ID NO: 8560927 - DNA, 22 bp, Homo sapiens
gacaataagaaaagaggaggca

SEQ ID NO: 8560928 - DNA, 22 bp, Homo sapiens
gacaataagaacagatactgtg

SEQ ID NO: 8560929 - DNA, 22 bp, Homo sapiens
gacaataaagtgatacatggga

SEQ ID NO: 8560930 - DNA, 19 bp, Homo sapiens
gaattttaggacttcagca

SEQ ID NO: 8560931 - DNA, 22 bp, Homo sapiens
gaatcagatactgatttcagtc

SEQ ID NO: 8560932 - DNA, 22 bp, Homo sapiens
gaatcagaatctctaaggtggg

SEQ ID NO: 8560933 - DNA, 22 bp, Homo sapiens
gaatcagactgacctgagttca

SEQ ID NO: 8560934 - DNA, 22 bp, Homo sapiens
gaatatttttaaagggactaat

SEQ ID NO: 8560935 - DNA, 22 bp, Homo sapiens
gaatatttttaaagggactaat

SEQ ID NO: 8560936 - DNA, 22 bp, Homo sapiens
gaatcaaatcaagttcttttga

SEQ ID NO: 8560937 - DNA, 22 bp, Homo sapiens
gaatacaaataataccaaggtg

SEQ ID NO: 8560938 - DNA, 22 bp, Homo sapiens
gaatattttcagtacagatggt

SEQ ID NO: 8560939 - DNA, 22 bp, Homo sapiens
gaatattttcagtacagatggt

SEQ ID NO: 8560940 - DNA, 22 bp, Homo sapiens
gaatattttcagtacagatggt

SEQ ID NO: 8560941 - DNA, 22 bp, Homo sapiens
gaatattttcagtacagatggt

SEQ ID NO: 8560942 - DNA, 22 bp, Homo sapiens
gaatattttcagtacagatggt

SEQ ID NO: 8560943 - DNA, 22 bp, Homo sapiens
gaatcacactcgtaagtgagtt

SEQ ID NO: 8560944 - DNA, 22 bp, Homo sapiens
gaatcacagaggcaaattctga

SEQ ID NO: 8560945 - DNA, 22 bp, Homo sapiens
gaatcacagaggcaaattctga

SEQ ID NO: 8560946 - DNA, 22 bp, Homo sapiens
gaatcacggtattctgcacggg

SEQ ID NO: 8560947 - DNA, 22 bp, Homo sapiens
gaatcacagaggcaaattctga

SEQ ID NO: 8560948 - DNA, 22 bp, Homo sapiens
gaccctggcagataccgtcaca

SEQ ID NO: 8560949 - DNA, 17 bp, Homo sapiens
atgctctatagtcagtg

SEQ ID NO: 8560950 - DNA, 22 bp, Homo sapiens
atgctctataaatatgacatgt

SEQ ID NO: 8560951 - DNA, 22 bp, Homo sapiens
atgctctctgtcctgctcagag

SEQ ID NO: 8560952 - DNA, 22 bp, Homo sapiens
atgctctggagtacgtgaaatt

SEQ ID NO: 8560953 - DNA, 22 bp, Homo sapiens
gaccctggagccgtctgaggca

SEQ ID NO: 8560954 - DNA, 22 bp, Homo sapiens
gaccttgtgatctgcccacctt

SEQ ID NO: 8560955 - DNA, 22 bp, Homo sapiens
atgctcattttattgagaatga

SEQ ID NO: 8560956 - DNA, 22 bp, Homo sapiens
atgctcattttattgagaatga

SEQ ID NO: 8560957 - DNA, 18 bp, Homo sapiens
atgctcctatctctgagc

SEQ ID NO: 8560958 - DNA, 17 bp, Homo sapiens
atgctccattcagaagc

SEQ ID NO: 8560959 - DNA, 18 bp, Homo sapiens
atgctcctatctctgagc

SEQ ID NO: 8560960 - DNA, 22 bp, Homo sapiens
atgctccagtgtgatgcttcat

SEQ ID NO: 8560961 - DNA, 22 bp, Homo sapiens
atgctccttggcttcaaagcca

SEQ ID NO: 8560962 - DNA, 18 bp, Homo sapiens
atgctcctatctctgagc

SEQ ID NO: 8560963 - DNA, 22 bp, Homo sapiens
atgctcctcgagtgtctcacag

SEQ ID NO: 8560964 - DNA, 22 bp, Homo sapiens
atgctcctcgagtgtctcacag

SEQ ID NO: 8560965 - DNA, 22 bp, Homo sapiens
atgctatttaccacacatcatt

SEQ ID NO: 8560966 - DNA, 22 bp, Homo sapiens
atgctcagggcacactctggac

SEQ ID NO: 8560967 - DNA, 22 bp, Homo sapiens
atgctcagtagctggctgaccc

SEQ ID NO: 8560968 - DNA, 22 bp, Homo sapiens
atgctcacttcagagaagatga

SEQ ID NO: 8560969 - DNA, 22 bp, Homo sapiens
gactggagcccccaaggacacc

SEQ ID NO: 8560970 - DNA, 22 bp, Homo sapiens
gactggagtgcctccaggaaag

SEQ ID NO: 8560971 - DNA, 21 bp, Homo sapiens
gactggagagaggaagtctgg

SEQ ID NO: 8560972 - DNA, 21 bp, Homo sapiens
gactggagagaggaagtctgg

SEQ ID NO: 8560973 - DNA, 22 bp, Homo sapiens
gactggaatcccaggctctgtg

SEQ ID NO: 8560974 - DNA, 22 bp, Homo sapiens
gactggctcactccactcctat

SEQ ID NO: 8560975 - DNA, 22 bp, Homo sapiens
gactggctctatctccttggcg

SEQ ID NO: 8560976 - DNA, 22 bp, Homo sapiens
gactggcttatttcacttagca

SEQ ID NO: 8560977 - DNA, 22 bp, Homo sapiens
gactacagatagccaattaagt

SEQ ID NO: 8560978 - DNA, 22 bp, Homo sapiens
gactacaggccggcatcagaga

SEQ ID NO: 8560979 - DNA, 22 bp, Homo sapiens
gactggaaagcctgtcctcaga

SEQ ID NO: 8560980 - DNA, 22 bp, Homo sapiens
gactggaaagcctgtcctcaga

SEQ ID NO: 8560981 - DNA, 19 bp, Homo sapiens
gactacagggggaagaagt

SEQ ID NO: 8560982 - DNA, 22 bp, Homo sapiens
gactaaataaaagccaaacttc

SEQ ID NO: 8560983 - DNA, 19 bp, Homo sapiens
gactaaataataatagcag

SEQ ID NO: 8560984 - DNA, 22 bp, Homo sapiens
gacggggcagccagctggtggc

SEQ ID NO: 8560985 - DNA, 22 bp, Homo sapiens
gacggagctggttgctgcggct

SEQ ID NO: 8560986 - DNA, 22 bp, Homo sapiens
gacggagctggttgctgcggct

SEQ ID NO: 8560987 - DNA, 22 bp, Homo sapiens
gacggggcagccagctggtggc

SEQ ID NO: 8560988 - DNA, 22 bp, Homo sapiens
gacaattagatcattcctttga

SEQ ID NO: 8560989 - DNA, 21 bp, Homo sapiens
gacacaaagggtagtaatggt

SEQ ID NO: 8560990 - DNA, 22 bp, Homo sapiens
gacaattgcttttgccgaataa

SEQ ID NO: 8560991 - DNA, 21 bp, Homo sapiens
gacacaaagggtagtaatggt

SEQ ID NO: 8560992 - DNA, 21 bp, Homo sapiens
gacacaaagggtagtaatggt

SEQ ID NO: 8560993 - DNA, 22 bp, Homo sapiens
gacacaaagtttgtcagaaatt

SEQ ID NO: 8560994 - DNA, 22 bp, Homo sapiens
gacaccagaagacataagcaga

SEQ ID NO: 8560995 - DNA, 22 bp, Homo sapiens
gacacatgtcagacggacaccc

SEQ ID NO: 8560996 - DNA, 18 bp, Homo sapiens
gacacatccccaggcctc

SEQ ID NO: 8560997 - DNA, 22 bp, Homo sapiens
gacacatgaccataaatgctaa

SEQ ID NO: 8560998 - DNA, 16 bp, Homo sapiens
gacacatgggggaaaa

SEQ ID NO: 8560999 - DNA, 22 bp, Homo sapiens
gacacatatgcgtatagtttag

SEQ ID NO: 8561000 - DNA, 22 bp, Homo sapiens
gacacatagatctatctcactc

SEQ ID NO: 8561001 - DNA, 22 bp, Homo sapiens
gacacatatgcgtatagtttag

SEQ ID NO: 8561002 - DNA, 22 bp, Homo sapiens
gacacatagatctatctcactc

SEQ ID NO: 8561003 - DNA, 18 bp, Homo sapiens
gacaccagcctctgcccc

SEQ ID NO: 8561004 - DNA, 18 bp, Homo sapiens
gacaccagcctctgcccc

SEQ ID NO: 8561005 - DNA, 18 bp, Homo sapiens
gacaccagcctctgcccc

SEQ ID NO: 8561006 - DNA, 22 bp, Homo sapiens
gacaccagcaaggctgtgagga

SEQ ID NO: 8561007 - DNA, 22 bp, Homo sapiens
gaccacagattcctaagtggca

SEQ ID NO: 8561008 - DNA, 22 bp, Homo sapiens
gaccacagaggtgtgggagaga

SEQ ID NO: 8561009 - DNA, 22 bp, Homo sapiens
gaccacagaagccttgataggg

SEQ ID NO: 8561010 - DNA, 22 bp, Homo sapiens
gaccacagactggaaagagggc

SEQ ID NO: 8561011 - DNA, 22 bp, Homo sapiens
gaccacagcagtgcaagaggag

SEQ ID NO: 8561012 - DNA, 22 bp, Homo sapiens
atgctattaatatccagtctga

SEQ ID NO: 8561013 - DNA, 22 bp, Homo sapiens
atgctattccagaatgtaaatt

SEQ ID NO: 8561014 - DNA, 22 bp, Homo sapiens
gacatttgttcctctaagtgac

SEQ ID NO: 8561015 - DNA, 22 bp, Homo sapiens
gacatttgtatcttaggggaaa

SEQ ID NO: 8561016 - DNA, 22 bp, Homo sapiens
gaccaaggccaggccagggcgt

SEQ ID NO: 8561017 - DNA, 22 bp, Homo sapiens
gaccaaggccctcagtgggagg

SEQ ID NO: 8561018 - DNA, 22 bp, Homo sapiens
gaccacactttggaaatcacga

SEQ ID NO: 8561019 - DNA, 22 bp, Homo sapiens
gaccacactttggaaatcacga

SEQ ID NO: 8561020 - DNA, 22 bp, Homo sapiens
gacataaatgaagtttgactat

SEQ ID NO: 8561021 - DNA, 22 bp, Homo sapiens
gacatttatgaaggagatatgc

SEQ ID NO: 8561022 - DNA, 22 bp, Homo sapiens
gacatttattagaaaactatca

SEQ ID NO: 8561023 - DNA, 22 bp, Homo sapiens
gacatttattggattttacgag

SEQ ID NO: 8561024 - DNA, 22 bp, Homo sapiens
gacatttcaatctcattatggg

SEQ ID NO: 8561025 - DNA, 22 bp, Homo sapiens
gacatttattagaaaactatca

SEQ ID NO: 8561026 - DNA, 22 bp, Homo sapiens
gacatttattagaaaactatca

SEQ ID NO: 8561027 - DNA, 22 bp, Homo sapiens
atgaaacaaacctctatggagt

SEQ ID NO: 8561028 - DNA, 22 bp, Homo sapiens
atgaaaattgacagcggaagta

SEQ ID NO: 8561029 - DNA, 22 bp, Homo sapiens
atgaaacaacagacttggtcaa

SEQ ID NO: 8561030 - DNA, 22 bp, Homo sapiens
atgaaacaacagacttggtcaa

SEQ ID NO: 8561031 - DNA, 22 bp, Homo sapiens
atgaaacagagtacttaatata

SEQ ID NO: 8561032 - DNA, 22 bp, Homo sapiens
atgaaacaagggtattttctct

SEQ ID NO: 8561033 - DNA, 22 bp, Homo sapiens
atgaaacaagggtattttctct

SEQ ID NO: 8561034 - DNA, 22 bp, Homo sapiens
atgaaaagttcgatctagaagg

SEQ ID NO: 8561035 - DNA, 22 bp, Homo sapiens
atgaacatcggaaatgagactg

SEQ ID NO: 8561036 - DNA, 22 bp, Homo sapiens
atgaacagtatgcaacatgatt

SEQ ID NO: 8561037 - DNA, 22 bp, Homo sapiens
atgaaattcatctgagaatgct

SEQ ID NO: 8561038 - DNA, 18 bp, Homo sapiens
atgaacactgagctgaat

SEQ ID NO: 8561039 - DNA, 22 bp, Homo sapiens
atgaaacagtgtgtatagcaaa

SEQ ID NO: 8561040 - DNA, 22 bp, Homo sapiens
atgaaacagtgtgtatagcaaa

SEQ ID NO: 8561041 - DNA, 22 bp, Homo sapiens
atgaaacagagtacttaatata

SEQ ID NO: 8561042 - DNA, 22 bp, Homo sapiens
atgaaacagtgtgtatagcaaa

SEQ ID NO: 8561043 - DNA, 22 bp, Homo sapiens
atgaaacagtgaattagtcaag

SEQ ID NO: 8561044 - DNA, 22 bp, Homo sapiens
atgaaacagtgaattagtcaag

SEQ ID NO: 8561045 - DNA, 22 bp, Homo sapiens
ctttctgatgtaaggaactagg

SEQ ID NO: 8561046 - DNA, 22 bp, Homo sapiens
ctttctggagtggaaaggtatt

SEQ ID NO: 8561047 - DNA, 22 bp, Homo sapiens
ctttctggacaagacagaggga

SEQ ID NO: 8561048 - DNA, 22 bp, Homo sapiens
ctttcttaatttttaaggacac

SEQ ID NO: 8561049 - DNA, 22 bp, Homo sapiens
ctttcttatacctgtcagggcc

SEQ ID NO: 8561050 - DNA, 22 bp, Homo sapiens
ctttctcttgagcaagagctgt

SEQ ID NO: 8561051 - DNA, 23 bp, Homo sapiens
atgaagacccgtggtgtccccac

SEQ ID NO: 8561052 - DNA, 22 bp, Homo sapiens
atgaagacaggtctcatcacca

SEQ ID NO: 8561053 - DNA, 23 bp, Homo sapiens
atgaagacccgtggtgtccccac

SEQ ID NO: 8561054 - DNA, 22 bp, Homo sapiens
atgaagaaactgttctgggtgg

SEQ ID NO: 8561055 - DNA, 22 bp, Homo sapiens
atgaagaaaaatccagctgtcc

SEQ ID NO: 8561056 - DNA, 20 bp, Homo sapiens
atgaagacaaatccgacttg

SEQ ID NO: 8561057 - DNA, 22 bp, Homo sapiens
atgaagacaaacgacgttgcaa

SEQ ID NO: 8561058 - DNA, 22 bp, Homo sapiens
atgaactcttgctttatttcag

SEQ ID NO: 8561059 - DNA, 22 bp, Homo sapiens
atgaactcttctggttattttt

SEQ ID NO: 8561060 - DNA, 22 bp, Homo sapiens
atgaactcatttattttcctct

SEQ ID NO: 8561061 - DNA, 22 bp, Homo sapiens
atgaaccataggcaagacaata

SEQ ID NO: 8561062 - DNA, 22 bp, Homo sapiens
atgaacatgtgactcagacctg

SEQ ID NO: 8561063 - DNA, 22 bp, Homo sapiens
atgaacatctctgatccaagca

SEQ ID NO: 8561064 - DNA, 22 bp, Homo sapiens
atctggctattgacatgttata

SEQ ID NO: 8561065 - DNA, 22 bp, Homo sapiens
atctggctcacttagtctagga

SEQ ID NO: 8561066 - DNA, 22 bp, Homo sapiens
ctttcaactacatacaggcgat

SEQ ID NO: 8561067 - DNA, 22 bp, Homo sapiens
ctttccagcatttccttgtgaa

SEQ ID NO: 8561068 - DNA, 22 bp, Homo sapiens
ctttccaggaatcctcacagcc

SEQ ID NO: 8561069 - DNA, 22 bp, Homo sapiens
ctttccaggaatcctcacagcc

SEQ ID NO: 8561070 - DNA, 22 bp, Homo sapiens
ctttccaggaatcctcacagcc

SEQ ID NO: 8561071 - DNA, 22 bp, Homo sapiens
ctttccaggctgagtttgcttg

SEQ ID NO: 8561072 - DNA, 22 bp, Homo sapiens
ctttccaggctgagtttgcttg

SEQ ID NO: 8561073 - DNA, 22 bp, Homo sapiens
ctttcctagatggccatctttc

SEQ ID NO: 8561074 - DNA, 22 bp, Homo sapiens
ctttcctagtagttacagaatg

SEQ ID NO: 8561075 - DNA, 22 bp, Homo sapiens
ctttcctagatggccatctttc

SEQ ID NO: 8561076 - DNA, 22 bp, Homo sapiens
atgaaaagttcgatctagaagg

SEQ ID NO: 8561077 - DNA, 22 bp, Homo sapiens
ctttcctagaaatatatactta

SEQ ID NO: 8561078 - DNA, 22 bp, Homo sapiens
ctttcccttagccccattctat

SEQ ID NO: 8561079 - DNA, 22 bp, Homo sapiens
ctttcccttagccccattctat

SEQ ID NO: 8561080 - DNA, 22 bp, Homo sapiens
ctttcccttagccccattctat

SEQ ID NO: 8561081 - DNA, 22 bp, Homo sapiens
ctttccctgcttagaaggattt

SEQ ID NO: 8561082 - DNA, 22 bp, Homo sapiens
ctttccccagtatatcattgcc

SEQ ID NO: 8561083 - DNA, 22 bp, Homo sapiens
ctttccctgcttagaaggattt

SEQ ID NO: 8561084 - DNA, 22 bp, Homo sapiens
ctttcccacgcagtggatgaga

SEQ ID NO: 8561085 - DNA, 22 bp, Homo sapiens
ctttcccacgcagtggatgaga

SEQ ID NO: 8561086 - DNA, 22 bp, Homo sapiens
ctttccccaagcaccacagtgc

SEQ ID NO: 8561087 - DNA, 22 bp, Homo sapiens
ctttccccaagcaccacagtgc

SEQ ID NO: 8561088 - DNA, 22 bp, Homo sapiens
ctttcccagagtagttgatgct

SEQ ID NO: 8561089 - DNA, 22 bp, Homo sapiens
ctttcccagagtagttgatgct

SEQ ID NO: 8561090 - DNA, 22 bp, Homo sapiens
ctttcccagagtagttgatgct

SEQ ID NO: 8561091 - DNA, 22 bp, Homo sapiens
atctggagctctgcacacctgg

SEQ ID NO: 8561092 - DNA, 22 bp, Homo sapiens
atctggagcttgttagatgttt

SEQ ID NO: 8561093 - DNA, 22 bp, Homo sapiens
atctggagcaagattaagagat

SEQ ID NO: 8561094 - DNA, 22 bp, Homo sapiens
atctggagtgggacacagaaat

SEQ ID NO: 8561095 - DNA, 22 bp, Homo sapiens
atctggaggcattactctgtct

SEQ ID NO: 8561096 - DNA, 22 bp, Homo sapiens
atctggagtagaaaaatcgctt

SEQ ID NO: 8561097 - DNA, 22 bp, Homo sapiens
cttcttgtcaatttgccattgt

SEQ ID NO: 8561098 - DNA, 22 bp, Homo sapiens
cttctttaatgtatacaaaaga

SEQ ID NO: 8561099 - DNA, 22 bp, Homo sapiens
cttctttaatgtatacaaaaga

SEQ ID NO: 8561100 - DNA, 22 bp, Homo sapiens
cttcttgttttagccctcatac

SEQ ID NO: 8561101 - DNA, 22 bp, Homo sapiens
cttctttaccaagagatagagt

SEQ ID NO: 8561102 - DNA, 22 bp, Homo sapiens
cttctttaccaagagatagagt

SEQ ID NO: 8561103 - DNA, 22 bp, Homo sapiens
cttctttactttctagaaataa

SEQ ID NO: 8561104 - DNA, 22 bp, Homo sapiens
atctggagagatcttcacaaaa

SEQ ID NO: 8561105 - DNA, 22 bp, Homo sapiens
gaaagcataactaatatttatt

SEQ ID NO: 8561106 - DNA, 22 bp, Homo sapiens
gaaagcataactaatatttatt

SEQ ID NO: 8561107 - DNA, 22 bp, Homo sapiens
gaaaggtttaagtaggatttgt

SEQ ID NO: 8561108 - DNA, 22 bp, Homo sapiens
gaaaggtttcatctacttttca

SEQ ID NO: 8561109 - DNA, 22 bp, Homo sapiens
gaaaggttgtaacaagactctt

SEQ ID NO: 8561110 - DNA, 22 bp, Homo sapiens
gaaagcagtatttagttctgtt

SEQ ID NO: 8561111 - DNA, 22 bp, Homo sapiens
atgacataagtgaaaaacatca

SEQ ID NO: 8561112 - DNA, 22 bp, Homo sapiens
atgacagttctttagagatgta

SEQ ID NO: 8561113 - DNA, 22 bp, Homo sapiens
atgacagttctacacttaatct

SEQ ID NO: 8561114 - DNA, 22 bp, Homo sapiens
atgacagtgggtcttgcaaaga

SEQ ID NO: 8561115 - DNA, 22 bp, Homo sapiens
atgacagttctacacttaatct

SEQ ID NO: 8561116 - DNA, 22 bp, Homo sapiens
atgacagtaggtaaatgatagc

SEQ ID NO: 8561117 - DNA, 22 bp, Homo sapiens
gaaacatttgttgagtacttgc

SEQ ID NO: 8561118 - DNA, 22 bp, Homo sapiens
gaaaccacagtacccaggaaaa

SEQ ID NO: 8561119 - DNA, 22 bp, Homo sapiens
gaaacatttgttgagtacttgc

SEQ ID NO: 8561120 - DNA, 21 bp, Homo sapiens
atgacagatgctgcagatcgt

SEQ ID NO: 8561121 - DNA, 20 bp, Homo sapiens
gaaaccagaacgcagccctg

SEQ ID NO: 8561122 - DNA, 22 bp, Homo sapiens
atgacaggaggcagctgggcag

SEQ ID NO: 8561123 - DNA, 22 bp, Homo sapiens
atgacagtactggtgacaatac

SEQ ID NO: 8561124 - DNA, 22 bp, Homo sapiens
gaaacattgtgttctacagatt

SEQ ID NO: 8561125 - DNA, 22 bp, Homo sapiens
gaaacattgagcagaaggagaa

SEQ ID NO: 8561126 - DNA, 20 bp, Homo sapiens
gaaacattggcagcaactga

SEQ ID NO: 8561127 - DNA, 20 bp, Homo sapiens
gaaacattggcagcaactga

SEQ ID NO: 8561128 - DNA, 22 bp, Homo sapiens
gaaacattcagtcaacagtgtt

SEQ ID NO: 8561129 - DNA, 22 bp, Homo sapiens
gaaacattcagtcaacagtgtt

SEQ ID NO: 8561130 - DNA, 22 bp, Homo sapiens
gaaacattcatatgagaaacct

SEQ ID NO: 8561131 - DNA, 22 bp, Homo sapiens
gaaacatagttgagacactgct

SEQ ID NO: 8561132 - DNA, 22 bp, Homo sapiens
gaaacatagttgagacactgct

SEQ ID NO: 8561133 - DNA, 22 bp, Homo sapiens
gaaacatacgatttaggagaaa

SEQ ID NO: 8561134 - DNA, 22 bp, Homo sapiens
gaaacatattaatccagtgaaa

SEQ ID NO: 8561135 - DNA, 22 bp, Homo sapiens
ctttcttgcataatttgaaacc

SEQ ID NO: 8561136 - DNA, 22 bp, Homo sapiens
ctttcttggtcctgaagatggc

SEQ ID NO: 8561137 - DNA, 22 bp, Homo sapiens
ctttctttcgaagacgtgatta

SEQ ID NO: 8561138 - DNA, 22 bp, Homo sapiens
ctttctttcgaagacgtgatta

SEQ ID NO: 8561139 - DNA, 22 bp, Homo sapiens
ctttcttggtcctgaagatggc

SEQ ID NO: 8561140 - DNA, 22 bp, Homo sapiens
ctttctttcgaagacgtgatta

SEQ ID NO: 8561141 - DNA, 22 bp, Homo sapiens
ctttcttggtcctgaagatggc

SEQ ID NO: 8561142 - DNA, 22 bp, Homo sapiens
ctttctttcgaagacgtgatta

SEQ ID NO: 8561143 - DNA, 22 bp, Homo sapiens
ctttctttcgaagacgtgatta

SEQ ID NO: 8561144 - DNA, 22 bp, Homo sapiens
ctttctttcgaagacgtgatta

SEQ ID NO: 8561145 - DNA, 22 bp, Homo sapiens
gaaaatgttagcttcatagtca

SEQ ID NO: 8561146 - DNA, 22 bp, Homo sapiens
gaaacatacgatttaggagaaa

SEQ ID NO: 8561147 - DNA, 22 bp, Homo sapiens
gaaacagtgagaacttttcctg

SEQ ID NO: 8561148 - DNA, 22 bp, Homo sapiens
gaaacagtcaactttctttccc

SEQ ID NO: 8561149 - DNA, 22 bp, Homo sapiens
atgatgaagcatggttacactg

SEQ ID NO: 8561150 - DNA, 22 bp, Homo sapiens
atgatgaaattttctatcatgt

SEQ ID NO: 8561151 - DNA, 22 bp, Homo sapiens
atgatggaggccgtgatggacg

SEQ ID NO: 8561152 - DNA, 22 bp, Homo sapiens
atgatgctgtttatcatatact

SEQ ID NO: 8561153 - DNA, 18 bp, Homo sapiens
atgatcttagcaaatatt

SEQ ID NO: 8561154 - DNA, 22 bp, Homo sapiens
atgatctcattctttcaaaggg

SEQ ID NO: 8561155 - DNA, 22 bp, Homo sapiens
atgatctgataatcatccacta

SEQ ID NO: 8561156 - DNA, 22 bp, Homo sapiens
atgatgaaattttctatcatgt

SEQ ID NO: 8561157 - DNA, 22 bp, Homo sapiens
atgatgaaactaggaactagag

SEQ ID NO: 8561158 - DNA, 22 bp, Homo sapiens
atgatgaaaactgaaggttagg

SEQ ID NO: 8561159 - DNA, 22 bp, Homo sapiens
atgatgaaaactgaaggttagg

SEQ ID NO: 8561160 - DNA, 22 bp, Homo sapiens
atgatgaaactaggaactagag

SEQ ID NO: 8561161 - DNA, 22 bp, Homo sapiens
atgatgaaaactgaaggttagg

SEQ ID NO: 8561162 - DNA, 22 bp, Homo sapiens
atgatcatggaagtgcacccat

SEQ ID NO: 8561163 - DNA, 22 bp, Homo sapiens
atgatcatggaagtgcacccat

SEQ ID NO: 8561164 - DNA, 22 bp, Homo sapiens
atgatccaaagccacaggggca

SEQ ID NO: 8561165 - DNA, 22 bp, Homo sapiens
atgatcatacagagccctggta

SEQ ID NO: 8561166 - DNA, 22 bp, Homo sapiens
atgatcagggcagaagcagaag

SEQ ID NO: 8561167 - DNA, 22 bp, Homo sapiens
atgatcagcagttttcagtgtt

SEQ ID NO: 8561168 - DNA, 22 bp, Homo sapiens
atgatatatgtgttgagcttgc

SEQ ID NO: 8561169 - DNA, 22 bp, Homo sapiens
atgatatttgcaatgtgcttgc

SEQ ID NO: 8561170 - DNA, 22 bp, Homo sapiens
atgatatttgcaatgtgcttgc

SEQ ID NO: 8561171 - DNA, 22 bp, Homo sapiens
gaaatagatctctgggatgcaa

SEQ ID NO: 8561172 - DNA, 22 bp, Homo sapiens
gaaatagaggacagctggatca

SEQ ID NO: 8561173 - DNA, 22 bp, Homo sapiens
gaaatatacatgaagtcggctg

SEQ ID NO: 8561174 - DNA, 22 bp, Homo sapiens
gaaatatacatgaagtcggctg

SEQ ID NO: 8561175 - DNA, 19 bp, Homo sapiens
atgatacaggtgaaaattg

SEQ ID NO: 8561176 - DNA, 22 bp, Homo sapiens
gaaagtatttacattaacatct

SEQ ID NO: 8561177 - DNA, 19 bp, Homo sapiens
gaaagtcatagagcttgtc

SEQ ID NO: 8561178 - DNA, 22 bp, Homo sapiens
gaaagtattagcctagaagtca

SEQ ID NO: 8561179 - DNA, 22 bp, Homo sapiens
gaaagtaacatttcttgaatta

SEQ ID NO: 8561180 - DNA, 22 bp, Homo sapiens
gaaaggtttggcttttcagtag

SEQ ID NO: 8561181 - DNA, 22 bp, Homo sapiens
gaaatagacactttctatgaat

SEQ ID NO: 8561182 - DNA, 22 bp, Homo sapiens
gaaatagaagctgccaatttct

SEQ ID NO: 8561183 - DNA, 22 bp, Homo sapiens
gaaagtgcagtcagacaaggca

SEQ ID NO: 8561184 - DNA, 22 bp, Homo sapiens
gaaagtgcagtcagacaaggca

SEQ ID NO: 8561185 - DNA, 22 bp, Homo sapiens
gaaatacagttgggaggaggta

SEQ ID NO: 8561186 - DNA, 22 bp, Homo sapiens
gaaatacagttgggaggaggta

SEQ ID NO: 8561187 - DNA, 22 bp, Homo sapiens
atgtgtctgaccactgtattgg

SEQ ID NO: 8561188 - DNA, 17 bp, Homo sapiens
atgtgtctgagtgtcct

SEQ ID NO: 8561189 - DNA, 22 bp, Homo sapiens
atgtgtctctaccaatgcaatt

SEQ ID NO: 8561190 - DNA, 22 bp, Homo sapiens
atgtgtctctaccaatgcaatt

SEQ ID NO: 8561191 - DNA, 20 bp, Homo sapiens
atgtgtctgcctctgtgttc

SEQ ID NO: 8561192 - DNA, 22 bp, Homo sapiens
atgtgtctgatggccctgaatt

SEQ ID NO: 8561193 - DNA, 17 bp, Homo sapiens
atgtgtctgagtgtcct

SEQ ID NO: 8561194 - DNA, 20 bp, Homo sapiens
atgtgtctgcctctgtgttc

SEQ ID NO: 8561195 - DNA, 22 bp, Homo sapiens
atgtgtctggcatggaaagtgt

SEQ ID NO: 8561196 - DNA, 22 bp, Homo sapiens
gaggtggcgcgccatccctgcc

SEQ ID NO: 8561197 - DNA, 22 bp, Homo sapiens
gaggtggcgcgccatccctgcc

SEQ ID NO: 8561198 - DNA, 22 bp, Homo sapiens
atgtgtctctaaaatttagtaa

SEQ ID NO: 8561199 - DNA, 22 bp, Homo sapiens
atgtgtctagattgctgtaccg

SEQ ID NO: 8561200 - DNA, 17 bp, Homo sapiens
atgtgtctagtgcaacc

SEQ ID NO: 8561201 - DNA, 22 bp, Homo sapiens
atgtgtctaattccaggagcac

SEQ ID NO: 8561202 - DNA, 22 bp, Homo sapiens
gaggtggcactgtgaggagcac

SEQ ID NO: 8561203 - DNA, 22 bp, Homo sapiens
gaggtggcagaggcctggacct

SEQ ID NO: 8561204 - DNA, 22 bp, Homo sapiens
gaggtggcactgtgaggagcac

SEQ ID NO: 8561205 - DNA, 22 bp, Homo sapiens
gaggtggcaatttaatgcagtc

SEQ ID NO: 8561206 - DNA, 22 bp, Homo sapiens
gaggtggcctcaagcagtcttc

SEQ ID NO: 8561207 - DNA, 22 bp, Homo sapiens
gaggtggccagagtcaagagcc

SEQ ID NO: 8561208 - DNA, 22 bp, Homo sapiens
gaggtggccaagcgaggaaggg

SEQ ID NO: 8561209 - DNA, 22 bp, Homo sapiens
atgttcttctatctttattaaa

SEQ ID NO: 8561210 - DNA, 22 bp, Homo sapiens
atgttctttcagccagtgcatc

SEQ ID NO: 8561211 - DNA, 22 bp, Homo sapiens
atgttctttcagccagtgcatc

SEQ ID NO: 8561212 - DNA, 22 bp, Homo sapiens
atgttgcacaaagtccatccat

SEQ ID NO: 8561213 - DNA, 22 bp, Homo sapiens
atgttctttgtgattctgagct

SEQ ID NO: 8561214 - DNA, 20 bp, Homo sapiens
atgtgtctgtaaacaactct

SEQ ID NO: 8561215 - DNA, 22 bp, Homo sapiens
atgtgtctggcatggctctatt

SEQ ID NO: 8561216 - DNA, 22 bp, Homo sapiens
atgtgtctggttattgacatgc

SEQ ID NO: 8561217 - DNA, 20 bp, Homo sapiens
atgtgtcttagagcatcagg

SEQ ID NO: 8561218 - DNA, 22 bp, Homo sapiens
atgtgtcttatttgattccaca

SEQ ID NO: 8561219 - DNA, 22 bp, Homo sapiens
atgtgtcttctaagccaagcct

SEQ ID NO: 8561220 - DNA, 20 bp, Homo sapiens
atgtgtcttagagcatcagg

SEQ ID NO: 8561221 - DNA, 22 bp, Homo sapiens
atgtgtctgtgggcacacacac

SEQ ID NO: 8561222 - DNA, 22 bp, Homo sapiens
atgttattttggaaaatacaaa

SEQ ID NO: 8561223 - DNA, 22 bp, Homo sapiens
atgttatttctgaaagatcatt

SEQ ID NO: 8561224 - DNA, 22 bp, Homo sapiens
atgttctgttttgtaattcata

SEQ ID NO: 8561225 - DNA, 22 bp, Homo sapiens
gatatgtaccacctcttaaaag

SEQ ID NO: 8561226 - DNA, 22 bp, Homo sapiens
gatatgtatgaggagtatgtat

SEQ ID NO: 8561227 - DNA, 22 bp, Homo sapiens
gatatgaagtggcattgtgaag

SEQ ID NO: 8561228 - DNA, 22 bp, Homo sapiens
gatatgaagtggcattgtgaag

SEQ ID NO: 8561229 - DNA, 22 bp, Homo sapiens
gatatcatgggaaggtgtactt

SEQ ID NO: 8561230 - DNA, 22 bp, Homo sapiens
gatatcatgggaaggtgtactt

SEQ ID NO: 8561231 - DNA, 22 bp, Homo sapiens
gatacaaattcatgtctgaatt

SEQ ID NO: 8561232 - DNA, 22 bp, Homo sapiens
gatacaaattcatgtctgaatt

SEQ ID NO: 8561233 - DNA, 22 bp, Homo sapiens
gatatattttccatggtctgca

SEQ ID NO: 8561234 - DNA, 22 bp, Homo sapiens
gataattataggctaagccact

SEQ ID NO: 8561235 - DNA, 22 bp, Homo sapiens
gataattataggctaagccact

SEQ ID NO: 8561236 - DNA, 22 bp, Homo sapiens
gataatgtgccgataatttcta

SEQ ID NO: 8561237 - DNA, 22 bp, Homo sapiens
gataatgtggatttattgtgat

SEQ ID NO: 8561238 - DNA, 22 bp, Homo sapiens
gataattttagtctgaaaattg

SEQ ID NO: 8561239 - DNA, 22 bp, Homo sapiens
gatacaaaatataaatggagag

SEQ ID NO: 8561240 - DNA, 22 bp, Homo sapiens
atgtttaaagggttgagaaata

SEQ ID NO: 8561241 - DNA, 22 bp, Homo sapiens
atgtttaaatttatagacagtg

SEQ ID NO: 8561242 - DNA, 22 bp, Homo sapiens
atgtttaaatttatagacagtg

SEQ ID NO: 8561243 - DNA, 22 bp, Homo sapiens
atgtttaaggaactggtttgct

SEQ ID NO: 8561244 - DNA, 22 bp, Homo sapiens
atgtttaagaaagtcttccata

SEQ ID NO: 8561245 - DNA, 22 bp, Homo sapiens
atgtttaatcggctgcctttcc

SEQ ID NO: 8561246 - DNA, 22 bp, Homo sapiens
atgtttaatcggctgcctttcc

SEQ ID NO: 8561247 - DNA, 22 bp, Homo sapiens
atgtttaatcggctgcctttcc

SEQ ID NO: 8561248 - DNA, 22 bp, Homo sapiens
gagttcatattcagagatcgct

SEQ ID NO: 8561249 - DNA, 20 bp, Homo sapiens
gagttccccatttctcctgg

SEQ ID NO: 8561250 - DNA, 22 bp, Homo sapiens
gataatccaagattgcctcact

SEQ ID NO: 8561251 - DNA, 22 bp, Homo sapiens
gataatccactctgctgacttt

SEQ ID NO: 8561252 - DNA, 22 bp, Homo sapiens
gataatgatgacaatgacaacc

SEQ ID NO: 8561253 - DNA, 20 bp, Homo sapiens
atgttgtttactcatagcat

SEQ ID NO: 8561254 - DNA, 22 bp, Homo sapiens
atgtttaaaggagtcagagact

SEQ ID NO: 8561255 - DNA, 22 bp, Homo sapiens
atgttgtgtttgactgttaccc

SEQ ID NO: 8561256 - DNA, 22 bp, Homo sapiens
atgttggagtcgtaaggcatgg

SEQ ID NO: 8561257 - DNA, 22 bp, Homo sapiens
atgttggagtcgtaaggcatgg

SEQ ID NO: 8561258 - DNA, 22 bp, Homo sapiens
atgttggagtcgtaaggcatgg

SEQ ID NO: 8561259 - DNA, 22 bp, Homo sapiens
atgttggagtcgtaaggcatgg

SEQ ID NO: 8561260 - DNA, 22 bp, Homo sapiens
atgtcatttaaatgtttgtata

SEQ ID NO: 8561261 - DNA, 23 bp, Homo sapiens
atgtccccttcttgatgcctggc

SEQ ID NO: 8561262 - DNA, 22 bp, Homo sapiens
atgtcattaaaattgtgctgca

SEQ ID NO: 8561263 - DNA, 22 bp, Homo sapiens
atgtcccttgtctgtgatgtct

SEQ ID NO: 8561264 - DNA, 22 bp, Homo sapiens
atgtcccttgtctgtgatgtct

SEQ ID NO: 8561265 - DNA, 22 bp, Homo sapiens
atgtcctcggctctgtgctgct

SEQ ID NO: 8561266 - DNA, 20 bp, Homo sapiens
atgtagatgaaagcaaaggc

SEQ ID NO: 8561267 - DNA, 22 bp, Homo sapiens
atgtagcagaagatgttttcct

SEQ ID NO: 8561268 - DNA, 22 bp, Homo sapiens
atgtagatgttcacttgatttt

SEQ ID NO: 8561269 - DNA, 22 bp, Homo sapiens
atgtagatttgcttctcctgcc

SEQ ID NO: 8561270 - DNA, 22 bp, Homo sapiens
atgtagcagatatttgtgcaca

SEQ ID NO: 8561271 - DNA, 20 bp, Homo sapiens
atgtagcagtgtgctgggaa

SEQ ID NO: 8561272 - DNA, 22 bp, Homo sapiens
atgtagcatctatcctgataaa

SEQ ID NO: 8561273 - DNA, 22 bp, Homo sapiens
atgtagcatgaggcactgtgcc

SEQ ID NO: 8561274 - DNA, 22 bp, Homo sapiens
atgtagcatgaggcactgtgcc

SEQ ID NO: 8561275 - DNA, 22 bp, Homo sapiens
atgtcatgaaatgctactaact

SEQ ID NO: 8561276 - DNA, 22 bp, Homo sapiens
atgtagctgcagatgataatgc

SEQ ID NO: 8561277 - DNA, 22 bp, Homo sapiens
atgtagagctccttgatcctcc

SEQ ID NO: 8561278 - DNA, 22 bp, Homo sapiens
atgtagagtagaatagtacaac

SEQ ID NO: 8561279 - DNA, 22 bp, Homo sapiens
atgtagacctttctttgtgatt

SEQ ID NO: 8561280 - DNA, 22 bp, Homo sapiens
atgtagagcagtgttgtccaat

SEQ ID NO: 8561281 - DNA, 22 bp, Homo sapiens
atgtagaagtgggcattataga

SEQ ID NO: 8561282 - DNA, 22 bp, Homo sapiens
atgtagaaagttcatagatgcg

SEQ ID NO: 8561283 - DNA, 22 bp, Homo sapiens
gaggcagcgggtcaggaccgtg

SEQ ID NO: 8561284 - DNA, 22 bp, Homo sapiens
atgtagaacaggttaatgacag

SEQ ID NO: 8561285 - DNA, 22 bp, Homo sapiens
atgtagaaattaggatgatagt

SEQ ID NO: 8561286 - DNA, 22 bp, Homo sapiens
gaggcagcggctcacagagaaa

SEQ ID NO: 8561287 - DNA, 22 bp, Homo sapiens
gaggcagcggctcacagagaaa

SEQ ID NO: 8561288 - DNA, 22 bp, Homo sapiens
gaggcagcgggtcaggaccgtg

SEQ ID NO: 8561289 - DNA, 22 bp, Homo sapiens
atgtccttaatctgaatgttag

SEQ ID NO: 8561290 - DNA, 22 bp, Homo sapiens
atgtctaaaagataaagtttaa

SEQ ID NO: 8561291 - DNA, 22 bp, Homo sapiens
atgtctagagcaagagatgctg

SEQ ID NO: 8561292 - DNA, 22 bp, Homo sapiens
atgtctatatagtcaataatca

SEQ ID NO: 8561293 - DNA, 22 bp, Homo sapiens
atgtctatatagtcaataatca

SEQ ID NO: 8561294 - DNA, 22 bp, Homo sapiens
atgtccttttaaaatgtgagaa

SEQ ID NO: 8561295 - DNA, 22 bp, Homo sapiens
atgtctctgctgtggttagctt

SEQ ID NO: 8561296 - DNA, 19 bp, Homo sapiens
atgtctctgtagcacatac

SEQ ID NO: 8561297 - DNA, 22 bp, Homo sapiens
atgtctctcaggtttaacttta

SEQ ID NO: 8561298 - DNA, 22 bp, Homo sapiens
atgtctctctctgagtgccaga

SEQ ID NO: 8561299 - DNA, 22 bp, Homo sapiens
atgtctctgccccagagagctt

SEQ ID NO: 8561300 - DNA, 22 bp, Homo sapiens
gagggctgaagattgtggcccc

SEQ ID NO: 8561301 - DNA, 22 bp, Homo sapiens
gagggctgaagattgtggcccc

SEQ ID NO: 8561302 - DNA, 22 bp, Homo sapiens
atgtgaaactgaagcatccata

SEQ ID NO: 8561303 - DNA, 22 bp, Homo sapiens
atgtgaaacgcaatgggatcat

SEQ ID NO: 8561304 - DNA, 22 bp, Homo sapiens
atgtgaaagaggtgttcagtgg

SEQ ID NO: 8561305 - DNA, 22 bp, Homo sapiens
atgtgaaatagctggatatgaa

SEQ ID NO: 8561306 - DNA, 22 bp, Homo sapiens
atgtgaaatagctggatatgaa

SEQ ID NO: 8561307 - DNA, 22 bp, Homo sapiens
atgtgaaatagctggatatgaa

SEQ ID NO: 8561308 - DNA, 20 bp, Homo sapiens
atgtgaaagatcagttgtct

SEQ ID NO: 8561309 - DNA, 21 bp, Homo sapiens
atgtgaaatatcatcagagca

SEQ ID NO: 8561310 - DNA, 21 bp, Homo sapiens
atgtgaaatatcatcagagca

SEQ ID NO: 8561311 - DNA, 22 bp, Homo sapiens
atgtgaaatagctggatatgaa

SEQ ID NO: 8561312 - DNA, 21 bp, Homo sapiens
atgtgaaatatcatcagagca

SEQ ID NO: 8561313 - DNA, 22 bp, Homo sapiens
atgtgaaatattaagccgagga

SEQ ID NO: 8561314 - DNA, 22 bp, Homo sapiens
atgtgaaatattaagccgagga

SEQ ID NO: 8561315 - DNA, 22 bp, Homo sapiens
atgtgaagcttgtgctaacata

SEQ ID NO: 8561316 - DNA, 22 bp, Homo sapiens
atgtgacaatatttggtcttat

SEQ ID NO: 8561317 - DNA, 22 bp, Homo sapiens
atgtgacagtgtttgacagatg

SEQ ID NO: 8561318 - DNA, 20 bp, Homo sapiens
atgtgaagtaggaagggtgt

SEQ ID NO: 8561319 - DNA, 20 bp, Homo sapiens
atgtgaagtaggaagggtgt

SEQ ID NO: 8561320 - DNA, 20 bp, Homo sapiens
atgtgaagtaggaagggtgt

SEQ ID NO: 8561321 - DNA, 22 bp, Homo sapiens
atgtgaactctgtactctctga

SEQ ID NO: 8561322 - DNA, 22 bp, Homo sapiens
atgtgagggaaatcagtcagaa

SEQ ID NO: 8561323 - DNA, 22 bp, Homo sapiens
atgtgagggctcaggctgactg

SEQ ID NO: 8561324 - DNA, 22 bp, Homo sapiens
gaggtggatgttgcagtgagct

SEQ ID NO: 8561325 - DNA, 20 bp, Homo sapiens
gaggtagggcttaaggcaag

SEQ ID NO: 8561326 - DNA, 22 bp, Homo sapiens
gaggtggatgttgcagtgagct

SEQ ID NO: 8561327 - DNA, 18 bp, Homo sapiens
atgtgagagaatcttctt

SEQ ID NO: 8561328 - DNA, 22 bp, Homo sapiens
atgtgagaataactcaaaacaa

SEQ ID NO: 8561329 - DNA, 22 bp, Homo sapiens
atgtgagaataactcaaaacaa

SEQ ID NO: 8561330 - DNA, 22 bp, Homo sapiens
atgtgagctccggcaggtggaa

SEQ ID NO: 8561331 - DNA, 22 bp, Homo sapiens
atgtgagcaggtgctggctgct

SEQ ID NO: 8561332 - DNA, 22 bp, Homo sapiens
atgtgagcagggagatgctgcc

SEQ ID NO: 8561333 - DNA, 22 bp, Homo sapiens
atgtgagctccggcaggtggaa

SEQ ID NO: 8561334 - DNA, 22 bp, Homo sapiens
gagggctctaccaagtaactct

SEQ ID NO: 8561335 - DNA, 22 bp, Homo sapiens
gagggctctactcaccaccctg

SEQ ID NO: 8561336 - DNA, 22 bp, Homo sapiens
gagggctctgaaaggaggtcac

SEQ ID NO: 8561337 - DNA, 23 bp, Homo sapiens
gagggctctgagtgcttgggcca

SEQ ID NO: 8561338 - DNA, 22 bp, Homo sapiens
gagggctgaagattgtggcccc

SEQ ID NO: 8561339 - DNA, 20 bp, Homo sapiens
gagggctcgtggatggataa

SEQ ID NO: 8561340 - DNA, 22 bp, Homo sapiens
gagggctctaccaagtaactct

SEQ ID NO: 8561341 - DNA, 22 bp, Homo sapiens
gagggctccattccccgtgccc

SEQ ID NO: 8561342 - DNA, 22 bp, Homo sapiens
gagggctcctcacattctctat

SEQ ID NO: 8561343 - DNA, 22 bp, Homo sapiens
gagggctcactgagaaagcagt

SEQ ID NO: 8561344 - DNA, 19 bp, Homo sapiens
gagggctcatttgaacaat

SEQ ID NO: 8561345 - DNA, 19 bp, Homo sapiens
gagggctcatttgaacaat

SEQ ID NO: 8561346 - DNA, 22 bp, Homo sapiens
gagggctccacacgggcccagc

SEQ ID NO: 8561347 - DNA, 20 bp, Homo sapiens
atgtctgaagtaatccattt

SEQ ID NO: 8561348 - DNA, 22 bp, Homo sapiens
atgtctgagtctgctccagttg

SEQ ID NO: 8561349 - DNA, 19 bp, Homo sapiens
atgtctctgtagcacatac

SEQ ID NO: 8561350 - DNA, 22 bp, Homo sapiens
gagggctcaactactactaggc

SEQ ID NO: 8561351 - DNA, 22 bp, Homo sapiens
gagggctcactgagaaagcagt

SEQ ID NO: 8561352 - DNA, 22 bp, Homo sapiens
gagggctcaactactactaggc

SEQ ID NO: 8561353 - DNA, 22 bp, Homo sapiens
gagggctcaactactactaggc

SEQ ID NO: 8561354 - DNA, 22 bp, Homo sapiens
gagggcgcttcagagagatgaa

SEQ ID NO: 8561355 - DNA, 22 bp, Homo sapiens
gagggcgcttcagagagatgaa

SEQ ID NO: 8561356 - DNA, 22 bp, Homo sapiens
gagggcagagacagtgattcac

SEQ ID NO: 8561357 - DNA, 22 bp, Homo sapiens
gagggcagaaaattatgcggtg

SEQ ID NO: 8561358 - DNA, 22 bp, Homo sapiens
gagggcctggcacagggaggct

SEQ ID NO: 8561359 - DNA, 22 bp, Homo sapiens
gagggcctggcacagggaggct

SEQ ID NO: 8561360 - DNA, 22 bp, Homo sapiens
gagagagctctgtgcctgggat

SEQ ID NO: 8561361 - DNA, 22 bp, Homo sapiens
gagagagctctgtgcctgggat

SEQ ID NO: 8561362 - DNA, 22 bp, Homo sapiens
gagagagctctgtgcctgggat

SEQ ID NO: 8561363 - DNA, 22 bp, Homo sapiens
gagagaggcctccatgtactga

SEQ ID NO: 8561364 - DNA, 22 bp, Homo sapiens
gagagaggcctccatgtactga

SEQ ID NO: 8561365 - DNA, 22 bp, Homo sapiens
gagagaggcctccatgtactga

SEQ ID NO: 8561366 - DNA, 22 bp, Homo sapiens
gagagaggcctccatgtactga

SEQ ID NO: 8561367 - DNA, 22 bp, Homo sapiens
gagagcacatgaacatggagga

SEQ ID NO: 8561368 - DNA, 22 bp, Homo sapiens
gagagcagactctcaaagctgg

SEQ ID NO: 8561369 - DNA, 22 bp, Homo sapiens
gagagcaatggggacgggcagg

SEQ ID NO: 8561370 - DNA, 22 bp, Homo sapiens
gactggggctctagccaggcct

SEQ ID NO: 8561371 - DNA, 22 bp, Homo sapiens
gactggggctctagccaggcct

SEQ ID NO: 8561372 - DNA, 22 bp, Homo sapiens
gagacatggcaaaagcactggt

SEQ ID NO: 8561373 - DNA, 22 bp, Homo sapiens
gagacatcataatgaagtttcc

SEQ ID NO: 8561374 - DNA, 22 bp, Homo sapiens
gactggggctctagccaggcct

SEQ ID NO: 8561375 - DNA, 22 bp, Homo sapiens
gactggggaaggacccgagacc

SEQ ID NO: 8561376 - DNA, 22 bp, Homo sapiens
gagacatggcaaaagcactggt

SEQ ID NO: 8561377 - DNA, 22 bp, Homo sapiens
gagagagaagtgggtgtcacct

SEQ ID NO: 8561378 - DNA, 22 bp, Homo sapiens
gagatgggcgagaaggtggact

SEQ ID NO: 8561379 - DNA, 22 bp, Homo sapiens
gagatgggcgagaaggtggact

SEQ ID NO: 8561380 - DNA, 22 bp, Homo sapiens
gagatgggcgagaaggtggact

SEQ ID NO: 8561381 - DNA, 22 bp, Homo sapiens
gagatggcttgctctcacgtgg

SEQ ID NO: 8561382 - DNA, 23 bp, Homo sapiens
gagatggctggttgtcctctgaa

SEQ ID NO: 8561383 - DNA, 22 bp, Homo sapiens
atggagggtgtcagagagcgaa

SEQ ID NO: 8561384 - DNA, 22 bp, Homo sapiens
atggagggaaaagtggagagcc

SEQ ID NO: 8561385 - DNA, 21 bp, Homo sapiens
atggagggaccagggaagcag

SEQ ID NO: 8561386 - DNA, 22 bp, Homo sapiens
atggagggtggtaagacagaga

SEQ ID NO: 8561387 - DNA, 21 bp, Homo sapiens
atggagggaccagggaagcag

SEQ ID NO: 8561388 - DNA, 22 bp, Homo sapiens
atggagggtggtaagacagaga

SEQ ID NO: 8561389 - DNA, 18 bp, Homo sapiens
atggaggcagagagctga

SEQ ID NO: 8561390 - DNA, 22 bp, Homo sapiens
atggaggatgtgcagcatgggc

SEQ ID NO: 8561391 - DNA, 22 bp, Homo sapiens
atggccagagagagcacacctg

SEQ ID NO: 8561392 - DNA, 22 bp, Homo sapiens
atggccagagaaggcagggtca

SEQ ID NO: 8561393 - DNA, 22 bp, Homo sapiens
atggccagagaaggcagggtca

SEQ ID NO: 8561394 - DNA, 22 bp, Homo sapiens
atggccagagaaggcagggtca

SEQ ID NO: 8561395 - DNA, 22 bp, Homo sapiens
gagatggggtcagctgggacat

SEQ ID NO: 8561396 - DNA, 22 bp, Homo sapiens
gagatggggaataggagcaagc

SEQ ID NO: 8561397 - DNA, 22 bp, Homo sapiens
gagatggggaataggagcaagc

SEQ ID NO: 8561398 - DNA, 22 bp, Homo sapiens
gagatggggaataggagcaagc

SEQ ID NO: 8561399 - DNA, 22 bp, Homo sapiens
gagatggggaataggagcaagc

SEQ ID NO: 8561400 - DNA, 22 bp, Homo sapiens
atggcattcacatttccagaga

SEQ ID NO: 8561401 - DNA, 22 bp, Homo sapiens
atggcattgagtaaagtcagta

SEQ ID NO: 8561402 - DNA, 22 bp, Homo sapiens
atggcattgcaagggcaggagg

SEQ ID NO: 8561403 - DNA, 17 bp, Homo sapiens
gagatgggtggatcacc

SEQ ID NO: 8561404 - DNA, 17 bp, Homo sapiens
gagatgggtggatcacc

SEQ ID NO: 8561405 - DNA, 17 bp, Homo sapiens
gagatgggtggatcacc

SEQ ID NO: 8561406 - DNA, 17 bp, Homo sapiens
gagatgggtggatcacc

SEQ ID NO: 8561407 - DNA, 22 bp, Homo sapiens
atggctttgtgttcagagctga

SEQ ID NO: 8561408 - DNA, 22 bp, Homo sapiens
atggctttttagactttggtac

SEQ ID NO: 8561409 - DNA, 22 bp, Homo sapiens
atggcttttgatgctaagccaa

SEQ ID NO: 8561410 - DNA, 22 bp, Homo sapiens
atggctttctgtgtttccgtag

SEQ ID NO: 8561411 - DNA, 17 bp, Homo sapiens
atggctttgtcacacag

SEQ ID NO: 8561412 - DNA, 22 bp, Homo sapiens
atggctttgaagttcagctttt

SEQ ID NO: 8561413 - DNA, 22 bp, Homo sapiens
atggcttggcaccatctccttg

SEQ ID NO: 8561414 - DNA, 22 bp, Homo sapiens
atggcttgatagaaagctagtt

SEQ ID NO: 8561415 - DNA, 18 bp, Homo sapiens
atggcttctgagtggagg

SEQ ID NO: 8561416 - DNA, 22 bp, Homo sapiens
atggcttctcgctggcacctgt

SEQ ID NO: 8561417 - DNA, 22 bp, Homo sapiens
atggcttgtctatgagtgctct

SEQ ID NO: 8561418 - DNA, 22 bp, Homo sapiens
atggctttcagatggtgaaaga

SEQ ID NO: 8561419 - DNA, 22 bp, Homo sapiens
atggctttccggactttggcca

SEQ ID NO: 8561420 - DNA, 22 bp, Homo sapiens
atggctggcatccaggtgggct

SEQ ID NO: 8561421 - DNA, 22 bp, Homo sapiens
atggctggcactggcctgggtt

SEQ ID NO: 8561422 - DNA, 22 bp, Homo sapiens
atggccagagaggccagcctgg

SEQ ID NO: 8561423 - DNA, 22 bp, Homo sapiens
atggctgtgttgttcctctgaa

SEQ ID NO: 8561424 - DNA, 22 bp, Homo sapiens
atggctgttcctgggagttcta

SEQ ID NO: 8561425 - DNA, 22 bp, Homo sapiens
atggctgtttagcttctctgct

SEQ ID NO: 8561426 - DNA, 22 bp, Homo sapiens
atggctgttttgtgacttctca

SEQ ID NO: 8561427 - DNA, 22 bp, Homo sapiens
atggctgttgtgaggatcaaat

SEQ ID NO: 8561428 - DNA, 22 bp, Homo sapiens
atggctgttggcaggaggcctc

SEQ ID NO: 8561429 - DNA, 21 bp, Homo sapiens
atggcttctcaggtgcactga

SEQ ID NO: 8561430 - DNA, 21 bp, Homo sapiens
atggcttctcaggtgcactga

SEQ ID NO: 8561431 - DNA, 22 bp, Homo sapiens
atggcttctcgctggcacctgt

SEQ ID NO: 8561432 - DNA, 22 bp, Homo sapiens
atggcttctagcattgtcacaa

SEQ ID NO: 8561433 - DNA, 21 bp, Homo sapiens
atggcttctcaggtgcactga

SEQ ID NO: 8561434 - DNA, 22 bp, Homo sapiens
atggcttcgagtatatacatag

SEQ ID NO: 8561435 - DNA, 22 bp, Homo sapiens
atggcttccaaggccctccgtg

SEQ ID NO: 8561436 - DNA, 22 bp, Homo sapiens
atggcttccaaggccctccgtg

SEQ ID NO: 8561437 - DNA, 22 bp, Homo sapiens
atggcttcctctggattggatt

SEQ ID NO: 8561438 - DNA, 17 bp, Homo sapiens
atggcttccattgacca

SEQ ID NO: 8561439 - DNA, 22 bp, Homo sapiens
atgggaagtgttagaagatttt

SEQ ID NO: 8561440 - DNA, 22 bp, Homo sapiens
atgggaagtgttagaagatttt

SEQ ID NO: 8561441 - DNA, 22 bp, Homo sapiens
atgggaaggttttgagagcggg

SEQ ID NO: 8561442 - DNA, 22 bp, Homo sapiens
atgggaagtgaagtcagggagg

SEQ ID NO: 8561443 - DNA, 19 bp, Homo sapiens
atgggaagcggccagcgga

SEQ ID NO: 8561444 - DNA, 22 bp, Homo sapiens
atgggaaggttttgagagcggg

SEQ ID NO: 8561445 - DNA, 22 bp, Homo sapiens
atgggaagctgacctgcatgga

SEQ ID NO: 8561446 - DNA, 22 bp, Homo sapiens
atgggagaaacatcatgaggca

SEQ ID NO: 8561447 - DNA, 22 bp, Homo sapiens
atgggcagggcagtgtataaga

SEQ ID NO: 8561448 - DNA, 22 bp, Homo sapiens
atgggcagggcagtgtataaga

SEQ ID NO: 8561449 - DNA, 18 bp, Homo sapiens
atgggcaggtaagatcca

SEQ ID NO: 8561450 - DNA, 22 bp, Homo sapiens
atgggctgaggaagctcctgag

SEQ ID NO: 8561451 - DNA, 22 bp, Homo sapiens
atggggagagcctctgtcccca

SEQ ID NO: 8561452 - DNA, 22 bp, Homo sapiens
atggggagagcctctgtcccca

SEQ ID NO: 8561453 - DNA, 22 bp, Homo sapiens
atggggagagcctctgtcccca

SEQ ID NO: 8561454 - DNA, 22 bp, Homo sapiens
atggggagagaagggctgagct

SEQ ID NO: 8561455 - DNA, 22 bp, Homo sapiens
atggggagagaagggctgagct

SEQ ID NO: 8561456 - DNA, 22 bp, Homo sapiens
atggggctagacaaccagtgcc

SEQ ID NO: 8561457 - DNA, 23 bp, Homo sapiens
atggggctcaacacttagtagct

SEQ ID NO: 8561458 - DNA, 22 bp, Homo sapiens
atggggagctcaccacctgttt

SEQ ID NO: 8561459 - DNA, 22 bp, Homo sapiens
atggggagagcctctgtcccca

SEQ ID NO: 8561460 - DNA, 22 bp, Homo sapiens
atggggagagaagggctgagct

SEQ ID NO: 8561461 - DNA, 22 bp, Homo sapiens
atggggagagaagggctgagct

SEQ ID NO: 8561462 - DNA, 22 bp, Homo sapiens
atggggagagaagggctgagct

SEQ ID NO: 8561463 - DNA, 22 bp, Homo sapiens
atgggctggggaagctcactcc

SEQ ID NO: 8561464 - DNA, 22 bp, Homo sapiens
atgggctgtcctagtccagccc

SEQ ID NO: 8561465 - DNA, 22 bp, Homo sapiens
atgggctgtcctagtccagccc

SEQ ID NO: 8561466 - DNA, 22 bp, Homo sapiens
atgggctgggaatacacagggg

SEQ ID NO: 8561467 - DNA, 22 bp, Homo sapiens
atgggctgcttctccagcacct

SEQ ID NO: 8561468 - DNA, 22 bp, Homo sapiens
gaggcacatatatacagagccc

SEQ ID NO: 8561469 - DNA, 22 bp, Homo sapiens
gaggcagcagggctggttcctt

SEQ ID NO: 8561470 - DNA, 22 bp, Homo sapiens
gaggcagcatctatggtgggaa

SEQ ID NO: 8561471 - DNA, 22 bp, Homo sapiens
atggtgtagcatgtgatatgac

SEQ ID NO: 8561472 - DNA, 22 bp, Homo sapiens
atggtgtagctgtcagtcataa

SEQ ID NO: 8561473 - DNA, 22 bp, Homo sapiens
atggtggatttgtgattcagct

SEQ ID NO: 8561474 - DNA, 22 bp, Homo sapiens
atggtggactcttgattcaggc

SEQ ID NO: 8561475 - DNA, 22 bp, Homo sapiens
atggtggacgggagacaggact

SEQ ID NO: 8561476 - DNA, 22 bp, Homo sapiens
gaggcagcatggtaccttggag

SEQ ID NO: 8561477 - DNA, 22 bp, Homo sapiens
gaggcagcatggtaccttggag

SEQ ID NO: 8561478 - DNA, 22 bp, Homo sapiens
gaggcagccagaggttctcatt

SEQ ID NO: 8561479 - DNA, 22 bp, Homo sapiens
gaggagaagggcacggagaaaa

SEQ ID NO: 8561480 - DNA, 22 bp, Homo sapiens
gaggagaagggcacggagaaaa

SEQ ID NO: 8561481 - DNA, 22 bp, Homo sapiens
gaggagaagggcacggagaaaa

SEQ ID NO: 8561482 - DNA, 18 bp, Homo sapiens
atggtctcatactgggag

SEQ ID NO: 8561483 - DNA, 18 bp, Homo sapiens
atggtctcatactgggag

SEQ ID NO: 8561484 - DNA, 22 bp, Homo sapiens
gaggagaatgcgcaccacatat

SEQ ID NO: 8561485 - DNA, 22 bp, Homo sapiens
atggtcttagggtaggcagctg

SEQ ID NO: 8561486 - DNA, 18 bp, Homo sapiens
atggtctcatactgggag

SEQ ID NO: 8561487 - DNA, 22 bp, Homo sapiens
atggtcttgtgagagtaacagt

SEQ ID NO: 8561488 - DNA, 22 bp, Homo sapiens
atggtgaagcttcatgggtgtt

SEQ ID NO: 8561489 - DNA, 22 bp, Homo sapiens
gaggaaggctaaggggcttaga

SEQ ID NO: 8561490 - DNA, 22 bp, Homo sapiens
gaggaaggctaaggggcttaga

SEQ ID NO: 8561491 - DNA, 22 bp, Homo sapiens
gaggagaaatttggggacctga

SEQ ID NO: 8561492 - DNA, 22 bp, Homo sapiens
gaggagaagctattggaaggac

SEQ ID NO: 8561493 - DNA, 22 bp, Homo sapiens
gaggagaagctattggaaggac

SEQ ID NO: 8561494 - DNA, 22 bp, Homo sapiens
gaggagaagctaagaaacacag

SEQ ID NO: 8561495 - DNA, 22 bp, Homo sapiens
gaggagaagctaagaaacacag

SEQ ID NO: 8561496 - DNA, 22 bp, Homo sapiens
gaggagaagctaagaaacacag

SEQ ID NO: 8561497 - DNA, 22 bp, Homo sapiens
atttctgttatacctttctcag

SEQ ID NO: 8561498 - DNA, 22 bp, Homo sapiens
atttctgtggcttcattctcct

SEQ ID NO: 8561499 - DNA, 22 bp, Homo sapiens
atttctgtgcagtaaatggtga

SEQ ID NO: 8561500 - DNA, 22 bp, Homo sapiens
atttctgtgcagtaaatggtga

SEQ ID NO: 8561501 - DNA, 22 bp, Homo sapiens
atttctgtatcctgctgtcaga

SEQ ID NO: 8561502 - DNA, 22 bp, Homo sapiens
gccccaggttgcctgtcccagg

SEQ ID NO: 8561503 - DNA, 22 bp, Homo sapiens
gccccaggttgcctgtcccagg

SEQ ID NO: 8561504 - DNA, 22 bp, Homo sapiens
atttctgttgcttataaattac

SEQ ID NO: 8561505 - DNA, 22 bp, Homo sapiens
atttctgttgcttataaattac

SEQ ID NO: 8561506 - DNA, 22 bp, Homo sapiens
atttctgttgcttataaattac

SEQ ID NO: 8561507 - DNA, 22 bp, Homo sapiens
gccccaggttgcctgtcccagg

SEQ ID NO: 8561508 - DNA, 22 bp, Homo sapiens
atttctgtagtccacattcttt

SEQ ID NO: 8561509 - DNA, 22 bp, Homo sapiens
atttctgtagtccacattcttt

SEQ ID NO: 8561510 - DNA, 22 bp, Homo sapiens
atttctgtaacttatgaaagtt

SEQ ID NO: 8561511 - DNA, 22 bp, Homo sapiens
atttctgataaacgtaagctgc

SEQ ID NO: 8561512 - DNA, 22 bp, Homo sapiens
atttctgataaacgtaagctgc

SEQ ID NO: 8561513 - DNA, 22 bp, Homo sapiens
atttctgataaacgtaagctgc

SEQ ID NO: 8561514 - DNA, 22 bp, Homo sapiens
atttctcagttcctactgttta

SEQ ID NO: 8561515 - DNA, 22 bp, Homo sapiens
gcccacctaacctgctcacctt

SEQ ID NO: 8561516 - DNA, 22 bp, Homo sapiens
gcccacctaacctgctcacctt

SEQ ID NO: 8561517 - DNA, 22 bp, Homo sapiens
gcccacctaacctgctcacctt

SEQ ID NO: 8561518 - DNA, 22 bp, Homo sapiens
atttccatgaaggcagatttta

SEQ ID NO: 8561519 - DNA, 22 bp, Homo sapiens
atttccatgaagtttagttata

SEQ ID NO: 8561520 - DNA, 22 bp, Homo sapiens
atttccatgccttagcttaagg

SEQ ID NO: 8561521 - DNA, 22 bp, Homo sapiens
atttccatgccttagcttaagg

SEQ ID NO: 8561522 - DNA, 22 bp, Homo sapiens
atttccatgaattcccactcat

SEQ ID NO: 8561523 - DNA, 22 bp, Homo sapiens
atttccatagagcgtctcacag

SEQ ID NO: 8561524 - DNA, 22 bp, Homo sapiens
atttccatcatcattaggccta

SEQ ID NO: 8561525 - DNA, 22 bp, Homo sapiens
atttccatacacccatttctga

SEQ ID NO: 8561526 - DNA, 22 bp, Homo sapiens
atttccagtgcactgaatagaa

SEQ ID NO: 8561527 - DNA, 22 bp, Homo sapiens
atttccattatcatgacaaatt

SEQ ID NO: 8561528 - DNA, 22 bp, Homo sapiens
atttcccaacacattagaaaat

SEQ ID NO: 8561529 - DNA, 22 bp, Homo sapiens
atttccattttcagccattact

SEQ ID NO: 8561530 - DNA, 22 bp, Homo sapiens
atttccatgtcggtattttata

SEQ ID NO: 8561531 - DNA, 22 bp, Homo sapiens
atttccatgtcggtattttata

SEQ ID NO: 8561532 - DNA, 22 bp, Homo sapiens
atttccatgtcggtattttata

SEQ ID NO: 8561533 - DNA, 22 bp, Homo sapiens
atttccatgtccaaaaattagt

SEQ ID NO: 8561534 - DNA, 22 bp, Homo sapiens
atttccatgtccaaaaattagt

SEQ ID NO: 8561535 - DNA, 23 bp, Homo sapiens
gcccaccctcagcgtcctcacgg

SEQ ID NO: 8561536 - DNA, 23 bp, Homo sapiens
gcccaccctcagcgtcctcacgg

SEQ ID NO: 8561537 - DNA, 17 bp, Homo sapiens
gcccacccttaggagct

SEQ ID NO: 8561538 - DNA, 17 bp, Homo sapiens
gcccacccttaggagct

SEQ ID NO: 8561539 - DNA, 22 bp, Homo sapiens
gcccacagtgtagcaggtactc

SEQ ID NO: 8561540 - DNA, 22 bp, Homo sapiens
gcccacagtgtagcaggtactc

SEQ ID NO: 8561541 - DNA, 22 bp, Homo sapiens
gccacaggtcggctagagggtc

SEQ ID NO: 8561542 - DNA, 22 bp, Homo sapiens
gccacaggtactatgggagaga

SEQ ID NO: 8561543 - DNA, 22 bp, Homo sapiens
gccacaggtaggaacctacctc

SEQ ID NO: 8561544 - DNA, 22 bp, Homo sapiens
gccacaggtactatgggagaga

SEQ ID NO: 8561545 - DNA, 22 bp, Homo sapiens
gccacaggtactatgggagaga

SEQ ID NO: 8561546 - DNA, 22 bp, Homo sapiens
gccacaggtggaattaagaaat

SEQ ID NO: 8561547 - DNA, 22 bp, Homo sapiens
gccacagtcactgctgcagggg

SEQ ID NO: 8561548 - DNA, 22 bp, Homo sapiens
gccacaggtgggctctgggaaa

SEQ ID NO: 8561549 - DNA, 22 bp, Homo sapiens
gccacaggtgggctctgggaaa

SEQ ID NO: 8561550 - DNA, 19 bp, Homo sapiens
gccaggcctggacctgcag

SEQ ID NO: 8561551 - DNA, 19 bp, Homo sapiens
gccaggcctggacctgcag

SEQ ID NO: 8561552 - DNA, 22 bp, Homo sapiens
gccaggctggaaagaacagaca

SEQ ID NO: 8561553 - DNA, 22 bp, Homo sapiens
gccaggctggaaagaacagaca

SEQ ID NO: 8561554 - DNA, 22 bp, Homo sapiens
gccaggctggcaaaaggaaacc

SEQ ID NO: 8561555 - DNA, 22 bp, Homo sapiens
gccaggctggcaaaaggaaacc

SEQ ID NO: 8561556 - DNA, 22 bp, Homo sapiens
gccaggctggccagcaccttct

SEQ ID NO: 8561557 - DNA, 22 bp, Homo sapiens
gccaggctggccagcaccttct

SEQ ID NO: 8561558 - DNA, 22 bp, Homo sapiens
gccaggctggtgcaaggatatt

SEQ ID NO: 8561559 - DNA, 22 bp, Homo sapiens
gccaggctggtgcaaggatatt

SEQ ID NO: 8561560 - DNA, 22 bp, Homo sapiens
gccaggctggtgcaaggatatt

SEQ ID NO: 8561561 - DNA, 22 bp, Homo sapiens
gccaggctggtcttgaactcct

SEQ ID NO: 8561562 - DNA, 22 bp, Homo sapiens
gccaggctggtcttgaactcct

SEQ ID NO: 8561563 - DNA, 22 bp, Homo sapiens
gccaggctggggggagatgtct

SEQ ID NO: 8561564 - DNA, 22 bp, Homo sapiens
gccaggctggggggagatgtct

SEQ ID NO: 8561565 - DNA, 22 bp, Homo sapiens
gccaggctggtcttgaactcct

SEQ ID NO: 8561566 - DNA, 22 bp, Homo sapiens
gccaggtggaggttgcagtgag

SEQ ID NO: 8561567 - DNA, 22 bp, Homo sapiens
gccaggtgcatggctgagtctc

SEQ ID NO: 8561568 - DNA, 19 bp, Homo sapiens
gccaggtcttgggtccagg

SEQ ID NO: 8561569 - DNA, 22 bp, Homo sapiens
gccaggtgagaggactgaggct

SEQ ID NO: 8561570 - DNA, 23 bp, Homo sapiens
gcctggattaaggcagtgacttc

SEQ ID NO: 8561571 - DNA, 22 bp, Homo sapiens
gcctggagttgtggtgaagcca

SEQ ID NO: 8561572 - DNA, 22 bp, Homo sapiens
gcctggagttgtggtgaagcca

SEQ ID NO: 8561573 - DNA, 22 bp, Homo sapiens
gcctggagttgaaactattatt

SEQ ID NO: 8561574 - DNA, 22 bp, Homo sapiens
gcctggagttgtggtgaagcca

SEQ ID NO: 8561575 - DNA, 22 bp, Homo sapiens
gcctggagttgtggtgaagcca

SEQ ID NO: 8561576 - DNA, 22 bp, Homo sapiens
gcctggatcccagggagtcagg

SEQ ID NO: 8561577 - DNA, 22 bp, Homo sapiens
gcctggaggaatgtagctgagg

SEQ ID NO: 8561578 - DNA, 22 bp, Homo sapiens
gcctggaggaatgtagctgagg

SEQ ID NO: 8561579 - DNA, 22 bp, Homo sapiens
gcctggaggaatgtagctgagg

SEQ ID NO: 8561580 - DNA, 22 bp, Homo sapiens
gcctggagttcagccaagtccc

SEQ ID NO: 8561581 - DNA, 22 bp, Homo sapiens
gcctggagttgaaactattatt

SEQ ID NO: 8561582 - DNA, 22 bp, Homo sapiens
gcctggcaaggccctgttgact

SEQ ID NO: 8561583 - DNA, 22 bp, Homo sapiens
attttactactccaattaatga

SEQ ID NO: 8561584 - DNA, 22 bp, Homo sapiens
gcctggcacattgcagtggatt

SEQ ID NO: 8561585 - DNA, 22 bp, Homo sapiens
attttactactccaattaatga

SEQ ID NO: 8561586 - DNA, 22 bp, Homo sapiens
attttactactccaattaatga

SEQ ID NO: 8561587 - DNA, 22 bp, Homo sapiens
attttacttagtgtaatgtcca

SEQ ID NO: 8561588 - DNA, 22 bp, Homo sapiens
gcctgagagaactgaccaagag

SEQ ID NO: 8561589 - DNA, 22 bp, Homo sapiens
gcctgagacagtgtggtccaat

SEQ ID NO: 8561590 - DNA, 22 bp, Homo sapiens
gcctgagacagtgtggtccaat

SEQ ID NO: 8561591 - DNA, 22 bp, Homo sapiens
gcctgagagacccatggggcaa

SEQ ID NO: 8561592 - DNA, 22 bp, Homo sapiens
gcctgagagacccatggggcaa

SEQ ID NO: 8561593 - DNA, 22 bp, Homo sapiens
gcctgagagaactgaccaagag

SEQ ID NO: 8561594 - DNA, 22 bp, Homo sapiens
gcctgagagaactgaccaagag

SEQ ID NO: 8561595 - DNA, 22 bp, Homo sapiens
gcctgagagttgaagttcagtg

SEQ ID NO: 8561596 - DNA, 22 bp, Homo sapiens
gcctgagaaggataggaagcga

SEQ ID NO: 8561597 - DNA, 22 bp, Homo sapiens
gcctgagaaggacacagcaggt

SEQ ID NO: 8561598 - DNA, 22 bp, Homo sapiens
gcctgacctcttctgccctggg

SEQ ID NO: 8561599 - DNA, 22 bp, Homo sapiens
atttggaaggcgtttctctgta

SEQ ID NO: 8561600 - DNA, 22 bp, Homo sapiens
gcctgagattcccggagccgtg

SEQ ID NO: 8561601 - DNA, 22 bp, Homo sapiens
gcccccagctctcaagctcaaa

SEQ ID NO: 8561602 - DNA, 22 bp, Homo sapiens
gcccccagctctcaagctcaaa

SEQ ID NO: 8561603 - DNA, 22 bp, Homo sapiens
gcccccagaagggccacagatt

SEQ ID NO: 8561604 - DNA, 22 bp, Homo sapiens
gcccccagaagggccacagatt

SEQ ID NO: 8561605 - DNA, 22 bp, Homo sapiens
gcccccagaagggccacagatt

SEQ ID NO: 8561606 - DNA, 22 bp, Homo sapiens
gcccccagaagggccacagatt

SEQ ID NO: 8561607 - DNA, 22 bp, Homo sapiens
gcccccagaagggccacagatt

SEQ ID NO: 8561608 - DNA, 22 bp, Homo sapiens
atttgctctagctgcagtgaat

SEQ ID NO: 8561609 - DNA, 22 bp, Homo sapiens
atttgctgaatcaatgaatttt

SEQ ID NO: 8561610 - DNA, 22 bp, Homo sapiens
atttgctgagctcaaagaaaag

SEQ ID NO: 8561611 - DNA, 22 bp, Homo sapiens
atttggaaaagcggtaacttgc

SEQ ID NO: 8561612 - DNA, 22 bp, Homo sapiens
gccccctctttggagccagcca

SEQ ID NO: 8561613 - DNA, 22 bp, Homo sapiens
atttgctagtggaattttcctg

SEQ ID NO: 8561614 - DNA, 22 bp, Homo sapiens
atttggaaacaattatattctt

SEQ ID NO: 8561615 - DNA, 22 bp, Homo sapiens
gcctaggtaccagcagagagcc

SEQ ID NO: 8561616 - DNA, 22 bp, Homo sapiens
gcctagggtgctcagggacgag

SEQ ID NO: 8561617 - DNA, 22 bp, Homo sapiens
gcctcaaatgtggagcactatt

SEQ ID NO: 8561618 - DNA, 22 bp, Homo sapiens
gcctattttattatgcatgtaa

SEQ ID NO: 8561619 - DNA, 22 bp, Homo sapiens
gcctctgatggaggccagcgct

SEQ ID NO: 8561620 - DNA, 22 bp, Homo sapiens
gcctctgatggaggccagcgct

SEQ ID NO: 8561621 - DNA, 22 bp, Homo sapiens
gcctctgagtttggagaagagc

SEQ ID NO: 8561622 - DNA, 19 bp, Homo sapiens
gcctcacaggtctcaggcc

SEQ ID NO: 8561623 - DNA, 22 bp, Homo sapiens
gcctcacatattcatggttact

SEQ ID NO: 8561624 - DNA, 22 bp, Homo sapiens
atttggaagaaatctgtcacag

SEQ ID NO: 8561625 - DNA, 22 bp, Homo sapiens
gcctaggagacaagcgtgaaag

SEQ ID NO: 8561626 - DNA, 22 bp, Homo sapiens
gcctaggagtacagaatggttt

SEQ ID NO: 8561627 - DNA, 22 bp, Homo sapiens
gcctaggagtggggatggcggt

SEQ ID NO: 8561628 - DNA, 22 bp, Homo sapiens
gcctaggggtaagagtactggc

SEQ ID NO: 8561629 - DNA, 22 bp, Homo sapiens
atttggaacaaatattagtaaa

SEQ ID NO: 8561630 - DNA, 22 bp, Homo sapiens
atttggaacttataataagttt

SEQ ID NO: 8561631 - DNA, 22 bp, Homo sapiens
caaaattctgcatttctaataa

SEQ ID NO: 8561632 - DNA, 22 bp, Homo sapiens
caaaattagggagtgagctgga

SEQ ID NO: 8561633 - DNA, 22 bp, Homo sapiens
caaaattagggagtgagctgga

SEQ ID NO: 8561634 - DNA, 22 bp, Homo sapiens
caaaattagaaatgcagctgtt

SEQ ID NO: 8561635 - DNA, 22 bp, Homo sapiens
caaaattagaaatgcagctgtt

SEQ ID NO: 8561636 - DNA, 22 bp, Homo sapiens
caaaattagggagtgagctgga

SEQ ID NO: 8561637 - DNA, 22 bp, Homo sapiens
caaaattgatgaatgtatgatt

SEQ ID NO: 8561638 - DNA, 22 bp, Homo sapiens
caaaattgatgaatgtatgatt

SEQ ID NO: 8561639 - DNA, 22 bp, Homo sapiens
caaaattgttgatgctgctttg

SEQ ID NO: 8561640 - DNA, 22 bp, Homo sapiens
caaacatagtgaagcaatgaca

SEQ ID NO: 8561641 - DNA, 22 bp, Homo sapiens
caaacatagtgaagcaatgaca

SEQ ID NO: 8561642 - DNA, 22 bp, Homo sapiens
caaaatgatgtgattttattgt

SEQ ID NO: 8561643 - DNA, 22 bp, Homo sapiens
caaaatgatgtgattttattgt

SEQ ID NO: 8561644 - DNA, 22 bp, Homo sapiens
caaaatgtgagtcccacctcaa

SEQ ID NO: 8561645 - DNA, 23 bp, Homo sapiens
caaaatgctatgtgcccaatgca

SEQ ID NO: 8561646 - DNA, 22 bp, Homo sapiens
caaaatgcatctgagaccaggc

SEQ ID NO: 8561647 - DNA, 22 bp, Homo sapiens
caaaatagatgttaacctggaa

SEQ ID NO: 8561648 - DNA, 22 bp, Homo sapiens
caaaatgtgagtcccacctcaa

SEQ ID NO: 8561649 - DNA, 22 bp, Homo sapiens
caaaatgttctggcacctttaa

SEQ ID NO: 8561650 - DNA, 22 bp, Homo sapiens
caaaatgttctggcacctttaa

SEQ ID NO: 8561651 - DNA, 22 bp, Homo sapiens
caaaattagaaatgcagctgtt

SEQ ID NO: 8561652 - DNA, 22 bp, Homo sapiens
caaagcagtattggattcttta

SEQ ID NO: 8561653 - DNA, 22 bp, Homo sapiens
caaagcagtattggattcttta

SEQ ID NO: 8561654 - DNA, 22 bp, Homo sapiens
caaagcagtgatccttaaagga

SEQ ID NO: 8561655 - DNA, 18 bp, Homo sapiens
caaagcaggtgacagtgt

SEQ ID NO: 8561656 - DNA, 18 bp, Homo sapiens
caaagcaggtgacagtgt

SEQ ID NO: 8561657 - DNA, 21 bp, Homo sapiens
caaagccaggcaactctctcc

SEQ ID NO: 8561658 - DNA, 22 bp, Homo sapiens
caaagcagttttaatcaagtag

SEQ ID NO: 8561659 - DNA, 22 bp, Homo sapiens
caaagccatagagtagataaga

SEQ ID NO: 8561660 - DNA, 22 bp, Homo sapiens
caaagcaggaagctcctgacag

SEQ ID NO: 8561661 - DNA, 22 bp, Homo sapiens
caaagcagcggattgggatagt

SEQ ID NO: 8561662 - DNA, 22 bp, Homo sapiens
caaagaggttttgagggcagct

SEQ ID NO: 8561663 - DNA, 22 bp, Homo sapiens
caaagagttttttcatataatg

SEQ ID NO: 8561664 - DNA, 22 bp, Homo sapiens
caaagaggttttgagggcagct

SEQ ID NO: 8561665 - DNA, 22 bp, Homo sapiens
caaacattcaagtacaagtctt

SEQ ID NO: 8561666 - DNA, 22 bp, Homo sapiens
caaacattcaagtacaagtctt

SEQ ID NO: 8561667 - DNA, 22 bp, Homo sapiens
caaacattcaagtacaagtctt

SEQ ID NO: 8561668 - DNA, 22 bp, Homo sapiens
attttagagaaacaaacgtagg

SEQ ID NO: 8561669 - DNA, 22 bp, Homo sapiens
attttagagaaacaaacgtagg

SEQ ID NO: 8561670 - DNA, 22 bp, Homo sapiens
attttactttgtgaatattgac

SEQ ID NO: 8561671 - DNA, 22 bp, Homo sapiens
attttacttcatttgaaatgcc

SEQ ID NO: 8561672 - DNA, 22 bp, Homo sapiens
attttagagctccaagtacagc

SEQ ID NO: 8561673 - DNA, 22 bp, Homo sapiens
attttagagaaacaaacgtagg

SEQ ID NO: 8561674 - DNA, 22 bp, Homo sapiens
attttagagctccaagtacagc

SEQ ID NO: 8561675 - DNA, 22 bp, Homo sapiens
attttagagctccaagtacagc

SEQ ID NO: 8561676 - DNA, 22 bp, Homo sapiens
atttttccaattaggataaaga

SEQ ID NO: 8561677 - DNA, 22 bp, Homo sapiens
atttttccatgatacttatctg

SEQ ID NO: 8561678 - DNA, 22 bp, Homo sapiens
atttttcagcttcattgaggca

SEQ ID NO: 8561679 - DNA, 22 bp, Homo sapiens
atttttcaactttggaaatggc

SEQ ID NO: 8561680 - DNA, 22 bp, Homo sapiens
attttgtttcctttggagtaga

SEQ ID NO: 8561681 - DNA, 22 bp, Homo sapiens
attttgctttatgtaaatatgt

SEQ ID NO: 8561682 - DNA, 22 bp, Homo sapiens
atttttatgacaaaccatcctc

SEQ ID NO: 8561683 - DNA, 22 bp, Homo sapiens
atttttatgacaaaccatcctc

SEQ ID NO: 8561684 - DNA, 22 bp, Homo sapiens
atttttatgacaaaccatcctc

SEQ ID NO: 8561685 - DNA, 22 bp, Homo sapiens
caaaataccacgacttgtttta

SEQ ID NO: 8561686 - DNA, 22 bp, Homo sapiens
atttttgagctgtgaacatagc

SEQ ID NO: 8561687 - DNA, 19 bp, Homo sapiens
atttttcttcctctgtgca

SEQ ID NO: 8561688 - DNA, 19 bp, Homo sapiens
atttttcttcctctgtgca

SEQ ID NO: 8561689 - DNA, 22 bp, Homo sapiens
atttttctctttccactgagat

SEQ ID NO: 8561690 - DNA, 22 bp, Homo sapiens
atttttctctttccactgagat

SEQ ID NO: 8561691 - DNA, 22 bp, Homo sapiens
atttttctctttccactgagat

SEQ ID NO: 8561692 - DNA, 22 bp, Homo sapiens
atttttctctccactccattaa

SEQ ID NO: 8561693 - DNA, 22 bp, Homo sapiens
atttttctctccactccattaa

SEQ ID NO: 8561694 - DNA, 22 bp, Homo sapiens
atttttctctccactccattaa

SEQ ID NO: 8561695 - DNA, 22 bp, Homo sapiens
atttttctctcacacttaccag

SEQ ID NO: 8561696 - DNA, 22 bp, Homo sapiens
atttttctctcacacttaccag

SEQ ID NO: 8561697 - DNA, 22 bp, Homo sapiens
caaatgcatagaaagatgaaac

SEQ ID NO: 8561698 - DNA, 22 bp, Homo sapiens
caaatgatacctattactaggc

SEQ ID NO: 8561699 - DNA, 22 bp, Homo sapiens
caaatgatacctattactaggc

SEQ ID NO: 8561700 - DNA, 22 bp, Homo sapiens
gctgactgtccgctgctcccgg

SEQ ID NO: 8561701 - DNA, 20 bp, Homo sapiens
gctgactgtttgggtggcgg

SEQ ID NO: 8561702 - DNA, 20 bp, Homo sapiens
gctgacccctgctgtcatgc

SEQ ID NO: 8561703 - DNA, 22 bp, Homo sapiens
gctgactggttcaggtcccgct

SEQ ID NO: 8561704 - DNA, 22 bp, Homo sapiens
gctgactgctcagggccagctg

SEQ ID NO: 8561705 - DNA, 22 bp, Homo sapiens
gctgactggttgcacagagggt

SEQ ID NO: 8561706 - DNA, 22 bp, Homo sapiens
gctgactgatggacacagcacc

SEQ ID NO: 8561707 - DNA, 22 bp, Homo sapiens
gctgactggttcaggtcccgct

SEQ ID NO: 8561708 - DNA, 22 bp, Homo sapiens
gctgactggttgcacagagggt

SEQ ID NO: 8561709 - DNA, 22 bp, Homo sapiens
gctgactgatggacacagcacc

SEQ ID NO: 8561710 - DNA, 22 bp, Homo sapiens
gctgactgatggacacagcacc

SEQ ID NO: 8561711 - DNA, 22 bp, Homo sapiens
gctgactgctcagggccagctg

SEQ ID NO: 8561712 - DNA, 22 bp, Homo sapiens
caaatgcatgagaaataagagg

SEQ ID NO: 8561713 - DNA, 22 bp, Homo sapiens
caaatgcatgagaaataagagg

SEQ ID NO: 8561714 - DNA, 22 bp, Homo sapiens
caaatgcatagtttataagaag

SEQ ID NO: 8561715 - DNA, 22 bp, Homo sapiens
caaatgcatgagaaataagagg

SEQ ID NO: 8561716 - DNA, 22 bp, Homo sapiens
caaatgcatgagaaataagagg

SEQ ID NO: 8561717 - DNA, 22 bp, Homo sapiens
caaatgcatgagaaataagagg

SEQ ID NO: 8561718 - DNA, 22 bp, Homo sapiens
caaatgctactaataggcaagt

SEQ ID NO: 8561719 - DNA, 22 bp, Homo sapiens
caaatgctactaataggcaagt

SEQ ID NO: 8561720 - DNA, 22 bp, Homo sapiens
caaatgctaacttctttccaaa

SEQ ID NO: 8561721 - DNA, 22 bp, Homo sapiens
caaatgcatgagaaataagagg

SEQ ID NO: 8561722 - DNA, 22 bp, Homo sapiens
caaatgctaacttctttccaaa

SEQ ID NO: 8561723 - DNA, 22 bp, Homo sapiens
caaatgctggccctgctactta

SEQ ID NO: 8561724 - DNA, 22 bp, Homo sapiens
caaatggctggcatccttctac

SEQ ID NO: 8561725 - DNA, 22 bp, Homo sapiens
gctgacccctacaggttgtgtt

SEQ ID NO: 8561726 - DNA, 22 bp, Homo sapiens
gctgaccattaggaggacgata

SEQ ID NO: 8561727 - DNA, 20 bp, Homo sapiens
gctgaccataaatcacactg

SEQ ID NO: 8561728 - DNA, 22 bp, Homo sapiens
gctgacagttactgctgtaaca

SEQ ID NO: 8561729 - DNA, 22 bp, Homo sapiens
gctgaaaaatagtgtcgtgttt

SEQ ID NO: 8561730 - DNA, 22 bp, Homo sapiens
gctgacagagtgcctggcctca

SEQ ID NO: 8561731 - DNA, 22 bp, Homo sapiens
gctgaaatgaaaacacaggtcg

SEQ ID NO: 8561732 - DNA, 22 bp, Homo sapiens
gctgaaatcccagcattcccca

SEQ ID NO: 8561733 - DNA, 22 bp, Homo sapiens
caaatagactctagaatttatt

SEQ ID NO: 8561734 - DNA, 22 bp, Homo sapiens
gctcttgtcaaaaattagttga

SEQ ID NO: 8561735 - DNA, 22 bp, Homo sapiens
gctcttgggggacagatggagt

SEQ ID NO: 8561736 - DNA, 22 bp, Homo sapiens
gctcttgtcaaaaattagttga

SEQ ID NO: 8561737 - DNA, 22 bp, Homo sapiens
gctcttgtcaaaaattagttga

SEQ ID NO: 8561738 - DNA, 22 bp, Homo sapiens
caaagctgatactcagcaagta

SEQ ID NO: 8561739 - DNA, 22 bp, Homo sapiens
caaagctggaaaaggaggctgg

SEQ ID NO: 8561740 - DNA, 22 bp, Homo sapiens
caaagcctctgatttcacttgt

SEQ ID NO: 8561741 - DNA, 22 bp, Homo sapiens
caaagcctctgatttcacttgt

SEQ ID NO: 8561742 - DNA, 22 bp, Homo sapiens
caaagcctctgatttcacttgt

SEQ ID NO: 8561743 - DNA, 18 bp, Homo sapiens
caaagctcacgttccatc

SEQ ID NO: 8561744 - DNA, 22 bp, Homo sapiens
caaagctgacgaggtcagcatc

SEQ ID NO: 8561745 - DNA, 22 bp, Homo sapiens
caaagctgacgaggtcagcatc

SEQ ID NO: 8561746 - DNA, 22 bp, Homo sapiens
caaagctcatgctcttagccat

SEQ ID NO: 8561747 - DNA, 22 bp, Homo sapiens
caaagtgctggaattacaggtg

SEQ ID NO: 8561748 - DNA, 22 bp, Homo sapiens
caaagtgctggaattacaggtg

SEQ ID NO: 8561749 - DNA, 22 bp, Homo sapiens
caaagtgctggaattacaggtg

SEQ ID NO: 8561750 - DNA, 22 bp, Homo sapiens
caaaggacccataattaaaacc

SEQ ID NO: 8561751 - DNA, 22 bp, Homo sapiens
caaaggaggtaatgggtgtgag

SEQ ID NO: 8561752 - DNA, 22 bp, Homo sapiens
caaaggaggtgataggccctct

SEQ ID NO: 8561753 - DNA, 22 bp, Homo sapiens
caaatactaaacataagatttt

SEQ ID NO: 8561754 - DNA, 22 bp, Homo sapiens
caaatactaaacataagatttt

SEQ ID NO: 8561755 - DNA, 22 bp, Homo sapiens
caaatactgagtttattttcaa

SEQ ID NO: 8561756 - DNA, 22 bp, Homo sapiens
caaatactctggatgtgtttgt

SEQ ID NO: 8561757 - DNA, 22 bp, Homo sapiens
caaatactacgattcttgcagt

SEQ ID NO: 8561758 - DNA, 22 bp, Homo sapiens
caaatactgagtttattttcaa

SEQ ID NO: 8561759 - DNA, 22 bp, Homo sapiens
caaatactgggtaagttaattt

SEQ ID NO: 8561760 - DNA, 22 bp, Homo sapiens
caaatactgggtaagttaattt

SEQ ID NO: 8561761 - DNA, 18 bp, Homo sapiens
caaatactgttgtcttat

SEQ ID NO: 8561762 - DNA, 22 bp, Homo sapiens
caaatagacaagatggcaggaa

SEQ ID NO: 8561763 - DNA, 22 bp, Homo sapiens
caaatagaaggtactcagagaa

SEQ ID NO: 8561764 - DNA, 22 bp, Homo sapiens
caaatagaactcacagacaaga

SEQ ID NO: 8561765 - DNA, 22 bp, Homo sapiens
caaatactttatatacttcaaa

SEQ ID NO: 8561766 - DNA, 22 bp, Homo sapiens
caaatacttactgaacctgtgc

SEQ ID NO: 8561767 - DNA, 22 bp, Homo sapiens
caaatactttatatacttcaaa

SEQ ID NO: 8561768 - DNA, 21 bp, Homo sapiens
caaatacttagaaacttaaga

SEQ ID NO: 8561769 - DNA, 22 bp, Homo sapiens
attcagaaatagaaaatttgat

SEQ ID NO: 8561770 - DNA, 22 bp, Homo sapiens
attcagaagcaatcacagtgag

SEQ ID NO: 8561771 - DNA, 22 bp, Homo sapiens
attcagaaagggttgcctggtt

SEQ ID NO: 8561772 - DNA, 21 bp, Homo sapiens
attcagaaagggaataaactc

SEQ ID NO: 8561773 - DNA, 21 bp, Homo sapiens
attcagaaagggaataaactc

SEQ ID NO: 8561774 - DNA, 22 bp, Homo sapiens
attcagaaagcaagtgctgggt

SEQ ID NO: 8561775 - DNA, 21 bp, Homo sapiens
attcagaaagggaataaactc

SEQ ID NO: 8561776 - DNA, 22 bp, Homo sapiens
attcagaaactctgggcagaac

SEQ ID NO: 8561777 - DNA, 22 bp, Homo sapiens
attcagaaagatatgcctggtt

SEQ ID NO: 8561778 - DNA, 22 bp, Homo sapiens
attcactgtcagcttgcatggg

SEQ ID NO: 8561779 - DNA, 22 bp, Homo sapiens
attcacatttagcctctgacat

SEQ ID NO: 8561780 - DNA, 22 bp, Homo sapiens
gcaccttgggaagcgccagttg

SEQ ID NO: 8561781 - DNA, 22 bp, Homo sapiens
attcaaggtatttaaaacataa

SEQ ID NO: 8561782 - DNA, 22 bp, Homo sapiens
attcaaggtatttaaaacataa

SEQ ID NO: 8561783 - DNA, 22 bp, Homo sapiens
attcaagattaattctatgtca

SEQ ID NO: 8561784 - DNA, 22 bp, Homo sapiens
attcaagagctggctttgaaat

SEQ ID NO: 8561785 - DNA, 22 bp, Homo sapiens
attcaagaggaacaatgaagat

SEQ ID NO: 8561786 - DNA, 22 bp, Homo sapiens
gcactaaaccaacatgtaataa

SEQ ID NO: 8561787 - DNA, 22 bp, Homo sapiens
gcacggctaatttttgtatttt

SEQ ID NO: 8561788 - DNA, 22 bp, Homo sapiens
gcacggctaatttttgtatttt

SEQ ID NO: 8561789 - DNA, 22 bp, Homo sapiens
attcacaatagcagcttgcatg

SEQ ID NO: 8561790 - DNA, 22 bp, Homo sapiens
attcacaatgatacataagcga

SEQ ID NO: 8561791 - DNA, 22 bp, Homo sapiens
attcacaatgatacataagcga

SEQ ID NO: 8561792 - DNA, 20 bp, Homo sapiens
gcagcagacagacaggggac

SEQ ID NO: 8561793 - DNA, 20 bp, Homo sapiens
gcagcagacagacaggggac

SEQ ID NO: 8561794 - DNA, 22 bp, Homo sapiens
gcagcagagaacacaatgatgg

SEQ ID NO: 8561795 - DNA, 22 bp, Homo sapiens
gcagcagagaccccaggaagga

SEQ ID NO: 8561796 - DNA, 22 bp, Homo sapiens
gcagcagagaccccaggaagga

SEQ ID NO: 8561797 - DNA, 22 bp, Homo sapiens
gcagcagagaccccaggaagga

SEQ ID NO: 8561798 - DNA, 17 bp, Homo sapiens
gcagcagagagaccctc

SEQ ID NO: 8561799 - DNA, 21 bp, Homo sapiens
gcagcagaggcttgacagaca

SEQ ID NO: 8561800 - DNA, 21 bp, Homo sapiens
gcagcagaggcttgacagaca

SEQ ID NO: 8561801 - DNA, 22 bp, Homo sapiens
gcagcagagtagacagagccct

SEQ ID NO: 8561802 - DNA, 22 bp, Homo sapiens
gcagcagagctttgtcctggct

SEQ ID NO: 8561803 - DNA, 22 bp, Homo sapiens
gcagcagaggccctactctttg

SEQ ID NO: 8561804 - DNA, 22 bp, Homo sapiens
attcagaagcaatcacagtgag

SEQ ID NO: 8561805 - DNA, 22 bp, Homo sapiens
attcagaagcaatcacagtgag

SEQ ID NO: 8561806 - DNA, 22 bp, Homo sapiens
attcagaagctattcttagttc

SEQ ID NO: 8561807 - DNA, 20 bp, Homo sapiens
attcagaataggcatgtaaa

SEQ ID NO: 8561808 - DNA, 20 bp, Homo sapiens
attcagaataggcatgtaaa

SEQ ID NO: 8561809 - DNA, 22 bp, Homo sapiens
attcagaatggcaaacttctag

SEQ ID NO: 8561810 - DNA, 22 bp, Homo sapiens
gcagatggaaagtgcttgaggg

SEQ ID NO: 8561811 - DNA, 22 bp, Homo sapiens
gcagatgcttggcactgacagt

SEQ ID NO: 8561812 - DNA, 22 bp, Homo sapiens
gcagatgctgtggtgatagaag

SEQ ID NO: 8561813 - DNA, 22 bp, Homo sapiens
attcagaattgtgggcagtaca

SEQ ID NO: 8561814 - DNA, 23 bp, Homo sapiens
attcagaattgtgtgtttgtata

SEQ ID NO: 8561815 - DNA, 22 bp, Homo sapiens
attcagaattttggggagctaa

SEQ ID NO: 8561816 - DNA, 22 bp, Homo sapiens
gcagcagagtttgggagatggt

SEQ ID NO: 8561817 - DNA, 22 bp, Homo sapiens
gcagcagagtagacagagccct

SEQ ID NO: 8561818 - DNA, 22 bp, Homo sapiens
gcagcagatgctttcatggaca

SEQ ID NO: 8561819 - DNA, 22 bp, Homo sapiens
gcagcagatgctttcatggaca

SEQ ID NO: 8561820 - DNA, 22 bp, Homo sapiens
gcagcagagtttgggagatggt

SEQ ID NO: 8561821 - DNA, 22 bp, Homo sapiens
gcagcagagtttgggagatggt

SEQ ID NO: 8561822 - DNA, 22 bp, Homo sapiens
gcagcagagtttgggagatggt

SEQ ID NO: 8561823 - DNA, 22 bp, Homo sapiens
attcagttgtctactactgcct

SEQ ID NO: 8561824 - DNA, 22 bp, Homo sapiens
attcagttgtaatctttgttag

SEQ ID NO: 8561825 - DNA, 22 bp, Homo sapiens
attcagttgtaatctttgttag

SEQ ID NO: 8561826 - DNA, 23 bp, Homo sapiens
attcagttgtgagagaagacaca

SEQ ID NO: 8561827 - DNA, 23 bp, Homo sapiens
attcagttgtgagagaagacaca

SEQ ID NO: 8561828 - DNA, 22 bp, Homo sapiens
attcagtttcaatcattgtagt

SEQ ID NO: 8561829 - DNA, 22 bp, Homo sapiens
attcagtttcaatcattgtagt

SEQ ID NO: 8561830 - DNA, 22 bp, Homo sapiens
attcagttccttgtgattgtag

SEQ ID NO: 8561831 - DNA, 22 bp, Homo sapiens
attcagttccttgtgattgtag

SEQ ID NO: 8561832 - DNA, 22 bp, Homo sapiens
attcagttctaaggtcagtgcc

SEQ ID NO: 8561833 - DNA, 22 bp, Homo sapiens
attcagttctggctgccttcct

SEQ ID NO: 8561834 - DNA, 22 bp, Homo sapiens
attcagttctgctggttctgct

SEQ ID NO: 8561835 - DNA, 22 bp, Homo sapiens
attcataacggcaaatgtcacc

SEQ ID NO: 8561836 - DNA, 22 bp, Homo sapiens
attcataacggcaaatgtcacc

SEQ ID NO: 8561837 - DNA, 22 bp, Homo sapiens
attcagtttttattggaccagc

SEQ ID NO: 8561838 - DNA, 22 bp, Homo sapiens
attcagtttttgaagggaaatt

SEQ ID NO: 8561839 - DNA, 22 bp, Homo sapiens
attcagtttttgaagggaaatt

SEQ ID NO: 8561840 - DNA, 22 bp, Homo sapiens
attcagtttttattggaccagc

SEQ ID NO: 8561841 - DNA, 22 bp, Homo sapiens
attcagtttcatggcacagcta

SEQ ID NO: 8561842 - DNA, 22 bp, Homo sapiens
attcagtttcaatcattgtagt

SEQ ID NO: 8561843 - DNA, 22 bp, Homo sapiens
attcagtttcatggcacagcta

SEQ ID NO: 8561844 - DNA, 22 bp, Homo sapiens
attcagtttcaatcattgtagt

SEQ ID NO: 8561845 - DNA, 21 bp, Homo sapiens
attcagtttgacatctagcag

SEQ ID NO: 8561846 - DNA, 21 bp, Homo sapiens
attcagtttgacatctagcag

SEQ ID NO: 8561847 - DNA, 22 bp, Homo sapiens
attcagtttcatggcacagcta

SEQ ID NO: 8561848 - DNA, 21 bp, Homo sapiens
attcagtttgacatctagcag

SEQ ID NO: 8561849 - DNA, 22 bp, Homo sapiens
attcatagctcagtacagactc

SEQ ID NO: 8561850 - DNA, 22 bp, Homo sapiens
attcataacggcaaatgtcacc

SEQ ID NO: 8561851 - DNA, 22 bp, Homo sapiens
attcatatcatagagttattga

SEQ ID NO: 8561852 - DNA, 22 bp, Homo sapiens
attcatctatgactctaatgtg

SEQ ID NO: 8561853 - DNA, 22 bp, Homo sapiens
attcatctgtacttcaatatct

SEQ ID NO: 8561854 - DNA, 22 bp, Homo sapiens
attcatcagctaatggacattt

SEQ ID NO: 8561855 - DNA, 22 bp, Homo sapiens
attcatccttaccagtccccgg

SEQ ID NO: 8561856 - DNA, 22 bp, Homo sapiens
attcatatcatagagttattga

SEQ ID NO: 8561857 - DNA, 22 bp, Homo sapiens
attcatcaactgatagccatag

SEQ ID NO: 8561858 - DNA, 22 bp, Homo sapiens
attcatcagctaatggacattt

SEQ ID NO: 8561859 - DNA, 23 bp, Homo sapiens
attagaaaggctttctggtgaaa

SEQ ID NO: 8561860 - DNA, 22 bp, Homo sapiens
gatttcagaagcaagaggaggt

SEQ ID NO: 8561861 - DNA, 22 bp, Homo sapiens
gatttcagagtttattaggtta

SEQ ID NO: 8561862 - DNA, 22 bp, Homo sapiens
gatttcaggctatctatgcaga

SEQ ID NO: 8561863 - DNA, 22 bp, Homo sapiens
gatttccaggacgggaggtggg

SEQ ID NO: 8561864 - DNA, 22 bp, Homo sapiens
gatttccaggtcattaataaag

SEQ ID NO: 8561865 - DNA, 22 bp, Homo sapiens
gatttcagtggctgtctcaaat

SEQ ID NO: 8561866 - DNA, 22 bp, Homo sapiens
gatttcagggtgcagatgatga

SEQ ID NO: 8561867 - DNA, 22 bp, Homo sapiens
gatttcaggctatctatgcaga

SEQ ID NO: 8561868 - DNA, 22 bp, Homo sapiens
gatttcagccccgctcccagct

SEQ ID NO: 8561869 - DNA, 22 bp, Homo sapiens
gatttcagggtgtcttccagct

SEQ ID NO: 8561870 - DNA, 22 bp, Homo sapiens
gatttcagggtgtcttccagct

SEQ ID NO: 8561871 - DNA, 22 bp, Homo sapiens
attagaaaatctggaggtgggg

SEQ ID NO: 8561872 - DNA, 22 bp, Homo sapiens
attagaaaatacatgggctgtc

SEQ ID NO: 8561873 - DNA, 22 bp, Homo sapiens
gatttccttgcatattggtaat

SEQ ID NO: 8561874 - DNA, 22 bp, Homo sapiens
gatttcctcactaacatccatc

SEQ ID NO: 8561875 - DNA, 17 bp, Homo sapiens
gatttcctgaagttctt

SEQ ID NO: 8561876 - DNA, 22 bp, Homo sapiens
gatttcctagacatggggcaga

SEQ ID NO: 8561877 - DNA, 22 bp, Homo sapiens
gatttcccagcaaaagctggtt

SEQ ID NO: 8561878 - DNA, 22 bp, Homo sapiens
gatttccctatagttttctctt

SEQ ID NO: 8561879 - DNA, 22 bp, Homo sapiens
gatttcctaatgtggatctctg

SEQ ID NO: 8561880 - DNA, 22 bp, Homo sapiens
gatttccattttcaactcctgc

SEQ ID NO: 8561881 - DNA, 22 bp, Homo sapiens
gatttccatgattgggccagaa

SEQ ID NO: 8561882 - DNA, 22 bp, Homo sapiens
gatttcagtggctgtctcaaat

SEQ ID NO: 8561883 - DNA, 22 bp, Homo sapiens
gatttctagtaagtcatgaagg

SEQ ID NO: 8561884 - DNA, 22 bp, Homo sapiens
gatttctaaggaggctgaactt

SEQ ID NO: 8561885 - DNA, 22 bp, Homo sapiens
gatttctacttgaacttgctaa

SEQ ID NO: 8561886 - DNA, 22 bp, Homo sapiens
attactccttttctagcaggtg

SEQ ID NO: 8561887 - DNA, 22 bp, Homo sapiens
attaccacttaatcaacatatg

SEQ ID NO: 8561888 - DNA, 23 bp, Homo sapiens
attacatgagcaaatatagctat

SEQ ID NO: 8561889 - DNA, 22 bp, Homo sapiens
attacatgagagaatgtaaata

SEQ ID NO: 8561890 - DNA, 22 bp, Homo sapiens
attacatatgttggcaacattt

SEQ ID NO: 8561891 - DNA, 21 bp, Homo sapiens
attacatccctggtgatacat

SEQ ID NO: 8561892 - DNA, 22 bp, Homo sapiens
attacatcagttgacatgtgag

SEQ ID NO: 8561893 - DNA, 21 bp, Homo sapiens
attacatccctggtgatacat

SEQ ID NO: 8561894 - DNA, 22 bp, Homo sapiens
attacagttctacacatccttt

SEQ ID NO: 8561895 - DNA, 22 bp, Homo sapiens
attacagttctgcaggtagttt

SEQ ID NO: 8561896 - DNA, 22 bp, Homo sapiens
attacagttctgcaggtagttt

SEQ ID NO: 8561897 - DNA, 22 bp, Homo sapiens
attacagttaatttaccttctt

SEQ ID NO: 8561898 - DNA, 23 bp, Homo sapiens
attacagttaattacaacatctt

SEQ ID NO: 8561899 - DNA, 22 bp, Homo sapiens
attacaatcgagagaaacaaat

SEQ ID NO: 8561900 - DNA, 22 bp, Homo sapiens
attacaatcgagagaaacaaat

SEQ ID NO: 8561901 - DNA, 22 bp, Homo sapiens
attacaatcgagagaaacaaat

SEQ ID NO: 8561902 - DNA, 22 bp, Homo sapiens
attacagtgggtaaacagaatt

SEQ ID NO: 8561903 - DNA, 22 bp, Homo sapiens
attacagtgggtaaacagaatt

SEQ ID NO: 8561904 - DNA, 22 bp, Homo sapiens
attacaatcgagagaaacaaat

SEQ ID NO: 8561905 - DNA, 22 bp, Homo sapiens
attacaatcgagagaaacaaat

SEQ ID NO: 8561906 - DNA, 22 bp, Homo sapiens
attacaatcgagagaaacaaat

SEQ ID NO: 8561907 - DNA, 22 bp, Homo sapiens
gatatgtattgaatgatcattt

SEQ ID NO: 8561908 - DNA, 22 bp, Homo sapiens
attagtgttcttatcttctagg

SEQ ID NO: 8561909 - DNA, 22 bp, Homo sapiens
attagtgttgtaagaagctgcc

SEQ ID NO: 8561910 - DNA, 22 bp, Homo sapiens
attagtgttgtggcttcatggc

SEQ ID NO: 8561911 - DNA, 22 bp, Homo sapiens
attagttgaacaagttaagtaa

SEQ ID NO: 8561912 - DNA, 22 bp, Homo sapiens
attcaaagtactagctattttt

SEQ ID NO: 8561913 - DNA, 22 bp, Homo sapiens
attatttctcactcacataata

SEQ ID NO: 8561914 - DNA, 22 bp, Homo sapiens
attatttccttgctttgaggaa

SEQ ID NO: 8561915 - DNA, 22 bp, Homo sapiens
attagtgtctgtgaataattct

SEQ ID NO: 8561916 - DNA, 22 bp, Homo sapiens
attagtgtctgtgaataattct

SEQ ID NO: 8561917 - DNA, 22 bp, Homo sapiens
attagtgttcttatcttctagg

SEQ ID NO: 8561918 - DNA, 22 bp, Homo sapiens
attagtgtgtaggctggaaaaa

SEQ ID NO: 8561919 - DNA, 22 bp, Homo sapiens
attagtgtggaccctaatttaa

SEQ ID NO: 8561920 - DNA, 22 bp, Homo sapiens
attagtgcccaggctgcctctt

SEQ ID NO: 8561921 - DNA, 22 bp, Homo sapiens
attagtgtacatctcacacgca

SEQ ID NO: 8561922 - DNA, 22 bp, Homo sapiens
attagtgtcatgttgaggactt

SEQ ID NO: 8561923 - DNA, 22 bp, Homo sapiens
attagtgtacatctcacacgca

SEQ ID NO: 8561924 - DNA, 22 bp, Homo sapiens
attagtgatatgtgactagacc

SEQ ID NO: 8561925 - DNA, 22 bp, Homo sapiens
attagtgcccaggctgcctctt

SEQ ID NO: 8561926 - DNA, 20 bp, Homo sapiens
attagtgcatctggacatgc

SEQ ID NO: 8561927 - DNA, 22 bp, Homo sapiens
attcaactgtaaacttgttcac

SEQ ID NO: 8561928 - DNA, 22 bp, Homo sapiens
attcaacatattctgagtaaaa

SEQ ID NO: 8561929 - DNA, 22 bp, Homo sapiens
attcaacatattctgagtaaaa

SEQ ID NO: 8561930 - DNA, 22 bp, Homo sapiens
attcaaattaagttaattcagc

SEQ ID NO: 8561931 - DNA, 22 bp, Homo sapiens
attcaaattaagttaattcagc

SEQ ID NO: 8561932 - DNA, 22 bp, Homo sapiens
attcaaattaagttaattcagc

SEQ ID NO: 8561933 - DNA, 22 bp, Homo sapiens
attcaaatgtcaaatccaccag

SEQ ID NO: 8561934 - DNA, 22 bp, Homo sapiens
attcaaattaagttaattcagc

SEQ ID NO: 8561935 - DNA, 22 bp, Homo sapiens
attcaaagtactagctattttt

SEQ ID NO: 8561936 - DNA, 22 bp, Homo sapiens
attagatatttgctgttggatt

SEQ ID NO: 8561937 - DNA, 22 bp, Homo sapiens
attagatacacagatttccact

SEQ ID NO: 8561938 - DNA, 22 bp, Homo sapiens
attaggatgtgtatattgtgtt

SEQ ID NO: 8561939 - DNA, 20 bp, Homo sapiens
attaggattttaggtcatca

SEQ ID NO: 8561940 - DNA, 22 bp, Homo sapiens
attaggatttggtatggtcata

SEQ ID NO: 8561941 - DNA, 22 bp, Homo sapiens
attaggatgttcctatgcacat

SEQ ID NO: 8561942 - DNA, 22 bp, Homo sapiens
attaggattttgtccaagtagc

SEQ ID NO: 8561943 - DNA, 22 bp, Homo sapiens
attaggcatatatgcttttaat

SEQ ID NO: 8561944 - DNA, 22 bp, Homo sapiens
attagtaaaacattgtatatgt

SEQ ID NO: 8561945 - DNA, 22 bp, Homo sapiens
attagtaaaacattgtatatgt

SEQ ID NO: 8561946 - DNA, 22 bp, Homo sapiens
attagtctactgtctaataaat

SEQ ID NO: 8561947 - DNA, 22 bp, Homo sapiens
attgatatcagtttgctgattg

SEQ ID NO: 8561948 - DNA, 22 bp, Homo sapiens
attgatcatgcagatgcttcac

SEQ ID NO: 8561949 - DNA, 22 bp, Homo sapiens
attgatcatgcagatgcttcac

SEQ ID NO: 8561950 - DNA, 22 bp, Homo sapiens
attgatatcagtttgctgattg

SEQ ID NO: 8561951 - DNA, 23 bp, Homo sapiens
attgatgacttgattacactttt

SEQ ID NO: 8561952 - DNA, 22 bp, Homo sapiens
gcaggcctttatccctgcctca

SEQ ID NO: 8561953 - DNA, 22 bp, Homo sapiens
attgacctgattgttcctggaa

SEQ ID NO: 8561954 - DNA, 23 bp, Homo sapiens
attgaccagctgtctcattttca

SEQ ID NO: 8561955 - DNA, 22 bp, Homo sapiens
gcaggcggaggttgcagtgagc

SEQ ID NO: 8561956 - DNA, 22 bp, Homo sapiens
attgagaaaataagtatggata

SEQ ID NO: 8561957 - DNA, 22 bp, Homo sapiens
attgactagagtcacagttgca

SEQ ID NO: 8561958 - DNA, 23 bp, Homo sapiens
attgacctgtttagtctctccct

SEQ ID NO: 8561959 - DNA, 22 bp, Homo sapiens
attgatatattatttctaactg

SEQ ID NO: 8561960 - DNA, 22 bp, Homo sapiens
attgataaattgcaatggggct

SEQ ID NO: 8561961 - DNA, 22 bp, Homo sapiens
gcaggcctggtttacatggtag

SEQ ID NO: 8561962 - DNA, 22 bp, Homo sapiens
gcaggcctgtcttgctcgccct

SEQ ID NO: 8561963 - DNA, 22 bp, Homo sapiens
gcaggccttggcaatgagcctg

SEQ ID NO: 8561964 - DNA, 22 bp, Homo sapiens
gcaggcctgactgtagggggca

SEQ ID NO: 8561965 - DNA, 22 bp, Homo sapiens
gcaggcctgactgtagggggca

SEQ ID NO: 8561966 - DNA, 23 bp, Homo sapiens
attgattccctcttggaagggat

SEQ ID NO: 8561967 - DNA, 22 bp, Homo sapiens
attgattctaccagctactttg

SEQ ID NO: 8561968 - DNA, 22 bp, Homo sapiens
attgattctcataggaccatct

SEQ ID NO: 8561969 - DNA, 22 bp, Homo sapiens
attgattctgtaagtcaacaat

SEQ ID NO: 8561970 - DNA, 22 bp, Homo sapiens
attgattctaccagctactttg

SEQ ID NO: 8561971 - DNA, 22 bp, Homo sapiens
attgcaaaattgtcctgtggaa

SEQ ID NO: 8561972 - DNA, 22 bp, Homo sapiens
attgcaaaattgtcctgtggaa

SEQ ID NO: 8561973 - DNA, 22 bp, Homo sapiens
attgcaaagcattgtgagcgca

SEQ ID NO: 8561974 - DNA, 22 bp, Homo sapiens
attgcaaagaaatacatgctta

SEQ ID NO: 8561975 - DNA, 22 bp, Homo sapiens
gcagggctgagtcatgtgtgcc

SEQ ID NO: 8561976 - DNA, 22 bp, Homo sapiens
gcagggctgactcagccaccct

SEQ ID NO: 8561977 - DNA, 22 bp, Homo sapiens
gcagggctgagtcatgtgtgcc

SEQ ID NO: 8561978 - DNA, 22 bp, Homo sapiens
gcagggctgatgttattgacga

SEQ ID NO: 8561979 - DNA, 18 bp, Homo sapiens
gcagggctgcacacgcat

SEQ ID NO: 8561980 - DNA, 22 bp, Homo sapiens
gcagggctgcagagggcactgt

SEQ ID NO: 8561981 - DNA, 22 bp, Homo sapiens
gcagggctgcagagggcactgt

SEQ ID NO: 8561982 - DNA, 22 bp, Homo sapiens
gcagggctgcagagggcactgt

SEQ ID NO: 8561983 - DNA, 22 bp, Homo sapiens
gcagggctgggacttactggta

SEQ ID NO: 8561984 - DNA, 22 bp, Homo sapiens
gcagggctgctgaaacttgttt

SEQ ID NO: 8561985 - DNA, 22 bp, Homo sapiens
gcagggctgctgaaacttgttt

SEQ ID NO: 8561986 - DNA, 22 bp, Homo sapiens
gcagctgcctattcagggcttg

SEQ ID NO: 8561987 - DNA, 22 bp, Homo sapiens
gcagcgagtgcggctgccacag

SEQ ID NO: 8561988 - DNA, 22 bp, Homo sapiens
gcagcgaggtgatgaaatagct

SEQ ID NO: 8561989 - DNA, 22 bp, Homo sapiens
gcagctgccttcagctggatgg

SEQ ID NO: 8561990 - DNA, 22 bp, Homo sapiens
gcagctgctcacattctcacaa

SEQ ID NO: 8561991 - DNA, 22 bp, Homo sapiens
gcagctgctggaagttcctgcc

SEQ ID NO: 8561992 - DNA, 22 bp, Homo sapiens
attccttggaacagatgcgaag

SEQ ID NO: 8561993 - DNA, 22 bp, Homo sapiens
attccttgctctcatcaacctt

SEQ ID NO: 8561994 - DNA, 22 bp, Homo sapiens
gcagctggacccacacggctta

SEQ ID NO: 8561995 - DNA, 22 bp, Homo sapiens
attccttctttgagaataagca

SEQ ID NO: 8561996 - DNA, 22 bp, Homo sapiens
attccttgcacatcagatagtt

SEQ ID NO: 8561997 - DNA, 22 bp, Homo sapiens
gcagctggacccacacggctta

SEQ ID NO: 8561998 - DNA, 22 bp, Homo sapiens
gcagctggacccacacggctta

SEQ ID NO: 8561999 - DNA, 22 bp, Homo sapiens
gcagctgctgtggcatcaagct

SEQ ID NO: 8562000 - DNA, 22 bp, Homo sapiens
gcagctgctgggatcatttagg

SEQ ID NO: 8562001 - DNA, 22 bp, Homo sapiens
gcagctggaagtgacactctgt

SEQ ID NO: 8562002 - DNA, 22 bp, Homo sapiens
gcagctggaagtgacactctgt

SEQ ID NO: 8562003 - DNA, 22 bp, Homo sapiens
gcagctggaagtgacactctgt

SEQ ID NO: 8562004 - DNA, 22 bp, Homo sapiens
attcttgatatagatagttaat

SEQ ID NO: 8562005 - DNA, 22 bp, Homo sapiens
attcttcttgagtcttggactc

SEQ ID NO: 8562006 - DNA, 22 bp, Homo sapiens
attcttggcaaggagatttaaa

SEQ ID NO: 8562007 - DNA, 22 bp, Homo sapiens
attccttgtttcactgaaaagg

SEQ ID NO: 8562008 - DNA, 22 bp, Homo sapiens
attccttgtatatctacatgca

SEQ ID NO: 8562009 - DNA, 22 bp, Homo sapiens
attccttggcattctggacttg

SEQ ID NO: 8562010 - DNA, 22 bp, Homo sapiens
attccttgggaattattgaatg

SEQ ID NO: 8562011 - DNA, 22 bp, Homo sapiens
attccttgggctgccttattat

SEQ ID NO: 8562012 - DNA, 22 bp, Homo sapiens
attctttagttggcttcttgcc

SEQ ID NO: 8562013 - DNA, 22 bp, Homo sapiens
attctttagttggcttcttgcc

SEQ ID NO: 8562014 - DNA, 22 bp, Homo sapiens
attctttagccagcaggtatat

SEQ ID NO: 8562015 - DNA, 22 bp, Homo sapiens
attctttcaaggaatagttatt

SEQ ID NO: 8562016 - DNA, 22 bp, Homo sapiens
attctttcaaggaatagttatt

SEQ ID NO: 8562017 - DNA, 22 bp, Homo sapiens
attctttcatataaaggctcag

SEQ ID NO: 8562018 - DNA, 22 bp, Homo sapiens
attcttgtttaatttgcatccc

SEQ ID NO: 8562019 - DNA, 19 bp, Homo sapiens
attcttgttaagtgtcatc

SEQ ID NO: 8562020 - DNA, 22 bp, Homo sapiens
attctttacattggcttcttcc

SEQ ID NO: 8562021 - DNA, 22 bp, Homo sapiens
attgtcattccagtcattgtta

SEQ ID NO: 8562022 - DNA, 22 bp, Homo sapiens
attgtctcttaaatgtggaaat

SEQ ID NO: 8562023 - DNA, 22 bp, Homo sapiens
attgtctctgaatttccagctg

SEQ ID NO: 8562024 - DNA, 22 bp, Homo sapiens
attgtctctgaattttcagctg

SEQ ID NO: 8562025 - DNA, 22 bp, Homo sapiens
attgtcctatctcagtgccatg

SEQ ID NO: 8562026 - DNA, 22 bp, Homo sapiens
attgtcacttaaaagtgcatgt

SEQ ID NO: 8562027 - DNA, 18 bp, Homo sapiens
attgtcagaagtcatgtg

SEQ ID NO: 8562028 - DNA, 22 bp, Homo sapiens
attgtcagtgggatttgtcaac

SEQ ID NO: 8562029 - DNA, 22 bp, Homo sapiens
attgtcatcgatgttagccagt

SEQ ID NO: 8562030 - DNA, 20 bp, Homo sapiens
attgtcagccttcagaggag

SEQ ID NO: 8562031 - DNA, 22 bp, Homo sapiens
gcatattttcacaagctcttgg

SEQ ID NO: 8562032 - DNA, 22 bp, Homo sapiens
gcatattttcacaagctcttgg

SEQ ID NO: 8562033 - DNA, 22 bp, Homo sapiens
gcatattttcacaagctcttgg

SEQ ID NO: 8562034 - DNA, 17 bp, Homo sapiens
gcatcacagataacacg

SEQ ID NO: 8562035 - DNA, 17 bp, Homo sapiens
gcatcacagataacacg

SEQ ID NO: 8562036 - DNA, 22 bp, Homo sapiens
attgtacttttattacatgtag

SEQ ID NO: 8562037 - DNA, 17 bp, Homo sapiens
gcatcacagataacacg

SEQ ID NO: 8562038 - DNA, 22 bp, Homo sapiens
attgtacttttattacatgtag

SEQ ID NO: 8562039 - DNA, 22 bp, Homo sapiens
attgtagcaatttctcttaatt

SEQ ID NO: 8562040 - DNA, 22 bp, Homo sapiens
attgtataacagcatgtatttt

SEQ ID NO: 8562041 - DNA, 22 bp, Homo sapiens
attgtagcccatgcataaaccg

SEQ ID NO: 8562042 - DNA, 22 bp, Homo sapiens
gcataggccactagtgccagga

SEQ ID NO: 8562043 - DNA, 22 bp, Homo sapiens
gcatattttcacaagctcttgg

SEQ ID NO: 8562044 - DNA, 22 bp, Homo sapiens
gcagtgcttgaagaggtggcca

SEQ ID NO: 8562045 - DNA, 23 bp, Homo sapiens
gcagtgtgaatccagtgtttcag

SEQ ID NO: 8562046 - DNA, 22 bp, Homo sapiens
gcagtgtgaccgagcttgcttc

SEQ ID NO: 8562047 - DNA, 22 bp, Homo sapiens
gcagtgtgaccgagcttgcttc

SEQ ID NO: 8562048 - DNA, 22 bp, Homo sapiens
gcagtgtgatgcttccagccac

SEQ ID NO: 8562049 - DNA, 22 bp, Homo sapiens
gcagtgtgatgcttccagccac

SEQ ID NO: 8562050 - DNA, 22 bp, Homo sapiens
gcagtgtgaccgagcttgcttc

SEQ ID NO: 8562051 - DNA, 22 bp, Homo sapiens
gcagtgtgtctggagtacatgg

SEQ ID NO: 8562052 - DNA, 22 bp, Homo sapiens
gcagtgtgtctcttggcttcct

SEQ ID NO: 8562053 - DNA, 22 bp, Homo sapiens
gcagtgtgtctcttggcttcct

SEQ ID NO: 8562054 - DNA, 22 bp, Homo sapiens
gcagtgtgtctcttggcttcct

SEQ ID NO: 8562055 - DNA, 22 bp, Homo sapiens
gcagtgtgtggtgagggctgcc

SEQ ID NO: 8562056 - DNA, 22 bp, Homo sapiens
gcagtgtgtggtgagggctgcc

SEQ ID NO: 8562057 - DNA, 22 bp, Homo sapiens
gcagtgtgtggtgagggctgcc

SEQ ID NO: 8562058 - DNA, 20 bp, Homo sapiens
gcagtgtgtatgaatagctg

SEQ ID NO: 8562059 - DNA, 22 bp, Homo sapiens
gcagtgtgtagagtttaggaaa

SEQ ID NO: 8562060 - DNA, 22 bp, Homo sapiens
gcagtgtggcgtggggacctaa

SEQ ID NO: 8562061 - DNA, 22 bp, Homo sapiens
gcagtgtggcgtggggacctaa

SEQ ID NO: 8562062 - DNA, 22 bp, Homo sapiens
gcagtgtgcatggcttttggcc

SEQ ID NO: 8562063 - DNA, 22 bp, Homo sapiens
gcagtgtggccccagtatcacg

SEQ ID NO: 8562064 - DNA, 22 bp, Homo sapiens
gcagtgttacttggtttgcaga

SEQ ID NO: 8562065 - DNA, 22 bp, Homo sapiens
gcatacaaaggtttacaactga

SEQ ID NO: 8562066 - DNA, 22 bp, Homo sapiens
gcatacaaaggtttacaactga

SEQ ID NO: 8562067 - DNA, 22 bp, Homo sapiens
gcatacagagaggatgtggcat

SEQ ID NO: 8562068 - DNA, 22 bp, Homo sapiens
gcatacagagaggatgtggcat

SEQ ID NO: 8562069 - DNA, 22 bp, Homo sapiens
gcatacaaaggtttacaactga

SEQ ID NO: 8562070 - DNA, 22 bp, Homo sapiens
gcatacaaaggtttacaactga

SEQ ID NO: 8562071 - DNA, 22 bp, Homo sapiens
gcatacattgcaccctggtagt

SEQ ID NO: 8562072 - DNA, 22 bp, Homo sapiens
gcagtgtgtttggataacacac

SEQ ID NO: 8562073 - DNA, 22 bp, Homo sapiens
gcagtgtgtttctgagatatgg

SEQ ID NO: 8562074 - DNA, 22 bp, Homo sapiens
gcagtgtgtggtgagggctgcc

SEQ ID NO: 8562075 - DNA, 22 bp, Homo sapiens
gcagtgttaatgcgagtgttca

SEQ ID NO: 8562076 - DNA, 22 bp, Homo sapiens
gcagtgttacctcttcagtggg

SEQ ID NO: 8562077 - DNA, 22 bp, Homo sapiens
gcagtgttaaacaactgctgct

SEQ ID NO: 8562078 - DNA, 22 bp, Homo sapiens
gcagtgttaccttgggctggtt

SEQ ID NO: 8562079 - DNA, 22 bp, Homo sapiens
gcagtgttacttggagtactaa

SEQ ID NO: 8562080 - DNA, 22 bp, Homo sapiens
gccaagaaggtggggacatgca

SEQ ID NO: 8562081 - DNA, 22 bp, Homo sapiens
gccaagagaatgtgagagaaat

SEQ ID NO: 8562082 - DNA, 22 bp, Homo sapiens
gccacagggcagatgcgcagag

SEQ ID NO: 8562083 - DNA, 22 bp, Homo sapiens
gccacagggcgagcggaggcca

SEQ ID NO: 8562084 - DNA, 22 bp, Homo sapiens
gccacagggcgagcggaggcca

SEQ ID NO: 8562085 - DNA, 22 bp, Homo sapiens
gccacagggcagatgcgcagag

SEQ ID NO: 8562086 - DNA, 22 bp, Homo sapiens
gccacagggcagatgcgcagag

SEQ ID NO: 8562087 - DNA, 22 bp, Homo sapiens
gccacagggcagatgcgcagag

SEQ ID NO: 8562088 - DNA, 22 bp, Homo sapiens
gccacagggattgttttgtgag

SEQ ID NO: 8562089 - DNA, 22 bp, Homo sapiens
gccaaagtcctccagccatgca

SEQ ID NO: 8562090 - DNA, 22 bp, Homo sapiens
gccaaagtacctagccctctgc

SEQ ID NO: 8562091 - DNA, 22 bp, Homo sapiens
gccaaaggattctatggagata

SEQ ID NO: 8562092 - DNA, 17 bp, Homo sapiens
gccaaagggttccaatc

SEQ ID NO: 8562093 - DNA, 20 bp, Homo sapiens
gccaacgcgctggggctgcc

SEQ ID NO: 8562094 - DNA, 22 bp, Homo sapiens
gccaaccattggcttcttgtca

SEQ ID NO: 8562095 - DNA, 22 bp, Homo sapiens
attgtcttctgtcttaggtgat

SEQ ID NO: 8562096 - DNA, 22 bp, Homo sapiens
attgtcttacatactgtggagg

SEQ ID NO: 8562097 - DNA, 22 bp, Homo sapiens
attgtcttagtcagctcggact

SEQ ID NO: 8562098 - DNA, 22 bp, Homo sapiens
attgtcttctggtcttatcttt

SEQ ID NO: 8562099 - DNA, 22 bp, Homo sapiens
attgtctgaatccaaagctctg

SEQ ID NO: 8562100 - DNA, 22 bp, Homo sapiens
attgtctttaacctctgagggg

SEQ ID NO: 8562101 - DNA, 22 bp, Homo sapiens
attgtctttccactgagaagtt

SEQ ID NO: 8562102 - DNA, 22 bp, Homo sapiens
attgtctttaaaaatatacaac

SEQ ID NO: 8562103 - DNA, 20 bp, Homo sapiens
attgtgaatactgcatatgt

SEQ ID NO: 8562104 - DNA, 20 bp, Homo sapiens
attgtgaatactgcatatgt

SEQ ID NO: 8562105 - DNA, 22 bp, Homo sapiens
attgtctttggtgcttccagga

SEQ ID NO: 8562106 - DNA, 22 bp, Homo sapiens
attgtctttccactgagaagtt

SEQ ID NO: 8562107 - DNA, 23 bp, Homo sapiens
gcattctgatggttctctgtgat

SEQ ID NO: 8562108 - DNA, 22 bp, Homo sapiens
gccaaagcagtcttgcctctgc

SEQ ID NO: 8562109 - DNA, 22 bp, Homo sapiens
attgtgcaaatattatctgtag

SEQ ID NO: 8562110 - DNA, 22 bp, Homo sapiens
attgtgcaatgttttacaattt

SEQ ID NO: 8562111 - DNA, 22 bp, Homo sapiens
attgtgaatagtgccgcagtaa

SEQ ID NO: 8562112 - DNA, 22 bp, Homo sapiens
attgtgaatagtgccgcagtaa

SEQ ID NO: 8562113 - DNA, 22 bp, Homo sapiens
attgtgaattgagagtacttct

SEQ ID NO: 8562114 - DNA, 22 bp, Homo sapiens
attgtgaattgagagtacttct

SEQ ID NO: 8562115 - DNA, 23 bp, Homo sapiens
attgtgagattactatcacactg

SEQ ID NO: 8562116 - DNA, 22 bp, Homo sapiens
ccagtcccgcatggtccagaat

SEQ ID NO: 8562117 - DNA, 22 bp, Homo sapiens
ccagtcccgcatggtccagaat

SEQ ID NO: 8562118 - DNA, 22 bp, Homo sapiens
tgaggcagcctgcattaaagag

SEQ ID NO: 8562119 - DNA, 22 bp, Homo sapiens
ccagtcccgcatggtccagaat

SEQ ID NO: 8562120 - DNA, 20 bp, Homo sapiens
ccagtccctgagcaccaggg

SEQ ID NO: 8562121 - DNA, 20 bp, Homo sapiens
ccagtccctgagcaccaggg

SEQ ID NO: 8562122 - DNA, 20 bp, Homo sapiens
ccagtccctgagcaccaggg

SEQ ID NO: 8562123 - DNA, 22 bp, Homo sapiens
ccagtcctagaagaggagtcga

SEQ ID NO: 8562124 - DNA, 22 bp, Homo sapiens
tgaggcagcattcttcaagaca

SEQ ID NO: 8562125 - DNA, 22 bp, Homo sapiens
tgaggcagcaattgtattgtat

SEQ ID NO: 8562126 - DNA, 22 bp, Homo sapiens
ccagtcctggccagtaacatga

SEQ ID NO: 8562127 - DNA, 22 bp, Homo sapiens
ccagtcctgctccctgaccacc

SEQ ID NO: 8562128 - DNA, 22 bp, Homo sapiens
ccagtcctgggagcttgcactg

SEQ ID NO: 8562129 - DNA, 22 bp, Homo sapiens
ccagtcctttgagccagttctg

SEQ ID NO: 8562130 - DNA, 22 bp, Homo sapiens
ccagtcctcagatggtctgtgc

SEQ ID NO: 8562131 - DNA, 22 bp, Homo sapiens
ccagtcctgccaccctgtctat

SEQ ID NO: 8562132 - DNA, 20 bp, Homo sapiens
ccagtctctatcagaaataa

SEQ ID NO: 8562133 - DNA, 23 bp, Homo sapiens
ccagtctctttccaaaatcacat

SEQ ID NO: 8562134 - DNA, 22 bp, Homo sapiens
ccagtctcagttcacgttggta

SEQ ID NO: 8562135 - DNA, 23 bp, Homo sapiens
ccagtctcacgtatacaggattt

SEQ ID NO: 8562136 - DNA, 19 bp, Homo sapiens
ccagtctccttgcagcatc

SEQ ID NO: 8562137 - DNA, 22 bp, Homo sapiens
ccagtctcctaagagcccctga

SEQ ID NO: 8562138 - DNA, 22 bp, Homo sapiens
ccagtgttgaacagtatttgga

SEQ ID NO: 8562139 - DNA, 22 bp, Homo sapiens
ccagtgttctggtgttcatttc

SEQ ID NO: 8562140 - DNA, 22 bp, Homo sapiens
ccagtgttccatggagtgatta

SEQ ID NO: 8562141 - DNA, 22 bp, Homo sapiens
ccagtgttccctcgggttcatg

SEQ ID NO: 8562142 - DNA, 22 bp, Homo sapiens
ccagtgtttaggaataaaatgt

SEQ ID NO: 8562143 - DNA, 22 bp, Homo sapiens
ccagtgttggaggatggcttgc

SEQ ID NO: 8562144 - DNA, 22 bp, Homo sapiens
ccagtgtttacagttgaacaaa

SEQ ID NO: 8562145 - DNA, 22 bp, Homo sapiens
ccagtgttgcataggatgggga

SEQ ID NO: 8562146 - DNA, 22 bp, Homo sapiens
tgagggctgcttccagagctag

SEQ ID NO: 8562147 - DNA, 22 bp, Homo sapiens
tgagggctgcttccagagctag

SEQ ID NO: 8562148 - DNA, 22 bp, Homo sapiens
tgagggctaaattgtggcaggt

SEQ ID NO: 8562149 - DNA, 22 bp, Homo sapiens
tgagggcagagcactggggagc

SEQ ID NO: 8562150 - DNA, 22 bp, Homo sapiens
tgagggcagagcactggggagc

SEQ ID NO: 8562151 - DNA, 22 bp, Homo sapiens
tgagggccgaggagctgtgggt

SEQ ID NO: 8562152 - DNA, 22 bp, Homo sapiens
tgaggctgccttgggaagaggg

SEQ ID NO: 8562153 - DNA, 23 bp, Homo sapiens
tgaggctgattgatttttgctca

SEQ ID NO: 8562154 - DNA, 22 bp, Homo sapiens
ccagtctgaggcctggtgaggg

SEQ ID NO: 8562155 - DNA, 23 bp, Homo sapiens
tgaggctgattgatttttgctca

SEQ ID NO: 8562156 - DNA, 22 bp, Homo sapiens
tgagggcaaagtggtgctgagg

SEQ ID NO: 8562157 - DNA, 22 bp, Homo sapiens
tgagggcaaagtggtgctgagg

SEQ ID NO: 8562158 - DNA, 22 bp, Homo sapiens
tgaggtatggtaaggtaaaatc

SEQ ID NO: 8562159 - DNA, 22 bp, Homo sapiens
tgaggtaggtgtcgagagaggt

SEQ ID NO: 8562160 - DNA, 22 bp, Homo sapiens
ccatggaactcagtaaattata

SEQ ID NO: 8562161 - DNA, 22 bp, Homo sapiens
tgaggtagtttgttgtacagta

SEQ ID NO: 8562162 - DNA, 22 bp, Homo sapiens
ccatgctgaccctgtgcaggca

SEQ ID NO: 8562163 - DNA, 22 bp, Homo sapiens
ccatgctaggaactctcaggga

SEQ ID NO: 8562164 - DNA, 22 bp, Homo sapiens
ccatgctccttaccactcactt

SEQ ID NO: 8562165 - DNA, 22 bp, Homo sapiens
ccatgctctggggaggtcaagc

SEQ ID NO: 8562166 - DNA, 22 bp, Homo sapiens
ccatgctggagtccctagctgt

SEQ ID NO: 8562167 - DNA, 22 bp, Homo sapiens
ccatgctgtgacacagtagtta

SEQ ID NO: 8562168 - DNA, 22 bp, Homo sapiens
ccatgctgtgacacagtagtta

SEQ ID NO: 8562169 - DNA, 22 bp, Homo sapiens
ccatgcctcgggaagagtctgt

SEQ ID NO: 8562170 - DNA, 22 bp, Homo sapiens
ccatgccctaaaggactggcag

SEQ ID NO: 8562171 - DNA, 19 bp, Homo sapiens
ccatgccatcattttaaag

SEQ ID NO: 8562172 - DNA, 22 bp, Homo sapiens
ccatgccccaccaggacgctgc

SEQ ID NO: 8562173 - DNA, 22 bp, Homo sapiens
ccatgccccaccaggacgctgc

SEQ ID NO: 8562174 - DNA, 22 bp, Homo sapiens
ccatgcatggcactggactggg

SEQ ID NO: 8562175 - DNA, 22 bp, Homo sapiens
ccatgcatgcctgaaattgctg

SEQ ID NO: 8562176 - DNA, 22 bp, Homo sapiens
ccatgcatataatagtgcctgg

SEQ ID NO: 8562177 - DNA, 22 bp, Homo sapiens
ccagtgtttccgtcagtacacg

SEQ ID NO: 8562178 - DNA, 22 bp, Homo sapiens
ccagtgtttccccagaagagag

SEQ ID NO: 8562179 - DNA, 22 bp, Homo sapiens
ccagtgtttgatgggattttca

SEQ ID NO: 8562180 - DNA, 22 bp, Homo sapiens
ccagtgttttcatcctcccttg

SEQ ID NO: 8562181 - DNA, 22 bp, Homo sapiens
ccatcctgcattgctattcaga

SEQ ID NO: 8562182 - DNA, 22 bp, Homo sapiens
ccatgcagtgctggagctgatt

SEQ ID NO: 8562183 - DNA, 22 bp, Homo sapiens
ccatcctggccttgctgtccac

SEQ ID NO: 8562184 - DNA, 22 bp, Homo sapiens
ccatcctggccttgctgtccac

SEQ ID NO: 8562185 - DNA, 22 bp, Homo sapiens
ccatcctggcctcgctgtccac

SEQ ID NO: 8562186 - DNA, 22 bp, Homo sapiens
ccatcctggcctcgctgtccac

SEQ ID NO: 8562187 - DNA, 22 bp, Homo sapiens
ccatcctgcattgctattcaga

SEQ ID NO: 8562188 - DNA, 22 bp, Homo sapiens
tgcaaataaatttctgttcatt

SEQ ID NO: 8562189 - DNA, 23 bp, Homo sapiens
tgcaaataacaaggagtttaagg

SEQ ID NO: 8562190 - DNA, 22 bp, Homo sapiens
tgcaaatacaaaatggtacagc

SEQ ID NO: 8562191 - DNA, 22 bp, Homo sapiens
tgcaaagccacaatgaaatcag

SEQ ID NO: 8562192 - DNA, 22 bp, Homo sapiens
tgcaaagcaatgtaggtcagct

SEQ ID NO: 8562193 - DNA, 22 bp, Homo sapiens
cccacccctggacaggtgagtg

SEQ ID NO: 8562194 - DNA, 22 bp, Homo sapiens
cccacccctggacaggtgagtg

SEQ ID NO: 8562195 - DNA, 22 bp, Homo sapiens
tgcaaatagcctatatttatag

SEQ ID NO: 8562196 - DNA, 22 bp, Homo sapiens
tgcaaatagcctgatgaaagaa

SEQ ID NO: 8562197 - DNA, 22 bp, Homo sapiens
tgcaaatagcctgatgaaagaa

SEQ ID NO: 8562198 - DNA, 22 bp, Homo sapiens
cccacttcatgggcaggaagga

SEQ ID NO: 8562199 - DNA, 22 bp, Homo sapiens
cccacttcatgggcaggaagga

SEQ ID NO: 8562200 - DNA, 22 bp, Homo sapiens
cccactttggttgcactctgcc

SEQ ID NO: 8562201 - DNA, 20 bp, Homo sapiens
cccagaagcttaacagagca

SEQ ID NO: 8562202 - DNA, 22 bp, Homo sapiens
tgcacagaataatatatgttct

SEQ ID NO: 8562203 - DNA, 22 bp, Homo sapiens
tgcacagacaactctttctaga

SEQ ID NO: 8562204 - DNA, 22 bp, Homo sapiens
tgcacagaatcattttcagctg

SEQ ID NO: 8562205 - DNA, 22 bp, Homo sapiens
tgcacacattaaggatacacag

SEQ ID NO: 8562206 - DNA, 22 bp, Homo sapiens
cccagactcatccctgggagct

SEQ ID NO: 8562207 - DNA, 22 bp, Homo sapiens
cccagactcctctggctggtgg

SEQ ID NO: 8562208 - DNA, 22 bp, Homo sapiens
cccagactcatccctgggagct

SEQ ID NO: 8562209 - DNA, 22 bp, Homo sapiens
tgcacacatgtatgtatatgtg

SEQ ID NO: 8562210 - DNA, 22 bp, Homo sapiens
tgcacacatgtttacaagcatc

SEQ ID NO: 8562211 - DNA, 22 bp, Homo sapiens
cccagaaggtcgaggctgcagt

SEQ ID NO: 8562212 - DNA, 22 bp, Homo sapiens
cccagaaggtcgaggctgcagt

SEQ ID NO: 8562213 - DNA, 22 bp, Homo sapiens
cccagaatgattcagcgacagt

SEQ ID NO: 8562214 - DNA, 22 bp, Homo sapiens
cccagacataacagcagagagg

SEQ ID NO: 8562215 - DNA, 22 bp, Homo sapiens
cccagacataacagcagagagg

SEQ ID NO: 8562216 - DNA, 22 bp, Homo sapiens
tgattcaagccaccacatactg

SEQ ID NO: 8562217 - DNA, 22 bp, Homo sapiens
tgattcaagctactgttactgg

SEQ ID NO: 8562218 - DNA, 22 bp, Homo sapiens
ccattgtaaagagtatactttg

SEQ ID NO: 8562219 - DNA, 22 bp, Homo sapiens
ccattgtaaattctgtggaagt

SEQ ID NO: 8562220 - DNA, 22 bp, Homo sapiens
tgattcaagattggttagctgt

SEQ ID NO: 8562221 - DNA, 22 bp, Homo sapiens
tgattcaagccaccacatactg

SEQ ID NO: 8562222 - DNA, 22 bp, Homo sapiens
tgattcaagagagttggggtat

SEQ ID NO: 8562223 - DNA, 22 bp, Homo sapiens
ccattgtaaattctgtggaagt

SEQ ID NO: 8562224 - DNA, 20 bp, Homo sapiens
tgatttctcttctattcctt

SEQ ID NO: 8562225 - DNA, 22 bp, Homo sapiens
tgatttgaggtacataaatcca

SEQ ID NO: 8562226 - DNA, 23 bp, Homo sapiens
tgattttaaaaagtaagttatca

SEQ ID NO: 8562227 - DNA, 23 bp, Homo sapiens
tgattttaaaaagtaagttatca

SEQ ID NO: 8562228 - DNA, 22 bp, Homo sapiens
tgattttacttagcatgatgtt

SEQ ID NO: 8562229 - DNA, 23 bp, Homo sapiens
tgattttaaaaagtaagttatca

SEQ ID NO: 8562230 - DNA, 22 bp, Homo sapiens
tgattttattggtgaggaaatt

SEQ ID NO: 8562231 - DNA, 22 bp, Homo sapiens
tgattttacttagcatgatgtt

SEQ ID NO: 8562232 - DNA, 23 bp, Homo sapiens
ccattcatctcagtcattgcttt

SEQ ID NO: 8562233 - DNA, 20 bp, Homo sapiens
ccattctgggtgcagtctgg

SEQ ID NO: 8562234 - DNA, 22 bp, Homo sapiens
ccattgcactccatcctgggca

SEQ ID NO: 8562235 - DNA, 22 bp, Homo sapiens
ccattgaaggcacttgagcaga

SEQ ID NO: 8562236 - DNA, 22 bp, Homo sapiens
ccattgaatcctcagctgctag

SEQ ID NO: 8562237 - DNA, 22 bp, Homo sapiens
ccattgaattagaaggggaagg

SEQ ID NO: 8562238 - DNA, 21 bp, Homo sapiens
ccattcttagtcaagtgtctc

SEQ ID NO: 8562239 - DNA, 22 bp, Homo sapiens
ccattctttcagtgtctcatgt

SEQ ID NO: 8562240 - DNA, 22 bp, Homo sapiens
ccattgaacccctctaggccac

SEQ ID NO: 8562241 - DNA, 22 bp, Homo sapiens
ccattaaaatggaatgtagtga

SEQ ID NO: 8562242 - DNA, 22 bp, Homo sapiens
ccattaaaattgtgacatagga

SEQ ID NO: 8562243 - DNA, 22 bp, Homo sapiens
ccattaaacttgtggacccagt

SEQ ID NO: 8562244 - DNA, 22 bp, Homo sapiens
ccattaaacttgtggacccagt

SEQ ID NO: 8562245 - DNA, 22 bp, Homo sapiens
ccattactttccaatatatcag

SEQ ID NO: 8562246 - DNA, 22 bp, Homo sapiens
ccattacttagaaaggaactga

SEQ ID NO: 8562247 - DNA, 22 bp, Homo sapiens
ccattaaagcaccactgtaata

SEQ ID NO: 8562248 - DNA, 22 bp, Homo sapiens
ccattactgaaataaagagaat

SEQ ID NO: 8562249 - DNA, 22 bp, Homo sapiens
ccattaaagcaccactgtaata

SEQ ID NO: 8562250 - DNA, 22 bp, Homo sapiens
ccattatccattttgagtctta

SEQ ID NO: 8562251 - DNA, 22 bp, Homo sapiens
ccattatccacgggcttcctga

SEQ ID NO: 8562252 - DNA, 22 bp, Homo sapiens
ccattcatagcaagctacatct

SEQ ID NO: 8562253 - DNA, 23 bp, Homo sapiens
ccattcatctcagtcattgcttt

SEQ ID NO: 8562254 - DNA, 22 bp, Homo sapiens
tgagacagttctgcagctgggt

SEQ ID NO: 8562255 - DNA, 22 bp, Homo sapiens
tgagacagttggtgaaatctaa

SEQ ID NO: 8562256 - DNA, 22 bp, Homo sapiens
tgagacagtttttctatttcca

SEQ ID NO: 8562257 - DNA, 22 bp, Homo sapiens
tgagacagtttttctatttcca

SEQ ID NO: 8562258 - DNA, 22 bp, Homo sapiens
ccaggtggacggcgagtacagg

SEQ ID NO: 8562259 - DNA, 22 bp, Homo sapiens
tgagacagttctgcagctgggt

SEQ ID NO: 8562260 - DNA, 22 bp, Homo sapiens
tgagacagttctgcagctgggt

SEQ ID NO: 8562261 - DNA, 22 bp, Homo sapiens
tgagacagttctgcagctgggt

SEQ ID NO: 8562262 - DNA, 22 bp, Homo sapiens
tgagacagttctgcagctgggt

SEQ ID NO: 8562263 - DNA, 22 bp, Homo sapiens
tgagacctgcctctgcactagg

SEQ ID NO: 8562264 - DNA, 23 bp, Homo sapiens
tgagaccctaatttagcaagtgt

SEQ ID NO: 8562265 - DNA, 22 bp, Homo sapiens
tgagacctgtaatgagaaattg

SEQ ID NO: 8562266 - DNA, 22 bp, Homo sapiens
tgagacctgtagcttcacagag

SEQ ID NO: 8562267 - DNA, 22 bp, Homo sapiens
tgagacgaagtcttgctctgtt

SEQ ID NO: 8562268 - DNA, 22 bp, Homo sapiens
tgagaccatttgacatacagtg

SEQ ID NO: 8562269 - DNA, 20 bp, Homo sapiens
tgagacccgctgacaagttc

SEQ ID NO: 8562270 - DNA, 22 bp, Homo sapiens
tgagacgaagtcttgctctgtt

SEQ ID NO: 8562271 - DNA, 22 bp, Homo sapiens
tgagacgaagtcttgctctgtt

SEQ ID NO: 8562272 - DNA, 22 bp, Homo sapiens
tgagaccttggggagccctgtt

SEQ ID NO: 8562273 - DNA, 17 bp, Homo sapiens
ccaggtgggaggtgggg

SEQ ID NO: 8562274 - DNA, 22 bp, Homo sapiens
ccaggtgggcgtgtcttcacct

SEQ ID NO: 8562275 - DNA, 22 bp, Homo sapiens
ccaggtgtgatttggcagtgtc

SEQ ID NO: 8562276 - DNA, 22 bp, Homo sapiens
ccaggtgtgccagcagggactg

SEQ ID NO: 8562277 - DNA, 23 bp, Homo sapiens
tgaggacctctcaggggccaggc

SEQ ID NO: 8562278 - DNA, 22 bp, Homo sapiens
tgaggactttccatgttaatgt

SEQ ID NO: 8562279 - DNA, 22 bp, Homo sapiens
tgaggcagaaaatagcagttca

SEQ ID NO: 8562280 - DNA, 22 bp, Homo sapiens
tgaggcagaaattcctgttttc

SEQ ID NO: 8562281 - DNA, 22 bp, Homo sapiens
tgaggcagcaattgtattgtat

SEQ ID NO: 8562282 - DNA, 22 bp, Homo sapiens
tgaggcagcaattgattattca

SEQ ID NO: 8562283 - DNA, 22 bp, Homo sapiens
tgaggcagatatttattgggtt

SEQ ID NO: 8562284 - DNA, 22 bp, Homo sapiens
tgaggcagatatttattgggtt

SEQ ID NO: 8562285 - DNA, 22 bp, Homo sapiens
tgaggcagagtaagatacatga

SEQ ID NO: 8562286 - DNA, 22 bp, Homo sapiens
ccaggtggaaggtctgtgctct

SEQ ID NO: 8562287 - DNA, 22 bp, Homo sapiens
ccaggtggaaggtctgtgctct

SEQ ID NO: 8562288 - DNA, 22 bp, Homo sapiens
ccaggtggaaggtctgtgctct

SEQ ID NO: 8562289 - DNA, 22 bp, Homo sapiens
ccaggtggaaggtctgtgctct

SEQ ID NO: 8562290 - DNA, 22 bp, Homo sapiens
ccaggtggaaggtctgtgctct

SEQ ID NO: 8562291 - DNA, 22 bp, Homo sapiens
ccaggtggacaaggctttcaca

SEQ ID NO: 8562292 - DNA, 17 bp, Homo sapiens
ccaggtggaatcgtgga

SEQ ID NO: 8562293 - DNA, 22 bp, Homo sapiens
ccaggtgctcttgccagggctg

SEQ ID NO: 8562294 - DNA, 22 bp, Homo sapiens
ccaggtgctgaccggtcagatt

SEQ ID NO: 8562295 - DNA, 19 bp, Homo sapiens
ccaggtggaactgaggtag

SEQ ID NO: 8562296 - DNA, 19 bp, Homo sapiens
ccaggtggaactgaggtag

SEQ ID NO: 8562297 - DNA, 19 bp, Homo sapiens
ccaggtggaactgaggtag

SEQ ID NO: 8562298 - DNA, 22 bp, Homo sapiens
ccaggtctcgggtctgctcgtg

SEQ ID NO: 8562299 - DNA, 22 bp, Homo sapiens
ccaggtgctagcaatcactgtc

SEQ ID NO: 8562300 - DNA, 17 bp, Homo sapiens
ccaggtctccttgcttt

SEQ ID NO: 8562301 - DNA, 21 bp, Homo sapiens
ccagggtccagctgccatggt

SEQ ID NO: 8562302 - DNA, 21 bp, Homo sapiens
ccagggtccagctgccatggt

SEQ ID NO: 8562303 - DNA, 22 bp, Homo sapiens
ccagggtcacaaataactgcag

SEQ ID NO: 8562304 - DNA, 22 bp, Homo sapiens
ccaggggctggtgctgagctgg

SEQ ID NO: 8562305 - DNA, 22 bp, Homo sapiens
ccaggggctggtgctgagctgg

SEQ ID NO: 8562306 - DNA, 22 bp, Homo sapiens
ccagggggcttggtgaggccat

SEQ ID NO: 8562307 - DNA, 22 bp, Homo sapiens
ccagggggcttggtgaggccat

SEQ ID NO: 8562308 - DNA, 22 bp, Homo sapiens
ccaggggggcgtagatgctggg

SEQ ID NO: 8562309 - DNA, 22 bp, Homo sapiens
ccaggggggcgtagatgctggg

SEQ ID NO: 8562310 - DNA, 19 bp, Homo sapiens
tgagaaggcagtggggagc

SEQ ID NO: 8562311 - DNA, 20 bp, Homo sapiens
tgagaaggggtcagctgtac

SEQ ID NO: 8562312 - DNA, 20 bp, Homo sapiens
tgagaaggggtcagctgtac

SEQ ID NO: 8562313 - DNA, 22 bp, Homo sapiens
tgagaagtactacaagagaggg

SEQ ID NO: 8562314 - DNA, 17 bp, Homo sapiens
tgagaagtaggcatcat

SEQ ID NO: 8562315 - DNA, 17 bp, Homo sapiens
tgagaagtaggcatcat

SEQ ID NO: 8562316 - DNA, 22 bp, Homo sapiens
tgagaatgaatcttttgctttc

SEQ ID NO: 8562317 - DNA, 22 bp, Homo sapiens
tgagaatgagggggtagaaggt

SEQ ID NO: 8562318 - DNA, 22 bp, Homo sapiens
tgagaatatttgaagatgttag

SEQ ID NO: 8562319 - DNA, 22 bp, Homo sapiens
tgagaatcagctgcacagaggt

SEQ ID NO: 8562320 - DNA, 22 bp, Homo sapiens
tgagaatagcagactggtaact

SEQ ID NO: 8562321 - DNA, 22 bp, Homo sapiens
tgagaatattgttttagtgagg

SEQ ID NO: 8562322 - DNA, 22 bp, Homo sapiens
tgagaatagcagactggtaact

SEQ ID NO: 8562323 - DNA, 22 bp, Homo sapiens
ccaggggctctcagggtgtgtg

SEQ ID NO: 8562324 - DNA, 22 bp, Homo sapiens
ccaggggcctgtgaaggtgccc

SEQ ID NO: 8562325 - DNA, 22 bp, Homo sapiens
ccaggggctctcagggtgtgtg

SEQ ID NO: 8562326 - DNA, 22 bp, Homo sapiens
ccaggggctggtgctgagctgg

SEQ ID NO: 8562327 - DNA, 22 bp, Homo sapiens
ccaggggctggtgctgagctgg

SEQ ID NO: 8562328 - DNA, 22 bp, Homo sapiens
ccaggggctggtgctgagctgg

SEQ ID NO: 8562329 - DNA, 22 bp, Homo sapiens
ccaggggctgcagatccatggt

SEQ ID NO: 8562330 - DNA, 22 bp, Homo sapiens
ccaggggctgcagatccatggt

SEQ ID NO: 8562331 - DNA, 22 bp, Homo sapiens
tgacaagtacataatttcatgt

SEQ ID NO: 8562332 - DNA, 22 bp, Homo sapiens
tgacaagtacataatttcatgt

SEQ ID NO: 8562333 - DNA, 22 bp, Homo sapiens
tgacaagtcactgttcttcaat

SEQ ID NO: 8562334 - DNA, 22 bp, Homo sapiens
ccagggctgctgtgggactcca

SEQ ID NO: 8562335 - DNA, 22 bp, Homo sapiens
tgacaatggggcacatggaaag

SEQ ID NO: 8562336 - DNA, 22 bp, Homo sapiens
ccagggcttcagaggttttggc

SEQ ID NO: 8562337 - DNA, 22 bp, Homo sapiens
tgacaatgacatggacagtgat

SEQ ID NO: 8562338 - DNA, 17 bp, Homo sapiens
tgacaatgacaagcact

SEQ ID NO: 8562339 - DNA, 22 bp, Homo sapiens
tgacaatgaggccctccacaaa

SEQ ID NO: 8562340 - DNA, 22 bp, Homo sapiens
tgacaatgattaggtagcttct

SEQ ID NO: 8562341 - DNA, 22 bp, Homo sapiens
tgacaatggatattagttgtgg

SEQ ID NO: 8562342 - DNA, 22 bp, Homo sapiens
ccagggcttcccacgtgccctg

SEQ ID NO: 8562343 - DNA, 22 bp, Homo sapiens
ccagggcttcagttagtggtga

SEQ ID NO: 8562344 - DNA, 22 bp, Homo sapiens
ccagggcttcccacgtgccctg

SEQ ID NO: 8562345 - DNA, 22 bp, Homo sapiens
ccagggcttcccacgtgccctg

SEQ ID NO: 8562346 - DNA, 22 bp, Homo sapiens
ccagggctttatctgcctttga

SEQ ID NO: 8562347 - DNA, 22 bp, Homo sapiens
ccaggggaaacagggagcactc

SEQ ID NO: 8562348 - DNA, 22 bp, Homo sapiens
ccaggggaaacagggagcactc

SEQ ID NO: 8562349 - DNA, 22 bp, Homo sapiens
ccaggggaaacagggagcactc

SEQ ID NO: 8562350 - DNA, 21 bp, Homo sapiens
ccaggggcaaattgtcgtttc

SEQ ID NO: 8562351 - DNA, 22 bp, Homo sapiens
ccaggggcctgtgaaggtgccc

SEQ ID NO: 8562352 - DNA, 22 bp, Homo sapiens
tgacagtgcgggtacatcatag

SEQ ID NO: 8562353 - DNA, 22 bp, Homo sapiens
tgacagtgtttgcacttcaggt

SEQ ID NO: 8562354 - DNA, 23 bp, Homo sapiens
tgacagtgtatttgactatatgg

SEQ ID NO: 8562355 - DNA, 22 bp, Homo sapiens
tgacagttaaggtatacattca

SEQ ID NO: 8562356 - DNA, 22 bp, Homo sapiens
tgacataaaccagtgagcaaaa

SEQ ID NO: 8562357 - DNA, 22 bp, Homo sapiens
tgacataaaccagtgagcaaaa

SEQ ID NO: 8562358 - DNA, 22 bp, Homo sapiens
tgacataaatctaaaggaaagg

SEQ ID NO: 8562359 - DNA, 20 bp, Homo sapiens
tgacatagctcttggggtgc

SEQ ID NO: 8562360 - DNA, 22 bp, Homo sapiens
tgacataagttggtagaaagga

SEQ ID NO: 8562361 - DNA, 22 bp, Homo sapiens
tgacataatgctttgaagttgc

SEQ ID NO: 8562362 - DNA, 22 bp, Homo sapiens
tgacataatgctttgaagttgc

SEQ ID NO: 8562363 - DNA, 22 bp, Homo sapiens
tgacataataatccaaacatac

SEQ ID NO: 8562364 - DNA, 22 bp, Homo sapiens
tgacataataatccaaacatac

SEQ ID NO: 8562365 - DNA, 22 bp, Homo sapiens
tgagaaggaaacaatggctttt

SEQ ID NO: 8562366 - DNA, 22 bp, Homo sapiens
tgagaaaagtacatggagaagc

SEQ ID NO: 8562367 - DNA, 22 bp, Homo sapiens
tgagaaaagtacatggagaagc

SEQ ID NO: 8562368 - DNA, 22 bp, Homo sapiens
tgagaaaaggttgagatgataa

SEQ ID NO: 8562369 - DNA, 22 bp, Homo sapiens
tgagaaaaggttgagatgataa

SEQ ID NO: 8562370 - DNA, 22 bp, Homo sapiens
tgacatctagtaggtagagacc

SEQ ID NO: 8562371 - DNA, 20 bp, Homo sapiens
ccaggctggcaaatgggggc

SEQ ID NO: 8562372 - DNA, 22 bp, Homo sapiens
ccaggctggattttgcagttca

SEQ ID NO: 8562373 - DNA, 22 bp, Homo sapiens
ccaggctggattttgcagttca

SEQ ID NO: 8562374 - DNA, 22 bp, Homo sapiens
ccaggctggagtgtagtcgcat

SEQ ID NO: 8562375 - DNA, 22 bp, Homo sapiens
ccaggctggagtgtagtcgcat

SEQ ID NO: 8562376 - DNA, 22 bp, Homo sapiens
ccaggctggattttgcagttca

SEQ ID NO: 8562377 - DNA, 22 bp, Homo sapiens
ccaggctggagtgcaatggtgc

SEQ ID NO: 8562378 - DNA, 22 bp, Homo sapiens
ccaggctggagtgcagtagtgt

SEQ ID NO: 8562379 - DNA, 22 bp, Homo sapiens
ccaggctggagtgcaatggtgc

SEQ ID NO: 8562380 - DNA, 22 bp, Homo sapiens
ccaggctggagtgcaatggtgc

SEQ ID NO: 8562381 - DNA, 22 bp, Homo sapiens
ccaggctggagtgcaatggtgc

SEQ ID NO: 8562382 - DNA, 22 bp, Homo sapiens
ccaggctggagtgcagtggcac

SEQ ID NO: 8562383 - DNA, 22 bp, Homo sapiens
ccaggctggagtgcagtggcac

SEQ ID NO: 8562384 - DNA, 22 bp, Homo sapiens
ccaggctggagtgcagtggcac

SEQ ID NO: 8562385 - DNA, 22 bp, Homo sapiens
ccaggctggagtgcagtagtgt

SEQ ID NO: 8562386 - DNA, 22 bp, Homo sapiens
ccaggctggagtgcagtggcac

SEQ ID NO: 8562387 - DNA, 22 bp, Homo sapiens
ccaggctggagtgcagtggcac

SEQ ID NO: 8562388 - DNA, 23 bp, Homo sapiens
tgacaacagctctcagccatgtc

SEQ ID NO: 8562389 - DNA, 23 bp, Homo sapiens
tgacaacagctctcagccatgtc

SEQ ID NO: 8562390 - DNA, 23 bp, Homo sapiens
tgacaacagctctcagccatgtc

SEQ ID NO: 8562391 - DNA, 22 bp, Homo sapiens
tgacaacatcatttttgtgtgg

SEQ ID NO: 8562392 - DNA, 20 bp, Homo sapiens
tgacaacatgccttttgctt

SEQ ID NO: 8562393 - DNA, 22 bp, Homo sapiens
tgacaacattgagttatgtgca

SEQ ID NO: 8562394 - DNA, 21 bp, Homo sapiens
tgacaacagaactgggcaagc

SEQ ID NO: 8562395 - DNA, 22 bp, Homo sapiens
tgacaacagccatcacttttag

SEQ ID NO: 8562396 - DNA, 23 bp, Homo sapiens
tgacaacagctctcagccatgtc

SEQ ID NO: 8562397 - DNA, 22 bp, Homo sapiens
tgacaacagccatcacttttag

SEQ ID NO: 8562398 - DNA, 22 bp, Homo sapiens
tgaatgcaagaaggaacatgaa

SEQ ID NO: 8562399 - DNA, 22 bp, Homo sapiens
tgaatgcactgctctcctagga

SEQ ID NO: 8562400 - DNA, 21 bp, Homo sapiens
tgaatgcttcgtcatcctggc

SEQ ID NO: 8562401 - DNA, 20 bp, Homo sapiens
tgacaacaaaatggtaattt

SEQ ID NO: 8562402 - DNA, 22 bp, Homo sapiens
tgacaacaaggatcctgcctgg

SEQ ID NO: 8562403 - DNA, 22 bp, Homo sapiens
tgaatgcagagactgtgggaaa

SEQ ID NO: 8562404 - DNA, 22 bp, Homo sapiens
tgaatgcactgctctcctagga

SEQ ID NO: 8562405 - DNA, 22 bp, Homo sapiens
tgaatgatttgggtgcattcag

SEQ ID NO: 8562406 - DNA, 22 bp, Homo sapiens
tgaatgatttcttaggcaattg

SEQ ID NO: 8562407 - DNA, 23 bp, Homo sapiens
tgaatgattgtactgagctttta

SEQ ID NO: 8562408 - DNA, 22 bp, Homo sapiens
tgaatgattaaaacccggacta

SEQ ID NO: 8562409 - DNA, 22 bp, Homo sapiens
tgaatgatggtgtgttcttgcc

SEQ ID NO: 8562410 - DNA, 22 bp, Homo sapiens
tgaatgatggtgtgttcttgcc

SEQ ID NO: 8562411 - DNA, 22 bp, Homo sapiens
tgaatgatgtataatattgaga

SEQ ID NO: 8562412 - DNA, 22 bp, Homo sapiens
tgaatgatgaggggagaataat

SEQ ID NO: 8562413 - DNA, 21 bp, Homo sapiens
tgaatgatctggttgcctttt

SEQ ID NO: 8562414 - DNA, 22 bp, Homo sapiens
tgaatgatgcatttgtttccca

SEQ ID NO: 8562415 - DNA, 22 bp, Homo sapiens
tgaatgatgcagtataatgata

SEQ ID NO: 8562416 - DNA, 23 bp, Homo sapiens
tgaatgatggtgctcctcatctt

SEQ ID NO: 8562417 - DNA, 21 bp, Homo sapiens
tgaatgatgccccagagttgt

SEQ ID NO: 8562418 - DNA, 22 bp, Homo sapiens
tgaagttgttaaggttgccatt

SEQ ID NO: 8562419 - DNA, 22 bp, Homo sapiens
tgaagttgttaaggttgccatt

SEQ ID NO: 8562420 - DNA, 22 bp, Homo sapiens
tgaagttgttaaggttgccatt

SEQ ID NO: 8562421 - DNA, 22 bp, Homo sapiens
tgaatgagtttggctgctgttc

SEQ ID NO: 8562422 - DNA, 22 bp, Homo sapiens
tgaatgatctagttttgtagac

SEQ ID NO: 8562423 - DNA, 22 bp, Homo sapiens
tgaatgatctccgattagtcct

SEQ ID NO: 8562424 - DNA, 22 bp, Homo sapiens
tgaatgatatgtgaaaaggaac

SEQ ID NO: 8562425 - DNA, 22 bp, Homo sapiens
tgaatgatatattgggaataat

SEQ ID NO: 8562426 - DNA, 22 bp, Homo sapiens
tgaatgatacagaattatgtag

SEQ ID NO: 8562427 - DNA, 22 bp, Homo sapiens
ccagctgctgtgcagggaggct

SEQ ID NO: 8562428 - DNA, 22 bp, Homo sapiens
ccagctgctgtgcagggaggct

SEQ ID NO: 8562429 - DNA, 22 bp, Homo sapiens
tctggcagcagcatcagtggct

SEQ ID NO: 8562430 - DNA, 22 bp, Homo sapiens
ccagctgctgtgaggaccacag

SEQ ID NO: 8562431 - DNA, 22 bp, Homo sapiens
ccagctgctgtgaggaccacag

SEQ ID NO: 8562432 - DNA, 22 bp, Homo sapiens
ccagctgctgtgaggaccacag

SEQ ID NO: 8562433 - DNA, 22 bp, Homo sapiens
ccagctgctgtgaggaccacag

SEQ ID NO: 8562434 - DNA, 22 bp, Homo sapiens
ccagctgctgacatgggcaggt

SEQ ID NO: 8562435 - DNA, 22 bp, Homo sapiens
ccagctgctgacatgggcaggt

SEQ ID NO: 8562436 - DNA, 22 bp, Homo sapiens
ccagctgctgacatgggcaggt

SEQ ID NO: 8562437 - DNA, 22 bp, Homo sapiens
ccagctgctctcttctccgcca

SEQ ID NO: 8562438 - DNA, 22 bp, Homo sapiens
ccagctgcccaagaggcatcct

SEQ ID NO: 8562439 - DNA, 22 bp, Homo sapiens
ccagctgcccaagaggcatcct

SEQ ID NO: 8562440 - DNA, 22 bp, Homo sapiens
ccagctgcccaagaggcatcct

SEQ ID NO: 8562441 - DNA, 22 bp, Homo sapiens
ccagctgcccactatgtgttct

SEQ ID NO: 8562442 - DNA, 18 bp, Homo sapiens
ccagctgcgctgaaccga

SEQ ID NO: 8562443 - DNA, 22 bp, Homo sapiens
ccagctgcctaagcaatccata

SEQ ID NO: 8562444 - DNA, 21 bp, Homo sapiens
ccagctgcctgcactttggac

SEQ ID NO: 8562445 - DNA, 22 bp, Homo sapiens
ccagctgcgggcatcgagagtt

SEQ ID NO: 8562446 - DNA, 22 bp, Homo sapiens
ccagctgcgggcatcgagagtt

SEQ ID NO: 8562447 - DNA, 21 bp, Homo sapiens
ccagctgctccttgaggttcc

SEQ ID NO: 8562448 - DNA, 17 bp, Homo sapiens
ccagctgctccctcaga

SEQ ID NO: 8562449 - DNA, 22 bp, Homo sapiens
ccagctgcgggcatcgagagtt

SEQ ID NO: 8562450 - DNA, 22 bp, Homo sapiens
ccagctgctatcatgccatttc

SEQ ID NO: 8562451 - DNA, 22 bp, Homo sapiens
ccagctgattcggtggtggttg

SEQ ID NO: 8562452 - DNA, 22 bp, Homo sapiens
ccagctgcaggggagcagtgga

SEQ ID NO: 8562453 - DNA, 22 bp, Homo sapiens
ccagctgcaggggagcagtgga

SEQ ID NO: 8562454 - DNA, 22 bp, Homo sapiens
ccagctgaggcagccacacagg

SEQ ID NO: 8562455 - DNA, 22 bp, Homo sapiens
ccagctgaggcagccacacagg

SEQ ID NO: 8562456 - DNA, 20 bp, Homo sapiens
ccagctgagccaaggggaga

SEQ ID NO: 8562457 - DNA, 22 bp, Homo sapiens
ccagctctgccaagcgtcagct

SEQ ID NO: 8562458 - DNA, 22 bp, Homo sapiens
ccagctctgccaagcgtcagct

SEQ ID NO: 8562459 - DNA, 22 bp, Homo sapiens
ccagctgcaggtgttccagatg

SEQ ID NO: 8562460 - DNA, 22 bp, Homo sapiens
ccagctgcatcctattcactgc

SEQ ID NO: 8562461 - DNA, 22 bp, Homo sapiens
ccagctctctgtcctccccaca

SEQ ID NO: 8562462 - DNA, 22 bp, Homo sapiens
ccagctctctgtcctccccaca

SEQ ID NO: 8562463 - DNA, 22 bp, Homo sapiens
ccagctctctgcagaaaggact

SEQ ID NO: 8562464 - DNA, 22 bp, Homo sapiens
ccagctctctgtcctccccaca

SEQ ID NO: 8562465 - DNA, 22 bp, Homo sapiens
ccagctctctttgaagcataaa

SEQ ID NO: 8562466 - DNA, 22 bp, Homo sapiens
ccagctctctttgaagcataaa

SEQ ID NO: 8562467 - DNA, 22 bp, Homo sapiens
ccagctctgcagggcctggggt

SEQ ID NO: 8562468 - DNA, 22 bp, Homo sapiens
ccagctctgcagggcctggggt

SEQ ID NO: 8562469 - DNA, 22 bp, Homo sapiens
ccagctctgattttgacctcca

SEQ ID NO: 8562470 - DNA, 22 bp, Homo sapiens
ccagctctgattttgacctcca

SEQ ID NO: 8562471 - DNA, 22 bp, Homo sapiens
ccagctctgcagggcctggggt

SEQ ID NO: 8562472 - DNA, 22 bp, Homo sapiens
ccagctctgcatgtttcccttg

SEQ ID NO: 8562473 - DNA, 22 bp, Homo sapiens
ccagctctgcatgtttcccttg

SEQ ID NO: 8562474 - DNA, 22 bp, Homo sapiens
ccagctctgccaagcgtcagct

SEQ ID NO: 8562475 - DNA, 22 bp, Homo sapiens
ccagctctgccaagcgtcagct

SEQ ID NO: 8562476 - DNA, 22 bp, Homo sapiens
tctcagaagtgatcaggatgtt

SEQ ID NO: 8562477 - DNA, 22 bp, Homo sapiens
tctcagaagtgatcaggatgtt

SEQ ID NO: 8562478 - DNA, 22 bp, Homo sapiens
tctcagaataaattcctaactt

SEQ ID NO: 8562479 - DNA, 22 bp, Homo sapiens
ccagagagagaggtcaatggca

SEQ ID NO: 8562480 - DNA, 22 bp, Homo sapiens
ccagagagaaatggatttgagt

SEQ ID NO: 8562481 - DNA, 22 bp, Homo sapiens
ccagagagagaggtcaatggca

SEQ ID NO: 8562482 - DNA, 22 bp, Homo sapiens
ccagagagagaggtcaatggca

SEQ ID NO: 8562483 - DNA, 22 bp, Homo sapiens
tctcagaagggtggtgctggag

SEQ ID NO: 8562484 - DNA, 22 bp, Homo sapiens
ccagagagagaggtcaatggca

SEQ ID NO: 8562485 - DNA, 22 bp, Homo sapiens
ccagagaccagaacatggggat

SEQ ID NO: 8562486 - DNA, 22 bp, Homo sapiens
ccagagacgtcggtcagggcgc

SEQ ID NO: 8562487 - DNA, 22 bp, Homo sapiens
ccagagacgtcggtcagggcgc

SEQ ID NO: 8562488 - DNA, 22 bp, Homo sapiens
ccagagactggctgagagatct

SEQ ID NO: 8562489 - DNA, 22 bp, Homo sapiens
ccagagagaaaatggagggcca

SEQ ID NO: 8562490 - DNA, 22 bp, Homo sapiens
ccagagagaaaatggagggcca

SEQ ID NO: 8562491 - DNA, 22 bp, Homo sapiens
ccagagagaaaatggagggcca

SEQ ID NO: 8562492 - DNA, 22 bp, Homo sapiens
tctcagaattgtgtccactggg

SEQ ID NO: 8562493 - DNA, 22 bp, Homo sapiens
tctcagaattgtgtccactggg

SEQ ID NO: 8562494 - DNA, 19 bp, Homo sapiens
tctcagaattggcaatcat

SEQ ID NO: 8562495 - DNA, 22 bp, Homo sapiens
tctcagaatcaggacctacttc

SEQ ID NO: 8562496 - DNA, 22 bp, Homo sapiens
tctcagaataaattcctaactt

SEQ ID NO: 8562497 - DNA, 22 bp, Homo sapiens
tctcagaatcaggacctacttc

SEQ ID NO: 8562498 - DNA, 22 bp, Homo sapiens
tctcagaatccttgcccaggtg

SEQ ID NO: 8562499 - DNA, 22 bp, Homo sapiens
tctcagaatccttgcccaggtg

SEQ ID NO: 8562500 - DNA, 19 bp, Homo sapiens
tctcagaattaagagtgct

SEQ ID NO: 8562501 - DNA, 22 bp, Homo sapiens
tctcagagaacagttggtgctt

SEQ ID NO: 8562502 - DNA, 22 bp, Homo sapiens
tctgctattttctatctgtgtg

SEQ ID NO: 8562503 - DNA, 22 bp, Homo sapiens
tctgcttgtgtctgtccagcct

SEQ ID NO: 8562504 - DNA, 22 bp, Homo sapiens
tctgctttagaatccagtagct

SEQ ID NO: 8562505 - DNA, 22 bp, Homo sapiens
tctgctttagtgcaaagtctta

SEQ ID NO: 8562506 - DNA, 22 bp, Homo sapiens
tctgctgtttactgtgtgatat

SEQ ID NO: 8562507 - DNA, 22 bp, Homo sapiens
tctgctcacatggctccatgca

SEQ ID NO: 8562508 - DNA, 22 bp, Homo sapiens
tctgctgtttactgtgtgatat

SEQ ID NO: 8562509 - DNA, 22 bp, Homo sapiens
tctgctcaatactgctcatgaa

SEQ ID NO: 8562510 - DNA, 22 bp, Homo sapiens
tctgcttgcgttctgctccctc

SEQ ID NO: 8562511 - DNA, 22 bp, Homo sapiens
tctgcttgcgttctgctccctc

SEQ ID NO: 8562512 - DNA, 22 bp, Homo sapiens
tctgcttgtgtctgtccagcct

SEQ ID NO: 8562513 - DNA, 22 bp, Homo sapiens
tctgctttagaatccagtagct

SEQ ID NO: 8562514 - DNA, 22 bp, Homo sapiens
ccagctctctgcagaaaggact

SEQ ID NO: 8562515 - DNA, 22 bp, Homo sapiens
ccagctctcagcgggagactca

SEQ ID NO: 8562516 - DNA, 22 bp, Homo sapiens
ccagctctcagcgggagactca

SEQ ID NO: 8562517 - DNA, 22 bp, Homo sapiens
ccagctctcagcgggagactca

SEQ ID NO: 8562518 - DNA, 22 bp, Homo sapiens
tctggaaatttcagttttagag

SEQ ID NO: 8562519 - DNA, 22 bp, Homo sapiens
tctggaaatttcagttttagag

SEQ ID NO: 8562520 - DNA, 22 bp, Homo sapiens
tctggaaagatcattaaatcca

SEQ ID NO: 8562521 - DNA, 22 bp, Homo sapiens
tctggaaataaaattatagttg

SEQ ID NO: 8562522 - DNA, 22 bp, Homo sapiens
tctggaaaagcgataaaccatt

SEQ ID NO: 8562523 - DNA, 22 bp, Homo sapiens
tctggaaaagcgataaaccatt

SEQ ID NO: 8562524 - DNA, 22 bp, Homo sapiens
tctgctttcttgcgcagatgtg

SEQ ID NO: 8562525 - DNA, 22 bp, Homo sapiens
tctggcaggcaatcggctctgg

SEQ ID NO: 8562526 - DNA, 22 bp, Homo sapiens
tctggcaggcaatcggctctgg

SEQ ID NO: 8562527 - DNA, 21 bp, Homo sapiens
tctggcaggaagacggatggg

SEQ ID NO: 8562528 - DNA, 22 bp, Homo sapiens
tctggcagcgaagcgtgtactt

SEQ ID NO: 8562529 - DNA, 22 bp, Homo sapiens
tctggcagctatcctctggcca

SEQ ID NO: 8562530 - DNA, 22 bp, Homo sapiens
tctggcctactggagtccatga

SEQ ID NO: 8562531 - DNA, 22 bp, Homo sapiens
tctggcctactggagtccatga

SEQ ID NO: 8562532 - DNA, 22 bp, Homo sapiens
tctggcctatttctgtcagatc

SEQ ID NO: 8562533 - DNA, 22 bp, Homo sapiens
tctggcctatttctgtcagatc

SEQ ID NO: 8562534 - DNA, 22 bp, Homo sapiens
tctggcctatttctgtcagatc

SEQ ID NO: 8562535 - DNA, 22 bp, Homo sapiens
tctggcaggggttctgcacttg

SEQ ID NO: 8562536 - DNA, 22 bp, Homo sapiens
tctggcaggggttctgcacttg

SEQ ID NO: 8562537 - DNA, 22 bp, Homo sapiens
tctggcctgaaagtccatgctt

SEQ ID NO: 8562538 - DNA, 22 bp, Homo sapiens
tctggcctcttgggatgctccc

SEQ ID NO: 8562539 - DNA, 22 bp, Homo sapiens
tctggcctcttgggatgctccc

SEQ ID NO: 8562540 - DNA, 22 bp, Homo sapiens
tctggcctcctccaccagggaa

SEQ ID NO: 8562541 - DNA, 22 bp, Homo sapiens
tctggcctcctccaccagggaa

SEQ ID NO: 8562542 - DNA, 22 bp, Homo sapiens
tctggccttatctgtccaagcc

SEQ ID NO: 8562543 - DNA, 22 bp, Homo sapiens
tctggccttatctgtccaagcc

SEQ ID NO: 8562544 - DNA, 22 bp, Homo sapiens
tctggccttatctgtccaagcc

SEQ ID NO: 8562545 - DNA, 22 bp, Homo sapiens
tctggcctgggcctgccggtgc

SEQ ID NO: 8562546 - DNA, 22 bp, Homo sapiens
tctggcctgtgttggtggcccc

SEQ ID NO: 8562547 - DNA, 22 bp, Homo sapiens
tctggcctgggcctgccggtgc

SEQ ID NO: 8562548 - DNA, 18 bp, Homo sapiens
ccaggacaggcaaaaggt

SEQ ID NO: 8562549 - DNA, 22 bp, Homo sapiens
ccaggacaggagttggcttcgc

SEQ ID NO: 8562550 - DNA, 22 bp, Homo sapiens
ccaggacactgcttcacagcag

SEQ ID NO: 8562551 - DNA, 22 bp, Homo sapiens
ccaggacagggagacgggagcc

SEQ ID NO: 8562552 - DNA, 22 bp, Homo sapiens
ccaggacagggagacgggagcc

SEQ ID NO: 8562553 - DNA, 22 bp, Homo sapiens
ccaggacagggagacgggagcc

SEQ ID NO: 8562554 - DNA, 22 bp, Homo sapiens
ccaggacagtgaacatgtaaga

SEQ ID NO: 8562555 - DNA, 22 bp, Homo sapiens
ccaggacagtgaacatgtaaga

SEQ ID NO: 8562556 - DNA, 22 bp, Homo sapiens
ccaggaccacacgacaggagag

SEQ ID NO: 8562557 - DNA, 22 bp, Homo sapiens
ccaggaccctgcaaaccctgtt

SEQ ID NO: 8562558 - DNA, 19 bp, Homo sapiens
ccaggacctttccagggtc

SEQ ID NO: 8562559 - DNA, 19 bp, Homo sapiens
ccaggacctttccagggtc

SEQ ID NO: 8562560 - DNA, 22 bp, Homo sapiens
ccaggacctggagctctatgaa

SEQ ID NO: 8562561 - DNA, 22 bp, Homo sapiens
tctggctcacttcaggcttcac

SEQ ID NO: 8562562 - DNA, 22 bp, Homo sapiens
tctggctcacttcaggcttcac

SEQ ID NO: 8562563 - DNA, 17 bp, Homo sapiens
tctggccttcctgaact

SEQ ID NO: 8562564 - DNA, 22 bp, Homo sapiens
ccaggacactgcttcacagcag

SEQ ID NO: 8562565 - DNA, 21 bp, Homo sapiens
ccaggaaggactgagctccct

SEQ ID NO: 8562566 - DNA, 22 bp, Homo sapiens
ccaggaaggatcgtttgggagt

SEQ ID NO: 8562567 - DNA, 22 bp, Homo sapiens
tctggctcaggagctgtgttca

SEQ ID NO: 8562568 - DNA, 22 bp, Homo sapiens
ccaggagaagcatctgagtgta

SEQ ID NO: 8562569 - DNA, 22 bp, Homo sapiens
tctggttagccaataatgccaa

SEQ ID NO: 8562570 - DNA, 19 bp, Homo sapiens
ccaggactttgcagacact

SEQ ID NO: 8562571 - DNA, 22 bp, Homo sapiens
ccaggacttcgaggctacagtg

SEQ ID NO: 8562572 - DNA, 22 bp, Homo sapiens
tctggtggcacgtgtcttgcat

SEQ ID NO: 8562573 - DNA, 20 bp, Homo sapiens
tctggtgccccttcctgaga

SEQ ID NO: 8562574 - DNA, 19 bp, Homo sapiens
tctggttcatttctgctgt

SEQ ID NO: 8562575 - DNA, 22 bp, Homo sapiens
tctggtggtgggccacaagcat

SEQ ID NO: 8562576 - DNA, 22 bp, Homo sapiens
tctggtgtcagtattctttgaa

SEQ ID NO: 8562577 - DNA, 22 bp, Homo sapiens
tctggtgtcagtattctttgaa

SEQ ID NO: 8562578 - DNA, 22 bp, Homo sapiens
tctggtcccttttcctgcagtc

SEQ ID NO: 8562579 - DNA, 22 bp, Homo sapiens
tctggtcccttttcctgcagtc

SEQ ID NO: 8562580 - DNA, 22 bp, Homo sapiens
tctggtccccattccaggtggg

SEQ ID NO: 8562581 - DNA, 19 bp, Homo sapiens
tctgggagagtgaatctga

SEQ ID NO: 8562582 - DNA, 19 bp, Homo sapiens
tctgggagagtgaatctga

SEQ ID NO: 8562583 - DNA, 22 bp, Homo sapiens
ccaggactgcagggggcgagga

SEQ ID NO: 8562584 - DNA, 22 bp, Homo sapiens
ccaggactgcagggggcgagga

SEQ ID NO: 8562585 - DNA, 22 bp, Homo sapiens
ccaggactgcagggggcgagga

SEQ ID NO: 8562586 - DNA, 22 bp, Homo sapiens
tctgggagagtcacaggcattg

SEQ ID NO: 8562587 - DNA, 22 bp, Homo sapiens
tctgggagatccaagcagaact

SEQ ID NO: 8562588 - DNA, 22 bp, Homo sapiens
tctgggagatccaagcagaact

SEQ ID NO: 8562589 - DNA, 22 bp, Homo sapiens
tctgggagcacacgcagtgatc

SEQ ID NO: 8562590 - DNA, 22 bp, Homo sapiens
tctgggagcacacgcagtgatc

SEQ ID NO: 8562591 - DNA, 22 bp, Homo sapiens
tctggtcaagacatcctaacat

SEQ ID NO: 8562592 - DNA, 22 bp, Homo sapiens
tctggtaacctttatccctcct

SEQ ID NO: 8562593 - DNA, 22 bp, Homo sapiens
tctgggtttgaagtagagccca

SEQ ID NO: 8562594 - DNA, 22 bp, Homo sapiens
tctggtaacctttatccctcct

SEQ ID NO: 8562595 - DNA, 22 bp, Homo sapiens
tctgggagcagctcagcagatt

SEQ ID NO: 8562596 - DNA, 22 bp, Homo sapiens
tctgggagcctgaaagtgaatg

SEQ ID NO: 8562597 - DNA, 22 bp, Homo sapiens
ccaggccagcgctggctggagg

SEQ ID NO: 8562598 - DNA, 22 bp, Homo sapiens
ccaggccagcgctggctggagg

SEQ ID NO: 8562599 - DNA, 22 bp, Homo sapiens
ccaggccagcctggagcatggc

SEQ ID NO: 8562600 - DNA, 22 bp, Homo sapiens
ccaggccagcaggcacacctgc

SEQ ID NO: 8562601 - DNA, 22 bp, Homo sapiens
ccaggccagagtgcagtggcac

SEQ ID NO: 8562602 - DNA, 22 bp, Homo sapiens
ccaggcagggagctgtttggcc

SEQ ID NO: 8562603 - DNA, 22 bp, Homo sapiens
ccaggccagagtgcagtggcac

SEQ ID NO: 8562604 - DNA, 19 bp, Homo sapiens
tcttccctggctgtcagtc

SEQ ID NO: 8562605 - DNA, 22 bp, Homo sapiens
tcttcctatggggctgcaggaa

SEQ ID NO: 8562606 - DNA, 22 bp, Homo sapiens
tcttcctagttacatatgcaca

SEQ ID NO: 8562607 - DNA, 22 bp, Homo sapiens
tcttcccccgtgctccagtgca

SEQ ID NO: 8562608 - DNA, 21 bp, Homo sapiens
tcttccctcaggatgtcctgc

SEQ ID NO: 8562609 - DNA, 21 bp, Homo sapiens
tcttccctcaggatgtcctgc

SEQ ID NO: 8562610 - DNA, 19 bp, Homo sapiens
tcttccctggctgtcagtc

SEQ ID NO: 8562611 - DNA, 22 bp, Homo sapiens
tcttcagagtgaaagtctgtga

SEQ ID NO: 8562612 - DNA, 22 bp, Homo sapiens
tcttcagagtgagcagtgtcat

SEQ ID NO: 8562613 - DNA, 20 bp, Homo sapiens
tcttcagatgcttttggagt

SEQ ID NO: 8562614 - DNA, 22 bp, Homo sapiens
tcttccagtctgtaggactagg

SEQ ID NO: 8562615 - DNA, 22 bp, Homo sapiens
tcttccagtgctgtgtagagct

SEQ ID NO: 8562616 - DNA, 20 bp, Homo sapiens
tcttccaggtacagtctgca

SEQ ID NO: 8562617 - DNA, 22 bp, Homo sapiens
tcttcccaatgcaaagtaggac

SEQ ID NO: 8562618 - DNA, 22 bp, Homo sapiens
tcttccagtgtagacatctgcc

SEQ ID NO: 8562619 - DNA, 22 bp, Homo sapiens
tcttcagaaaattatcacttgt

SEQ ID NO: 8562620 - DNA, 22 bp, Homo sapiens
tcttcagaagatcacatcagtg

SEQ ID NO: 8562621 - DNA, 22 bp, Homo sapiens
tcttcagacccttagctgtgat

SEQ ID NO: 8562622 - DNA, 22 bp, Homo sapiens
tcttcagactgttgttcttttg

SEQ ID NO: 8562623 - DNA, 22 bp, Homo sapiens
tcttcagacccttagctgtgat

SEQ ID NO: 8562624 - DNA, 22 bp, Homo sapiens
tcttcagagatgtaacatatgg

SEQ ID NO: 8562625 - DNA, 22 bp, Homo sapiens
tcttcagagactctgagcccct

SEQ ID NO: 8562626 - DNA, 22 bp, Homo sapiens
tcttcagagactctgagcccct

SEQ ID NO: 8562627 - DNA, 22 bp, Homo sapiens
tcttcagagcatttctgaggta

SEQ ID NO: 8562628 - DNA, 22 bp, Homo sapiens
tcttcagaggaagtcagtcttt

SEQ ID NO: 8562629 - DNA, 22 bp, Homo sapiens
ccaggaggttgaggctgcagtg

SEQ ID NO: 8562630 - DNA, 22 bp, Homo sapiens
ccaggaggttgaggctgcagtg

SEQ ID NO: 8562631 - DNA, 22 bp, Homo sapiens
ccaggaggttgaggctgcagtg

SEQ ID NO: 8562632 - DNA, 22 bp, Homo sapiens
ccaggaggttgaggctgcagtg

SEQ ID NO: 8562633 - DNA, 22 bp, Homo sapiens
ccaggaggttgaggctgcagtg

SEQ ID NO: 8562634 - DNA, 22 bp, Homo sapiens
ccaggaggttgaggctgcagtg

SEQ ID NO: 8562635 - DNA, 22 bp, Homo sapiens
ccaggaggttgaggctgcagtg

SEQ ID NO: 8562636 - DNA, 19 bp, Homo sapiens
ccaggagtggtggggtgag

SEQ ID NO: 8562637 - DNA, 22 bp, Homo sapiens
ccaggagtggctggtgaccttc

SEQ ID NO: 8562638 - DNA, 22 bp, Homo sapiens
ccaggagtggctggtgaccttc

SEQ ID NO: 8562639 - DNA, 22 bp, Homo sapiens
ccaggagtcaataaaggaagct

SEQ ID NO: 8562640 - DNA, 22 bp, Homo sapiens
ccaggagtcaataaaggaagct

SEQ ID NO: 8562641 - DNA, 22 bp, Homo sapiens
ccaggagtcaataaaggaagct

SEQ ID NO: 8562642 - DNA, 22 bp, Homo sapiens
ccaggagtctggatgaggtgtc

SEQ ID NO: 8562643 - DNA, 22 bp, Homo sapiens
ccaggagtgcagggatggtatc

SEQ ID NO: 8562644 - DNA, 22 bp, Homo sapiens
ccaggagtctggatgaggtgtc

SEQ ID NO: 8562645 - DNA, 22 bp, Homo sapiens
ccaggagacaaagatgactgct

SEQ ID NO: 8562646 - DNA, 22 bp, Homo sapiens
ccaggagacccagggaaggagc

SEQ ID NO: 8562647 - DNA, 22 bp, Homo sapiens
ccaggagacccagggaaggagc

SEQ ID NO: 8562648 - DNA, 22 bp, Homo sapiens
ccaggagggaccgcggcatccc

SEQ ID NO: 8562649 - DNA, 22 bp, Homo sapiens
ccaggagggaccgcggcatccc

SEQ ID NO: 8562650 - DNA, 22 bp, Homo sapiens
ccaggagtttgaggctgcagtg

SEQ ID NO: 8562651 - DNA, 22 bp, Homo sapiens
ccaggagtttgaggctgcagtg

SEQ ID NO: 8562652 - DNA, 22 bp, Homo sapiens
ccaggagttggaggttgcagtg

SEQ ID NO: 8562653 - DNA, 22 bp, Homo sapiens
ccaggagttggaggttgcagtg

SEQ ID NO: 8562654 - DNA, 22 bp, Homo sapiens
ccaggagttggaggctgcagtg

SEQ ID NO: 8562655 - DNA, 22 bp, Homo sapiens
ccaggagttggaggctgcagtg

SEQ ID NO: 8562656 - DNA, 22 bp, Homo sapiens
ccaggagttggaagctgccatg

SEQ ID NO: 8562657 - DNA, 22 bp, Homo sapiens
ccaggatagtatgagtagggat

SEQ ID NO: 8562658 - DNA, 22 bp, Homo sapiens
ccaggcaagagaggctctggca

SEQ ID NO: 8562659 - DNA, 22 bp, Homo sapiens
tcttagaatgtcaactgatgtt

SEQ ID NO: 8562660 - DNA, 22 bp, Homo sapiens
tcttagaatgtcaactgatgtt

SEQ ID NO: 8562661 - DNA, 22 bp, Homo sapiens
tcttcacatggaacatgaagct

SEQ ID NO: 8562662 - DNA, 22 bp, Homo sapiens
tcttagaatgtcaactgatgtt

SEQ ID NO: 8562663 - DNA, 22 bp, Homo sapiens
tcttagaagtttatggcacgga

SEQ ID NO: 8562664 - DNA, 22 bp, Homo sapiens
tcttcacattttaagaagttct

SEQ ID NO: 8562665 - DNA, 22 bp, Homo sapiens
tcttcacattttagtggtttgt

SEQ ID NO: 8562666 - DNA, 22 bp, Homo sapiens
tcttcacgccaagtgcccctca

SEQ ID NO: 8562667 - DNA, 22 bp, Homo sapiens
tcttcaccatcaacagaatgaa

SEQ ID NO: 8562668 - DNA, 22 bp, Homo sapiens
tcttcacattcacgtaacatag

SEQ ID NO: 8562669 - DNA, 22 bp, Homo sapiens
tcttcacattttaagaagttct

SEQ ID NO: 8562670 - DNA, 22 bp, Homo sapiens
tcttcacattcacgtaacatag

SEQ ID NO: 8562671 - DNA, 19 bp, Homo sapiens
tctttggcttctggatcag

SEQ ID NO: 8562672 - DNA, 19 bp, Homo sapiens
tctttggcttctggatcag

SEQ ID NO: 8562673 - DNA, 22 bp, Homo sapiens
tctttggcatttaggagcagga

SEQ ID NO: 8562674 - DNA, 22 bp, Homo sapiens
ccaggctgaatatgttccaggg

SEQ ID NO: 8562675 - DNA, 22 bp, Homo sapiens
ccaggctgctgttggtgtccgc

SEQ ID NO: 8562676 - DNA, 22 bp, Homo sapiens
ccaggctggagtgcaatggcat

SEQ ID NO: 8562677 - DNA, 22 bp, Homo sapiens
ccaggctgctgttggtgtccgc

SEQ ID NO: 8562678 - DNA, 22 bp, Homo sapiens
ccaggctggagtgcaatggcat

SEQ ID NO: 8562679 - DNA, 22 bp, Homo sapiens
ccaggctggagtgcaatggcat

SEQ ID NO: 8562680 - DNA, 22 bp, Homo sapiens
ccaggctggagtgcaatggcgt

SEQ ID NO: 8562681 - DNA, 22 bp, Homo sapiens
ccaggctggagtgcaatggcgt

SEQ ID NO: 8562682 - DNA, 22 bp, Homo sapiens
ccaggctggagtgcaatggcat

SEQ ID NO: 8562683 - DNA, 22 bp, Homo sapiens
ccaggctggagtgcaatggcgt

SEQ ID NO: 8562684 - DNA, 22 bp, Homo sapiens
ccaggctggagtgcaatggtgc

SEQ ID NO: 8562685 - DNA, 22 bp, Homo sapiens
ccaggctggagtgcaatggcgt

SEQ ID NO: 8562686 - DNA, 22 bp, Homo sapiens
ccaggctctgttccccgaggag

SEQ ID NO: 8562687 - DNA, 22 bp, Homo sapiens
ccaggctctgttccccgaggag

SEQ ID NO: 8562688 - DNA, 22 bp, Homo sapiens
ccaggctctgttccccgaggag

SEQ ID NO: 8562689 - DNA, 22 bp, Homo sapiens
ccaggctctgtgtgggctagag

SEQ ID NO: 8562690 - DNA, 22 bp, Homo sapiens
ccaggctctgtgtgggctagag

SEQ ID NO: 8562691 - DNA, 22 bp, Homo sapiens
ccaggctctgtgtgggctagag

SEQ ID NO: 8562692 - DNA, 22 bp, Homo sapiens
ccaggctctgtgtgggctagag

SEQ ID NO: 8562693 - DNA, 22 bp, Homo sapiens
ccaggctgaatatgttccaggg

SEQ ID NO: 8562694 - DNA, 22 bp, Homo sapiens
ccaggctgaatatgttccaggg

SEQ ID NO: 8562695 - DNA, 23 bp, Homo sapiens
ccaggctctttcacctgctattc

SEQ ID NO: 8562696 - DNA, 23 bp, Homo sapiens
ccaggctctttcacctgctattc

SEQ ID NO: 8562697 - DNA, 23 bp, Homo sapiens
ccaggctctttcacctgctattc

SEQ ID NO: 8562698 - DNA, 22 bp, Homo sapiens
ccaggctctgtctggtcagaag

SEQ ID NO: 8562699 - DNA, 21 bp, Homo sapiens
ccaggctcctgaggctggtca

SEQ ID NO: 8562700 - DNA, 21 bp, Homo sapiens
ccaggctcctgaggctggtca

SEQ ID NO: 8562701 - DNA, 22 bp, Homo sapiens
ccaggcctggccaggggatgcc

SEQ ID NO: 8562702 - DNA, 22 bp, Homo sapiens
ccaggcctggacgggtggcctg

SEQ ID NO: 8562703 - DNA, 22 bp, Homo sapiens
ccaggcctggacgggtggcctg

SEQ ID NO: 8562704 - DNA, 22 bp, Homo sapiens
ccaggcctggacgggtggcctg

SEQ ID NO: 8562705 - DNA, 22 bp, Homo sapiens
ccaggcctggacgggtggcctg

SEQ ID NO: 8562706 - DNA, 22 bp, Homo sapiens
ccaggccagggctgcagcgagc

SEQ ID NO: 8562707 - DNA, 22 bp, Homo sapiens
ccaggccaggagagcgaggttt

SEQ ID NO: 8562708 - DNA, 22 bp, Homo sapiens
ccaggccagggctgcagcgagc

SEQ ID NO: 8562709 - DNA, 22 bp, Homo sapiens
ccaggccagtgtttggtccagg

SEQ ID NO: 8562710 - DNA, 19 bp, Homo sapiens
ccaggccatcccagttccc

SEQ ID NO: 8562711 - DNA, 19 bp, Homo sapiens
ccaggccatcccagttccc

SEQ ID NO: 8562712 - DNA, 22 bp, Homo sapiens
ccaggccattcccagagttgct

SEQ ID NO: 8562713 - DNA, 22 bp, Homo sapiens
ccaggccattcccagagttgct

SEQ ID NO: 8562714 - DNA, 22 bp, Homo sapiens
ccaggccccagggctggctttc

SEQ ID NO: 8562715 - DNA, 22 bp, Homo sapiens
tctttcaaatgcttgaattgga

SEQ ID NO: 8562716 - DNA, 22 bp, Homo sapiens
tctttcttattagccattgttc

SEQ ID NO: 8562717 - DNA, 22 bp, Homo sapiens
tctttcaatccattcatatgtc

SEQ ID NO: 8562718 - DNA, 22 bp, Homo sapiens
tctttgaaaagggagatagaaa

SEQ ID NO: 8562719 - DNA, 22 bp, Homo sapiens
tctttgaaaagatattcctcct

SEQ ID NO: 8562720 - DNA, 22 bp, Homo sapiens
tctttgaaacaccctaaccttt

SEQ ID NO: 8562721 - DNA, 22 bp, Homo sapiens
tctttgaaacaccctaaccttt

SEQ ID NO: 8562722 - DNA, 22 bp, Homo sapiens
tctttgaaaagatattcctcct

SEQ ID NO: 8562723 - DNA, 22 bp, Homo sapiens
tctttctttatcacctgatatg

SEQ ID NO: 8562724 - DNA, 22 bp, Homo sapiens
tctttgaaagctgttctagagt

SEQ ID NO: 8562725 - DNA, 22 bp, Homo sapiens
tctttgaaagctgttctagagt

SEQ ID NO: 8562726 - DNA, 22 bp, Homo sapiens
ccaggcctgcatctgctgcgca

SEQ ID NO: 8562727 - DNA, 22 bp, Homo sapiens
ccaggcctgcattccctctcag

SEQ ID NO: 8562728 - DNA, 22 bp, Homo sapiens
ccaggcctggaccatgccaggg

SEQ ID NO: 8562729 - DNA, 22 bp, Homo sapiens
ccaggcctggaccatgccaggg

SEQ ID NO: 8562730 - DNA, 22 bp, Homo sapiens
tctttcttggtattctgagcta

SEQ ID NO: 8562731 - DNA, 22 bp, Homo sapiens
tctttcttgtgggtgccctttt

SEQ ID NO: 8562732 - DNA, 22 bp, Homo sapiens
tctttcttgcaaggatgcagga

SEQ ID NO: 8562733 - DNA, 22 bp, Homo sapiens
tctttcttctttcatagtgtga

SEQ ID NO: 8562734 - DNA, 22 bp, Homo sapiens
tctttcttattatgctcaatgt

SEQ ID NO: 8562735 - DNA, 22 bp, Homo sapiens
tctttcttcagccctgtaagat

SEQ ID NO: 8562736 - DNA, 22 bp, Homo sapiens
tggcctggggaagaccatgggc

SEQ ID NO: 8562737 - DNA, 22 bp, Homo sapiens
tggcctggggaagaccatgggc

SEQ ID NO: 8562738 - DNA, 22 bp, Homo sapiens
tggcctggggaagaccatgggc

SEQ ID NO: 8562739 - DNA, 22 bp, Homo sapiens
tggcctggggaagaccatgggc

SEQ ID NO: 8562740 - DNA, 22 bp, Homo sapiens
tggcctggggacctgtgagacc

SEQ ID NO: 8562741 - DNA, 22 bp, Homo sapiens
tggcctgggcctgccggtgcaa

SEQ ID NO: 8562742 - DNA, 22 bp, Homo sapiens
tggcctgggcctgccggtgcaa

SEQ ID NO: 8562743 - DNA, 22 bp, Homo sapiens
tggcctgggcctgccggtgcaa

SEQ ID NO: 8562744 - DNA, 22 bp, Homo sapiens
tggcctgggcctgccggtgcaa

SEQ ID NO: 8562745 - DNA, 22 bp, Homo sapiens
tggcctggggaagaccatgggc

SEQ ID NO: 8562746 - DNA, 22 bp, Homo sapiens
tggcctggctgccctgtctgga

SEQ ID NO: 8562747 - DNA, 22 bp, Homo sapiens
tggcctggctgccctgtctgga

SEQ ID NO: 8562748 - DNA, 22 bp, Homo sapiens
tggcctgggcatgaagcatcgt

SEQ ID NO: 8562749 - DNA, 22 bp, Homo sapiens
tggcctgggcatgaagcatcgt

SEQ ID NO: 8562750 - DNA, 22 bp, Homo sapiens
tggcctgggccggcagatatac

SEQ ID NO: 8562751 - DNA, 22 bp, Homo sapiens
tggcctgggccggcagatatac

SEQ ID NO: 8562752 - DNA, 22 bp, Homo sapiens
tggctctgagacacaggctctc

SEQ ID NO: 8562753 - DNA, 22 bp, Homo sapiens
tggctctgagacacaggctctc

SEQ ID NO: 8562754 - DNA, 21 bp, Homo sapiens
tggctctgggtaggagagtgc

SEQ ID NO: 8562755 - DNA, 21 bp, Homo sapiens
tggctctgggtaggagagtgc

SEQ ID NO: 8562756 - DNA, 22 bp, Homo sapiens
tggctctgtcaaactgcacaca

SEQ ID NO: 8562757 - DNA, 22 bp, Homo sapiens
tggctctgtcaaactgcacaca

SEQ ID NO: 8562758 - DNA, 22 bp, Homo sapiens
tggctctggtgcgggctcctgc

SEQ ID NO: 8562759 - DNA, 22 bp, Homo sapiens
tggctctggtgcgggctcctgc

SEQ ID NO: 8562760 - DNA, 18 bp, Homo sapiens
cctcagggagagagacgc

SEQ ID NO: 8562761 - DNA, 18 bp, Homo sapiens
cctcagggagagagacgc

SEQ ID NO: 8562762 - DNA, 22 bp, Homo sapiens
cctcagggactccatgctgcag

SEQ ID NO: 8562763 - DNA, 22 bp, Homo sapiens
cctcagtgtgtggatgttagag

SEQ ID NO: 8562764 - DNA, 22 bp, Homo sapiens
cctcatggccttgagctgaggg

SEQ ID NO: 8562765 - DNA, 23 bp, Homo sapiens
cctcatgaaggtctgcttcctgg

SEQ ID NO: 8562766 - DNA, 22 bp, Homo sapiens
cctcatggccttgagctgaggg

SEQ ID NO: 8562767 - DNA, 22 bp, Homo sapiens
cctcattctttcctgggcccct

SEQ ID NO: 8562768 - DNA, 22 bp, Homo sapiens
tggcctggctgccctgtctgga

SEQ ID NO: 8562769 - DNA, 22 bp, Homo sapiens
tggcctggctcacagtgagatt

SEQ ID NO: 8562770 - DNA, 22 bp, Homo sapiens
cctccaaggtgagagaggatgg

SEQ ID NO: 8562771 - DNA, 22 bp, Homo sapiens
cctcagaggttttcattctgta

SEQ ID NO: 8562772 - DNA, 22 bp, Homo sapiens
cctcagagttggaatcacattt

SEQ ID NO: 8562773 - DNA, 22 bp, Homo sapiens
cctcagagttggaatcacattt

SEQ ID NO: 8562774 - DNA, 22 bp, Homo sapiens
cctcagcagacacgcttctcac

SEQ ID NO: 8562775 - DNA, 22 bp, Homo sapiens
cctcagcagacacgcttctcac

SEQ ID NO: 8562776 - DNA, 17 bp, Homo sapiens
cctcagcttctttcctc

SEQ ID NO: 8562777 - DNA, 17 bp, Homo sapiens
cctcagcttctttcctc

SEQ ID NO: 8562778 - DNA, 22 bp, Homo sapiens
cctcaggctgctcacacttgtc

SEQ ID NO: 8562779 - DNA, 22 bp, Homo sapiens
cctcaggctgggctgcccctgg

SEQ ID NO: 8562780 - DNA, 22 bp, Homo sapiens
cctcaggctgggctgcccctgg

SEQ ID NO: 8562781 - DNA, 22 bp, Homo sapiens
cctcaggctgggctgcccctgg

SEQ ID NO: 8562782 - DNA, 22 bp, Homo sapiens
cctcaggctgctcacacttgtc

SEQ ID NO: 8562783 - DNA, 22 bp, Homo sapiens
cctcaggctgctcacacttgtc

SEQ ID NO: 8562784 - DNA, 22 bp, Homo sapiens
cctcaggctgctcacacttgtc

SEQ ID NO: 8562785 - DNA, 22 bp, Homo sapiens
cctcaggctctgggtgcctacc

SEQ ID NO: 8562786 - DNA, 22 bp, Homo sapiens
cctcaggctctgggtgcctacc

SEQ ID NO: 8562787 - DNA, 22 bp, Homo sapiens
cctcaggctctgggtgcctacc

SEQ ID NO: 8562788 - DNA, 22 bp, Homo sapiens
cctcaggctagctactgtccct

SEQ ID NO: 8562789 - DNA, 22 bp, Homo sapiens
cctcaggctagctactgtccct

SEQ ID NO: 8562790 - DNA, 22 bp, Homo sapiens
cctcaggcctctgcctcattgg

SEQ ID NO: 8562791 - DNA, 22 bp, Homo sapiens
cctcaggcctctgcctcattgg

SEQ ID NO: 8562792 - DNA, 22 bp, Homo sapiens
cctcaggcctgccagagcccca

SEQ ID NO: 8562793 - DNA, 22 bp, Homo sapiens
cctcaggcctgccagagcccca

SEQ ID NO: 8562794 - DNA, 22 bp, Homo sapiens
cctcaggcttacgggcaatgga

SEQ ID NO: 8562795 - DNA, 22 bp, Homo sapiens
cctcaggcttacgggcaatgga

SEQ ID NO: 8562796 - DNA, 22 bp, Homo sapiens
cctcaggcttcgtcttccaccc

SEQ ID NO: 8562797 - DNA, 22 bp, Homo sapiens
cctcaggcttcgtcttccaccc

SEQ ID NO: 8562798 - DNA, 22 bp, Homo sapiens
cctcaggcttaacttgtcttga

SEQ ID NO: 8562799 - DNA, 22 bp, Homo sapiens
cctcaggctgtcttccttctgg

SEQ ID NO: 8562800 - DNA, 22 bp, Homo sapiens
cctcaggctgtcttccttctgg

SEQ ID NO: 8562801 - DNA, 22 bp, Homo sapiens
cctcaggcttacgggcaatgga

SEQ ID NO: 8562802 - DNA, 22 bp, Homo sapiens
cctcagggaatgggaggctggg

SEQ ID NO: 8562803 - DNA, 22 bp, Homo sapiens
cctcaggcttctagttcagtga

SEQ ID NO: 8562804 - DNA, 22 bp, Homo sapiens
cctcaggcttctagttcagtga

SEQ ID NO: 8562805 - DNA, 22 bp, Homo sapiens
cctcaggcttctagttcagtga

SEQ ID NO: 8562806 - DNA, 22 bp, Homo sapiens
cctcaggcttgtgagccttcag

SEQ ID NO: 8562807 - DNA, 22 bp, Homo sapiens
cctcaggcttgtgagccttcag

SEQ ID NO: 8562808 - DNA, 22 bp, Homo sapiens
cctcaggcttgtgagccttcag

SEQ ID NO: 8562809 - DNA, 22 bp, Homo sapiens
cctcaggcttgtgagccttcag

SEQ ID NO: 8562810 - DNA, 22 bp, Homo sapiens
tggcagaggagaattaagatta

SEQ ID NO: 8562811 - DNA, 22 bp, Homo sapiens
tggcagaggagaattaagatta

SEQ ID NO: 8562812 - DNA, 19 bp, Homo sapiens
tggcagaggacaaggactt

SEQ ID NO: 8562813 - DNA, 19 bp, Homo sapiens
tggcagaggacaaggactt

SEQ ID NO: 8562814 - DNA, 19 bp, Homo sapiens
tggcagaggacaaggactt

SEQ ID NO: 8562815 - DNA, 21 bp, Homo sapiens
cccttcttgggtcaaagtata

SEQ ID NO: 8562816 - DNA, 22 bp, Homo sapiens
cccttcctcaaggagctgtgtt

SEQ ID NO: 8562817 - DNA, 22 bp, Homo sapiens
cccttcccttctgggagatcca

SEQ ID NO: 8562818 - DNA, 22 bp, Homo sapiens
cccttcctcccaggcttctgtg

SEQ ID NO: 8562819 - DNA, 22 bp, Homo sapiens
cccttcctcccaggcttctgtg

SEQ ID NO: 8562820 - DNA, 22 bp, Homo sapiens
cccttcctcctcgcctgtcaga

SEQ ID NO: 8562821 - DNA, 22 bp, Homo sapiens
cccttcctggagtaccctctgt

SEQ ID NO: 8562822 - DNA, 22 bp, Homo sapiens
cccttcctcctcgcctgtcaga

SEQ ID NO: 8562823 - DNA, 22 bp, Homo sapiens
cccttcctgggtgtcccggagt

SEQ ID NO: 8562824 - DNA, 19 bp, Homo sapiens
tggagcagggcccttgttt

SEQ ID NO: 8562825 - DNA, 18 bp, Homo sapiens
tggagcaggtaggcatga

SEQ ID NO: 8562826 - DNA, 22 bp, Homo sapiens
ccctgcagccttgcatgccttc

SEQ ID NO: 8562827 - DNA, 22 bp, Homo sapiens
ccctgcagccttgcatgccttc

SEQ ID NO: 8562828 - DNA, 18 bp, Homo sapiens
tggagcaggtaggcatga

SEQ ID NO: 8562829 - DNA, 22 bp, Homo sapiens
tggagcaggcatctttctctct

SEQ ID NO: 8562830 - DNA, 22 bp, Homo sapiens
tggagcaggccggaagtggctt

SEQ ID NO: 8562831 - DNA, 22 bp, Homo sapiens
tggagcaggccggaagtggctt

SEQ ID NO: 8562832 - DNA, 22 bp, Homo sapiens
tggagcagggcatcactgtgcg

SEQ ID NO: 8562833 - DNA, 22 bp, Homo sapiens
tggagcagggcatcactgtgcg

SEQ ID NO: 8562834 - DNA, 22 bp, Homo sapiens
tggagcagggcatcactgtgcg

SEQ ID NO: 8562835 - DNA, 22 bp, Homo sapiens
tggagcagggcatcactgtgcg

SEQ ID NO: 8562836 - DNA, 22 bp, Homo sapiens
tggagcaggccggaagtggctt

SEQ ID NO: 8562837 - DNA, 22 bp, Homo sapiens
ccctgcaggctcagactggagt

SEQ ID NO: 8562838 - DNA, 21 bp, Homo sapiens
ccctgcaggccagggctgagc

SEQ ID NO: 8562839 - DNA, 22 bp, Homo sapiens
ccctgcagcttttgcatagtca

SEQ ID NO: 8562840 - DNA, 22 bp, Homo sapiens
ccctgcagcttttgcatagtca

SEQ ID NO: 8562841 - DNA, 22 bp, Homo sapiens
ccctgcagccttgcatgccttc

SEQ ID NO: 8562842 - DNA, 22 bp, Homo sapiens
ccctgcagccttgcatgccttc

SEQ ID NO: 8562843 - DNA, 22 bp, Homo sapiens
ccctgcaggggacctgcagcct

SEQ ID NO: 8562844 - DNA, 22 bp, Homo sapiens
ccctgcaggggacctgcagcct

SEQ ID NO: 8562845 - DNA, 22 bp, Homo sapiens
ccctgcaggggacctgcagcct

SEQ ID NO: 8562846 - DNA, 22 bp, Homo sapiens
ccctgcagggaggattctgaag

SEQ ID NO: 8562847 - DNA, 22 bp, Homo sapiens
ccctgcaggctcagactggagt

SEQ ID NO: 8562848 - DNA, 23 bp, Homo sapiens
ccctgcagtcagggtgagatggt

SEQ ID NO: 8562849 - DNA, 23 bp, Homo sapiens
ccctgcagtcagggtgagatggt

SEQ ID NO: 8562850 - DNA, 22 bp, Homo sapiens
ccctgtgggccatgtgtctaca

SEQ ID NO: 8562851 - DNA, 22 bp, Homo sapiens
cctaggagttcgaagctgcagt

SEQ ID NO: 8562852 - DNA, 22 bp, Homo sapiens
cctaggagagggaaaatctagg

SEQ ID NO: 8562853 - DNA, 22 bp, Homo sapiens
cctaggagagggaaaatctagg

SEQ ID NO: 8562854 - DNA, 22 bp, Homo sapiens
tggcagggtggcaacttttggt

SEQ ID NO: 8562855 - DNA, 22 bp, Homo sapiens
tggcagggtggcaacttttggt

SEQ ID NO: 8562856 - DNA, 20 bp, Homo sapiens
cctaggcatgctgagtctcc

SEQ ID NO: 8562857 - DNA, 22 bp, Homo sapiens
tggcagggttggccaccttacc

SEQ ID NO: 8562858 - DNA, 22 bp, Homo sapiens
tggcagggtgggcttcagcccc

SEQ ID NO: 8562859 - DNA, 22 bp, Homo sapiens
cctcagaatagtcctcagatca

SEQ ID NO: 8562860 - DNA, 22 bp, Homo sapiens
cctcagaggtgaacatcagtgc

SEQ ID NO: 8562861 - DNA, 22 bp, Homo sapiens
cctcagaggtgaacatcagtgc

SEQ ID NO: 8562862 - DNA, 22 bp, Homo sapiens
cctcagaaggacaagagacaaa

SEQ ID NO: 8562863 - DNA, 22 bp, Homo sapiens
cctcagaaggacaagagacaaa

SEQ ID NO: 8562864 - DNA, 22 bp, Homo sapiens
tggcagaggagaattaagatta

SEQ ID NO: 8562865 - DNA, 22 bp, Homo sapiens
tggcagaggagaattaagatta

SEQ ID NO: 8562866 - DNA, 22 bp, Homo sapiens
tggcagaggaggctcagattga

SEQ ID NO: 8562867 - DNA, 22 bp, Homo sapiens
tggcagaggaggctcagattga

SEQ ID NO: 8562868 - DNA, 22 bp, Homo sapiens
tggcagaggaggctcagattga

SEQ ID NO: 8562869 - DNA, 19 bp, Homo sapiens
tggcagaggcagtttgtac

SEQ ID NO: 8562870 - DNA, 19 bp, Homo sapiens
tggcagaggcagtttgtac

SEQ ID NO: 8562871 - DNA, 22 bp, Homo sapiens
tggcagaggtaattcaaatccc

SEQ ID NO: 8562872 - DNA, 22 bp, Homo sapiens
tggcagaggctctgtgatgttg

SEQ ID NO: 8562873 - DNA, 22 bp, Homo sapiens
tggcagaggctctgtgatgttg

SEQ ID NO: 8562874 - DNA, 22 bp, Homo sapiens
tggcagaggtaattcaaatccc

SEQ ID NO: 8562875 - DNA, 22 bp, Homo sapiens
cctaacttcacttcattgaagt

SEQ ID NO: 8562876 - DNA, 22 bp, Homo sapiens
cctaactttaatgggaccagga

SEQ ID NO: 8562877 - DNA, 22 bp, Homo sapiens
cctaactttcattaggccccag

SEQ ID NO: 8562878 - DNA, 22 bp, Homo sapiens
cctaagaattaatgaatacacc

SEQ ID NO: 8562879 - DNA, 18 bp, Homo sapiens
cctaagctccagccccag

SEQ ID NO: 8562880 - DNA, 22 bp, Homo sapiens
cctaagattgcaaactctctcc

SEQ ID NO: 8562881 - DNA, 22 bp, Homo sapiens
cctaagatctggtatgtgacag

SEQ ID NO: 8562882 - DNA, 22 bp, Homo sapiens
cctagagctctgctttatctaa

SEQ ID NO: 8562883 - DNA, 22 bp, Homo sapiens
cctagaggctgcaaggagaggc

SEQ ID NO: 8562884 - DNA, 22 bp, Homo sapiens
cctagagctctgctttatctaa

SEQ ID NO: 8562885 - DNA, 22 bp, Homo sapiens
cctagagctctgctttatctaa

SEQ ID NO: 8562886 - DNA, 22 bp, Homo sapiens
cctaagattggtgtgcactgtg

SEQ ID NO: 8562887 - DNA, 22 bp, Homo sapiens
cctagactagaggcagggagcc

SEQ ID NO: 8562888 - DNA, 19 bp, Homo sapiens
cctagagggaaggcaggac

SEQ ID NO: 8562889 - DNA, 22 bp, Homo sapiens
cctagatgggatggcggccggg

SEQ ID NO: 8562890 - DNA, 22 bp, Homo sapiens
cctagcaataaagatatcattt

SEQ ID NO: 8562891 - DNA, 22 bp, Homo sapiens
tggcttccagagctgctccacc

SEQ ID NO: 8562892 - DNA, 22 bp, Homo sapiens
tggcttccactgtgtgccccct

SEQ ID NO: 8562893 - DNA, 22 bp, Homo sapiens
tggcttccaaattatccctaga

SEQ ID NO: 8562894 - DNA, 22 bp, Homo sapiens
tggcttccagaactgagcaaca

SEQ ID NO: 8562895 - DNA, 22 bp, Homo sapiens
tggcttccagtaatcaggattt

SEQ ID NO: 8562896 - DNA, 22 bp, Homo sapiens
cctctgagtcctccctggttgc

SEQ ID NO: 8562897 - DNA, 22 bp, Homo sapiens
cctctgcccttttcctgtatca

SEQ ID NO: 8562898 - DNA, 22 bp, Homo sapiens
cctctgcctgcacatcatcctg

SEQ ID NO: 8562899 - DNA, 22 bp, Homo sapiens
cctctgcctgcacatcatcctg

SEQ ID NO: 8562900 - DNA, 21 bp, Homo sapiens
cctctgctcgggcatgcgttt

SEQ ID NO: 8562901 - DNA, 22 bp, Homo sapiens
cctctgctctggtccatgtgct

SEQ ID NO: 8562902 - DNA, 22 bp, Homo sapiens
cctctgctgctgttgagcaccg

SEQ ID NO: 8562903 - DNA, 22 bp, Homo sapiens
cctctgctgctgttgagcaccg

SEQ ID NO: 8562904 - DNA, 22 bp, Homo sapiens
cctctgctgctgttgagcaccg

SEQ ID NO: 8562905 - DNA, 22 bp, Homo sapiens
cctctgctctggtccatgtgct

SEQ ID NO: 8562906 - DNA, 20 bp, Homo sapiens
cctctgcctttctagtctga

SEQ ID NO: 8562907 - DNA, 20 bp, Homo sapiens
cctctgcctttctagtctga

SEQ ID NO: 8562908 - DNA, 20 bp, Homo sapiens
cctctgcctttctagtctga

SEQ ID NO: 8562909 - DNA, 22 bp, Homo sapiens
cctctgcctttagtgaaagttg

SEQ ID NO: 8562910 - DNA, 20 bp, Homo sapiens
cctctgcctttctagtctga

SEQ ID NO: 8562911 - DNA, 18 bp, Homo sapiens
cctctgcctttgtagagc

SEQ ID NO: 8562912 - DNA, 22 bp, Homo sapiens
tgggaagctgcattttaacaag

SEQ ID NO: 8562913 - DNA, 22 bp, Homo sapiens
cctctggacttgggacagtgag

SEQ ID NO: 8562914 - DNA, 22 bp, Homo sapiens
tgggaagctactcatgcaggca

SEQ ID NO: 8562915 - DNA, 22 bp, Homo sapiens
cctctggagtcagaccagcttg

SEQ ID NO: 8562916 - DNA, 22 bp, Homo sapiens
tgggaaggacagaacataattg

SEQ ID NO: 8562917 - DNA, 22 bp, Homo sapiens
tgggaaggaactgcctttagct

SEQ ID NO: 8562918 - DNA, 19 bp, Homo sapiens
cctctgtgggagtcagtga

SEQ ID NO: 8562919 - DNA, 22 bp, Homo sapiens
tgggaaggcagtcactgtccta

SEQ ID NO: 8562920 - DNA, 22 bp, Homo sapiens
cctctgtggccttggaccagct

SEQ ID NO: 8562921 - DNA, 22 bp, Homo sapiens
cctctgtggccctgactctctt

SEQ ID NO: 8562922 - DNA, 22 bp, Homo sapiens
tgggaaggatacgttacaagat

SEQ ID NO: 8562923 - DNA, 22 bp, Homo sapiens
tgggaaggacgtgtcagtggca

SEQ ID NO: 8562924 - DNA, 22 bp, Homo sapiens
tgggaaggacgtgtcagtggca

SEQ ID NO: 8562925 - DNA, 22 bp, Homo sapiens
tggcttcatggcaagtcttagt

SEQ ID NO: 8562926 - DNA, 22 bp, Homo sapiens
tggcttccaaaggaatgggcct

SEQ ID NO: 8562927 - DNA, 22 bp, Homo sapiens
tggcttcattctgtagttaaaa

SEQ ID NO: 8562928 - DNA, 22 bp, Homo sapiens
tggcttcattcagcatgacagt

SEQ ID NO: 8562929 - DNA, 22 bp, Homo sapiens
tggcttcattattgtttttcct

SEQ ID NO: 8562930 - DNA, 22 bp, Homo sapiens
tggcttcattcagcatgacagt

SEQ ID NO: 8562931 - DNA, 22 bp, Homo sapiens
tggcttcattcagcatgacagt

SEQ ID NO: 8562932 - DNA, 22 bp, Homo sapiens
tggcttcatgtagtttgagttg

SEQ ID NO: 8562933 - DNA, 22 bp, Homo sapiens
tggctggctgtcagtaggctgt

SEQ ID NO: 8562934 - DNA, 22 bp, Homo sapiens
tggctggctgtcaaggaaagcc

SEQ ID NO: 8562935 - DNA, 22 bp, Homo sapiens
tggctggctgtccagctgggca

SEQ ID NO: 8562936 - DNA, 22 bp, Homo sapiens
tggctggcttgttcactgactg

SEQ ID NO: 8562937 - DNA, 22 bp, Homo sapiens
tggctgggagctggaactgggc

SEQ ID NO: 8562938 - DNA, 22 bp, Homo sapiens
tggctgagaccatcagggtgta

SEQ ID NO: 8562939 - DNA, 22 bp, Homo sapiens
tggctgagaccttcccaaattc

SEQ ID NO: 8562940 - DNA, 22 bp, Homo sapiens
tggctgagaccttcccaaattc

SEQ ID NO: 8562941 - DNA, 22 bp, Homo sapiens
tggctgagagaagacggggaag

SEQ ID NO: 8562942 - DNA, 16 bp, Homo sapiens
tggctgagagagggtt

SEQ ID NO: 8562943 - DNA, 22 bp, Homo sapiens
tggctggctagtgggcaggatt

SEQ ID NO: 8562944 - DNA, 22 bp, Homo sapiens
tggctgctagccagagcttcag

SEQ ID NO: 8562945 - DNA, 22 bp, Homo sapiens
tggctgctagccagagcttcag

SEQ ID NO: 8562946 - DNA, 22 bp, Homo sapiens
tggctgctcaagggaggaggct

SEQ ID NO: 8562947 - DNA, 22 bp, Homo sapiens
tggctctgtcactgtgagctat

SEQ ID NO: 8562948 - DNA, 22 bp, Homo sapiens
tggctctgtcactgtgagctat

SEQ ID NO: 8562949 - DNA, 22 bp, Homo sapiens
tggctctgtcactgtgagctat

SEQ ID NO: 8562950 - DNA, 17 bp, Homo sapiens
tggctctgtcctcagct

SEQ ID NO: 8562951 - DNA, 17 bp, Homo sapiens
tggctctgtcctcagct

SEQ ID NO: 8562952 - DNA, 17 bp, Homo sapiens
tggctctgtcctcagct

SEQ ID NO: 8562953 - DNA, 17 bp, Homo sapiens
tggctctgtcctcagct

SEQ ID NO: 8562954 - DNA, 17 bp, Homo sapiens
tggctctgtcctcagct

SEQ ID NO: 8562955 - DNA, 22 bp, Homo sapiens
tggctgagaatgggatgatgcc

SEQ ID NO: 8562956 - DNA, 22 bp, Homo sapiens
tggctgagaagttctggtggga

SEQ ID NO: 8562957 - DNA, 19 bp, Homo sapiens
tggctctgtcgaaggcaca

SEQ ID NO: 8562958 - DNA, 19 bp, Homo sapiens
tggctctgtcgaaggcaca

SEQ ID NO: 8562959 - DNA, 22 bp, Homo sapiens
tggctgagaatgggatgatgcc

SEQ ID NO: 8562960 - DNA, 22 bp, Homo sapiens
tggctgagaccatcagggtgta

SEQ ID NO: 8562961 - DNA, 22 bp, Homo sapiens
tggctgagaatgggatgatgcc

SEQ ID NO: 8562962 - DNA, 22 bp, Homo sapiens
cctgagatggggattattccaa

SEQ ID NO: 8562963 - DNA, 23 bp, Homo sapiens
cctgagatctgtaagggaccttg

SEQ ID NO: 8562964 - DNA, 22 bp, Homo sapiens
cctgagatggccagtgctggga

SEQ ID NO: 8562965 - DNA, 22 bp, Homo sapiens
cctgagatttgtaatttttgta

SEQ ID NO: 8562966 - DNA, 22 bp, Homo sapiens
cctgagcaaaggaaggatgact

SEQ ID NO: 8562967 - DNA, 22 bp, Homo sapiens
cctgagcaaaggcccagaggga

SEQ ID NO: 8562968 - DNA, 22 bp, Homo sapiens
cctgagcacaagggagctttga

SEQ ID NO: 8562969 - DNA, 23 bp, Homo sapiens
tgggagtgttgggatctctgctc

SEQ ID NO: 8562970 - DNA, 22 bp, Homo sapiens
cctgagaccaagttgcagccat

SEQ ID NO: 8562971 - DNA, 22 bp, Homo sapiens
cctgagagagaagcgacctggt

SEQ ID NO: 8562972 - DNA, 22 bp, Homo sapiens
cctgagatcagtgcatttggtg

SEQ ID NO: 8562973 - DNA, 21 bp, Homo sapiens
cctgagatctggagtggcttt

SEQ ID NO: 8562974 - DNA, 22 bp, Homo sapiens
cctgagcctcttgcacgctcag

SEQ ID NO: 8562975 - DNA, 22 bp, Homo sapiens
cctgagcctgagtggtgcaggg

SEQ ID NO: 8562976 - DNA, 22 bp, Homo sapiens
tgggccatttttggaagactgg

SEQ ID NO: 8562977 - DNA, 22 bp, Homo sapiens
cctgagcattagacatccatca

SEQ ID NO: 8562978 - DNA, 18 bp, Homo sapiens
cctgagccctgcttactt

SEQ ID NO: 8562979 - DNA, 22 bp, Homo sapiens
cctgagcagggctctgcagggc

SEQ ID NO: 8562980 - DNA, 22 bp, Homo sapiens
cctcttctcaactccagccaga

SEQ ID NO: 8562981 - DNA, 19 bp, Homo sapiens
cctcttctctggcagcaga

SEQ ID NO: 8562982 - DNA, 18 bp, Homo sapiens
tgggagtgggagtggata

SEQ ID NO: 8562983 - DNA, 18 bp, Homo sapiens
tgggagtgggagtggata

SEQ ID NO: 8562984 - DNA, 18 bp, Homo sapiens
tgggagtgggagtggata

SEQ ID NO: 8562985 - DNA, 22 bp, Homo sapiens
tgggagtggggcatagaaggta

SEQ ID NO: 8562986 - DNA, 19 bp, Homo sapiens
tgggagtggggaaggtcct

SEQ ID NO: 8562987 - DNA, 19 bp, Homo sapiens
tgggagtggggaaggtcct

SEQ ID NO: 8562988 - DNA, 19 bp, Homo sapiens
tgggagtggggaaggtcct

SEQ ID NO: 8562989 - DNA, 22 bp, Homo sapiens
tgggagtggggcatagaaggta

SEQ ID NO: 8562990 - DNA, 22 bp, Homo sapiens
tgggagtggggcatagaaggta

SEQ ID NO: 8562991 - DNA, 22 bp, Homo sapiens
tgggagtgttcttggcttgctt

SEQ ID NO: 8562992 - DNA, 22 bp, Homo sapiens
tgggagtgttcttggcttgctt

SEQ ID NO: 8562993 - DNA, 22 bp, Homo sapiens
cctcttccttctcactgtggaa

SEQ ID NO: 8562994 - DNA, 19 bp, Homo sapiens
cctcttcctctgacactat

SEQ ID NO: 8562995 - DNA, 17 bp, Homo sapiens
cctcttcctctcagctg

SEQ ID NO: 8562996 - DNA, 22 bp, Homo sapiens
cctcttcctcaccatctacaac

SEQ ID NO: 8562997 - DNA, 22 bp, Homo sapiens
cctcttctaggacgtccttgtg

SEQ ID NO: 8562998 - DNA, 22 bp, Homo sapiens
cctcttctaggacgtccttgtg

SEQ ID NO: 8562999 - DNA, 22 bp, Homo sapiens
cctcttctaggacgtccttgtg

SEQ ID NO: 8563000 - DNA, 22 bp, Homo sapiens
cctcttctaccatttacatttt

SEQ ID NO: 8563001 - DNA, 22 bp, Homo sapiens
cctcttctaggtttcagcctgc

SEQ ID NO: 8563002 - DNA, 22 bp, Homo sapiens
cctcttctaggtttcagcctgc

SEQ ID NO: 8563003 - DNA, 22 bp, Homo sapiens
cctcttctaggtttcagcctgc

SEQ ID NO: 8563004 - DNA, 22 bp, Homo sapiens
tgggctggcccaccacacctcg

SEQ ID NO: 8563005 - DNA, 22 bp, Homo sapiens
tgggctggcccaccacacctcg

SEQ ID NO: 8563006 - DNA, 22 bp, Homo sapiens
tgggctggcccaccacacctcg

SEQ ID NO: 8563007 - DNA, 22 bp, Homo sapiens
tgggctggcccaccacacctcg

SEQ ID NO: 8563008 - DNA, 22 bp, Homo sapiens
tgggctggagcttgttgcttcc

SEQ ID NO: 8563009 - DNA, 21 bp, Homo sapiens
cctgagcctgtttatccagaa

SEQ ID NO: 8563010 - DNA, 22 bp, Homo sapiens
cctgagctagggaaggaagacc

SEQ ID NO: 8563011 - DNA, 22 bp, Homo sapiens
cctgagcctggctcatgcactc

SEQ ID NO: 8563012 - DNA, 22 bp, Homo sapiens
tgggctgcttctcaaatgtctc

SEQ ID NO: 8563013 - DNA, 22 bp, Homo sapiens
tgggctggagcttgttgcttcc

SEQ ID NO: 8563014 - DNA, 22 bp, Homo sapiens
tgggctggagcttgttgcttcc

SEQ ID NO: 8563015 - DNA, 22 bp, Homo sapiens
tgggctgcttcctcagctgaga

SEQ ID NO: 8563016 - DNA, 22 bp, Homo sapiens
tgggctgcttcctcagctgaga

SEQ ID NO: 8563017 - DNA, 22 bp, Homo sapiens
tgggctgcttcctcagctgaga

SEQ ID NO: 8563018 - DNA, 22 bp, Homo sapiens
cctgagctggcagtgacctgga

SEQ ID NO: 8563019 - DNA, 22 bp, Homo sapiens
cctgagctggagacattacata

SEQ ID NO: 8563020 - DNA, 22 bp, Homo sapiens
tggggaggaagtcagatttcag

SEQ ID NO: 8563021 - DNA, 22 bp, Homo sapiens
cctgagctggaagagcttgtgc

SEQ ID NO: 8563022 - DNA, 22 bp, Homo sapiens
cctgagctggaagagcttgtgc

SEQ ID NO: 8563023 - DNA, 22 bp, Homo sapiens
cctgagctgcggggcagtgctc

SEQ ID NO: 8563024 - DNA, 22 bp, Homo sapiens
cctgagctggaagagcttgtgc

SEQ ID NO: 8563025 - DNA, 22 bp, Homo sapiens
cctgagctgactctcctttcag

SEQ ID NO: 8563026 - DNA, 22 bp, Homo sapiens
cctgagctgcggggcagtgctc

SEQ ID NO: 8563027 - DNA, 22 bp, Homo sapiens
cctgagctgactctcctttcag

SEQ ID NO: 8563028 - DNA, 22 bp, Homo sapiens
cctgagctgactctcctttcag

SEQ ID NO: 8563029 - DNA, 22 bp, Homo sapiens
cctgagctctgcactttttaga

SEQ ID NO: 8563030 - DNA, 22 bp, Homo sapiens
cctgagctgaactaagcagttt

SEQ ID NO: 8563031 - DNA, 22 bp, Homo sapiens
cctgagctgaactaagcagttt

SEQ ID NO: 8563032 - DNA, 22 bp, Homo sapiens
cctgagctctgcactttttaga

SEQ ID NO: 8563033 - DNA, 22 bp, Homo sapiens
cctgagctccagtagcagccag

SEQ ID NO: 8563034 - DNA, 22 bp, Homo sapiens
cctgagctctgcactttttaga

SEQ ID NO: 8563035 - DNA, 22 bp, Homo sapiens
cctgagctcaagaaggtgacca

SEQ ID NO: 8563036 - DNA, 22 bp, Homo sapiens
cctgagctcaagaaggtgacca

SEQ ID NO: 8563037 - DNA, 22 bp, Homo sapiens
cctgagctcaaagggtgcctgg

SEQ ID NO: 8563038 - DNA, 22 bp, Homo sapiens
tgggccctgacttcaagcatcc

SEQ ID NO: 8563039 - DNA, 22 bp, Homo sapiens
tgggccctgcccttgtctgtcc

SEQ ID NO: 8563040 - DNA, 22 bp, Homo sapiens
tgggcccaagagagtctccaac

SEQ ID NO: 8563041 - DNA, 22 bp, Homo sapiens
tgggcccaggtcctgggagaag

SEQ ID NO: 8563042 - DNA, 21 bp, Homo sapiens
tgggcccagttcccgctgggc

SEQ ID NO: 8563043 - DNA, 22 bp, Homo sapiens
tgggcccatcattgctgtgggc

SEQ ID NO: 8563044 - DNA, 22 bp, Homo sapiens
tgggctgctgcggtgctcttgg

SEQ ID NO: 8563045 - DNA, 22 bp, Homo sapiens
tgggctgctgcggtgctcttgg

SEQ ID NO: 8563046 - DNA, 22 bp, Homo sapiens
tgggctgctgttacaggggctg

SEQ ID NO: 8563047 - DNA, 22 bp, Homo sapiens
tgggctgctgtctgcacatgct

SEQ ID NO: 8563048 - DNA, 22 bp, Homo sapiens
tgggctgctgtctgcacatgct

SEQ ID NO: 8563049 - DNA, 18 bp, Homo sapiens
tgggctgcctggcctctg

SEQ ID NO: 8563050 - DNA, 22 bp, Homo sapiens
tgggctgcggataggcctcgga

SEQ ID NO: 8563051 - DNA, 22 bp, Homo sapiens
tgggctccttgggagcaagtga

SEQ ID NO: 8563052 - DNA, 22 bp, Homo sapiens
tgggctctagactttagtgtgg

SEQ ID NO: 8563053 - DNA, 22 bp, Homo sapiens
tgggctccttgggagcaagtga

SEQ ID NO: 8563054 - DNA, 22 bp, Homo sapiens
tgccacagaggtgaagcccact

SEQ ID NO: 8563055 - DNA, 22 bp, Homo sapiens
tgcacagatctggtggcaagga

SEQ ID NO: 8563056 - DNA, 22 bp, Homo sapiens
tgccagctcctgcagctcctgt

SEQ ID NO: 8563057 - DNA, 22 bp, Homo sapiens
tgccagctcctgcagctcctgt

SEQ ID NO: 8563058 - DNA, 22 bp, Homo sapiens
tgccagctcccttttctcctcc

SEQ ID NO: 8563059 - DNA, 22 bp, Homo sapiens
tgccagctccgaggagctgcag

SEQ ID NO: 8563060 - DNA, 20 bp, Homo sapiens
tgcacagacaatgagcccag

SEQ ID NO: 8563061 - DNA, 22 bp, Homo sapiens
tgcacagacatacacatatatg

SEQ ID NO: 8563062 - DNA, 22 bp, Homo sapiens
tgcacagacatacacatatatg

SEQ ID NO: 8563063 - DNA, 22 bp, Homo sapiens
tgcacagagagatgagacacgt

SEQ ID NO: 8563064 - DNA, 22 bp, Homo sapiens
tgcacagagagatgagacacgt

SEQ ID NO: 8563065 - DNA, 22 bp, Homo sapiens
tgcacagagggaggcataaaat

SEQ ID NO: 8563066 - DNA, 22 bp, Homo sapiens
tgcacagatagtgatagatagc

SEQ ID NO: 8563067 - DNA, 22 bp, Homo sapiens
tgcacagatagtgatagatagc

SEQ ID NO: 8563068 - DNA, 22 bp, Homo sapiens
tgcacagagcaggcaccagcgg

SEQ ID NO: 8563069 - DNA, 22 bp, Homo sapiens
tgcacagagctggactccgcgg

SEQ ID NO: 8563070 - DNA, 22 bp, Homo sapiens
tgccaggagagtgcatgcaggg

SEQ ID NO: 8563071 - DNA, 22 bp, Homo sapiens
tgccagcttttgactatcttag

SEQ ID NO: 8563072 - DNA, 22 bp, Homo sapiens
tgccagcttttgactatcttag

SEQ ID NO: 8563073 - DNA, 22 bp, Homo sapiens
tgccagcttttgactatcttag

SEQ ID NO: 8563074 - DNA, 22 bp, Homo sapiens
tgccagcttgtggtcagaggct

SEQ ID NO: 8563075 - DNA, 21 bp, Homo sapiens
tgccagctgctgcatctgtct

SEQ ID NO: 8563076 - DNA, 21 bp, Homo sapiens
tgccagctgctgcatctgtct

SEQ ID NO: 8563077 - DNA, 22 bp, Homo sapiens
cccaggagacatatagaaggac

SEQ ID NO: 8563078 - DNA, 22 bp, Homo sapiens
cccaggagacctgtgaaaggac

SEQ ID NO: 8563079 - DNA, 22 bp, Homo sapiens
cccaggagacctagatctgttt

SEQ ID NO: 8563080 - DNA, 22 bp, Homo sapiens
cccaggagagagacttgaatct

SEQ ID NO: 8563081 - DNA, 22 bp, Homo sapiens
cccaggagagagacttgaatct

SEQ ID NO: 8563082 - DNA, 22 bp, Homo sapiens
cccaggagactgagctgtaacc

SEQ ID NO: 8563083 - DNA, 22 bp, Homo sapiens
cccaggagagaggccagttggc

SEQ ID NO: 8563084 - DNA, 22 bp, Homo sapiens
cccaggagagaggccagttggc

SEQ ID NO: 8563085 - DNA, 22 bp, Homo sapiens
cccaggagagaggggataaagc

SEQ ID NO: 8563086 - DNA, 22 bp, Homo sapiens
cccaggagagaggggataaagc

SEQ ID NO: 8563087 - DNA, 22 bp, Homo sapiens
tgccaggctaagtggaggactt

SEQ ID NO: 8563088 - DNA, 22 bp, Homo sapiens
cccaggagataacgttcccaag

SEQ ID NO: 8563089 - DNA, 22 bp, Homo sapiens
tgccaggctaagtggaggactt

SEQ ID NO: 8563090 - DNA, 22 bp, Homo sapiens
tgccagtgggtgtgcagagact

SEQ ID NO: 8563091 - DNA, 22 bp, Homo sapiens
tgccagtgcttgtgtctgagca

SEQ ID NO: 8563092 - DNA, 22 bp, Homo sapiens
tgccagtgaaacgtggtctcat

SEQ ID NO: 8563093 - DNA, 22 bp, Homo sapiens
cccaggctcactgtccgcttcc

SEQ ID NO: 8563094 - DNA, 22 bp, Homo sapiens
cccaggctcagactggcttgtt

SEQ ID NO: 8563095 - DNA, 22 bp, Homo sapiens
cccaggctcccaggtgggacaa

SEQ ID NO: 8563096 - DNA, 22 bp, Homo sapiens
cccaggctcagactggcttgtt

SEQ ID NO: 8563097 - DNA, 22 bp, Homo sapiens
cccaggctagaaaggccaacaa

SEQ ID NO: 8563098 - DNA, 22 bp, Homo sapiens
cccaggctagaaaggccaacaa

SEQ ID NO: 8563099 - DNA, 19 bp, Homo sapiens
cccaggctacatggagagg

SEQ ID NO: 8563100 - DNA, 22 bp, Homo sapiens
cccaggctagtatgatatcagt

SEQ ID NO: 8563101 - DNA, 22 bp, Homo sapiens
tgccctggggagcccagccagg

SEQ ID NO: 8563102 - DNA, 22 bp, Homo sapiens
tgccctggggagcccagccagg

SEQ ID NO: 8563103 - DNA, 22 bp, Homo sapiens
tgccctggggtctggagcagca

SEQ ID NO: 8563104 - DNA, 21 bp, Homo sapiens
tgccctggggctcttccctca

SEQ ID NO: 8563105 - DNA, 22 bp, Homo sapiens
tgccctgggagttggagctgct

SEQ ID NO: 8563106 - DNA, 22 bp, Homo sapiens
cccaggctcccaggtgggacaa

SEQ ID NO: 8563107 - DNA, 22 bp, Homo sapiens
cccaggctcccaggtgggacaa

SEQ ID NO: 8563108 - DNA, 22 bp, Homo sapiens
tgcccagcctaaacttggcaag

SEQ ID NO: 8563109 - DNA, 22 bp, Homo sapiens
tgcccagcccctatccctggga

SEQ ID NO: 8563110 - DNA, 22 bp, Homo sapiens
tgcccagcgcccacattctgtc

SEQ ID NO: 8563111 - DNA, 22 bp, Homo sapiens
tgcccagctattcctttcttag

SEQ ID NO: 8563112 - DNA, 22 bp, Homo sapiens
cccaggcagtgtgtgcatgcgt

SEQ ID NO: 8563113 - DNA, 22 bp, Homo sapiens
tgcccagctgtcaaagtagata

SEQ ID NO: 8563114 - DNA, 22 bp, Homo sapiens
cccaggcatcccattaaggagc

SEQ ID NO: 8563115 - DNA, 23 bp, Homo sapiens
cccaggctacaaattatgctctg

SEQ ID NO: 8563116 - DNA, 22 bp, Homo sapiens
tgccagtgtggaactaggaaga

SEQ ID NO: 8563117 - DNA, 22 bp, Homo sapiens
tgccagtgtggaactaggaaga

SEQ ID NO: 8563118 - DNA, 22 bp, Homo sapiens
tgccagtgggtgtgcagagact

SEQ ID NO: 8563119 - DNA, 22 bp, Homo sapiens
tgccatattattgagcatatta

SEQ ID NO: 8563120 - DNA, 22 bp, Homo sapiens
tgccatagcaatggtaagctga

SEQ ID NO: 8563121 - DNA, 22 bp, Homo sapiens
tgccatattgcaaagtgtctgc

SEQ ID NO: 8563122 - DNA, 22 bp, Homo sapiens
tgccatattgatgtgctgtacc

SEQ ID NO: 8563123 - DNA, 22 bp, Homo sapiens
tgcccagccaatttgttatgtt

SEQ ID NO: 8563124 - DNA, 22 bp, Homo sapiens
tgcccagccagtttatggtaat

SEQ ID NO: 8563125 - DNA, 22 bp, Homo sapiens
tgcctgttgcccacctgataaa

SEQ ID NO: 8563126 - DNA, 22 bp, Homo sapiens
tgcctgttgcccacctgataaa

SEQ ID NO: 8563127 - DNA, 22 bp, Homo sapiens
tgcctgttattgttggcttagt

SEQ ID NO: 8563128 - DNA, 22 bp, Homo sapiens
tgccttcaatcaggatggtctc

SEQ ID NO: 8563129 - DNA, 22 bp, Homo sapiens
cccagggattataaaggtgaaa

SEQ ID NO: 8563130 - DNA, 22 bp, Homo sapiens
cccagggattataaaggtgaaa

SEQ ID NO: 8563131 - DNA, 22 bp, Homo sapiens
tgccttcaccaggccttcagcc

SEQ ID NO: 8563132 - DNA, 22 bp, Homo sapiens
cccagggacagatgggcagcta

SEQ ID NO: 8563133 - DNA, 22 bp, Homo sapiens
cccagggacagatgggcagcta

SEQ ID NO: 8563134 - DNA, 22 bp, Homo sapiens
cccagggacagctaggtggggc

SEQ ID NO: 8563135 - DNA, 22 bp, Homo sapiens
cccagggacagatgggcagcta

SEQ ID NO: 8563136 - DNA, 22 bp, Homo sapiens
cccagggacagctaggtggggc

SEQ ID NO: 8563137 - DNA, 22 bp, Homo sapiens
cccagggacagctaggtggggc

SEQ ID NO: 8563138 - DNA, 22 bp, Homo sapiens
tgcctgtgttgattactttgtc

SEQ ID NO: 8563139 - DNA, 22 bp, Homo sapiens
tgcctgtgtggtctgcgcatta

SEQ ID NO: 8563140 - DNA, 17 bp, Homo sapiens
cccagggaccactgctt

SEQ ID NO: 8563141 - DNA, 22 bp, Homo sapiens
tgcctgtgtgaccacgggcaag

SEQ ID NO: 8563142 - DNA, 17 bp, Homo sapiens
cccagggaccactgctt

SEQ ID NO: 8563143 - DNA, 22 bp, Homo sapiens
tgcctgtgtggggtctgccgcc

SEQ ID NO: 8563144 - DNA, 22 bp, Homo sapiens
cccagggtggatgcaagcagca

SEQ ID NO: 8563145 - DNA, 22 bp, Homo sapiens
cccaggtagtgagaaatggagg

SEQ ID NO: 8563146 - DNA, 22 bp, Homo sapiens
cccaggtagttggaagagacaa

SEQ ID NO: 8563147 - DNA, 22 bp, Homo sapiens
cccagggtagctgagctggcag

SEQ ID NO: 8563148 - DNA, 22 bp, Homo sapiens
cccagggtccctgctctctgtg

SEQ ID NO: 8563149 - DNA, 20 bp, Homo sapiens
cccaggggttgtggtgagga

SEQ ID NO: 8563150 - DNA, 20 bp, Homo sapiens
cccaggggttgtggtgagga

SEQ ID NO: 8563151 - DNA, 22 bp, Homo sapiens
cccagggtaatcatgtgaagcc

SEQ ID NO: 8563152 - DNA, 22 bp, Homo sapiens
cccaggggttctgagcagcagc

SEQ ID NO: 8563153 - DNA, 22 bp, Homo sapiens
cccaggggttctgagcagcagc

SEQ ID NO: 8563154 - DNA, 22 bp, Homo sapiens
cccaggggttctgagcagcagc

SEQ ID NO: 8563155 - DNA, 22 bp, Homo sapiens
cccaggggttctgagcagcagc

SEQ ID NO: 8563156 - DNA, 22 bp, Homo sapiens
cccaggggttcaaggctgcagt

SEQ ID NO: 8563157 - DNA, 22 bp, Homo sapiens
cccaggggttctagaccagctt

SEQ ID NO: 8563158 - DNA, 22 bp, Homo sapiens
cccaggggttctagaccagctt

SEQ ID NO: 8563159 - DNA, 22 bp, Homo sapiens
cccaggggttctagaccagctt

SEQ ID NO: 8563160 - DNA, 22 bp, Homo sapiens
cccaggggttctagaccagctt

SEQ ID NO: 8563161 - DNA, 22 bp, Homo sapiens
cccaggggttcaaggctgcagt

SEQ ID NO: 8563162 - DNA, 22 bp, Homo sapiens
cccaggggttcaaggctgcagt

SEQ ID NO: 8563163 - DNA, 22 bp, Homo sapiens
cccaggctgagttagaggtgtc

SEQ ID NO: 8563164 - DNA, 22 bp, Homo sapiens
cccaggctgagttagaggtgtc

SEQ ID NO: 8563165 - DNA, 22 bp, Homo sapiens
cccaggctggagggcagtgtca

SEQ ID NO: 8563166 - DNA, 22 bp, Homo sapiens
tgccctggtgaagtgctctcct

SEQ ID NO: 8563167 - DNA, 22 bp, Homo sapiens
tgccctggggtctggagcagca

SEQ ID NO: 8563168 - DNA, 22 bp, Homo sapiens
cccaggctggagtgcaatggtg

SEQ ID NO: 8563169 - DNA, 22 bp, Homo sapiens
cccaggctggagtgcagtggcg

SEQ ID NO: 8563170 - DNA, 22 bp, Homo sapiens
cccaggctggagtgcagtggcg

SEQ ID NO: 8563171 - DNA, 22 bp, Homo sapiens
cccaggctggagtgcaatggtg

SEQ ID NO: 8563172 - DNA, 22 bp, Homo sapiens
cccaggctggagtgcaatggca

SEQ ID NO: 8563173 - DNA, 22 bp, Homo sapiens
cccaggctggagtgcaatggca

SEQ ID NO: 8563174 - DNA, 22 bp, Homo sapiens
cccaggctggagggcagtgtca

SEQ ID NO: 8563175 - DNA, 22 bp, Homo sapiens
cccaggctggagggcagtgtca

SEQ ID NO: 8563176 - DNA, 22 bp, Homo sapiens
cccaggctggggctcctccagc

SEQ ID NO: 8563177 - DNA, 22 bp, Homo sapiens
cccaggctgggaacgattctag

SEQ ID NO: 8563178 - DNA, 22 bp, Homo sapiens
cccaggctggcctccgcagtgc

SEQ ID NO: 8563179 - DNA, 22 bp, Homo sapiens
cccaggctggatttcggtggca

SEQ ID NO: 8563180 - DNA, 22 bp, Homo sapiens
cccaggctggatttcggtggca

SEQ ID NO: 8563181 - DNA, 22 bp, Homo sapiens
cccaggctggagtgtaatggtg

SEQ ID NO: 8563182 - DNA, 22 bp, Homo sapiens
cccaggctggcactgctgaagt

SEQ ID NO: 8563183 - DNA, 22 bp, Homo sapiens
cccaggctggcactgctgaagt

SEQ ID NO: 8563184 - DNA, 21 bp, Homo sapiens
cccagggaagccgcagtcacc

SEQ ID NO: 8563185 - DNA, 22 bp, Homo sapiens
cccagggaaggcagatggagga

SEQ ID NO: 8563186 - DNA, 21 bp, Homo sapiens
cccagggaagccgcagtcacc

SEQ ID NO: 8563187 - DNA, 22 bp, Homo sapiens
cccaggctggtcctgaactcct

SEQ ID NO: 8563188 - DNA, 21 bp, Homo sapiens
cccagggaagccgcagtcacc

SEQ ID NO: 8563189 - DNA, 21 bp, Homo sapiens
cccagggaagccgcagtcacc

SEQ ID NO: 8563190 - DNA, 22 bp, Homo sapiens
cccaggctggtcctgaactcct

SEQ ID NO: 8563191 - DNA, 22 bp, Homo sapiens
cccaggctggtcctgaactcct

SEQ ID NO: 8563192 - DNA, 22 bp, Homo sapiens
cccaggctggggctcctccagc

SEQ ID NO: 8563193 - DNA, 23 bp, Homo sapiens
cccagggacacgatgacacctcc

SEQ ID NO: 8563194 - DNA, 22 bp, Homo sapiens
cccagggaatgactctggcctt

SEQ ID NO: 8563195 - DNA, 22 bp, Homo sapiens
cccagggaatgactctggcctt

SEQ ID NO: 8563196 - DNA, 22 bp, Homo sapiens
cccagggaagggctacctgagg

SEQ ID NO: 8563197 - DNA, 22 bp, Homo sapiens
cccagggaaggcagatggagga

SEQ ID NO: 8563198 - DNA, 22 bp, Homo sapiens
tgctggctttttggtccttgct

SEQ ID NO: 8563199 - DNA, 22 bp, Homo sapiens
tgctggctttttgtgtcaaaga

SEQ ID NO: 8563200 - DNA, 22 bp, Homo sapiens
tgctggctttttggtccttgct

SEQ ID NO: 8563201 - DNA, 22 bp, Homo sapiens
tgctggctttttgtgtcaaaga

SEQ ID NO: 8563202 - DNA, 22 bp, Homo sapiens
tgctgggatatagcttctaggg

SEQ ID NO: 8563203 - DNA, 22 bp, Homo sapiens
tgctgggcacacagtaggtgct

SEQ ID NO: 8563204 - DNA, 22 bp, Homo sapiens
tgctgggatatagcttctaggg

SEQ ID NO: 8563205 - DNA, 22 bp, Homo sapiens
ccccttccttcctcagacagcc

SEQ ID NO: 8563206 - DNA, 22 bp, Homo sapiens
ccccttccgtctcttgagtgtc

SEQ ID NO: 8563207 - DNA, 22 bp, Homo sapiens
ccccttccgtctcttgagtgtc

SEQ ID NO: 8563208 - DNA, 22 bp, Homo sapiens
ccccttccttcctcagacagcc

SEQ ID NO: 8563209 - DNA, 22 bp, Homo sapiens
ccccttccttcctcagacagcc

SEQ ID NO: 8563210 - DNA, 23 bp, Homo sapiens
cccctctggtggctcagctcctg

SEQ ID NO: 8563211 - DNA, 22 bp, Homo sapiens
ccccttccaggaagcagaatcg

SEQ ID NO: 8563212 - DNA, 22 bp, Homo sapiens
cccctcttgtactagacagttt

SEQ ID NO: 8563213 - DNA, 22 bp, Homo sapiens
ccccttctgtgtcctgtcagcc

SEQ ID NO: 8563214 - DNA, 22 bp, Homo sapiens
cccggacagaggggcagagtgt

SEQ ID NO: 8563215 - DNA, 21 bp, Homo sapiens
cccgcacagcggtaggccgcc

SEQ ID NO: 8563216 - DNA, 22 bp, Homo sapiens
cccgactagctgggattacagg

SEQ ID NO: 8563217 - DNA, 22 bp, Homo sapiens
cccgagcctcggtttcttttct

SEQ ID NO: 8563218 - DNA, 22 bp, Homo sapiens
cccgaggaaccagaggtagctc

SEQ ID NO: 8563219 - DNA, 22 bp, Homo sapiens
tgctggcctgggctgcaccttg

SEQ ID NO: 8563220 - DNA, 21 bp, Homo sapiens
tgctggcctcaagggtgactt

SEQ ID NO: 8563221 - DNA, 21 bp, Homo sapiens
tgctggcctcaagggtgactt

SEQ ID NO: 8563222 - DNA, 22 bp, Homo sapiens
tgctggccctggctcagggaac

SEQ ID NO: 8563223 - DNA, 22 bp, Homo sapiens
tgctggccctggctcagggaac

SEQ ID NO: 8563224 - DNA, 22 bp, Homo sapiens
tgctggccggccaggtgctgag

SEQ ID NO: 8563225 - DNA, 22 bp, Homo sapiens
tgctggcccatgaagacgcagt

SEQ ID NO: 8563226 - DNA, 22 bp, Homo sapiens
tgctggcccagtatggactgca

SEQ ID NO: 8563227 - DNA, 22 bp, Homo sapiens
tgctggcccagtatggactgca

SEQ ID NO: 8563228 - DNA, 22 bp, Homo sapiens
tgctggcctgtccacgggctgt

SEQ ID NO: 8563229 - DNA, 22 bp, Homo sapiens
tgctggctttgcgagatgcatt

SEQ ID NO: 8563230 - DNA, 22 bp, Homo sapiens
ccccacagtccgtgaggagcca

SEQ ID NO: 8563231 - DNA, 22 bp, Homo sapiens
ccccacagccgccagcagggag

SEQ ID NO: 8563232 - DNA, 22 bp, Homo sapiens
ccccacactctttacattcata

SEQ ID NO: 8563233 - DNA, 22 bp, Homo sapiens
ccccacacctgccgggcagcag

SEQ ID NO: 8563234 - DNA, 20 bp, Homo sapiens
ccccacactattgagcactt

SEQ ID NO: 8563235 - DNA, 22 bp, Homo sapiens
ccccacaactcatgttgaaact

SEQ ID NO: 8563236 - DNA, 22 bp, Homo sapiens
ccccaaggtgctcactgtctgg

SEQ ID NO: 8563237 - DNA, 22 bp, Homo sapiens
ccccacaactcatgttgaaact

SEQ ID NO: 8563238 - DNA, 22 bp, Homo sapiens
ccccacacctgccgggcagcag

SEQ ID NO: 8563239 - DNA, 22 bp, Homo sapiens
ccccaccctcgctccatttcgg

SEQ ID NO: 8563240 - DNA, 22 bp, Homo sapiens
tgctggagcccaggcggccttt

SEQ ID NO: 8563241 - DNA, 22 bp, Homo sapiens
tgctggagcccaggcggccttt

SEQ ID NO: 8563242 - DNA, 22 bp, Homo sapiens
tgctggccaatggcagaggcgg

SEQ ID NO: 8563243 - DNA, 22 bp, Homo sapiens
ccccaccatgtagaaactgaga

SEQ ID NO: 8563244 - DNA, 22 bp, Homo sapiens
ccccaccaccaaggctcagttt

SEQ ID NO: 8563245 - DNA, 22 bp, Homo sapiens
ccccacccacctaagagaaact

SEQ ID NO: 8563246 - DNA, 22 bp, Homo sapiens
ccccaccctcgctccatttcgg

SEQ ID NO: 8563247 - DNA, 22 bp, Homo sapiens
cccatttttgtgtgagtaatga

SEQ ID NO: 8563248 - DNA, 22 bp, Homo sapiens
ccccaaagtgttggataattga

SEQ ID NO: 8563249 - DNA, 19 bp, Homo sapiens
ccccaaagtttagatgttg

SEQ ID NO: 8563250 - DNA, 19 bp, Homo sapiens
ccccaaagtttagatgttg

SEQ ID NO: 8563251 - DNA, 22 bp, Homo sapiens
ccccaaccctggttccgtggcg

SEQ ID NO: 8563252 - DNA, 22 bp, Homo sapiens
ccccaaagctgagttcccgcct

SEQ ID NO: 8563253 - DNA, 22 bp, Homo sapiens
ccccaaagcctcagcctgcctg

SEQ ID NO: 8563254 - DNA, 22 bp, Homo sapiens
cccatttatcccaaggttactc

SEQ ID NO: 8563255 - DNA, 23 bp, Homo sapiens
cccattttcatgttaactcctgg

SEQ ID NO: 8563256 - DNA, 23 bp, Homo sapiens
cccattttcatgttaactcctgg

SEQ ID NO: 8563257 - DNA, 22 bp, Homo sapiens
cccatttaaacacaagctttca

SEQ ID NO: 8563258 - DNA, 22 bp, Homo sapiens
cccatttagataacagttcaaa

SEQ ID NO: 8563259 - DNA, 22 bp, Homo sapiens
cccaggtccccacctgtctgct

SEQ ID NO: 8563260 - DNA, 22 bp, Homo sapiens
cccaggtccccacctgtctgct

SEQ ID NO: 8563261 - DNA, 22 bp, Homo sapiens
cccaggtcccgccccagctcta

SEQ ID NO: 8563262 - DNA, 22 bp, Homo sapiens
cccaggtcccggggccagctgc

SEQ ID NO: 8563263 - DNA, 22 bp, Homo sapiens
cccaggtctatgccagctctga

SEQ ID NO: 8563264 - DNA, 22 bp, Homo sapiens
cccagttgttgccggctctgga

SEQ ID NO: 8563265 - DNA, 22 bp, Homo sapiens
cccattcatcctcgcttccttc

SEQ ID NO: 8563266 - DNA, 22 bp, Homo sapiens
cccagttgttgccggctctgga

SEQ ID NO: 8563267 - DNA, 22 bp, Homo sapiens
cccattcatcctcgcttccttc

SEQ ID NO: 8563268 - DNA, 22 bp, Homo sapiens
cccattcatcctcgcttccttc

SEQ ID NO: 8563269 - DNA, 22 bp, Homo sapiens
cccattcatcctcgcttccttc

SEQ ID NO: 8563270 - DNA, 22 bp, Homo sapiens
cccattccctttactgttgcat

SEQ ID NO: 8563271 - DNA, 22 bp, Homo sapiens
ccctcgggtcgcggactgcgct

SEQ ID NO: 8563272 - DNA, 22 bp, Homo sapiens
ccctctacagggaagcgctttc

SEQ ID NO: 8563273 - DNA, 22 bp, Homo sapiens
ccctcgccgcagctgcttcccg

SEQ ID NO: 8563274 - DNA, 22 bp, Homo sapiens
ccctcgctctaggcagccctgt

SEQ ID NO: 8563275 - DNA, 22 bp, Homo sapiens
ccctcctggaggcggatgccca

SEQ ID NO: 8563276 - DNA, 22 bp, Homo sapiens
ccctcctgtgcctgaggccagc

SEQ ID NO: 8563277 - DNA, 22 bp, Homo sapiens
ccctcctctccctaagagtcac

SEQ ID NO: 8563278 - DNA, 20 bp, Homo sapiens
tggaatgggtccttgaaaaa

SEQ ID NO: 8563279 - DNA, 22 bp, Homo sapiens
tggaatgtaaactctgtgaggg

SEQ ID NO: 8563280 - DNA, 22 bp, Homo sapiens
tggaatgtgaacatacaaggta

SEQ ID NO: 8563281 - DNA, 22 bp, Homo sapiens
tggaatgtgctagggctgtggc

SEQ ID NO: 8563282 - DNA, 22 bp, Homo sapiens
tggaatgtgctagggctgtggc

SEQ ID NO: 8563283 - DNA, 22 bp, Homo sapiens
tggaatgtcataccataaaaga

SEQ ID NO: 8563284 - DNA, 22 bp, Homo sapiens
tggaatggaaacaaactgagga

SEQ ID NO: 8563285 - DNA, 22 bp, Homo sapiens
tggaatggaaacaaactgagga

SEQ ID NO: 8563286 - DNA, 22 bp, Homo sapiens
tggaatggaaacaaactgagga

SEQ ID NO: 8563287 - DNA, 22 bp, Homo sapiens
tgctgttatacttagctggtta

SEQ ID NO: 8563288 - DNA, 22 bp, Homo sapiens
tgctgtgttctcctgactcacc

SEQ ID NO: 8563289 - DNA, 22 bp, Homo sapiens
tgctgtgttctcctgactcacc

SEQ ID NO: 8563290 - DNA, 22 bp, Homo sapiens
tggaagggagctggaatttgga

SEQ ID NO: 8563291 - DNA, 22 bp, Homo sapiens
tggaagggagctggaatttgga

SEQ ID NO: 8563292 - DNA, 22 bp, Homo sapiens
tggaagggagctggaatttgga

SEQ ID NO: 8563293 - DNA, 22 bp, Homo sapiens
tgctgtgttcctcagtttcatg

SEQ ID NO: 8563294 - DNA, 22 bp, Homo sapiens
tgctgtgttcaccaatatgtgt

SEQ ID NO: 8563295 - DNA, 22 bp, Homo sapiens
tgctgtgttcaccaatatgtgt

SEQ ID NO: 8563296 - DNA, 22 bp, Homo sapiens
tgctgtgttactgagatccggc

SEQ ID NO: 8563297 - DNA, 22 bp, Homo sapiens
tgctgtgttaaatacaagcatg

SEQ ID NO: 8563298 - DNA, 22 bp, Homo sapiens
tgctgtgtggatgtgaagaatc

SEQ ID NO: 8563299 - DNA, 20 bp, Homo sapiens
tgctgtgtggcccagcatga

SEQ ID NO: 8563300 - DNA, 22 bp, Homo sapiens
tgctgtgtaaaaggtgattgaa

SEQ ID NO: 8563301 - DNA, 22 bp, Homo sapiens
tgctgtgtggatgtgaagaatc

SEQ ID NO: 8563302 - DNA, 22 bp, Homo sapiens
tgctgtgtctttctgtgaaaag

SEQ ID NO: 8563303 - DNA, 22 bp, Homo sapiens
tgctgtgtggatgtgaagaatc

SEQ ID NO: 8563304 - DNA, 22 bp, Homo sapiens
tgctgtgctccattgtcttcac

SEQ ID NO: 8563305 - DNA, 18 bp, Homo sapiens
cccggctaatttttggta

SEQ ID NO: 8563306 - DNA, 18 bp, Homo sapiens
cccggctaatttttggta

SEQ ID NO: 8563307 - DNA, 18 bp, Homo sapiens
cccggctaatttttggta

SEQ ID NO: 8563308 - DNA, 22 bp, Homo sapiens
tgctgtgctggcggcagaggcc

SEQ ID NO: 8563309 - DNA, 22 bp, Homo sapiens
tgctgtggattcagagatgaaa

SEQ ID NO: 8563310 - DNA, 22 bp, Homo sapiens
tgctgtggttcccagagtggat

SEQ ID NO: 8563311 - DNA, 22 bp, Homo sapiens
tgctgtggcagtttatgtatag

SEQ ID NO: 8563312 - DNA, 22 bp, Homo sapiens
tgctgtggcagtttatgtatag

SEQ ID NO: 8563313 - DNA, 22 bp, Homo sapiens
tgctgtgtaaaaggtgattgaa

SEQ ID NO: 8563314 - DNA, 22 bp, Homo sapiens
tgctgtgtctttctgtgaaaag

SEQ ID NO: 8563315 - DNA, 22 bp, Homo sapiens
tgctgtgtaaaaggtgattgaa

SEQ ID NO: 8563316 - DNA, 22 bp, Homo sapiens
ccctgagcattcatgtgagctt

SEQ ID NO: 8563317 - DNA, 22 bp, Homo sapiens
ccctgagcccatagttgacatt

SEQ ID NO: 8563318 - DNA, 22 bp, Homo sapiens
ccctgagcccatagttgacatt

SEQ ID NO: 8563319 - DNA, 22 bp, Homo sapiens
ccctgagccacacagagcaggt

SEQ ID NO: 8563320 - DNA, 22 bp, Homo sapiens
ccctgagccacacagagcaggt

SEQ ID NO: 8563321 - DNA, 22 bp, Homo sapiens
ccctgagccgctgctccaacct

SEQ ID NO: 8563322 - DNA, 22 bp, Homo sapiens
ccctgagccgctgctccaacct

SEQ ID NO: 8563323 - DNA, 22 bp, Homo sapiens
ccctgagcccatagttgacatt

SEQ ID NO: 8563324 - DNA, 22 bp, Homo sapiens
ccctgagatgtgaatttcagag

SEQ ID NO: 8563325 - DNA, 22 bp, Homo sapiens
ccctgagcaacaaactgaatac

SEQ ID NO: 8563326 - DNA, 22 bp, Homo sapiens
ccctgagcacacctggcagaca

SEQ ID NO: 8563327 - DNA, 22 bp, Homo sapiens
ccctgagcacacctggcagaca

SEQ ID NO: 8563328 - DNA, 22 bp, Homo sapiens
ccctgagcagtctgcagagagc

SEQ ID NO: 8563329 - DNA, 22 bp, Homo sapiens
ccctgagagtgagtgccacctt

SEQ ID NO: 8563330 - DNA, 22 bp, Homo sapiens
ccctgagatgcctcaccctagt

SEQ ID NO: 8563331 - DNA, 18 bp, Homo sapiens
ccctgagatgatgctgtg

SEQ ID NO: 8563332 - DNA, 22 bp, Homo sapiens
tggagcaggactgctgccctca

SEQ ID NO: 8563333 - DNA, 16 bp, Homo sapiens
tggagcaggcaggatg

SEQ ID NO: 8563334 - DNA, 22 bp, Homo sapiens
tggagcaggcatctttctctct

SEQ ID NO: 8563335 - DNA, 22 bp, Homo sapiens
tggagcaggactgctgccctca

SEQ ID NO: 8563336 - DNA, 22 bp, Homo sapiens
tggagcaggacggggagtggta

SEQ ID NO: 8563337 - DNA, 22 bp, Homo sapiens
tggagcaggacggggagtggta

SEQ ID NO: 8563338 - DNA, 22 bp, Homo sapiens
tggagcaagctggagagaacat

SEQ ID NO: 8563339 - DNA, 22 bp, Homo sapiens
ccctgaggaaagggtggagggc

SEQ ID NO: 8563340 - DNA, 23 bp, Homo sapiens
ccctgagctggtccaggctcaac

SEQ ID NO: 8563341 - DNA, 22 bp, Homo sapiens
ccctgaggaaagggtggagggc

SEQ ID NO: 8563342 - DNA, 20 bp, Homo sapiens
ccctgagaccagagagcagc

SEQ ID NO: 8563343 - DNA, 20 bp, Homo sapiens
ccctgagaccagagagcagc

SEQ ID NO: 8563344 - DNA, 20 bp, Homo sapiens
ccctgagaccagagagcagc

SEQ ID NO: 8563345 - DNA, 20 bp, Homo sapiens
ccctgagaccagagagcagc

SEQ ID NO: 8563346 - DNA, 20 bp, Homo sapiens
ccctgagacaaaggaggggc

SEQ ID NO: 8563347 - DNA, 20 bp, Homo sapiens
ccctgagacaaaggaggggc

SEQ ID NO: 8563348 - DNA, 20 bp, Homo sapiens
ccctgagacaaaggaggggc

SEQ ID NO: 8563349 - DNA, 20 bp, Homo sapiens
ccctgagacaaaggaggggc

SEQ ID NO: 8563350 - DNA, 22 bp, Homo sapiens
ccctgagaacaacttaggggtc

SEQ ID NO: 8563351 - DNA, 22 bp, Homo sapiens
ccctgactcggcgcgctcccgt

SEQ ID NO: 8563352 - DNA, 22 bp, Homo sapiens
ccctgaccctatcagagggcca

SEQ ID NO: 8563353 - DNA, 22 bp, Homo sapiens
ccctgacccaaaactgtcagaa

SEQ ID NO: 8563354 - DNA, 22 bp, Homo sapiens
ccctgaaagtacactgggacgg

SEQ ID NO: 8563355 - DNA, 22 bp, Homo sapiens
ccctgaaatcctgtgctctgtg

SEQ ID NO: 8563356 - DNA, 22 bp, Homo sapiens
ccctgaaatcctgtgctctgtg

SEQ ID NO: 8563357 - DNA, 19 bp, Homo sapiens
ccctcttgcacaaagcaaa

SEQ ID NO: 8563358 - DNA, 19 bp, Homo sapiens
ccctcttgcacaaagcaaa

SEQ ID NO: 8563359 - DNA, 22 bp, Homo sapiens
ccctctcctggctgcatggagc

SEQ ID NO: 8563360 - DNA, 22 bp, Homo sapiens
ccctctcctggctgcatggagc

SEQ ID NO: 8563361 - DNA, 18 bp, Homo sapiens
ccctctcctgctagtggg

SEQ ID NO: 8563362 - DNA, 18 bp, Homo sapiens
ccctctcctgctagtggg

SEQ ID NO: 8563363 - DNA, 18 bp, Homo sapiens
ccctctcctgctagtggg

SEQ ID NO: 8563364 - DNA, 22 bp, Homo sapiens
catctgctgttccttggactca

SEQ ID NO: 8563365 - DNA, 22 bp, Homo sapiens
catctggacaaaactctgaagg

SEQ ID NO: 8563366 - DNA, 22 bp, Homo sapiens
catctgctgttccttggactca

SEQ ID NO: 8563367 - DNA, 22 bp, Homo sapiens
catctgctgttccttggactca

SEQ ID NO: 8563368 - DNA, 22 bp, Homo sapiens
catctgctgttccttggactca

SEQ ID NO: 8563369 - DNA, 22 bp, Homo sapiens
catctggcagaccctgcctccg

SEQ ID NO: 8563370 - DNA, 19 bp, Homo sapiens
catctggatgattctcctg

SEQ ID NO: 8563371 - DNA, 19 bp, Homo sapiens
catctggatgattctcctg

SEQ ID NO: 8563372 - DNA, 19 bp, Homo sapiens
catctggatgattctcctg

SEQ ID NO: 8563373 - DNA, 19 bp, Homo sapiens
catctggatgattctcctg

SEQ ID NO: 8563374 - DNA, 22 bp, Homo sapiens
catctgtagctccatgacaatt

SEQ ID NO: 8563375 - DNA, 22 bp, Homo sapiens
catctgtaaagtaggaatattg

SEQ ID NO: 8563376 - DNA, 22 bp, Homo sapiens
catctgaaatctgcctacaagc

SEQ ID NO: 8563377 - DNA, 22 bp, Homo sapiens
catctgaagtgaattgcttttt

SEQ ID NO: 8563378 - DNA, 22 bp, Homo sapiens
catctgaatttgccttagtttc

SEQ ID NO: 8563379 - DNA, 22 bp, Homo sapiens
catctgaatatcccaggcatat

SEQ ID NO: 8563380 - DNA, 22 bp, Homo sapiens
catctgaataaagacttgcaga

SEQ ID NO: 8563381 - DNA, 22 bp, Homo sapiens
catctgaataaagacttgcaga

SEQ ID NO: 8563382 - DNA, 22 bp, Homo sapiens
catctgaatttgccttagtttc

SEQ ID NO: 8563383 - DNA, 22 bp, Homo sapiens
catctgagggaaaacatgtagt

SEQ ID NO: 8563384 - DNA, 22 bp, Homo sapiens
catctgctgacttgacaagtac

SEQ ID NO: 8563385 - DNA, 22 bp, Homo sapiens
catctgctctgtctgccatgtt

SEQ ID NO: 8563386 - DNA, 22 bp, Homo sapiens
catctgctgtaattaacaagcc

SEQ ID NO: 8563387 - DNA, 22 bp, Homo sapiens
catctgctgttccttggactca

SEQ ID NO: 8563388 - DNA, 17 bp, Homo sapiens
catctgctctgcccctt

SEQ ID NO: 8563389 - DNA, 22 bp, Homo sapiens
catctgcctaagtggccctgtt

SEQ ID NO: 8563390 - DNA, 22 bp, Homo sapiens
catctgttctatccacgttgct

SEQ ID NO: 8563391 - DNA, 22 bp, Homo sapiens
catctgtgccgggtgtttgtca

SEQ ID NO: 8563392 - DNA, 22 bp, Homo sapiens
catctgtttttgtcaattacat

SEQ ID NO: 8563393 - DNA, 22 bp, Homo sapiens
catcttaaattaaagcttaagg

SEQ ID NO: 8563394 - DNA, 22 bp, Homo sapiens
catctgttgcttcctaacaagt

SEQ ID NO: 8563395 - DNA, 22 bp, Homo sapiens
catctgtttcctaatctgtagc

SEQ ID NO: 8563396 - DNA, 22 bp, Homo sapiens
catgaaaataacattgttgtga

SEQ ID NO: 8563397 - DNA, 22 bp, Homo sapiens
catgaaaataacattgttgtga

SEQ ID NO: 8563398 - DNA, 22 bp, Homo sapiens
catgaaaataacattgttgtga

SEQ ID NO: 8563399 - DNA, 22 bp, Homo sapiens
catgaactccaagcttccttcc

SEQ ID NO: 8563400 - DNA, 22 bp, Homo sapiens
catgaagcatgttttgtcatga

SEQ ID NO: 8563401 - DNA, 22 bp, Homo sapiens
catgaacagattcttcatttct

SEQ ID NO: 8563402 - DNA, 22 bp, Homo sapiens
catgaacagctaacattttggg

SEQ ID NO: 8563403 - DNA, 21 bp, Homo sapiens
catgaacatgcttatcctcag

SEQ ID NO: 8563404 - DNA, 22 bp, Homo sapiens
catgaacattcagaaatacagc

SEQ ID NO: 8563405 - DNA, 22 bp, Homo sapiens
catgaacaccaggcatgaacaa

SEQ ID NO: 8563406 - DNA, 22 bp, Homo sapiens
catgaacaaattctgtttgagg

SEQ ID NO: 8563407 - DNA, 22 bp, Homo sapiens
catgaacaaattctgtttgagg

SEQ ID NO: 8563408 - DNA, 22 bp, Homo sapiens
catgaacaatttgctcactgat

SEQ ID NO: 8563409 - DNA, 22 bp, Homo sapiens
tcagtcccttaaaggtggcagc

SEQ ID NO: 8563410 - DNA, 22 bp, Homo sapiens
tcagtccaggggctgtgatgtc

SEQ ID NO: 8563411 - DNA, 22 bp, Homo sapiens
tcagtccagctcctcatttccc

SEQ ID NO: 8563412 - DNA, 22 bp, Homo sapiens
tcagtccataggtgggcctgag

SEQ ID NO: 8563413 - DNA, 22 bp, Homo sapiens
tcagtcccaaggtcctgaggtg

SEQ ID NO: 8563414 - DNA, 22 bp, Homo sapiens
tcagtgctgagtagcgtgcacc

SEQ ID NO: 8563415 - DNA, 19 bp, Homo sapiens
tcagtgctcctatgtcctt

SEQ ID NO: 8563416 - DNA, 22 bp, Homo sapiens
tcagtgctctgaggtccagggt

SEQ ID NO: 8563417 - DNA, 22 bp, Homo sapiens
tcagtgctgctttatgacagtt

SEQ ID NO: 8563418 - DNA, 22 bp, Homo sapiens
catctcacttccctgcagcatc

SEQ ID NO: 8563419 - DNA, 22 bp, Homo sapiens
catctcttgccaaagtttgacc

SEQ ID NO: 8563420 - DNA, 22 bp, Homo sapiens
catctcttgccaaagtttgacc

SEQ ID NO: 8563421 - DNA, 22 bp, Homo sapiens
tcagtgcctactttgatcaatt

SEQ ID NO: 8563422 - DNA, 22 bp, Homo sapiens
tcagtgccatgggcagacaggc

SEQ ID NO: 8563423 - DNA, 20 bp, Homo sapiens
tcagtgctcaggcaccaggt

SEQ ID NO: 8563424 - DNA, 20 bp, Homo sapiens
tcagtgctcaggcaccaggt

SEQ ID NO: 8563425 - DNA, 22 bp, Homo sapiens
tcagtgctcctaaagtgaatgc

SEQ ID NO: 8563426 - DNA, 22 bp, Homo sapiens
tcagtgctcctaaagtgaatgc

SEQ ID NO: 8563427 - DNA, 22 bp, Homo sapiens
tcagtgctcaggggagccgagg

SEQ ID NO: 8563428 - DNA, 19 bp, Homo sapiens
tcagggagtttacagcatg

SEQ ID NO: 8563429 - DNA, 22 bp, Homo sapiens
tcagggagatttggggactcaa

SEQ ID NO: 8563430 - DNA, 22 bp, Homo sapiens
tcagggagggacctgaggctgg

SEQ ID NO: 8563431 - DNA, 22 bp, Homo sapiens
tcagggagggacctgaggctgg

SEQ ID NO: 8563432 - DNA, 22 bp, Homo sapiens
tcagggagcctggacttcaagg

SEQ ID NO: 8563433 - DNA, 21 bp, Homo sapiens
tcagtcattgcctccttctgg

SEQ ID NO: 8563434 - DNA, 22 bp, Homo sapiens
tcagtcatcccagctttcatct

SEQ ID NO: 8563435 - DNA, 22 bp, Homo sapiens
tcagtcacactcactgaggtag

SEQ ID NO: 8563436 - DNA, 22 bp, Homo sapiens
tcagtcaacataaatccaaggt

SEQ ID NO: 8563437 - DNA, 22 bp, Homo sapiens
catggcagcaattttcctgact

SEQ ID NO: 8563438 - DNA, 22 bp, Homo sapiens
catggcaggaaggacatgcact

SEQ ID NO: 8563439 - DNA, 22 bp, Homo sapiens
catggcaggaaaatgaacaggc

SEQ ID NO: 8563440 - DNA, 22 bp, Homo sapiens
catggcagctttgggaggagga

SEQ ID NO: 8563441 - DNA, 22 bp, Homo sapiens
catggaaggcaaaagacacaga

SEQ ID NO: 8563442 - DNA, 22 bp, Homo sapiens
catggaaggcaaaagacacaga

SEQ ID NO: 8563443 - DNA, 22 bp, Homo sapiens
catggaaggcaaaagacacaga

SEQ ID NO: 8563444 - DNA, 22 bp, Homo sapiens
catggaaggcaaaagacacaga

SEQ ID NO: 8563445 - DNA, 22 bp, Homo sapiens
catggcagagaaggggaactgg

SEQ ID NO: 8563446 - DNA, 22 bp, Homo sapiens
catggcagagcctgcaggtggg

SEQ ID NO: 8563447 - DNA, 22 bp, Homo sapiens
catggaactgtataaaggcact

SEQ ID NO: 8563448 - DNA, 22 bp, Homo sapiens
catgcattttctattcactcag

SEQ ID NO: 8563449 - DNA, 22 bp, Homo sapiens
catgcatttctaccaaggaata

SEQ ID NO: 8563450 - DNA, 22 bp, Homo sapiens
catgcatttggagttttcaagt

SEQ ID NO: 8563451 - DNA, 22 bp, Homo sapiens
catgcatgcctggctcacagag

SEQ ID NO: 8563452 - DNA, 22 bp, Homo sapiens
catgcatggtcatgctgggact

SEQ ID NO: 8563453 - DNA, 22 bp, Homo sapiens
catgcatgtcagggatcctgga

SEQ ID NO: 8563454 - DNA, 22 bp, Homo sapiens
catgcatgtttactacagtgac

SEQ ID NO: 8563455 - DNA, 22 bp, Homo sapiens
catgcatgtttactacagtgac

SEQ ID NO: 8563456 - DNA, 22 bp, Homo sapiens
catgcattcagaatctctcaca

SEQ ID NO: 8563457 - DNA, 22 bp, Homo sapiens
catgcattacaattgcatagta

SEQ ID NO: 8563458 - DNA, 22 bp, Homo sapiens
catgcattcctcctctgcctta

SEQ ID NO: 8563459 - DNA, 22 bp, Homo sapiens
catgcattgtaatttttagtct

SEQ ID NO: 8563460 - DNA, 22 bp, Homo sapiens
catgcattcagaatctctcaca

SEQ ID NO: 8563461 - DNA, 22 bp, Homo sapiens
tccaggagaaggccatccagcg

SEQ ID NO: 8563462 - DNA, 22 bp, Homo sapiens
tccaggagaaggccatccagcg

SEQ ID NO: 8563463 - DNA, 22 bp, Homo sapiens
tccaggagaaggccatccagcg

SEQ ID NO: 8563464 - DNA, 22 bp, Homo sapiens
tccagctggggacatgggcttc

SEQ ID NO: 8563465 - DNA, 20 bp, Homo sapiens
tccagctgggaacagctgat

SEQ ID NO: 8563466 - DNA, 20 bp, Homo sapiens
tccagctgggaacagctgat

SEQ ID NO: 8563467 - DNA, 20 bp, Homo sapiens
tccagctgggaacagctgat

SEQ ID NO: 8563468 - DNA, 22 bp, Homo sapiens
catggcaggaggctgctggcag

SEQ ID NO: 8563469 - DNA, 22 bp, Homo sapiens
catggcaggtgcagattctgtg

SEQ ID NO: 8563470 - DNA, 22 bp, Homo sapiens
catggcaggtgcagattctgtg

SEQ ID NO: 8563471 - DNA, 22 bp, Homo sapiens
catggcaggtgcagattctgtg

SEQ ID NO: 8563472 - DNA, 22 bp, Homo sapiens
catgcagtattcaggacagttc

SEQ ID NO: 8563473 - DNA, 22 bp, Homo sapiens
catgcagtcaataaacatgtgt

SEQ ID NO: 8563474 - DNA, 22 bp, Homo sapiens
catgcagtctggagccttctgt

SEQ ID NO: 8563475 - DNA, 22 bp, Homo sapiens
catgcagtgaaattgatatcca

SEQ ID NO: 8563476 - DNA, 22 bp, Homo sapiens
catgcagtgactcagacacagg

SEQ ID NO: 8563477 - DNA, 22 bp, Homo sapiens
catgcagggagcagaggagaca

SEQ ID NO: 8563478 - DNA, 22 bp, Homo sapiens
catgcagggagcagaggagaca

SEQ ID NO: 8563479 - DNA, 22 bp, Homo sapiens
catgcagggagtgctcctatta

SEQ ID NO: 8563480 - DNA, 22 bp, Homo sapiens
catgcagggagcagaggagaca

SEQ ID NO: 8563481 - DNA, 22 bp, Homo sapiens
catgcagggactagagaacagg

SEQ ID NO: 8563482 - DNA, 22 bp, Homo sapiens
catgcagggactagagaacagg

SEQ ID NO: 8563483 - DNA, 22 bp, Homo sapiens
catgcagtttctctatgcgtag

SEQ ID NO: 8563484 - DNA, 22 bp, Homo sapiens
catgcatacacaggtcaggcag

SEQ ID NO: 8563485 - DNA, 22 bp, Homo sapiens
catgcagtgcctctggattctt

SEQ ID NO: 8563486 - DNA, 22 bp, Homo sapiens
catgcagtggtaaaaagtcagg

SEQ ID NO: 8563487 - DNA, 22 bp, Homo sapiens
catgcagttgaagcacagagag

SEQ ID NO: 8563488 - DNA, 22 bp, Homo sapiens
catgcatcgatgaatgcgtggg

SEQ ID NO: 8563489 - DNA, 22 bp, Homo sapiens
catgcatattactagcacagca

SEQ ID NO: 8563490 - DNA, 22 bp, Homo sapiens
catgcatattactagcacagca

SEQ ID NO: 8563491 - DNA, 22 bp, Homo sapiens
catgcatattactagcacagca

SEQ ID NO: 8563492 - DNA, 22 bp, Homo sapiens
catgcatgccgggctgacagag

SEQ ID NO: 8563493 - DNA, 22 bp, Homo sapiens
catgcatgccgggctgacagag

SEQ ID NO: 8563494 - DNA, 22 bp, Homo sapiens
catgcatgccgggctgacagag

SEQ ID NO: 8563495 - DNA, 20 bp, Homo sapiens
catgcatgacactggaaagg

SEQ ID NO: 8563496 - DNA, 22 bp, Homo sapiens
catgcatatgtcaaaaaagcta

SEQ ID NO: 8563497 - DNA, 22 bp, Homo sapiens
catgcatagctttggagctagg

SEQ ID NO: 8563498 - DNA, 22 bp, Homo sapiens
catgacagtcctgaagagaacg

SEQ ID NO: 8563499 - DNA, 20 bp, Homo sapiens
catgacactgttcctctgcc

SEQ ID NO: 8563500 - DNA, 22 bp, Homo sapiens
catgacagatgcaaaggattgg

SEQ ID NO: 8563501 - DNA, 22 bp, Homo sapiens
catgagaaccaggtctgtgttt

SEQ ID NO: 8563502 - DNA, 22 bp, Homo sapiens
catgcacacacgtgcatgtacg

SEQ ID NO: 8563503 - DNA, 22 bp, Homo sapiens
catgcacacacgtgcatgtacg

SEQ ID NO: 8563504 - DNA, 22 bp, Homo sapiens
catgcacacacagttctaatta

SEQ ID NO: 8563505 - DNA, 22 bp, Homo sapiens
catgcacacacagttctaatta

SEQ ID NO: 8563506 - DNA, 20 bp, Homo sapiens
catgagaagggcagtgtgag

SEQ ID NO: 8563507 - DNA, 22 bp, Homo sapiens
catgagaaccaggtctgtgttt

SEQ ID NO: 8563508 - DNA, 22 bp, Homo sapiens
catgagaaccaggtctgtgttt

SEQ ID NO: 8563509 - DNA, 22 bp, Homo sapiens
catgacacccaggcatagcacc

SEQ ID NO: 8563510 - DNA, 22 bp, Homo sapiens
catgaatttatattattagtga

SEQ ID NO: 8563511 - DNA, 22 bp, Homo sapiens
catgaatatacatcctgatggc

SEQ ID NO: 8563512 - DNA, 22 bp, Homo sapiens
catgaatatttagtatttactt

SEQ ID NO: 8563513 - DNA, 22 bp, Homo sapiens
catgaaggaataattgtttaga

SEQ ID NO: 8563514 - DNA, 22 bp, Homo sapiens
catgaaggaccatttcacggtc

SEQ ID NO: 8563515 - DNA, 22 bp, Homo sapiens
tcagcaggtctgaggcggggcc

SEQ ID NO: 8563516 - DNA, 22 bp, Homo sapiens
tcagcagggtttgacttctaat

SEQ ID NO: 8563517 - DNA, 22 bp, Homo sapiens
tcagcaggtctgaggcggggcc

SEQ ID NO: 8563518 - DNA, 22 bp, Homo sapiens
tcagcaggtggtgggcaggtga

SEQ ID NO: 8563519 - DNA, 22 bp, Homo sapiens
tcagcaggtggtgggcaggtga

SEQ ID NO: 8563520 - DNA, 22 bp, Homo sapiens
tcagcagtagagggggcacagt

SEQ ID NO: 8563521 - DNA, 22 bp, Homo sapiens
cataatatctccgattacttgc

SEQ ID NO: 8563522 - DNA, 22 bp, Homo sapiens
cataatatctccgattacttgc

SEQ ID NO: 8563523 - DNA, 22 bp, Homo sapiens
cataacatccttgctactttga

SEQ ID NO: 8563524 - DNA, 22 bp, Homo sapiens
tcagcagtcctccaggatcaag

SEQ ID NO: 8563525 - DNA, 22 bp, Homo sapiens
cataacatccttgctactttga

SEQ ID NO: 8563526 - DNA, 22 bp, Homo sapiens
cataatccttgattcaaataat

SEQ ID NO: 8563527 - DNA, 22 bp, Homo sapiens
cataatcagatgtgtacataag

SEQ ID NO: 8563528 - DNA, 22 bp, Homo sapiens
cataatcccccatttgtgacat

SEQ ID NO: 8563529 - DNA, 22 bp, Homo sapiens
cataatcccaggcttgcattca

SEQ ID NO: 8563530 - DNA, 22 bp, Homo sapiens
cataatcccaggcttgcattca

SEQ ID NO: 8563531 - DNA, 22 bp, Homo sapiens
cataatccatttgcactgcaga

SEQ ID NO: 8563532 - DNA, 22 bp, Homo sapiens
cataatcctggtgtagccctct

SEQ ID NO: 8563533 - DNA, 22 bp, Homo sapiens
cataatcctggtgtagccctct

SEQ ID NO: 8563534 - DNA, 22 bp, Homo sapiens
cataatccttgattcaaataat

SEQ ID NO: 8563535 - DNA, 22 bp, Homo sapiens
cataatcctgtcctggattctt

SEQ ID NO: 8563536 - DNA, 22 bp, Homo sapiens
cataatttcccaagagattgaa

SEQ ID NO: 8563537 - DNA, 22 bp, Homo sapiens
cataattagtcatgttatgcat

SEQ ID NO: 8563538 - DNA, 22 bp, Homo sapiens
cataattataaacgcaagttca

SEQ ID NO: 8563539 - DNA, 22 bp, Homo sapiens
cataattataaacgcaagttca

SEQ ID NO: 8563540 - DNA, 22 bp, Homo sapiens
cataattaggcagttgatcatt

SEQ ID NO: 8563541 - DNA, 22 bp, Homo sapiens
cataattaggcagttgatcatt

SEQ ID NO: 8563542 - DNA, 22 bp, Homo sapiens
cataattagtcatgttatgcat

SEQ ID NO: 8563543 - DNA, 22 bp, Homo sapiens
cataattaaattctgggcaaga

SEQ ID NO: 8563544 - DNA, 22 bp, Homo sapiens
cataattaaattctgggcaaga

SEQ ID NO: 8563545 - DNA, 22 bp, Homo sapiens
cataatgtgtgtcatacagact

SEQ ID NO: 8563546 - DNA, 22 bp, Homo sapiens
cataattagagaattcatgtta

SEQ ID NO: 8563547 - DNA, 22 bp, Homo sapiens
cataattaggcagttgatcatt

SEQ ID NO: 8563548 - DNA, 22 bp, Homo sapiens
cataattactgatatgctgatt

SEQ ID NO: 8563549 - DNA, 22 bp, Homo sapiens
cataattactgatatgctgatt

SEQ ID NO: 8563550 - DNA, 22 bp, Homo sapiens
tcaggccaggagatcagattga

SEQ ID NO: 8563551 - DNA, 22 bp, Homo sapiens
tcaggcagagtggaagctgcaa

SEQ ID NO: 8563552 - DNA, 18 bp, Homo sapiens
cataattttctttcttta

SEQ ID NO: 8563553 - DNA, 22 bp, Homo sapiens
cataattttccatggtttgcta

SEQ ID NO: 8563554 - DNA, 22 bp, Homo sapiens
tcaggcctagggagccacacca

SEQ ID NO: 8563555 - DNA, 22 bp, Homo sapiens
tcaggccctttgctgctgcccc

SEQ ID NO: 8563556 - DNA, 22 bp, Homo sapiens
tcaggcccttctcccaggactc

SEQ ID NO: 8563557 - DNA, 22 bp, Homo sapiens
tcaggcccagagtcacggatcc

SEQ ID NO: 8563558 - DNA, 22 bp, Homo sapiens
tcaggccccttgtcagctctgt

SEQ ID NO: 8563559 - DNA, 22 bp, Homo sapiens
catagaaactgagacaaggatt

SEQ ID NO: 8563560 - DNA, 22 bp, Homo sapiens
catagaaactgagacaaggatt

SEQ ID NO: 8563561 - DNA, 22 bp, Homo sapiens
tcaggctgtgggcactggccat

SEQ ID NO: 8563562 - DNA, 22 bp, Homo sapiens
tcaggctgtggctttgaccgca

SEQ ID NO: 8563563 - DNA, 22 bp, Homo sapiens
tcaggctgtgggcactggccat

SEQ ID NO: 8563564 - DNA, 22 bp, Homo sapiens
tcaggctgtgggcactggccat

SEQ ID NO: 8563565 - DNA, 22 bp, Homo sapiens
tcaggctgtggcttcagttctt

SEQ ID NO: 8563566 - DNA, 17 bp, Homo sapiens
tcaggctgtgcctggta

SEQ ID NO: 8563567 - DNA, 22 bp, Homo sapiens
tcagggagagtgacccatccac

SEQ ID NO: 8563568 - DNA, 22 bp, Homo sapiens
tcagggagaggtgagagcctgt

SEQ ID NO: 8563569 - DNA, 22 bp, Homo sapiens
tcaggctgtgtctttaaacaat

SEQ ID NO: 8563570 - DNA, 17 bp, Homo sapiens
tcaggctgtgcctggta

SEQ ID NO: 8563571 - DNA, 17 bp, Homo sapiens
tcaggctgtgcctggta

SEQ ID NO: 8563572 - DNA, 17 bp, Homo sapiens
tcaggctgtgcctggta

SEQ ID NO: 8563573 - DNA, 17 bp, Homo sapiens
tcaggctgtgcctggta

SEQ ID NO: 8563574 - DNA, 21 bp, Homo sapiens
tcaggctgtctgctggttcca

SEQ ID NO: 8563575 - DNA, 22 bp, Homo sapiens
tcaggctgtatatcttgcactc

SEQ ID NO: 8563576 - DNA, 21 bp, Homo sapiens
tcaggctgtctgctggttcca

SEQ ID NO: 8563577 - DNA, 22 bp, Homo sapiens
tcaggctgcctatcagactgtg

SEQ ID NO: 8563578 - DNA, 22 bp, Homo sapiens
tcaggctgcctatcagactgtg

SEQ ID NO: 8563579 - DNA, 22 bp, Homo sapiens
catagaatgcagcaggaaagtt

SEQ ID NO: 8563580 - DNA, 22 bp, Homo sapiens
catagaatggattgacaagatt

SEQ ID NO: 8563581 - DNA, 22 bp, Homo sapiens
tcaggctgcctatcagactgtg

SEQ ID NO: 8563582 - DNA, 22 bp, Homo sapiens
catagaatatgtgtgattgtta

SEQ ID NO: 8563583 - DNA, 22 bp, Homo sapiens
catagaatcatagcacatttga

SEQ ID NO: 8563584 - DNA, 22 bp, Homo sapiens
cataaaatggcttgttctttaa

SEQ ID NO: 8563585 - DNA, 23 bp, Homo sapiens
cataaaatattagtatggtagca

SEQ ID NO: 8563586 - DNA, 23 bp, Homo sapiens
cataaaatattagtatggtagca

SEQ ID NO: 8563587 - DNA, 22 bp, Homo sapiens
cagtttttgccattaagagtaa

SEQ ID NO: 8563588 - DNA, 22 bp, Homo sapiens
cagtttttcaaaattacatgat

SEQ ID NO: 8563589 - DNA, 22 bp, Homo sapiens
cagtttttcaaaattacatgat

SEQ ID NO: 8563590 - DNA, 22 bp, Homo sapiens
cagtttttgccattaagagtaa

SEQ ID NO: 8563591 - DNA, 22 bp, Homo sapiens
cagtttttgccattaagagtaa

SEQ ID NO: 8563592 - DNA, 17 bp, Homo sapiens
cataaaacagttctatt

SEQ ID NO: 8563593 - DNA, 22 bp, Homo sapiens
cagttttctaaagtctctttaa

SEQ ID NO: 8563594 - DNA, 22 bp, Homo sapiens
cagttttggtcctttctaggta

SEQ ID NO: 8563595 - DNA, 22 bp, Homo sapiens
cagtttttagattagttggtgg

SEQ ID NO: 8563596 - DNA, 22 bp, Homo sapiens
tcagatctggtgaagttatagt

SEQ ID NO: 8563597 - DNA, 22 bp, Homo sapiens
tcagatctggtgaagttatagt

SEQ ID NO: 8563598 - DNA, 22 bp, Homo sapiens
tcagatctaattggattattat

SEQ ID NO: 8563599 - DNA, 22 bp, Homo sapiens
cagtttgtcttgattcagaaca

SEQ ID NO: 8563600 - DNA, 22 bp, Homo sapiens
tcagatgagtgctttcagctgc

SEQ ID NO: 8563601 - DNA, 22 bp, Homo sapiens
tcagatcaggatgcagcaacat

SEQ ID NO: 8563602 - DNA, 22 bp, Homo sapiens
tcagatcatggatctattactt

SEQ ID NO: 8563603 - DNA, 22 bp, Homo sapiens
tcagaggatagaaatacttatt

SEQ ID NO: 8563604 - DNA, 23 bp, Homo sapiens
tcagaggatcatcaaacgttttc

SEQ ID NO: 8563605 - DNA, 22 bp, Homo sapiens
tcagaggatagaaatacttatt

SEQ ID NO: 8563606 - DNA, 22 bp, Homo sapiens
tcagaggatcatgtccctactc

SEQ ID NO: 8563607 - DNA, 22 bp, Homo sapiens
tcagaggatcatgtccctactc

SEQ ID NO: 8563608 - DNA, 22 bp, Homo sapiens
tcagaggagggactcagaccca

SEQ ID NO: 8563609 - DNA, 22 bp, Homo sapiens
tcagaggagggactcagaccca

SEQ ID NO: 8563610 - DNA, 22 bp, Homo sapiens
tcagaggagctgcagaacgctg

SEQ ID NO: 8563611 - DNA, 22 bp, Homo sapiens
tcagaggaggcatttaaacaga

SEQ ID NO: 8563612 - DNA, 22 bp, Homo sapiens
tcagaggaggcatttaaacaga

SEQ ID NO: 8563613 - DNA, 22 bp, Homo sapiens
tcagaggagcaaaagaggggat

SEQ ID NO: 8563614 - DNA, 22 bp, Homo sapiens
tcagaggagccaaagttctgag

SEQ ID NO: 8563615 - DNA, 22 bp, Homo sapiens
tcagaggagccaaagttctgag

SEQ ID NO: 8563616 - DNA, 22 bp, Homo sapiens
tcagaggagccaaagttctgag

SEQ ID NO: 8563617 - DNA, 18 bp, Homo sapiens
tcagaggagatacctaaa

SEQ ID NO: 8563618 - DNA, 22 bp, Homo sapiens
tcagaggagcaaaagaggggat

SEQ ID NO: 8563619 - DNA, 22 bp, Homo sapiens
tcagaggagcaaaagaggggat

SEQ ID NO: 8563620 - DNA, 22 bp, Homo sapiens
tcagaggagatggttaccaggg

SEQ ID NO: 8563621 - DNA, 22 bp, Homo sapiens
tcagaggatgctgttctttaat

SEQ ID NO: 8563622 - DNA, 22 bp, Homo sapiens
tcagaggatgctgttctttaat

SEQ ID NO: 8563623 - DNA, 22 bp, Homo sapiens
tcagaggatgctgttctttaat

SEQ ID NO: 8563624 - DNA, 22 bp, Homo sapiens
tcagaggattgcctcagcgagc

SEQ ID NO: 8563625 - DNA, 22 bp, Homo sapiens
tcagagttggcctttctgtatt

SEQ ID NO: 8563626 - DNA, 22 bp, Homo sapiens
tcagagttggcctttctgtatt

SEQ ID NO: 8563627 - DNA, 22 bp, Homo sapiens
tcagagtttcaggatacaaata

SEQ ID NO: 8563628 - DNA, 22 bp, Homo sapiens
tcagatattcaattaagttaaa

SEQ ID NO: 8563629 - DNA, 22 bp, Homo sapiens
tcagatatagtcatttaaataa

SEQ ID NO: 8563630 - DNA, 22 bp, Homo sapiens
tcagatagtgataatagcatgt

SEQ ID NO: 8563631 - DNA, 22 bp, Homo sapiens
cagttctttgtggggagttctc

SEQ ID NO: 8563632 - DNA, 22 bp, Homo sapiens
cagttcttatttggccagtgtc

SEQ ID NO: 8563633 - DNA, 22 bp, Homo sapiens
cagttctggagtttcattcttt

SEQ ID NO: 8563634 - DNA, 22 bp, Homo sapiens
cagttataagactaagctattc

SEQ ID NO: 8563635 - DNA, 22 bp, Homo sapiens
tcaatagcaatcaagccttcca

SEQ ID NO: 8563636 - DNA, 22 bp, Homo sapiens
tcaatatttttatgagcataga

SEQ ID NO: 8563637 - DNA, 22 bp, Homo sapiens
tcaatattcttctttagtagga

SEQ ID NO: 8563638 - DNA, 22 bp, Homo sapiens
tcaatcataatgaagtgaagaa

SEQ ID NO: 8563639 - DNA, 22 bp, Homo sapiens
tcaatgaaagagcatgcatttt

SEQ ID NO: 8563640 - DNA, 22 bp, Homo sapiens
tcaatgaaagagcatgcatttt

SEQ ID NO: 8563641 - DNA, 22 bp, Homo sapiens
tcagagattcacgtcagtccca

SEQ ID NO: 8563642 - DNA, 22 bp, Homo sapiens
tcagagatcttcaggatgggac

SEQ ID NO: 8563643 - DNA, 22 bp, Homo sapiens
tcagagagttacacaaattgtt

SEQ ID NO: 8563644 - DNA, 22 bp, Homo sapiens
tcagagaggttggtgataagaa

SEQ ID NO: 8563645 - DNA, 21 bp, Homo sapiens
tcagagagtcacagtgaactg

SEQ ID NO: 8563646 - DNA, 21 bp, Homo sapiens
tcagagagtcacagtgaactg

SEQ ID NO: 8563647 - DNA, 22 bp, Homo sapiens
tcagagagtcctggtcatttgc

SEQ ID NO: 8563648 - DNA, 22 bp, Homo sapiens
tcagagagtgcaaaatatagct

SEQ ID NO: 8563649 - DNA, 22 bp, Homo sapiens
cagttgcagaggcagagtgcta

SEQ ID NO: 8563650 - DNA, 22 bp, Homo sapiens
cagttgctggatgtgcagctct

SEQ ID NO: 8563651 - DNA, 22 bp, Homo sapiens
cagttgctacagttcaagtgtg

SEQ ID NO: 8563652 - DNA, 22 bp, Homo sapiens
cagttgctggatgtgcagctct

SEQ ID NO: 8563653 - DNA, 22 bp, Homo sapiens
cagttgctggatgtgcagctct

SEQ ID NO: 8563654 - DNA, 22 bp, Homo sapiens
tctaatcctatggtggggaggg

SEQ ID NO: 8563655 - DNA, 22 bp, Homo sapiens
tctaataaataaatgctctagg

SEQ ID NO: 8563656 - DNA, 22 bp, Homo sapiens
tctaaggagccaggactattag

SEQ ID NO: 8563657 - DNA, 22 bp, Homo sapiens
tctaaggagcgctccagaaaaa

SEQ ID NO: 8563658 - DNA, 22 bp, Homo sapiens
tctaaggacaaggtcttggaga

SEQ ID NO: 8563659 - DNA, 22 bp, Homo sapiens
tctaaggacagttattactggg

SEQ ID NO: 8563660 - DNA, 22 bp, Homo sapiens
tctaaggacattggctttggag

SEQ ID NO: 8563661 - DNA, 22 bp, Homo sapiens
tctaagcctgtgtcctctgcag

SEQ ID NO: 8563662 - DNA, 21 bp, Homo sapiens
tctaagccttgcagatgggtt

SEQ ID NO: 8563663 - DNA, 19 bp, Homo sapiens
ccagagacattggcatctt

SEQ ID NO: 8563664 - DNA, 22 bp, Homo sapiens
ccagagaccagaacatggggat

SEQ ID NO: 8563665 - DNA, 22 bp, Homo sapiens
ccagagacaaggagctggagtc

SEQ ID NO: 8563666 - DNA, 22 bp, Homo sapiens
ccagagaatccggagagtccat

SEQ ID NO: 8563667 - DNA, 22 bp, Homo sapiens
ccactgtcagaggggctgtgcc

SEQ ID NO: 8563668 - DNA, 22 bp, Homo sapiens
ccactgtcagaggggctgtgcc

SEQ ID NO: 8563669 - DNA, 22 bp, Homo sapiens
ccactgtctgcaggcctcagca

SEQ ID NO: 8563670 - DNA, 22 bp, Homo sapiens
ccactgtcttttccaggctgaa

SEQ ID NO: 8563671 - DNA, 22 bp, Homo sapiens
ccactgtcttttccaggctgaa

SEQ ID NO: 8563672 - DNA, 22 bp, Homo sapiens
ccactgtataagcaaaatgaaa

SEQ ID NO: 8563673 - DNA, 22 bp, Homo sapiens
ccactgtaagtttgaaaataac

SEQ ID NO: 8563674 - DNA, 22 bp, Homo sapiens
ccactgtaaccattatcaccat

SEQ ID NO: 8563675 - DNA, 22 bp, Homo sapiens
ccactgtttttcagttaacttt

SEQ ID NO: 8563676 - DNA, 22 bp, Homo sapiens
ccactgtttcctttctgctggc

SEQ ID NO: 8563677 - DNA, 22 bp, Homo sapiens
ccactgtttttcagttaacttt

SEQ ID NO: 8563678 - DNA, 22 bp, Homo sapiens
ccactgtggaaagcagttcaga

SEQ ID NO: 8563679 - DNA, 21 bp, Homo sapiens
tctaagaacatgattctccct

SEQ ID NO: 8563680 - DNA, 22 bp, Homo sapiens
ccacttcctgcaggtaaggagc

SEQ ID NO: 8563681 - DNA, 22 bp, Homo sapiens
tctaagaaatcagatgatgagg

SEQ ID NO: 8563682 - DNA, 22 bp, Homo sapiens
tctaagaatactcatatcttct

SEQ ID NO: 8563683 - DNA, 22 bp, Homo sapiens
tctaagccaggactgagagacg

SEQ ID NO: 8563684 - DNA, 22 bp, Homo sapiens
tctaagcagaactgaagctctg

SEQ ID NO: 8563685 - DNA, 21 bp, Homo sapiens
tccttcagtctagatgattgt

SEQ ID NO: 8563686 - DNA, 22 bp, Homo sapiens
tccttcagtcttctgagccata

SEQ ID NO: 8563687 - DNA, 21 bp, Homo sapiens
tccttcagtctagatgattgt

SEQ ID NO: 8563688 - DNA, 21 bp, Homo sapiens
tccttcagtctagatgattgt

SEQ ID NO: 8563689 - DNA, 22 bp, Homo sapiens
tccttcagtcttctgagccata

SEQ ID NO: 8563690 - DNA, 22 bp, Homo sapiens
tccttcagtcttctgagccata

SEQ ID NO: 8563691 - DNA, 22 bp, Homo sapiens
tccttcagtgtcccgctcaggt

SEQ ID NO: 8563692 - DNA, 22 bp, Homo sapiens
tccttcagtgtcccgctcaggt

SEQ ID NO: 8563693 - DNA, 22 bp, Homo sapiens
tccttcagttaaagatctcaca

SEQ ID NO: 8563694 - DNA, 22 bp, Homo sapiens
tccttcagtgtcccgctcaggt

SEQ ID NO: 8563695 - DNA, 22 bp, Homo sapiens
tccttcagttaaagatctcaca

SEQ ID NO: 8563696 - DNA, 17 bp, Homo sapiens
tccttcagtgcctctgc

SEQ ID NO: 8563697 - DNA, 17 bp, Homo sapiens
tccttcagtgcctctgc

SEQ ID NO: 8563698 - DNA, 17 bp, Homo sapiens
tccttcagtgcctctgc

SEQ ID NO: 8563699 - DNA, 22 bp, Homo sapiens
tccttcagtgtcccgctcaggt

SEQ ID NO: 8563700 - DNA, 22 bp, Homo sapiens
tccttccatggtggggctgctt

SEQ ID NO: 8563701 - DNA, 22 bp, Homo sapiens
tccttcccaggtgtcgccgcct

SEQ ID NO: 8563702 - DNA, 22 bp, Homo sapiens
tccttcagttcaattagtccgt

SEQ ID NO: 8563703 - DNA, 22 bp, Homo sapiens
tccttcagttcaattagtccgt

SEQ ID NO: 8563704 - DNA, 21 bp, Homo sapiens
tccttcagttctgcactttct

SEQ ID NO: 8563705 - DNA, 22 bp, Homo sapiens
tccttcatgatgcttagcagag

SEQ ID NO: 8563706 - DNA, 21 bp, Homo sapiens
tccttcagttctgcactttct

SEQ ID NO: 8563707 - DNA, 21 bp, Homo sapiens
tccttcagttctgcactttct

SEQ ID NO: 8563708 - DNA, 22 bp, Homo sapiens
tccttcagttatcacagtactg

SEQ ID NO: 8563709 - DNA, 22 bp, Homo sapiens
tccttcagttatcacagtactg

SEQ ID NO: 8563710 - DNA, 22 bp, Homo sapiens
tccttcagttcaattagtccgt

SEQ ID NO: 8563711 - DNA, 22 bp, Homo sapiens
tccttcagttaaagatctcaca

SEQ ID NO: 8563712 - DNA, 22 bp, Homo sapiens
tccttcagttatcacagtactg

SEQ ID NO: 8563713 - DNA, 19 bp, Homo sapiens
tcctggggaggggcatggc

SEQ ID NO: 8563714 - DNA, 22 bp, Homo sapiens
tcctgggctttgtttctctcct

SEQ ID NO: 8563715 - DNA, 22 bp, Homo sapiens
tcctgggcttcacagactctgt

SEQ ID NO: 8563716 - DNA, 22 bp, Homo sapiens
tcctgggcttcacagactctgt

SEQ ID NO: 8563717 - DNA, 22 bp, Homo sapiens
tcctgggcttgctcctccagct

SEQ ID NO: 8563718 - DNA, 22 bp, Homo sapiens
tcctgggcttgctcctccagct

SEQ ID NO: 8563719 - DNA, 22 bp, Homo sapiens
tcctgggcttcacagactctgt

SEQ ID NO: 8563720 - DNA, 22 bp, Homo sapiens
tcctgggcttgctcctccagct

SEQ ID NO: 8563721 - DNA, 22 bp, Homo sapiens
tccttcctgcaggccaagtcct

SEQ ID NO: 8563722 - DNA, 22 bp, Homo sapiens
tccttggggtaactccagcctg

SEQ ID NO: 8563723 - DNA, 23 bp, Homo sapiens
tccttgggcctgcccagagtggt

SEQ ID NO: 8563724 - DNA, 22 bp, Homo sapiens
tccttcctcggggacccagatc

SEQ ID NO: 8563725 - DNA, 22 bp, Homo sapiens
tccttcctgcaggccaagtcct

SEQ ID NO: 8563726 - DNA, 19 bp, Homo sapiens
tccttccccccagcacaga

SEQ ID NO: 8563727 - DNA, 19 bp, Homo sapiens
tccttccccccagcacaga

SEQ ID NO: 8563728 - DNA, 22 bp, Homo sapiens
tcctttaaagaactgtgctttt

SEQ ID NO: 8563729 - DNA, 22 bp, Homo sapiens
tcctttaaactcctttcaagtc

SEQ ID NO: 8563730 - DNA, 22 bp, Homo sapiens
tcctttaactagttaccatgtt

SEQ ID NO: 8563731 - DNA, 22 bp, Homo sapiens
tcctttaacttgattattttca

SEQ ID NO: 8563732 - DNA, 22 bp, Homo sapiens
tcctttaactagttaccatgtt

SEQ ID NO: 8563733 - DNA, 22 bp, Homo sapiens
tccttgtaaaggagctctaaca

SEQ ID NO: 8563734 - DNA, 22 bp, Homo sapiens
tccttgtaaaggagctctaaca

SEQ ID NO: 8563735 - DNA, 22 bp, Homo sapiens
tccttgtaacgttgggctgggg

SEQ ID NO: 8563736 - DNA, 22 bp, Homo sapiens
tcctttcaccaaaaagtgttgt

SEQ ID NO: 8563737 - DNA, 22 bp, Homo sapiens
ccactgctaacttgctgcagct

SEQ ID NO: 8563738 - DNA, 22 bp, Homo sapiens
ccactgctaacttgctgcagct

SEQ ID NO: 8563739 - DNA, 22 bp, Homo sapiens
tcctgggcttaagtgatcctcc

SEQ ID NO: 8563740 - DNA, 22 bp, Homo sapiens
tcctgggcttaagtgatcctcc

SEQ ID NO: 8563741 - DNA, 22 bp, Homo sapiens
tcctgggagcccttgctccacc

SEQ ID NO: 8563742 - DNA, 22 bp, Homo sapiens
tcctgggagcccttgctccacc

SEQ ID NO: 8563743 - DNA, 22 bp, Homo sapiens
tcctgggagcccttgctccacc

SEQ ID NO: 8563744 - DNA, 22 bp, Homo sapiens
tcctgggagcccttgctccacc

SEQ ID NO: 8563745 - DNA, 22 bp, Homo sapiens
tcctgggagcacatggtcctgc

SEQ ID NO: 8563746 - DNA, 22 bp, Homo sapiens
tcctgggagagtttgattcatt

SEQ ID NO: 8563747 - DNA, 22 bp, Homo sapiens
tcctgggagcacatggtcctgc

SEQ ID NO: 8563748 - DNA, 22 bp, Homo sapiens
tcctgggagcacatggtcctgc

SEQ ID NO: 8563749 - DNA, 22 bp, Homo sapiens
tcctgggagcacatggtcctgc

SEQ ID NO: 8563750 - DNA, 22 bp, Homo sapiens
tcctgggagcatggtgccgtga

SEQ ID NO: 8563751 - DNA, 22 bp, Homo sapiens
tcctgggagcatgaagagggat

SEQ ID NO: 8563752 - DNA, 22 bp, Homo sapiens
tcctgggagcatggtgccgtga

SEQ ID NO: 8563753 - DNA, 22 bp, Homo sapiens
tcctgggagcatggtgccgtga

SEQ ID NO: 8563754 - DNA, 22 bp, Homo sapiens
tcctgggagcccttgctccacc

SEQ ID NO: 8563755 - DNA, 22 bp, Homo sapiens
tcctgggactctttatcagaga

SEQ ID NO: 8563756 - DNA, 22 bp, Homo sapiens
tcctgggactctttatcagaga

SEQ ID NO: 8563757 - DNA, 22 bp, Homo sapiens
tcctgggactctgcctcaggct

SEQ ID NO: 8563758 - DNA, 22 bp, Homo sapiens
tcctggctccagcagctcttcc

SEQ ID NO: 8563759 - DNA, 22 bp, Homo sapiens
ccacagaaagttgtctagagta

SEQ ID NO: 8563760 - DNA, 22 bp, Homo sapiens
ccacagaaagttgtctagagta

SEQ ID NO: 8563761 - DNA, 22 bp, Homo sapiens
tcctgggagacccagctgtgga

SEQ ID NO: 8563762 - DNA, 22 bp, Homo sapiens
tcctgggagacccagctgtgga

SEQ ID NO: 8563763 - DNA, 22 bp, Homo sapiens
tcctgggactttcaaggctagg

SEQ ID NO: 8563764 - DNA, 22 bp, Homo sapiens
tcctgggagagtttgattcatt

SEQ ID NO: 8563765 - DNA, 22 bp, Homo sapiens
tcctgggagacccagctgtgga

SEQ ID NO: 8563766 - DNA, 22 bp, Homo sapiens
tcctgggagagtgggactgtat

SEQ ID NO: 8563767 - DNA, 22 bp, Homo sapiens
tcctgggagagtgggactgtat

SEQ ID NO: 8563768 - DNA, 22 bp, Homo sapiens
tcctggcagcccgcaggtgctg

SEQ ID NO: 8563769 - DNA, 22 bp, Homo sapiens
tcctggcaggtctgagaggtct

SEQ ID NO: 8563770 - DNA, 19 bp, Homo sapiens
ccacacagtgtgcaattta

SEQ ID NO: 8563771 - DNA, 22 bp, Homo sapiens
ccacactaaactgctcaaacca

SEQ ID NO: 8563772 - DNA, 22 bp, Homo sapiens
ccacacagtcagtttccaagaa

SEQ ID NO: 8563773 - DNA, 22 bp, Homo sapiens
ccacacagggggatgagttatt

SEQ ID NO: 8563774 - DNA, 22 bp, Homo sapiens
ccacacagtcagtttccaagaa

SEQ ID NO: 8563775 - DNA, 22 bp, Homo sapiens
ccacacagtcagtttccaagaa

SEQ ID NO: 8563776 - DNA, 22 bp, Homo sapiens
ccacagaaaataaagcacgatt

SEQ ID NO: 8563777 - DNA, 22 bp, Homo sapiens
ccacactttgagatgactagga

SEQ ID NO: 8563778 - DNA, 22 bp, Homo sapiens
ccacactggcatgggatggagg

SEQ ID NO: 8563779 - DNA, 22 bp, Homo sapiens
ccacactgaacctcagtgtctt

SEQ ID NO: 8563780 - DNA, 22 bp, Homo sapiens
ccacactgaacctcagtgtctt

SEQ ID NO: 8563781 - DNA, 22 bp, Homo sapiens
ccacactgaccagctgtgagac

SEQ ID NO: 8563782 - DNA, 18 bp, Homo sapiens
ccaaggcccctgctgggg

SEQ ID NO: 8563783 - DNA, 18 bp, Homo sapiens
ccaaggcccctgctgggg

SEQ ID NO: 8563784 - DNA, 22 bp, Homo sapiens
ccaaggctcctcagctggtctt

SEQ ID NO: 8563785 - DNA, 17 bp, Homo sapiens
ccaaggctatttgtagt

SEQ ID NO: 8563786 - DNA, 22 bp, Homo sapiens
ccaaggctggagtgcagtggcg

SEQ ID NO: 8563787 - DNA, 22 bp, Homo sapiens
ccaaggctgtggggctgtgcag

SEQ ID NO: 8563788 - DNA, 22 bp, Homo sapiens
ccaaggctggagtgcagtggcg

SEQ ID NO: 8563789 - DNA, 22 bp, Homo sapiens
ccaaggctggagtgcagtggcg

SEQ ID NO: 8563790 - DNA, 22 bp, Homo sapiens
ccaaggctggagggcttatgta

SEQ ID NO: 8563791 - DNA, 22 bp, Homo sapiens
ccaaggctcctcagctggtctt

SEQ ID NO: 8563792 - DNA, 22 bp, Homo sapiens
ccaaggctgaggtttccagttg

SEQ ID NO: 8563793 - DNA, 22 bp, Homo sapiens
tcctggaggagatccaatctga

SEQ ID NO: 8563794 - DNA, 22 bp, Homo sapiens
tcctggaggacagaggcatctc

SEQ ID NO: 8563795 - DNA, 22 bp, Homo sapiens
ccaagggaaaccgagaggctgg

SEQ ID NO: 8563796 - DNA, 22 bp, Homo sapiens
tcctggaggacagaggcatctc

SEQ ID NO: 8563797 - DNA, 22 bp, Homo sapiens
ccaaggcttcccagagatgctc

SEQ ID NO: 8563798 - DNA, 22 bp, Homo sapiens
ccaaggctgtggggctgtgcag

SEQ ID NO: 8563799 - DNA, 22 bp, Homo sapiens
ccaaggcttcccagagatgctc

SEQ ID NO: 8563800 - DNA, 22 bp, Homo sapiens
ccaaggctgtcattcagtagct

SEQ ID NO: 8563801 - DNA, 22 bp, Homo sapiens
ccaaggcttcccagagatgctc

SEQ ID NO: 8563802 - DNA, 20 bp, Homo sapiens
tcctaataacctgaagaaat

SEQ ID NO: 8563803 - DNA, 22 bp, Homo sapiens
tcctagaacagcccacctggaa

SEQ ID NO: 8563804 - DNA, 22 bp, Homo sapiens
tcctagaactccaggacagtcc

SEQ ID NO: 8563805 - DNA, 22 bp, Homo sapiens
tcctacatcagctctcagtagc

SEQ ID NO: 8563806 - DNA, 22 bp, Homo sapiens
tcctacagatactaaggagatc

SEQ ID NO: 8563807 - DNA, 22 bp, Homo sapiens
ccaagaggttgaggctgcagtg

SEQ ID NO: 8563808 - DNA, 22 bp, Homo sapiens
ccaagaggttgtgaggcaggca

SEQ ID NO: 8563809 - DNA, 22 bp, Homo sapiens
ccaagagtaaattcatgatgcc

SEQ ID NO: 8563810 - DNA, 22 bp, Homo sapiens
ccaaggagaatgacaccatgga

SEQ ID NO: 8563811 - DNA, 22 bp, Homo sapiens
ccaaggagcaaggctcaacaag

SEQ ID NO: 8563812 - DNA, 22 bp, Homo sapiens
ccaaggcaacgttggtgtcagg

SEQ ID NO: 8563813 - DNA, 22 bp, Homo sapiens
ccaaggcaacgttggtgtcagg

SEQ ID NO: 8563814 - DNA, 22 bp, Homo sapiens
ccaaggaggccccaggtcagct

SEQ ID NO: 8563815 - DNA, 22 bp, Homo sapiens
ccaaggaggccccaggtcagct

SEQ ID NO: 8563816 - DNA, 22 bp, Homo sapiens
ccaaggagtagagcaggaagct

SEQ ID NO: 8563817 - DNA, 22 bp, Homo sapiens
ccaaggagtagagcaggaagct

SEQ ID NO: 8563818 - DNA, 22 bp, Homo sapiens
ccaaggcagaagatggctcttg

SEQ ID NO: 8563819 - DNA, 22 bp, Homo sapiens
ccaaggcacactctgcaaggtt

SEQ ID NO: 8563820 - DNA, 22 bp, Homo sapiens
ccaaggcacactctgcaaggtt

SEQ ID NO: 8563821 - DNA, 22 bp, Homo sapiens
ccaaggcagaagatggctcttg

SEQ ID NO: 8563822 - DNA, 22 bp, Homo sapiens
ccaaggcatatggctgaaacca

SEQ ID NO: 8563823 - DNA, 22 bp, Homo sapiens
tccattttagagatgaagaaac

SEQ ID NO: 8563824 - DNA, 22 bp, Homo sapiens
tccattttagagatgaagaaac

SEQ ID NO: 8563825 - DNA, 22 bp, Homo sapiens
tccattttagagatgaagaaac

SEQ ID NO: 8563826 - DNA, 22 bp, Homo sapiens
tccattttagagatgaagaaac

SEQ ID NO: 8563827 - DNA, 22 bp, Homo sapiens
tccattttcatctcatgtataa

SEQ ID NO: 8563828 - DNA, 22 bp, Homo sapiens
tccattttctaagtatcactta

SEQ ID NO: 8563829 - DNA, 22 bp, Homo sapiens
tccattttcatctcatgtataa

SEQ ID NO: 8563830 - DNA, 22 bp, Homo sapiens
tccattttcatctcatgtataa

SEQ ID NO: 8563831 - DNA, 22 bp, Homo sapiens
tccattttcatctcatgtataa

SEQ ID NO: 8563832 - DNA, 22 bp, Homo sapiens
tccattttctaagtatcactta

SEQ ID NO: 8563833 - DNA, 22 bp, Homo sapiens
tccattttctaagtatcactta

SEQ ID NO: 8563834 - DNA, 22 bp, Homo sapiens
tccattttcttgctctaggtaa

SEQ ID NO: 8563835 - DNA, 22 bp, Homo sapiens
tccattttgtaggtatgctaca

SEQ ID NO: 8563836 - DNA, 22 bp, Homo sapiens
tccattttgtaggtatgctaca

SEQ ID NO: 8563837 - DNA, 22 bp, Homo sapiens
tccatttttcatgactcctcaa

SEQ ID NO: 8563838 - DNA, 22 bp, Homo sapiens
tccattttgtaggtatgctaca

SEQ ID NO: 8563839 - DNA, 20 bp, Homo sapiens
tcccaaaattctactttatc

SEQ ID NO: 8563840 - DNA, 22 bp, Homo sapiens
tccatttttcatgactcctcaa

SEQ ID NO: 8563841 - DNA, 22 bp, Homo sapiens
tccatattaactaaaactagaa

SEQ ID NO: 8563842 - DNA, 22 bp, Homo sapiens
tccatttgaaatgaaagtgata

SEQ ID NO: 8563843 - DNA, 22 bp, Homo sapiens
tccattttagaagaaaatccac

SEQ ID NO: 8563844 - DNA, 22 bp, Homo sapiens
tccattttagaagaaaatccac

SEQ ID NO: 8563845 - DNA, 22 bp, Homo sapiens
tccattttagaagaaaatccac

SEQ ID NO: 8563846 - DNA, 22 bp, Homo sapiens
catgggcccgtgagaggcaggg

SEQ ID NO: 8563847 - DNA, 22 bp, Homo sapiens
catgggcagaagtggcatcatt

SEQ ID NO: 8563848 - DNA, 22 bp, Homo sapiens
catgggcagttggcagggctca

SEQ ID NO: 8563849 - DNA, 22 bp, Homo sapiens
tccaggagcatccaggtgaagc

SEQ ID NO: 8563850 - DNA, 22 bp, Homo sapiens
catgggaggcctgctgctggtg

SEQ ID NO: 8563851 - DNA, 22 bp, Homo sapiens
catgggaggcctgctgctggtg

SEQ ID NO: 8563852 - DNA, 19 bp, Homo sapiens
tccaggagcaaagccagtt

SEQ ID NO: 8563853 - DNA, 21 bp, Homo sapiens
tccaggagcacgggactagga

SEQ ID NO: 8563854 - DNA, 23 bp, Homo sapiens
catgggagtgagaatgccagctc

SEQ ID NO: 8563855 - DNA, 23 bp, Homo sapiens
catgggagtgagaatgccagctc

SEQ ID NO: 8563856 - DNA, 22 bp, Homo sapiens
catgggaggttggcttggcatg

SEQ ID NO: 8563857 - DNA, 22 bp, Homo sapiens
catgggcaccttaaaatgaggc

SEQ ID NO: 8563858 - DNA, 22 bp, Homo sapiens
catgggaggttggcttggcatg

SEQ ID NO: 8563859 - DNA, 22 bp, Homo sapiens
catgggaggtctgcaaggtgct

SEQ ID NO: 8563860 - DNA, 22 bp, Homo sapiens
catgggaggtctgcaaggtgct

SEQ ID NO: 8563861 - DNA, 22 bp, Homo sapiens
catgggaggtctgcaaggtgct

SEQ ID NO: 8563862 - DNA, 22 bp, Homo sapiens
catgggaggtctgcaaggtgct

SEQ ID NO: 8563863 - DNA, 22 bp, Homo sapiens
tccaggagacacaaggtacata

SEQ ID NO: 8563864 - DNA, 22 bp, Homo sapiens
tccaggagacacaaggtacata

SEQ ID NO: 8563865 - DNA, 22 bp, Homo sapiens
tccaggagaccagatgtaggcc

SEQ ID NO: 8563866 - DNA, 22 bp, Homo sapiens
tccaggagacacccttgtgtgt

SEQ ID NO: 8563867 - DNA, 22 bp, Homo sapiens
tccaggagaccagatgtaggcc

SEQ ID NO: 8563868 - DNA, 22 bp, Homo sapiens
tccaggagattcattaggtcat

SEQ ID NO: 8563869 - DNA, 22 bp, Homo sapiens
tccaggagattcattaggtcat

SEQ ID NO: 8563870 - DNA, 22 bp, Homo sapiens
tccaggagatacactgcaccag

SEQ ID NO: 8563871 - DNA, 22 bp, Homo sapiens
tccaggagaggtgtggggactg

SEQ ID NO: 8563872 - DNA, 22 bp, Homo sapiens
tccaggagaggtgtggggactg

SEQ ID NO: 8563873 - DNA, 22 bp, Homo sapiens
tccaggagaggtgtggggactg

SEQ ID NO: 8563874 - DNA, 22 bp, Homo sapiens
tccaggagaggtagagggttcc

SEQ ID NO: 8563875 - DNA, 22 bp, Homo sapiens
tccaggagaggtagagggttcc

SEQ ID NO: 8563876 - DNA, 22 bp, Homo sapiens
tccaggagaggcctgaccaggt

SEQ ID NO: 8563877 - DNA, 22 bp, Homo sapiens
tccaggagaggcctgaccaggt

SEQ ID NO: 8563878 - DNA, 22 bp, Homo sapiens
tccaggagaggcctgaccaggt

SEQ ID NO: 8563879 - DNA, 22 bp, Homo sapiens
tccaggagaggcctgaccaggt

SEQ ID NO: 8563880 - DNA, 22 bp, Homo sapiens
tccaggagaggcctgaccaggt

SEQ ID NO: 8563881 - DNA, 22 bp, Homo sapiens
cattctctgatcttcacatacc

SEQ ID NO: 8563882 - DNA, 22 bp, Homo sapiens
cattctctgatcttcacatacc

SEQ ID NO: 8563883 - DNA, 22 bp, Homo sapiens
cattctctgatcttcacatacc

SEQ ID NO: 8563884 - DNA, 22 bp, Homo sapiens
cattctgagtcactctttagca

SEQ ID NO: 8563885 - DNA, 22 bp, Homo sapiens
cattcttatatttactcattca

SEQ ID NO: 8563886 - DNA, 22 bp, Homo sapiens
cattcttatatttactcattca

SEQ ID NO: 8563887 - DNA, 22 bp, Homo sapiens
cattcttctggatagttagttg

SEQ ID NO: 8563888 - DNA, 22 bp, Homo sapiens
cattcttatatttactcattca

SEQ ID NO: 8563889 - DNA, 22 bp, Homo sapiens
cattcttctcccttaccttcca

SEQ ID NO: 8563890 - DNA, 17 bp, Homo sapiens
cattctgtaatctttct

SEQ ID NO: 8563891 - DNA, 22 bp, Homo sapiens
cattctgggtctggctcaggga

SEQ ID NO: 8563892 - DNA, 22 bp, Homo sapiens
cattctgtgattctaaatccct

SEQ ID NO: 8563893 - DNA, 22 bp, Homo sapiens
tcccaccccctccaaggaggaa

SEQ ID NO: 8563894 - DNA, 22 bp, Homo sapiens
tcccaccttccgtggaacccgt

SEQ ID NO: 8563895 - DNA, 22 bp, Homo sapiens
tcccacattaccctgactgaca

SEQ ID NO: 8563896 - DNA, 22 bp, Homo sapiens
tcccacatgtgaatcctcaggt

SEQ ID NO: 8563897 - DNA, 22 bp, Homo sapiens
tcccacccatcctgcatctctt

SEQ ID NO: 8563898 - DNA, 22 bp, Homo sapiens
cattacttctcatgcttcatgc

SEQ ID NO: 8563899 - DNA, 22 bp, Homo sapiens
cattacatttcaaaatgtttcc

SEQ ID NO: 8563900 - DNA, 22 bp, Homo sapiens
cattacatggtccaggatatat

SEQ ID NO: 8563901 - DNA, 22 bp, Homo sapiens
cattacatggtccaggatatat

SEQ ID NO: 8563902 - DNA, 22 bp, Homo sapiens
cattacatctttgatgcagtat

SEQ ID NO: 8563903 - DNA, 22 bp, Homo sapiens
tcccaaagaactgaatagtaat

SEQ ID NO: 8563904 - DNA, 22 bp, Homo sapiens
cattagaacctataaaaagcat

SEQ ID NO: 8563905 - DNA, 22 bp, Homo sapiens
cattagaagaacagttatatta

SEQ ID NO: 8563906 - DNA, 22 bp, Homo sapiens
cattctatcttggactggatct

SEQ ID NO: 8563907 - DNA, 22 bp, Homo sapiens
cattcatttatgaaatatctat

SEQ ID NO: 8563908 - DNA, 22 bp, Homo sapiens
cattcatttgcccagtaagtca

SEQ ID NO: 8563909 - DNA, 22 bp, Homo sapiens
cattctcaatagtagatgagta

SEQ ID NO: 8563910 - DNA, 22 bp, Homo sapiens
cattctcaatagtagatgagta

SEQ ID NO: 8563911 - DNA, 22 bp, Homo sapiens
cattctcaatagtagatgagta

SEQ ID NO: 8563912 - DNA, 22 bp, Homo sapiens
cattaggtatttaagcacacag

SEQ ID NO: 8563913 - DNA, 22 bp, Homo sapiens
cattagcaggcactaagaaggt

SEQ ID NO: 8563914 - DNA, 22 bp, Homo sapiens
tccctccttaataagaggtctg

SEQ ID NO: 8563915 - DNA, 20 bp, Homo sapiens
tccctcctgcagatagagaa

SEQ ID NO: 8563916 - DNA, 22 bp, Homo sapiens
tccctcagaaattctctctgaa

SEQ ID NO: 8563917 - DNA, 20 bp, Homo sapiens
tccctcctgcagatagagaa

SEQ ID NO: 8563918 - DNA, 20 bp, Homo sapiens
tccctcctgcagatagagaa

SEQ ID NO: 8563919 - DNA, 22 bp, Homo sapiens
catttacacttctaaccacaag

SEQ ID NO: 8563920 - DNA, 22 bp, Homo sapiens
catttacacttctaaccacaag

SEQ ID NO: 8563921 - DNA, 22 bp, Homo sapiens
tccctcagaaattctctctgaa

SEQ ID NO: 8563922 - DNA, 22 bp, Homo sapiens
tccctcagaaattctctctgaa

SEQ ID NO: 8563923 - DNA, 22 bp, Homo sapiens
catttacacttctaaccacaag

SEQ ID NO: 8563924 - DNA, 22 bp, Homo sapiens
catttaatctggctcatgagca

SEQ ID NO: 8563925 - DNA, 22 bp, Homo sapiens
catttaatgcacggatgtagcc

SEQ ID NO: 8563926 - DNA, 22 bp, Homo sapiens
catttaatcctcacaagcctat

SEQ ID NO: 8563927 - DNA, 22 bp, Homo sapiens
catttaatcctcacaagcctat

SEQ ID NO: 8563928 - DNA, 22 bp, Homo sapiens
catttaatagatgctgtttcag

SEQ ID NO: 8563929 - DNA, 22 bp, Homo sapiens
catttaatagatgctgtttcag

SEQ ID NO: 8563930 - DNA, 22 bp, Homo sapiens
catttaatgcctttgccatcca

SEQ ID NO: 8563931 - DNA, 22 bp, Homo sapiens
cattgtttgagcatctgggatc

SEQ ID NO: 8563932 - DNA, 18 bp, Homo sapiens
cattgtttccagaagacc

SEQ ID NO: 8563933 - DNA, 22 bp, Homo sapiens
catttaaaggttgtgggtaaaa

SEQ ID NO: 8563934 - DNA, 22 bp, Homo sapiens
cattgttttgagaacaacctga

SEQ ID NO: 8563935 - DNA, 22 bp, Homo sapiens
cattgttcaacactgacttgca

SEQ ID NO: 8563936 - DNA, 22 bp, Homo sapiens
tcccactcccaggcaggcctct

SEQ ID NO: 8563937 - DNA, 22 bp, Homo sapiens
cattgtcacccaaagctcatag

SEQ ID NO: 8563938 - DNA, 22 bp, Homo sapiens
cattgtcacccaaagctcatag

SEQ ID NO: 8563939 - DNA, 22 bp, Homo sapiens
cattgtattgaggatacttaag

SEQ ID NO: 8563940 - DNA, 18 bp, Homo sapiens
cattgtacaatgctttat

SEQ ID NO: 8563941 - DNA, 18 bp, Homo sapiens
cattgtacaatgctttat

SEQ ID NO: 8563942 - DNA, 22 bp, Homo sapiens
cattgtcacccaaagctcatag

SEQ ID NO: 8563943 - DNA, 22 bp, Homo sapiens
cattgtcattctatgctattca

SEQ ID NO: 8563944 - DNA, 22 bp, Homo sapiens
cattgtctggtaggaagtgggc

SEQ ID NO: 8563945 - DNA, 22 bp, Homo sapiens
cattgtctcttgtcatttagta

SEQ ID NO: 8563946 - DNA, 22 bp, Homo sapiens
tccctgggttcccgtggaagtg

SEQ ID NO: 8563947 - DNA, 22 bp, Homo sapiens
tcctaactaatttgtagcaaaa

SEQ ID NO: 8563948 - DNA, 20 bp, Homo sapiens
tcctaactataaagtggctc

SEQ ID NO: 8563949 - DNA, 23 bp, Homo sapiens
tcctaactcaattcaggggtgtc

SEQ ID NO: 8563950 - DNA, 23 bp, Homo sapiens
tcctaactgattctgcagtctct

SEQ ID NO: 8563951 - DNA, 23 bp, Homo sapiens
tcctaactgattctgcagtctct

SEQ ID NO: 8563952 - DNA, 22 bp, Homo sapiens
tcctaactccactagccttggg

SEQ ID NO: 8563953 - DNA, 23 bp, Homo sapiens
tcctaactcaattcaggggtgtc

SEQ ID NO: 8563954 - DNA, 16 bp, Homo sapiens
tcctaactggcagttc

SEQ ID NO: 8563955 - DNA, 18 bp, Homo sapiens
tcctaacttagatactcc

SEQ ID NO: 8563956 - DNA, 22 bp, Homo sapiens
tcctaactgccctgggcaaggt

SEQ ID NO: 8563957 - DNA, 22 bp, Homo sapiens
tccctgggtcctgcttgctctc

SEQ ID NO: 8563958 - DNA, 22 bp, Homo sapiens
tccctgggtcctgcttgctctc

SEQ ID NO: 8563959 - DNA, 22 bp, Homo sapiens
tccctgggtcctgcttgctctc

SEQ ID NO: 8563960 - DNA, 22 bp, Homo sapiens
tccctgggttacctttcaaggt

SEQ ID NO: 8563961 - DNA, 22 bp, Homo sapiens
tccctgggttacctttcaaggt

SEQ ID NO: 8563962 - DNA, 22 bp, Homo sapiens
tccctggggttcctccagccac

SEQ ID NO: 8563963 - DNA, 22 bp, Homo sapiens
tccctgggtcattctctggcac

SEQ ID NO: 8563964 - DNA, 22 bp, Homo sapiens
tccctggggttcctccagccac

SEQ ID NO: 8563965 - DNA, 22 bp, Homo sapiens
tccctggggtatcgctgaggca

SEQ ID NO: 8563966 - DNA, 22 bp, Homo sapiens
tccctggggtaacattagaggg

SEQ ID NO: 8563967 - DNA, 20 bp, Homo sapiens
tccctggggccctacttcct

SEQ ID NO: 8563968 - DNA, 20 bp, Homo sapiens
tccctggggccctacttcct

SEQ ID NO: 8563969 - DNA, 18 bp, Homo sapiens
tccctggggctgccaccc

SEQ ID NO: 8563970 - DNA, 22 bp, Homo sapiens
tccctggaacagagagacaacg

SEQ ID NO: 8563971 - DNA, 22 bp, Homo sapiens
tccctggaacagagagacaacg

SEQ ID NO: 8563972 - DNA, 22 bp, Homo sapiens
tccctgctttcttgtgagggga

SEQ ID NO: 8563973 - DNA, 22 bp, Homo sapiens
catttattgagtggccacagtg

SEQ ID NO: 8563974 - DNA, 22 bp, Homo sapiens
tccctcgaagagcttattcttt

SEQ ID NO: 8563975 - DNA, 22 bp, Homo sapiens
tccctctccctattgcctggag

SEQ ID NO: 8563976 - DNA, 22 bp, Homo sapiens
tccctctccctattgcctggag

SEQ ID NO: 8563977 - DNA, 22 bp, Homo sapiens
tccctctccctattgcctggag

SEQ ID NO: 8563978 - DNA, 22 bp, Homo sapiens
tccctctctagcctgttcagta

SEQ ID NO: 8563979 - DNA, 22 bp, Homo sapiens
tccctctctagcctgttcagta

SEQ ID NO: 8563980 - DNA, 22 bp, Homo sapiens
tccctctcttgggcgtggctca

SEQ ID NO: 8563981 - DNA, 22 bp, Homo sapiens
catttattcagctcagtcggtt

SEQ ID NO: 8563982 - DNA, 22 bp, Homo sapiens
catttattctcagatccttgtc

SEQ ID NO: 8563983 - DNA, 22 bp, Homo sapiens
catttattctcagatccttgtc

SEQ ID NO: 8563984 - DNA, 22 bp, Homo sapiens
catttattctcagatccttgtc

SEQ ID NO: 8563985 - DNA, 22 bp, Homo sapiens
catttattctcagatccttgtc

SEQ ID NO: 8563986 - DNA, 22 bp, Homo sapiens
catttattctcagatccttgtc

SEQ ID NO: 8563987 - DNA, 22 bp, Homo sapiens
catttattcatttgctagggct

SEQ ID NO: 8563988 - DNA, 22 bp, Homo sapiens
catttattcatgatctgtagct

SEQ ID NO: 8563989 - DNA, 22 bp, Homo sapiens
catttattcatgatctgtagct

SEQ ID NO: 8563990 - DNA, 22 bp, Homo sapiens
catttattcatgatctgtagct

SEQ ID NO: 8563991 - DNA, 22 bp, Homo sapiens
cagtattttcaggatttggaag

SEQ ID NO: 8563992 - DNA, 22 bp, Homo sapiens
cagtattttcaggatttggaag

SEQ ID NO: 8563993 - DNA, 22 bp, Homo sapiens
cagtattttcaggatttggaag

SEQ ID NO: 8563994 - DNA, 22 bp, Homo sapiens
cagtatttttaagctgctttgt

SEQ ID NO: 8563995 - DNA, 22 bp, Homo sapiens
cagtatctccacatgtaaagtg

SEQ ID NO: 8563996 - DNA, 21 bp, Homo sapiens
cagtattttaagcagtgagtt

SEQ ID NO: 8563997 - DNA, 22 bp, Homo sapiens
cagtatattctgcagagcctta

SEQ ID NO: 8563998 - DNA, 22 bp, Homo sapiens
cagtatattttagagaagtccc

SEQ ID NO: 8563999 - DNA, 22 bp, Homo sapiens
cagtatattttagagaagtccc

SEQ ID NO: 8564000 - DNA, 19 bp, Homo sapiens
cagtatcattgcacatagt

SEQ ID NO: 8564001 - DNA, 22 bp, Homo sapiens
cagtatatgctctttcatcaaa

SEQ ID NO: 8564002 - DNA, 22 bp, Homo sapiens
cagtatatgctctttcatcaaa

SEQ ID NO: 8564003 - DNA, 19 bp, Homo sapiens
caggtggtaatctgagcct

SEQ ID NO: 8564004 - DNA, 19 bp, Homo sapiens
caggtggtaatctgagcct

SEQ ID NO: 8564005 - DNA, 22 bp, Homo sapiens
caggtgggtgtatgaatgcaaa

SEQ ID NO: 8564006 - DNA, 22 bp, Homo sapiens
caggtgggtgtatgaatgcaaa

SEQ ID NO: 8564007 - DNA, 22 bp, Homo sapiens
cagtcacagtgacaggatgtgg

SEQ ID NO: 8564008 - DNA, 17 bp, Homo sapiens
cagtcacaggtcttttc

SEQ ID NO: 8564009 - DNA, 22 bp, Homo sapiens
cagtcacataggtatacacata

SEQ ID NO: 8564010 - DNA, 22 bp, Homo sapiens
cagtcacataggtatacacata

SEQ ID NO: 8564011 - DNA, 22 bp, Homo sapiens
cagtcaaacttataggcacatt

SEQ ID NO: 8564012 - DNA, 22 bp, Homo sapiens
cagtcaaacttataggcacatt

SEQ ID NO: 8564013 - DNA, 22 bp, Homo sapiens
cagtcaaacttataggcacatt

SEQ ID NO: 8564014 - DNA, 22 bp, Homo sapiens
cagtcaacagagagcccgtcag

SEQ ID NO: 8564015 - DNA, 22 bp, Homo sapiens
cagtcacaagcgtacctaattt

SEQ ID NO: 8564016 - DNA, 22 bp, Homo sapiens
cagtcacctagacagaacttac

SEQ ID NO: 8564017 - DNA, 22 bp, Homo sapiens
cagtcacatttcgacataacta

SEQ ID NO: 8564018 - DNA, 22 bp, Homo sapiens
cagtcagggacaccagctagga

SEQ ID NO: 8564019 - DNA, 22 bp, Homo sapiens
cagtcagggacaccagctagga

SEQ ID NO: 8564020 - DNA, 22 bp, Homo sapiens
cagtcagggacaccagctagga

SEQ ID NO: 8564021 - DNA, 22 bp, Homo sapiens
cagtcagggacaccagctagga

SEQ ID NO: 8564022 - DNA, 22 bp, Homo sapiens
cagtcaggggtgggatcaaggc

SEQ ID NO: 8564023 - DNA, 22 bp, Homo sapiens
cagtcagagtcacagtaatttg

SEQ ID NO: 8564024 - DNA, 22 bp, Homo sapiens
cagtcaggaatgcctccttcct

SEQ ID NO: 8564025 - DNA, 22 bp, Homo sapiens
cagtcaggctgcgcttctctga

SEQ ID NO: 8564026 - DNA, 22 bp, Homo sapiens
cagtcaggctgcgcttctctga

SEQ ID NO: 8564027 - DNA, 22 bp, Homo sapiens
cagtcagaaggaagatgcttaa

SEQ ID NO: 8564028 - DNA, 22 bp, Homo sapiens
cagtcactggttctataggccc

SEQ ID NO: 8564029 - DNA, 22 bp, Homo sapiens
cagtcactccagcctgcctcag

SEQ ID NO: 8564030 - DNA, 22 bp, Homo sapiens
cagtcagaggtcttctaaaaca

SEQ ID NO: 8564031 - DNA, 22 bp, Homo sapiens
cagtcacttacaaaaatataat

SEQ ID NO: 8564032 - DNA, 22 bp, Homo sapiens
tattttaaagtgaagggtcttg

SEQ ID NO: 8564033 - DNA, 22 bp, Homo sapiens
tattttaaagtgaagggtcttg

SEQ ID NO: 8564034 - DNA, 22 bp, Homo sapiens
tattttacaaatgggaatgctg

SEQ ID NO: 8564035 - DNA, 22 bp, Homo sapiens
tattttacagactactttagat

SEQ ID NO: 8564036 - DNA, 22 bp, Homo sapiens
tattttacagactactttagat

SEQ ID NO: 8564037 - DNA, 22 bp, Homo sapiens
tattttaaagactgccagccta

SEQ ID NO: 8564038 - DNA, 22 bp, Homo sapiens
tattttaaagactgccagccta

SEQ ID NO: 8564039 - DNA, 20 bp, Homo sapiens
tatttgaaatggccaagtgt

SEQ ID NO: 8564040 - DNA, 22 bp, Homo sapiens
tatttgaagattcttctgatgt

SEQ ID NO: 8564041 - DNA, 22 bp, Homo sapiens
tcaagcaaactctgagaaataa

SEQ ID NO: 8564042 - DNA, 22 bp, Homo sapiens
tcaagcaaagatacaaatggaa

SEQ ID NO: 8564043 - DNA, 22 bp, Homo sapiens
tcaagcaaagtttagctggtta

SEQ ID NO: 8564044 - DNA, 22 bp, Homo sapiens
tcaagcaagtgtttggtgtaaa

SEQ ID NO: 8564045 - DNA, 22 bp, Homo sapiens
tcaagcaagttgcatattgcta

SEQ ID NO: 8564046 - DNA, 22 bp, Homo sapiens
tcaagcaacagaactgtgagac

SEQ ID NO: 8564047 - DNA, 22 bp, Homo sapiens
tcaagcaactgaattctaaaag

SEQ ID NO: 8564048 - DNA, 22 bp, Homo sapiens
tcaacaaatacttaaagcagag

SEQ ID NO: 8564049 - DNA, 22 bp, Homo sapiens
tcaagctcattcctctaacctc

SEQ ID NO: 8564050 - DNA, 22 bp, Homo sapiens
tcaatagataaagctacataaa

SEQ ID NO: 8564051 - DNA, 23 bp, Homo sapiens
tcaagcaattctcctgcctcggc

SEQ ID NO: 8564052 - DNA, 22 bp, Homo sapiens
tcaagcaagttgcatattgcta

SEQ ID NO: 8564053 - DNA, 22 bp, Homo sapiens
tcaagcagggtagcaagctggt

SEQ ID NO: 8564054 - DNA, 19 bp, Homo sapiens
tcaaaacacaaatggttga

SEQ ID NO: 8564055 - DNA, 22 bp, Homo sapiens
tcaaaacactattacctttaat

SEQ ID NO: 8564056 - DNA, 22 bp, Homo sapiens
tcaaaacactattacctttaat

SEQ ID NO: 8564057 - DNA, 22 bp, Homo sapiens
tcaaaacaacactcaggtgtaa

SEQ ID NO: 8564058 - DNA, 22 bp, Homo sapiens
tcaaaacaacactcaggtgtaa

SEQ ID NO: 8564059 - DNA, 22 bp, Homo sapiens
tcaaaaatgttttatattggta

SEQ ID NO: 8564060 - DNA, 22 bp, Homo sapiens
tcaaaacaacactcaggtgtaa

SEQ ID NO: 8564061 - DNA, 22 bp, Homo sapiens
tcaaaaattttctgaggatgag

SEQ ID NO: 8564062 - DNA, 22 bp, Homo sapiens
tcaaaacaatcattggatgtgc

SEQ ID NO: 8564063 - DNA, 22 bp, Homo sapiens
tcaaaacaatcattggatgtgc

SEQ ID NO: 8564064 - DNA, 22 bp, Homo sapiens
tattttactttaaagcgagaga

SEQ ID NO: 8564065 - DNA, 22 bp, Homo sapiens
tcaaaaatgttttatattggta

SEQ ID NO: 8564066 - DNA, 22 bp, Homo sapiens
tattttcaccatgtatccctgt

SEQ ID NO: 8564067 - DNA, 22 bp, Homo sapiens
tcaaaaatgttttatattggta

SEQ ID NO: 8564068 - DNA, 22 bp, Homo sapiens
tattttcaccatgtatccctgt

SEQ ID NO: 8564069 - DNA, 22 bp, Homo sapiens
tattttcaccatgtatccctgt

SEQ ID NO: 8564070 - DNA, 22 bp, Homo sapiens
tattttcaccatgtatccctgt

SEQ ID NO: 8564071 - DNA, 22 bp, Homo sapiens
tattttatctgccagagtggag

SEQ ID NO: 8564072 - DNA, 22 bp, Homo sapiens
tattttatctgccagagtggag

SEQ ID NO: 8564073 - DNA, 22 bp, Homo sapiens
tattttatctgccagagtggag

SEQ ID NO: 8564074 - DNA, 22 bp, Homo sapiens
tattttatctgccagagtggag

SEQ ID NO: 8564075 - DNA, 22 bp, Homo sapiens
tattttatctgccagagtggag

SEQ ID NO: 8564076 - DNA, 22 bp, Homo sapiens
tattttatctgccagagtggag

SEQ ID NO: 8564077 - DNA, 22 bp, Homo sapiens
caggtgctgcgtggcggagctg

SEQ ID NO: 8564078 - DNA, 22 bp, Homo sapiens
caggtgctgcgtggcggagctg

SEQ ID NO: 8564079 - DNA, 22 bp, Homo sapiens
caggtgctgtcctgcacatgtc

SEQ ID NO: 8564080 - DNA, 22 bp, Homo sapiens
caggtgctgcagggctggcgtc

SEQ ID NO: 8564081 - DNA, 22 bp, Homo sapiens
caggtgctctgctgcaggtaag

SEQ ID NO: 8564082 - DNA, 22 bp, Homo sapiens
caggtgctcccagagaagtgct

SEQ ID NO: 8564083 - DNA, 22 bp, Homo sapiens
caggtgcctcaggatgagacaa

SEQ ID NO: 8564084 - DNA, 22 bp, Homo sapiens
caggtgccgggaatgcagcaat

SEQ ID NO: 8564085 - DNA, 22 bp, Homo sapiens
caggtgcccaggggacagtggc

SEQ ID NO: 8564086 - DNA, 22 bp, Homo sapiens
caggtgccgggaatgcagcaat

SEQ ID NO: 8564087 - DNA, 22 bp, Homo sapiens
caggtgccgggaatgcagcaat

SEQ ID NO: 8564088 - DNA, 22 bp, Homo sapiens
caggtgcccagctcctgctgtg

SEQ ID NO: 8564089 - DNA, 22 bp, Homo sapiens
caggtgcccagctcctgctgtg

SEQ ID NO: 8564090 - DNA, 22 bp, Homo sapiens
caggtgcccagctcctgctgtg

SEQ ID NO: 8564091 - DNA, 18 bp, Homo sapiens
caggtcagcctggcctca

SEQ ID NO: 8564092 - DNA, 18 bp, Homo sapiens
caggtcagcctggcctca

SEQ ID NO: 8564093 - DNA, 22 bp, Homo sapiens
caggtcagcacttggaggtgca

SEQ ID NO: 8564094 - DNA, 22 bp, Homo sapiens
caggtcagctggtgccccaggt

SEQ ID NO: 8564095 - DNA, 22 bp, Homo sapiens
caggtccaactatttatctgtg

SEQ ID NO: 8564096 - DNA, 22 bp, Homo sapiens
caggtcagctggtgccccaggt

SEQ ID NO: 8564097 - DNA, 22 bp, Homo sapiens
caggtccaagagatcctcctac

SEQ ID NO: 8564098 - DNA, 22 bp, Homo sapiens
caggtccaattgcgctaaaatc

SEQ ID NO: 8564099 - DNA, 22 bp, Homo sapiens
caggtccaattgcgctaaaatc

SEQ ID NO: 8564100 - DNA, 22 bp, Homo sapiens
caggtccacagcccatcactgc

SEQ ID NO: 8564101 - DNA, 22 bp, Homo sapiens
caggtccacagcccatcactgc

SEQ ID NO: 8564102 - DNA, 22 bp, Homo sapiens
caggtgaagaggataaaaagtt

SEQ ID NO: 8564103 - DNA, 22 bp, Homo sapiens
caggtgaatcacttgagtccag

SEQ ID NO: 8564104 - DNA, 22 bp, Homo sapiens
caggtcagagtccccctgtcct

SEQ ID NO: 8564105 - DNA, 22 bp, Homo sapiens
caggtcagaggtagatgagatg

SEQ ID NO: 8564106 - DNA, 22 bp, Homo sapiens
caggtcagaggtagatgagatg

SEQ ID NO: 8564107 - DNA, 22 bp, Homo sapiens
caggtcagaggcgcagccccca

SEQ ID NO: 8564108 - DNA, 22 bp, Homo sapiens
caggtcagaggtagatgagatg

SEQ ID NO: 8564109 - DNA, 22 bp, Homo sapiens
caggtcagaggcgcagccccca

SEQ ID NO: 8564110 - DNA, 22 bp, Homo sapiens
caggtcagaggcgcagccccca

SEQ ID NO: 8564111 - DNA, 22 bp, Homo sapiens
caggtaggtatggtgcagtctt

SEQ ID NO: 8564112 - DNA, 22 bp, Homo sapiens
caggtagtccacagtgagggag

SEQ ID NO: 8564113 - DNA, 22 bp, Homo sapiens
caggtataacgtgcatgttgta

SEQ ID NO: 8564114 - DNA, 22 bp, Homo sapiens
caggtagggatatgatggtgat

SEQ ID NO: 8564115 - DNA, 22 bp, Homo sapiens
caggtagggatatgatggtgat

SEQ ID NO: 8564116 - DNA, 22 bp, Homo sapiens
caggtaggcagccggtctctgg

SEQ ID NO: 8564117 - DNA, 22 bp, Homo sapiens
cagggtttctgttgagaagtcc

SEQ ID NO: 8564118 - DNA, 22 bp, Homo sapiens
cagggtggggctggctatcaaa

SEQ ID NO: 8564119 - DNA, 22 bp, Homo sapiens
caggtacactcccttgtgctga

SEQ ID NO: 8564120 - DNA, 22 bp, Homo sapiens
caggtacaaagctactgcctga

SEQ ID NO: 8564121 - DNA, 22 bp, Homo sapiens
caggtacaaagctactgcctga

SEQ ID NO: 8564122 - DNA, 22 bp, Homo sapiens
caggtaaggtcacattctgaag

SEQ ID NO: 8564123 - DNA, 17 bp, Homo sapiens
caggtacattgctactg

SEQ ID NO: 8564124 - DNA, 22 bp, Homo sapiens
caggtacattcgtagacccatt

SEQ ID NO: 8564125 - DNA, 22 bp, Homo sapiens
caggtaggatggaagggctcaa

SEQ ID NO: 8564126 - DNA, 22 bp, Homo sapiens
caggtaggatggaagggctcaa

SEQ ID NO: 8564127 - DNA, 22 bp, Homo sapiens
tattatcattaactgttgaatt

SEQ ID NO: 8564128 - DNA, 22 bp, Homo sapiens
tattatcattggtaatatggtc

SEQ ID NO: 8564129 - DNA, 22 bp, Homo sapiens
tattatcattaactgttgaatt

SEQ ID NO: 8564130 - DNA, 22 bp, Homo sapiens
tattatatttagtaatgtggag

SEQ ID NO: 8564131 - DNA, 22 bp, Homo sapiens
tattatctagtaactgatagtg

SEQ ID NO: 8564132 - DNA, 22 bp, Homo sapiens
tattatgagccaggtgctgtct

SEQ ID NO: 8564133 - DNA, 20 bp, Homo sapiens
tattatgacctgtgttctgg

SEQ ID NO: 8564134 - DNA, 22 bp, Homo sapiens
tattatgaggggcagagggcat

SEQ ID NO: 8564135 - DNA, 22 bp, Homo sapiens
tattatgaggcttagggatgac

SEQ ID NO: 8564136 - DNA, 22 bp, Homo sapiens
tattatgaggactggtgtaagg

SEQ ID NO: 8564137 - DNA, 22 bp, Homo sapiens
tattatgattcggacgtggcag

SEQ ID NO: 8564138 - DNA, 22 bp, Homo sapiens
tattatgatcgtgactcaagga

SEQ ID NO: 8564139 - DNA, 22 bp, Homo sapiens
tattatgatcccagccctggag

SEQ ID NO: 8564140 - DNA, 22 bp, Homo sapiens
tattatgaggtatttggacttt

SEQ ID NO: 8564141 - DNA, 18 bp, Homo sapiens
caggtgggtctcctgccc

SEQ ID NO: 8564142 - DNA, 18 bp, Homo sapiens
caggtgggtctcctgccc

SEQ ID NO: 8564143 - DNA, 18 bp, Homo sapiens
caggtgggtctcctgccc

SEQ ID NO: 8564144 - DNA, 22 bp, Homo sapiens
caggtgggtacatcacagagac

SEQ ID NO: 8564145 - DNA, 22 bp, Homo sapiens
caggtgggtacatcacagagac

SEQ ID NO: 8564146 - DNA, 22 bp, Homo sapiens
caggtgggtacatcacagagac

SEQ ID NO: 8564147 - DNA, 22 bp, Homo sapiens
tattatggcagcattcagtatg

SEQ ID NO: 8564148 - DNA, 22 bp, Homo sapiens
tattatggggggaacatcactc

SEQ ID NO: 8564149 - DNA, 22 bp, Homo sapiens
tattatggttgtaggttaacaa

SEQ ID NO: 8564150 - DNA, 22 bp, Homo sapiens
tattatgtagagtaagggttaa

SEQ ID NO: 8564151 - DNA, 22 bp, Homo sapiens
caggtggatctctaaggactga

SEQ ID NO: 8564152 - DNA, 22 bp, Homo sapiens
caggtggagctgactgagggca

SEQ ID NO: 8564153 - DNA, 22 bp, Homo sapiens
caggtggcagaggtctctggaa

SEQ ID NO: 8564154 - DNA, 22 bp, Homo sapiens
caggtggcagtgcctgcattct

SEQ ID NO: 8564155 - DNA, 22 bp, Homo sapiens
caggtggcagaggtctctggaa

SEQ ID NO: 8564156 - DNA, 22 bp, Homo sapiens
caggtggcatgactgcctacaa

SEQ ID NO: 8564157 - DNA, 22 bp, Homo sapiens
caggtggccagtactcaaggat

SEQ ID NO: 8564158 - DNA, 22 bp, Homo sapiens
caggtggccttgccatctcctg

SEQ ID NO: 8564159 - DNA, 22 bp, Homo sapiens
caggtggccttgccatctcctg

SEQ ID NO: 8564160 - DNA, 23 bp, Homo sapiens
caggtggctccacgaggggtggg

SEQ ID NO: 8564161 - DNA, 23 bp, Homo sapiens
caggtggctccacgaggggtggg

SEQ ID NO: 8564162 - DNA, 23 bp, Homo sapiens
caggtggctccacgaggggtggg

SEQ ID NO: 8564163 - DNA, 23 bp, Homo sapiens
caggtggctccacgaggggtggg

SEQ ID NO: 8564164 - DNA, 22 bp, Homo sapiens
caggtggctaacggcctcatag

SEQ ID NO: 8564165 - DNA, 19 bp, Homo sapiens
caggtggcgctctacaggg

SEQ ID NO: 8564166 - DNA, 19 bp, Homo sapiens
caggtggcgctctacaggg

SEQ ID NO: 8564167 - DNA, 19 bp, Homo sapiens
caggtggcgctctacaggg

SEQ ID NO: 8564168 - DNA, 22 bp, Homo sapiens
tattaaatatatctgttagttg

SEQ ID NO: 8564169 - DNA, 22 bp, Homo sapiens
tattaaatgttatttgggttgt

SEQ ID NO: 8564170 - DNA, 22 bp, Homo sapiens
caggtggctgagctgacctttg

SEQ ID NO: 8564171 - DNA, 22 bp, Homo sapiens
tattaaatgttatttgggttgt

SEQ ID NO: 8564172 - DNA, 22 bp, Homo sapiens
tattagtagcttgaaattggtg

SEQ ID NO: 8564173 - DNA, 22 bp, Homo sapiens
cagggagatcttggctcctggt

SEQ ID NO: 8564174 - DNA, 22 bp, Homo sapiens
cagggagatcttggctcctggt

SEQ ID NO: 8564175 - DNA, 22 bp, Homo sapiens
cagggagcagcccctagaagta

SEQ ID NO: 8564176 - DNA, 22 bp, Homo sapiens
cagggagcaggctctgtccatc

SEQ ID NO: 8564177 - DNA, 22 bp, Homo sapiens
cagggagcagcccctagaagta

SEQ ID NO: 8564178 - DNA, 22 bp, Homo sapiens
tagatttgtttccttctctcca

SEQ ID NO: 8564179 - DNA, 22 bp, Homo sapiens
tagatttgtttccttctctcca

SEQ ID NO: 8564180 - DNA, 22 bp, Homo sapiens
tagatttctaacagtgtgcttg

SEQ ID NO: 8564181 - DNA, 22 bp, Homo sapiens
tagatttcgctgcatctcaatc

SEQ ID NO: 8564182 - DNA, 22 bp, Homo sapiens
tagattgattgcaaagacaggc

SEQ ID NO: 8564183 - DNA, 22 bp, Homo sapiens
tagattgttcttaactttataa

SEQ ID NO: 8564184 - DNA, 22 bp, Homo sapiens
tagatttcaggagacaaaatgg

SEQ ID NO: 8564185 - DNA, 22 bp, Homo sapiens
cagggagcaggctctgtccatc

SEQ ID NO: 8564186 - DNA, 22 bp, Homo sapiens
cagggagccccaattccatgcc

SEQ ID NO: 8564187 - DNA, 22 bp, Homo sapiens
cagggccagggctatggtgaag

SEQ ID NO: 8564188 - DNA, 22 bp, Homo sapiens
cagggccagttctcgcagcagt

SEQ ID NO: 8564189 - DNA, 22 bp, Homo sapiens
cagggccagggctatggtgaag

SEQ ID NO: 8564190 - DNA, 22 bp, Homo sapiens
cagggccattggcgtggctgtc

SEQ ID NO: 8564191 - DNA, 22 bp, Homo sapiens
tagcttaaggagtaccagatca

SEQ ID NO: 8564192 - DNA, 22 bp, Homo sapiens
cagggccattggcgtggctgtc

SEQ ID NO: 8564193 - DNA, 22 bp, Homo sapiens
cagggccatgaggcacagggtc

SEQ ID NO: 8564194 - DNA, 22 bp, Homo sapiens
cagggccatgaggcacagggtc

SEQ ID NO: 8564195 - DNA, 22 bp, Homo sapiens
cagggccatatcttgtgcacca

SEQ ID NO: 8564196 - DNA, 22 bp, Homo sapiens
cagggccatatcttgtgcacca

SEQ ID NO: 8564197 - DNA, 22 bp, Homo sapiens
cagggccagttctcgcagcagt

SEQ ID NO: 8564198 - DNA, 22 bp, Homo sapiens
cagggccatatcttgtgcacca

SEQ ID NO: 8564199 - DNA, 22 bp, Homo sapiens
cagggccatatcttgtgcacca

SEQ ID NO: 8564200 - DNA, 22 bp, Homo sapiens
taggccaaggacagtaaggaca

SEQ ID NO: 8564201 - DNA, 22 bp, Homo sapiens
taggccaacgtggaagggtcca

SEQ ID NO: 8564202 - DNA, 22 bp, Homo sapiens
taggccaaatgacttgatgttt

SEQ ID NO: 8564203 - DNA, 22 bp, Homo sapiens
taggcaggtgtgcactgcccac

SEQ ID NO: 8564204 - DNA, 22 bp, Homo sapiens
taggcagggattagggttgatt

SEQ ID NO: 8564205 - DNA, 22 bp, Homo sapiens
taggcagggattagggttgatt

SEQ ID NO: 8564206 - DNA, 22 bp, Homo sapiens
tagcttctaatacttaccaatt

SEQ ID NO: 8564207 - DNA, 22 bp, Homo sapiens
tagcttctatacaacttcagca

SEQ ID NO: 8564208 - DNA, 21 bp, Homo sapiens
tagcttccagctcaagctgag

SEQ ID NO: 8564209 - DNA, 22 bp, Homo sapiens
tagcttccctagctaaagaggt

SEQ ID NO: 8564210 - DNA, 22 bp, Homo sapiens
tagcttctaatacttaccaatt

SEQ ID NO: 8564211 - DNA, 22 bp, Homo sapiens
tagcttccctgctggatcataa

SEQ ID NO: 8564212 - DNA, 22 bp, Homo sapiens
tagcttcagggaaaccactgct

SEQ ID NO: 8564213 - DNA, 19 bp, Homo sapiens
tagcttcacgtggtctaga

SEQ ID NO: 8564214 - DNA, 22 bp, Homo sapiens
tagcttgactattctatgatgt

SEQ ID NO: 8564215 - DNA, 22 bp, Homo sapiens
tagcttctgggagtgtttacta

SEQ ID NO: 8564216 - DNA, 22 bp, Homo sapiens
tagcttctcttttcaacatctt

SEQ ID NO: 8564217 - DNA, 22 bp, Homo sapiens
tagcttctggagtgtttgaaaa

SEQ ID NO: 8564218 - DNA, 22 bp, Homo sapiens
tagctttaaaaatcatcaaagc

SEQ ID NO: 8564219 - DNA, 22 bp, Homo sapiens
tagctttaaaaatcatcaaagc

SEQ ID NO: 8564220 - DNA, 22 bp, Homo sapiens
tagctttaagacatggtgaatg

SEQ ID NO: 8564221 - DNA, 22 bp, Homo sapiens
taggccacagagaggagatttc

SEQ ID NO: 8564222 - DNA, 22 bp, Homo sapiens
taggccacaaataagatcctgt

SEQ ID NO: 8564223 - DNA, 22 bp, Homo sapiens
taggccaccagggttccattta

SEQ ID NO: 8564224 - DNA, 21 bp, Homo sapiens
taggccacatgggttggagat

SEQ ID NO: 8564225 - DNA, 22 bp, Homo sapiens
taggccacagatgagacataag

SEQ ID NO: 8564226 - DNA, 19 bp, Homo sapiens
taggccagaagttttccac

SEQ ID NO: 8564227 - DNA, 22 bp, Homo sapiens
taggccactctcctttgtctca

SEQ ID NO: 8564228 - DNA, 22 bp, Homo sapiens
taggccacggaaagcaggttgc

SEQ ID NO: 8564229 - DNA, 22 bp, Homo sapiens
taggccacgaaggagatgatag

SEQ ID NO: 8564230 - DNA, 22 bp, Homo sapiens
cagggcccaggccactgggttg

SEQ ID NO: 8564231 - DNA, 22 bp, Homo sapiens
cagggcccaggccactgggttg

SEQ ID NO: 8564232 - DNA, 22 bp, Homo sapiens
cagggcccaagacacaatgagg

SEQ ID NO: 8564233 - DNA, 22 bp, Homo sapiens
cagggcccaagacacaatgagg

SEQ ID NO: 8564234 - DNA, 22 bp, Homo sapiens
taggccagaggagcagctttgg

SEQ ID NO: 8564235 - DNA, 22 bp, Homo sapiens
cagggcccagtccctgctgtca

SEQ ID NO: 8564236 - DNA, 22 bp, Homo sapiens
cagggcccagtccctgctgtca

SEQ ID NO: 8564237 - DNA, 22 bp, Homo sapiens
cagggcccatggctcaggtagg

SEQ ID NO: 8564238 - DNA, 18 bp, Homo sapiens
cagggccccagaattatc

SEQ ID NO: 8564239 - DNA, 22 bp, Homo sapiens
cagggcccatggctcaggtagg

SEQ ID NO: 8564240 - DNA, 22 bp, Homo sapiens
cagggcccatggctcaggtagg

SEQ ID NO: 8564241 - DNA, 22 bp, Homo sapiens
cagggccccagggatgtctgct

SEQ ID NO: 8564242 - DNA, 22 bp, Homo sapiens
cagggccccagggatgtctgct

SEQ ID NO: 8564243 - DNA, 22 bp, Homo sapiens
cagggcctcatcctcagagatt

SEQ ID NO: 8564244 - DNA, 22 bp, Homo sapiens
cagggcctcatcctcagagatt

SEQ ID NO: 8564245 - DNA, 22 bp, Homo sapiens
cagggcctcatcctcagagatt

SEQ ID NO: 8564246 - DNA, 22 bp, Homo sapiens
cagggctccatgcagggactcc

SEQ ID NO: 8564247 - DNA, 22 bp, Homo sapiens
cagggcctcatggccggggtgc

SEQ ID NO: 8564248 - DNA, 22 bp, Homo sapiens
cagggctcttcatcacacagta

SEQ ID NO: 8564249 - DNA, 20 bp, Homo sapiens
cagggctctgggcctggcct

SEQ ID NO: 8564250 - DNA, 20 bp, Homo sapiens
cagggctctgggcctggcct

SEQ ID NO: 8564251 - DNA, 22 bp, Homo sapiens
cagggctgaaatcaaggtgtag

SEQ ID NO: 8564252 - DNA, 22 bp, Homo sapiens
cagggctgaaatcaaggtgtag

SEQ ID NO: 8564253 - DNA, 22 bp, Homo sapiens
cagggctgaaatcaaggtgtag

SEQ ID NO: 8564254 - DNA, 18 bp, Homo sapiens
taggctgggggctgtagt

SEQ ID NO: 8564255 - DNA, 22 bp, Homo sapiens
taggctgggggtaggaattgag

SEQ ID NO: 8564256 - DNA, 22 bp, Homo sapiens
taggctgggctgagctggacgg

SEQ ID NO: 8564257 - DNA, 18 bp, Homo sapiens
taggctgggggctgtagt

SEQ ID NO: 8564258 - DNA, 22 bp, Homo sapiens
taggctgggctgagctggacgg

SEQ ID NO: 8564259 - DNA, 22 bp, Homo sapiens
taggctgggctgagctggacgg

SEQ ID NO: 8564260 - DNA, 22 bp, Homo sapiens
taggctgggcctgccttccagg

SEQ ID NO: 8564261 - DNA, 22 bp, Homo sapiens
taggctgggctgagctggacgg

SEQ ID NO: 8564262 - DNA, 22 bp, Homo sapiens
cagggctgagaatttagagaca

SEQ ID NO: 8564263 - DNA, 22 bp, Homo sapiens
taggctgtaagagagggcagag

SEQ ID NO: 8564264 - DNA, 22 bp, Homo sapiens
taggcttcccgctcacatgccc

SEQ ID NO: 8564265 - DNA, 22 bp, Homo sapiens
taggcttccgagtcttggtatc

SEQ ID NO: 8564266 - DNA, 22 bp, Homo sapiens
tagggaaaagacttcactgttt

SEQ ID NO: 8564267 - DNA, 22 bp, Homo sapiens
tagggaaatatagatttagggc

SEQ ID NO: 8564268 - DNA, 22 bp, Homo sapiens
cagggctgggttaaaagcaggg

SEQ ID NO: 8564269 - DNA, 22 bp, Homo sapiens
cagggctgggttaaaagcaggg

SEQ ID NO: 8564270 - DNA, 23 bp, Homo sapiens
cagggctggtagggaagagcgtg

SEQ ID NO: 8564271 - DNA, 23 bp, Homo sapiens
cagggctggtagggaagagcgtg

SEQ ID NO: 8564272 - DNA, 23 bp, Homo sapiens
cagggctggtagggaagagcgtg

SEQ ID NO: 8564273 - DNA, 22 bp, Homo sapiens
cagggctggtttgtcgaagaaa

SEQ ID NO: 8564274 - DNA, 23 bp, Homo sapiens
cagggctggtagggaagagcgtg

SEQ ID NO: 8564275 - DNA, 23 bp, Homo sapiens
cagggctggtagggaagagcgtg

SEQ ID NO: 8564276 - DNA, 22 bp, Homo sapiens
cagggctggtttgtcgaagaaa

SEQ ID NO: 8564277 - DNA, 22 bp, Homo sapiens
cagggctggtttgtcgaagaaa

SEQ ID NO: 8564278 - DNA, 22 bp, Homo sapiens
cagggctggtttgtcgaagaaa

SEQ ID NO: 8564279 - DNA, 22 bp, Homo sapiens
cagggctgtaaattagtgctga

SEQ ID NO: 8564280 - DNA, 22 bp, Homo sapiens
cagggctgtctccaaaggcccc

SEQ ID NO: 8564281 - DNA, 22 bp, Homo sapiens
cagggctgtaaattagtgctga

SEQ ID NO: 8564282 - DNA, 22 bp, Homo sapiens
cagggggtggtccaggctgcgc

SEQ ID NO: 8564283 - DNA, 22 bp, Homo sapiens
cagggggtggtccaggctgcgc

SEQ ID NO: 8564284 - DNA, 22 bp, Homo sapiens
caggggtggctgcagcagaggt

SEQ ID NO: 8564285 - DNA, 22 bp, Homo sapiens
caggggtggctgcagcagaggt

SEQ ID NO: 8564286 - DNA, 22 bp, Homo sapiens
caggggtggctgcagcagaggt

SEQ ID NO: 8564287 - DNA, 22 bp, Homo sapiens
caggggtggctgcagcagaggt

SEQ ID NO: 8564288 - DNA, 22 bp, Homo sapiens
caggggtggctgcagcagaggt

SEQ ID NO: 8564289 - DNA, 22 bp, Homo sapiens
cagggtagacagtaggtgtctg

SEQ ID NO: 8564290 - DNA, 22 bp, Homo sapiens
cagggtagggcaagggaacctg

SEQ ID NO: 8564291 - DNA, 22 bp, Homo sapiens
cagggtagacagtaggtgtctg

SEQ ID NO: 8564292 - DNA, 22 bp, Homo sapiens
cagggtagacagtaggtgtctg

SEQ ID NO: 8564293 - DNA, 22 bp, Homo sapiens
cagggtagggcaagggaacctg

SEQ ID NO: 8564294 - DNA, 22 bp, Homo sapiens
caggggtgtttttggccaggag

SEQ ID NO: 8564295 - DNA, 22 bp, Homo sapiens
caggggtgtttttggccaggag

SEQ ID NO: 8564296 - DNA, 22 bp, Homo sapiens
cagggtacagagttttctaaac

SEQ ID NO: 8564297 - DNA, 22 bp, Homo sapiens
caggggtgtttttggccaggag

SEQ ID NO: 8564298 - DNA, 22 bp, Homo sapiens
cagggtagacagtaggtgtctg

SEQ ID NO: 8564299 - DNA, 22 bp, Homo sapiens
cagggtagacagtaggtgtctg

SEQ ID NO: 8564300 - DNA, 22 bp, Homo sapiens
cagggtccggctgcctggctgt

SEQ ID NO: 8564301 - DNA, 22 bp, Homo sapiens
cagggtggggctggctatcaaa

SEQ ID NO: 8564302 - DNA, 22 bp, Homo sapiens
cagggtctgatggtcctcactt

SEQ ID NO: 8564303 - DNA, 22 bp, Homo sapiens
cagggtagtaatttaatacaag

SEQ ID NO: 8564304 - DNA, 22 bp, Homo sapiens
cagggtccatctttcatcactg

SEQ ID NO: 8564305 - DNA, 22 bp, Homo sapiens
cagggtcatggcacctgcacgg

SEQ ID NO: 8564306 - DNA, 22 bp, Homo sapiens
cagggtcaggctgctagaagct

SEQ ID NO: 8564307 - DNA, 22 bp, Homo sapiens
caggggcctgtcctggcttctg

SEQ ID NO: 8564308 - DNA, 22 bp, Homo sapiens
caggggcgggtaaaaggcctcc

SEQ ID NO: 8564309 - DNA, 22 bp, Homo sapiens
caggggctgtttgcctcaggcc

SEQ ID NO: 8564310 - DNA, 22 bp, Homo sapiens
caggggctgtttgcctcaggcc

SEQ ID NO: 8564311 - DNA, 22 bp, Homo sapiens
caggggctgtttgcctcaggcc

SEQ ID NO: 8564312 - DNA, 22 bp, Homo sapiens
caggggcttaagtgacagaagg

SEQ ID NO: 8564313 - DNA, 22 bp, Homo sapiens
caggggcttaagtgacagaagg

SEQ ID NO: 8564314 - DNA, 22 bp, Homo sapiens
caggggcttttcctctataagg

SEQ ID NO: 8564315 - DNA, 22 bp, Homo sapiens
caggggcttttcctctataagg

SEQ ID NO: 8564316 - DNA, 22 bp, Homo sapiens
caggggcttaagtgacagaagg

SEQ ID NO: 8564317 - DNA, 22 bp, Homo sapiens
cagggggctgtggctgtccagt

SEQ ID NO: 8564318 - DNA, 22 bp, Homo sapiens
cagggggctcaaaggagagtgc

SEQ ID NO: 8564319 - DNA, 22 bp, Homo sapiens
cagggggctcaaaggagagtgc

SEQ ID NO: 8564320 - DNA, 22 bp, Homo sapiens
cagggggctcaaaggagagtgc

SEQ ID NO: 8564321 - DNA, 22 bp, Homo sapiens
cagggggcagcgtagaaaatga

SEQ ID NO: 8564322 - DNA, 22 bp, Homo sapiens
cagggggctcaaaggagagtgc

SEQ ID NO: 8564323 - DNA, 22 bp, Homo sapiens
cagggctgtggctttgtgctgt

SEQ ID NO: 8564324 - DNA, 22 bp, Homo sapiens
cagggctgtggctttgtgctgt

SEQ ID NO: 8564325 - DNA, 22 bp, Homo sapiens
caggggcctgtcctggcttctg

SEQ ID NO: 8564326 - DNA, 22 bp, Homo sapiens
cagggctgtgcccatcttcccc

SEQ ID NO: 8564327 - DNA, 22 bp, Homo sapiens
cagggctgtctccaaaggcccc

SEQ ID NO: 8564328 - DNA, 17 bp, Homo sapiens
cagggctgtctgcctag

SEQ ID NO: 8564329 - DNA, 22 bp, Homo sapiens
taatcacagaaacagactgttt

SEQ ID NO: 8564330 - DNA, 22 bp, Homo sapiens
taatcacagaaacagactgttt

SEQ ID NO: 8564331 - DNA, 22 bp, Homo sapiens
taatcacagaaacagactgttt

SEQ ID NO: 8564332 - DNA, 22 bp, Homo sapiens
taatcacagaaatgcccattca

SEQ ID NO: 8564333 - DNA, 22 bp, Homo sapiens
taatcacatcagggtaaatggg

SEQ ID NO: 8564334 - DNA, 22 bp, Homo sapiens
taatcacatcagggtaaatggg

SEQ ID NO: 8564335 - DNA, 22 bp, Homo sapiens
taatatttctaccctgctgcct

SEQ ID NO: 8564336 - DNA, 22 bp, Homo sapiens
taatcacaattcagatgtctta

SEQ ID NO: 8564337 - DNA, 22 bp, Homo sapiens
taatcacaattcagatgtctta

SEQ ID NO: 8564338 - DNA, 22 bp, Homo sapiens
taatatctggcattcaaacatg

SEQ ID NO: 8564339 - DNA, 22 bp, Homo sapiens
taatatctggcattcaaacatg

SEQ ID NO: 8564340 - DNA, 22 bp, Homo sapiens
taatatctacttcatagagttt

SEQ ID NO: 8564341 - DNA, 22 bp, Homo sapiens
taatacagatacaaaggaggac

SEQ ID NO: 8564342 - DNA, 22 bp, Homo sapiens
taatatgtgttactgacttttt

SEQ ID NO: 8564343 - DNA, 22 bp, Homo sapiens
taatccaatggcacaatgtatg

SEQ ID NO: 8564344 - DNA, 22 bp, Homo sapiens
taatccaaaactgaatctgtgg

SEQ ID NO: 8564345 - DNA, 22 bp, Homo sapiens
taatccacaatagagattatct

SEQ ID NO: 8564346 - DNA, 22 bp, Homo sapiens
taatccacaatagagattatct

SEQ ID NO: 8564347 - DNA, 22 bp, Homo sapiens
taatccaaaactgaatctgtgg

SEQ ID NO: 8564348 - DNA, 22 bp, Homo sapiens
taatcatatgggtaatccaatg

SEQ ID NO: 8564349 - DNA, 22 bp, Homo sapiens
taatcatatgggtaatccaatg

SEQ ID NO: 8564350 - DNA, 22 bp, Homo sapiens
taatcacttttcattagtacct

SEQ ID NO: 8564351 - DNA, 20 bp, Homo sapiens
taatcacttataagacaatg

SEQ ID NO: 8564352 - DNA, 22 bp, Homo sapiens
taatcacatcagggtaaatggg

SEQ ID NO: 8564353 - DNA, 22 bp, Homo sapiens
taatcactgggcgtttggtact

SEQ ID NO: 8564354 - DNA, 22 bp, Homo sapiens
taatcactgggcgtttggtact

SEQ ID NO: 8564355 - DNA, 22 bp, Homo sapiens
taatcactgtgagtctgttttc

SEQ ID NO: 8564356 - DNA, 22 bp, Homo sapiens
taatcactgtcaacctttgttc

SEQ ID NO: 8564357 - DNA, 20 bp, Homo sapiens
taatcacttataagacaatg

SEQ ID NO: 8564358 - DNA, 20 bp, Homo sapiens
taatgtcaaagtcacaaggt

SEQ ID NO: 8564359 - DNA, 22 bp, Homo sapiens
taatgtcaaggtcattctagag

SEQ ID NO: 8564360 - DNA, 22 bp, Homo sapiens
taatccagcgggtgattgcaca

SEQ ID NO: 8564361 - DNA, 22 bp, Homo sapiens
taatgtcaaggtcattctagag

SEQ ID NO: 8564362 - DNA, 22 bp, Homo sapiens
taatgtctagatcagacctcga

SEQ ID NO: 8564363 - DNA, 22 bp, Homo sapiens
taatgtcttagtaccttaattt

SEQ ID NO: 8564364 - DNA, 22 bp, Homo sapiens
taatgtctgtgtttcagtgcag

SEQ ID NO: 8564365 - DNA, 22 bp, Homo sapiens
taatgtctatgggccagataat

SEQ ID NO: 8564366 - DNA, 22 bp, Homo sapiens
taatgtgtcctgaaagcttctg

SEQ ID NO: 8564367 - DNA, 22 bp, Homo sapiens
taatgtgaagacataaatcaga

SEQ ID NO: 8564368 - DNA, 22 bp, Homo sapiens
taatgtctttaagagcattggg

SEQ ID NO: 8564369 - DNA, 22 bp, Homo sapiens
taatgtgttgaatatttgtaca

SEQ ID NO: 8564370 - DNA, 22 bp, Homo sapiens
taatgtgtgtcatcagtagagt

SEQ ID NO: 8564371 - DNA, 22 bp, Homo sapiens
caggcatgcttctgtctgggca

SEQ ID NO: 8564372 - DNA, 22 bp, Homo sapiens
caggcagggagctggaaaggat

SEQ ID NO: 8564373 - DNA, 22 bp, Homo sapiens
caggcatggagaggcagagact

SEQ ID NO: 8564374 - DNA, 22 bp, Homo sapiens
caggcatggaaaagcccagagg

SEQ ID NO: 8564375 - DNA, 22 bp, Homo sapiens
caggcatggagaggcagagact

SEQ ID NO: 8564376 - DNA, 22 bp, Homo sapiens
caggcccaagactgatgagtct

SEQ ID NO: 8564377 - DNA, 22 bp, Homo sapiens
caggcccacgaggcacacagag

SEQ ID NO: 8564378 - DNA, 22 bp, Homo sapiens
caggccagtgtgcttcccaggc

SEQ ID NO: 8564379 - DNA, 22 bp, Homo sapiens
caggccagtgtgcttcccaggc

SEQ ID NO: 8564380 - DNA, 19 bp, Homo sapiens
caggccagtgtcagggggc

SEQ ID NO: 8564381 - DNA, 22 bp, Homo sapiens
caggccagtgtgcttcccaggc

SEQ ID NO: 8564382 - DNA, 22 bp, Homo sapiens
caggccaggtgctctagaatca

SEQ ID NO: 8564383 - DNA, 22 bp, Homo sapiens
caggccagggttgagaagagaa

SEQ ID NO: 8564384 - DNA, 22 bp, Homo sapiens
caggccagggttgagaagagaa

SEQ ID NO: 8564385 - DNA, 22 bp, Homo sapiens
caggccagggttgagaagagaa

SEQ ID NO: 8564386 - DNA, 22 bp, Homo sapiens
caggccagggttgagaagagaa

SEQ ID NO: 8564387 - DNA, 19 bp, Homo sapiens
caggccagtgtcagggggc

SEQ ID NO: 8564388 - DNA, 19 bp, Homo sapiens
caggccagtgtcagggggc

SEQ ID NO: 8564389 - DNA, 22 bp, Homo sapiens
caggccagtgggaaatagggat

SEQ ID NO: 8564390 - DNA, 22 bp, Homo sapiens
caggccaggtggcaggcaaaac

SEQ ID NO: 8564391 - DNA, 22 bp, Homo sapiens
caggccaggtggcaggcaaaac

SEQ ID NO: 8564392 - DNA, 22 bp, Homo sapiens
caggccaggtggcaggcaaaac

SEQ ID NO: 8564393 - DNA, 22 bp, Homo sapiens
tacaaaacagtgctctggtcct

SEQ ID NO: 8564394 - DNA, 22 bp, Homo sapiens
tacaaaacagtgctctggtcct

SEQ ID NO: 8564395 - DNA, 22 bp, Homo sapiens
tacaaaacagtgctctggtcct

SEQ ID NO: 8564396 - DNA, 22 bp, Homo sapiens
tacaaaagtaattacggttttt

SEQ ID NO: 8564397 - DNA, 20 bp, Homo sapiens
tacaaacctccacactggtg

SEQ ID NO: 8564398 - DNA, 22 bp, Homo sapiens
caggcatttcgcaaaggctgag

SEQ ID NO: 8564399 - DNA, 22 bp, Homo sapiens
caggcatgtggcccaggggtga

SEQ ID NO: 8564400 - DNA, 22 bp, Homo sapiens
tacaaaaaattgatactgacga

SEQ ID NO: 8564401 - DNA, 22 bp, Homo sapiens
tacaaaaaattgatactgacga

SEQ ID NO: 8564402 - DNA, 22 bp, Homo sapiens
tacaaaaaattgatactgacga

SEQ ID NO: 8564403 - DNA, 22 bp, Homo sapiens
tacaaaaaattgatactgacga

SEQ ID NO: 8564404 - DNA, 22 bp, Homo sapiens
caggcacctgtgtgtctcaggg

SEQ ID NO: 8564405 - DNA, 22 bp, Homo sapiens
caggcacctgtgtgtctcaggg

SEQ ID NO: 8564406 - DNA, 22 bp, Homo sapiens
caggcacctcacgtgggtccca

SEQ ID NO: 8564407 - DNA, 22 bp, Homo sapiens
caggcaccccaggtgagcactg

SEQ ID NO: 8564408 - DNA, 22 bp, Homo sapiens
caggcaccccaggtgagcactg

SEQ ID NO: 8564409 - DNA, 22 bp, Homo sapiens
caggcacctcacgtgggtccca

SEQ ID NO: 8564410 - DNA, 22 bp, Homo sapiens
caggcaccctctgaggggaagc

SEQ ID NO: 8564411 - DNA, 22 bp, Homo sapiens
caggcaccaatagggatcgtgg

SEQ ID NO: 8564412 - DNA, 22 bp, Homo sapiens
caggcaccaacttcctggggag

SEQ ID NO: 8564413 - DNA, 22 bp, Homo sapiens
caggcaccagtgagaagggcct

SEQ ID NO: 8564414 - DNA, 22 bp, Homo sapiens
caggcaccacactaggggctga

SEQ ID NO: 8564415 - DNA, 22 bp, Homo sapiens
caggcacccagcccagtcgcac

SEQ ID NO: 8564416 - DNA, 22 bp, Homo sapiens
caggcacccagcccagtcgcac

SEQ ID NO: 8564417 - DNA, 22 bp, Homo sapiens
caggcacccagcccagtcgcac

SEQ ID NO: 8564418 - DNA, 22 bp, Homo sapiens
caggcaccccaggtgagcactg

SEQ ID NO: 8564419 - DNA, 22 bp, Homo sapiens
caggcacctttgtgcatgggca

SEQ ID NO: 8564420 - DNA, 22 bp, Homo sapiens
caggcagagttagagcaactgg

SEQ ID NO: 8564421 - DNA, 22 bp, Homo sapiens
caggcagagttagagcaactgg

SEQ ID NO: 8564422 - DNA, 22 bp, Homo sapiens
caggcagagttagagcaactgg

SEQ ID NO: 8564423 - DNA, 22 bp, Homo sapiens
caggcagatgctgacaagagtt

SEQ ID NO: 8564424 - DNA, 22 bp, Homo sapiens
caggcagatgctgacaagagtt

SEQ ID NO: 8564425 - DNA, 22 bp, Homo sapiens
caggcagagttagtgatttagg

SEQ ID NO: 8564426 - DNA, 22 bp, Homo sapiens
caggcagatgctgacaagagtt

SEQ ID NO: 8564427 - DNA, 22 bp, Homo sapiens
caggcagatttgctgccctcca

SEQ ID NO: 8564428 - DNA, 22 bp, Homo sapiens
caggcagatttgctgccctcca

SEQ ID NO: 8564429 - DNA, 22 bp, Homo sapiens
caggcagatttgctgccctcca

SEQ ID NO: 8564430 - DNA, 22 bp, Homo sapiens
caggcagcagaggagtgtggga

SEQ ID NO: 8564431 - DNA, 22 bp, Homo sapiens
taataattagttattgatcgtg

SEQ ID NO: 8564432 - DNA, 21 bp, Homo sapiens
taataattccactacagagta

SEQ ID NO: 8564433 - DNA, 21 bp, Homo sapiens
taataattccactacagagta

SEQ ID NO: 8564434 - DNA, 22 bp, Homo sapiens
taataattggcaatgttgagca

SEQ ID NO: 8564435 - DNA, 22 bp, Homo sapiens
taataattggcaatgttgagca

SEQ ID NO: 8564436 - DNA, 22 bp, Homo sapiens
taataattttaaagaaggctag

SEQ ID NO: 8564437 - DNA, 22 bp, Homo sapiens
taataattggctaaccctggga

SEQ ID NO: 8564438 - DNA, 22 bp, Homo sapiens
taatacagaagtgtattaaaat

SEQ ID NO: 8564439 - DNA, 22 bp, Homo sapiens
taatacaaggcaggaagcagta

SEQ ID NO: 8564440 - DNA, 22 bp, Homo sapiens
taatacaatggagttgggcccc

SEQ ID NO: 8564441 - DNA, 22 bp, Homo sapiens
taagtcgtggatgattcttcgg

SEQ ID NO: 8564442 - DNA, 22 bp, Homo sapiens
taagtcctattccaggtctctc

SEQ ID NO: 8564443 - DNA, 22 bp, Homo sapiens
taagtgaaataagtcagataca

SEQ ID NO: 8564444 - DNA, 22 bp, Homo sapiens
taagtgaaataagtcagataca

SEQ ID NO: 8564445 - DNA, 22 bp, Homo sapiens
taagtccactatatccttctct

SEQ ID NO: 8564446 - DNA, 18 bp, Homo sapiens
taagtcattttgccagca

SEQ ID NO: 8564447 - DNA, 18 bp, Homo sapiens
taagtcatttgaaatgcc

SEQ ID NO: 8564448 - DNA, 22 bp, Homo sapiens
taagtatgttagaaaatcaagt

SEQ ID NO: 8564449 - DNA, 23 bp, Homo sapiens
cagctcagcacataggaggtact

SEQ ID NO: 8564450 - DNA, 23 bp, Homo sapiens
cagctcagagtgtgtcctgtttc

SEQ ID NO: 8564451 - DNA, 23 bp, Homo sapiens
cagctcagcacataggaggtact

SEQ ID NO: 8564452 - DNA, 22 bp, Homo sapiens
taagtcatcacattgcagagat

SEQ ID NO: 8564453 - DNA, 22 bp, Homo sapiens
taagtcatcccataacagtgct

SEQ ID NO: 8564454 - DNA, 22 bp, Homo sapiens
taagtcataagtcatgatgtta

SEQ ID NO: 8564455 - DNA, 22 bp, Homo sapiens
gtgcttctcttcacacccaact

SEQ ID NO: 8564456 - DNA, 22 bp, Homo sapiens
gtgcttctcttcacacccaact

SEQ ID NO: 8564457 - DNA, 22 bp, Homo sapiens
gtgcttctccgttctgcagcac

SEQ ID NO: 8564458 - DNA, 22 bp, Homo sapiens
gtgcttcctctgccaacactct

SEQ ID NO: 8564459 - DNA, 20 bp, Homo sapiens
gtgcttcagaagccattgct

SEQ ID NO: 8564460 - DNA, 22 bp, Homo sapiens
gtgcttcactgacctgttttca

SEQ ID NO: 8564461 - DNA, 22 bp, Homo sapiens
gtgcttcaagttcttaatgttt

SEQ ID NO: 8564462 - DNA, 22 bp, Homo sapiens
gtgcttaacctagtttctagta

SEQ ID NO: 8564463 - DNA, 22 bp, Homo sapiens
gtgcttaacctagtttctagta

SEQ ID NO: 8564464 - DNA, 22 bp, Homo sapiens
cagctcagacgcaggtcgagca

SEQ ID NO: 8564465 - DNA, 22 bp, Homo sapiens
cagctcagacgcaggtcgagca

SEQ ID NO: 8564466 - DNA, 22 bp, Homo sapiens
cagctcagacgcaggtcgagca

SEQ ID NO: 8564467 - DNA, 22 bp, Homo sapiens
cagctcagacgcaggtcgagca

SEQ ID NO: 8564468 - DNA, 22 bp, Homo sapiens
cagctcaagtttcccaggtcag

SEQ ID NO: 8564469 - DNA, 22 bp, Homo sapiens
cagctcaagtttcccaggtcag

SEQ ID NO: 8564470 - DNA, 22 bp, Homo sapiens
cagctattttgcctatcatggt

SEQ ID NO: 8564471 - DNA, 22 bp, Homo sapiens
cagctattctctgaaatgaata

SEQ ID NO: 8564472 - DNA, 22 bp, Homo sapiens
cagctattggcaagaagtggtg

SEQ ID NO: 8564473 - DNA, 22 bp, Homo sapiens
cagctattgataaatgttgggg

SEQ ID NO: 8564474 - DNA, 22 bp, Homo sapiens
cagctattggtccacaggtatg

SEQ ID NO: 8564475 - DNA, 22 bp, Homo sapiens
cagctattggtccacaggtatg

SEQ ID NO: 8564476 - DNA, 22 bp, Homo sapiens
cagctattgataaatgttgggg

SEQ ID NO: 8564477 - DNA, 22 bp, Homo sapiens
cagctatttgtaggaaaactgt

SEQ ID NO: 8564478 - DNA, 22 bp, Homo sapiens
cagctattttctcattaaggat

SEQ ID NO: 8564479 - DNA, 22 bp, Homo sapiens
cagctattggtccacaggtatg

SEQ ID NO: 8564480 - DNA, 22 bp, Homo sapiens
cagctattggtccacaggtatg

SEQ ID NO: 8564481 - DNA, 22 bp, Homo sapiens
cagctattgttctgtataatga

SEQ ID NO: 8564482 - DNA, 22 bp, Homo sapiens
cagctatttatctttcatgata

SEQ ID NO: 8564483 - DNA, 22 bp, Homo sapiens
tagattctcccatcatgagatg

SEQ ID NO: 8564484 - DNA, 22 bp, Homo sapiens
tagattcttctaggtctttagc

SEQ ID NO: 8564485 - DNA, 22 bp, Homo sapiens
tagattcttcttttgagtctct

SEQ ID NO: 8564486 - DNA, 22 bp, Homo sapiens
tagattcatgcagtatgctagt

SEQ ID NO: 8564487 - DNA, 22 bp, Homo sapiens
tagattcagatatttaggacaa

SEQ ID NO: 8564488 - DNA, 22 bp, Homo sapiens
tagattcaagtattcagtttgg

SEQ ID NO: 8564489 - DNA, 22 bp, Homo sapiens
tagattcagatatttaggacaa

SEQ ID NO: 8564490 - DNA, 22 bp, Homo sapiens
tagatacaggctctctgagcct

SEQ ID NO: 8564491 - DNA, 22 bp, Homo sapiens
tagatacacacacagtcatgtg

SEQ ID NO: 8564492 - DNA, 22 bp, Homo sapiens
cagggacagcactaaactcttg

SEQ ID NO: 8564493 - DNA, 22 bp, Homo sapiens
cagggacaatggcagagcctga

SEQ ID NO: 8564494 - DNA, 22 bp, Homo sapiens
cagggacaaagtgagaaaggaa

SEQ ID NO: 8564495 - DNA, 22 bp, Homo sapiens
cagggacaaagtgagaaaggaa

SEQ ID NO: 8564496 - DNA, 22 bp, Homo sapiens
caggctttttctgctgtcctct

SEQ ID NO: 8564497 - DNA, 22 bp, Homo sapiens
caggctttttctgctgtcctct

SEQ ID NO: 8564498 - DNA, 22 bp, Homo sapiens
cagggaagaatagttagcaaag

SEQ ID NO: 8564499 - DNA, 22 bp, Homo sapiens
cagggaagaatagttagcaaag

SEQ ID NO: 8564500 - DNA, 22 bp, Homo sapiens
cagggaagagccgatgctgcag

SEQ ID NO: 8564501 - DNA, 22 bp, Homo sapiens
cagggaagagccgatgctgcag

SEQ ID NO: 8564502 - DNA, 22 bp, Homo sapiens
cagggaagagccgatgctgcag

SEQ ID NO: 8564503 - DNA, 22 bp, Homo sapiens
caggctgtctgaatggaggccc

SEQ ID NO: 8564504 - DNA, 22 bp, Homo sapiens
tagaaacaagggagaggattct

SEQ ID NO: 8564505 - DNA, 22 bp, Homo sapiens
caggcttggagggcagtggcat

SEQ ID NO: 8564506 - DNA, 22 bp, Homo sapiens
caggcttggcagggaggctggt

SEQ ID NO: 8564507 - DNA, 22 bp, Homo sapiens
caggcttgggagcagagccact

SEQ ID NO: 8564508 - DNA, 22 bp, Homo sapiens
caggcttgtgtctcagctgcag

SEQ ID NO: 8564509 - DNA, 22 bp, Homo sapiens
caggctttactttctctctgaa

SEQ ID NO: 8564510 - DNA, 22 bp, Homo sapiens
tagaaacaaagacctgggtgct

SEQ ID NO: 8564511 - DNA, 22 bp, Homo sapiens
tagaaacaaaatctgatgactc

SEQ ID NO: 8564512 - DNA, 22 bp, Homo sapiens
tagaaacaaaatctgatgactc

SEQ ID NO: 8564513 - DNA, 22 bp, Homo sapiens
tagaaacaaaatctgatgactc

SEQ ID NO: 8564514 - DNA, 22 bp, Homo sapiens
tagaaaatagggcctgtggagc

SEQ ID NO: 8564515 - DNA, 22 bp, Homo sapiens
tagaaaatagggcctgtggagc

SEQ ID NO: 8564516 - DNA, 22 bp, Homo sapiens
caggctgggcagcctccccggc

SEQ ID NO: 8564517 - DNA, 22 bp, Homo sapiens
caggctgggactgacccctgct

SEQ ID NO: 8564518 - DNA, 22 bp, Homo sapiens
caggctgggaacgccacccgct

SEQ ID NO: 8564519 - DNA, 22 bp, Homo sapiens
caggctgggaacgccacccgct

SEQ ID NO: 8564520 - DNA, 22 bp, Homo sapiens
caggctgggactgacccctgct

SEQ ID NO: 8564521 - DNA, 22 bp, Homo sapiens
caggctgggaacgccacccgct

SEQ ID NO: 8564522 - DNA, 22 bp, Homo sapiens
caggctgggaacgccacccgct

SEQ ID NO: 8564523 - DNA, 22 bp, Homo sapiens
caggctggcaatgcgtcaagca

SEQ ID NO: 8564524 - DNA, 22 bp, Homo sapiens
caggctgggaacgccacccgct

SEQ ID NO: 8564525 - DNA, 22 bp, Homo sapiens
caggctggagttcagtggtgtg

SEQ ID NO: 8564526 - DNA, 22 bp, Homo sapiens
caggctggcaatgcgtcaagca

SEQ ID NO: 8564527 - DNA, 22 bp, Homo sapiens
caggctggagttcagtggtgtg

SEQ ID NO: 8564528 - DNA, 22 bp, Homo sapiens
caggctggagttcagtggtgtg

SEQ ID NO: 8564529 - DNA, 22 bp, Homo sapiens
caggctggagttcagtggtgtg

SEQ ID NO: 8564530 - DNA, 22 bp, Homo sapiens
caggctggagttcagtggtgtg

SEQ ID NO: 8564531 - DNA, 22 bp, Homo sapiens
caggctggagtgcagtggtgcc

SEQ ID NO: 8564532 - DNA, 22 bp, Homo sapiens
caggctggagtgcagtggtgcc

SEQ ID NO: 8564533 - DNA, 22 bp, Homo sapiens
caggctggagttcagtggtgtg

SEQ ID NO: 8564534 - DNA, 22 bp, Homo sapiens
caggctgccgtgaagcaggcct

SEQ ID NO: 8564535 - DNA, 22 bp, Homo sapiens
caggctgccgtgaagcaggcct

SEQ ID NO: 8564536 - DNA, 22 bp, Homo sapiens
caggctgcagtgcagtggctat

SEQ ID NO: 8564537 - DNA, 22 bp, Homo sapiens
caggctgcagtgcagtggctat

SEQ ID NO: 8564538 - DNA, 22 bp, Homo sapiens
caggctgccaaggctggggagg

SEQ ID NO: 8564539 - DNA, 22 bp, Homo sapiens
caggcccagcccagcccttcga

SEQ ID NO: 8564540 - DNA, 22 bp, Homo sapiens
caggcccagcccagcccttcga

SEQ ID NO: 8564541 - DNA, 22 bp, Homo sapiens
caggcccagcccttagccaggt

SEQ ID NO: 8564542 - DNA, 21 bp, Homo sapiens
caggccgggtgagcaggcagc

SEQ ID NO: 8564543 - DNA, 22 bp, Homo sapiens
caggccggggcggcgccatctt

SEQ ID NO: 8564544 - DNA, 22 bp, Homo sapiens
caggccgggcactgcgctaggt

SEQ ID NO: 8564545 - DNA, 22 bp, Homo sapiens
caggcccagggagggagaccaa

SEQ ID NO: 8564546 - DNA, 22 bp, Homo sapiens
caggcctctccttagtctggca

SEQ ID NO: 8564547 - DNA, 22 bp, Homo sapiens
caggcctctccttagtctggca

SEQ ID NO: 8564548 - DNA, 20 bp, Homo sapiens
caggcctctgggggccctgg

SEQ ID NO: 8564549 - DNA, 20 bp, Homo sapiens
caggcctctgggggccctgg

SEQ ID NO: 8564550 - DNA, 22 bp, Homo sapiens
caggcctctccttagtctggca

SEQ ID NO: 8564551 - DNA, 22 bp, Homo sapiens
caggcctctatggtcagctgag

SEQ ID NO: 8564552 - DNA, 22 bp, Homo sapiens
caggcctctatggtcagctgag

SEQ ID NO: 8564553 - DNA, 22 bp, Homo sapiens
caggcctctatggtcagctgag

SEQ ID NO: 8564554 - DNA, 22 bp, Homo sapiens
caggcctctatggtcagctgag

SEQ ID NO: 8564555 - DNA, 22 bp, Homo sapiens
caggcctcgaggagacagctac

SEQ ID NO: 8564556 - DNA, 22 bp, Homo sapiens
caggcctgaccctgagcttcac

SEQ ID NO: 8564557 - DNA, 22 bp, Homo sapiens
caggcctgaccctgagcttcac

SEQ ID NO: 8564558 - DNA, 22 bp, Homo sapiens
caggcctgagacatctgagata

SEQ ID NO: 8564559 - DNA, 22 bp, Homo sapiens
caggcctgagacatctgagata

SEQ ID NO: 8564560 - DNA, 22 bp, Homo sapiens
caggcctgagacatctgagata

SEQ ID NO: 8564561 - DNA, 22 bp, Homo sapiens
caggcctgagacatctgagata

SEQ ID NO: 8564562 - DNA, 18 bp, Homo sapiens
caggcctcttgatcttcc

SEQ ID NO: 8564563 - DNA, 22 bp, Homo sapiens
caggcctgaccctgagcttcac

SEQ ID NO: 8564564 - DNA, 22 bp, Homo sapiens
caggcctgaccctgagcttcac

SEQ ID NO: 8564565 - DNA, 22 bp, Homo sapiens
caggcctcttccatgcagcagc

SEQ ID NO: 8564566 - DNA, 22 bp, Homo sapiens
caggcctgatacactgaactct

SEQ ID NO: 8564567 - DNA, 20 bp, Homo sapiens
tacattgtagaaatattcaa

SEQ ID NO: 8564568 - DNA, 22 bp, Homo sapiens
tacattgtacttacaaatagtg

SEQ ID NO: 8564569 - DNA, 22 bp, Homo sapiens
tacattgattcaggatataggc

SEQ ID NO: 8564570 - DNA, 22 bp, Homo sapiens
tacatttcctgtcagagatata

SEQ ID NO: 8564571 - DNA, 22 bp, Homo sapiens
caggcggccatgatctggcagg

SEQ ID NO: 8564572 - DNA, 22 bp, Homo sapiens
caggctaaagctttgagcatgt

SEQ ID NO: 8564573 - DNA, 22 bp, Homo sapiens
caggcgggcaggtgcggcccct

SEQ ID NO: 8564574 - DNA, 22 bp, Homo sapiens
caggcgagggccctgaggagcc

SEQ ID NO: 8564575 - DNA, 22 bp, Homo sapiens
tacatttataaggcttctctgt

SEQ ID NO: 8564576 - DNA, 22 bp, Homo sapiens
tacatttataaggcttctctgt

SEQ ID NO: 8564577 - DNA, 22 bp, Homo sapiens
tacatttataaggcttctctgt

SEQ ID NO: 8564578 - DNA, 22 bp, Homo sapiens
tacatttacagagccttctctg

SEQ ID NO: 8564579 - DNA, 22 bp, Homo sapiens
tacattgttttttcttgccatc

SEQ ID NO: 8564580 - DNA, 22 bp, Homo sapiens
tacattgtgatgtttcaataca

SEQ ID NO: 8564581 - DNA, 22 bp, Homo sapiens
tacattgtgatgtttcaataca

SEQ ID NO: 8564582 - DNA, 22 bp, Homo sapiens
tacattgtgataggaagtcacc

SEQ ID NO: 8564583 - DNA, 22 bp, Homo sapiens
tacattgttcatgcatgagaaa

SEQ ID NO: 8564584 - DNA, 22 bp, Homo sapiens
tacattgtgtctctatctagtc

SEQ ID NO: 8564585 - DNA, 23 bp, Homo sapiens
tacattgtggatggagtcctggg

SEQ ID NO: 8564586 - DNA, 22 bp, Homo sapiens
tactttacagtattagataatt

SEQ ID NO: 8564587 - DNA, 22 bp, Homo sapiens
tactttagaaggaaataagttc

SEQ ID NO: 8564588 - DNA, 22 bp, Homo sapiens
tactttatattgtggctggcca

SEQ ID NO: 8564589 - DNA, 22 bp, Homo sapiens
tactttatcagcgtcaaaggta

SEQ ID NO: 8564590 - DNA, 22 bp, Homo sapiens
tactttatattgtggctggcca

SEQ ID NO: 8564591 - DNA, 22 bp, Homo sapiens
tactttattgtaaatgctgatg

SEQ ID NO: 8564592 - DNA, 22 bp, Homo sapiens
tactttattgtaaatgctgatg

SEQ ID NO: 8564593 - DNA, 18 bp, Homo sapiens
tactttattccccctcca

SEQ ID NO: 8564594 - DNA, 22 bp, Homo sapiens
tactttattgtaaatgctgatg

SEQ ID NO: 8564595 - DNA, 22 bp, Homo sapiens
tactttattgtaaatgctgatg

SEQ ID NO: 8564596 - DNA, 22 bp, Homo sapiens
tactttattcaggaaggctggt

SEQ ID NO: 8564597 - DNA, 22 bp, Homo sapiens
tactttattcaggaaggctggt

SEQ ID NO: 8564598 - DNA, 22 bp, Homo sapiens
tactttatcagcgtcaaaggta

SEQ ID NO: 8564599 - DNA, 18 bp, Homo sapiens
tactttattccccctcca

SEQ ID NO: 8564600 - DNA, 18 bp, Homo sapiens
tactttattccccctcca

SEQ ID NO: 8564601 - DNA, 22 bp, Homo sapiens
tactttattcaggaaggctggt

SEQ ID NO: 8564602 - DNA, 22 bp, Homo sapiens
tacttgttctttcaagagatag

SEQ ID NO: 8564603 - DNA, 22 bp, Homo sapiens
tactgtgtcttaggatgtggaa

SEQ ID NO: 8564604 - DNA, 22 bp, Homo sapiens
tactttaaaaactgataattca

SEQ ID NO: 8564605 - DNA, 22 bp, Homo sapiens
tactttaaaaactgataattca

SEQ ID NO: 8564606 - DNA, 22 bp, Homo sapiens
tacttgttttgtgttcctaaac

SEQ ID NO: 8564607 - DNA, 18 bp, Homo sapiens
tactgtggatcaggggtt

SEQ ID NO: 8564608 - DNA, 22 bp, Homo sapiens
tactgtgggatgttgtgattag

SEQ ID NO: 8564609 - DNA, 22 bp, Homo sapiens
caggctagattggggccagtag

SEQ ID NO: 8564610 - DNA, 22 bp, Homo sapiens
caggctcaagccctgcttatat

SEQ ID NO: 8564611 - DNA, 22 bp, Homo sapiens
caggctagattggggccagtag

SEQ ID NO: 8564612 - DNA, 20 bp, Homo sapiens
tttccactgtaatgtatgat

SEQ ID NO: 8564613 - DNA, 20 bp, Homo sapiens
tttccactgtaatgtatgat

SEQ ID NO: 8564614 - DNA, 20 bp, Homo sapiens
tttccactgtaatgtatgat

SEQ ID NO: 8564615 - DNA, 22 bp, Homo sapiens
tttccagagcatgtctgctcag

SEQ ID NO: 8564616 - DNA, 22 bp, Homo sapiens
tttccagagcatgtctgctcag

SEQ ID NO: 8564617 - DNA, 22 bp, Homo sapiens
tttcctaacacaatgcatgaga

SEQ ID NO: 8564618 - DNA, 22 bp, Homo sapiens
tttcctaaggctcattttaaaa

SEQ ID NO: 8564619 - DNA, 22 bp, Homo sapiens
tttcctaagatagatacttcag

SEQ ID NO: 8564620 - DNA, 22 bp, Homo sapiens
tttcctaagatagatacttcag

SEQ ID NO: 8564621 - DNA, 22 bp, Homo sapiens
tttcctaactcatcggatgtac

SEQ ID NO: 8564622 - DNA, 22 bp, Homo sapiens
tttcctaacacaatgcatgaga

SEQ ID NO: 8564623 - DNA, 22 bp, Homo sapiens
tttcctaagggatgcggctcaa

SEQ ID NO: 8564624 - DNA, 22 bp, Homo sapiens
tttcctaaggtagtgataattt

SEQ ID NO: 8564625 - DNA, 22 bp, Homo sapiens
tttcctaatcccaatgacattt

SEQ ID NO: 8564626 - DNA, 20 bp, Homo sapiens
tttcctaagtggtttgctga

SEQ ID NO: 8564627 - DNA, 22 bp, Homo sapiens
tttcctacccttccaggcagag

SEQ ID NO: 8564628 - DNA, 22 bp, Homo sapiens
tttcctaatcccaatgacattt

SEQ ID NO: 8564629 - DNA, 22 bp, Homo sapiens
tttcacagtgctctgtaagtat

SEQ ID NO: 8564630 - DNA, 22 bp, Homo sapiens
tttcacagtgctctgtaagtat

SEQ ID NO: 8564631 - DNA, 22 bp, Homo sapiens
tttcacataaatattatgccta

SEQ ID NO: 8564632 - DNA, 22 bp, Homo sapiens
tttcacagttagcatgaggact

SEQ ID NO: 8564633 - DNA, 22 bp, Homo sapiens
tttcacagttagcatgaggact

SEQ ID NO: 8564634 - DNA, 22 bp, Homo sapiens
tttcacagttagcatgaggact

SEQ ID NO: 8564635 - DNA, 20 bp, Homo sapiens
tttcacagtccctgtttcct

SEQ ID NO: 8564636 - DNA, 20 bp, Homo sapiens
tttcacagtccctgtttcct

SEQ ID NO: 8564637 - DNA, 22 bp, Homo sapiens
tttcacagtagaaatcattatg

SEQ ID NO: 8564638 - DNA, 22 bp, Homo sapiens
tttcacagtcaatttggagtca

SEQ ID NO: 8564639 - DNA, 22 bp, Homo sapiens
tttcacagtagaaatcattatg

SEQ ID NO: 8564640 - DNA, 22 bp, Homo sapiens
tttcacatacagtgtatagtag

SEQ ID NO: 8564641 - DNA, 22 bp, Homo sapiens
tttcacatacagtgtatagtag

SEQ ID NO: 8564642 - DNA, 22 bp, Homo sapiens
tttcacatagaaagtgatttac

SEQ ID NO: 8564643 - DNA, 22 bp, Homo sapiens
tttcaatgtatgtctttctgag

SEQ ID NO: 8564644 - DNA, 22 bp, Homo sapiens
ctcctggccctgagctcccagg

SEQ ID NO: 8564645 - DNA, 22 bp, Homo sapiens
ctcctggccctgagctcccagg

SEQ ID NO: 8564646 - DNA, 22 bp, Homo sapiens
tttcaaatggagtcgtgaaatg

SEQ ID NO: 8564647 - DNA, 21 bp, Homo sapiens
tttcaatttgccttgagtcat

SEQ ID NO: 8564648 - DNA, 22 bp, Homo sapiens
tttcaattccaccaaagcgccc

SEQ ID NO: 8564649 - DNA, 22 bp, Homo sapiens
tttcaattgactttggaagaaa

SEQ ID NO: 8564650 - DNA, 22 bp, Homo sapiens
tttcacaaactgaggagacaat

SEQ ID NO: 8564651 - DNA, 21 bp, Homo sapiens
tttcacaaaagtatgtgacaa

SEQ ID NO: 8564652 - DNA, 22 bp, Homo sapiens
tttcacaaactgaggagacaat

SEQ ID NO: 8564653 - DNA, 22 bp, Homo sapiens
tttcacaggtacaaacactcct

SEQ ID NO: 8564654 - DNA, 22 bp, Homo sapiens
tttcacaggtatccacgggtct

SEQ ID NO: 8564655 - DNA, 22 bp, Homo sapiens
tttcacaacacaatctcgttaa

SEQ ID NO: 8564656 - DNA, 22 bp, Homo sapiens
tttcacaggtaagcaatacagg

SEQ ID NO: 8564657 - DNA, 22 bp, Homo sapiens
tttcacaaatgtctttaacttg

SEQ ID NO: 8564658 - DNA, 22 bp, Homo sapiens
tttcacaaagcatagcacttta

SEQ ID NO: 8564659 - DNA, 22 bp, Homo sapiens
ctctctggaagggggagctgat

SEQ ID NO: 8564660 - DNA, 22 bp, Homo sapiens
tttccttgcctcctgtccttct

SEQ ID NO: 8564661 - DNA, 22 bp, Homo sapiens
tttccttgggtctcttagtggc

SEQ ID NO: 8564662 - DNA, 18 bp, Homo sapiens
tttccttgtatgaacata

SEQ ID NO: 8564663 - DNA, 22 bp, Homo sapiens
tttccttgttattatttgtcct

SEQ ID NO: 8564664 - DNA, 22 bp, Homo sapiens
ctctctgcaagttttgaaatag

SEQ ID NO: 8564665 - DNA, 22 bp, Homo sapiens
ctctctgaggcaggcctgtggg

SEQ ID NO: 8564666 - DNA, 22 bp, Homo sapiens
ctctctgagtgagggacaagct

SEQ ID NO: 8564667 - DNA, 22 bp, Homo sapiens
ctctctgagtgagggacaagct

SEQ ID NO: 8564668 - DNA, 22 bp, Homo sapiens
ctctctgctgtatccttaggct

SEQ ID NO: 8564669 - DNA, 22 bp, Homo sapiens
ctctctgctgtatccttaggct

SEQ ID NO: 8564670 - DNA, 21 bp, Homo sapiens
ctctctgcttatgaatagtga

SEQ ID NO: 8564671 - DNA, 22 bp, Homo sapiens
ctctctgctgtatccttaggct

SEQ ID NO: 8564672 - DNA, 22 bp, Homo sapiens
ctctctggaagggggagctgat

SEQ ID NO: 8564673 - DNA, 22 bp, Homo sapiens
ctctctggaagggggagctgat

SEQ ID NO: 8564674 - DNA, 22 bp, Homo sapiens
ctctctcttgtgttgctgcaga

SEQ ID NO: 8564675 - DNA, 22 bp, Homo sapiens
ctctctcttgtgttgctgcaga

SEQ ID NO: 8564676 - DNA, 22 bp, Homo sapiens
ctctctgaggaaggagcatctg

SEQ ID NO: 8564677 - DNA, 22 bp, Homo sapiens
ctctctctttagaagcgtctgg

SEQ ID NO: 8564678 - DNA, 20 bp, Homo sapiens
ctctctctccattcccaggg

SEQ ID NO: 8564679 - DNA, 20 bp, Homo sapiens
ctctctctccattcccaggg

SEQ ID NO: 8564680 - DNA, 20 bp, Homo sapiens
ctctctctccattcccaggg

SEQ ID NO: 8564681 - DNA, 22 bp, Homo sapiens
ctctctctatgcgttgttccta

SEQ ID NO: 8564682 - DNA, 22 bp, Homo sapiens
ctctctctatgcgttgttccta

SEQ ID NO: 8564683 - DNA, 22 bp, Homo sapiens
ctctccagtcaggaactctgac

SEQ ID NO: 8564684 - DNA, 22 bp, Homo sapiens
ctctccaggttagagcacttat

SEQ ID NO: 8564685 - DNA, 22 bp, Homo sapiens
ctctccaggttagagcacttat

SEQ ID NO: 8564686 - DNA, 22 bp, Homo sapiens
ctctcctggggagcacacacac

SEQ ID NO: 8564687 - DNA, 22 bp, Homo sapiens
ctctccagtcatattctcagtc

SEQ ID NO: 8564688 - DNA, 22 bp, Homo sapiens
ctctccagtcatattctcagtc

SEQ ID NO: 8564689 - DNA, 22 bp, Homo sapiens
ctctccagggcatgagttccac

SEQ ID NO: 8564690 - DNA, 22 bp, Homo sapiens
ctctccagggaagcagtgtact

SEQ ID NO: 8564691 - DNA, 22 bp, Homo sapiens
ctctccagggcatgagttccac

SEQ ID NO: 8564692 - DNA, 22 bp, Homo sapiens
ctctccaggggtagatgccttc

SEQ ID NO: 8564693 - DNA, 22 bp, Homo sapiens
ctctccaggagctcagagtcta

SEQ ID NO: 8564694 - DNA, 22 bp, Homo sapiens
ctctccaggcgaggtcctactg

SEQ ID NO: 8564695 - DNA, 22 bp, Homo sapiens
ctctccaggctgggacaggacc

SEQ ID NO: 8564696 - DNA, 22 bp, Homo sapiens
ctctccaggcgaggtcctactg

SEQ ID NO: 8564697 - DNA, 22 bp, Homo sapiens
tttcctcactcatgtcatcagt

SEQ ID NO: 8564698 - DNA, 22 bp, Homo sapiens
tttcctcactcatgtcatcagt

SEQ ID NO: 8564699 - DNA, 22 bp, Homo sapiens
tttcctcactcatgtcatcagt

SEQ ID NO: 8564700 - DNA, 22 bp, Homo sapiens
ctctccaggagagcactttgag

SEQ ID NO: 8564701 - DNA, 22 bp, Homo sapiens
tttcctcaactgtcaaatgggg

SEQ ID NO: 8564702 - DNA, 22 bp, Homo sapiens
tttcctcaactgtcaaatgggg

SEQ ID NO: 8564703 - DNA, 22 bp, Homo sapiens
tttcctcaactgtcaaatgggg

SEQ ID NO: 8564704 - DNA, 22 bp, Homo sapiens
tttcctcacacagaagatcttg

SEQ ID NO: 8564705 - DNA, 22 bp, Homo sapiens
tttcctcacacagaagatcttg

SEQ ID NO: 8564706 - DNA, 22 bp, Homo sapiens
tttattgttgttagtcataagt

SEQ ID NO: 8564707 - DNA, 22 bp, Homo sapiens
tttattgttgttagtcataagt

SEQ ID NO: 8564708 - DNA, 22 bp, Homo sapiens
tttattgttgggtcttaagctg

SEQ ID NO: 8564709 - DNA, 22 bp, Homo sapiens
tttattgttgttagtcataagt

SEQ ID NO: 8564710 - DNA, 22 bp, Homo sapiens
tttattgttgttagtcataagt

SEQ ID NO: 8564711 - DNA, 22 bp, Homo sapiens
tttattgtgttgaaactgaatt

SEQ ID NO: 8564712 - DNA, 22 bp, Homo sapiens
tttattgttgggtcttaagctg

SEQ ID NO: 8564713 - DNA, 22 bp, Homo sapiens
tttattctaacttgctgctcta

SEQ ID NO: 8564714 - DNA, 18 bp, Homo sapiens
tttattcctgcccccagc

SEQ ID NO: 8564715 - DNA, 22 bp, Homo sapiens
tttattctaacttgctgctcta

SEQ ID NO: 8564716 - DNA, 22 bp, Homo sapiens
tttattccatgtgtctatgacc

SEQ ID NO: 8564717 - DNA, 22 bp, Homo sapiens
tttattccatgtgtctatgacc

SEQ ID NO: 8564718 - DNA, 22 bp, Homo sapiens
ctcctccagcttccagtggctc

SEQ ID NO: 8564719 - DNA, 22 bp, Homo sapiens
ctcctccagtcctccaaggaca

SEQ ID NO: 8564720 - DNA, 22 bp, Homo sapiens
ctcctccagtcctccaaggaca

SEQ ID NO: 8564721 - DNA, 22 bp, Homo sapiens
ctcctccagcttccagtggctc

SEQ ID NO: 8564722 - DNA, 22 bp, Homo sapiens
ctcctccagcttccagtggctc

SEQ ID NO: 8564723 - DNA, 22 bp, Homo sapiens
ctcctccagtgggtccctcagg

SEQ ID NO: 8564724 - DNA, 22 bp, Homo sapiens
ctcctcccaattgccaagtgct

SEQ ID NO: 8564725 - DNA, 22 bp, Homo sapiens
ctcctccagtgggtccctcagg

SEQ ID NO: 8564726 - DNA, 22 bp, Homo sapiens
ctcctccactaggcaaaatgtg

SEQ ID NO: 8564727 - DNA, 22 bp, Homo sapiens
ctcctccacccgctggggccca

SEQ ID NO: 8564728 - DNA, 22 bp, Homo sapiens
ctcctccacccgctggggccca

SEQ ID NO: 8564729 - DNA, 22 bp, Homo sapiens
ctcctccagacttactgaatcc

SEQ ID NO: 8564730 - DNA, 18 bp, Homo sapiens
ctcctccacagcccctgc

SEQ ID NO: 8564731 - DNA, 22 bp, Homo sapiens
ctcctccagcttccagtggctc

SEQ ID NO: 8564732 - DNA, 22 bp, Homo sapiens
ctcctccagctctccctggggg

SEQ ID NO: 8564733 - DNA, 22 bp, Homo sapiens
ctcctccagctctccctggggg

SEQ ID NO: 8564734 - DNA, 22 bp, Homo sapiens
ctcctccagctctccctggggg

SEQ ID NO: 8564735 - DNA, 22 bp, Homo sapiens
ctcctccagctctccctggggg

SEQ ID NO: 8564736 - DNA, 22 bp, Homo sapiens
ctcctccagacttactgaatcc

SEQ ID NO: 8564737 - DNA, 22 bp, Homo sapiens
ctcctggcaggctgagtgaaat

SEQ ID NO: 8564738 - DNA, 17 bp, Homo sapiens
ctcctggcagcctcagg

SEQ ID NO: 8564739 - DNA, 17 bp, Homo sapiens
ctcctggcagcctcagg

SEQ ID NO: 8564740 - DNA, 22 bp, Homo sapiens
ctcctggcactgtcttgaccca

SEQ ID NO: 8564741 - DNA, 22 bp, Homo sapiens
ctcctggcagttccccttgtca

SEQ ID NO: 8564742 - DNA, 17 bp, Homo sapiens
ctcctggccacccctct

SEQ ID NO: 8564743 - DNA, 22 bp, Homo sapiens
ctcctggccacgttcttgctgg

SEQ ID NO: 8564744 - DNA, 22 bp, Homo sapiens
ctcctggccccagatcccaatc

SEQ ID NO: 8564745 - DNA, 22 bp, Homo sapiens
tttatttaccttatgtcctcca

SEQ ID NO: 8564746 - DNA, 22 bp, Homo sapiens
tttatttaccttatgtcctcca

SEQ ID NO: 8564747 - DNA, 22 bp, Homo sapiens
tttatttaccttatgtcctcca

SEQ ID NO: 8564748 - DNA, 22 bp, Homo sapiens
tttatttaaagtcgtgtgttaa

SEQ ID NO: 8564749 - DNA, 22 bp, Homo sapiens
tttatttaaagtcgtgtgttaa

SEQ ID NO: 8564750 - DNA, 22 bp, Homo sapiens
tttatttaaagtcgtgtgttaa

SEQ ID NO: 8564751 - DNA, 16 bp, Homo sapiens
tttatttactagtgtt

SEQ ID NO: 8564752 - DNA, 16 bp, Homo sapiens
tttatttactagtgtt

SEQ ID NO: 8564753 - DNA, 16 bp, Homo sapiens
tttatttactagtgtt

SEQ ID NO: 8564754 - DNA, 22 bp, Homo sapiens
ctcctggatgcaggctgtctgc

SEQ ID NO: 8564755 - DNA, 22 bp, Homo sapiens
ctcctggatgcaggctgtctgc

SEQ ID NO: 8564756 - DNA, 22 bp, Homo sapiens
ctcctggcactcagtgtggaag

SEQ ID NO: 8564757 - DNA, 18 bp, Homo sapiens
ctcccctgttttccctgc

SEQ ID NO: 8564758 - DNA, 22 bp, Homo sapiens
ctccctcacaaagcattctctt

SEQ ID NO: 8564759 - DNA, 22 bp, Homo sapiens
ctcccgtggatgttcttcagtc

SEQ ID NO: 8564760 - DNA, 22 bp, Homo sapiens
tttagactaattcctaaagggc

SEQ ID NO: 8564761 - DNA, 22 bp, Homo sapiens
ctccccatggcaacagttatgg

SEQ ID NO: 8564762 - DNA, 22 bp, Homo sapiens
ctccccattgtgacctcatcca

SEQ ID NO: 8564763 - DNA, 22 bp, Homo sapiens
ctcccctccttaggtcttctag

SEQ ID NO: 8564764 - DNA, 22 bp, Homo sapiens
tttaatcaggcaaagcataata

SEQ ID NO: 8564765 - DNA, 23 bp, Homo sapiens
ctccccagtgtcctcatgcatct

SEQ ID NO: 8564766 - DNA, 23 bp, Homo sapiens
ctccccagtgtcctcatgcatct

SEQ ID NO: 8564767 - DNA, 23 bp, Homo sapiens
ctccccagtgtcctcatgcatct

SEQ ID NO: 8564768 - DNA, 23 bp, Homo sapiens
ctccccagtgtcctcatgcatct

SEQ ID NO: 8564769 - DNA, 22 bp, Homo sapiens
tttaatctattccctaaacacc

SEQ ID NO: 8564770 - DNA, 23 bp, Homo sapiens
ctccccagtgtcctcatgcatct

SEQ ID NO: 8564771 - DNA, 23 bp, Homo sapiens
ctccccagtgtcctcatgcatct

SEQ ID NO: 8564772 - DNA, 22 bp, Homo sapiens
tttaggtcttcttaagagtcaa

SEQ ID NO: 8564773 - DNA, 22 bp, Homo sapiens
tttaggcatacttttgggagaa

SEQ ID NO: 8564774 - DNA, 22 bp, Homo sapiens
tttagtaagttcactgcaaagc

SEQ ID NO: 8564775 - DNA, 22 bp, Homo sapiens
tttagtaagttcactgcaaagc

SEQ ID NO: 8564776 - DNA, 22 bp, Homo sapiens
ctcctccacagagtccttgcca

SEQ ID NO: 8564777 - DNA, 18 bp, Homo sapiens
ctcctccacagcccctgc

SEQ ID NO: 8564778 - DNA, 22 bp, Homo sapiens
ctcctccacagagtccttgcca

SEQ ID NO: 8564779 - DNA, 22 bp, Homo sapiens
ctcctccacagacctactgaat

SEQ ID NO: 8564780 - DNA, 22 bp, Homo sapiens
ctcctccacagacctactgaat

SEQ ID NO: 8564781 - DNA, 22 bp, Homo sapiens
tttagtgcctgggccagttcca

SEQ ID NO: 8564782 - DNA, 22 bp, Homo sapiens
tttagtcaggtaagatgcaggg

SEQ ID NO: 8564783 - DNA, 22 bp, Homo sapiens
tttagtcaggtaagatgcaggg

SEQ ID NO: 8564784 - DNA, 23 bp, Homo sapiens
tttagtcagttgacagccatata

SEQ ID NO: 8564785 - DNA, 22 bp, Homo sapiens
tttagtgataagaattatgaaa

SEQ ID NO: 8564786 - DNA, 22 bp, Homo sapiens
tttagtgattcatttagaaaaa

SEQ ID NO: 8564787 - DNA, 22 bp, Homo sapiens
tttagtgattcatttagaaaaa

SEQ ID NO: 8564788 - DNA, 22 bp, Homo sapiens
tttagtgagtgtgaatcaaatg

SEQ ID NO: 8564789 - DNA, 22 bp, Homo sapiens
ctcccactcctggctcaccaca

SEQ ID NO: 8564790 - DNA, 22 bp, Homo sapiens
ctcccactcctggctcaccaca

SEQ ID NO: 8564791 - DNA, 22 bp, Homo sapiens
ctcccactcctggctcaccaca

SEQ ID NO: 8564792 - DNA, 22 bp, Homo sapiens
ctcccagaaaattctcagacaa

SEQ ID NO: 8564793 - DNA, 22 bp, Homo sapiens
ctcccagaaaattctcagacaa

SEQ ID NO: 8564794 - DNA, 22 bp, Homo sapiens
ctccatggctttcgcatctgca

SEQ ID NO: 8564795 - DNA, 22 bp, Homo sapiens
ctccatgggggctggcctgtgt

SEQ ID NO: 8564796 - DNA, 22 bp, Homo sapiens
ctccattgaacatcctctcaga

SEQ ID NO: 8564797 - DNA, 22 bp, Homo sapiens
ctcccaagctgtgctgaactgt

SEQ ID NO: 8564798 - DNA, 22 bp, Homo sapiens
ctcccaaggggtaagggagctg

SEQ ID NO: 8564799 - DNA, 22 bp, Homo sapiens
ctcccaaggggtaagggagctg

SEQ ID NO: 8564800 - DNA, 22 bp, Homo sapiens
ctcccaaggggtaagggagctg

SEQ ID NO: 8564801 - DNA, 22 bp, Homo sapiens
ctcccacatggaatagcaggga

SEQ ID NO: 8564802 - DNA, 22 bp, Homo sapiens
ctcccagagaccaagctgagaa

SEQ ID NO: 8564803 - DNA, 22 bp, Homo sapiens
ctcccagagaccaagctgagaa

SEQ ID NO: 8564804 - DNA, 22 bp, Homo sapiens
ctcccagattcctgctgtggga

SEQ ID NO: 8564805 - DNA, 22 bp, Homo sapiens
ctcccagagagcaggtgggccg

SEQ ID NO: 8564806 - DNA, 22 bp, Homo sapiens
ctcccagccttcgccagtctga

SEQ ID NO: 8564807 - DNA, 22 bp, Homo sapiens
ctcccagccttcgccagtctga

SEQ ID NO: 8564808 - DNA, 22 bp, Homo sapiens
ctcccagccttcgccagtctga

SEQ ID NO: 8564809 - DNA, 22 bp, Homo sapiens
ctcccagccttcgccagtctga

SEQ ID NO: 8564810 - DNA, 22 bp, Homo sapiens
ctcccaggactcagaggagaag

SEQ ID NO: 8564811 - DNA, 22 bp, Homo sapiens
tttaatatctcacacttccatg

SEQ ID NO: 8564812 - DNA, 22 bp, Homo sapiens
tttaatatttctttcctgaagc

SEQ ID NO: 8564813 - DNA, 22 bp, Homo sapiens
tttaatatttctttcctgaagc

SEQ ID NO: 8564814 - DNA, 22 bp, Homo sapiens
tttaatatccagtggatacaaa

SEQ ID NO: 8564815 - DNA, 22 bp, Homo sapiens
tttaatatccagtggatacaaa

SEQ ID NO: 8564816 - DNA, 22 bp, Homo sapiens
tttaatatccagtggatacaaa

SEQ ID NO: 8564817 - DNA, 22 bp, Homo sapiens
tttaatatctcacacttccatg

SEQ ID NO: 8564818 - DNA, 22 bp, Homo sapiens
tttaatactatggggatgaaca

SEQ ID NO: 8564819 - DNA, 22 bp, Homo sapiens
tttaatatccagtggatacaaa

SEQ ID NO: 8564820 - DNA, 22 bp, Homo sapiens
tttaatatccagtggatacaaa

SEQ ID NO: 8564821 - DNA, 22 bp, Homo sapiens
ctcccaggcagggctgcccact

SEQ ID NO: 8564822 - DNA, 22 bp, Homo sapiens
ctcccaggcagggctgcccact

SEQ ID NO: 8564823 - DNA, 22 bp, Homo sapiens
ctcccaggcacagggaggagcc

SEQ ID NO: 8564824 - DNA, 22 bp, Homo sapiens
ctcccaggcacagggaggagcc

SEQ ID NO: 8564825 - DNA, 22 bp, Homo sapiens
ctcccaggcacagggaggagcc

SEQ ID NO: 8564826 - DNA, 22 bp, Homo sapiens
tttaacagatgctatgtctacc

SEQ ID NO: 8564827 - DNA, 22 bp, Homo sapiens
ctcccaggccatgctctagcca

SEQ ID NO: 8564828 - DNA, 22 bp, Homo sapiens
tttaacagatgctatgtctacc

SEQ ID NO: 8564829 - DNA, 22 bp, Homo sapiens
ttgtctttggaaatttaatgtt

SEQ ID NO: 8564830 - DNA, 22 bp, Homo sapiens
ttgtcttttgtgggaaatatgg

SEQ ID NO: 8564831 - DNA, 22 bp, Homo sapiens
ttgtctgtcccagcttgtgcat

SEQ ID NO: 8564832 - DNA, 22 bp, Homo sapiens
ttgtctgtgaaatggaaatagt

SEQ ID NO: 8564833 - DNA, 23 bp, Homo sapiens
ttgtctgtgcttttccagttgct

SEQ ID NO: 8564834 - DNA, 22 bp, Homo sapiens
ttgtctgtgaaatggaaatagt

SEQ ID NO: 8564835 - DNA, 22 bp, Homo sapiens
ttgtctttcccagcttctagag

SEQ ID NO: 8564836 - DNA, 22 bp, Homo sapiens
ttgtcttaaatggatggacaat

SEQ ID NO: 8564837 - DNA, 22 bp, Homo sapiens
ctccagccagagtgcctctgtt

SEQ ID NO: 8564838 - DNA, 20 bp, Homo sapiens
ctccagcccctgccctggtc

SEQ ID NO: 8564839 - DNA, 20 bp, Homo sapiens
ctccagcccctgccctggtc

SEQ ID NO: 8564840 - DNA, 22 bp, Homo sapiens
ttgtctgtcccagcttgtgcat

SEQ ID NO: 8564841 - DNA, 23 bp, Homo sapiens
ttgtatttttagtagagacaggg

SEQ ID NO: 8564842 - DNA, 22 bp, Homo sapiens
ttgtctgtccaggcaccccaag

SEQ ID NO: 8564843 - DNA, 22 bp, Homo sapiens
ttgtattttgttatgctactgc

SEQ ID NO: 8564844 - DNA, 22 bp, Homo sapiens
ttgtattttgttatgctactgc

SEQ ID NO: 8564845 - DNA, 22 bp, Homo sapiens
ctccagcctcagatgacggtac

SEQ ID NO: 8564846 - DNA, 22 bp, Homo sapiens
ctccatggaaccggggctgctt

SEQ ID NO: 8564847 - DNA, 22 bp, Homo sapiens
ctccatggaaaaggctgttgtt

SEQ ID NO: 8564848 - DNA, 22 bp, Homo sapiens
ctccagtgctgtcatcccttcc

SEQ ID NO: 8564849 - DNA, 22 bp, Homo sapiens
ctccatggaaccggggctgctt

SEQ ID NO: 8564850 - DNA, 22 bp, Homo sapiens
ctccagtgcgtcttagtaaacc

SEQ ID NO: 8564851 - DNA, 22 bp, Homo sapiens
ttgtgtaaatgtctgtctttct

SEQ ID NO: 8564852 - DNA, 22 bp, Homo sapiens
ttgtgtaacttgagcaaacaca

SEQ ID NO: 8564853 - DNA, 22 bp, Homo sapiens
ttgtggttaaccgcacattttt

SEQ ID NO: 8564854 - DNA, 22 bp, Homo sapiens
ttgtgaaatcgtgtttggaagc

SEQ ID NO: 8564855 - DNA, 23 bp, Homo sapiens
ttgtgggcagattccatggggag

SEQ ID NO: 8564856 - DNA, 22 bp, Homo sapiens
ttgtgaaaagccgcaagtatag

SEQ ID NO: 8564857 - DNA, 22 bp, Homo sapiens
ttgtgaaaagccgcaagtatag

SEQ ID NO: 8564858 - DNA, 22 bp, Homo sapiens
ttgtgaaaagccgcaagtatag

SEQ ID NO: 8564859 - DNA, 22 bp, Homo sapiens
ttgtggggcaacagcaggtgaa

SEQ ID NO: 8564860 - DNA, 22 bp, Homo sapiens
ttgtggggaggatttgatgaga

SEQ ID NO: 8564861 - DNA, 22 bp, Homo sapiens
ttgtgggcttgcctggctcttg

SEQ ID NO: 8564862 - DNA, 22 bp, Homo sapiens
ttgtacaagtattatgtgaaca

SEQ ID NO: 8564863 - DNA, 22 bp, Homo sapiens
ttgtacaagtattatgtgaaca

SEQ ID NO: 8564864 - DNA, 22 bp, Homo sapiens
ctccagattccgtttattcagg

SEQ ID NO: 8564865 - DNA, 22 bp, Homo sapiens
ctccagattccgtttattcagg

SEQ ID NO: 8564866 - DNA, 22 bp, Homo sapiens
ctccagatccagctgagctgca

SEQ ID NO: 8564867 - DNA, 22 bp, Homo sapiens
ctccagatgtatactttccaag

SEQ ID NO: 8564868 - DNA, 22 bp, Homo sapiens
ctccagattccgtttattcagg

SEQ ID NO: 8564869 - DNA, 22 bp, Homo sapiens
ctccagattctggatgactggg

SEQ ID NO: 8564870 - DNA, 22 bp, Homo sapiens
ctccagattctggatgactggg

SEQ ID NO: 8564871 - DNA, 22 bp, Homo sapiens
ctccagattcctgctggcagaa

SEQ ID NO: 8564872 - DNA, 22 bp, Homo sapiens
ttgtacaaatgcatattcctgg

SEQ ID NO: 8564873 - DNA, 22 bp, Homo sapiens
ttgtacaaatgcatattcctgg

SEQ ID NO: 8564874 - DNA, 22 bp, Homo sapiens
ttgtacaaatgcatattcctgg

SEQ ID NO: 8564875 - DNA, 22 bp, Homo sapiens
ttgtacaacacatattctacag

SEQ ID NO: 8564876 - DNA, 22 bp, Homo sapiens
ttgtacaacgttttaaatttga

SEQ ID NO: 8564877 - DNA, 22 bp, Homo sapiens
ctccaccccgtgccggtgctgg

SEQ ID NO: 8564878 - DNA, 22 bp, Homo sapiens
ttggtcacttgctatgtgccaa

SEQ ID NO: 8564879 - DNA, 22 bp, Homo sapiens
ttgtaatggagcaaacaggttg

SEQ ID NO: 8564880 - DNA, 22 bp, Homo sapiens
ttgtacaaagatttcacagctc

SEQ ID NO: 8564881 - DNA, 22 bp, Homo sapiens
ttgtacaaataggaacctctga

SEQ ID NO: 8564882 - DNA, 22 bp, Homo sapiens
ttgtacaaataggaacctctga

SEQ ID NO: 8564883 - DNA, 22 bp, Homo sapiens
ttgtacaaaggatttggaagag

SEQ ID NO: 8564884 - DNA, 22 bp, Homo sapiens
ttgtacaaagatttcacagctc

SEQ ID NO: 8564885 - DNA, 22 bp, Homo sapiens
ctccaaggctctggtgctgagg

SEQ ID NO: 8564886 - DNA, 20 bp, Homo sapiens
ctccaaggcttgcaggaggc

SEQ ID NO: 8564887 - DNA, 18 bp, Homo sapiens
ctccaaggtctctggctt

SEQ ID NO: 8564888 - DNA, 18 bp, Homo sapiens
ctccaaggtctctggctt

SEQ ID NO: 8564889 - DNA, 22 bp, Homo sapiens
ctccaagggctcccagacgtct

SEQ ID NO: 8564890 - DNA, 22 bp, Homo sapiens
ctccaagggttgtgggtggtca

SEQ ID NO: 8564891 - DNA, 22 bp, Homo sapiens
ctccaacgaggctggggtacaa

SEQ ID NO: 8564892 - DNA, 22 bp, Homo sapiens
ctccaacgaggctggggtacaa

SEQ ID NO: 8564893 - DNA, 23 bp, Homo sapiens
ctccaaggcccaactgtctaggc

SEQ ID NO: 8564894 - DNA, 22 bp, Homo sapiens
ctccaaggattctggacccttg

SEQ ID NO: 8564895 - DNA, 22 bp, Homo sapiens
ctccaaggtggttatttgagat

SEQ ID NO: 8564896 - DNA, 19 bp, Homo sapiens
ctccacagggattgtgatt

SEQ ID NO: 8564897 - DNA, 22 bp, Homo sapiens
ctccacagcccctccagtggca

SEQ ID NO: 8564898 - DNA, 22 bp, Homo sapiens
ctccacagcccctccagtggca

SEQ ID NO: 8564899 - DNA, 22 bp, Homo sapiens
ctccacagcccctccagtggca

SEQ ID NO: 8564900 - DNA, 22 bp, Homo sapiens
ctccacagcccctccagtggca

SEQ ID NO: 8564901 - DNA, 22 bp, Homo sapiens
ctccaaaggataaaagcagagt

SEQ ID NO: 8564902 - DNA, 22 bp, Homo sapiens
ctccaaatacaatattgttgtt

SEQ ID NO: 8564903 - DNA, 22 bp, Homo sapiens
ttgaaagtcacaatggcattaa

SEQ ID NO: 8564904 - DNA, 22 bp, Homo sapiens
ttgaaagtagcagctgcatatg

SEQ ID NO: 8564905 - DNA, 22 bp, Homo sapiens
ttgaaagttatctagattctga

SEQ ID NO: 8564906 - DNA, 22 bp, Homo sapiens
ttgaaagttaggatttagctgg

SEQ ID NO: 8564907 - DNA, 22 bp, Homo sapiens
ctcatctgtatatagtgaatga

SEQ ID NO: 8564908 - DNA, 22 bp, Homo sapiens
ctcatctgtatatagtgaatga

SEQ ID NO: 8564909 - DNA, 22 bp, Homo sapiens
ctcatctgtatatagtgaatga

SEQ ID NO: 8564910 - DNA, 22 bp, Homo sapiens
ctcatctgtctgggctggtttt

SEQ ID NO: 8564911 - DNA, 22 bp, Homo sapiens
ttgaaatactgcattgttcagt

SEQ ID NO: 8564912 - DNA, 22 bp, Homo sapiens
ttcttttcccaatattttgctg

SEQ ID NO: 8564913 - DNA, 18 bp, Homo sapiens
ttcttttcatgtgatctc

SEQ ID NO: 8564914 - DNA, 22 bp, Homo sapiens
ttcttttcccaatattttgctg

SEQ ID NO: 8564915 - DNA, 22 bp, Homo sapiens
ttcttttcctacacagcgattt

SEQ ID NO: 8564916 - DNA, 22 bp, Homo sapiens
ttcttttcctacacagcgattt

SEQ ID NO: 8564917 - DNA, 22 bp, Homo sapiens
ttcttttcctacacagcgattt

SEQ ID NO: 8564918 - DNA, 22 bp, Homo sapiens
ttcttttcctgtggctcatcca

SEQ ID NO: 8564919 - DNA, 22 bp, Homo sapiens
ttgaaaggtgacattgttagag

SEQ ID NO: 8564920 - DNA, 22 bp, Homo sapiens
ttgaaaggtgaacatgatgcac

SEQ ID NO: 8564921 - DNA, 22 bp, Homo sapiens
ttgaaaggtgctgtgtgctgat

SEQ ID NO: 8564922 - DNA, 22 bp, Homo sapiens
ttgaaaggtgctgtgtgctgat

SEQ ID NO: 8564923 - DNA, 22 bp, Homo sapiens
ttgaaagtaataactttgttca

SEQ ID NO: 8564924 - DNA, 22 bp, Homo sapiens
ttcttttcctgtggctcatcca

SEQ ID NO: 8564925 - DNA, 22 bp, Homo sapiens
ttcttttcggcctgtgagaagg

SEQ ID NO: 8564926 - DNA, 23 bp, Homo sapiens
ttgaaaggtagctggcagctaga

SEQ ID NO: 8564927 - DNA, 22 bp, Homo sapiens
ttcttttacattaagatttcag

SEQ ID NO: 8564928 - DNA, 22 bp, Homo sapiens
ttcttttagaatttcctaaggt

SEQ ID NO: 8564929 - DNA, 22 bp, Homo sapiens
ttcttttcaagaggggcaagga

SEQ ID NO: 8564930 - DNA, 22 bp, Homo sapiens
ttcttttaatttctgtctgcag

SEQ ID NO: 8564931 - DNA, 22 bp, Homo sapiens
ttctttcttagcaatctatggt

SEQ ID NO: 8564932 - DNA, 22 bp, Homo sapiens
ttctttcttagcaatctatggt

SEQ ID NO: 8564933 - DNA, 22 bp, Homo sapiens
ttttagatagtttaactgcact

SEQ ID NO: 8564934 - DNA, 22 bp, Homo sapiens
ttttagaatcaggttgtctggg

SEQ ID NO: 8564935 - DNA, 22 bp, Homo sapiens
ttttaatactgctattgtagga

SEQ ID NO: 8564936 - DNA, 22 bp, Homo sapiens
ttttagatagtttaactgcact

SEQ ID NO: 8564937 - DNA, 22 bp, Homo sapiens
ttttagattataagtctaattc

SEQ ID NO: 8564938 - DNA, 22 bp, Homo sapiens
ttttagcactaagtgatatgct

SEQ ID NO: 8564939 - DNA, 22 bp, Homo sapiens
ttttagcacactttctttagcg

SEQ ID NO: 8564940 - DNA, 22 bp, Homo sapiens
ttttagattgggaaatgtaaag

SEQ ID NO: 8564941 - DNA, 22 bp, Homo sapiens
ttttagattgggaaatgtaaag

SEQ ID NO: 8564942 - DNA, 22 bp, Homo sapiens
ttttagattgggaaatgtaaag

SEQ ID NO: 8564943 - DNA, 20 bp, Homo sapiens
ttttagcacttgttatggtg

SEQ ID NO: 8564944 - DNA, 20 bp, Homo sapiens
ttttagcacttgttatggtg

SEQ ID NO: 8564945 - DNA, 22 bp, Homo sapiens
ttttagcactaagtgatatgct

SEQ ID NO: 8564946 - DNA, 22 bp, Homo sapiens
ttttagcactaagtgatatgct

SEQ ID NO: 8564947 - DNA, 22 bp, Homo sapiens
ttttaatactgctattgtagga

SEQ ID NO: 8564948 - DNA, 22 bp, Homo sapiens
ttttaatactgctattgtagga

SEQ ID NO: 8564949 - DNA, 22 bp, Homo sapiens
ttttaatactgctattgtagga

SEQ ID NO: 8564950 - DNA, 22 bp, Homo sapiens
ttttaagttggattgctaagta

SEQ ID NO: 8564951 - DNA, 19 bp, Homo sapiens
ttttaagtgccctttcttc

SEQ ID NO: 8564952 - DNA, 22 bp, Homo sapiens
ttttaagttaatataattgagg

SEQ ID NO: 8564953 - DNA, 22 bp, Homo sapiens
ttttaagttaatataattgagg

SEQ ID NO: 8564954 - DNA, 22 bp, Homo sapiens
ttttaagcaaaagaatggtgtg

SEQ ID NO: 8564955 - DNA, 19 bp, Homo sapiens
ttttaagtcctctctattc

SEQ ID NO: 8564956 - DNA, 19 bp, Homo sapiens
ttttaagtcctctctattc

SEQ ID NO: 8564957 - DNA, 22 bp, Homo sapiens
tttgtacacctacctaatacag

SEQ ID NO: 8564958 - DNA, 22 bp, Homo sapiens
tttgtacacctacctaatacag

SEQ ID NO: 8564959 - DNA, 22 bp, Homo sapiens
tttgtacactgtctactatgaa

SEQ ID NO: 8564960 - DNA, 22 bp, Homo sapiens
tttgtacacaggtcattcaggg

SEQ ID NO: 8564961 - DNA, 22 bp, Homo sapiens
tttgtacacaggtcattcaggg

SEQ ID NO: 8564962 - DNA, 22 bp, Homo sapiens
tttgtacactgtctactatgaa

SEQ ID NO: 8564963 - DNA, 22 bp, Homo sapiens
tttgtacactgtctactatgaa

SEQ ID NO: 8564964 - DNA, 22 bp, Homo sapiens
tttgtacactgtctactatgaa

SEQ ID NO: 8564965 - DNA, 22 bp, Homo sapiens
tttgtacagtgaaagcgaggtt

SEQ ID NO: 8564966 - DNA, 22 bp, Homo sapiens
tttgtacagtgatgttgtatgc

SEQ ID NO: 8564967 - DNA, 22 bp, Homo sapiens
tttgttctgaaaactcaagtcc

SEQ ID NO: 8564968 - DNA, 22 bp, Homo sapiens
tttgtacatcctaattctgagt

SEQ ID NO: 8564969 - DNA, 22 bp, Homo sapiens
tttgtacatataaatcttgtat

SEQ ID NO: 8564970 - DNA, 22 bp, Homo sapiens
tttgtacatatataaaatctgt

SEQ ID NO: 8564971 - DNA, 22 bp, Homo sapiens
tttgtacatatataaaatctgt

SEQ ID NO: 8564972 - DNA, 22 bp, Homo sapiens
tttgtacatatataaaatctgt

SEQ ID NO: 8564973 - DNA, 22 bp, Homo sapiens
tttgttctgaaaactcaagtcc

SEQ ID NO: 8564974 - DNA, 22 bp, Homo sapiens
ttttaagaactgttctgtgctt

SEQ ID NO: 8564975 - DNA, 22 bp, Homo sapiens
ttttaagatgctagtatttcag

SEQ ID NO: 8564976 - DNA, 22 bp, Homo sapiens
ttttaagatgctagtatttcag

SEQ ID NO: 8564977 - DNA, 22 bp, Homo sapiens
ttttaagaggaggctgtttgaa

SEQ ID NO: 8564978 - DNA, 22 bp, Homo sapiens
ttttcagaattagcataccatt

SEQ ID NO: 8564979 - DNA, 22 bp, Homo sapiens
ttttcagagagcttttatgtcc

SEQ ID NO: 8564980 - DNA, 22 bp, Homo sapiens
ttttcacattgtcccagcacta

SEQ ID NO: 8564981 - DNA, 22 bp, Homo sapiens
ttttcacattgtcccagcacta

SEQ ID NO: 8564982 - DNA, 22 bp, Homo sapiens
ttttcaccatagacactggtcc

SEQ ID NO: 8564983 - DNA, 22 bp, Homo sapiens
ttttcagtggtatctttgtaaa

SEQ ID NO: 8564984 - DNA, 22 bp, Homo sapiens
ttttcagtaatgtctacataat

SEQ ID NO: 8564985 - DNA, 22 bp, Homo sapiens
ttttcaggtgcagtaatcatat

SEQ ID NO: 8564986 - DNA, 22 bp, Homo sapiens
ttttcaggtgcagtaatcatat

SEQ ID NO: 8564987 - DNA, 22 bp, Homo sapiens
ttttcaggccagaagatagacc

SEQ ID NO: 8564988 - DNA, 22 bp, Homo sapiens
ttttcagttactgtttatgtga

SEQ ID NO: 8564989 - DNA, 22 bp, Homo sapiens
ttttcagttactgtttatgtga

SEQ ID NO: 8564990 - DNA, 22 bp, Homo sapiens
ttttcagtggtatctttgtaaa

SEQ ID NO: 8564991 - DNA, 22 bp, Homo sapiens
ttttcagtgggcaatgatgtga

SEQ ID NO: 8564992 - DNA, 22 bp, Homo sapiens
ctcttcttggaatgctgactgt

SEQ ID NO: 8564993 - DNA, 22 bp, Homo sapiens
ctcttcttgaaagaggaattca

SEQ ID NO: 8564994 - DNA, 22 bp, Homo sapiens
ctcttcttgctagactgagtgc

SEQ ID NO: 8564995 - DNA, 22 bp, Homo sapiens
ctcttcttgctagactgagtgc

SEQ ID NO: 8564996 - DNA, 22 bp, Homo sapiens
ctctttaagctcctaacagcca

SEQ ID NO: 8564997 - DNA, 22 bp, Homo sapiens
ctctttaactcccattctgtcc

SEQ ID NO: 8564998 - DNA, 22 bp, Homo sapiens
ctctttaaagtaaaatttgtct

SEQ ID NO: 8564999 - DNA, 22 bp, Homo sapiens
ctctttaactcccattctgtcc

SEQ ID NO: 8565000 - DNA, 22 bp, Homo sapiens
ctctttaaagtaaaatttgtct

SEQ ID NO: 8565001 - DNA, 21 bp, Homo sapiens
ctcttgtgtcagagccagagg

SEQ ID NO: 8565002 - DNA, 20 bp, Homo sapiens
ctctttacatgtctcttcct

SEQ ID NO: 8565003 - DNA, 19 bp, Homo sapiens
ctctttactcccttgcctt

SEQ ID NO: 8565004 - DNA, 22 bp, Homo sapiens
ctctttactctgtgttattgtt

SEQ ID NO: 8565005 - DNA, 20 bp, Homo sapiens
ctctttacatgtctcttcct

SEQ ID NO: 8565006 - DNA, 22 bp, Homo sapiens
ctctttactgctactacaaaga

SEQ ID NO: 8565007 - DNA, 22 bp, Homo sapiens
ctctttactgctactacaaaga

SEQ ID NO: 8565008 - DNA, 22 bp, Homo sapiens
ctctttactgctactacaaaga

SEQ ID NO: 8565009 - DNA, 22 bp, Homo sapiens
ctctttagtcacagggcttcat

SEQ ID NO: 8565010 - DNA, 22 bp, Homo sapiens
ctctttagtctgtgtggagaag

SEQ ID NO: 8565011 - DNA, 21 bp, Homo sapiens
ctcttcagtggtgagctcttc

SEQ ID NO: 8565012 - DNA, 22 bp, Homo sapiens
ctcttcattagttcctgtccca

SEQ ID NO: 8565013 - DNA, 22 bp, Homo sapiens
ctcttccacctccttcaggaga

SEQ ID NO: 8565014 - DNA, 22 bp, Homo sapiens
ctcttcaggtttctgctctgga

SEQ ID NO: 8565015 - DNA, 22 bp, Homo sapiens
ctcttcaggtttctgctctgga

SEQ ID NO: 8565016 - DNA, 22 bp, Homo sapiens
ctcttcagtaaatgacactgtt

SEQ ID NO: 8565017 - DNA, 22 bp, Homo sapiens
ctcttcaggaatatgtcagtca

SEQ ID NO: 8565018 - DNA, 22 bp, Homo sapiens
ctcttcagatatacagtactct

SEQ ID NO: 8565019 - DNA, 22 bp, Homo sapiens
ctcttcagataaaagggatatt

SEQ ID NO: 8565020 - DNA, 22 bp, Homo sapiens
ctcttattcctacagtaacagg

SEQ ID NO: 8565021 - DNA, 22 bp, Homo sapiens
ctcttattgatgaaggtgctaa

SEQ ID NO: 8565022 - DNA, 22 bp, Homo sapiens
ctcttattcctacagtaacagg

SEQ ID NO: 8565023 - DNA, 20 bp, Homo sapiens
ctcttattgcattagtttct

SEQ ID NO: 8565024 - DNA, 22 bp, Homo sapiens
ctcttcaaaagtctaatcctta

SEQ ID NO: 8565025 - DNA, 22 bp, Homo sapiens
ctctgttgtcagtggaagcagc

SEQ ID NO: 8565026 - DNA, 22 bp, Homo sapiens
ctctgtttctcagcctatttcc

SEQ ID NO: 8565027 - DNA, 22 bp, Homo sapiens
ctctgtttctcagcctatttcc

SEQ ID NO: 8565028 - DNA, 22 bp, Homo sapiens
ctcttagtttatctttgacaaa

SEQ ID NO: 8565029 - DNA, 22 bp, Homo sapiens
ctctgttgagcatttttcccct

SEQ ID NO: 8565030 - DNA, 18 bp, Homo sapiens
ctctgtgttggtgtgaag

SEQ ID NO: 8565031 - DNA, 18 bp, Homo sapiens
ctctgtgttggtgtgaag

SEQ ID NO: 8565032 - DNA, 22 bp, Homo sapiens
ttttagttactgcagtagcaaa

SEQ ID NO: 8565033 - DNA, 22 bp, Homo sapiens
ttttagtaccaaccagaagatg

SEQ ID NO: 8565034 - DNA, 23 bp, Homo sapiens
ttttagtgactcctttatctgcc

SEQ ID NO: 8565035 - DNA, 21 bp, Homo sapiens
tttgccttcacgaagcatcct

SEQ ID NO: 8565036 - DNA, 22 bp, Homo sapiens
tttgcctgggaattctagtgta

SEQ ID NO: 8565037 - DNA, 22 bp, Homo sapiens
tttgccttctctgaacctattt

SEQ ID NO: 8565038 - DNA, 22 bp, Homo sapiens
tttgcctctcagagtctacaca

SEQ ID NO: 8565039 - DNA, 19 bp, Homo sapiens
tttgccttgcagctgtgtg

SEQ ID NO: 8565040 - DNA, 22 bp, Homo sapiens
tttgctatttttctgtgcagct

SEQ ID NO: 8565041 - DNA, 22 bp, Homo sapiens
tttgctattgtgaatagtgcca

SEQ ID NO: 8565042 - DNA, 22 bp, Homo sapiens
tttgctataaaagggtcacacg

SEQ ID NO: 8565043 - DNA, 22 bp, Homo sapiens
ctctggaaaaccactagcagga

SEQ ID NO: 8565044 - DNA, 22 bp, Homo sapiens
ctctggaagaatacacttagaa

SEQ ID NO: 8565045 - DNA, 22 bp, Homo sapiens
ctctgctttttagggagcctag

SEQ ID NO: 8565046 - DNA, 22 bp, Homo sapiens
ctctgcttttatgtgccggcgc

SEQ ID NO: 8565047 - DNA, 22 bp, Homo sapiens
ctctgcttttatgtgccggcgc

SEQ ID NO: 8565048 - DNA, 22 bp, Homo sapiens
tttgctcttatgaacaaggtgg

SEQ ID NO: 8565049 - DNA, 20 bp, Homo sapiens
ctctgctttaggagagtcag

SEQ ID NO: 8565050 - DNA, 20 bp, Homo sapiens
ctctgctttaggagagtcag

SEQ ID NO: 8565051 - DNA, 20 bp, Homo sapiens
ctctgctttccacctttcag

SEQ ID NO: 8565052 - DNA, 22 bp, Homo sapiens
ctctgctttcctcttacacact

SEQ ID NO: 8565053 - DNA, 22 bp, Homo sapiens
tttgggaacttaattatgtctg

SEQ ID NO: 8565054 - DNA, 22 bp, Homo sapiens
tttgggaattgtagctgtcttg

SEQ ID NO: 8565055 - DNA, 22 bp, Homo sapiens
tttgggcaattcagtgggacct

SEQ ID NO: 8565056 - DNA, 22 bp, Homo sapiens
ctctggaatgggtgtttctaac

SEQ ID NO: 8565057 - DNA, 22 bp, Homo sapiens
ctctggaattaaggaagcctgt

SEQ ID NO: 8565058 - DNA, 22 bp, Homo sapiens
ctctggaatgtttacatgccct

SEQ ID NO: 8565059 - DNA, 22 bp, Homo sapiens
ctctggaattaaggaagcctgt

SEQ ID NO: 8565060 - DNA, 22 bp, Homo sapiens
tttggaattggcattctattct

SEQ ID NO: 8565061 - DNA, 21 bp, Homo sapiens
ctctgcccagggcctcctgcc

SEQ ID NO: 8565062 - DNA, 22 bp, Homo sapiens
ctctgcccagtgcccacaggag

SEQ ID NO: 8565063 - DNA, 22 bp, Homo sapiens
ctctgcccagtgcccacaggag

SEQ ID NO: 8565064 - DNA, 22 bp, Homo sapiens
ctctgcccagtgcccacaggag

SEQ ID NO: 8565065 - DNA, 22 bp, Homo sapiens
ctctgcccgtgcctttcccagt

SEQ ID NO: 8565066 - DNA, 22 bp, Homo sapiens
ctctgcccgtgcctttcccagt

SEQ ID NO: 8565067 - DNA, 22 bp, Homo sapiens
ctctgcccgcggatgccacgtc

SEQ ID NO: 8565068 - DNA, 22 bp, Homo sapiens
ctctgcccgcggatgccacgtc

SEQ ID NO: 8565069 - DNA, 22 bp, Homo sapiens
ctctgcccgcggatgccacgtc

SEQ ID NO: 8565070 - DNA, 22 bp, Homo sapiens
tttgcaaagtgcttgcagagta

SEQ ID NO: 8565071 - DNA, 19 bp, Homo sapiens
ctctgcctccctcctgggt

SEQ ID NO: 8565072 - DNA, 22 bp, Homo sapiens
tttgcattttagatttaggcct

SEQ ID NO: 8565073 - DNA, 22 bp, Homo sapiens
ctctgccctcgcacatctgcca

SEQ ID NO: 8565074 - DNA, 22 bp, Homo sapiens
ctctgccctcgcacatctgcca

SEQ ID NO: 8565075 - DNA, 22 bp, Homo sapiens
ctctgcctcagtgatttcttta

SEQ ID NO: 8565076 - DNA, 19 bp, Homo sapiens
ctctgcctccctcctgggt

SEQ ID NO: 8565077 - DNA, 19 bp, Homo sapiens
ctctgcctccctcctgggt

SEQ ID NO: 8565078 - DNA, 19 bp, Homo sapiens
ctctgcctccctcctgggt

SEQ ID NO: 8565079 - DNA, 19 bp, Homo sapiens
ctctgcctccctcctgggt

SEQ ID NO: 8565080 - DNA, 22 bp, Homo sapiens
ctctgccaccatgcttcctgac

SEQ ID NO: 8565081 - DNA, 22 bp, Homo sapiens
tttcctttatgacatcaccact

SEQ ID NO: 8565082 - DNA, 22 bp, Homo sapiens
tttccttgttcatttgccctat

SEQ ID NO: 8565083 - DNA, 22 bp, Homo sapiens
ctctgccagtttctggcctcag

SEQ ID NO: 8565084 - DNA, 22 bp, Homo sapiens
ctctgccagtttctggcctcag

SEQ ID NO: 8565085 - DNA, 22 bp, Homo sapiens
ctctgccatcttggagctcaag

SEQ ID NO: 8565086 - DNA, 22 bp, Homo sapiens
ctctgccatctcactgggtcct

SEQ ID NO: 8565087 - DNA, 21 bp, Homo sapiens
ctctgcccagggcctcctgcc

SEQ ID NO: 8565088 - DNA, 22 bp, Homo sapiens
ctctgcccacgtcttgcccaga

SEQ ID NO: 8565089 - DNA, 22 bp, Homo sapiens
ctctgcccacgtcttgcccaga

SEQ ID NO: 8565090 - DNA, 19 bp, Homo sapiens
ctctgccatttgctgcctg

SEQ ID NO: 8565091 - DNA, 22 bp, Homo sapiens
ctctgccatcttggagctcaag

SEQ ID NO: 8565092 - DNA, 17 bp, Homo sapiens
ctgaggcccagggccca

SEQ ID NO: 8565093 - DNA, 17 bp, Homo sapiens
ctgaggcccagggccca

SEQ ID NO: 8565094 - DNA, 18 bp, Homo sapiens
ctgaggcccagagagggc

SEQ ID NO: 8565095 - DNA, 22 bp, Homo sapiens
ctgaggccagctgcagagctct

SEQ ID NO: 8565096 - DNA, 22 bp, Homo sapiens
ctgaggccagctgcagagctct

SEQ ID NO: 8565097 - DNA, 22 bp, Homo sapiens
ctgaggccagctgcagagctct

SEQ ID NO: 8565098 - DNA, 18 bp, Homo sapiens
ctgaggcccagagagggc

SEQ ID NO: 8565099 - DNA, 19 bp, Homo sapiens
ctgaggcccatgtaccatg

SEQ ID NO: 8565100 - DNA, 19 bp, Homo sapiens
ctgaggcccatgtaccatg

SEQ ID NO: 8565101 - DNA, 22 bp, Homo sapiens
ctgaggcccctctcttgagctt

SEQ ID NO: 8565102 - DNA, 22 bp, Homo sapiens
ctgaggcccctctcttgagctt

SEQ ID NO: 8565103 - DNA, 22 bp, Homo sapiens
ctgaggcccctcttgtgagcat

SEQ ID NO: 8565104 - DNA, 22 bp, Homo sapiens
ctgaggcccctcttgtgagcat

SEQ ID NO: 8565105 - DNA, 18 bp, Homo sapiens
ctgaggccaactacactg

SEQ ID NO: 8565106 - DNA, 22 bp, Homo sapiens
ctgaggccagaacccgaccctg

SEQ ID NO: 8565107 - DNA, 22 bp, Homo sapiens
ctgaggccagctgcagagctct

SEQ ID NO: 8565108 - DNA, 22 bp, Homo sapiens
ctgaggccagagtgggcctctt

SEQ ID NO: 8565109 - DNA, 22 bp, Homo sapiens
ctgaggccagagtgggcctctt

SEQ ID NO: 8565110 - DNA, 22 bp, Homo sapiens
ctgaggcatgttacaggacata

SEQ ID NO: 8565111 - DNA, 22 bp, Homo sapiens
ctgaggcatgggaagttgggtg

SEQ ID NO: 8565112 - DNA, 21 bp, Homo sapiens
ctgaggcatgcaggcctgggc

SEQ ID NO: 8565113 - DNA, 22 bp, Homo sapiens
ctgcacagaggtcggtctgcca

SEQ ID NO: 8565114 - DNA, 22 bp, Homo sapiens
ctgcacagagcggcagttctta

SEQ ID NO: 8565115 - DNA, 22 bp, Homo sapiens
ctgcacagagcagggcagacac

SEQ ID NO: 8565116 - DNA, 22 bp, Homo sapiens
ctgcacagagcagggcagacac

SEQ ID NO: 8565117 - DNA, 22 bp, Homo sapiens
ctgcacagagcagggcagacac

SEQ ID NO: 8565118 - DNA, 22 bp, Homo sapiens
ctgcacagagcagggcagacac

SEQ ID NO: 8565119 - DNA, 22 bp, Homo sapiens
ctgcacacatcgcactgcccgt

SEQ ID NO: 8565120 - DNA, 21 bp, Homo sapiens
ctgcaaatacctagttatctg

SEQ ID NO: 8565121 - DNA, 22 bp, Homo sapiens
ctgcaaaggtgggggaggagct

SEQ ID NO: 8565122 - DNA, 22 bp, Homo sapiens
ctgcaaaattgttctttgctcc

SEQ ID NO: 8565123 - DNA, 22 bp, Homo sapiens
ctgaggccggagcactgaagag

SEQ ID NO: 8565124 - DNA, 22 bp, Homo sapiens
ctgaggccggagcactgaagag

SEQ ID NO: 8565125 - DNA, 22 bp, Homo sapiens
ctgcacagcctgtctgggggcc

SEQ ID NO: 8565126 - DNA, 22 bp, Homo sapiens
ctgcacagctggccagggagag

SEQ ID NO: 8565127 - DNA, 22 bp, Homo sapiens
ctgcacagctggccagggagag

SEQ ID NO: 8565128 - DNA, 22 bp, Homo sapiens
ctgcacagctggccagggagag

SEQ ID NO: 8565129 - DNA, 22 bp, Homo sapiens
ctgcacagctggccagggagag

SEQ ID NO: 8565130 - DNA, 22 bp, Homo sapiens
ctgcacaggggatgagggcagt

SEQ ID NO: 8565131 - DNA, 22 bp, Homo sapiens
ctgcacaggggatgagggcagt

SEQ ID NO: 8565132 - DNA, 22 bp, Homo sapiens
ctgcacagggatatggggagct

SEQ ID NO: 8565133 - DNA, 22 bp, Homo sapiens
ctgcacagggatatggggagct

SEQ ID NO: 8565134 - DNA, 22 bp, Homo sapiens
ctgcacaggggatgagggcagt

SEQ ID NO: 8565135 - DNA, 22 bp, Homo sapiens
ctgcacagtgggtggggcgtca

SEQ ID NO: 8565136 - DNA, 22 bp, Homo sapiens
ctgcacagtggacagtgaagat

SEQ ID NO: 8565137 - DNA, 22 bp, Homo sapiens
ctgcacagtggacagtgaagat

SEQ ID NO: 8565138 - DNA, 22 bp, Homo sapiens
ctgcagggagcagatggcgtgt

SEQ ID NO: 8565139 - DNA, 22 bp, Homo sapiens
ctgcaggcccccttcctggagt

SEQ ID NO: 8565140 - DNA, 22 bp, Homo sapiens
ctgcaggcatctaactgtgggc

SEQ ID NO: 8565141 - DNA, 22 bp, Homo sapiens
ctgcactgctgatcccaggtct

SEQ ID NO: 8565142 - DNA, 22 bp, Homo sapiens
ctgcactgaagaaaggagctct

SEQ ID NO: 8565143 - DNA, 22 bp, Homo sapiens
ctgcactgacttccccggctgc

SEQ ID NO: 8565144 - DNA, 22 bp, Homo sapiens
ctgcactgacttccccggctgc

SEQ ID NO: 8565145 - DNA, 22 bp, Homo sapiens
ctgcacgtataatcagtctgtt

SEQ ID NO: 8565146 - DNA, 22 bp, Homo sapiens
ctgcacctacagccacatttac

SEQ ID NO: 8565147 - DNA, 22 bp, Homo sapiens
ctgcactgaagaaaggagctct

SEQ ID NO: 8565148 - DNA, 22 bp, Homo sapiens
ctgcaccatccttcatgctctg

SEQ ID NO: 8565149 - DNA, 22 bp, Homo sapiens
ctgcaccacagcctgaggcagc

SEQ ID NO: 8565150 - DNA, 22 bp, Homo sapiens
ctgcacatgttcatcatgacaa

SEQ ID NO: 8565151 - DNA, 22 bp, Homo sapiens
ctgcacagtgttggaagctgcc

SEQ ID NO: 8565152 - DNA, 22 bp, Homo sapiens
ctgcagggccatgggttctata

SEQ ID NO: 8565153 - DNA, 22 bp, Homo sapiens
ctgcagggcccaaggtcaacgg

SEQ ID NO: 8565154 - DNA, 22 bp, Homo sapiens
ctgcagggcccaaggtcaacgg

SEQ ID NO: 8565155 - DNA, 22 bp, Homo sapiens
ctgcagggcccgcctgagccct

SEQ ID NO: 8565156 - DNA, 22 bp, Homo sapiens
ctgcagggcccgcctgagccct

SEQ ID NO: 8565157 - DNA, 22 bp, Homo sapiens
ctgcaggggcagtccacttcct

SEQ ID NO: 8565158 - DNA, 22 bp, Homo sapiens
ctgcaggggcctcgagcacagg

SEQ ID NO: 8565159 - DNA, 22 bp, Homo sapiens
ctgcaggggcagtccacttcct

SEQ ID NO: 8565160 - DNA, 22 bp, Homo sapiens
ctgcagggcttaccttgctctg

SEQ ID NO: 8565161 - DNA, 22 bp, Homo sapiens
ctgcaggggaccaaagtctgac

SEQ ID NO: 8565162 - DNA, 22 bp, Homo sapiens
ctgcagggcattgtaactcttt

SEQ ID NO: 8565163 - DNA, 22 bp, Homo sapiens
ctgcagggcagggcctcctggc

SEQ ID NO: 8565164 - DNA, 22 bp, Homo sapiens
ctgcagggcagggcctcctggc

SEQ ID NO: 8565165 - DNA, 22 bp, Homo sapiens
ctgcagggcagggcctcctggc

SEQ ID NO: 8565166 - DNA, 22 bp, Homo sapiens
ctgcagggattgcttctgtata

SEQ ID NO: 8565167 - DNA, 19 bp, Homo sapiens
ctgcagggatgtgcagagt

SEQ ID NO: 8565168 - DNA, 19 bp, Homo sapiens
ctgcagggatgtgcagagt

SEQ ID NO: 8565169 - DNA, 19 bp, Homo sapiens
ctgcagggatgtgcagagt

SEQ ID NO: 8565170 - DNA, 22 bp, Homo sapiens
ctgcagggatgtgaggcccgtt

SEQ ID NO: 8565171 - DNA, 22 bp, Homo sapiens
ctgagccagtagtcagggacaa

SEQ ID NO: 8565172 - DNA, 22 bp, Homo sapiens
ctgagccagtagtcagggacaa

SEQ ID NO: 8565173 - DNA, 22 bp, Homo sapiens
ctgagccataagggaggctggg

SEQ ID NO: 8565174 - DNA, 22 bp, Homo sapiens
ctgagccataagggaggctggg

SEQ ID NO: 8565175 - DNA, 22 bp, Homo sapiens
ctgagccaaggggacagtgaca

SEQ ID NO: 8565176 - DNA, 20 bp, Homo sapiens
ctgagccaactctcttcttg

SEQ ID NO: 8565177 - DNA, 22 bp, Homo sapiens
ctgagccagtagtcagggacaa

SEQ ID NO: 8565178 - DNA, 22 bp, Homo sapiens
ctgagccatgagcctgcgccca

SEQ ID NO: 8565179 - DNA, 22 bp, Homo sapiens
ctgagccatgagcctgcgccca

SEQ ID NO: 8565180 - DNA, 22 bp, Homo sapiens
ctgagccataagggaggctggg

SEQ ID NO: 8565181 - DNA, 22 bp, Homo sapiens
ctgagccataagggaggctggg

SEQ ID NO: 8565182 - DNA, 22 bp, Homo sapiens
ctgagccatccataccagctta

SEQ ID NO: 8565183 - DNA, 22 bp, Homo sapiens
ctgagccatccataccagctta

SEQ ID NO: 8565184 - DNA, 22 bp, Homo sapiens
ctgagccatccataccagctta

SEQ ID NO: 8565185 - DNA, 22 bp, Homo sapiens
ctgactccctccccaaagctgg

SEQ ID NO: 8565186 - DNA, 22 bp, Homo sapiens
ctgactccttaccatatgcttt

SEQ ID NO: 8565187 - DNA, 22 bp, Homo sapiens
ctgactctcctcaagcataaat

SEQ ID NO: 8565188 - DNA, 22 bp, Homo sapiens
ctgactctgacaggacttgtgg

SEQ ID NO: 8565189 - DNA, 22 bp, Homo sapiens
ctgagccaaccacagcaggagc

SEQ ID NO: 8565190 - DNA, 22 bp, Homo sapiens
ctgacccttgctcgggccctgt

SEQ ID NO: 8565191 - DNA, 22 bp, Homo sapiens
ctgaccctttagggtatgttta

SEQ ID NO: 8565192 - DNA, 18 bp, Homo sapiens
ctgacccttttacattcc

SEQ ID NO: 8565193 - DNA, 23 bp, Homo sapiens
ctgacctgacccataagcaagga

SEQ ID NO: 8565194 - DNA, 22 bp, Homo sapiens
ctgactcagcagctgatgatcc

SEQ ID NO: 8565195 - DNA, 23 bp, Homo sapiens
ctgactcatcccaccacctcctc

SEQ ID NO: 8565196 - DNA, 22 bp, Homo sapiens
ctgactcccaagctagtgctct

SEQ ID NO: 8565197 - DNA, 17 bp, Homo sapiens
ctgagccccgggcagct

SEQ ID NO: 8565198 - DNA, 20 bp, Homo sapiens
ctgagcccccagcctgcagg

SEQ ID NO: 8565199 - DNA, 20 bp, Homo sapiens
ctgagcccccagcctgcagg

SEQ ID NO: 8565200 - DNA, 22 bp, Homo sapiens
ctgagcccctctgacctcagag

SEQ ID NO: 8565201 - DNA, 22 bp, Homo sapiens
ctgagcccaggcgggagctgag

SEQ ID NO: 8565202 - DNA, 22 bp, Homo sapiens
ctgagcccaggcgggagctgag

SEQ ID NO: 8565203 - DNA, 22 bp, Homo sapiens
ctgagcccattgggtgctgtta

SEQ ID NO: 8565204 - DNA, 22 bp, Homo sapiens
ctgagccccatctgaggtgccc

SEQ ID NO: 8565205 - DNA, 22 bp, Homo sapiens
ctgagccccatctgaggtgccc

SEQ ID NO: 8565206 - DNA, 22 bp, Homo sapiens
ctgagccccatctgaggtgccc

SEQ ID NO: 8565207 - DNA, 19 bp, Homo sapiens
ctgagcctcagtttcctag

SEQ ID NO: 8565208 - DNA, 22 bp, Homo sapiens
ctgagcccttgcttatgcttcc

SEQ ID NO: 8565209 - DNA, 22 bp, Homo sapiens
ctgagcctcctgcttctatttc

SEQ ID NO: 8565210 - DNA, 22 bp, Homo sapiens
ctgagcctgtgtttctctggca

SEQ ID NO: 8565211 - DNA, 22 bp, Homo sapiens
ctgaggcagagggcagaccaga

SEQ ID NO: 8565212 - DNA, 22 bp, Homo sapiens
ctgacagtctcattgatttgct

SEQ ID NO: 8565213 - DNA, 22 bp, Homo sapiens
ctgacagtaactaatgtggaga

SEQ ID NO: 8565214 - DNA, 22 bp, Homo sapiens
ctgacagtctcattgatttgct

SEQ ID NO: 8565215 - DNA, 22 bp, Homo sapiens
ctgacagtttttgctgtattgt

SEQ ID NO: 8565216 - DNA, 22 bp, Homo sapiens
ctgacatttactgagcacttac

SEQ ID NO: 8565217 - DNA, 22 bp, Homo sapiens
ctgacccttaatgagcaagtaa

SEQ ID NO: 8565218 - DNA, 22 bp, Homo sapiens
ctgaccctggtcaagttgcctc

SEQ ID NO: 8565219 - DNA, 22 bp, Homo sapiens
ctgacagggtagacagagggca

SEQ ID NO: 8565220 - DNA, 22 bp, Homo sapiens
ctgacagctgttgcagtgaatg

SEQ ID NO: 8565221 - DNA, 22 bp, Homo sapiens
ctgacagattagatgtgcatat

SEQ ID NO: 8565222 - DNA, 22 bp, Homo sapiens
ctgaatatcatttatcattggc

SEQ ID NO: 8565223 - DNA, 22 bp, Homo sapiens
ctgaatattagtcatgtctgat

SEQ ID NO: 8565224 - DNA, 22 bp, Homo sapiens
ctgaatatcatttatcattggc

SEQ ID NO: 8565225 - DNA, 22 bp, Homo sapiens
ctgaatcatgccattttgctta

SEQ ID NO: 8565226 - DNA, 22 bp, Homo sapiens
ctgacagatacttatgacataa

SEQ ID NO: 8565227 - DNA, 22 bp, Homo sapiens
ctgacagatgctgctggcagta

SEQ ID NO: 8565228 - DNA, 22 bp, Homo sapiens
ctgacagattagatgtgcatat

SEQ ID NO: 8565229 - DNA, 22 bp, Homo sapiens
ctctttcctcagccacagtcta

SEQ ID NO: 8565230 - DNA, 22 bp, Homo sapiens
ctctttcctcagccacagtcta

SEQ ID NO: 8565231 - DNA, 22 bp, Homo sapiens
ctctttcctcagccacagtcta

SEQ ID NO: 8565232 - DNA, 22 bp, Homo sapiens
ctctttctgattcgctgggacc

SEQ ID NO: 8565233 - DNA, 22 bp, Homo sapiens
ctctttcagttctgatagtctc

SEQ ID NO: 8565234 - DNA, 22 bp, Homo sapiens
ctctttccagggtaccccaggt

SEQ ID NO: 8565235 - DNA, 19 bp, Homo sapiens
ctctttccattgtatttgc

SEQ ID NO: 8565236 - DNA, 17 bp, Homo sapiens
ctctttataaagagtta

SEQ ID NO: 8565237 - DNA, 22 bp, Homo sapiens
ctctttagtggtgatgatgcta

SEQ ID NO: 8565238 - DNA, 22 bp, Homo sapiens
ctctttagtttgaaatccacat

SEQ ID NO: 8565239 - DNA, 22 bp, Homo sapiens
ctctttggatagaattacaaag

SEQ ID NO: 8565240 - DNA, 22 bp, Homo sapiens
ctgaatatcatttacatttgga

SEQ ID NO: 8565241 - DNA, 22 bp, Homo sapiens
ctgaatatcatttatcattggc

SEQ ID NO: 8565242 - DNA, 22 bp, Homo sapiens
ctctttgcctaactgttttcaa

SEQ ID NO: 8565243 - DNA, 22 bp, Homo sapiens
ctctttgacgtgcccatgtccc

SEQ ID NO: 8565244 - DNA, 22 bp, Homo sapiens
ctctttctgattcgctgggacc

SEQ ID NO: 8565245 - DNA, 22 bp, Homo sapiens
ctacaggtcagtaagacctaga

SEQ ID NO: 8565246 - DNA, 22 bp, Homo sapiens
ctacaggtcagtaagacctaga

SEQ ID NO: 8565247 - DNA, 23 bp, Homo sapiens
ctacaggttaattttcagtggaa

SEQ ID NO: 8565248 - DNA, 22 bp, Homo sapiens
ctacaggtcaagcagtagctct

SEQ ID NO: 8565249 - DNA, 22 bp, Homo sapiens
ctacagtactggatgctcagcc

SEQ ID NO: 8565250 - DNA, 22 bp, Homo sapiens
ctacagtagagaggatgtagaa

SEQ ID NO: 8565251 - DNA, 22 bp, Homo sapiens
ctacagtagagaggatgtagaa

SEQ ID NO: 8565252 - DNA, 22 bp, Homo sapiens
ctacagtagaggttgtcaggga

SEQ ID NO: 8565253 - DNA, 22 bp, Homo sapiens
ctacagtagagtaggcctctga

SEQ ID NO: 8565254 - DNA, 22 bp, Homo sapiens
ctacagtatgaaacctttactc

SEQ ID NO: 8565255 - DNA, 22 bp, Homo sapiens
ctacaggtatgtgcatgacatc

SEQ ID NO: 8565256 - DNA, 22 bp, Homo sapiens
ctacaggctcagggagccctct

SEQ ID NO: 8565257 - DNA, 22 bp, Homo sapiens
ctacaggctcagggagccctct

SEQ ID NO: 8565258 - DNA, 22 bp, Homo sapiens
ctacaggaaggatcttgctcaa

SEQ ID NO: 8565259 - DNA, 22 bp, Homo sapiens
ctacagcagagctacactaact

SEQ ID NO: 8565260 - DNA, 22 bp, Homo sapiens
ctacagctggccttggaaaact

SEQ ID NO: 8565261 - DNA, 22 bp, Homo sapiens
ctacagctgtgtgtttatgtgc

SEQ ID NO: 8565262 - DNA, 22 bp, Homo sapiens
ctacagagtgaatgcagaaaat

SEQ ID NO: 8565263 - DNA, 22 bp, Homo sapiens
ctacagcagagaccagccacat

SEQ ID NO: 8565264 - DNA, 22 bp, Homo sapiens
ctacagagttcacaggatttta

SEQ ID NO: 8565265 - DNA, 22 bp, Homo sapiens
ttcctgggaggctgtgtacttg

SEQ ID NO: 8565266 - DNA, 22 bp, Homo sapiens
ttcctgggattattgtcaagca

SEQ ID NO: 8565267 - DNA, 22 bp, Homo sapiens
ttcctgggcaggacgagagtct

SEQ ID NO: 8565268 - DNA, 22 bp, Homo sapiens
ttcctgggccttaaatcttttg

SEQ ID NO: 8565269 - DNA, 22 bp, Homo sapiens
ttcctgggctgcagagagcacc

SEQ ID NO: 8565270 - DNA, 20 bp, Homo sapiens
ttcctggctctaggaccttg

SEQ ID NO: 8565271 - DNA, 22 bp, Homo sapiens
ttcctggctcacagcagtgggg

SEQ ID NO: 8565272 - DNA, 22 bp, Homo sapiens
ctacagtctggcaggaatgtta

SEQ ID NO: 8565273 - DNA, 19 bp, Homo sapiens
ttcctggctcttctgtttt

SEQ ID NO: 8565274 - DNA, 22 bp, Homo sapiens
ttcctggctgtcatgccctagt

SEQ ID NO: 8565275 - DNA, 22 bp, Homo sapiens
ttcctgggactggagcagccca

SEQ ID NO: 8565276 - DNA, 22 bp, Homo sapiens
ttcctgggagctagccacatct

SEQ ID NO: 8565277 - DNA, 22 bp, Homo sapiens
ctacagagaactcagctgccct

SEQ ID NO: 8565278 - DNA, 22 bp, Homo sapiens
ctacagaggacacaaagatctt

SEQ ID NO: 8565279 - DNA, 22 bp, Homo sapiens
ctacagagtatctaaagaggta

SEQ ID NO: 8565280 - DNA, 22 bp, Homo sapiens
ttccaggacttcatggctctga

SEQ ID NO: 8565281 - DNA, 22 bp, Homo sapiens
ttccaggagccacacaggggcg

SEQ ID NO: 8565282 - DNA, 22 bp, Homo sapiens
ctaaatgacaggtaccatagtg

SEQ ID NO: 8565283 - DNA, 22 bp, Homo sapiens
ctaaatgacttccagtggttat

SEQ ID NO: 8565284 - DNA, 22 bp, Homo sapiens
ttccaggaccaggaagagggga

SEQ ID NO: 8565285 - DNA, 22 bp, Homo sapiens
ctaaatgatattttggtttcct

SEQ ID NO: 8565286 - DNA, 22 bp, Homo sapiens
ttcctgggctgcagagagcacc

SEQ ID NO: 8565287 - DNA, 22 bp, Homo sapiens
ttcctgggctgcagagagcacc

SEQ ID NO: 8565288 - DNA, 22 bp, Homo sapiens
ttcctgggctgcagagagcacc

SEQ ID NO: 8565289 - DNA, 22 bp, Homo sapiens
ttcctgggctttcccctctggt

SEQ ID NO: 8565290 - DNA, 22 bp, Homo sapiens
ctacatttcccagctgccttcc

SEQ ID NO: 8565291 - DNA, 22 bp, Homo sapiens
ctacccaggctggagtgcagta

SEQ ID NO: 8565292 - DNA, 22 bp, Homo sapiens
ctacatttcatccagggagagc

SEQ ID NO: 8565293 - DNA, 21 bp, Homo sapiens
ttcctggggaaggagctgcct

SEQ ID NO: 8565294 - DNA, 22 bp, Homo sapiens
ctacccttaagtttctgtgggg

SEQ ID NO: 8565295 - DNA, 22 bp, Homo sapiens
ctacctgaaaaggttgtggtga

SEQ ID NO: 8565296 - DNA, 22 bp, Homo sapiens
ctacccaggcttagagggctgg

SEQ ID NO: 8565297 - DNA, 21 bp, Homo sapiens
ctaccctcactcccattcctc

SEQ ID NO: 8565298 - DNA, 22 bp, Homo sapiens
ctacccaggctggagtgcagta

SEQ ID NO: 8565299 - DNA, 22 bp, Homo sapiens
ctacccaggctggagtgcagta

SEQ ID NO: 8565300 - DNA, 22 bp, Homo sapiens
ctacccaggcttagagggctgg

SEQ ID NO: 8565301 - DNA, 22 bp, Homo sapiens
ctactgccattgtctctgccat

SEQ ID NO: 8565302 - DNA, 22 bp, Homo sapiens
ctactgtctcatcagtgttatt

SEQ ID NO: 8565303 - DNA, 22 bp, Homo sapiens
ctactgtcttccttggtaacaa

SEQ ID NO: 8565304 - DNA, 22 bp, Homo sapiens
ctactgtccataaagtataact

SEQ ID NO: 8565305 - DNA, 22 bp, Homo sapiens
ctactgtctcatcagtgttatt

SEQ ID NO: 8565306 - DNA, 22 bp, Homo sapiens
ctactagatcagtatgcctcaa

SEQ ID NO: 8565307 - DNA, 22 bp, Homo sapiens
ctactgatgctatacttctcag

SEQ ID NO: 8565308 - DNA, 22 bp, Homo sapiens
ctactgatgatgttggttgtgg

SEQ ID NO: 8565309 - DNA, 22 bp, Homo sapiens
ctactgagtccttcagctgcca

SEQ ID NO: 8565310 - DNA, 22 bp, Homo sapiens
ctactcttttgagtcttcagat

SEQ ID NO: 8565311 - DNA, 22 bp, Homo sapiens
ctactctgaattgaagtgatat

SEQ ID NO: 8565312 - DNA, 22 bp, Homo sapiens
ctagaaacattacatgtgttaa

SEQ ID NO: 8565313 - DNA, 22 bp, Homo sapiens
ctagaaacgcctttagcacaac

SEQ ID NO: 8565314 - DNA, 22 bp, Homo sapiens
ttctctggactatttgcactcc

SEQ ID NO: 8565315 - DNA, 21 bp, Homo sapiens
ttctctggataggccagtcct

SEQ ID NO: 8565316 - DNA, 20 bp, Homo sapiens
ttctctggatagccagatgt

SEQ ID NO: 8565317 - DNA, 22 bp, Homo sapiens
ttctctggagggctgcccggcc

SEQ ID NO: 8565318 - DNA, 22 bp, Homo sapiens
ctacttctgtgatgaaactaca

SEQ ID NO: 8565319 - DNA, 22 bp, Homo sapiens
ctacttctaagtacatggtgat

SEQ ID NO: 8565320 - DNA, 21 bp, Homo sapiens
ctacttaagtaggggattagg

SEQ ID NO: 8565321 - DNA, 19 bp, Homo sapiens
ctactttataatatgcctc

SEQ ID NO: 8565322 - DNA, 20 bp, Homo sapiens
ctactttaggcactgagaat

SEQ ID NO: 8565323 - DNA, 22 bp, Homo sapiens
ctacttgttcactgtaggtcgc

SEQ ID NO: 8565324 - DNA, 22 bp, Homo sapiens
ctactttaacaattcgcaagaa

SEQ ID NO: 8565325 - DNA, 22 bp, Homo sapiens
ctactttaacatggaggcactt

SEQ ID NO: 8565326 - DNA, 22 bp, Homo sapiens
ctactttaattttctgcagaga

SEQ ID NO: 8565327 - DNA, 22 bp, Homo sapiens
ctactttaattttctgcagaga

SEQ ID NO: 8565328 - DNA, 22 bp, Homo sapiens
ctactttacctccatcagactg

SEQ ID NO: 8565329 - DNA, 22 bp, Homo sapiens
ctactttacctccatcagactg

SEQ ID NO: 8565330 - DNA, 22 bp, Homo sapiens
ctattacaatctgctactatga

SEQ ID NO: 8565331 - DNA, 22 bp, Homo sapiens
ctattacaatctgctactatga

SEQ ID NO: 8565332 - DNA, 22 bp, Homo sapiens
ctattaaatactcttcaaattg

SEQ ID NO: 8565333 - DNA, 22 bp, Homo sapiens
ctattaaatactcttcaaattg

SEQ ID NO: 8565334 - DNA, 22 bp, Homo sapiens
ctattacaatctgctactatga

SEQ ID NO: 8565335 - DNA, 22 bp, Homo sapiens
ctattaaatactcttcaaattg

SEQ ID NO: 8565336 - DNA, 22 bp, Homo sapiens
ctattaaacactactgtgcact

SEQ ID NO: 8565337 - DNA, 22 bp, Homo sapiens
ctattaaacactactgtgcact

SEQ ID NO: 8565338 - DNA, 22 bp, Homo sapiens
ctattaaatactcttcaaattg

SEQ ID NO: 8565339 - DNA, 22 bp, Homo sapiens
ctatggtctggaccgaggtcct

SEQ ID NO: 8565340 - DNA, 22 bp, Homo sapiens
ctatggtgatagaaatcagaat

SEQ ID NO: 8565341 - DNA, 22 bp, Homo sapiens
ctatggctgtgttcatgctaca

SEQ ID NO: 8565342 - DNA, 22 bp, Homo sapiens
ctatgcatctgaacaatagaga

SEQ ID NO: 8565343 - DNA, 22 bp, Homo sapiens
ctatgagaagaaaacaagatta

SEQ ID NO: 8565344 - DNA, 22 bp, Homo sapiens
ctatgagaagaaaacaagatta

SEQ ID NO: 8565345 - DNA, 23 bp, Homo sapiens
ctatggaataccaatgattctca

SEQ ID NO: 8565346 - DNA, 23 bp, Homo sapiens
ctatggaataccaatgattctca

SEQ ID NO: 8565347 - DNA, 22 bp, Homo sapiens
ctatggaaacctaatcaggaga

SEQ ID NO: 8565348 - DNA, 22 bp, Homo sapiens
ctatggaaactcaacatttgtt

SEQ ID NO: 8565349 - DNA, 22 bp, Homo sapiens
ctatggaaacctaatcaggaga

SEQ ID NO: 8565350 - DNA, 22 bp, Homo sapiens
ctatggaaactcaacatttgtt

SEQ ID NO: 8565351 - DNA, 22 bp, Homo sapiens
ctatggaagggatgcaaagaaa

SEQ ID NO: 8565352 - DNA, 22 bp, Homo sapiens
ttctctggcgcgctgtgctatg

SEQ ID NO: 8565353 - DNA, 22 bp, Homo sapiens
ttctctggcgcgctgtgctatg

SEQ ID NO: 8565354 - DNA, 22 bp, Homo sapiens
ttctctggcctgaggcgaggcc

SEQ ID NO: 8565355 - DNA, 22 bp, Homo sapiens
ttctctggccatagctggctag

SEQ ID NO: 8565356 - DNA, 22 bp, Homo sapiens
ttctctggatgtttctcagtca

SEQ ID NO: 8565357 - DNA, 22 bp, Homo sapiens
ttctctggatgtttctcagtca

SEQ ID NO: 8565358 - DNA, 21 bp, Homo sapiens
ttctctggcttctgtagctgg

SEQ ID NO: 8565359 - DNA, 21 bp, Homo sapiens
ttctctggcttctgtagctgg

SEQ ID NO: 8565360 - DNA, 21 bp, Homo sapiens
ttctctggcttctgtagctgg

SEQ ID NO: 8565361 - DNA, 22 bp, Homo sapiens
ctagcacagtatggtatcagat

SEQ ID NO: 8565362 - DNA, 22 bp, Homo sapiens
ctagccagatgattcccaaata

SEQ ID NO: 8565363 - DNA, 22 bp, Homo sapiens
ctagccagactcaagggccacc

SEQ ID NO: 8565364 - DNA, 22 bp, Homo sapiens
ctatatacttttcacagatgtt

SEQ ID NO: 8565365 - DNA, 22 bp, Homo sapiens
ctagccagatttaaagagagac

SEQ ID NO: 8565366 - DNA, 22 bp, Homo sapiens
ctatatacttttcacagatgtt

SEQ ID NO: 8565367 - DNA, 22 bp, Homo sapiens
ctatatacttttcacagatgtt

SEQ ID NO: 8565368 - DNA, 22 bp, Homo sapiens
ctcacaggtaccagcaccctcc

SEQ ID NO: 8565369 - DNA, 22 bp, Homo sapiens
ctcacaggcatctcatcaggct

SEQ ID NO: 8565370 - DNA, 21 bp, Homo sapiens
ctcacaggatgcagtgttact

SEQ ID NO: 8565371 - DNA, 22 bp, Homo sapiens
ctcacagcacttgtgtcattgg

SEQ ID NO: 8565372 - DNA, 22 bp, Homo sapiens
ctcacagcacttgtgtcattgg

SEQ ID NO: 8565373 - DNA, 22 bp, Homo sapiens
ctcacagcagctctgcgagata

SEQ ID NO: 8565374 - DNA, 22 bp, Homo sapiens
ctcacagcagccagtctgcctt

SEQ ID NO: 8565375 - DNA, 22 bp, Homo sapiens
ctcacagcagctctgcgagata

SEQ ID NO: 8565376 - DNA, 22 bp, Homo sapiens
ctcacaggagaaagtcatggtc

SEQ ID NO: 8565377 - DNA, 22 bp, Homo sapiens
ctcacagctgcttcaggatcca

SEQ ID NO: 8565378 - DNA, 22 bp, Homo sapiens
ctcacagcatggaattttctgg

SEQ ID NO: 8565379 - DNA, 22 bp, Homo sapiens
ctcacagctgcttcaggatcca

SEQ ID NO: 8565380 - DNA, 22 bp, Homo sapiens
ctcacaccagcttacaagactt

SEQ ID NO: 8565381 - DNA, 22 bp, Homo sapiens
ctcacacacgaagcccttggcc

SEQ ID NO: 8565382 - DNA, 22 bp, Homo sapiens
ctcacaatttttcagtgactat

SEQ ID NO: 8565383 - DNA, 22 bp, Homo sapiens
ctcacacacgaagcccttggcc

SEQ ID NO: 8565384 - DNA, 22 bp, Homo sapiens
ctcacagatacggctattcctg

SEQ ID NO: 8565385 - DNA, 22 bp, Homo sapiens
ctcacagagcctctgtgtcttc

SEQ ID NO: 8565386 - DNA, 22 bp, Homo sapiens
ctcacagatgctgtgggtcagg

SEQ ID NO: 8565387 - DNA, 22 bp, Homo sapiens
ctcacagatatttgcttcaggt

SEQ ID NO: 8565388 - DNA, 22 bp, Homo sapiens
ctcaagatattccagctctcaa

SEQ ID NO: 8565389 - DNA, 22 bp, Homo sapiens
ctattagacacaattagtgatt

SEQ ID NO: 8565390 - DNA, 22 bp, Homo sapiens
ctattagaaagcatcttctata

SEQ ID NO: 8565391 - DNA, 22 bp, Homo sapiens
ctattagaaagcatcttctata

SEQ ID NO: 8565392 - DNA, 22 bp, Homo sapiens
ctattacatttctggacattca

SEQ ID NO: 8565393 - DNA, 22 bp, Homo sapiens
ctattactgacttctgtattta

SEQ ID NO: 8565394 - DNA, 22 bp, Homo sapiens
ctattattagcaaaaggtggat

SEQ ID NO: 8565395 - DNA, 22 bp, Homo sapiens
ctattatttcctcatctataaa

SEQ ID NO: 8565396 - DNA, 22 bp, Homo sapiens
ctattatttcctcatctataaa

SEQ ID NO: 8565397 - DNA, 22 bp, Homo sapiens
ttcatcttgatggcttcctaat

SEQ ID NO: 8565398 - DNA, 22 bp, Homo sapiens
ttcatcttgatggcttcctaat

SEQ ID NO: 8565399 - DNA, 22 bp, Homo sapiens
ttcatgaaacttaactgttggg

SEQ ID NO: 8565400 - DNA, 22 bp, Homo sapiens
ttcatgaaacttaactgttggg

SEQ ID NO: 8565401 - DNA, 22 bp, Homo sapiens
ttcatgaaacttaactgttggg

SEQ ID NO: 8565402 - DNA, 22 bp, Homo sapiens
ttcatgaaacttaactgttggg

SEQ ID NO: 8565403 - DNA, 22 bp, Homo sapiens
ttcatgaaagacagcaactgtg

SEQ ID NO: 8565404 - DNA, 22 bp, Homo sapiens
ttcatctgtagcatcttccaat

SEQ ID NO: 8565405 - DNA, 22 bp, Homo sapiens
cgtatacatgaagacattgctg

SEQ ID NO: 8565406 - DNA, 22 bp, Homo sapiens
cgtatttagaaggctgctgaaa

SEQ ID NO: 8565407 - DNA, 22 bp, Homo sapiens
cgtatttagaaggctgctgaaa

SEQ ID NO: 8565408 - DNA, 22 bp, Homo sapiens
cgtatttcatctcctttctgct

SEQ ID NO: 8565409 - DNA, 22 bp, Homo sapiens
cgtcactggcgtgaagtgagga

SEQ ID NO: 8565410 - DNA, 22 bp, Homo sapiens
cgtcacttcttagtctattttc

SEQ ID NO: 8565411 - DNA, 22 bp, Homo sapiens
cgtcacttcttagtctattttc

SEQ ID NO: 8565412 - DNA, 22 bp, Homo sapiens
ttcatccatatgcagagagctt

SEQ ID NO: 8565413 - DNA, 22 bp, Homo sapiens
ttcatccatatgcagagagctt

SEQ ID NO: 8565414 - DNA, 22 bp, Homo sapiens
ttcatctgcttcttcctattcc

SEQ ID NO: 8565415 - DNA, 22 bp, Homo sapiens
cgggggagttgaggcacatggg

SEQ ID NO: 8565416 - DNA, 22 bp, Homo sapiens
cggtctgagatttttaataggc

SEQ ID NO: 8565417 - DNA, 22 bp, Homo sapiens
cggtctgatctggaaatagggc

SEQ ID NO: 8565418 - DNA, 22 bp, Homo sapiens
cggtctgagagcaggagaaggg

SEQ ID NO: 8565419 - DNA, 19 bp, Homo sapiens
cgtacctgacacagaacag

SEQ ID NO: 8565420 - DNA, 22 bp, Homo sapiens
cggttagttatttttcagatat

SEQ ID NO: 8565421 - DNA, 22 bp, Homo sapiens
ttcatgaacgaacatatgtata

SEQ ID NO: 8565422 - DNA, 22 bp, Homo sapiens
ttcatgaacgaacatatgtata

SEQ ID NO: 8565423 - DNA, 22 bp, Homo sapiens
ttcatgaaattctcgtgtacct

SEQ ID NO: 8565424 - DNA, 22 bp, Homo sapiens
ttcatgaatatattgaattagc

SEQ ID NO: 8565425 - DNA, 22 bp, Homo sapiens
ttcatgaatatattgaattagc

SEQ ID NO: 8565426 - DNA, 22 bp, Homo sapiens
ttcatgaataccccttctgtaa

SEQ ID NO: 8565427 - DNA, 22 bp, Homo sapiens
ttcatgaagggtgaatatagtc

SEQ ID NO: 8565428 - DNA, 22 bp, Homo sapiens
ctaaagaagctagcaatctata

SEQ ID NO: 8565429 - DNA, 22 bp, Homo sapiens
ttcatgaatgttccatgtgagt

SEQ ID NO: 8565430 - DNA, 22 bp, Homo sapiens
ttcatgaatgttccatgtgagt

SEQ ID NO: 8565431 - DNA, 22 bp, Homo sapiens
ttcatgaatgttccatgtgagt

SEQ ID NO: 8565432 - DNA, 22 bp, Homo sapiens
ctaaagaattttgcttgaccag

SEQ ID NO: 8565433 - DNA, 22 bp, Homo sapiens
ctaaagataaggaaagtatcct

SEQ ID NO: 8565434 - DNA, 22 bp, Homo sapiens
ctaaagtccttatcaagtgtaa

SEQ ID NO: 8565435 - DNA, 22 bp, Homo sapiens
ctaaataatccctctggtctta

SEQ ID NO: 8565436 - DNA, 22 bp, Homo sapiens
ctaaataatccctctggtctta

SEQ ID NO: 8565437 - DNA, 22 bp, Homo sapiens
ctaaagtgccaggaatacaggt

SEQ ID NO: 8565438 - DNA, 17 bp, Homo sapiens
ctaaatacttgcgtttc

SEQ ID NO: 8565439 - DNA, 17 bp, Homo sapiens
ctaaatacttgcgtttc

SEQ ID NO: 8565440 - DNA, 22 bp, Homo sapiens
cggggctgtagcacagctgagc

SEQ ID NO: 8565441 - DNA, 22 bp, Homo sapiens
cggtcaggtgcagcgttggcac

SEQ ID NO: 8565442 - DNA, 22 bp, Homo sapiens
cggtcaggtgcagcgttggcac

SEQ ID NO: 8565443 - DNA, 22 bp, Homo sapiens
ttcagggcagacagaagagatg

SEQ ID NO: 8565444 - DNA, 22 bp, Homo sapiens
ttcagggcagctagaaccagga

SEQ ID NO: 8565445 - DNA, 22 bp, Homo sapiens
ttcagggcatgagggacacatc

SEQ ID NO: 8565446 - DNA, 22 bp, Homo sapiens
ttcaggcatggaaactggatta

SEQ ID NO: 8565447 - DNA, 22 bp, Homo sapiens
ttcagggacttagtgtcagttt

SEQ ID NO: 8565448 - DNA, 22 bp, Homo sapiens
ttcagggagagcgggacgggtg

SEQ ID NO: 8565449 - DNA, 22 bp, Homo sapiens
ttcagatgtggctttgtcaggc

SEQ ID NO: 8565450 - DNA, 22 bp, Homo sapiens
ttcagcaaacacgatgcttgtt

SEQ ID NO: 8565451 - DNA, 22 bp, Homo sapiens
ttcagcaaacacgatgcttgtt

SEQ ID NO: 8565452 - DNA, 22 bp, Homo sapiens
ttcaggagtgtcaggagtgcct

SEQ ID NO: 8565453 - DNA, 22 bp, Homo sapiens
ttcagcaaacacgatgcttgtt

SEQ ID NO: 8565454 - DNA, 22 bp, Homo sapiens
ttcagataagtcaagttagtat

SEQ ID NO: 8565455 - DNA, 22 bp, Homo sapiens
ttcagataaactacaaataatt

SEQ ID NO: 8565456 - DNA, 20 bp, Homo sapiens
ttcagagtttactcaaactg

SEQ ID NO: 8565457 - DNA, 22 bp, Homo sapiens
ttcagagttagacgaaaagcaa

SEQ ID NO: 8565458 - DNA, 22 bp, Homo sapiens
ttcagagttagacgaaaagcaa

SEQ ID NO: 8565459 - DNA, 22 bp, Homo sapiens
ttcagagtaggatactagctta

SEQ ID NO: 8565460 - DNA, 20 bp, Homo sapiens
ttcagagtcagcaaatgcag

SEQ ID NO: 8565461 - DNA, 22 bp, Homo sapiens
ttcagagtggtatgaagtgatg

SEQ ID NO: 8565462 - DNA, 22 bp, Homo sapiens
ttcagagtcagggatctcagag

SEQ ID NO: 8565463 - DNA, 18 bp, Homo sapiens
ttcagagtctggtgagga

SEQ ID NO: 8565464 - DNA, 22 bp, Homo sapiens
ttcagagggttttagggtcaga

SEQ ID NO: 8565465 - DNA, 22 bp, Homo sapiens
ttcagagtacacagagatcttc

SEQ ID NO: 8565466 - DNA, 22 bp, Homo sapiens
ttcagaggtgggctgagaggat

SEQ ID NO: 8565467 - DNA, 22 bp, Homo sapiens
ttcacactttggaattccacct

SEQ ID NO: 8565468 - DNA, 22 bp, Homo sapiens
ttcacagaagaggtcacatttc

SEQ ID NO: 8565469 - DNA, 22 bp, Homo sapiens
ttcacactctcactccctgacc

SEQ ID NO: 8565470 - DNA, 22 bp, Homo sapiens
ttcagaaagtgaatcttgttat

SEQ ID NO: 8565471 - DNA, 22 bp, Homo sapiens
ttcacagacattgcagactgaa

SEQ ID NO: 8565472 - DNA, 22 bp, Homo sapiens
ttcacagaattgtcttgactgg

SEQ ID NO: 8565473 - DNA, 22 bp, Homo sapiens
ttcacagaattgtcttgactgg

SEQ ID NO: 8565474 - DNA, 22 bp, Homo sapiens
ttcagagggacattcaagggaa

SEQ ID NO: 8565475 - DNA, 22 bp, Homo sapiens
ttcagaaagtgaatcttgttat

SEQ ID NO: 8565476 - DNA, 22 bp, Homo sapiens
ttcagaaagtgaatcttgttat

SEQ ID NO: 8565477 - DNA, 22 bp, Homo sapiens
ttcaagttacctttaaacagct

SEQ ID NO: 8565478 - DNA, 22 bp, Homo sapiens
ttcaagttttgacttagtcctt

SEQ ID NO: 8565479 - DNA, 22 bp, Homo sapiens
ttcacacagcaactgtatgaat

SEQ ID NO: 8565480 - DNA, 22 bp, Homo sapiens
ttcacacagcaactgtatgaat

SEQ ID NO: 8565481 - DNA, 22 bp, Homo sapiens
ttcacacagaatctgaggagct

SEQ ID NO: 8565482 - DNA, 22 bp, Homo sapiens
ttcacacagaatctgaggagct

SEQ ID NO: 8565483 - DNA, 22 bp, Homo sapiens
ttcacaatttcccttcatcagg

SEQ ID NO: 8565484 - DNA, 22 bp, Homo sapiens
ttcacaatttcccttcatcagg

SEQ ID NO: 8565485 - DNA, 22 bp, Homo sapiens
ttcacaatttcccttcatcagg

SEQ ID NO: 8565486 - DNA, 22 bp, Homo sapiens
ttcacaatttcccttcatcagg

SEQ ID NO: 8565487 - DNA, 22 bp, Homo sapiens
ttcacacacagcttcctattgt

SEQ ID NO: 8565488 - DNA, 19 bp, Homo sapiens
ttcacaattatgaaattag

SEQ ID NO: 8565489 - DNA, 22 bp, Homo sapiens
ttcaataggatgcatgatataa

SEQ ID NO: 8565490 - DNA, 22 bp, Homo sapiens
ttcaatacaaagaaaggaattt

SEQ ID NO: 8565491 - DNA, 21 bp, Homo sapiens
ttcaatactatttcaatagtc

SEQ ID NO: 8565492 - DNA, 22 bp, Homo sapiens
cgccccggacgtctgaccaaac

SEQ ID NO: 8565493 - DNA, 22 bp, Homo sapiens
cgcccctcagcgacccaccagc

SEQ ID NO: 8565494 - DNA, 22 bp, Homo sapiens
ttcaagttaactctccttgtac

SEQ ID NO: 8565495 - DNA, 22 bp, Homo sapiens
cgccggcttgaggcaggcggca

SEQ ID NO: 8565496 - DNA, 22 bp, Homo sapiens
cgccggcttgaggcaggcggca

SEQ ID NO: 8565497 - DNA, 20 bp, Homo sapiens
cgcccaggagggcccatgtg

SEQ ID NO: 8565498 - DNA, 22 bp, Homo sapiens
cgcccagctgaaatctccaggc

SEQ ID NO: 8565499 - DNA, 22 bp, Homo sapiens
cgcccaggctggagagcagtgg

SEQ ID NO: 8565500 - DNA, 22 bp, Homo sapiens
cgcccaggctggagagcagtgg

SEQ ID NO: 8565501 - DNA, 22 bp, Homo sapiens
cgcccaggctggagtgcagtga

SEQ ID NO: 8565502 - DNA, 22 bp, Homo sapiens
cgcccaggctggagtgcagtga

SEQ ID NO: 8565503 - DNA, 22 bp, Homo sapiens
cgcccaggctggagtgcagtga

SEQ ID NO: 8565504 - DNA, 22 bp, Homo sapiens
cgcccagggcaggaggccgctc

SEQ ID NO: 8565505 - DNA, 22 bp, Homo sapiens
cgcccaggctggagtgcagtgg

SEQ ID NO: 8565506 - DNA, 22 bp, Homo sapiens
cgcccaggctggagtgcagtgg

SEQ ID NO: 8565507 - DNA, 22 bp, Homo sapiens
cgcccaggctggagtgcagtgg

SEQ ID NO: 8565508 - DNA, 22 bp, Homo sapiens
cgccccagatgcaagacaaaga

SEQ ID NO: 8565509 - DNA, 22 bp, Homo sapiens
cgcccagggcaggaggccgctc

SEQ ID NO: 8565510 - DNA, 22 bp, Homo sapiens
cctttcagatgggcatggaccg

SEQ ID NO: 8565511 - DNA, 22 bp, Homo sapiens
cctttcaaaacagaacactagc

SEQ ID NO: 8565512 - DNA, 22 bp, Homo sapiens
cctttcccgctttgagggcaag

SEQ ID NO: 8565513 - DNA, 22 bp, Homo sapiens
cctttcctgcctcaggaagtag

SEQ ID NO: 8565514 - DNA, 22 bp, Homo sapiens
cctttcctttttagtgtgggag

SEQ ID NO: 8565515 - DNA, 22 bp, Homo sapiens
cctttctcattttaagcattag

SEQ ID NO: 8565516 - DNA, 22 bp, Homo sapiens
cctttctacagatgcctcttgc

SEQ ID NO: 8565517 - DNA, 16 bp, Homo sapiens
cctttctctgccttcc

SEQ ID NO: 8565518 - DNA, 16 bp, Homo sapiens
cctttctctgccttcc

SEQ ID NO: 8565519 - DNA, 22 bp, Homo sapiens
cctttctctatcgacccatcgc

SEQ ID NO: 8565520 - DNA, 22 bp, Homo sapiens
ttaggaatcaaattccgaaagg

SEQ ID NO: 8565521 - DNA, 22 bp, Homo sapiens
ttaggaatttatcacagactgg

SEQ ID NO: 8565522 - DNA, 22 bp, Homo sapiens
cctttctctttgctgatcatgt

SEQ ID NO: 8565523 - DNA, 22 bp, Homo sapiens
cctttctctttgctgatcatgt

SEQ ID NO: 8565524 - DNA, 17 bp, Homo sapiens
cctttctctttcatctc

SEQ ID NO: 8565525 - DNA, 22 bp, Homo sapiens
cctttctcttggataccgattg

SEQ ID NO: 8565526 - DNA, 22 bp, Homo sapiens
cctttctctggcagcaggacag

SEQ ID NO: 8565527 - DNA, 22 bp, Homo sapiens
ttaggctgttcttgtgttgtta

SEQ ID NO: 8565528 - DNA, 22 bp, Homo sapiens
ttaggctgttcttgtgttgtta

SEQ ID NO: 8565529 - DNA, 22 bp, Homo sapiens
ttaggctgttcttgtgttgtta

SEQ ID NO: 8565530 - DNA, 22 bp, Homo sapiens
ttaggatttgaaaaggggcaga

SEQ ID NO: 8565531 - DNA, 22 bp, Homo sapiens
ttaggatttgaaaaggggcaga

SEQ ID NO: 8565532 - DNA, 22 bp, Homo sapiens
ttaggatttgaaaaggggcaga

SEQ ID NO: 8565533 - DNA, 22 bp, Homo sapiens
ttaggagtccagatgtcttggg

SEQ ID NO: 8565534 - DNA, 22 bp, Homo sapiens
ttaggagtccagatgtcttggg

SEQ ID NO: 8565535 - DNA, 23 bp, Homo sapiens
cgcccagcctcagtgacctgggc

SEQ ID NO: 8565536 - DNA, 22 bp, Homo sapiens
cgccaggcttggtagctcatgc

SEQ ID NO: 8565537 - DNA, 22 bp, Homo sapiens
cgcatccagggcgcaggatctg

SEQ ID NO: 8565538 - DNA, 22 bp, Homo sapiens
cgccaggcttggtagctcatgc

SEQ ID NO: 8565539 - DNA, 22 bp, Homo sapiens
cgcatgtgcgttgattgcagtg

SEQ ID NO: 8565540 - DNA, 22 bp, Homo sapiens
cgcagctgtccatgtgtggggg

SEQ ID NO: 8565541 - DNA, 19 bp, Homo sapiens
cgcaggtggaaggagccgc

SEQ ID NO: 8565542 - DNA, 22 bp, Homo sapiens
cgcatacatagaaacacacaga

SEQ ID NO: 8565543 - DNA, 20 bp, Homo sapiens
cctgtctggagacaaagaga

SEQ ID NO: 8565544 - DNA, 20 bp, Homo sapiens
cctgtctggagacaaagaga

SEQ ID NO: 8565545 - DNA, 22 bp, Homo sapiens
cctgtctggaacatggcctgtt

SEQ ID NO: 8565546 - DNA, 22 bp, Homo sapiens
cctgtctggccaccagggcgat

SEQ ID NO: 8565547 - DNA, 22 bp, Homo sapiens
cctgtctggaacatggcctgtt

SEQ ID NO: 8565548 - DNA, 22 bp, Homo sapiens
cctgtctggaacatggcctgtt

SEQ ID NO: 8565549 - DNA, 20 bp, Homo sapiens
cctgtctggagacaaagaga

SEQ ID NO: 8565550 - DNA, 22 bp, Homo sapiens
cctgtctggccttccacggggg

SEQ ID NO: 8565551 - DNA, 22 bp, Homo sapiens
cctgtctggggactccctgggt

SEQ ID NO: 8565552 - DNA, 22 bp, Homo sapiens
cctgtctgtcctctcatgagcc

SEQ ID NO: 8565553 - DNA, 22 bp, Homo sapiens
cctgtctgtcctttgcattctt

SEQ ID NO: 8565554 - DNA, 22 bp, Homo sapiens
cctgtctgtcctctcatgagcc

SEQ ID NO: 8565555 - DNA, 22 bp, Homo sapiens
cctgtctgtcctctcatgagcc

SEQ ID NO: 8565556 - DNA, 22 bp, Homo sapiens
cctgtctgtattggtttgctat

SEQ ID NO: 8565557 - DNA, 22 bp, Homo sapiens
cctgtctgtcctctcatgagcc

SEQ ID NO: 8565558 - DNA, 22 bp, Homo sapiens
cctgtctgtatcggttcagagt

SEQ ID NO: 8565559 - DNA, 22 bp, Homo sapiens
cctgtctggggactccctgggt

SEQ ID NO: 8565560 - DNA, 18 bp, Homo sapiens
cctgtctggggtccccac

SEQ ID NO: 8565561 - DNA, 21 bp, Homo sapiens
cctgtcttggactgaggcacc

SEQ ID NO: 8565562 - DNA, 17 bp, Homo sapiens
cctgtcttgtttctgcc

SEQ ID NO: 8565563 - DNA, 22 bp, Homo sapiens
cctgtcttagggaaagactgga

SEQ ID NO: 8565564 - DNA, 22 bp, Homo sapiens
cctgtgccatcctgagcatccc

SEQ ID NO: 8565565 - DNA, 22 bp, Homo sapiens
cctgtctgttctgactggtcag

SEQ ID NO: 8565566 - DNA, 23 bp, Homo sapiens
cctgtctgtgctgggtggacaca

SEQ ID NO: 8565567 - DNA, 22 bp, Homo sapiens
cctgtctgttctgactggtcag

SEQ ID NO: 8565568 - DNA, 22 bp, Homo sapiens
cctgtctgtcctttgcattctt

SEQ ID NO: 8565569 - DNA, 19 bp, Homo sapiens
cctgtctgtcttcagctag

SEQ ID NO: 8565570 - DNA, 19 bp, Homo sapiens
cctgtctgtcttcagctag

SEQ ID NO: 8565571 - DNA, 23 bp, Homo sapiens
cctgtctgtgctgggtggacaca

SEQ ID NO: 8565572 - DNA, 22 bp, Homo sapiens
cctgtcagatgaagtaattgtg

SEQ ID NO: 8565573 - DNA, 22 bp, Homo sapiens
cctgtctctttcaatctgagag

SEQ ID NO: 8565574 - DNA, 22 bp, Homo sapiens
cctgtctctttcaatctgagag

SEQ ID NO: 8565575 - DNA, 22 bp, Homo sapiens
tgtttacttttaattacctgtc

SEQ ID NO: 8565576 - DNA, 22 bp, Homo sapiens
tgtttactttccttctcacagg

SEQ ID NO: 8565577 - DNA, 22 bp, Homo sapiens
tgtttactttccttctcacagg

SEQ ID NO: 8565578 - DNA, 22 bp, Homo sapiens
cctgtctgaaggcagggggatg

SEQ ID NO: 8565579 - DNA, 22 bp, Homo sapiens
cctgtctgaatcatgatttcct

SEQ ID NO: 8565580 - DNA, 22 bp, Homo sapiens
cctgtctgagccagggtgggca

SEQ ID NO: 8565581 - DNA, 22 bp, Homo sapiens
cctgtctgagccagggtgggca

SEQ ID NO: 8565582 - DNA, 22 bp, Homo sapiens
cctgtctgaatcatgatttcct

SEQ ID NO: 8565583 - DNA, 22 bp, Homo sapiens
cctgtctgaaggcagggggatg

SEQ ID NO: 8565584 - DNA, 22 bp, Homo sapiens
cctgtctgaggaggtgctcttt

SEQ ID NO: 8565585 - DNA, 20 bp, Homo sapiens
cctgtctgcaatggaggtca

SEQ ID NO: 8565586 - DNA, 22 bp, Homo sapiens
cctgtctgcagatatctcaggt

SEQ ID NO: 8565587 - DNA, 22 bp, Homo sapiens
cctgtctgcatgatccctgcca

SEQ ID NO: 8565588 - DNA, 22 bp, Homo sapiens
cctgtctgcatgatccctgcca

SEQ ID NO: 8565589 - DNA, 22 bp, Homo sapiens
cctgtctgcatgatccctgcca

SEQ ID NO: 8565590 - DNA, 22 bp, Homo sapiens
cctgtctgcatgagtgagcata

SEQ ID NO: 8565591 - DNA, 22 bp, Homo sapiens
cctgtctgcggaggagtggaag

SEQ ID NO: 8565592 - DNA, 22 bp, Homo sapiens
cctgtctgcatgatccctgcca

SEQ ID NO: 8565593 - DNA, 22 bp, Homo sapiens
cctgtctgcggaggagtggaag

SEQ ID NO: 8565594 - DNA, 22 bp, Homo sapiens
cctgtctgcagatatctcaggt

SEQ ID NO: 8565595 - DNA, 20 bp, Homo sapiens
cctgtctgcaatggaggtca

SEQ ID NO: 8565596 - DNA, 22 bp, Homo sapiens
cctgtctgcatgagtgagcata

SEQ ID NO: 8565597 - DNA, 22 bp, Homo sapiens
cctgtgtcagcccctgcctcca

SEQ ID NO: 8565598 - DNA, 21 bp, Homo sapiens
cctgtggtctggagggagcac

SEQ ID NO: 8565599 - DNA, 21 bp, Homo sapiens
cctgtggtctggagggagcac

SEQ ID NO: 8565600 - DNA, 22 bp, Homo sapiens
cctgtggtttacatgacagtta

SEQ ID NO: 8565601 - DNA, 22 bp, Homo sapiens
cctgtggtttactctgtggcta

SEQ ID NO: 8565602 - DNA, 22 bp, Homo sapiens
ttaaagttcattaaatgagcca

SEQ ID NO: 8565603 - DNA, 19 bp, Homo sapiens
ttaaagtgcgagaagtctt

SEQ ID NO: 8565604 - DNA, 19 bp, Homo sapiens
ttaaagtgcgagaagtctt

SEQ ID NO: 8565605 - DNA, 22 bp, Homo sapiens
ttaaatagctcttgtagaagaa

SEQ ID NO: 8565606 - DNA, 22 bp, Homo sapiens
ttaaaggctgatcttaatatta

SEQ ID NO: 8565607 - DNA, 22 bp, Homo sapiens
ttaaagtaatctgtgtgaattt

SEQ ID NO: 8565608 - DNA, 22 bp, Homo sapiens
ttaaagtaatctgtgtgaattt

SEQ ID NO: 8565609 - DNA, 22 bp, Homo sapiens
ttaaagtatagaggacaaaaac

SEQ ID NO: 8565610 - DNA, 22 bp, Homo sapiens
ttaaagtatagaggacaaaaac

SEQ ID NO: 8565611 - DNA, 22 bp, Homo sapiens
ttaaagtccctgccttaattcc

SEQ ID NO: 8565612 - DNA, 22 bp, Homo sapiens
ttaaagtctatgtactacactt

SEQ ID NO: 8565613 - DNA, 19 bp, Homo sapiens
ttaaagtgcgagaagtctt

SEQ ID NO: 8565614 - DNA, 19 bp, Homo sapiens
cctgtgctaggagctgacc

SEQ ID NO: 8565615 - DNA, 22 bp, Homo sapiens
cctgtgcctgcctgtgagttct

SEQ ID NO: 8565616 - DNA, 18 bp, Homo sapiens
cctgtgctccagcatctg

SEQ ID NO: 8565617 - DNA, 22 bp, Homo sapiens
cctgtgctcccatagcttctgt

SEQ ID NO: 8565618 - DNA, 22 bp, Homo sapiens
cctgtgctcccatagcttctgt

SEQ ID NO: 8565619 - DNA, 22 bp, Homo sapiens
cctgtgctccctatgtatctgg

SEQ ID NO: 8565620 - DNA, 22 bp, Homo sapiens
cctgtgccctgccaggctggtg

SEQ ID NO: 8565621 - DNA, 22 bp, Homo sapiens
cctgtgccctcagcctggctct

SEQ ID NO: 8565622 - DNA, 22 bp, Homo sapiens
cctgtgccatcctgagcatccc

SEQ ID NO: 8565623 - DNA, 21 bp, Homo sapiens
ttaaagctatggtagtgggct

SEQ ID NO: 8565624 - DNA, 22 bp, Homo sapiens
cctgtgcttcagctggaggagg

SEQ ID NO: 8565625 - DNA, 20 bp, Homo sapiens
cctgtgcttatcacttgctg

SEQ ID NO: 8565626 - DNA, 22 bp, Homo sapiens
cctgtgctggacagggctgggc

SEQ ID NO: 8565627 - DNA, 22 bp, Homo sapiens
cctgtgctccctatgtatctgg

SEQ ID NO: 8565628 - DNA, 22 bp, Homo sapiens
cctgtgctggctttattctcag

SEQ ID NO: 8565629 - DNA, 22 bp, Homo sapiens
ttaaagctggcgttacagtttg

SEQ ID NO: 8565630 - DNA, 22 bp, Homo sapiens
ttaaagctgctgaatcctattt

SEQ ID NO: 8565631 - DNA, 22 bp, Homo sapiens
ttaaagctgagccctcagaagc

SEQ ID NO: 8565632 - DNA, 23 bp, Homo sapiens
ttaaaggcagatgttgagtatta

SEQ ID NO: 8565633 - DNA, 22 bp, Homo sapiens
cctgtgtgctgatgacgacaga

SEQ ID NO: 8565634 - DNA, 22 bp, Homo sapiens
cctgtgtggaaaccgcatgacg

SEQ ID NO: 8565635 - DNA, 22 bp, Homo sapiens
cctgtgtggaaaccgcatgacg

SEQ ID NO: 8565636 - DNA, 23 bp, Homo sapiens
cctgtgtgcccttaattcacagc

SEQ ID NO: 8565637 - DNA, 23 bp, Homo sapiens
cctgtgtgcccttaattcacagc

SEQ ID NO: 8565638 - DNA, 22 bp, Homo sapiens
cctgtgtgctgatgacgacaga

SEQ ID NO: 8565639 - DNA, 22 bp, Homo sapiens
cctgtgtgctgatgacgacaga

SEQ ID NO: 8565640 - DNA, 22 bp, Homo sapiens
cctgtgtgcctggccgcgggag

SEQ ID NO: 8565641 - DNA, 22 bp, Homo sapiens
cctgtgtgattggaagctgaga

SEQ ID NO: 8565642 - DNA, 22 bp, Homo sapiens
cctgtgtgaaggttaggcaggt

SEQ ID NO: 8565643 - DNA, 22 bp, Homo sapiens
cctgtgtgaaggttaggcaggt

SEQ ID NO: 8565644 - DNA, 22 bp, Homo sapiens
cctgtgtgcacacgaggccatg

SEQ ID NO: 8565645 - DNA, 22 bp, Homo sapiens
cctgtgtgcacacgaggccatg

SEQ ID NO: 8565646 - DNA, 22 bp, Homo sapiens
cctgtgtgattggaagctgaga

SEQ ID NO: 8565647 - DNA, 22 bp, Homo sapiens
cctgtgtgcacacgaggccatg

SEQ ID NO: 8565648 - DNA, 22 bp, Homo sapiens
cctgtgtgcacacgaggccatg

SEQ ID NO: 8565649 - DNA, 22 bp, Homo sapiens
cctgtgtcttccccactggtgt

SEQ ID NO: 8565650 - DNA, 22 bp, Homo sapiens
cctgtgtctgaccatgcacatg

SEQ ID NO: 8565651 - DNA, 21 bp, Homo sapiens
cctgtgtgtctgactgggcta

SEQ ID NO: 8565652 - DNA, 21 bp, Homo sapiens
cctgtgtgtctgactgggcta

SEQ ID NO: 8565653 - DNA, 22 bp, Homo sapiens
cctgtgtgtaggccaggggagt

SEQ ID NO: 8565654 - DNA, 22 bp, Homo sapiens
cctgtgtgtaggccaggggagt

SEQ ID NO: 8565655 - DNA, 22 bp, Homo sapiens
cctgtgtgtaggccaggggagt

SEQ ID NO: 8565656 - DNA, 22 bp, Homo sapiens
cctgtgtgtaggccaggggagt

SEQ ID NO: 8565657 - DNA, 22 bp, Homo sapiens
cctgtgtgtaggccaggggagt

SEQ ID NO: 8565658 - DNA, 20 bp, Homo sapiens
cctgtgtggtttgcactaca

SEQ ID NO: 8565659 - DNA, 20 bp, Homo sapiens
cctgtgtggtttgcactaca

SEQ ID NO: 8565660 - DNA, 22 bp, Homo sapiens
cctgtgtggtagccagcggtgc

SEQ ID NO: 8565661 - DNA, 20 bp, Homo sapiens
cctgtgtggtttgcactaca

SEQ ID NO: 8565662 - DNA, 22 bp, Homo sapiens
cctgtgtggtagccagcggtgc

SEQ ID NO: 8565663 - DNA, 19 bp, Homo sapiens
cctgtgtggggtagagatc

SEQ ID NO: 8565664 - DNA, 22 bp, Homo sapiens
cctgtgtggtagccagcggtgc

SEQ ID NO: 8565665 - DNA, 19 bp, Homo sapiens
cctgtgtggggtagagatc

SEQ ID NO: 8565666 - DNA, 19 bp, Homo sapiens
cctgtgtggggtagagatc

SEQ ID NO: 8565667 - DNA, 19 bp, Homo sapiens
cctgtgtggggtagagatc

SEQ ID NO: 8565668 - DNA, 22 bp, Homo sapiens
cctgtgtggccgcactgctccc

SEQ ID NO: 8565669 - DNA, 22 bp, Homo sapiens
cctgtgtggccaggctggagtc

SEQ ID NO: 8565670 - DNA, 22 bp, Homo sapiens
cctgtgtggccaggctggagtc

SEQ ID NO: 8565671 - DNA, 22 bp, Homo sapiens
cctgtgtggccaggctggagtc

SEQ ID NO: 8565672 - DNA, 20 bp, Homo sapiens
cctgtgtggccagctgaggc

SEQ ID NO: 8565673 - DNA, 22 bp, Homo sapiens
cctgtgtggccaggctggagtc

SEQ ID NO: 8565674 - DNA, 20 bp, Homo sapiens
cctgtgtggccagctgaggc

SEQ ID NO: 8565675 - DNA, 22 bp, Homo sapiens
cctgtgtggaaggcaggaggcc

SEQ ID NO: 8565676 - DNA, 22 bp, Homo sapiens
cctgtgtggaaaccgcatgacg

SEQ ID NO: 8565677 - DNA, 22 bp, Homo sapiens
cctgtgtggaaggcaggaggcc

SEQ ID NO: 8565678 - DNA, 20 bp, Homo sapiens
cctgtgtggccagctgaggc

SEQ ID NO: 8565679 - DNA, 20 bp, Homo sapiens
cctgtgtggccagctgaggc

SEQ ID NO: 8565680 - DNA, 22 bp, Homo sapiens
ccttcctggagcccatgcagat

SEQ ID NO: 8565681 - DNA, 22 bp, Homo sapiens
ccttcctggctgtccgcctgat

SEQ ID NO: 8565682 - DNA, 22 bp, Homo sapiens
ccttcctggctgtccgcctgat

SEQ ID NO: 8565683 - DNA, 22 bp, Homo sapiens
ccttcctggagcccatgcagat

SEQ ID NO: 8565684 - DNA, 22 bp, Homo sapiens
ccttcctggagcccatgcagat

SEQ ID NO: 8565685 - DNA, 19 bp, Homo sapiens
ccttcctccccagggccat

SEQ ID NO: 8565686 - DNA, 22 bp, Homo sapiens
ccttccctaaagcgtcgcttag

SEQ ID NO: 8565687 - DNA, 17 bp, Homo sapiens
ccttcctcatctccttc

SEQ ID NO: 8565688 - DNA, 17 bp, Homo sapiens
ccttcctcatctccttc

SEQ ID NO: 8565689 - DNA, 19 bp, Homo sapiens
ccttccccttcagcctctg

SEQ ID NO: 8565690 - DNA, 22 bp, Homo sapiens
ccttcccaggctagaccaacat

SEQ ID NO: 8565691 - DNA, 22 bp, Homo sapiens
ccttcccaggctagaccaacat

SEQ ID NO: 8565692 - DNA, 22 bp, Homo sapiens
ccttcccatgcagcctgtctga

SEQ ID NO: 8565693 - DNA, 22 bp, Homo sapiens
ccttcatgatggaaagggttca

SEQ ID NO: 8565694 - DNA, 22 bp, Homo sapiens
ccttcatgtcattggacacctt

SEQ ID NO: 8565695 - DNA, 18 bp, Homo sapiens
ccttcagctctggttttc

SEQ ID NO: 8565696 - DNA, 22 bp, Homo sapiens
ccttcagtcccatgtttctctt

SEQ ID NO: 8565697 - DNA, 22 bp, Homo sapiens
ttagaaaaaggctgtggtctta

SEQ ID NO: 8565698 - DNA, 22 bp, Homo sapiens
ttagaaaaaacgtcttctagtg

SEQ ID NO: 8565699 - DNA, 21 bp, Homo sapiens
ttacttttgcagcaacctaat

SEQ ID NO: 8565700 - DNA, 21 bp, Homo sapiens
ttacttttgcagcaacctaat

SEQ ID NO: 8565701 - DNA, 23 bp, Homo sapiens
ttacttttgcaccaacctaatat

SEQ ID NO: 8565702 - DNA, 23 bp, Homo sapiens
ttacttttgcaccaacctaatat

SEQ ID NO: 8565703 - DNA, 23 bp, Homo sapiens
ttacttttgcaccaacctaatat

SEQ ID NO: 8565704 - DNA, 22 bp, Homo sapiens
ttacttttgcaccaaactaata

SEQ ID NO: 8565705 - DNA, 21 bp, Homo sapiens
ttactaaacaaaacatgcagg

SEQ ID NO: 8565706 - DNA, 21 bp, Homo sapiens
ttacttttgcaccaacctaat

SEQ ID NO: 8565707 - DNA, 21 bp, Homo sapiens
ttacttttgcaccaacctaat

SEQ ID NO: 8565708 - DNA, 22 bp, Homo sapiens
ccttccttgagaagcaattcct

SEQ ID NO: 8565709 - DNA, 22 bp, Homo sapiens
ccttcctttcagggctatgcct

SEQ ID NO: 8565710 - DNA, 21 bp, Homo sapiens
ccttctccacagggtctccgg

SEQ ID NO: 8565711 - DNA, 22 bp, Homo sapiens
ccttctagcaaatcaacataaa

SEQ ID NO: 8565712 - DNA, 22 bp, Homo sapiens
ccttcgagatttaaacactgat

SEQ ID NO: 8565713 - DNA, 22 bp, Homo sapiens
ccttctagcaaatcaacataaa

SEQ ID NO: 8565714 - DNA, 22 bp, Homo sapiens
cctttacagtatggttgtatca

SEQ ID NO: 8565715 - DNA, 22 bp, Homo sapiens
cctttacatctgacttctttca

SEQ ID NO: 8565716 - DNA, 22 bp, Homo sapiens
cctttacatctgacttctttca

SEQ ID NO: 8565717 - DNA, 22 bp, Homo sapiens
ttagaatcagaagagaggtatt

SEQ ID NO: 8565718 - DNA, 22 bp, Homo sapiens
ttagaatctaacattcttatct

SEQ ID NO: 8565719 - DNA, 22 bp, Homo sapiens
ttagaatcaggtgttataatca

SEQ ID NO: 8565720 - DNA, 22 bp, Homo sapiens
ttagaatctttagagtctcact

SEQ ID NO: 8565721 - DNA, 22 bp, Homo sapiens
ttagaaaatggaggtgggaggg

SEQ ID NO: 8565722 - DNA, 22 bp, Homo sapiens
ttagaagtgaaatagctgtaca

SEQ ID NO: 8565723 - DNA, 22 bp, Homo sapiens
ttagaaaaatgttcagtagttt

SEQ ID NO: 8565724 - DNA, 22 bp, Homo sapiens
ttagaaaaatgttcagtagttt

SEQ ID NO: 8565725 - DNA, 22 bp, Homo sapiens
ttagaaaaaggctgtggtctta

SEQ ID NO: 8565726 - DNA, 22 bp, Homo sapiens
ttagaaaacataagtggtaaag

SEQ ID NO: 8565727 - DNA, 22 bp, Homo sapiens
cctgggcaacatagggagaccc

SEQ ID NO: 8565728 - DNA, 22 bp, Homo sapiens
cctgggcaacatagggagaccc

SEQ ID NO: 8565729 - DNA, 22 bp, Homo sapiens
cctgggcaacatagtgagaccc

SEQ ID NO: 8565730 - DNA, 22 bp, Homo sapiens
cctgggcaacatagtgagaccc

SEQ ID NO: 8565731 - DNA, 22 bp, Homo sapiens
cctgggcaacatagtgagacct

SEQ ID NO: 8565732 - DNA, 22 bp, Homo sapiens
cctgggcaacatagtgagacct

SEQ ID NO: 8565733 - DNA, 22 bp, Homo sapiens
cctgggcaacatagtgagacct

SEQ ID NO: 8565734 - DNA, 22 bp, Homo sapiens
cctgggcaacatagtgagaccc

SEQ ID NO: 8565735 - DNA, 22 bp, Homo sapiens
cctgggcaaatgccagagacaa

SEQ ID NO: 8565736 - DNA, 22 bp, Homo sapiens
cctgggcaaatgccagagacaa

SEQ ID NO: 8565737 - DNA, 22 bp, Homo sapiens
cctgggatttgcgccagacctt

SEQ ID NO: 8565738 - DNA, 22 bp, Homo sapiens
cctgggatttgcgccagacctt

SEQ ID NO: 8565739 - DNA, 22 bp, Homo sapiens
cctgggatttcctgagcactct

SEQ ID NO: 8565740 - DNA, 22 bp, Homo sapiens
cctgggcaaatgccagagacaa

SEQ ID NO: 8565741 - DNA, 22 bp, Homo sapiens
cctgggcaaatgccagagacaa

SEQ ID NO: 8565742 - DNA, 22 bp, Homo sapiens
cctgggcaaattatgttactca

SEQ ID NO: 8565743 - DNA, 22 bp, Homo sapiens
cctgggcaaattatgttactca

SEQ ID NO: 8565744 - DNA, 22 bp, Homo sapiens
tgtgtatagatgcatgcatata

SEQ ID NO: 8565745 - DNA, 22 bp, Homo sapiens
tgtgtataggttgtgctaatag

SEQ ID NO: 8565746 - DNA, 22 bp, Homo sapiens
tgtgtataagtgagaatgctgt

SEQ ID NO: 8565747 - DNA, 20 bp, Homo sapiens
tgtgtataaatatatgtttc

SEQ ID NO: 8565748 - DNA, 22 bp, Homo sapiens
tgtgtataaacaagagtctgtg

SEQ ID NO: 8565749 - DNA, 22 bp, Homo sapiens
tgtgtagtgattttcttccaac

SEQ ID NO: 8565750 - DNA, 22 bp, Homo sapiens
tgtgtagctttcttctgtgggg

SEQ ID NO: 8565751 - DNA, 22 bp, Homo sapiens
tgtgtagctttcttctgtgggg

SEQ ID NO: 8565752 - DNA, 22 bp, Homo sapiens
tgtgggtgatgaatttgttctt

SEQ ID NO: 8565753 - DNA, 22 bp, Homo sapiens
tgtgggtcctcctgtgtgcccg

SEQ ID NO: 8565754 - DNA, 22 bp, Homo sapiens
tgtgggtgatgaatttgttctt

SEQ ID NO: 8565755 - DNA, 22 bp, Homo sapiens
tgtgtatgttttgaggttgcta

SEQ ID NO: 8565756 - DNA, 22 bp, Homo sapiens
tgtgtattaatgtttgtatatg

SEQ ID NO: 8565757 - DNA, 22 bp, Homo sapiens
tgtgtctcaagtcagagcatca

SEQ ID NO: 8565758 - DNA, 18 bp, Homo sapiens
tgtgtatgtctcagggaa

SEQ ID NO: 8565759 - DNA, 22 bp, Homo sapiens
tgtgtatgtctgtatgcacaca

SEQ ID NO: 8565760 - DNA, 20 bp, Homo sapiens
tgtgtatgtgcacatgcgaa

SEQ ID NO: 8565761 - DNA, 20 bp, Homo sapiens
tgtgtatgtgcacatgcgaa

SEQ ID NO: 8565762 - DNA, 22 bp, Homo sapiens
tgtgtatgtgtatacactatat

SEQ ID NO: 8565763 - DNA, 22 bp, Homo sapiens
tgtgtatgcatacacacataga

SEQ ID NO: 8565764 - DNA, 22 bp, Homo sapiens
tgtgtatgtaagcatgtgcata

SEQ ID NO: 8565765 - DNA, 23 bp, Homo sapiens
tgtgtatgtatctatgcataggt

SEQ ID NO: 8565766 - DNA, 23 bp, Homo sapiens
tgtgtatgtatctatgcataggt

SEQ ID NO: 8565767 - DNA, 21 bp, Homo sapiens
tgtgtatgtccaatgccctac

SEQ ID NO: 8565768 - DNA, 22 bp, Homo sapiens
tgtgtatatgtaaatatagttg

SEQ ID NO: 8565769 - DNA, 22 bp, Homo sapiens
tgtgtctgaactagttgctctc

SEQ ID NO: 8565770 - DNA, 22 bp, Homo sapiens
tgtgtctgaactagttgctctc

SEQ ID NO: 8565771 - DNA, 22 bp, Homo sapiens
tgtgtctgaacatgctttgtaa

SEQ ID NO: 8565772 - DNA, 23 bp, Homo sapiens
tgtgtctgaggatatatgtgcat

SEQ ID NO: 8565773 - DNA, 22 bp, Homo sapiens
tgtgtctgcactgagtcctcac

SEQ ID NO: 8565774 - DNA, 22 bp, Homo sapiens
tgtgtctgcccttagtacatct

SEQ ID NO: 8565775 - DNA, 23 bp, Homo sapiens
tgtgtctgaggatatatgtgcat

SEQ ID NO: 8565776 - DNA, 22 bp, Homo sapiens
tgtgtctgcactgagtcctcac

SEQ ID NO: 8565777 - DNA, 22 bp, Homo sapiens
tgtgtctctttgtcctagagct

SEQ ID NO: 8565778 - DNA, 22 bp, Homo sapiens
tgtgtctgaacatgctttgtaa

SEQ ID NO: 8565779 - DNA, 22 bp, Homo sapiens
tgtgtctgaacatgctttgtaa

SEQ ID NO: 8565780 - DNA, 22 bp, Homo sapiens
tgtgtctgaactagttgctctc

SEQ ID NO: 8565781 - DNA, 19 bp, Homo sapiens
tgtgtctctgtgtagcctg

SEQ ID NO: 8565782 - DNA, 22 bp, Homo sapiens
tgtgtctctcctggaagcacgt

SEQ ID NO: 8565783 - DNA, 22 bp, Homo sapiens
tgggggacaccagtctctctct

SEQ ID NO: 8565784 - DNA, 21 bp, Homo sapiens
tgggggagaattggttgcttt

SEQ ID NO: 8565785 - DNA, 21 bp, Homo sapiens
tgggggagaattggttgcttt

SEQ ID NO: 8565786 - DNA, 22 bp, Homo sapiens
tgggggactgcactggcgtcag

SEQ ID NO: 8565787 - DNA, 22 bp, Homo sapiens
tgggggactgcactggcgtcag

SEQ ID NO: 8565788 - DNA, 21 bp, Homo sapiens
tgggggagaattggttgcttt

SEQ ID NO: 8565789 - DNA, 21 bp, Homo sapiens
tgggggagaattggttgcttt

SEQ ID NO: 8565790 - DNA, 22 bp, Homo sapiens
cctgggaggctgaggctgcagt

SEQ ID NO: 8565791 - DNA, 22 bp, Homo sapiens
cctgggaggtggatgttgcggt

SEQ ID NO: 8565792 - DNA, 22 bp, Homo sapiens
cctgggagtgtcagacttgctt

SEQ ID NO: 8565793 - DNA, 22 bp, Homo sapiens
cctgggagtgtcagacttgctt

SEQ ID NO: 8565794 - DNA, 22 bp, Homo sapiens
cctgggagtgtgccatctctgt

SEQ ID NO: 8565795 - DNA, 22 bp, Homo sapiens
cctgggagtgtgccatctctgt

SEQ ID NO: 8565796 - DNA, 22 bp, Homo sapiens
cctgggagtgtgccatctctgt

SEQ ID NO: 8565797 - DNA, 22 bp, Homo sapiens
cctgggagtgtgccatctctgt

SEQ ID NO: 8565798 - DNA, 22 bp, Homo sapiens
cctgggagtgtgccatctctgt

SEQ ID NO: 8565799 - DNA, 22 bp, Homo sapiens
cctgggagtgtgccatctctgt

SEQ ID NO: 8565800 - DNA, 22 bp, Homo sapiens
cctgggagtgtgccatctctgt

SEQ ID NO: 8565801 - DNA, 19 bp, Homo sapiens
cctgggagtcagctgaagg

SEQ ID NO: 8565802 - DNA, 19 bp, Homo sapiens
cctgggagtcagctgaagg

SEQ ID NO: 8565803 - DNA, 19 bp, Homo sapiens
cctgggagtcagctgaagg

SEQ ID NO: 8565804 - DNA, 22 bp, Homo sapiens
cctgggagtggcactcacagca

SEQ ID NO: 8565805 - DNA, 22 bp, Homo sapiens
cctgggagtggcactcacagca

SEQ ID NO: 8565806 - DNA, 22 bp, Homo sapiens
cctgggagtggcactcacagca

SEQ ID NO: 8565807 - DNA, 22 bp, Homo sapiens
cctgggagtggcactcacagca

SEQ ID NO: 8565808 - DNA, 22 bp, Homo sapiens
tggggcagggatgggaaactat

SEQ ID NO: 8565809 - DNA, 22 bp, Homo sapiens
tggggcagggatgggaaactat

SEQ ID NO: 8565810 - DNA, 22 bp, Homo sapiens
tggggcagggatgggaaactat

SEQ ID NO: 8565811 - DNA, 22 bp, Homo sapiens
tggggcagtggcttttcaccct

SEQ ID NO: 8565812 - DNA, 22 bp, Homo sapiens
tggggcagtggcttttcaccct

SEQ ID NO: 8565813 - DNA, 22 bp, Homo sapiens
tggggcagttaataaacattct

SEQ ID NO: 8565814 - DNA, 22 bp, Homo sapiens
tggggcagctccatctattcca

SEQ ID NO: 8565815 - DNA, 22 bp, Homo sapiens
tggggcagctccatctattcca

SEQ ID NO: 8565816 - DNA, 22 bp, Homo sapiens
tggggcagctccatctattcca

SEQ ID NO: 8565817 - DNA, 22 bp, Homo sapiens
tggggcagccacatagacaaca

SEQ ID NO: 8565818 - DNA, 22 bp, Homo sapiens
tggggcagccacatagacaaca

SEQ ID NO: 8565819 - DNA, 22 bp, Homo sapiens
tggggctgtccttagtctgaga

SEQ ID NO: 8565820 - DNA, 22 bp, Homo sapiens
tggggccacacatctctttcta

SEQ ID NO: 8565821 - DNA, 22 bp, Homo sapiens
tggggccacactgatctcccag

SEQ ID NO: 8565822 - DNA, 23 bp, Homo sapiens
tggggccaagtgaggaagggtct

SEQ ID NO: 8565823 - DNA, 23 bp, Homo sapiens
tggggccaagtgaggaagggtct

SEQ ID NO: 8565824 - DNA, 22 bp, Homo sapiens
tggggctgtgagactacaggat

SEQ ID NO: 8565825 - DNA, 22 bp, Homo sapiens
tggggctgtgagactacaggat

SEQ ID NO: 8565826 - DNA, 22 bp, Homo sapiens
tggggctgtgagactacaggat

SEQ ID NO: 8565827 - DNA, 22 bp, Homo sapiens
tggggctgtgagactacaggat

SEQ ID NO: 8565828 - DNA, 22 bp, Homo sapiens
tggggctgtggattctcacgaa

SEQ ID NO: 8565829 - DNA, 22 bp, Homo sapiens
tggggctgtggattctcacgaa

SEQ ID NO: 8565830 - DNA, 19 bp, Homo sapiens
tggggctgtgttttgaccc

SEQ ID NO: 8565831 - DNA, 22 bp, Homo sapiens
cctgggctctgaggagggagtc

SEQ ID NO: 8565832 - DNA, 22 bp, Homo sapiens
cctgggctctatcctgacccag

SEQ ID NO: 8565833 - DNA, 22 bp, Homo sapiens
cctgggctcaagtgatcctcct

SEQ ID NO: 8565834 - DNA, 22 bp, Homo sapiens
cctgggctcaagtgatcctcct

SEQ ID NO: 8565835 - DNA, 22 bp, Homo sapiens
tgtgtctggaccggggaggagc

SEQ ID NO: 8565836 - DNA, 22 bp, Homo sapiens
tgtgtctgcccttagtacatct

SEQ ID NO: 8565837 - DNA, 22 bp, Homo sapiens
tgtgtctggataggtaatggat

SEQ ID NO: 8565838 - DNA, 22 bp, Homo sapiens
tgtgtctggataggtaatggat

SEQ ID NO: 8565839 - DNA, 22 bp, Homo sapiens
cctgggctggagtacagcagtg

SEQ ID NO: 8565840 - DNA, 22 bp, Homo sapiens
cctgggctggagtacagcagtg

SEQ ID NO: 8565841 - DNA, 22 bp, Homo sapiens
cctgggctggagtacagcagtg

SEQ ID NO: 8565842 - DNA, 22 bp, Homo sapiens
cctgggctgcatgatggcattt

SEQ ID NO: 8565843 - DNA, 22 bp, Homo sapiens
cctgggctgcatgatggcattt

SEQ ID NO: 8565844 - DNA, 16 bp, Homo sapiens
cctgggctctgttgga

SEQ ID NO: 8565845 - DNA, 22 bp, Homo sapiens
cctgggctctgaggagggagtc

SEQ ID NO: 8565846 - DNA, 22 bp, Homo sapiens
tgttaatcaatcaacagtatta

SEQ ID NO: 8565847 - DNA, 22 bp, Homo sapiens
tgttaatggctgaagacatcct

SEQ ID NO: 8565848 - DNA, 17 bp, Homo sapiens
tgttaattccaatgata

SEQ ID NO: 8565849 - DNA, 22 bp, Homo sapiens
tgttacaagtcttgaggtactt

SEQ ID NO: 8565850 - DNA, 22 bp, Homo sapiens
tgttacaagtcttgaggtactt

SEQ ID NO: 8565851 - DNA, 22 bp, Homo sapiens
tgttacaactatagatcccaag

SEQ ID NO: 8565852 - DNA, 22 bp, Homo sapiens
tgtgttctgaaggagaagagtg

SEQ ID NO: 8565853 - DNA, 22 bp, Homo sapiens
tgttaatatactaaaatccact

SEQ ID NO: 8565854 - DNA, 23 bp, Homo sapiens
tgttaatacatctgccactcatt

SEQ ID NO: 8565855 - DNA, 22 bp, Homo sapiens
cctgggctgggcgtctcatggg

SEQ ID NO: 8565856 - DNA, 22 bp, Homo sapiens
cctgggctgggcgtctcatggg

SEQ ID NO: 8565857 - DNA, 22 bp, Homo sapiens
cctgggcttacgacctctgact

SEQ ID NO: 8565858 - DNA, 22 bp, Homo sapiens
cctgggcttacgacctctgact

SEQ ID NO: 8565859 - DNA, 22 bp, Homo sapiens
cctgggcttccacgagcagagg

SEQ ID NO: 8565860 - DNA, 22 bp, Homo sapiens
cctgggctgttgcatcatcctt

SEQ ID NO: 8565861 - DNA, 22 bp, Homo sapiens
cctgggcttacgacctctgact

SEQ ID NO: 8565862 - DNA, 22 bp, Homo sapiens
cctgggcttacgacctctgact

SEQ ID NO: 8565863 - DNA, 22 bp, Homo sapiens
cctgggctgttgcatcatcctt

SEQ ID NO: 8565864 - DNA, 22 bp, Homo sapiens
tgtttactggctcctgtggttc

SEQ ID NO: 8565865 - DNA, 22 bp, Homo sapiens
tgtttacttaaatgttttcata

SEQ ID NO: 8565866 - DNA, 22 bp, Homo sapiens
tgtttactggaccagggagggg

SEQ ID NO: 8565867 - DNA, 22 bp, Homo sapiens
tgtttacttgaggtggaaacaa

SEQ ID NO: 8565868 - DNA, 22 bp, Homo sapiens
tgtttacttctttccatggctt

SEQ ID NO: 8565869 - DNA, 22 bp, Homo sapiens
tgtttacttatgtgggtcacat

SEQ ID NO: 8565870 - DNA, 22 bp, Homo sapiens
tgtttacttcatcgagtacttc

SEQ ID NO: 8565871 - DNA, 22 bp, Homo sapiens
cctggttcagtctttctatgct

SEQ ID NO: 8565872 - DNA, 22 bp, Homo sapiens
cctggtgttgtgaagtagccgt

SEQ ID NO: 8565873 - DNA, 22 bp, Homo sapiens
cctggtgtggctgtcacagagg

SEQ ID NO: 8565874 - DNA, 22 bp, Homo sapiens
cctggtggcttctgggtggacg

SEQ ID NO: 8565875 - DNA, 22 bp, Homo sapiens
cctggtggagaggggcggagcg

SEQ ID NO: 8565876 - DNA, 22 bp, Homo sapiens
cctggtgcttaccagagctttt

SEQ ID NO: 8565877 - DNA, 22 bp, Homo sapiens
cctgggtgtcatgggcagctgg

SEQ ID NO: 8565878 - DNA, 22 bp, Homo sapiens
tgttcattcgctattgtctatg

SEQ ID NO: 8565879 - DNA, 22 bp, Homo sapiens
tgttcatttggcccttttgtat

SEQ ID NO: 8565880 - DNA, 22 bp, Homo sapiens
tgttcatttggcccttttgtat

SEQ ID NO: 8565881 - DNA, 22 bp, Homo sapiens
tgttccagatttagccaaccga

SEQ ID NO: 8565882 - DNA, 22 bp, Homo sapiens
tgttccagattcggcgtgggac

SEQ ID NO: 8565883 - DNA, 23 bp, Homo sapiens
tgttccagatacgccttttcctc

SEQ ID NO: 8565884 - DNA, 23 bp, Homo sapiens
tgttccagatacgccttttcctc

SEQ ID NO: 8565885 - DNA, 22 bp, Homo sapiens
tgttacagtactacaattctgc

SEQ ID NO: 8565886 - DNA, 22 bp, Homo sapiens
tgttacagtcattgttttctga

SEQ ID NO: 8565887 - DNA, 22 bp, Homo sapiens
tgttacagtcattgttttctga

SEQ ID NO: 8565888 - DNA, 22 bp, Homo sapiens
tgttacagtactacaattctgc

SEQ ID NO: 8565889 - DNA, 22 bp, Homo sapiens
tgttacagtcattgttttctga

SEQ ID NO: 8565890 - DNA, 22 bp, Homo sapiens
tgttacagtactacaattctgc

SEQ ID NO: 8565891 - DNA, 22 bp, Homo sapiens
tgttacagaaatattgcttctt

SEQ ID NO: 8565892 - DNA, 22 bp, Homo sapiens
tgttacagaatgaatttccgga

SEQ ID NO: 8565893 - DNA, 22 bp, Homo sapiens
tgttacacccacaaaaaattcc

SEQ ID NO: 8565894 - DNA, 22 bp, Homo sapiens
tgttacacagcagaatagcaag

SEQ ID NO: 8565895 - DNA, 22 bp, Homo sapiens
tgttacagaaatattgcttctt

SEQ ID NO: 8565896 - DNA, 22 bp, Homo sapiens
tgttacagaatgaatttccgga

SEQ ID NO: 8565897 - DNA, 22 bp, Homo sapiens
tgttacagaaatattgcttctt

SEQ ID NO: 8565898 - DNA, 22 bp, Homo sapiens
tgttacaatattatcaactgag

SEQ ID NO: 8565899 - DNA, 22 bp, Homo sapiens
tgttacacagcagaatagcaag

SEQ ID NO: 8565900 - DNA, 19 bp, Homo sapiens
tgttcagatatgtcagctt

SEQ ID NO: 8565901 - DNA, 22 bp, Homo sapiens
tgttcagccctctattaatcag

SEQ ID NO: 8565902 - DNA, 22 bp, Homo sapiens
tgttacagtgactaatgtttta

SEQ ID NO: 8565903 - DNA, 21 bp, Homo sapiens
tgttacagtccaaatgtttgt

SEQ ID NO: 8565904 - DNA, 22 bp, Homo sapiens
tgttcagagacagaaattctaa

SEQ ID NO: 8565905 - DNA, 22 bp, Homo sapiens
ctggcttttagtgtgaagactt

SEQ ID NO: 8565906 - DNA, 22 bp, Homo sapiens
ctggcttttcctaaactgggaa

SEQ ID NO: 8565907 - DNA, 22 bp, Homo sapiens
ctggctttggtcccctgtgcct

SEQ ID NO: 8565908 - DNA, 22 bp, Homo sapiens
ctggctttggaacaaatcatag

SEQ ID NO: 8565909 - DNA, 22 bp, Homo sapiens
ctggctttgtatagttccctga

SEQ ID NO: 8565910 - DNA, 22 bp, Homo sapiens
ctggctttgttctgattgcttc

SEQ ID NO: 8565911 - DNA, 22 bp, Homo sapiens
ctggcttttttcccattatgca

SEQ ID NO: 8565912 - DNA, 22 bp, Homo sapiens
ctgggaggcaccgcgtcgtgct

SEQ ID NO: 8565913 - DNA, 22 bp, Homo sapiens
ctgggaggcaccgcgtcgtgct

SEQ ID NO: 8565914 - DNA, 22 bp, Homo sapiens
ctgggaggcaccgcgtcgtgct

SEQ ID NO: 8565915 - DNA, 22 bp, Homo sapiens
ctgggaggcaccgcgtcgtgct

SEQ ID NO: 8565916 - DNA, 22 bp, Homo sapiens
ctgggaggcaccgcgtcgtgct

SEQ ID NO: 8565917 - DNA, 22 bp, Homo sapiens
ctgggaggattcattgaggtga

SEQ ID NO: 8565918 - DNA, 22 bp, Homo sapiens
ctgggaggattcattgaggtga

SEQ ID NO: 8565919 - DNA, 22 bp, Homo sapiens
ctgggaggattcattgaggtga

SEQ ID NO: 8565920 - DNA, 22 bp, Homo sapiens
ctgggaggattcattgaggtga

SEQ ID NO: 8565921 - DNA, 22 bp, Homo sapiens
ctgggagctgaggctgacgctg

SEQ ID NO: 8565922 - DNA, 22 bp, Homo sapiens
ctgggagctagctctgagctga

SEQ ID NO: 8565923 - DNA, 22 bp, Homo sapiens
ctgggaagaaattgtgggaggc

SEQ ID NO: 8565924 - DNA, 22 bp, Homo sapiens
ctggctttctatttggtgctat

SEQ ID NO: 8565925 - DNA, 22 bp, Homo sapiens
ctggctttccttgtctgcatcc

SEQ ID NO: 8565926 - DNA, 22 bp, Homo sapiens
ctggctttctgaacatcagtga

SEQ ID NO: 8565927 - DNA, 22 bp, Homo sapiens
ctggctttctctgtggtgttca

SEQ ID NO: 8565928 - DNA, 22 bp, Homo sapiens
ctggctttctctgtggtgttca

SEQ ID NO: 8565929 - DNA, 22 bp, Homo sapiens
ctggctttctgcacagaattgg

SEQ ID NO: 8565930 - DNA, 22 bp, Homo sapiens
ctggctttctgcaaatctccat

SEQ ID NO: 8565931 - DNA, 22 bp, Homo sapiens
ctggctttgaaggtctttccta

SEQ ID NO: 8565932 - DNA, 18 bp, Homo sapiens
ctggctttcttatccatc

SEQ ID NO: 8565933 - DNA, 22 bp, Homo sapiens
ctggctttgaaatgcatttcag

SEQ ID NO: 8565934 - DNA, 22 bp, Homo sapiens
ctggctttgctggactgggagt

SEQ ID NO: 8565935 - DNA, 22 bp, Homo sapiens
ctggctttgaggatcccctctt

SEQ ID NO: 8565936 - DNA, 22 bp, Homo sapiens
ctggctgtgctgcaggctttgg

SEQ ID NO: 8565937 - DNA, 22 bp, Homo sapiens
ctggctgtgctggagttgagga

SEQ ID NO: 8565938 - DNA, 22 bp, Homo sapiens
ctggcttgggtctacctgcctt

SEQ ID NO: 8565939 - DNA, 22 bp, Homo sapiens
ctggctgtgctgcaggctttgg

SEQ ID NO: 8565940 - DNA, 22 bp, Homo sapiens
ctggctgtgctgactgagaggg

SEQ ID NO: 8565941 - DNA, 22 bp, Homo sapiens
ctggctgtgctgactgagaggg

SEQ ID NO: 8565942 - DNA, 22 bp, Homo sapiens
ctggctttaaaatgctcctgga

SEQ ID NO: 8565943 - DNA, 22 bp, Homo sapiens
ctggcttgttttaagaatacaa

SEQ ID NO: 8565944 - DNA, 22 bp, Homo sapiens
ctggcttgttttaagaatacaa

SEQ ID NO: 8565945 - DNA, 22 bp, Homo sapiens
ctggcttgggtctacctgcctt

SEQ ID NO: 8565946 - DNA, 22 bp, Homo sapiens
ctggctttaatgtcatctttct

SEQ ID NO: 8565947 - DNA, 22 bp, Homo sapiens
ctggctttcattcattcaggcc

SEQ ID NO: 8565948 - DNA, 22 bp, Homo sapiens
ctggctttccttgtctgcatcc

SEQ ID NO: 8565949 - DNA, 22 bp, Homo sapiens
ctggctttccttgtctgcatcc

SEQ ID NO: 8565950 - DNA, 22 bp, Homo sapiens
ctggctttacctcactggggct

SEQ ID NO: 8565951 - DNA, 22 bp, Homo sapiens
ctgggaggcagaggttgcagtg

SEQ ID NO: 8565952 - DNA, 22 bp, Homo sapiens
ctgggaggcagaggttgcagtg

SEQ ID NO: 8565953 - DNA, 22 bp, Homo sapiens
ctgggaggcagaggttgcagtg

SEQ ID NO: 8565954 - DNA, 22 bp, Homo sapiens
ctgggaggcagaggttgtagtg

SEQ ID NO: 8565955 - DNA, 22 bp, Homo sapiens
ctgggaggcagaggttgtagtg

SEQ ID NO: 8565956 - DNA, 22 bp, Homo sapiens
ctgggaggcagaggttgtagtg

SEQ ID NO: 8565957 - DNA, 22 bp, Homo sapiens
ctgggaggcagaggttgtagtg

SEQ ID NO: 8565958 - DNA, 22 bp, Homo sapiens
ctgggaggcagaggttgtagtg

SEQ ID NO: 8565959 - DNA, 22 bp, Homo sapiens
ctgggaggcagtctctctagaa

SEQ ID NO: 8565960 - DNA, 22 bp, Homo sapiens
ctgggaggcagaggttgcagtg

SEQ ID NO: 8565961 - DNA, 22 bp, Homo sapiens
ctgggaggcagaggttgcagtg

SEQ ID NO: 8565962 - DNA, 22 bp, Homo sapiens
ctgggaggcactattcaggagg

SEQ ID NO: 8565963 - DNA, 22 bp, Homo sapiens
ctgggaggcactattcaggagg

SEQ ID NO: 8565964 - DNA, 22 bp, Homo sapiens
ctgggaggcactattcaggagg

SEQ ID NO: 8565965 - DNA, 22 bp, Homo sapiens
ctgggaggcactattcaggagg

SEQ ID NO: 8565966 - DNA, 22 bp, Homo sapiens
ctgggaggcactattcaggagg

SEQ ID NO: 8565967 - DNA, 22 bp, Homo sapiens
ctgggaggcggagcttgcagtg

SEQ ID NO: 8565968 - DNA, 22 bp, Homo sapiens
ctgggaggcggagcttgcagtg

SEQ ID NO: 8565969 - DNA, 22 bp, Homo sapiens
ctgggaggcggagcttgcagtg

SEQ ID NO: 8565970 - DNA, 22 bp, Homo sapiens
ctgggaggcggagcttgcagtg

SEQ ID NO: 8565971 - DNA, 22 bp, Homo sapiens
ctgggaggcggagcttgcagtg

SEQ ID NO: 8565972 - DNA, 22 bp, Homo sapiens
ctgggaggcagtctctctagaa

SEQ ID NO: 8565973 - DNA, 22 bp, Homo sapiens
ctgggaggcagtctctctagaa

SEQ ID NO: 8565974 - DNA, 22 bp, Homo sapiens
ctgggaggcagtctctctagaa

SEQ ID NO: 8565975 - DNA, 22 bp, Homo sapiens
ctgggaggcccacgttgggaag

SEQ ID NO: 8565976 - DNA, 22 bp, Homo sapiens
ctgggaggcagtctctctagaa

SEQ ID NO: 8565977 - DNA, 22 bp, Homo sapiens
ctgggaggcccacgttgggaag

SEQ ID NO: 8565978 - DNA, 22 bp, Homo sapiens
ctgggaggcccacgttgggaag

SEQ ID NO: 8565979 - DNA, 22 bp, Homo sapiens
ctgggaggcccacgttgggaag

SEQ ID NO: 8565980 - DNA, 22 bp, Homo sapiens
ctgggaggcccacgttgggaag

SEQ ID NO: 8565981 - DNA, 22 bp, Homo sapiens
ctgggccacaagcctgtgtgat

SEQ ID NO: 8565982 - DNA, 22 bp, Homo sapiens
ctgggccacaagcctgtgtgat

SEQ ID NO: 8565983 - DNA, 22 bp, Homo sapiens
ctgggccacatcagatgaagac

SEQ ID NO: 8565984 - DNA, 22 bp, Homo sapiens
ctgggccacagactcaaggcag

SEQ ID NO: 8565985 - DNA, 22 bp, Homo sapiens
ctgggccacatcagatgaagac

SEQ ID NO: 8565986 - DNA, 22 bp, Homo sapiens
ctgggccactccagatgcccac

SEQ ID NO: 8565987 - DNA, 22 bp, Homo sapiens
ctgggccactccagatgcccac

SEQ ID NO: 8565988 - DNA, 22 bp, Homo sapiens
ctgggccacttcctcaggggaa

SEQ ID NO: 8565989 - DNA, 22 bp, Homo sapiens
ctgggccacttcctcaggggaa

SEQ ID NO: 8565990 - DNA, 19 bp, Homo sapiens
ctgggccagaatcagctca

SEQ ID NO: 8565991 - DNA, 22 bp, Homo sapiens
ctgggcaggagggctctatgga

SEQ ID NO: 8565992 - DNA, 22 bp, Homo sapiens
ctgggcaggagggctctatgga

SEQ ID NO: 8565993 - DNA, 22 bp, Homo sapiens
ctgggcatatacgtgcaagtca

SEQ ID NO: 8565994 - DNA, 22 bp, Homo sapiens
ctgggcagttttacatcattgc

SEQ ID NO: 8565995 - DNA, 22 bp, Homo sapiens
ctgggcagttttacatcattgc

SEQ ID NO: 8565996 - DNA, 22 bp, Homo sapiens
ctgggcagtttattcagttctg

SEQ ID NO: 8565997 - DNA, 22 bp, Homo sapiens
ctgggcagtttattcagttctg

SEQ ID NO: 8565998 - DNA, 22 bp, Homo sapiens
ctgggcagtttattcagttctg

SEQ ID NO: 8565999 - DNA, 23 bp, Homo sapiens
ctgggcatggagcttcagaggct

SEQ ID NO: 8566000 - DNA, 22 bp, Homo sapiens
ctgggcatttttctctgttaca

SEQ ID NO: 8566001 - DNA, 22 bp, Homo sapiens
ctgggccacaaaaaactcctgt

SEQ ID NO: 8566002 - DNA, 22 bp, Homo sapiens
ctgggccaagaagttgtgtatg

SEQ ID NO: 8566003 - DNA, 22 bp, Homo sapiens
ctggggctctctggaatgcttg

SEQ ID NO: 8566004 - DNA, 22 bp, Homo sapiens
ctggggctgcagcgatcttcat

SEQ ID NO: 8566005 - DNA, 23 bp, Homo sapiens
ctggggctcattgcagtagccat

SEQ ID NO: 8566006 - DNA, 22 bp, Homo sapiens
ctggggctcactttggtcaggc

SEQ ID NO: 8566007 - DNA, 22 bp, Homo sapiens
ctggggctcactttggtcaggc

SEQ ID NO: 8566008 - DNA, 22 bp, Homo sapiens
ctggggctcactttggtcaggc

SEQ ID NO: 8566009 - DNA, 22 bp, Homo sapiens
ctggggctcactttggtcaggc

SEQ ID NO: 8566010 - DNA, 22 bp, Homo sapiens
ctggggctcactccagccctgg

SEQ ID NO: 8566011 - DNA, 22 bp, Homo sapiens
ctggggctcactccagccctgg

SEQ ID NO: 8566012 - DNA, 22 bp, Homo sapiens
ctggggccctgggtctgccctc

SEQ ID NO: 8566013 - DNA, 22 bp, Homo sapiens
ctggggcccgagccttgggcca

SEQ ID NO: 8566014 - DNA, 22 bp, Homo sapiens
ctggggcattgggagaggcctg

SEQ ID NO: 8566015 - DNA, 20 bp, Homo sapiens
ctggggaggaggatgtgttc

SEQ ID NO: 8566016 - DNA, 20 bp, Homo sapiens
ctggggaggaggatgtgttc

SEQ ID NO: 8566017 - DNA, 22 bp, Homo sapiens
ctggggccacaacggcgcacgc

SEQ ID NO: 8566018 - DNA, 22 bp, Homo sapiens
ctggggcccatcgagggctgag

SEQ ID NO: 8566019 - DNA, 22 bp, Homo sapiens
ctggggcccatcgagggctgag

SEQ ID NO: 8566020 - DNA, 22 bp, Homo sapiens
ctggggcccatcgagggctgag

SEQ ID NO: 8566021 - DNA, 22 bp, Homo sapiens
ctggggccagtgaggaggcttt

SEQ ID NO: 8566022 - DNA, 22 bp, Homo sapiens
ctggggctgcagcgatcttcat

SEQ ID NO: 8566023 - DNA, 22 bp, Homo sapiens
ctggggctgcagcgatcttcat

SEQ ID NO: 8566024 - DNA, 22 bp, Homo sapiens
ctggggctgcggacgggagccc

SEQ ID NO: 8566025 - DNA, 22 bp, Homo sapiens
ctggggctgcagcgatcttcat

SEQ ID NO: 8566026 - DNA, 22 bp, Homo sapiens
ctggggctgcagcgatcttcat

SEQ ID NO: 8566027 - DNA, 22 bp, Homo sapiens
ctggggctgcggacgggagccc

SEQ ID NO: 8566028 - DNA, 22 bp, Homo sapiens
ctggggctgcggacgggagccc

SEQ ID NO: 8566029 - DNA, 22 bp, Homo sapiens
ctggggctgcggtggaggagcc

SEQ ID NO: 8566030 - DNA, 22 bp, Homo sapiens
ctggggtgtgctcagagcaggg

SEQ ID NO: 8566031 - DNA, 22 bp, Homo sapiens
ctggggtgtgctcagagcaggg

SEQ ID NO: 8566032 - DNA, 22 bp, Homo sapiens
ctggggtgtgctcagagcaggg

SEQ ID NO: 8566033 - DNA, 22 bp, Homo sapiens
ctgggtctctttagggtgccgt

SEQ ID NO: 8566034 - DNA, 22 bp, Homo sapiens
ctgggtctcttaccatgtgact

SEQ ID NO: 8566035 - DNA, 22 bp, Homo sapiens
ctgggtctcttaccatgtgact

SEQ ID NO: 8566036 - DNA, 20 bp, Homo sapiens
ctgggtctccttctgcttaa

SEQ ID NO: 8566037 - DNA, 22 bp, Homo sapiens
ctgggtctcttaccatgtgact

SEQ ID NO: 8566038 - DNA, 22 bp, Homo sapiens
ctgggtctccggcagcctcggg

SEQ ID NO: 8566039 - DNA, 22 bp, Homo sapiens
ctgggtaaaggctgcttttcta

SEQ ID NO: 8566040 - DNA, 22 bp, Homo sapiens
ctgggtctgggcctcctggagt

SEQ ID NO: 8566041 - DNA, 22 bp, Homo sapiens
ctgggtctggctactgcttcct

SEQ ID NO: 8566042 - DNA, 22 bp, Homo sapiens
ctgggtctggaggccaagggtg

SEQ ID NO: 8566043 - DNA, 23 bp, Homo sapiens
ctgggctgcttgagtccctggct

SEQ ID NO: 8566044 - DNA, 22 bp, Homo sapiens
ctgggctgcttgctgaaggggt

SEQ ID NO: 8566045 - DNA, 22 bp, Homo sapiens
ctgggctgctgtccactagggt

SEQ ID NO: 8566046 - DNA, 20 bp, Homo sapiens
ctggggagctgctcccacga

SEQ ID NO: 8566047 - DNA, 20 bp, Homo sapiens
ctggggagctgctcccacga

SEQ ID NO: 8566048 - DNA, 20 bp, Homo sapiens
ctggggaggaggatgtgttc

SEQ ID NO: 8566049 - DNA, 22 bp, Homo sapiens
ctgggctgcttgctgaaggggt

SEQ ID NO: 8566050 - DNA, 22 bp, Homo sapiens
ctgggctgcttgctgaaggggt

SEQ ID NO: 8566051 - DNA, 22 bp, Homo sapiens
ctgggctggagtgcaatggcgc

SEQ ID NO: 8566052 - DNA, 22 bp, Homo sapiens
ctgggctgcgggcgcccctcca

SEQ ID NO: 8566053 - DNA, 22 bp, Homo sapiens
ctgggctgcgggcgcccctcca

SEQ ID NO: 8566054 - DNA, 22 bp, Homo sapiens
ctgggctgcggtggtaggttgt

SEQ ID NO: 8566055 - DNA, 20 bp, Homo sapiens
ctgggctgcccagctatggg

SEQ ID NO: 8566056 - DNA, 20 bp, Homo sapiens
ctgggctgcccagctatggg

SEQ ID NO: 8566057 - DNA, 20 bp, Homo sapiens
ctgggctgcccagctatggg

SEQ ID NO: 8566058 - DNA, 22 bp, Homo sapiens
ctgggctgccaggtaggcacac

SEQ ID NO: 8566059 - DNA, 22 bp, Homo sapiens
ctgggctgcatcaaagaggcat

SEQ ID NO: 8566060 - DNA, 22 bp, Homo sapiens
ctgggctgccaggtaggcacac

SEQ ID NO: 8566061 - DNA, 22 bp, Homo sapiens
ctgggctgcagcgggagcgacg

SEQ ID NO: 8566062 - DNA, 22 bp, Homo sapiens
ctgggctgcagcgggagcgacg

SEQ ID NO: 8566063 - DNA, 22 bp, Homo sapiens
ctgggctgcaggagtggggcaa

SEQ ID NO: 8566064 - DNA, 22 bp, Homo sapiens
ctgggctgcaggagtggggcaa

SEQ ID NO: 8566065 - DNA, 22 bp, Homo sapiens
ctgggctgcagcgggagcgacg

SEQ ID NO: 8566066 - DNA, 22 bp, Homo sapiens
ctgggctgcatcaaagaggcat

SEQ ID NO: 8566067 - DNA, 22 bp, Homo sapiens
ctgggctgcatcaaagaggcat

SEQ ID NO: 8566068 - DNA, 22 bp, Homo sapiens
ctgggctgcatcaaagaggcat

SEQ ID NO: 8566069 - DNA, 22 bp, Homo sapiens
ctgggctgcagttcctggtcct

SEQ ID NO: 8566070 - DNA, 22 bp, Homo sapiens
ctgggctgcagttcctggtcct

SEQ ID NO: 8566071 - DNA, 22 bp, Homo sapiens
ctgggctgcagttcctggtcct

SEQ ID NO: 8566072 - DNA, 22 bp, Homo sapiens
ctgggctgcagttcctggtcct

SEQ ID NO: 8566073 - DNA, 22 bp, Homo sapiens
ctgggctgcaggagtggggcaa

SEQ ID NO: 8566074 - DNA, 22 bp, Homo sapiens
ctgggctctaggaaccattcct

SEQ ID NO: 8566075 - DNA, 22 bp, Homo sapiens
ctgggctctgcagttgatgttt

SEQ ID NO: 8566076 - DNA, 22 bp, Homo sapiens
ctgggccagatccagcctcaca

SEQ ID NO: 8566077 - DNA, 22 bp, Homo sapiens
ctgggccagatccagcctcaca

SEQ ID NO: 8566078 - DNA, 22 bp, Homo sapiens
ctgggccagatccagcctcaca

SEQ ID NO: 8566079 - DNA, 22 bp, Homo sapiens
ctgggctctaggaaccattcct

SEQ ID NO: 8566080 - DNA, 22 bp, Homo sapiens
ctgggccagaccttgtggtctt

SEQ ID NO: 8566081 - DNA, 22 bp, Homo sapiens
ctgggccagaccttgtggtctt

SEQ ID NO: 8566082 - DNA, 19 bp, Homo sapiens
ctgggccagagctgtcctc

SEQ ID NO: 8566083 - DNA, 19 bp, Homo sapiens
ctgggccagagctgtcctc

SEQ ID NO: 8566084 - DNA, 22 bp, Homo sapiens
ctggctgcaggaaggagtgggc

SEQ ID NO: 8566085 - DNA, 22 bp, Homo sapiens
ctggctcttgcgactcagcttg

SEQ ID NO: 8566086 - DNA, 22 bp, Homo sapiens
ctggctcttgcgactcagcttg

SEQ ID NO: 8566087 - DNA, 22 bp, Homo sapiens
ctggctgcaggatgaggctgcc

SEQ ID NO: 8566088 - DNA, 22 bp, Homo sapiens
ctggctgcaggatgaggctgcc

SEQ ID NO: 8566089 - DNA, 22 bp, Homo sapiens
ctggctgcagtagcaagagact

SEQ ID NO: 8566090 - DNA, 22 bp, Homo sapiens
ctggctcttctgggttctgtgt

SEQ ID NO: 8566091 - DNA, 21 bp, Homo sapiens
ctggctctgttgtcacccggc

SEQ ID NO: 8566092 - DNA, 22 bp, Homo sapiens
ctggctcttcagtgcttggttc

SEQ ID NO: 8566093 - DNA, 23 bp, Homo sapiens
ctggctcatcctggttgcagtgg

SEQ ID NO: 8566094 - DNA, 22 bp, Homo sapiens
ctggctcatccaggtgttgctc

SEQ ID NO: 8566095 - DNA, 23 bp, Homo sapiens
ctggctcatcctggttgcagtgg

SEQ ID NO: 8566096 - DNA, 22 bp, Homo sapiens
ctggctcatgtgatgagggcaa

SEQ ID NO: 8566097 - DNA, 22 bp, Homo sapiens
ctggctcattttagcatcaggt

SEQ ID NO: 8566098 - DNA, 22 bp, Homo sapiens
ctggctcagttcttggttttca

SEQ ID NO: 8566099 - DNA, 22 bp, Homo sapiens
ctggctcagttcttggttttca

SEQ ID NO: 8566100 - DNA, 22 bp, Homo sapiens
ctggctcagtgccttcagaagt

SEQ ID NO: 8566101 - DNA, 22 bp, Homo sapiens
ctggctcatagagcagctccaa

SEQ ID NO: 8566102 - DNA, 22 bp, Homo sapiens
ctggctcatccaggtgttgctc

SEQ ID NO: 8566103 - DNA, 22 bp, Homo sapiens
ctggctcatagagcagctccaa

SEQ ID NO: 8566104 - DNA, 22 bp, Homo sapiens
ctggctgccacttcagggtctt

SEQ ID NO: 8566105 - DNA, 22 bp, Homo sapiens
ctggctgccacttcagggtctt

SEQ ID NO: 8566106 - DNA, 22 bp, Homo sapiens
ctggctgccacttcagggtctt

SEQ ID NO: 8566107 - DNA, 22 bp, Homo sapiens
ctggctgcagtagcaagagact

SEQ ID NO: 8566108 - DNA, 22 bp, Homo sapiens
ctggctgctggcctgaggatgc

SEQ ID NO: 8566109 - DNA, 22 bp, Homo sapiens
ctggctgcttgggacagccatg

SEQ ID NO: 8566110 - DNA, 22 bp, Homo sapiens
ctggctgcttgggacagccatg

SEQ ID NO: 8566111 - DNA, 22 bp, Homo sapiens
ctggctgcttgtagactcgact

SEQ ID NO: 8566112 - DNA, 22 bp, Homo sapiens
ctggctgcttgtagactcgact

SEQ ID NO: 8566113 - DNA, 22 bp, Homo sapiens
ctggctgctggcctgaggatgc

SEQ ID NO: 8566114 - DNA, 22 bp, Homo sapiens
ctggctgcgtctgctctgacag

SEQ ID NO: 8566115 - DNA, 22 bp, Homo sapiens
ctggctgcgctagtccagaaga

SEQ ID NO: 8566116 - DNA, 22 bp, Homo sapiens
ctggctgcgtctgctctgacag

SEQ ID NO: 8566117 - DNA, 22 bp, Homo sapiens
ctggctgtgcagtcttccagaa

SEQ ID NO: 8566118 - DNA, 22 bp, Homo sapiens
ctggctgtgcagtcttccagaa

SEQ ID NO: 8566119 - DNA, 22 bp, Homo sapiens
ctggctgtgcagtcttccagaa

SEQ ID NO: 8566120 - DNA, 22 bp, Homo sapiens
ctggctgtgaaatggcagtgtc

SEQ ID NO: 8566121 - DNA, 22 bp, Homo sapiens
ctggctggagcaggcatcttgt

SEQ ID NO: 8566122 - DNA, 22 bp, Homo sapiens
ctggctgcttgttttgatgggt

SEQ ID NO: 8566123 - DNA, 20 bp, Homo sapiens
ctggctggaaacttagcctt

SEQ ID NO: 8566124 - DNA, 22 bp, Homo sapiens
ctggctggaacgccgaggcggc

SEQ ID NO: 8566125 - DNA, 22 bp, Homo sapiens
ctggctggaagttagagaactt

SEQ ID NO: 8566126 - DNA, 22 bp, Homo sapiens
ctggccctgtaggatgtgagtt

SEQ ID NO: 8566127 - DNA, 22 bp, Homo sapiens
ctggccctgtaggatgtgagtt

SEQ ID NO: 8566128 - DNA, 22 bp, Homo sapiens
ctggccctgtcagcacagaatc

SEQ ID NO: 8566129 - DNA, 22 bp, Homo sapiens
ctggcctgtcctgacccagcct

SEQ ID NO: 8566130 - DNA, 22 bp, Homo sapiens
ctggcctggtctggcctctcca

SEQ ID NO: 8566131 - DNA, 22 bp, Homo sapiens
ctggccctgtggaggcaggaac

SEQ ID NO: 8566132 - DNA, 22 bp, Homo sapiens
ctggccctgtggaggcaggaac

SEQ ID NO: 8566133 - DNA, 23 bp, Homo sapiens
ctggccctggctctgtgatcatg

SEQ ID NO: 8566134 - DNA, 23 bp, Homo sapiens
ctggccctggctctgtgatcatg

SEQ ID NO: 8566135 - DNA, 22 bp, Homo sapiens
ctggccctggctggagcccagg

SEQ ID NO: 8566136 - DNA, 22 bp, Homo sapiens
ctggccctggctggagcccagg

SEQ ID NO: 8566137 - DNA, 22 bp, Homo sapiens
ctggccctggtaaggacaccca

SEQ ID NO: 8566138 - DNA, 22 bp, Homo sapiens
ctggccctggtaaggacaccca

SEQ ID NO: 8566139 - DNA, 22 bp, Homo sapiens
ctggctcaggaaagttgctgct

SEQ ID NO: 8566140 - DNA, 22 bp, Homo sapiens
ctggctcagggtggtctgggtc

SEQ ID NO: 8566141 - DNA, 22 bp, Homo sapiens
ctggctcaggaaagttgctgct

SEQ ID NO: 8566142 - DNA, 22 bp, Homo sapiens
ctggctcagacagctgtgcagt

SEQ ID NO: 8566143 - DNA, 22 bp, Homo sapiens
ctggctcactagccctgccctg

SEQ ID NO: 8566144 - DNA, 22 bp, Homo sapiens
ctggctcacctccgctccagca

SEQ ID NO: 8566145 - DNA, 22 bp, Homo sapiens
ctggctcactagccctgccctg

SEQ ID NO: 8566146 - DNA, 22 bp, Homo sapiens
ctggcctgtcctgacccagcct

SEQ ID NO: 8566147 - DNA, 22 bp, Homo sapiens
ctggccaggccccttgcagggc

SEQ ID NO: 8566148 - DNA, 19 bp, Homo sapiens
ctggccaggccaggggccc

SEQ ID NO: 8566149 - DNA, 19 bp, Homo sapiens
ctggccaggccaggggccc

SEQ ID NO: 8566150 - DNA, 19 bp, Homo sapiens
ctggccaggccaggggccc

SEQ ID NO: 8566151 - DNA, 19 bp, Homo sapiens
ctggccaggccaggggccc

SEQ ID NO: 8566152 - DNA, 22 bp, Homo sapiens
ctggccctatgagcctcctgat

SEQ ID NO: 8566153 - DNA, 22 bp, Homo sapiens
ctggccctatgagcctcctgat

SEQ ID NO: 8566154 - DNA, 22 bp, Homo sapiens
ctggccctattccaggccttcc

SEQ ID NO: 8566155 - DNA, 22 bp, Homo sapiens
ctggccctattccaggccttcc

SEQ ID NO: 8566156 - DNA, 22 bp, Homo sapiens
ctggcccagtctcagagtgtca

SEQ ID NO: 8566157 - DNA, 22 bp, Homo sapiens
ctggcccagtctcagagtgtca

SEQ ID NO: 8566158 - DNA, 22 bp, Homo sapiens
ctggcccaggtggtcgttgagg

SEQ ID NO: 8566159 - DNA, 22 bp, Homo sapiens
ctggccaggccccttgcagggc

SEQ ID NO: 8566160 - DNA, 22 bp, Homo sapiens
ctggccaggccccttgcagggc

SEQ ID NO: 8566161 - DNA, 22 bp, Homo sapiens
ctggccctgccagagatcaaca

SEQ ID NO: 8566162 - DNA, 22 bp, Homo sapiens
ctggccctgccagagatcaaca

SEQ ID NO: 8566163 - DNA, 22 bp, Homo sapiens
ctggccctgctccgcgccgcgg

SEQ ID NO: 8566164 - DNA, 22 bp, Homo sapiens
ctggccctgcctaatgtacttg

SEQ ID NO: 8566165 - DNA, 22 bp, Homo sapiens
ctggccctgcctaatgtacttg

SEQ ID NO: 8566166 - DNA, 22 bp, Homo sapiens
ctggccctggagggctgtgcga

SEQ ID NO: 8566167 - DNA, 22 bp, Homo sapiens
ctggccctggagggctgtgcga

SEQ ID NO: 8566168 - DNA, 16 bp, Homo sapiens
ctggccctggctctgg

SEQ ID NO: 8566169 - DNA, 22 bp, Homo sapiens
ctggccctggagggctgtgcga

SEQ ID NO: 8566170 - DNA, 22 bp, Homo sapiens
ctggccctcggagtccagctgc

SEQ ID NO: 8566171 - DNA, 22 bp, Homo sapiens
ctggccctcagactcatgggca

SEQ ID NO: 8566172 - DNA, 22 bp, Homo sapiens
ctggccctcggagtccagctgc

SEQ ID NO: 8566173 - DNA, 22 bp, Homo sapiens
ctggccctcggagtccagctgc

SEQ ID NO: 8566174 - DNA, 22 bp, Homo sapiens
ctggccctcggagtccagctgc

SEQ ID NO: 8566175 - DNA, 22 bp, Homo sapiens
ctggccctcggagtccagctgc

SEQ ID NO: 8566176 - DNA, 22 bp, Homo sapiens
ctggccctcggagtccagctgc

SEQ ID NO: 8566177 - DNA, 22 bp, Homo sapiens
ctggccctcgtcagtttcactg

SEQ ID NO: 8566178 - DNA, 22 bp, Homo sapiens
ctggccctcgtcagtttcactg

SEQ ID NO: 8566179 - DNA, 22 bp, Homo sapiens
ctggcaggcggcagagcccagg

SEQ ID NO: 8566180 - DNA, 22 bp, Homo sapiens
ctggccactgattcctcccctg

SEQ ID NO: 8566181 - DNA, 22 bp, Homo sapiens
ctggcaggcagacttctgcaag

SEQ ID NO: 8566182 - DNA, 22 bp, Homo sapiens
ctggcaggcagacttctgcaag

SEQ ID NO: 8566183 - DNA, 22 bp, Homo sapiens
ctggcaggcggaggttgcagtg

SEQ ID NO: 8566184 - DNA, 22 bp, Homo sapiens
ctggcaggagcattcacagagg

SEQ ID NO: 8566185 - DNA, 20 bp, Homo sapiens
ctggcaggagcgagtctacc

SEQ ID NO: 8566186 - DNA, 22 bp, Homo sapiens
ctggcaggatctaaccagggaa

SEQ ID NO: 8566187 - DNA, 22 bp, Homo sapiens
ctggcaggcaaattggtgggag

SEQ ID NO: 8566188 - DNA, 22 bp, Homo sapiens
ctggccactgcacctcttcctt

SEQ ID NO: 8566189 - DNA, 21 bp, Homo sapiens
ctggccactgcacctcttcct

SEQ ID NO: 8566190 - DNA, 22 bp, Homo sapiens
ctggccagagttggagggtgtg

SEQ ID NO: 8566191 - DNA, 22 bp, Homo sapiens
ctggccagagttggagggtgtg

SEQ ID NO: 8566192 - DNA, 22 bp, Homo sapiens
ctggccagagttggagggtgtg

SEQ ID NO: 8566193 - DNA, 22 bp, Homo sapiens
ctggccagatgttacgtccaat

SEQ ID NO: 8566194 - DNA, 22 bp, Homo sapiens
ctggccagcatggctgaagtac

SEQ ID NO: 8566195 - DNA, 22 bp, Homo sapiens
ctggccagatgttacgtccaat

SEQ ID NO: 8566196 - DNA, 22 bp, Homo sapiens
ctggccagcatggctgaagtac

SEQ ID NO: 8566197 - DNA, 22 bp, Homo sapiens
ctggccagcatggctgaagtac

SEQ ID NO: 8566198 - DNA, 22 bp, Homo sapiens
ctggccagcatttttgctttag

SEQ ID NO: 8566199 - DNA, 22 bp, Homo sapiens
ctggccagcatttttgctttag

SEQ ID NO: 8566200 - DNA, 22 bp, Homo sapiens
ctggccagcctgtcgatgccct

SEQ ID NO: 8566201 - DNA, 22 bp, Homo sapiens
ctggccagcctgtcgatgccct

SEQ ID NO: 8566202 - DNA, 22 bp, Homo sapiens
ctggccagcctcccaggtaccc

SEQ ID NO: 8566203 - DNA, 22 bp, Homo sapiens
ctggccagcctcccaggtaccc

SEQ ID NO: 8566204 - DNA, 22 bp, Homo sapiens
ctggccagcctcccaggtaccc

SEQ ID NO: 8566205 - DNA, 22 bp, Homo sapiens
ctggccagcctcccaggtaccc

SEQ ID NO: 8566206 - DNA, 22 bp, Homo sapiens
ctggccagcctcccaggtaccc

SEQ ID NO: 8566207 - DNA, 22 bp, Homo sapiens
ctggccagctgacagcagggct

SEQ ID NO: 8566208 - DNA, 22 bp, Homo sapiens
ctggccagctgacagcagggct

SEQ ID NO: 8566209 - DNA, 22 bp, Homo sapiens
ctggccagctgacagcagggct

SEQ ID NO: 8566210 - DNA, 22 bp, Homo sapiens
ctggccaggcatcccctgatcc

SEQ ID NO: 8566211 - DNA, 22 bp, Homo sapiens
ctggccaggaggtaaccagatg

SEQ ID NO: 8566212 - DNA, 22 bp, Homo sapiens
ctggccaggaggtaaccagatg

SEQ ID NO: 8566213 - DNA, 22 bp, Homo sapiens
ctgccagcactgcctcctgagg

SEQ ID NO: 8566214 - DNA, 22 bp, Homo sapiens
ctgccagcactgcctcctgagg

SEQ ID NO: 8566215 - DNA, 22 bp, Homo sapiens
ctgccagcactgcctcctgagg

SEQ ID NO: 8566216 - DNA, 22 bp, Homo sapiens
ctgccagcaatgtgaccatgct

SEQ ID NO: 8566217 - DNA, 22 bp, Homo sapiens
ctgccagccaggccaggtaggc

SEQ ID NO: 8566218 - DNA, 22 bp, Homo sapiens
ctgccagcagaggccagcgctg

SEQ ID NO: 8566219 - DNA, 22 bp, Homo sapiens
ctgccagccaggccaggtaggc

SEQ ID NO: 8566220 - DNA, 22 bp, Homo sapiens
ctggcagccaagtgggatactc

SEQ ID NO: 8566221 - DNA, 22 bp, Homo sapiens
ctgccagctcaccggctcagac

SEQ ID NO: 8566222 - DNA, 22 bp, Homo sapiens
ctgccagctcgccacaatgaca

SEQ ID NO: 8566223 - DNA, 22 bp, Homo sapiens
ctgccagctcaaagcgcagcta

SEQ ID NO: 8566224 - DNA, 22 bp, Homo sapiens
ctgccagctcaccggctcagac

SEQ ID NO: 8566225 - DNA, 22 bp, Homo sapiens
ctggcagcttcaggacactcgg

SEQ ID NO: 8566226 - DNA, 22 bp, Homo sapiens
ctggcagcttcctttgcatctg

SEQ ID NO: 8566227 - DNA, 22 bp, Homo sapiens
ctggcagcttcctttgcatctg

SEQ ID NO: 8566228 - DNA, 22 bp, Homo sapiens
ctggcagcttcaggacactcgg

SEQ ID NO: 8566229 - DNA, 19 bp, Homo sapiens
ctggcagcctgtctgtgtc

SEQ ID NO: 8566230 - DNA, 22 bp, Homo sapiens
ctggcagcccaacctagagtct

SEQ ID NO: 8566231 - DNA, 22 bp, Homo sapiens
ctggcagcccaacctagagtct

SEQ ID NO: 8566232 - DNA, 22 bp, Homo sapiens
ctggcagcccaacctagagtct

SEQ ID NO: 8566233 - DNA, 22 bp, Homo sapiens
ctggcaggaagaggaaaggtca

SEQ ID NO: 8566234 - DNA, 22 bp, Homo sapiens
ctggcaggaagaggaaaggtca

SEQ ID NO: 8566235 - DNA, 22 bp, Homo sapiens
ctggcaggaagaggaaaggtca

SEQ ID NO: 8566236 - DNA, 22 bp, Homo sapiens
ctggcaggagcattcacagagg

SEQ ID NO: 8566237 - DNA, 22 bp, Homo sapiens
ctggcaggaagttagatggtaa

SEQ ID NO: 8566238 - DNA, 22 bp, Homo sapiens
ctggcaggaagttagatggtaa

SEQ ID NO: 8566239 - DNA, 22 bp, Homo sapiens
ctgccagaaggttcctgctgca

SEQ ID NO: 8566240 - DNA, 22 bp, Homo sapiens
ctgccactttggagtgctcaga

SEQ ID NO: 8566241 - DNA, 22 bp, Homo sapiens
ctgccactttggagtgctcaga

SEQ ID NO: 8566242 - DNA, 22 bp, Homo sapiens
ctgccagagatctgggcagagt

SEQ ID NO: 8566243 - DNA, 22 bp, Homo sapiens
ctgccagatcattggattcaca

SEQ ID NO: 8566244 - DNA, 18 bp, Homo sapiens
ctgccacttaatgtggtg

SEQ ID NO: 8566245 - DNA, 22 bp, Homo sapiens
ctgccacttactaggcatggtg

SEQ ID NO: 8566246 - DNA, 22 bp, Homo sapiens
ctgccactttcacccagtgctc

SEQ ID NO: 8566247 - DNA, 22 bp, Homo sapiens
ctgccactttcacccagtgctc

SEQ ID NO: 8566248 - DNA, 21 bp, Homo sapiens
ctgccacctgctccatcagca

SEQ ID NO: 8566249 - DNA, 22 bp, Homo sapiens
ctgccactagctttcacatctt

SEQ ID NO: 8566250 - DNA, 21 bp, Homo sapiens
ctgccacctgctccatcagca

SEQ ID NO: 8566251 - DNA, 22 bp, Homo sapiens
ctgccactctgggtgggcctgg

SEQ ID NO: 8566252 - DNA, 22 bp, Homo sapiens
ctgccactagctttcacatctt

SEQ ID NO: 8566253 - DNA, 22 bp, Homo sapiens
ctgcatcattttcagacaatgg

SEQ ID NO: 8566254 - DNA, 22 bp, Homo sapiens
ctgcatccatgttgctgcaaag

SEQ ID NO: 8566255 - DNA, 22 bp, Homo sapiens
ctgcatcagtggatatgatggt

SEQ ID NO: 8566256 - DNA, 22 bp, Homo sapiens
ctgcatccatgttgctgcaaag

SEQ ID NO: 8566257 - DNA, 22 bp, Homo sapiens
ctgccaaggctggggaggacaa

SEQ ID NO: 8566258 - DNA, 22 bp, Homo sapiens
ctgccaagtaatgcctgggctc

SEQ ID NO: 8566259 - DNA, 22 bp, Homo sapiens
ctgcatccatgttgctgcaaag

SEQ ID NO: 8566260 - DNA, 22 bp, Homo sapiens
ctgcatccatgttgctgcaaag

SEQ ID NO: 8566261 - DNA, 22 bp, Homo sapiens
ctgccacaagctggccctgtgt

SEQ ID NO: 8566262 - DNA, 22 bp, Homo sapiens
ctgccaccatgccccagcagag

SEQ ID NO: 8566263 - DNA, 22 bp, Homo sapiens
ctgccaccatgccccagcagag

SEQ ID NO: 8566264 - DNA, 22 bp, Homo sapiens
ctgccaccatgccccagcagag

SEQ ID NO: 8566265 - DNA, 22 bp, Homo sapiens
ctgtgtcctgcgtcaagccaat

SEQ ID NO: 8566266 - DNA, 22 bp, Homo sapiens
ctgtgtcctgtctcctaaggtg

SEQ ID NO: 8566267 - DNA, 22 bp, Homo sapiens
ctgtgtagtcaggtggtcccac

SEQ ID NO: 8566268 - DNA, 22 bp, Homo sapiens
ctgtgtagcctcatgtgggctt

SEQ ID NO: 8566269 - DNA, 20 bp, Homo sapiens
ctgtgtagtgctcaggtaag

SEQ ID NO: 8566270 - DNA, 22 bp, Homo sapiens
ctgtgtagtatttgtacacata

SEQ ID NO: 8566271 - DNA, 22 bp, Homo sapiens
ctgtgtcctcccgctgcaccca

SEQ ID NO: 8566272 - DNA, 22 bp, Homo sapiens
ctgtgtcctccccatcacttct

SEQ ID NO: 8566273 - DNA, 22 bp, Homo sapiens
ctgtgtctaatcaggtcagtca

SEQ ID NO: 8566274 - DNA, 22 bp, Homo sapiens
ctgtgtctaatcaggtcagtca

SEQ ID NO: 8566275 - DNA, 22 bp, Homo sapiens
ctgtgtctaatcttatacatca

SEQ ID NO: 8566276 - DNA, 21 bp, Homo sapiens
ctgtgtcgctctcgctgggag

SEQ ID NO: 8566277 - DNA, 22 bp, Homo sapiens
ctgtgtctaatcttatacatca

SEQ ID NO: 8566278 - DNA, 23 bp, Homo sapiens
ctgtgtctatgcagccatatcca

SEQ ID NO: 8566279 - DNA, 22 bp, Homo sapiens
ctgtgtctcatccgcctctggc

SEQ ID NO: 8566280 - DNA, 23 bp, Homo sapiens
ctgtgtctatgcagccatatcca

SEQ ID NO: 8566281 - DNA, 22 bp, Homo sapiens
ctgtggctgtctctttcccatg

SEQ ID NO: 8566282 - DNA, 22 bp, Homo sapiens
ctgtggctgtgaaacttctcag

SEQ ID NO: 8566283 - DNA, 22 bp, Homo sapiens
ctgtggcttcagcattcagagc

SEQ ID NO: 8566284 - DNA, 22 bp, Homo sapiens
ctgtgtagcctcatgtgggctt

SEQ ID NO: 8566285 - DNA, 22 bp, Homo sapiens
ctgtgtagagcggctgcgagcg

SEQ ID NO: 8566286 - DNA, 22 bp, Homo sapiens
ctgtgtagagcggctgcgagcg

SEQ ID NO: 8566287 - DNA, 22 bp, Homo sapiens
ctgtggtgggccctgggcttca

SEQ ID NO: 8566288 - DNA, 22 bp, Homo sapiens
ctgtggtgggccctgggcttca

SEQ ID NO: 8566289 - DNA, 22 bp, Homo sapiens
ctgtggctggccttattgctgc

SEQ ID NO: 8566290 - DNA, 22 bp, Homo sapiens
ctgtggctggcctgtctgacat

SEQ ID NO: 8566291 - DNA, 22 bp, Homo sapiens
ctgtggctggaataataaatgt

SEQ ID NO: 8566292 - DNA, 22 bp, Homo sapiens
ctgtggctgtatttggccagag

SEQ ID NO: 8566293 - DNA, 22 bp, Homo sapiens
ctgtggctggctcatcataggt

SEQ ID NO: 8566294 - DNA, 22 bp, Homo sapiens
ctgtggctctcagaggctgctg

SEQ ID NO: 8566295 - DNA, 22 bp, Homo sapiens
ctgtggctctctgcagggtccc

SEQ ID NO: 8566296 - DNA, 22 bp, Homo sapiens
ctgtggctctccaatggaggga

SEQ ID NO: 8566297 - DNA, 20 bp, Homo sapiens
ctgtggctcatgcatctgcc

SEQ ID NO: 8566298 - DNA, 20 bp, Homo sapiens
ctgtggctcatgcatctgcc

SEQ ID NO: 8566299 - DNA, 20 bp, Homo sapiens
ctgtggctcatgcatctgcc

SEQ ID NO: 8566300 - DNA, 20 bp, Homo sapiens
ctgtggctcatgcatctgcc

SEQ ID NO: 8566301 - DNA, 22 bp, Homo sapiens
ctgtggctcatatctgtaatct

SEQ ID NO: 8566302 - DNA, 22 bp, Homo sapiens
ctgtggctccagtgaaccaatg

SEQ ID NO: 8566303 - DNA, 22 bp, Homo sapiens
ctgtggctcattcttggtggca

SEQ ID NO: 8566304 - DNA, 22 bp, Homo sapiens
ctgtggctccatagaagttgca

SEQ ID NO: 8566305 - DNA, 16 bp, Homo sapiens
ctgtggctcccaggtt

SEQ ID NO: 8566306 - DNA, 22 bp, Homo sapiens
ctgtggctgcagccttggtcct

SEQ ID NO: 8566307 - DNA, 22 bp, Homo sapiens
ctgtggctgcagaccttaaaca

SEQ ID NO: 8566308 - DNA, 22 bp, Homo sapiens
ctgtggctgcagccttggtcct

SEQ ID NO: 8566309 - DNA, 22 bp, Homo sapiens
ctgtggctgcagccttggtcct

SEQ ID NO: 8566310 - DNA, 22 bp, Homo sapiens
ctgtggctgcagccttggtcct

SEQ ID NO: 8566311 - DNA, 22 bp, Homo sapiens
ctgtggctgcagccttggtcct

SEQ ID NO: 8566312 - DNA, 22 bp, Homo sapiens
ctgtggctgagttccttatgtt

SEQ ID NO: 8566313 - DNA, 22 bp, Homo sapiens
ctgtggctgcgccctgggggag

SEQ ID NO: 8566314 - DNA, 22 bp, Homo sapiens
ctgtggctgcgtaggtctggca

SEQ ID NO: 8566315 - DNA, 22 bp, Homo sapiens
ctgtggctgcgccatcgaaaac

SEQ ID NO: 8566316 - DNA, 22 bp, Homo sapiens
ctgtggctgcgccatcgaaaac

SEQ ID NO: 8566317 - DNA, 22 bp, Homo sapiens
ctgtggctgcctcacctacagg

SEQ ID NO: 8566318 - DNA, 22 bp, Homo sapiens
ctgtggctctttagttgagcac

SEQ ID NO: 8566319 - DNA, 22 bp, Homo sapiens
ctgtggctctgcagtcccaaca

SEQ ID NO: 8566320 - DNA, 22 bp, Homo sapiens
ctgtggctgaactctgaagagg

SEQ ID NO: 8566321 - DNA, 23 bp, Homo sapiens
ctgtggctgagtcctgttggagt

SEQ ID NO: 8566322 - DNA, 23 bp, Homo sapiens
ctgtggctgagtcctgttggagt

SEQ ID NO: 8566323 - DNA, 19 bp, Homo sapiens
ctgtggctgacctctggcc

SEQ ID NO: 8566324 - DNA, 19 bp, Homo sapiens
ctgtggctgacctctggcc

SEQ ID NO: 8566325 - DNA, 22 bp, Homo sapiens
ctgttacatagcttttcttaac

SEQ ID NO: 8566326 - DNA, 22 bp, Homo sapiens
ctgttacacggaccttcaaatc

SEQ ID NO: 8566327 - DNA, 22 bp, Homo sapiens
ctgttacaagagagagacatga

SEQ ID NO: 8566328 - DNA, 22 bp, Homo sapiens
ctgttaagcaacatgagtaagt

SEQ ID NO: 8566329 - DNA, 22 bp, Homo sapiens
ctgtgtcttctgcttacagtct

SEQ ID NO: 8566330 - DNA, 22 bp, Homo sapiens
ctgttaatctgcttgcatgatg

SEQ ID NO: 8566331 - DNA, 22 bp, Homo sapiens
ctgttaagtgtagataatgtgg

SEQ ID NO: 8566332 - DNA, 22 bp, Homo sapiens
ctgttaatggaggactacagga

SEQ ID NO: 8566333 - DNA, 22 bp, Homo sapiens
ctgtgtcttcacatttgtgtgc

SEQ ID NO: 8566334 - DNA, 22 bp, Homo sapiens
ctgtgtcttcctctgcccaggc

SEQ ID NO: 8566335 - DNA, 22 bp, Homo sapiens
ctgtgtcttcacatttgtgtgc

SEQ ID NO: 8566336 - DNA, 22 bp, Homo sapiens
ctgtgtcttctgcttacagtct

SEQ ID NO: 8566337 - DNA, 22 bp, Homo sapiens
ctgtgtctgtggaatagcgaat

SEQ ID NO: 8566338 - DNA, 22 bp, Homo sapiens
ctgtgtcttcaatgtactggga

SEQ ID NO: 8566339 - DNA, 22 bp, Homo sapiens
ctgtgtcttcaatgtactggga

SEQ ID NO: 8566340 - DNA, 22 bp, Homo sapiens
ctgtgtcttcaatgtactggga

SEQ ID NO: 8566341 - DNA, 22 bp, Homo sapiens
ctgtgtcttcaatgtactggga

SEQ ID NO: 8566342 - DNA, 22 bp, Homo sapiens
ctgtgtcttcaatgtactggga

SEQ ID NO: 8566343 - DNA, 22 bp, Homo sapiens
ctgtgtctgcctgggatccatt

SEQ ID NO: 8566344 - DNA, 22 bp, Homo sapiens
ctgtgtctgaataactctgtgt

SEQ ID NO: 8566345 - DNA, 22 bp, Homo sapiens
ctgtgtctgaataactctgtgt

SEQ ID NO: 8566346 - DNA, 22 bp, Homo sapiens
ctgtgtctgaataactctgtgt

SEQ ID NO: 8566347 - DNA, 22 bp, Homo sapiens
ctgtgtctctccttacaagact

SEQ ID NO: 8566348 - DNA, 22 bp, Homo sapiens
ctgtgtctgaataactctgtgt

SEQ ID NO: 8566349 - DNA, 22 bp, Homo sapiens
ctgtgtctctacctccccatcc

SEQ ID NO: 8566350 - DNA, 22 bp, Homo sapiens
ctgtgtctctccttacaagact

SEQ ID NO: 8566351 - DNA, 22 bp, Homo sapiens
ctgtgtctcatccgcctctggc

SEQ ID NO: 8566352 - DNA, 22 bp, Homo sapiens
ctgtgtctccttggtgggatat

SEQ ID NO: 8566353 - DNA, 22 bp, Homo sapiens
ctgtgtctcccaaggagggtca

SEQ ID NO: 8566354 - DNA, 22 bp, Homo sapiens
ctgtgtctcatccgcctctggc

SEQ ID NO: 8566355 - DNA, 22 bp, Homo sapiens
ctgtgtctcgttaaagcattgg

SEQ ID NO: 8566356 - DNA, 22 bp, Homo sapiens
ctgtgtctctacctccccatcc

SEQ ID NO: 8566357 - DNA, 22 bp, Homo sapiens
ctgtgtctccttggtgggatat

SEQ ID NO: 8566358 - DNA, 22 bp, Homo sapiens
ctgtgtctcgttaaagcattgg

SEQ ID NO: 8566359 - DNA, 22 bp, Homo sapiens
ctgttcatgctgattctgtatg

SEQ ID NO: 8566360 - DNA, 22 bp, Homo sapiens
ctgttattttcctctgaactct

SEQ ID NO: 8566361 - DNA, 22 bp, Homo sapiens
ctgttcacagaatcctcccctg

SEQ ID NO: 8566362 - DNA, 22 bp, Homo sapiens
ctgttctgaactgcctgcatgc

SEQ ID NO: 8566363 - DNA, 22 bp, Homo sapiens
ctgttctctggcggtggctgtt

SEQ ID NO: 8566364 - DNA, 22 bp, Homo sapiens
ctgttctctggcggtggctgtt

SEQ ID NO: 8566365 - DNA, 22 bp, Homo sapiens
ctgttctatcattaaaagctat

SEQ ID NO: 8566366 - DNA, 20 bp, Homo sapiens
ctgttcctgtcccatgaagc

SEQ ID NO: 8566367 - DNA, 20 bp, Homo sapiens
ctgttcctgtcccatgaagc

SEQ ID NO: 8566368 - DNA, 22 bp, Homo sapiens
ctgttgcatgactgtgcatgct

SEQ ID NO: 8566369 - DNA, 22 bp, Homo sapiens
ctgttgatctcagttagctaga

SEQ ID NO: 8566370 - DNA, 22 bp, Homo sapiens
ctgttctggagacactgatgaa

SEQ ID NO: 8566371 - DNA, 22 bp, Homo sapiens
ctgttctgtaagctgctgttgt

SEQ ID NO: 8566372 - DNA, 22 bp, Homo sapiens
ctgttctttagttccactgcaa

SEQ ID NO: 8566373 - DNA, 18 bp, Homo sapiens
ctgttgagatgtggctga

SEQ ID NO: 8566374 - DNA, 22 bp, Homo sapiens
ctgttcttctagtccactgaca

SEQ ID NO: 8566375 - DNA, 22 bp, Homo sapiens
ctgttcttctgggaatggccct

SEQ ID NO: 8566376 - DNA, 22 bp, Homo sapiens
ctgggtctttttcttccattga

SEQ ID NO: 8566377 - DNA, 22 bp, Homo sapiens
ctgggtgagttgatgaaggaga

SEQ ID NO: 8566378 - DNA, 22 bp, Homo sapiens
ctgggtgagctggccagagggt

SEQ ID NO: 8566379 - DNA, 22 bp, Homo sapiens
ctgggtgacagagtgagatggt

SEQ ID NO: 8566380 - DNA, 22 bp, Homo sapiens
ctgggtgacagagtgagatggt

SEQ ID NO: 8566381 - DNA, 22 bp, Homo sapiens
ctgggtgagttgatgaaggaga

SEQ ID NO: 8566382 - DNA, 22 bp, Homo sapiens
ctgggtgagttgatgaaggaga

SEQ ID NO: 8566383 - DNA, 22 bp, Homo sapiens
ctgtcctctgtcctcagcagga

SEQ ID NO: 8566384 - DNA, 22 bp, Homo sapiens
ctgtcccttcattattcactac

SEQ ID NO: 8566385 - DNA, 22 bp, Homo sapiens
ctgtcccttcattattcactac

SEQ ID NO: 8566386 - DNA, 22 bp, Homo sapiens
ctgtcccttcattattcactac

SEQ ID NO: 8566387 - DNA, 22 bp, Homo sapiens
ctgtccctgagcaactcctgtt

SEQ ID NO: 8566388 - DNA, 22 bp, Homo sapiens
ctgtcctgaagttttcatgaga

SEQ ID NO: 8566389 - DNA, 22 bp, Homo sapiens
ctgtcctgaagttttcatgaga

SEQ ID NO: 8566390 - DNA, 22 bp, Homo sapiens
ctgtcctgaaagggagattggg

SEQ ID NO: 8566391 - DNA, 22 bp, Homo sapiens
ctgtccctgagcaactcctgtt

SEQ ID NO: 8566392 - DNA, 22 bp, Homo sapiens
ctgtccctgagcaactcctgtt

SEQ ID NO: 8566393 - DNA, 22 bp, Homo sapiens
ctgtcctgcccaccctgcaggg

SEQ ID NO: 8566394 - DNA, 22 bp, Homo sapiens
ctgtcctgcccaccctgcaggg

SEQ ID NO: 8566395 - DNA, 22 bp, Homo sapiens
ctgtcctgcagttgggggcagg

SEQ ID NO: 8566396 - DNA, 22 bp, Homo sapiens
ctgtcctgatggtgccactggt

SEQ ID NO: 8566397 - DNA, 22 bp, Homo sapiens
ctgtcctgatggtgccactggt

SEQ ID NO: 8566398 - DNA, 22 bp, Homo sapiens
ctgtcctgatggtgccactggt

SEQ ID NO: 8566399 - DNA, 22 bp, Homo sapiens
ctgtcctgatggtgccactggt

SEQ ID NO: 8566400 - DNA, 21 bp, Homo sapiens
ctgtcctggtctagaggcaca

SEQ ID NO: 8566401 - DNA, 22 bp, Homo sapiens
ctgtcctgtactttgaggccct

SEQ ID NO: 8566402 - DNA, 22 bp, Homo sapiens
ctgtcctgtagctccatcagtc

SEQ ID NO: 8566403 - DNA, 22 bp, Homo sapiens
ctgtcctgtagctccatcagtc

SEQ ID NO: 8566404 - DNA, 22 bp, Homo sapiens
ctgtcctgtagctccatcagtc

SEQ ID NO: 8566405 - DNA, 22 bp, Homo sapiens
ctgtcctgcccaccctgcaggg

SEQ ID NO: 8566406 - DNA, 22 bp, Homo sapiens
ctgtcctgcccaccctgcaggg

SEQ ID NO: 8566407 - DNA, 22 bp, Homo sapiens
ctgtcctggagggcataggacg

SEQ ID NO: 8566408 - DNA, 22 bp, Homo sapiens
ctgtcctggagggcataggacg

SEQ ID NO: 8566409 - DNA, 22 bp, Homo sapiens
ctgtcctggccgcccttgtgag

SEQ ID NO: 8566410 - DNA, 22 bp, Homo sapiens
ctgtcctggggaaagccagccc

SEQ ID NO: 8566411 - DNA, 19 bp, Homo sapiens
ctgtgccctatgacttgta

SEQ ID NO: 8566412 - DNA, 22 bp, Homo sapiens
ctgtgccctctttgctggcctt

SEQ ID NO: 8566413 - DNA, 23 bp, Homo sapiens
ctgtgcccggggctccacctgat

SEQ ID NO: 8566414 - DNA, 22 bp, Homo sapiens
ctgtggccagatggtgccagtt

SEQ ID NO: 8566415 - DNA, 17 bp, Homo sapiens
ctgtggccacctggatg

SEQ ID NO: 8566416 - DNA, 17 bp, Homo sapiens
ctgtggccacctggatg

SEQ ID NO: 8566417 - DNA, 22 bp, Homo sapiens
ctgtggctcatatctgtaatct

SEQ ID NO: 8566418 - DNA, 22 bp, Homo sapiens
ctgtggccccaccctcttggcc

SEQ ID NO: 8566419 - DNA, 22 bp, Homo sapiens
ctgtgcccaggctggagtgcag

SEQ ID NO: 8566420 - DNA, 22 bp, Homo sapiens
ctgtgcccacctggctctgagg

SEQ ID NO: 8566421 - DNA, 22 bp, Homo sapiens
ctgtgccatctttttgctacct

SEQ ID NO: 8566422 - DNA, 22 bp, Homo sapiens
ctgtgccaggcccagctgactt

SEQ ID NO: 8566423 - DNA, 22 bp, Homo sapiens
ctgtgccaggcccagctgactt

SEQ ID NO: 8566424 - DNA, 22 bp, Homo sapiens
ctgtgccaggcccagctgactt

SEQ ID NO: 8566425 - DNA, 22 bp, Homo sapiens
ctgtgccactgccccaggcctc

SEQ ID NO: 8566426 - DNA, 22 bp, Homo sapiens
ctgtgccactgccctgccacgc

SEQ ID NO: 8566427 - DNA, 22 bp, Homo sapiens
ctgtgccagcctgtcccaggag

SEQ ID NO: 8566428 - DNA, 22 bp, Homo sapiens
ctgtgcagtggggctctgggtt

SEQ ID NO: 8566429 - DNA, 22 bp, Homo sapiens
ctgtgcagtgtggggtaggcct

SEQ ID NO: 8566430 - DNA, 22 bp, Homo sapiens
ctgtgcattgtcttgtctgtag

SEQ ID NO: 8566431 - DNA, 22 bp, Homo sapiens
ctgtgcattgttgagtgtttag

SEQ ID NO: 8566432 - DNA, 22 bp, Homo sapiens
ctgtgcattgtcttgtctgtag

SEQ ID NO: 8566433 - DNA, 19 bp, Homo sapiens
ctgtgagtcttgtggcctc

SEQ ID NO: 8566434 - DNA, 22 bp, Homo sapiens
ctgtgagtaatgacctgtcttg

SEQ ID NO: 8566435 - DNA, 22 bp, Homo sapiens
ctgtgcagtaggtcagggctgg

SEQ ID NO: 8566436 - DNA, 22 bp, Homo sapiens
ctgtgagtcttcagcaagtgtt

SEQ ID NO: 8566437 - DNA, 19 bp, Homo sapiens
ctgtgagtcttgtggcctc

SEQ ID NO: 8566438 - DNA, 22 bp, Homo sapiens
ctgtcctgtagctccatcagtc

SEQ ID NO: 8566439 - DNA, 22 bp, Homo sapiens
ctgtcctgtggacctgaggacg

SEQ ID NO: 8566440 - DNA, 22 bp, Homo sapiens
ctgtgagggccagagtcagggc

SEQ ID NO: 8566441 - DNA, 22 bp, Homo sapiens
ctgtgagggccagagtcagggc

SEQ ID NO: 8566442 - DNA, 22 bp, Homo sapiens
cttatttctccatccagagtca

SEQ ID NO: 8566443 - DNA, 22 bp, Homo sapiens
cttatttctccatccagagtca

SEQ ID NO: 8566444 - DNA, 22 bp, Homo sapiens
cttatttctccatccagagtca

SEQ ID NO: 8566445 - DNA, 19 bp, Homo sapiens
cttatttctggttttgggt

SEQ ID NO: 8566446 - DNA, 22 bp, Homo sapiens
cttatttgaatgtatgagtttt

SEQ ID NO: 8566447 - DNA, 22 bp, Homo sapiens
cttatttgaatgtatgagtttt

SEQ ID NO: 8566448 - DNA, 22 bp, Homo sapiens
cttatttgagagaaaagaaact

SEQ ID NO: 8566449 - DNA, 22 bp, Homo sapiens
cttatttatgtctgtctctaat

SEQ ID NO: 8566450 - DNA, 22 bp, Homo sapiens
cttatttactgatccacagatg

SEQ ID NO: 8566451 - DNA, 22 bp, Homo sapiens
cttatttcctgacatggaaaga

SEQ ID NO: 8566452 - DNA, 22 bp, Homo sapiens
cttatttcagccctgggcaccc

SEQ ID NO: 8566453 - DNA, 22 bp, Homo sapiens
cttatttcagccctgggcaccc

SEQ ID NO: 8566454 - DNA, 22 bp, Homo sapiens
cttattttaagtcagtttgggt

SEQ ID NO: 8566455 - DNA, 22 bp, Homo sapiens
cttattttaagtcagtttgggt

SEQ ID NO: 8566456 - DNA, 22 bp, Homo sapiens
cttattttaagtcagtttgggt

SEQ ID NO: 8566457 - DNA, 22 bp, Homo sapiens
cttattttaagtcagtttgggt

SEQ ID NO: 8566458 - DNA, 22 bp, Homo sapiens
cttattttgctgatgacccagg

SEQ ID NO: 8566459 - DNA, 22 bp, Homo sapiens
cttatttgcccatgtttcttta

SEQ ID NO: 8566460 - DNA, 22 bp, Homo sapiens
cttatttgcccatgtttcttta

SEQ ID NO: 8566461 - DNA, 22 bp, Homo sapiens
cttatttgagagaaaagaaact

SEQ ID NO: 8566462 - DNA, 22 bp, Homo sapiens
cttatttgtactaataaatctg

SEQ ID NO: 8566463 - DNA, 22 bp, Homo sapiens
cttatttgtactaataaatctg

SEQ ID NO: 8566464 - DNA, 22 bp, Homo sapiens
cttatttgtactaataaatctg

SEQ ID NO: 8566465 - DNA, 22 bp, Homo sapiens
cttattttaagtcagtttgggt

SEQ ID NO: 8566466 - DNA, 22 bp, Homo sapiens
cttcagccagctggggatgcgg

SEQ ID NO: 8566467 - DNA, 22 bp, Homo sapiens
cttcagcccagcctccgcctcc

SEQ ID NO: 8566468 - DNA, 22 bp, Homo sapiens
cttcagaagaaaagcagtgtgt

SEQ ID NO: 8566469 - DNA, 22 bp, Homo sapiens
cttcagaagaaaagcagtgtgt

SEQ ID NO: 8566470 - DNA, 22 bp, Homo sapiens
cttcaaacccagattaaatgca

SEQ ID NO: 8566471 - DNA, 22 bp, Homo sapiens
cttattttgctgatgacccagg

SEQ ID NO: 8566472 - DNA, 22 bp, Homo sapiens
cttattttgctgatgacccagg

SEQ ID NO: 8566473 - DNA, 22 bp, Homo sapiens
cttattttgctgatgacccagg

SEQ ID NO: 8566474 - DNA, 22 bp, Homo sapiens
cttattttgctgatgacccagg

SEQ ID NO: 8566475 - DNA, 22 bp, Homo sapiens
cttattttgctgatgacccagg

SEQ ID NO: 8566476 - DNA, 22 bp, Homo sapiens
cttattgaaagcccctgtgcct

SEQ ID NO: 8566477 - DNA, 22 bp, Homo sapiens
cttatttaatgagggttagaat

SEQ ID NO: 8566478 - DNA, 22 bp, Homo sapiens
cttatcaaactggagcaggctt

SEQ ID NO: 8566479 - DNA, 22 bp, Homo sapiens
cttatattttaggaacagacaa

SEQ ID NO: 8566480 - DNA, 22 bp, Homo sapiens
cttatcagattatctgggctgt

SEQ ID NO: 8566481 - DNA, 23 bp, Homo sapiens
cttattcattcatgtagcccatt

SEQ ID NO: 8566482 - DNA, 22 bp, Homo sapiens
cttatattttaggaacagacaa

SEQ ID NO: 8566483 - DNA, 22 bp, Homo sapiens
cttatattttaggaacagacaa

SEQ ID NO: 8566484 - DNA, 22 bp, Homo sapiens
ctgtttaaccagatctcatatc

SEQ ID NO: 8566485 - DNA, 22 bp, Homo sapiens
ctgttgtgaatttagttaccaa

SEQ ID NO: 8566486 - DNA, 22 bp, Homo sapiens
ctgttgtagctgcgctgcttca

SEQ ID NO: 8566487 - DNA, 22 bp, Homo sapiens
ctgttgtatcatttgttcacat

SEQ ID NO: 8566488 - DNA, 22 bp, Homo sapiens
ctgttgtatttccaactatgta

SEQ ID NO: 8566489 - DNA, 22 bp, Homo sapiens
ctgttgtattattcaatattat

SEQ ID NO: 8566490 - DNA, 22 bp, Homo sapiens
ctgttggacttttcaaggtctg

SEQ ID NO: 8566491 - DNA, 22 bp, Homo sapiens
ctgttggagtcattccttccag

SEQ ID NO: 8566492 - DNA, 22 bp, Homo sapiens
ctgttggatggtttccaaaaga

SEQ ID NO: 8566493 - DNA, 22 bp, Homo sapiens
ctgttggatgtgacactgttag

SEQ ID NO: 8566494 - DNA, 22 bp, Homo sapiens
ctgttggtgttgattaaatagt

SEQ ID NO: 8566495 - DNA, 22 bp, Homo sapiens
ctgttgtaaagctattcatttg

SEQ ID NO: 8566496 - DNA, 23 bp, Homo sapiens
cttcagtgtgggactgcagcgtg

SEQ ID NO: 8566497 - DNA, 18 bp, Homo sapiens
cttcagtggctgctctgc

SEQ ID NO: 8566498 - DNA, 22 bp, Homo sapiens
cttccctttttatgtcttcagc

SEQ ID NO: 8566499 - DNA, 22 bp, Homo sapiens
cttccctttttatgtcttcagc

SEQ ID NO: 8566500 - DNA, 22 bp, Homo sapiens
cttccgtgtcagttccaggtgg

SEQ ID NO: 8566501 - DNA, 22 bp, Homo sapiens
cttcctaaaagcttcaagagaa

SEQ ID NO: 8566502 - DNA, 22 bp, Homo sapiens
cttcctaaaagcttcaagagaa

SEQ ID NO: 8566503 - DNA, 22 bp, Homo sapiens
cttcctctgcctcccgtgctca

SEQ ID NO: 8566504 - DNA, 22 bp, Homo sapiens
cttcctctgcggcgccgggcgc

SEQ ID NO: 8566505 - DNA, 22 bp, Homo sapiens
cttcctctgcctcccgtgctca

SEQ ID NO: 8566506 - DNA, 22 bp, Homo sapiens
cttcctctgtgtcctgggcttg

SEQ ID NO: 8566507 - DNA, 16 bp, Homo sapiens
cttcctcttcactggc

SEQ ID NO: 8566508 - DNA, 16 bp, Homo sapiens
cttcctcttcactggc

SEQ ID NO: 8566509 - DNA, 16 bp, Homo sapiens
cttcctcttcactggc

SEQ ID NO: 8566510 - DNA, 22 bp, Homo sapiens
cttcctctgtgtcctgggcttc

SEQ ID NO: 8566511 - DNA, 22 bp, Homo sapiens
cttcctctgtggccagagtgta

SEQ ID NO: 8566512 - DNA, 22 bp, Homo sapiens
cttcctgaggtgctgagcacag

SEQ ID NO: 8566513 - DNA, 22 bp, Homo sapiens
cttcctgagcaaggaactatag

SEQ ID NO: 8566514 - DNA, 18 bp, Homo sapiens
cttcctgactagctctgg

SEQ ID NO: 8566515 - DNA, 22 bp, Homo sapiens
cttcctgaacaatgccatcaat

SEQ ID NO: 8566516 - DNA, 22 bp, Homo sapiens
cttcctgaagaggttggtcagg

SEQ ID NO: 8566517 - DNA, 18 bp, Homo sapiens
cttcctcttctggagaaa

SEQ ID NO: 8566518 - DNA, 22 bp, Homo sapiens
cttcctgaaagtagtaggttga

SEQ ID NO: 8566519 - DNA, 22 bp, Homo sapiens
cttcagcctcgttactcctgcg

SEQ ID NO: 8566520 - DNA, 22 bp, Homo sapiens
cttcagctgcagttatgtttag

SEQ ID NO: 8566521 - DNA, 22 bp, Homo sapiens
cttcagccctgagtgccagcag

SEQ ID NO: 8566522 - DNA, 22 bp, Homo sapiens
cttcagcctcgttactcctgcg

SEQ ID NO: 8566523 - DNA, 22 bp, Homo sapiens
cttcagcctcatctcagcccgt

SEQ ID NO: 8566524 - DNA, 22 bp, Homo sapiens
cttcagcctcaactactatggt

SEQ ID NO: 8566525 - DNA, 22 bp, Homo sapiens
cttcaggattaatttggggcct

SEQ ID NO: 8566526 - DNA, 20 bp, Homo sapiens
cttcaggacccatcctcccc

SEQ ID NO: 8566527 - DNA, 20 bp, Homo sapiens
cttcaggacccatcctcccc

SEQ ID NO: 8566528 - DNA, 22 bp, Homo sapiens
cttcagctgcagttatgtttag

SEQ ID NO: 8566529 - DNA, 22 bp, Homo sapiens
cttcagctgtggtctccaaggc

SEQ ID NO: 8566530 - DNA, 22 bp, Homo sapiens
cttcagggtgacgcaggctgca

SEQ ID NO: 8566531 - DNA, 22 bp, Homo sapiens
cttcagtatcctccacatgtta

SEQ ID NO: 8566532 - DNA, 22 bp, Homo sapiens
cttcagtatcctccacatgtta

SEQ ID NO: 8566533 - DNA, 22 bp, Homo sapiens
cttcagtgatataggcttctcc

SEQ ID NO: 8566534 - DNA, 18 bp, Homo sapiens
cttcagtgacagtctggc

SEQ ID NO: 8566535 - DNA, 22 bp, Homo sapiens
cttcagtgaatgttgagtaagg

SEQ ID NO: 8566536 - DNA, 22 bp, Homo sapiens
cttgcaggattttgctgctgta

SEQ ID NO: 8566537 - DNA, 23 bp, Homo sapiens
cttgcaggaagcagatggcacac

SEQ ID NO: 8566538 - DNA, 22 bp, Homo sapiens
cttgcagcatccggtcctctct

SEQ ID NO: 8566539 - DNA, 22 bp, Homo sapiens
cttgcagccttaccaaggcatt

SEQ ID NO: 8566540 - DNA, 22 bp, Homo sapiens
cttgcagaggctgttccagatg

SEQ ID NO: 8566541 - DNA, 22 bp, Homo sapiens
cttgcagatgtgactaaattaa

SEQ ID NO: 8566542 - DNA, 22 bp, Homo sapiens
cttgcaggcagggcctcctgga

SEQ ID NO: 8566543 - DNA, 22 bp, Homo sapiens
cttgcaggcagggacactgtct

SEQ ID NO: 8566544 - DNA, 22 bp, Homo sapiens
cttgcaggcagggcctcctgga

SEQ ID NO: 8566545 - DNA, 22 bp, Homo sapiens
cttgcaggcccagccttacaag

SEQ ID NO: 8566546 - DNA, 23 bp, Homo sapiens
cttgcagggctggaggcttagaa

SEQ ID NO: 8566547 - DNA, 23 bp, Homo sapiens
cttgcagggctggaggcttagaa

SEQ ID NO: 8566548 - DNA, 22 bp, Homo sapiens
cttgatgtataagttgatatgt

SEQ ID NO: 8566549 - DNA, 22 bp, Homo sapiens
cttgcacaggatctgaagtggg

SEQ ID NO: 8566550 - DNA, 22 bp, Homo sapiens
cttgcacagaactcttagaggt

SEQ ID NO: 8566551 - DNA, 22 bp, Homo sapiens
cttgactttgccttttaaatgt

SEQ ID NO: 8566552 - DNA, 22 bp, Homo sapiens
cttgatctacatagtgaaaccc

SEQ ID NO: 8566553 - DNA, 22 bp, Homo sapiens
cttgagaaaggaacaggaagct

SEQ ID NO: 8566554 - DNA, 22 bp, Homo sapiens
cttgatggaggggccaggcttt

SEQ ID NO: 8566555 - DNA, 22 bp, Homo sapiens
cttcctggatgagcaggctgat

SEQ ID NO: 8566556 - DNA, 22 bp, Homo sapiens
cttcctggatgaagcccagcat

SEQ ID NO: 8566557 - DNA, 22 bp, Homo sapiens
cttcctggatgagcaggctgat

SEQ ID NO: 8566558 - DNA, 22 bp, Homo sapiens
cttcctggatgagcaggctgat

SEQ ID NO: 8566559 - DNA, 19 bp, Homo sapiens
cttcctggaggagagcctc

SEQ ID NO: 8566560 - DNA, 22 bp, Homo sapiens
cttcctgcccacttcctgctgg

SEQ ID NO: 8566561 - DNA, 22 bp, Homo sapiens
cttcctgcccacttcctgctgg

SEQ ID NO: 8566562 - DNA, 22 bp, Homo sapiens
cttcctgcattgtgccagagtt

SEQ ID NO: 8566563 - DNA, 22 bp, Homo sapiens
cttcctgcattgtgccagagtt

SEQ ID NO: 8566564 - DNA, 22 bp, Homo sapiens
cttcctgcaacacctgtgttgc

SEQ ID NO: 8566565 - DNA, 22 bp, Homo sapiens
cttcctgcaacacctgtgttgc

SEQ ID NO: 8566566 - DNA, 22 bp, Homo sapiens
cttcctgcaggacagccatctg

SEQ ID NO: 8566567 - DNA, 22 bp, Homo sapiens
cttcctgcaggacagccatctg

SEQ ID NO: 8566568 - DNA, 22 bp, Homo sapiens
cttcctgcatggagtctgaatg

SEQ ID NO: 8566569 - DNA, 22 bp, Homo sapiens
cttcctgggtcagcctggaggt

SEQ ID NO: 8566570 - DNA, 22 bp, Homo sapiens
cttcctgggtcagcctggaggt

SEQ ID NO: 8566571 - DNA, 22 bp, Homo sapiens
cttgacactgtcactcaggcca

SEQ ID NO: 8566572 - DNA, 22 bp, Homo sapiens
cttgacactgtcactcaggcca

SEQ ID NO: 8566573 - DNA, 22 bp, Homo sapiens
cttgacaactggcagatatata

SEQ ID NO: 8566574 - DNA, 22 bp, Homo sapiens
cttgacagaaggttttatccta

SEQ ID NO: 8566575 - DNA, 22 bp, Homo sapiens
cttcctggctcggtgcctcacc

SEQ ID NO: 8566576 - DNA, 22 bp, Homo sapiens
cttcctgggacacctaactcta

SEQ ID NO: 8566577 - DNA, 22 bp, Homo sapiens
cttcctgggcaatgttctgctt

SEQ ID NO: 8566578 - DNA, 22 bp, Homo sapiens
cttcctggcatgggtctcatga

SEQ ID NO: 8566579 - DNA, 22 bp, Homo sapiens
cttcctggcatgggtctcatga

SEQ ID NO: 8566580 - DNA, 22 bp, Homo sapiens
cttcctggctcggtgcctcacc

SEQ ID NO: 8566581 - DNA, 22 bp, Homo sapiens
cttcctggccattgccatggca

SEQ ID NO: 8566582 - DNA, 22 bp, Homo sapiens
cttgtattcccctatctctaaa

SEQ ID NO: 8566583 - DNA, 23 bp, Homo sapiens
cttgtattcactcatttgggaac

SEQ ID NO: 8566584 - DNA, 22 bp, Homo sapiens
cttgtattaagcttagagaggc

SEQ ID NO: 8566585 - DNA, 22 bp, Homo sapiens
cttgtattaggaagaatgcttt

SEQ ID NO: 8566586 - DNA, 22 bp, Homo sapiens
cttgtcctttacttgagactca

SEQ ID NO: 8566587 - DNA, 22 bp, Homo sapiens
cttgtcctttacttgagactca

SEQ ID NO: 8566588 - DNA, 22 bp, Homo sapiens
cttgtccagatgtttgttaggt

SEQ ID NO: 8566589 - DNA, 22 bp, Homo sapiens
cttgtctttatttcatattcca

SEQ ID NO: 8566590 - DNA, 21 bp, Homo sapiens
cttgtcttgcttagaatagac

SEQ ID NO: 8566591 - DNA, 22 bp, Homo sapiens
ctttatgtccaccagactgcaa

SEQ ID NO: 8566592 - DNA, 20 bp, Homo sapiens
cttgcccagggtctcctgcc

SEQ ID NO: 8566593 - DNA, 22 bp, Homo sapiens
cttgccagtgttgcagaagctc

SEQ ID NO: 8566594 - DNA, 20 bp, Homo sapiens
cttgccagttccctggcaga

SEQ ID NO: 8566595 - DNA, 22 bp, Homo sapiens
cttgccagcacttggccagctg

SEQ ID NO: 8566596 - DNA, 22 bp, Homo sapiens
cttgccagcacttggccagctg

SEQ ID NO: 8566597 - DNA, 22 bp, Homo sapiens
cttgcatgcatttgaagatcat

SEQ ID NO: 8566598 - DNA, 22 bp, Homo sapiens
cttgcagtttaggtcctctgtg

SEQ ID NO: 8566599 - DNA, 18 bp, Homo sapiens
cttgcagtgtgtggagaa

SEQ ID NO: 8566600 - DNA, 22 bp, Homo sapiens
cttgccagtgttgcagaagctc

SEQ ID NO: 8566601 - DNA, 22 bp, Homo sapiens
cttgccagggactcagtcaggg

SEQ ID NO: 8566602 - DNA, 22 bp, Homo sapiens
cttgtatacagtgtacacattg

SEQ ID NO: 8566603 - DNA, 22 bp, Homo sapiens
cttgtagctgactatcttgttc

SEQ ID NO: 8566604 - DNA, 22 bp, Homo sapiens
cttgtagctgcttcttctgaag

SEQ ID NO: 8566605 - DNA, 22 bp, Homo sapiens
cttgtagacccctggactcacg

SEQ ID NO: 8566606 - DNA, 22 bp, Homo sapiens
cttgtacattgatttctgcatt

SEQ ID NO: 8566607 - DNA, 22 bp, Homo sapiens
cttgtacattgatttctgcatt

SEQ ID NO: 8566608 - DNA, 22 bp, Homo sapiens
cttgtacatgataatctcactc

SEQ ID NO: 8566609 - DNA, 22 bp, Homo sapiens
cttgtagaattgaaatggtctc

SEQ ID NO: 8566610 - DNA, 22 bp, Homo sapiens
cttgtacattgatttctgcatt

SEQ ID NO: 8566611 - DNA, 22 bp, Homo sapiens
cttgtagaattgaaatggtctc

SEQ ID NO: 8566612 - DNA, 22 bp, Homo sapiens
cttgtacatcactggcagatgg

SEQ ID NO: 8566613 - DNA, 22 bp, Homo sapiens
cttgtacatagagaagaagcct

SEQ ID NO: 8566614 - DNA, 22 bp, Homo sapiens
cttgtacactcagtacttctag

SEQ ID NO: 8566615 - DNA, 22 bp, Homo sapiens
cttgtacaggaatccatggtat

SEQ ID NO: 8566616 - DNA, 22 bp, Homo sapiens
cttgtacactcagtacttctag

SEQ ID NO: 8566617 - DNA, 22 bp, Homo sapiens
gaaatccagttccctactctta

SEQ ID NO: 8566618 - DNA, 22 bp, Homo sapiens
gaaatcattagcaaagatatgt

SEQ ID NO: 8566619 - DNA, 22 bp, Homo sapiens
gaaatcatctgagtaataatct

SEQ ID NO: 8566620 - DNA, 22 bp, Homo sapiens
gaaatgattttagtttatcatg

SEQ ID NO: 8566621 - DNA, 22 bp, Homo sapiens
gaaatgcaaattctctctcgct

SEQ ID NO: 8566622 - DNA, 22 bp, Homo sapiens
gaaatctacgattagtgaaaat

SEQ ID NO: 8566623 - DNA, 22 bp, Homo sapiens
gaaatgcagaacctgagaccat

SEQ ID NO: 8566624 - DNA, 22 bp, Homo sapiens
gaaatgcagattctgattctgt

SEQ ID NO: 8566625 - DNA, 22 bp, Homo sapiens
gaaatgcagattctgattctgt

SEQ ID NO: 8566626 - DNA, 20 bp, Homo sapiens
gaaatgtacacattaccaca

SEQ ID NO: 8566627 - DNA, 22 bp, Homo sapiens
gaaatgtactttaaagccatcc

SEQ ID NO: 8566628 - DNA, 22 bp, Homo sapiens
gaaatgtactttaaagccatcc

SEQ ID NO: 8566629 - DNA, 20 bp, Homo sapiens
gaaatgtacacattaccaca

SEQ ID NO: 8566630 - DNA, 20 bp, Homo sapiens
gaaatgtacacattaccaca

SEQ ID NO: 8566631 - DNA, 22 bp, Homo sapiens
gaaatgtactttaaagccatcc

SEQ ID NO: 8566632 - DNA, 22 bp, Homo sapiens
gaaatgcatggatcttggcaga

SEQ ID NO: 8566633 - DNA, 22 bp, Homo sapiens
gaaatgtaattctcttgaagat

SEQ ID NO: 8566634 - DNA, 22 bp, Homo sapiens
gaaatgtaattctcttgaagat

SEQ ID NO: 8566635 - DNA, 22 bp, Homo sapiens
gaaatgcataatcttagtagat

SEQ ID NO: 8566636 - DNA, 22 bp, Homo sapiens
gaaatgcaggcttggattcagc

SEQ ID NO: 8566637 - DNA, 22 bp, Homo sapiens
gaacagtaaatttatgcagcac

SEQ ID NO: 8566638 - DNA, 22 bp, Homo sapiens
gaacagggagtacggcacattt

SEQ ID NO: 8566639 - DNA, 22 bp, Homo sapiens
gaacagcttcttgggagctggg

SEQ ID NO: 8566640 - DNA, 22 bp, Homo sapiens
gaacagcatgtaagaagctact

SEQ ID NO: 8566641 - DNA, 22 bp, Homo sapiens
gaacagctataatcatctgtcc

SEQ ID NO: 8566642 - DNA, 22 bp, Homo sapiens
gaacagctctgaagcagtaaat

SEQ ID NO: 8566643 - DNA, 22 bp, Homo sapiens
gaacagctataatcatctgtcc

SEQ ID NO: 8566644 - DNA, 22 bp, Homo sapiens
gaacagcttcttgggagctggg

SEQ ID NO: 8566645 - DNA, 22 bp, Homo sapiens
gaacagctgctagagatctgtg

SEQ ID NO: 8566646 - DNA, 22 bp, Homo sapiens
gaacagctgctagagatctgtg

SEQ ID NO: 8566647 - DNA, 22 bp, Homo sapiens
gaacagtaactgtctgctgtgt

SEQ ID NO: 8566648 - DNA, 22 bp, Homo sapiens
gaacagtatttccaggaatccc

SEQ ID NO: 8566649 - DNA, 22 bp, Homo sapiens
gaacagtatcagtagtgccagt

SEQ ID NO: 8566650 - DNA, 22 bp, Homo sapiens
gaacagtgccagcacacaataa

SEQ ID NO: 8566651 - DNA, 20 bp, Homo sapiens
gaacagtcttctgagccaca

SEQ ID NO: 8566652 - DNA, 17 bp, Homo sapiens
gaacagtgtaagacact

SEQ ID NO: 8566653 - DNA, 22 bp, Homo sapiens
gaacatttggatttgtaaattt

SEQ ID NO: 8566654 - DNA, 22 bp, Homo sapiens
gaacatttggatttgtaaattt

SEQ ID NO: 8566655 - DNA, 22 bp, Homo sapiens
gaacatttggatttgtaaattt

SEQ ID NO: 8566656 - DNA, 22 bp, Homo sapiens
gaaatatttctcttgagcccct

SEQ ID NO: 8566657 - DNA, 22 bp, Homo sapiens
gaaatatttctcttgagcccct

SEQ ID NO: 8566658 - DNA, 22 bp, Homo sapiens
gaaatatttctcttgagcccct

SEQ ID NO: 8566659 - DNA, 22 bp, Homo sapiens
gaaatatttctcttgagcccct

SEQ ID NO: 8566660 - DNA, 22 bp, Homo sapiens
gaaatatttctcttgagcccct

SEQ ID NO: 8566661 - DNA, 22 bp, Homo sapiens
gaaatatttctcttgagcccct

SEQ ID NO: 8566662 - DNA, 22 bp, Homo sapiens
gaaatcacttttttcatagttg

SEQ ID NO: 8566663 - DNA, 20 bp, Homo sapiens
gaaatcagttaatgatggtt

SEQ ID NO: 8566664 - DNA, 20 bp, Homo sapiens
gaaatcagttaatgatggtt

SEQ ID NO: 8566665 - DNA, 22 bp, Homo sapiens
ctttcattcttagatattagtg

SEQ ID NO: 8566666 - DNA, 22 bp, Homo sapiens
ctttcattcttagatattagtg

SEQ ID NO: 8566667 - DNA, 23 bp, Homo sapiens
ctttcattgtggtttcacagagc

SEQ ID NO: 8566668 - DNA, 23 bp, Homo sapiens
ctttcattgtggtttcacagagc

SEQ ID NO: 8566669 - DNA, 22 bp, Homo sapiens
ctttccaactctagtgaaattt

SEQ ID NO: 8566670 - DNA, 23 bp, Homo sapiens
ctttcattgtggtttcacagagc

SEQ ID NO: 8566671 - DNA, 22 bp, Homo sapiens
ctttcatttgataagaatgcca

SEQ ID NO: 8566672 - DNA, 22 bp, Homo sapiens
ctttcattcttagatattagtg

SEQ ID NO: 8566673 - DNA, 22 bp, Homo sapiens
ctttcattcttagatattagtg

SEQ ID NO: 8566674 - DNA, 22 bp, Homo sapiens
ctttcattcttagatattagtg

SEQ ID NO: 8566675 - DNA, 19 bp, Homo sapiens
ctttcatgtggttcttctt

SEQ ID NO: 8566676 - DNA, 22 bp, Homo sapiens
ctttcatgcagttgacaaggtg

SEQ ID NO: 8566677 - DNA, 22 bp, Homo sapiens
ctttcatgaacagacaaggaac

SEQ ID NO: 8566678 - DNA, 22 bp, Homo sapiens
ctttcagaggttactcaggaaa

SEQ ID NO: 8566679 - DNA, 18 bp, Homo sapiens
ctttcagatggatatgct

SEQ ID NO: 8566680 - DNA, 22 bp, Homo sapiens
ctttcagcatccctgggattac

SEQ ID NO: 8566681 - DNA, 18 bp, Homo sapiens
ctttcagatggatatgct

SEQ ID NO: 8566682 - DNA, 22 bp, Homo sapiens
ctttcagttagtacctagtggc

SEQ ID NO: 8566683 - DNA, 22 bp, Homo sapiens
ctttcagtctttacaaggttgc

SEQ ID NO: 8566684 - DNA, 22 bp, Homo sapiens
ctttcagttacagttacacaca

SEQ ID NO: 8566685 - DNA, 22 bp, Homo sapiens
ctttcagtcagttaactcagaa

SEQ ID NO: 8566686 - DNA, 18 bp, Homo sapiens
ctttcagtaatttcagcc

SEQ ID NO: 8566687 - DNA, 22 bp, Homo sapiens
ctttcacagccttcgttctgaa

SEQ ID NO: 8566688 - DNA, 22 bp, Homo sapiens
ctttcacagccttcgttctgaa

SEQ ID NO: 8566689 - DNA, 22 bp, Homo sapiens
ctttcacagctgtgcttatgat

SEQ ID NO: 8566690 - DNA, 22 bp, Homo sapiens
ctttcacagctgtgcttatgat

SEQ ID NO: 8566691 - DNA, 22 bp, Homo sapiens
ctttcacagcttgaaaagtatt

SEQ ID NO: 8566692 - DNA, 22 bp, Homo sapiens
ctttcacagtcctgactgagcg

SEQ ID NO: 8566693 - DNA, 22 bp, Homo sapiens
ctttcagaagaggacctttcca

SEQ ID NO: 8566694 - DNA, 22 bp, Homo sapiens
ctttcactttaatctgacacct

SEQ ID NO: 8566695 - DNA, 22 bp, Homo sapiens
ctttcactcgagctcctgcagc

SEQ ID NO: 8566696 - DNA, 22 bp, Homo sapiens
ctttcacataattgaccttgaa

SEQ ID NO: 8566697 - DNA, 22 bp, Homo sapiens
ctttcacacacatacatttgga

SEQ ID NO: 8566698 - DNA, 22 bp, Homo sapiens
ctttcacaagatttgagatgct

SEQ ID NO: 8566699 - DNA, 22 bp, Homo sapiens
ctttatgtgctgggcattaagg

SEQ ID NO: 8566700 - DNA, 18 bp, Homo sapiens
ctttatgtgcagagcttt

SEQ ID NO: 8566701 - DNA, 22 bp, Homo sapiens
ctttatgtccttgaagagttgt

SEQ ID NO: 8566702 - DNA, 22 bp, Homo sapiens
gaagataattcctacttataac

SEQ ID NO: 8566703 - DNA, 22 bp, Homo sapiens
gaagataactttaaaaagtggc

SEQ ID NO: 8566704 - DNA, 22 bp, Homo sapiens
gaagataactttaaaaagtggc

SEQ ID NO: 8566705 - DNA, 22 bp, Homo sapiens
gaagagtggttatccctgctgt

SEQ ID NO: 8566706 - DNA, 22 bp, Homo sapiens
gaagaggttcaacgtggtcatc

SEQ ID NO: 8566707 - DNA, 22 bp, Homo sapiens
gaagaggtagcattggcaggtg

SEQ ID NO: 8566708 - DNA, 22 bp, Homo sapiens
gaagaggtagcattggcaggtg

SEQ ID NO: 8566709 - DNA, 22 bp, Homo sapiens
gaagaggctttcctagggcaag

SEQ ID NO: 8566710 - DNA, 20 bp, Homo sapiens
gaagatgggtagaggcacag

SEQ ID NO: 8566711 - DNA, 22 bp, Homo sapiens
gaagatgggaatgatgagtggg

SEQ ID NO: 8566712 - DNA, 22 bp, Homo sapiens
gaagatgggaatgatgagtggg

SEQ ID NO: 8566713 - DNA, 22 bp, Homo sapiens
gaagatgggaatgatgagtggg

SEQ ID NO: 8566714 - DNA, 22 bp, Homo sapiens
gaagatcaagtgtcattctgtg

SEQ ID NO: 8566715 - DNA, 22 bp, Homo sapiens
gaagatctgcagcctcaggcga

SEQ ID NO: 8566716 - DNA, 22 bp, Homo sapiens
gaagataattcctacttataac

SEQ ID NO: 8566717 - DNA, 22 bp, Homo sapiens
gaagattgaaggctgggaatta

SEQ ID NO: 8566718 - DNA, 20 bp, Homo sapiens
gaagatgggtagaggcacag

SEQ ID NO: 8566719 - DNA, 22 bp, Homo sapiens
gaagatgtgggcccactccaga

SEQ ID NO: 8566720 - DNA, 22 bp, Homo sapiens
gaagatgtgggaactgctgaaa

SEQ ID NO: 8566721 - DNA, 22 bp, Homo sapiens
gaagatgtgcaatacaaagaaa

SEQ ID NO: 8566722 - DNA, 22 bp, Homo sapiens
gaagatttataggagcctatta

SEQ ID NO: 8566723 - DNA, 22 bp, Homo sapiens
gaagattgaaggctgggaatta

SEQ ID NO: 8566724 - DNA, 22 bp, Homo sapiens
gaagatttataaggaccttatt

SEQ ID NO: 8566725 - DNA, 22 bp, Homo sapiens
gaagatttggattccatgtcac

SEQ ID NO: 8566726 - DNA, 22 bp, Homo sapiens
gaagatttggattccatgtcac

SEQ ID NO: 8566727 - DNA, 22 bp, Homo sapiens
gaagattttctcctttaaatga

SEQ ID NO: 8566728 - DNA, 22 bp, Homo sapiens
gaagccagtactgtgctctgca

SEQ ID NO: 8566729 - DNA, 22 bp, Homo sapiens
gaagccccaaaccctcgccatc

SEQ ID NO: 8566730 - DNA, 22 bp, Homo sapiens
gaagcccatttgtacagcacat

SEQ ID NO: 8566731 - DNA, 22 bp, Homo sapiens
gaagccctatcctctcctggga

SEQ ID NO: 8566732 - DNA, 22 bp, Homo sapiens
gaagcctcaacatctctgcgtc

SEQ ID NO: 8566733 - DNA, 22 bp, Homo sapiens
gaagccctgtaggtgcaaaggt

SEQ ID NO: 8566734 - DNA, 22 bp, Homo sapiens
gaagagctgcacactggggact

SEQ ID NO: 8566735 - DNA, 22 bp, Homo sapiens
gaagagctgcacactggggact

SEQ ID NO: 8566736 - DNA, 22 bp, Homo sapiens
gaagagctgcagtttcctgggc

SEQ ID NO: 8566737 - DNA, 22 bp, Homo sapiens
gaagagctatgtccagggagca

SEQ ID NO: 8566738 - DNA, 22 bp, Homo sapiens
gaagagctccaaaaacagtgag

SEQ ID NO: 8566739 - DNA, 22 bp, Homo sapiens
gaagactactgttgcactcata

SEQ ID NO: 8566740 - DNA, 22 bp, Homo sapiens
gaagactactgttgcactcata

SEQ ID NO: 8566741 - DNA, 22 bp, Homo sapiens
gaagagctggaatccagtctgg

SEQ ID NO: 8566742 - DNA, 22 bp, Homo sapiens
gaagagctgtcagaaaagctaa

SEQ ID NO: 8566743 - DNA, 22 bp, Homo sapiens
gaagaggactgtggcatcctag

SEQ ID NO: 8566744 - DNA, 22 bp, Homo sapiens
gaagaggactgtggcatcctag

SEQ ID NO: 8566745 - DNA, 22 bp, Homo sapiens
gaagaggactgtggcatcctag

SEQ ID NO: 8566746 - DNA, 22 bp, Homo sapiens
gaagaggactgtggcatcctag

SEQ ID NO: 8566747 - DNA, 22 bp, Homo sapiens
gaagaggcaattgaataagcta

SEQ ID NO: 8566748 - DNA, 22 bp, Homo sapiens
gaagaggatgacaggagccggt

SEQ ID NO: 8566749 - DNA, 22 bp, Homo sapiens
gaagaggctttcctagggcaag

SEQ ID NO: 8566750 - DNA, 22 bp, Homo sapiens
gaagaggctttcctagggcaag

SEQ ID NO: 8566751 - DNA, 22 bp, Homo sapiens
gaagacattttatgcatactct

SEQ ID NO: 8566752 - DNA, 22 bp, Homo sapiens
gaagacgagataaaatggtgtc

SEQ ID NO: 8566753 - DNA, 22 bp, Homo sapiens
gaagacatgtttttaatatgta

SEQ ID NO: 8566754 - DNA, 22 bp, Homo sapiens
gaagacatgtggattctagttt

SEQ ID NO: 8566755 - DNA, 22 bp, Homo sapiens
gaagacatgtttttaatatgta

SEQ ID NO: 8566756 - DNA, 21 bp, Homo sapiens
gaagacacataacctctctcc

SEQ ID NO: 8566757 - DNA, 22 bp, Homo sapiens
gaagacactaaactggggcttc

SEQ ID NO: 8566758 - DNA, 22 bp, Homo sapiens
gaagacactaaggcccagggag

SEQ ID NO: 8566759 - DNA, 22 bp, Homo sapiens
gaagacactctgcagagttatc

SEQ ID NO: 8566760 - DNA, 22 bp, Homo sapiens
gaagacatcatggagaggatag

SEQ ID NO: 8566761 - DNA, 22 bp, Homo sapiens
gaagacatcgtgtggactaaca

SEQ ID NO: 8566762 - DNA, 22 bp, Homo sapiens
gaagacatcatggagaggatag

SEQ ID NO: 8566763 - DNA, 22 bp, Homo sapiens
gaaccacaagattcaaaggggt

SEQ ID NO: 8566764 - DNA, 22 bp, Homo sapiens
gaaccacaatgtgaagaaggag

SEQ ID NO: 8566765 - DNA, 21 bp, Homo sapiens
gaacatttgggttgtttctac

SEQ ID NO: 8566766 - DNA, 21 bp, Homo sapiens
gaacatttgggttgtttctac

SEQ ID NO: 8566767 - DNA, 21 bp, Homo sapiens
gaacatttgggttgtttctac

SEQ ID NO: 8566768 - DNA, 22 bp, Homo sapiens
gaacatttggcatgagaatttg

SEQ ID NO: 8566769 - DNA, 20 bp, Homo sapiens
gaacatttggccatactgag

SEQ ID NO: 8566770 - DNA, 22 bp, Homo sapiens
gaaccagcagactttgacaggt

SEQ ID NO: 8566771 - DNA, 22 bp, Homo sapiens
gaagacacaattggtgggtcca

SEQ ID NO: 8566772 - DNA, 21 bp, Homo sapiens
gaacccagcagcagtgctctg

SEQ ID NO: 8566773 - DNA, 22 bp, Homo sapiens
gacaagactggtttatttaagg

SEQ ID NO: 8566774 - DNA, 22 bp, Homo sapiens
gacaagactggtttatttaagg

SEQ ID NO: 8566775 - DNA, 22 bp, Homo sapiens
gacaagacattggtaaagatat

SEQ ID NO: 8566776 - DNA, 22 bp, Homo sapiens
gacaagacatgtgatgacatca

SEQ ID NO: 8566777 - DNA, 22 bp, Homo sapiens
gacaagacatgtgatgacatca

SEQ ID NO: 8566778 - DNA, 22 bp, Homo sapiens
gacaagactatgtagaaagtat

SEQ ID NO: 8566779 - DNA, 22 bp, Homo sapiens
gacaagactatgtagaaagtat

SEQ ID NO: 8566780 - DNA, 22 bp, Homo sapiens
gacaagacattggtaaagatat

SEQ ID NO: 8566781 - DNA, 22 bp, Homo sapiens
gacaagacagcttgcagacaac

SEQ ID NO: 8566782 - DNA, 22 bp, Homo sapiens
gacaagacagcttgcagacaac

SEQ ID NO: 8566783 - DNA, 17 bp, Homo sapiens
gacaagacagaattcat

SEQ ID NO: 8566784 - DNA, 17 bp, Homo sapiens
gacaagacagaattcat

SEQ ID NO: 8566785 - DNA, 22 bp, Homo sapiens
gacaagacacctctctccatcc

SEQ ID NO: 8566786 - DNA, 22 bp, Homo sapiens
gacaagacacctctctccatcc

SEQ ID NO: 8566787 - DNA, 22 bp, Homo sapiens
gacaaccgagcagctgtgggaa

SEQ ID NO: 8566788 - DNA, 22 bp, Homo sapiens
gaatattagtatcagttatacc

SEQ ID NO: 8566789 - DNA, 22 bp, Homo sapiens
gaatatcccgctatgcaaagta

SEQ ID NO: 8566790 - DNA, 22 bp, Homo sapiens
gaatatatttctcttaccttta

SEQ ID NO: 8566791 - DNA, 22 bp, Homo sapiens
gaatatatttctcttaccttta

SEQ ID NO: 8566792 - DNA, 22 bp, Homo sapiens
gaatatatttctcttaccttta

SEQ ID NO: 8566793 - DNA, 18 bp, Homo sapiens
gaatatctagcacatagt

SEQ ID NO: 8566794 - DNA, 22 bp, Homo sapiens
gaatatcccgctatgcaaagta

SEQ ID NO: 8566795 - DNA, 22 bp, Homo sapiens
gaatatcccgctatgcaaagta

SEQ ID NO: 8566796 - DNA, 22 bp, Homo sapiens
gaatatattggtgaaaatagtt

SEQ ID NO: 8566797 - DNA, 22 bp, Homo sapiens
gaatatattggtgaaaatagtt

SEQ ID NO: 8566798 - DNA, 22 bp, Homo sapiens
gaatatattggtgaaaatagtt

SEQ ID NO: 8566799 - DNA, 22 bp, Homo sapiens
gaatatattggtgaaaatagtt

SEQ ID NO: 8566800 - DNA, 22 bp, Homo sapiens
gaatatattggtgaaaatagtt

SEQ ID NO: 8566801 - DNA, 22 bp, Homo sapiens
gaatatattattcagcttttca

SEQ ID NO: 8566802 - DNA, 22 bp, Homo sapiens
gaatagcttccttttttccaaa

SEQ ID NO: 8566803 - DNA, 22 bp, Homo sapiens
gaatagctgtaggctagtgtct

SEQ ID NO: 8566804 - DNA, 22 bp, Homo sapiens
gaatagcttagattccttagtg

SEQ ID NO: 8566805 - DNA, 22 bp, Homo sapiens
gaatagcttccttttttccaaa

SEQ ID NO: 8566806 - DNA, 22 bp, Homo sapiens
gaatagatatccttgagggtct

SEQ ID NO: 8566807 - DNA, 22 bp, Homo sapiens
gaatagatagcttggatggttg

SEQ ID NO: 8566808 - DNA, 22 bp, Homo sapiens
gaatagattatacttgaagcat

SEQ ID NO: 8566809 - DNA, 22 bp, Homo sapiens
gaatacattggaaatcagaata

SEQ ID NO: 8566810 - DNA, 22 bp, Homo sapiens
gaatacattggaaatcagaata

SEQ ID NO: 8566811 - DNA, 22 bp, Homo sapiens
gaatacattggaaatcagaata

SEQ ID NO: 8566812 - DNA, 22 bp, Homo sapiens
gaatacttttgttaggaaaacg

SEQ ID NO: 8566813 - DNA, 22 bp, Homo sapiens
gaagttgatagagtacatgatt

SEQ ID NO: 8566814 - DNA, 22 bp, Homo sapiens
gaagttgtaagcctgggaaggt

SEQ ID NO: 8566815 - DNA, 22 bp, Homo sapiens
gaagtttagaagtgacaggttt

SEQ ID NO: 8566816 - DNA, 22 bp, Homo sapiens
gaaggaaaacagatctgcctga

SEQ ID NO: 8566817 - DNA, 22 bp, Homo sapiens
gaaggaaaacagatctgcctga

SEQ ID NO: 8566818 - DNA, 22 bp, Homo sapiens
gaaggaaaacagatctgcctga

SEQ ID NO: 8566819 - DNA, 22 bp, Homo sapiens
gaaggaaaaatactctgtaagg

SEQ ID NO: 8566820 - DNA, 22 bp, Homo sapiens
gaagcttcgaaagagtgatttc

SEQ ID NO: 8566821 - DNA, 22 bp, Homo sapiens
gaagcttctggcatttctcaaa

SEQ ID NO: 8566822 - DNA, 22 bp, Homo sapiens
gaagcttcgtggctcttcaaat

SEQ ID NO: 8566823 - DNA, 22 bp, Homo sapiens
gaagcctcaacatctctgcgtc

SEQ ID NO: 8566824 - DNA, 22 bp, Homo sapiens
gaagcctcaacatctctgcgtc

SEQ ID NO: 8566825 - DNA, 22 bp, Homo sapiens
gaagctgtgttgatggcatgga

SEQ ID NO: 8566826 - DNA, 22 bp, Homo sapiens
gaagctgtgttgatggcatgga

SEQ ID NO: 8566827 - DNA, 19 bp, Homo sapiens
gaatacagataataagcag

SEQ ID NO: 8566828 - DNA, 22 bp, Homo sapiens
gaatacaagcctgccacctgga

SEQ ID NO: 8566829 - DNA, 22 bp, Homo sapiens
gaatacaagccaggcacaaggc

SEQ ID NO: 8566830 - DNA, 22 bp, Homo sapiens
gaatacaccaaggaatcagaat

SEQ ID NO: 8566831 - DNA, 22 bp, Homo sapiens
gaataaactcctcagcttcctt

SEQ ID NO: 8566832 - DNA, 22 bp, Homo sapiens
gaagttttagtcaaaatgtaga

SEQ ID NO: 8566833 - DNA, 22 bp, Homo sapiens
gaataacattttttcctttaca

SEQ ID NO: 8566834 - DNA, 22 bp, Homo sapiens
gaataacagcaagtttgcaggc

SEQ ID NO: 8566835 - DNA, 22 bp, Homo sapiens
gaataacattggaaccctgaag

SEQ ID NO: 8566836 - DNA, 22 bp, Homo sapiens
gaagtttttgtagagacagggt

SEQ ID NO: 8566837 - DNA, 22 bp, Homo sapiens
gaagtttagagtgttgtaattt

SEQ ID NO: 8566838 - DNA, 22 bp, Homo sapiens
gaagtttaggttcttatgttta

SEQ ID NO: 8566839 - DNA, 22 bp, Homo sapiens
gaagtttatttcaatctattca

SEQ ID NO: 8566840 - DNA, 22 bp, Homo sapiens
gaccctgtttctacaaataatt

SEQ ID NO: 8566841 - DNA, 22 bp, Homo sapiens
gaccctgtttctacaaataatt

SEQ ID NO: 8566842 - DNA, 22 bp, Homo sapiens
gaccctgtttctacaaataatt

SEQ ID NO: 8566843 - DNA, 22 bp, Homo sapiens
gacccttagaatgtgatcttat

SEQ ID NO: 8566844 - DNA, 22 bp, Homo sapiens
gaccctggctggagctggcctg

SEQ ID NO: 8566845 - DNA, 22 bp, Homo sapiens
gaccctggggaccatctagccc

SEQ ID NO: 8566846 - DNA, 22 bp, Homo sapiens
gaccctggctggagctggcctg

SEQ ID NO: 8566847 - DNA, 22 bp, Homo sapiens
gaccctggtgggcactggcacc

SEQ ID NO: 8566848 - DNA, 22 bp, Homo sapiens
gaccctggtgggcactggcacc

SEQ ID NO: 8566849 - DNA, 22 bp, Homo sapiens
gaccctgtttctacaaataatt

SEQ ID NO: 8566850 - DNA, 22 bp, Homo sapiens
gaccctggtgtccaggtcctgc

SEQ ID NO: 8566851 - DNA, 22 bp, Homo sapiens
gacagtatttaactagttcatt

SEQ ID NO: 8566852 - DNA, 22 bp, Homo sapiens
gacagtcccccagcagcaaacc

SEQ ID NO: 8566853 - DNA, 22 bp, Homo sapiens
gacagtcacttccaggagagga

SEQ ID NO: 8566854 - DNA, 22 bp, Homo sapiens
gacccagtgactcgtctctgtg

SEQ ID NO: 8566855 - DNA, 22 bp, Homo sapiens
gacccatataggaccctccaaa

SEQ ID NO: 8566856 - DNA, 22 bp, Homo sapiens
gaccctggcaggtagcctcaca

SEQ ID NO: 8566857 - DNA, 22 bp, Homo sapiens
gaccctggcaggtagcctcaca

SEQ ID NO: 8566858 - DNA, 22 bp, Homo sapiens
gacagtaagtcagagacttggt

SEQ ID NO: 8566859 - DNA, 22 bp, Homo sapiens
gacagtatccaggtggtgaaga

SEQ ID NO: 8566860 - DNA, 22 bp, Homo sapiens
gacagtagtaaagctaggacca

SEQ ID NO: 8566861 - DNA, 22 bp, Homo sapiens
gacagtatccaggtggtgaaga

SEQ ID NO: 8566862 - DNA, 22 bp, Homo sapiens
gacagggtccaaaggcagggga

SEQ ID NO: 8566863 - DNA, 22 bp, Homo sapiens
gacagggtccaaaggcagggga

SEQ ID NO: 8566864 - DNA, 22 bp, Homo sapiens
gacagggtacgggctaggcaca

SEQ ID NO: 8566865 - DNA, 22 bp, Homo sapiens
gacagggtacgggctaggcaca

SEQ ID NO: 8566866 - DNA, 22 bp, Homo sapiens
gacagggtccaaaggcagggga

SEQ ID NO: 8566867 - DNA, 22 bp, Homo sapiens
gacagggtggctgatagggctc

SEQ ID NO: 8566868 - DNA, 22 bp, Homo sapiens
gacagggtccaaaggcagggga

SEQ ID NO: 8566869 - DNA, 22 bp, Homo sapiens
gacaggtaaagatggtggcagg

SEQ ID NO: 8566870 - DNA, 23 bp, Homo sapiens
gacaggtaagggttgggagaatc

SEQ ID NO: 8566871 - DNA, 22 bp, Homo sapiens
gacagggtggctgatagggctc

SEQ ID NO: 8566872 - DNA, 22 bp, Homo sapiens
gacagggtttgcaaggacttcg

SEQ ID NO: 8566873 - DNA, 22 bp, Homo sapiens
gacaggtatttgagagctggga

SEQ ID NO: 8566874 - DNA, 22 bp, Homo sapiens
gacaggtgaaacagcaaggtaa

SEQ ID NO: 8566875 - DNA, 22 bp, Homo sapiens
gacaggtgagatgaggaacacc

SEQ ID NO: 8566876 - DNA, 21 bp, Homo sapiens
gacaggtgattcagagcaggg

SEQ ID NO: 8566877 - DNA, 22 bp, Homo sapiens
gacaggttgaagtatcaaaggt

SEQ ID NO: 8566878 - DNA, 18 bp, Homo sapiens
gacaggtgggtgagacca

SEQ ID NO: 8566879 - DNA, 22 bp, Homo sapiens
gacaggtggggaaactaaggta

SEQ ID NO: 8566880 - DNA, 20 bp, Homo sapiens
gacaggtgctaaagaggggc

SEQ ID NO: 8566881 - DNA, 22 bp, Homo sapiens
gacaggtgctaagggacctggc

SEQ ID NO: 8566882 - DNA, 22 bp, Homo sapiens
gacaggggtccctctgggctgt

SEQ ID NO: 8566883 - DNA, 22 bp, Homo sapiens
gacaggggtccctctgggctgt

SEQ ID NO: 8566884 - DNA, 22 bp, Homo sapiens
gacaggggtccctctgggctgt

SEQ ID NO: 8566885 - DNA, 22 bp, Homo sapiens
gacaggggtccctctgggctgt

SEQ ID NO: 8566886 - DNA, 22 bp, Homo sapiens
gacaggggctttgcatgcttta

SEQ ID NO: 8566887 - DNA, 21 bp, Homo sapiens
gacaggggaagaagcaaggag

SEQ ID NO: 8566888 - DNA, 21 bp, Homo sapiens
gacaggggaagaagcaaggag

SEQ ID NO: 8566889 - DNA, 21 bp, Homo sapiens
gacaggggaagaagcaaggag

SEQ ID NO: 8566890 - DNA, 21 bp, Homo sapiens
gacaggggccatgggtttcta

SEQ ID NO: 8566891 - DNA, 21 bp, Homo sapiens
gacaggggccatgggtttcta

SEQ ID NO: 8566892 - DNA, 21 bp, Homo sapiens
gacaggggccatgggtttcta

SEQ ID NO: 8566893 - DNA, 23 bp, Homo sapiens
gacagggctgacttggcagctgc

SEQ ID NO: 8566894 - DNA, 22 bp, Homo sapiens
gacagggctgtgggaggagcag

SEQ ID NO: 8566895 - DNA, 22 bp, Homo sapiens
gacagggctgtgggaggagcag

SEQ ID NO: 8566896 - DNA, 22 bp, Homo sapiens
gacagggctgtgggaggagcag

SEQ ID NO: 8566897 - DNA, 22 bp, Homo sapiens
gacagggctgtgggaggagcag

SEQ ID NO: 8566898 - DNA, 22 bp, Homo sapiens
gacaggcttcatgatggcagga

SEQ ID NO: 8566899 - DNA, 22 bp, Homo sapiens
gacaggcttagggagggtgctc

SEQ ID NO: 8566900 - DNA, 22 bp, Homo sapiens
gacaggcttagggagggtgctc

SEQ ID NO: 8566901 - DNA, 22 bp, Homo sapiens
gacaggcttcatcctcagagtt

SEQ ID NO: 8566902 - DNA, 22 bp, Homo sapiens
gacaggctgtgatggccgggag

SEQ ID NO: 8566903 - DNA, 22 bp, Homo sapiens
gacaggcttagggagggtgctc

SEQ ID NO: 8566904 - DNA, 22 bp, Homo sapiens
gacaggctggcaatgccctgct

SEQ ID NO: 8566905 - DNA, 17 bp, Homo sapiens
gacaggctcagtgacga

SEQ ID NO: 8566906 - DNA, 22 bp, Homo sapiens
gacaggctttgagtcccagaac

SEQ ID NO: 8566907 - DNA, 22 bp, Homo sapiens
gacaggcttcctaagtgccaga

SEQ ID NO: 8566908 - DNA, 22 bp, Homo sapiens
gacaggcttcctaagtgccaga

SEQ ID NO: 8566909 - DNA, 22 bp, Homo sapiens
gacaggctaggttgctgtcctc

SEQ ID NO: 8566910 - DNA, 22 bp, Homo sapiens
gacaggcccgagtagctgatga

SEQ ID NO: 8566911 - DNA, 22 bp, Homo sapiens
gacacagagataggcctgtgtt

SEQ ID NO: 8566912 - DNA, 22 bp, Homo sapiens
gacaggccaggggctgaggtgg

SEQ ID NO: 8566913 - DNA, 22 bp, Homo sapiens
gacacagaatttactcccgata

SEQ ID NO: 8566914 - DNA, 22 bp, Homo sapiens
gacacagaatttactcccgata

SEQ ID NO: 8566915 - DNA, 22 bp, Homo sapiens
gacacagacagttagaggtaat

SEQ ID NO: 8566916 - DNA, 22 bp, Homo sapiens
gacacagagacttgcagttgta

SEQ ID NO: 8566917 - DNA, 22 bp, Homo sapiens
gacacagagataggcctgtgtt

SEQ ID NO: 8566918 - DNA, 22 bp, Homo sapiens
gacacagacagttagaggtaat

SEQ ID NO: 8566919 - DNA, 22 bp, Homo sapiens
gacacagaccaccaggccctgg

SEQ ID NO: 8566920 - DNA, 22 bp, Homo sapiens
gacacagaccaccaggccctgg

SEQ ID NO: 8566921 - DNA, 22 bp, Homo sapiens
gacacagaccaccaggccctgg

SEQ ID NO: 8566922 - DNA, 22 bp, Homo sapiens
gacacagaattcccctccaagt

SEQ ID NO: 8566923 - DNA, 22 bp, Homo sapiens
gacacagaatgggtgctcagta

SEQ ID NO: 8566924 - DNA, 22 bp, Homo sapiens
gacacagaatgggtgctcagta

SEQ ID NO: 8566925 - DNA, 22 bp, Homo sapiens
gacacagaaggtcacatgttca

SEQ ID NO: 8566926 - DNA, 22 bp, Homo sapiens
gacacagaaggtcacatgttca

SEQ ID NO: 8566927 - DNA, 22 bp, Homo sapiens
gacaataaaatgatcttacagt

SEQ ID NO: 8566928 - DNA, 22 bp, Homo sapiens
gacaaggcaaccagggaggctt

SEQ ID NO: 8566929 - DNA, 22 bp, Homo sapiens
gacaaggaaattactagctgga

SEQ ID NO: 8566930 - DNA, 22 bp, Homo sapiens
gacaagctcttgtttcatggtt

SEQ ID NO: 8566931 - DNA, 22 bp, Homo sapiens
gacaagggttctgcagagcctg

SEQ ID NO: 8566932 - DNA, 22 bp, Homo sapiens
gagcagcagctgggccaggttc

SEQ ID NO: 8566933 - DNA, 22 bp, Homo sapiens
gagcagcaggtggggctggctt

SEQ ID NO: 8566934 - DNA, 22 bp, Homo sapiens
gagcagcaggtggctgtgatgg

SEQ ID NO: 8566935 - DNA, 22 bp, Homo sapiens
gagcagcagttgttacaatgat

SEQ ID NO: 8566936 - DNA, 22 bp, Homo sapiens
gagcagcaggtggggctggctt

SEQ ID NO: 8566937 - DNA, 22 bp, Homo sapiens
gagcagcaggtggggctggctt

SEQ ID NO: 8566938 - DNA, 22 bp, Homo sapiens
gagcagcaagcactcaaaggct

SEQ ID NO: 8566939 - DNA, 18 bp, Homo sapiens
gagcagaggctcaactgg

SEQ ID NO: 8566940 - DNA, 22 bp, Homo sapiens
gagcagagtctatttccacact

SEQ ID NO: 8566941 - DNA, 22 bp, Homo sapiens
gagcagagtctatttccacact

SEQ ID NO: 8566942 - DNA, 22 bp, Homo sapiens
gagcagagtctatttccacact

SEQ ID NO: 8566943 - DNA, 22 bp, Homo sapiens
gagcagatgtgtgccaggatgc

SEQ ID NO: 8566944 - DNA, 22 bp, Homo sapiens
gagcagatgtgtgccaggatgc

SEQ ID NO: 8566945 - DNA, 22 bp, Homo sapiens
gagcagatctcaggccttctgt

SEQ ID NO: 8566946 - DNA, 22 bp, Homo sapiens
gagatgtacaatgtgtattaat

SEQ ID NO: 8566947 - DNA, 22 bp, Homo sapiens
gagattggatttaatggccaaa

SEQ ID NO: 8566948 - DNA, 22 bp, Homo sapiens
gagattggcctggcttgccaac

SEQ ID NO: 8566949 - DNA, 22 bp, Homo sapiens
gagattgggtcttgctctgtca

SEQ ID NO: 8566950 - DNA, 21 bp, Homo sapiens
gagatttagaaggatcaattt

SEQ ID NO: 8566951 - DNA, 22 bp, Homo sapiens
gagattctgtagtcaggcatct

SEQ ID NO: 8566952 - DNA, 20 bp, Homo sapiens
gagatggacagatgaagggg

SEQ ID NO: 8566953 - DNA, 22 bp, Homo sapiens
gagatggaatctgtgtggaggg

SEQ ID NO: 8566954 - DNA, 22 bp, Homo sapiens
gagatgctttgtgtatagacaa

SEQ ID NO: 8566955 - DNA, 22 bp, Homo sapiens
gagatggttgggttaacaacta

SEQ ID NO: 8566956 - DNA, 22 bp, Homo sapiens
gagatggagtctttttctgtca

SEQ ID NO: 8566957 - DNA, 22 bp, Homo sapiens
gagatggagtctttttctgtca

SEQ ID NO: 8566958 - DNA, 22 bp, Homo sapiens
gagatggagtctttttctgtca

SEQ ID NO: 8566959 - DNA, 22 bp, Homo sapiens
gagatggagtctttttctgtca

SEQ ID NO: 8566960 - DNA, 22 bp, Homo sapiens
gagatggagtctttttctgtca

SEQ ID NO: 8566961 - DNA, 22 bp, Homo sapiens
gagccacagtggtggcccacgt

SEQ ID NO: 8566962 - DNA, 22 bp, Homo sapiens
gagccaaatgtgcagacattgt

SEQ ID NO: 8566963 - DNA, 22 bp, Homo sapiens
gagccaagggcgtgctggagag

SEQ ID NO: 8566964 - DNA, 22 bp, Homo sapiens
gagcagctgtccccaaagcttc

SEQ ID NO: 8566965 - DNA, 22 bp, Homo sapiens
gagccagagctacaagtgtctg

SEQ ID NO: 8566966 - DNA, 22 bp, Homo sapiens
gagccagagctacaagtgtctg

SEQ ID NO: 8566967 - DNA, 22 bp, Homo sapiens
gagccagcagccggcaccacca

SEQ ID NO: 8566968 - DNA, 22 bp, Homo sapiens
gagccagccgcaagagctgtga

SEQ ID NO: 8566969 - DNA, 22 bp, Homo sapiens
gagccagccgcaagagctgtga

SEQ ID NO: 8566970 - DNA, 22 bp, Homo sapiens
gagccagagatccaggatggct

SEQ ID NO: 8566971 - DNA, 22 bp, Homo sapiens
gagccagagatccaggatggct

SEQ ID NO: 8566972 - DNA, 22 bp, Homo sapiens
gagccagaaaagctgcctgact

SEQ ID NO: 8566973 - DNA, 22 bp, Homo sapiens
gagccaggttggaggctgcagt

SEQ ID NO: 8566974 - DNA, 22 bp, Homo sapiens
gagccaggttggaggctgcagt

SEQ ID NO: 8566975 - DNA, 22 bp, Homo sapiens
gagccaggttggaggctgcagt

SEQ ID NO: 8566976 - DNA, 22 bp, Homo sapiens
gagccaggttggaggctgcagt

SEQ ID NO: 8566977 - DNA, 22 bp, Homo sapiens
gagccaggtcgggccgcggcga

SEQ ID NO: 8566978 - DNA, 16 bp, Homo sapiens
gagccaggtgccttga

SEQ ID NO: 8566979 - DNA, 22 bp, Homo sapiens
gagccagggctgtgagctgagc

SEQ ID NO: 8566980 - DNA, 22 bp, Homo sapiens
gagccaggggtcagctccgagg

SEQ ID NO: 8566981 - DNA, 22 bp, Homo sapiens
gagccagggtttgaaactagac

SEQ ID NO: 8566982 - DNA, 22 bp, Homo sapiens
gagccaggggtcagctccgagg

SEQ ID NO: 8566983 - DNA, 18 bp, Homo sapiens
gagagggatccctcagga

SEQ ID NO: 8566984 - DNA, 22 bp, Homo sapiens
gagatctctagcacttcctgta

SEQ ID NO: 8566985 - DNA, 22 bp, Homo sapiens
gagatgagtgggggatctctca

SEQ ID NO: 8566986 - DNA, 22 bp, Homo sapiens
gagatgacatgcctgttgtagg

SEQ ID NO: 8566987 - DNA, 22 bp, Homo sapiens
gagatgaatgtaaacaaaggca

SEQ ID NO: 8566988 - DNA, 22 bp, Homo sapiens
gagatgcaagcaagtctatttt

SEQ ID NO: 8566989 - DNA, 22 bp, Homo sapiens
gagatgctatggctattcccct

SEQ ID NO: 8566990 - DNA, 22 bp, Homo sapiens
gagatgctgtcaggctatctgt

SEQ ID NO: 8566991 - DNA, 22 bp, Homo sapiens
gagagggagccagccaggaacc

SEQ ID NO: 8566992 - DNA, 22 bp, Homo sapiens
gagagggagccagccaggaacc

SEQ ID NO: 8566993 - DNA, 22 bp, Homo sapiens
gagatcctgtaggcagctaaga

SEQ ID NO: 8566994 - DNA, 22 bp, Homo sapiens
gagagggagccagccaggaacc

SEQ ID NO: 8566995 - DNA, 22 bp, Homo sapiens
gagaggcttgtgtgaagaacaa

SEQ ID NO: 8566996 - DNA, 22 bp, Homo sapiens
gagaggcttgtgtgaagaacaa

SEQ ID NO: 8566997 - DNA, 22 bp, Homo sapiens
gagaggctgtgtgccattgttg

SEQ ID NO: 8566998 - DNA, 22 bp, Homo sapiens
gagaggcttaagggctgtgaag

SEQ ID NO: 8566999 - DNA, 22 bp, Homo sapiens
gagaggctccatgaccccggca

SEQ ID NO: 8567000 - DNA, 22 bp, Homo sapiens
gagaggctgggttggagatcga

SEQ ID NO: 8567001 - DNA, 22 bp, Homo sapiens
gagaggctggtaaagtctgaac

SEQ ID NO: 8567002 - DNA, 18 bp, Homo sapiens
gagaggcccggctgtgcc

SEQ ID NO: 8567003 - DNA, 18 bp, Homo sapiens
gagaggcccggctgtgcc

SEQ ID NO: 8567004 - DNA, 22 bp, Homo sapiens
gagaggcctgagaggctgcgga

SEQ ID NO: 8567005 - DNA, 22 bp, Homo sapiens
gagaggctatgaggttctgtgt

SEQ ID NO: 8567006 - DNA, 22 bp, Homo sapiens
gagaggctcagggacttgctga

SEQ ID NO: 8567007 - DNA, 19 bp, Homo sapiens
gagaggcctgtgcttgaag

SEQ ID NO: 8567008 - DNA, 22 bp, Homo sapiens
gagaggccatggctgtgcagtg

SEQ ID NO: 8567009 - DNA, 22 bp, Homo sapiens
gagaggccatggctgtgcagtg

SEQ ID NO: 8567010 - DNA, 22 bp, Homo sapiens
gagaggccatggctgtgcagtg

SEQ ID NO: 8567011 - DNA, 22 bp, Homo sapiens
gagaggccatggggtgggatgc

SEQ ID NO: 8567012 - DNA, 22 bp, Homo sapiens
gagaggccaaaatccctgcccc

SEQ ID NO: 8567013 - DNA, 22 bp, Homo sapiens
gagaggccaaaatccctgcccc

SEQ ID NO: 8567014 - DNA, 22 bp, Homo sapiens
gagaggccaagggatccgtgag

SEQ ID NO: 8567015 - DNA, 22 bp, Homo sapiens
gagaggccacctgacgagcagt

SEQ ID NO: 8567016 - DNA, 22 bp, Homo sapiens
gagaggccacctgacgagcagt

SEQ ID NO: 8567017 - DNA, 22 bp, Homo sapiens
gagaggcatggaacagattctt

SEQ ID NO: 8567018 - DNA, 22 bp, Homo sapiens
gagaggcatggaacagattctt

SEQ ID NO: 8567019 - DNA, 22 bp, Homo sapiens
gagaggcatggaacagattctt

SEQ ID NO: 8567020 - DNA, 22 bp, Homo sapiens
gagacacaaacacatttagagg

SEQ ID NO: 8567021 - DNA, 22 bp, Homo sapiens
gacctcatgatccacctgcctt

SEQ ID NO: 8567022 - DNA, 22 bp, Homo sapiens
gacctccgtgtacacctcccag

SEQ ID NO: 8567023 - DNA, 22 bp, Homo sapiens
gacctccgtgtacacctcccag

SEQ ID NO: 8567024 - DNA, 22 bp, Homo sapiens
gacctcagtgaatggtcatgta

SEQ ID NO: 8567025 - DNA, 22 bp, Homo sapiens
gacctcatgatccacctgcctt

SEQ ID NO: 8567026 - DNA, 22 bp, Homo sapiens
gacctcatgatccacctgcctt

SEQ ID NO: 8567027 - DNA, 22 bp, Homo sapiens
gacctcatgatccacctgcctt

SEQ ID NO: 8567028 - DNA, 22 bp, Homo sapiens
gagaaggagtagctgacctggg

SEQ ID NO: 8567029 - DNA, 22 bp, Homo sapiens
gagaaggatgaggaaatggtat

SEQ ID NO: 8567030 - DNA, 22 bp, Homo sapiens
gagaaggatgtggctcatagct

SEQ ID NO: 8567031 - DNA, 22 bp, Homo sapiens
gagaaggagctcaaatatggct

SEQ ID NO: 8567032 - DNA, 22 bp, Homo sapiens
gagaaggagctccttggggtct

SEQ ID NO: 8567033 - DNA, 22 bp, Homo sapiens
gagaaggaggcgaagcgtgtgc

SEQ ID NO: 8567034 - DNA, 22 bp, Homo sapiens
gagaaggaggcgaagcgtgtgc

SEQ ID NO: 8567035 - DNA, 22 bp, Homo sapiens
gacctgaaatttgtggtagaac

SEQ ID NO: 8567036 - DNA, 22 bp, Homo sapiens
gacctgaaatgggggcctgtcc

SEQ ID NO: 8567037 - DNA, 22 bp, Homo sapiens
gagaaggactacacatctggcc

SEQ ID NO: 8567038 - DNA, 22 bp, Homo sapiens
gacctgaaagtgtgggcgacct

SEQ ID NO: 8567039 - DNA, 22 bp, Homo sapiens
gacctgaaagagattaaatgac

SEQ ID NO: 8567040 - DNA, 22 bp, Homo sapiens
gacctcttgcaccctggctctt

SEQ ID NO: 8567041 - DNA, 22 bp, Homo sapiens
gacctctcaggaatctcacatg

SEQ ID NO: 8567042 - DNA, 22 bp, Homo sapiens
gacctctgaaggcagagcaggg

SEQ ID NO: 8567043 - DNA, 22 bp, Homo sapiens
gagaagggatatgccactctcg

SEQ ID NO: 8567044 - DNA, 22 bp, Homo sapiens
gagaagggcttgggagtcaaca

SEQ ID NO: 8567045 - DNA, 22 bp, Homo sapiens
gagaagggggctcgagtgtcct

SEQ ID NO: 8567046 - DNA, 22 bp, Homo sapiens
gagaagggggctcgagtgtcct

SEQ ID NO: 8567047 - DNA, 22 bp, Homo sapiens
gagaaggatgtggctcatagct

SEQ ID NO: 8567048 - DNA, 22 bp, Homo sapiens
gagaaggatgtggctcatagct

SEQ ID NO: 8567049 - DNA, 22 bp, Homo sapiens
gagaaggatgtggctcatagct

SEQ ID NO: 8567050 - DNA, 22 bp, Homo sapiens
gagaaggatgtggctcatagct

SEQ ID NO: 8567051 - DNA, 18 bp, Homo sapiens
gagaaggccacttgtttt

SEQ ID NO: 8567052 - DNA, 22 bp, Homo sapiens
gagaaggctgatccttggagtt

SEQ ID NO: 8567053 - DNA, 22 bp, Homo sapiens
gagaaggcttcttttcctctga

SEQ ID NO: 8567054 - DNA, 22 bp, Homo sapiens
gagaaggcttcttttcctctga

SEQ ID NO: 8567055 - DNA, 22 bp, Homo sapiens
gagaattagggcgtaattcaga

SEQ ID NO: 8567056 - DNA, 22 bp, Homo sapiens
gagaattactgtttttataaca

SEQ ID NO: 8567057 - DNA, 22 bp, Homo sapiens
gagaattactgtttttataaca

SEQ ID NO: 8567058 - DNA, 22 bp, Homo sapiens
gagaattttctagtagtttcat

SEQ ID NO: 8567059 - DNA, 22 bp, Homo sapiens
gagacaaaagttggagtgcaag

SEQ ID NO: 8567060 - DNA, 22 bp, Homo sapiens
gagaagggggctcgagtgtcct

SEQ ID NO: 8567061 - DNA, 22 bp, Homo sapiens
gagaagggggctcgagtgtcct

SEQ ID NO: 8567062 - DNA, 22 bp, Homo sapiens
gagaagggggctcgagtgtcct

SEQ ID NO: 8567063 - DNA, 22 bp, Homo sapiens
gagaatgtggagcctgtggttg

SEQ ID NO: 8567064 - DNA, 22 bp, Homo sapiens
gaggaggctatcagcaatcagg

SEQ ID NO: 8567065 - DNA, 22 bp, Homo sapiens
gaggaggctaagtgggctctgg

SEQ ID NO: 8567066 - DNA, 22 bp, Homo sapiens
gaggaggctaagtgggctctgg

SEQ ID NO: 8567067 - DNA, 22 bp, Homo sapiens
gaggaggaaaccctgttcctct

SEQ ID NO: 8567068 - DNA, 22 bp, Homo sapiens
gaggaggaagttctctgtaggc

SEQ ID NO: 8567069 - DNA, 22 bp, Homo sapiens
gaggaggaagttctctgtaggc

SEQ ID NO: 8567070 - DNA, 22 bp, Homo sapiens
gaggaggaggaagtggaaccca

SEQ ID NO: 8567071 - DNA, 22 bp, Homo sapiens
gaggagcttgtgagaagatgtc

SEQ ID NO: 8567072 - DNA, 22 bp, Homo sapiens
gaggagccctgttccccaggcc

SEQ ID NO: 8567073 - DNA, 22 bp, Homo sapiens
gaggagccctgttccccaggcc

SEQ ID NO: 8567074 - DNA, 22 bp, Homo sapiens
gaggagcctggccccacatcca

SEQ ID NO: 8567075 - DNA, 22 bp, Homo sapiens
gaggagctgttccctcacctct

SEQ ID NO: 8567076 - DNA, 19 bp, Homo sapiens
gaggagctatcggagacag

SEQ ID NO: 8567077 - DNA, 19 bp, Homo sapiens
gaggagctatcggagacag

SEQ ID NO: 8567078 - DNA, 22 bp, Homo sapiens
gaggaaaagagacaggttattg

SEQ ID NO: 8567079 - DNA, 22 bp, Homo sapiens
gaggaaaataacaactaagggc

SEQ ID NO: 8567080 - DNA, 22 bp, Homo sapiens
gaggaaaataacaactaagggc

SEQ ID NO: 8567081 - DNA, 22 bp, Homo sapiens
gaggaaaataacaactaagggc

SEQ ID NO: 8567082 - DNA, 22 bp, Homo sapiens
gaggaaaataacaactaagggc

SEQ ID NO: 8567083 - DNA, 22 bp, Homo sapiens
gaggaaaatattcagggaggtt

SEQ ID NO: 8567084 - DNA, 22 bp, Homo sapiens
gaggaaaatattcagggaggtt

SEQ ID NO: 8567085 - DNA, 22 bp, Homo sapiens
gaggccaggacatgaaagctga

SEQ ID NO: 8567086 - DNA, 22 bp, Homo sapiens
gaggccaggacatgaaagctga

SEQ ID NO: 8567087 - DNA, 22 bp, Homo sapiens
gaggccaggaagcccaagatca

SEQ ID NO: 8567088 - DNA, 22 bp, Homo sapiens
gaggccaggaagcccaagatca

SEQ ID NO: 8567089 - DNA, 22 bp, Homo sapiens
gaggccagctagtccaggaagt

SEQ ID NO: 8567090 - DNA, 22 bp, Homo sapiens
gaggccagctacccaagggtca

SEQ ID NO: 8567091 - DNA, 22 bp, Homo sapiens
gaggccagctagtccaggaagt

SEQ ID NO: 8567092 - DNA, 22 bp, Homo sapiens
gaggccagctagtccaggaagt

SEQ ID NO: 8567093 - DNA, 22 bp, Homo sapiens
gaggccagctacccaagggtca

SEQ ID NO: 8567094 - DNA, 22 bp, Homo sapiens
gaggccagctacccaagggtca

SEQ ID NO: 8567095 - DNA, 22 bp, Homo sapiens
gaggccagctacccaagggtca

SEQ ID NO: 8567096 - DNA, 22 bp, Homo sapiens
gaggccagatgtcatgtcttat

SEQ ID NO: 8567097 - DNA, 22 bp, Homo sapiens
gaggccagatactctcttctgc

SEQ ID NO: 8567098 - DNA, 22 bp, Homo sapiens
gaggcagaggaaggtggtctct

SEQ ID NO: 8567099 - DNA, 22 bp, Homo sapiens
gaggcagaggaaggtggtctct

SEQ ID NO: 8567100 - DNA, 22 bp, Homo sapiens
gaggcagaggaaggtggtctct

SEQ ID NO: 8567101 - DNA, 22 bp, Homo sapiens
gaggccagatgtcatgtcttat

SEQ ID NO: 8567102 - DNA, 22 bp, Homo sapiens
gaggccagatgtcatgtcttat

SEQ ID NO: 8567103 - DNA, 22 bp, Homo sapiens
gaggccagcgcgcagcactttt

SEQ ID NO: 8567104 - DNA, 22 bp, Homo sapiens
gaggccagcgcgcagcactttt

SEQ ID NO: 8567105 - DNA, 22 bp, Homo sapiens
gaggcagaagttgcagtgagca

SEQ ID NO: 8567106 - DNA, 22 bp, Homo sapiens
gaggcagaagttgcagtgagca

SEQ ID NO: 8567107 - DNA, 22 bp, Homo sapiens
gaggcagaagttgcagtgagca

SEQ ID NO: 8567108 - DNA, 22 bp, Homo sapiens
gaggcagagactccaccttcag

SEQ ID NO: 8567109 - DNA, 22 bp, Homo sapiens
gaggcagagaccttcaggacct

SEQ ID NO: 8567110 - DNA, 22 bp, Homo sapiens
gaggcaccagccccgctagcct

SEQ ID NO: 8567111 - DNA, 22 bp, Homo sapiens
gaggcacctcgcgggaggaggc

SEQ ID NO: 8567112 - DNA, 23 bp, Homo sapiens
gaggcactcaggaaatgtgagtg

SEQ ID NO: 8567113 - DNA, 22 bp, Homo sapiens
gaggcacctcgcgggaggaggc

SEQ ID NO: 8567114 - DNA, 22 bp, Homo sapiens
gaggcaccagacatggcctcat

SEQ ID NO: 8567115 - DNA, 22 bp, Homo sapiens
gaggcacaatacatgtctcaag

SEQ ID NO: 8567116 - DNA, 22 bp, Homo sapiens
gaggcacatcacttggtgcatt

SEQ ID NO: 8567117 - DNA, 22 bp, Homo sapiens
gaggcacatcacttggtgcatt

SEQ ID NO: 8567118 - DNA, 22 bp, Homo sapiens
gaggcacatcacttggtgcatt

SEQ ID NO: 8567119 - DNA, 22 bp, Homo sapiens
gagctgaattacggtgagtcat

SEQ ID NO: 8567120 - DNA, 22 bp, Homo sapiens
gagctgaaggagaaagcagggg

SEQ ID NO: 8567121 - DNA, 22 bp, Homo sapiens
gagctgaatcagagatattatt

SEQ ID NO: 8567122 - DNA, 18 bp, Homo sapiens
gagctgagaagaggatgc

SEQ ID NO: 8567123 - DNA, 18 bp, Homo sapiens
gagctgagaagaggatgc

SEQ ID NO: 8567124 - DNA, 22 bp, Homo sapiens
gagctgtgttcatgaggagaaa

SEQ ID NO: 8567125 - DNA, 22 bp, Homo sapiens
gagctgtgttcatgaggagaaa

SEQ ID NO: 8567126 - DNA, 19 bp, Homo sapiens
gagctgagagtagcactgg

SEQ ID NO: 8567127 - DNA, 22 bp, Homo sapiens
gagctgagaagcagcgcttgat

SEQ ID NO: 8567128 - DNA, 22 bp, Homo sapiens
gagctgagacacactttggcaa

SEQ ID NO: 8567129 - DNA, 22 bp, Homo sapiens
gagctgagacacactttggcaa

SEQ ID NO: 8567130 - DNA, 22 bp, Homo sapiens
gagctgaacaaattgcgagtgg

SEQ ID NO: 8567131 - DNA, 22 bp, Homo sapiens
gagctgaacatcatggaaaggc

SEQ ID NO: 8567132 - DNA, 22 bp, Homo sapiens
gagctgaagcgctacagcatcc

SEQ ID NO: 8567133 - DNA, 22 bp, Homo sapiens
gagcttggaagcagatcctcac

SEQ ID NO: 8567134 - DNA, 22 bp, Homo sapiens
gagcttcttgtttcttcatctg

SEQ ID NO: 8567135 - DNA, 22 bp, Homo sapiens
gagcttctcaacagttatctct

SEQ ID NO: 8567136 - DNA, 22 bp, Homo sapiens
gagcttcctgatgccgaccagt

SEQ ID NO: 8567137 - DNA, 22 bp, Homo sapiens
gagcttcctcagcctttctcac

SEQ ID NO: 8567138 - DNA, 22 bp, Homo sapiens
gagcttcctcagcctttctcac

SEQ ID NO: 8567139 - DNA, 22 bp, Homo sapiens
gagcttccctctgcagtccctg

SEQ ID NO: 8567140 - DNA, 22 bp, Homo sapiens
gagcttcctttttctgcatgac

SEQ ID NO: 8567141 - DNA, 22 bp, Homo sapiens
gagcttcctgcaggtcactgtg

SEQ ID NO: 8567142 - DNA, 22 bp, Homo sapiens
gagcttaggccagggacaggga

SEQ ID NO: 8567143 - DNA, 22 bp, Homo sapiens
gagcttcagaatttaacagact

SEQ ID NO: 8567144 - DNA, 22 bp, Homo sapiens
gagcttaaatggctaaatataa

SEQ ID NO: 8567145 - DNA, 22 bp, Homo sapiens
gagctgtttttccaaactattg

SEQ ID NO: 8567146 - DNA, 22 bp, Homo sapiens
gagcttccctctgcagtccctg

SEQ ID NO: 8567147 - DNA, 22 bp, Homo sapiens
gagcttccatggacgccatctg

SEQ ID NO: 8567148 - DNA, 22 bp, Homo sapiens
gagcttccatggacgccatctg

SEQ ID NO: 8567149 - DNA, 22 bp, Homo sapiens
gagcttccatccttactgtgtg

SEQ ID NO: 8567150 - DNA, 22 bp, Homo sapiens
gagcttccagagacatcagagt

SEQ ID NO: 8567151 - DNA, 22 bp, Homo sapiens
gagcttccatccttactgtgtg

SEQ ID NO: 8567152 - DNA, 22 bp, Homo sapiens
gagcttccatccttactgtgtg

SEQ ID NO: 8567153 - DNA, 22 bp, Homo sapiens
gagcttcagagaccacttaact

SEQ ID NO: 8567154 - DNA, 22 bp, Homo sapiens
gagcttcagcgtgtgctaaggg

SEQ ID NO: 8567155 - DNA, 22 bp, Homo sapiens
gagcttcagctgccatgactgt

SEQ ID NO: 8567156 - DNA, 18 bp, Homo sapiens
gagcttcaggctaacctg

SEQ ID NO: 8567157 - DNA, 22 bp, Homo sapiens
gagcttccactctagaaggagt

SEQ ID NO: 8567158 - DNA, 22 bp, Homo sapiens
gagctaagagtctagaaaggct

SEQ ID NO: 8567159 - DNA, 22 bp, Homo sapiens
gagctaagaactgtgccaggtg

SEQ ID NO: 8567160 - DNA, 22 bp, Homo sapiens
gagctaagacctgagggcaagt

SEQ ID NO: 8567161 - DNA, 22 bp, Homo sapiens
gagctactgaaatattgatttt

SEQ ID NO: 8567162 - DNA, 22 bp, Homo sapiens
gagctaaggtcacaagaagcag

SEQ ID NO: 8567163 - DNA, 22 bp, Homo sapiens
gagctaagtttctggaggcaga

SEQ ID NO: 8567164 - DNA, 22 bp, Homo sapiens
gagctaagctatgttatgcagc

SEQ ID NO: 8567165 - DNA, 22 bp, Homo sapiens
gagctaagccctggagaggtcg

SEQ ID NO: 8567166 - DNA, 22 bp, Homo sapiens
gagctaaggcacaggcaggctt

SEQ ID NO: 8567167 - DNA, 22 bp, Homo sapiens
gagctagagtttgtagggtaga

SEQ ID NO: 8567168 - DNA, 22 bp, Homo sapiens
gagctagagggagaagggcact

SEQ ID NO: 8567169 - DNA, 22 bp, Homo sapiens
gagctagagggagaagggcact

SEQ ID NO: 8567170 - DNA, 22 bp, Homo sapiens
gagctaggttgagactcactta

SEQ ID NO: 8567171 - DNA, 22 bp, Homo sapiens
gagctaggggtagtcaggagac

SEQ ID NO: 8567172 - DNA, 22 bp, Homo sapiens
gagctaggggtagtcaggagac

SEQ ID NO: 8567173 - DNA, 22 bp, Homo sapiens
gagctaggatatcatgagggta

SEQ ID NO: 8567174 - DNA, 22 bp, Homo sapiens
gagctaggctagggggagtcgc

SEQ ID NO: 8567175 - DNA, 22 bp, Homo sapiens
gagctctgactgctgggtgaca

SEQ ID NO: 8567176 - DNA, 22 bp, Homo sapiens
gagctctgatgtttagtggaga

SEQ ID NO: 8567177 - DNA, 22 bp, Homo sapiens
gagctagtagaacaagtgagga

SEQ ID NO: 8567178 - DNA, 21 bp, Homo sapiens
gagctctcaggcaagaagcag

SEQ ID NO: 8567179 - DNA, 22 bp, Homo sapiens
gagctctgaaaaagcttgcctt

SEQ ID NO: 8567180 - DNA, 22 bp, Homo sapiens
gagctctgtgtagcctgagggt

SEQ ID NO: 8567181 - DNA, 22 bp, Homo sapiens
gagctctgtgtggcttgggtgg

SEQ ID NO: 8567182 - DNA, 22 bp, Homo sapiens
gagctctgttctcgtcctgctg

SEQ ID NO: 8567183 - DNA, 22 bp, Homo sapiens
gagccctgttcaggcctcctca

SEQ ID NO: 8567184 - DNA, 22 bp, Homo sapiens
gagccaggtttgaatctcagtc

SEQ ID NO: 8567185 - DNA, 22 bp, Homo sapiens
gagccaggtttgaatctcagtc

SEQ ID NO: 8567186 - DNA, 22 bp, Homo sapiens
gagccaggtttgaatctcagtc

SEQ ID NO: 8567187 - DNA, 22 bp, Homo sapiens
gagccctgttcaggcctcctca

SEQ ID NO: 8567188 - DNA, 22 bp, Homo sapiens
gagcctcctcctggtgtgccga

SEQ ID NO: 8567189 - DNA, 22 bp, Homo sapiens
gagcctcctcctggtgtgccga

SEQ ID NO: 8567190 - DNA, 22 bp, Homo sapiens
gagcctcgtggcggccactgcg

SEQ ID NO: 8567191 - DNA, 22 bp, Homo sapiens
gagcctgaatttgacctgctta

SEQ ID NO: 8567192 - DNA, 22 bp, Homo sapiens
gagcctcgtggcggccactgcg

SEQ ID NO: 8567193 - DNA, 22 bp, Homo sapiens
gagcctgatgaaacaggcagac

SEQ ID NO: 8567194 - DNA, 22 bp, Homo sapiens
gagcctgcagctttcacagcat

SEQ ID NO: 8567195 - DNA, 22 bp, Homo sapiens
gagcctgcaggcctcggcctca

SEQ ID NO: 8567196 - DNA, 22 bp, Homo sapiens
gagcctgcccagccctgtccac

SEQ ID NO: 8567197 - DNA, 22 bp, Homo sapiens
gagcctggatagccttgttcca

SEQ ID NO: 8567198 - DNA, 22 bp, Homo sapiens
gagcctggagctggaacgaagc

SEQ ID NO: 8567199 - DNA, 22 bp, Homo sapiens
gagcctggattgaagtgggtgg

SEQ ID NO: 8567200 - DNA, 22 bp, Homo sapiens
gagcctggattgaagtgggtgg

SEQ ID NO: 8567201 - DNA, 22 bp, Homo sapiens
gagcctggattgtcaccgactt

SEQ ID NO: 8567202 - DNA, 22 bp, Homo sapiens
gagcctggattgtcaccgactt

SEQ ID NO: 8567203 - DNA, 22 bp, Homo sapiens
gagcctggacatctcaggccca

SEQ ID NO: 8567204 - DNA, 22 bp, Homo sapiens
gagcctggacatctcaggccca

SEQ ID NO: 8567205 - DNA, 22 bp, Homo sapiens
gagcctggagctggaacgaagc

SEQ ID NO: 8567206 - DNA, 22 bp, Homo sapiens
gagcctggacatctcaggccca

SEQ ID NO: 8567207 - DNA, 22 bp, Homo sapiens
gagcctggacatctcaggccca

SEQ ID NO: 8567208 - DNA, 22 bp, Homo sapiens
gagcctgcgagggagtaaggca

SEQ ID NO: 8567209 - DNA, 22 bp, Homo sapiens
gagcctgcgagggagtaaggca

SEQ ID NO: 8567210 - DNA, 22 bp, Homo sapiens
gagcctgcccctccaccaggat

SEQ ID NO: 8567211 - DNA, 22 bp, Homo sapiens
gagcctgcctctagtctctaga

SEQ ID NO: 8567212 - DNA, 19 bp, Homo sapiens
ggctctggcggctgtagcc

SEQ ID NO: 8567213 - DNA, 22 bp, Homo sapiens
ggctctggcggctctttcaata

SEQ ID NO: 8567214 - DNA, 22 bp, Homo sapiens
ggctctggcgtccaatggagcg

SEQ ID NO: 8567215 - DNA, 22 bp, Homo sapiens
ggctctggcgtccaatggagcg

SEQ ID NO: 8567216 - DNA, 22 bp, Homo sapiens
ggctctgggaaatggtcttcct

SEQ ID NO: 8567217 - DNA, 22 bp, Homo sapiens
ggctctgggcatagaaggaagc

SEQ ID NO: 8567218 - DNA, 22 bp, Homo sapiens
ggctctggctactccaccctgt

SEQ ID NO: 8567219 - DNA, 22 bp, Homo sapiens
ggctctggagacatgtggagag

SEQ ID NO: 8567220 - DNA, 22 bp, Homo sapiens
ggctctggagcacagacgtctg

SEQ ID NO: 8567221 - DNA, 22 bp, Homo sapiens
ggctctggagatgtccgacctg

SEQ ID NO: 8567222 - DNA, 22 bp, Homo sapiens
ggctctggcaaggggaggctac

SEQ ID NO: 8567223 - DNA, 22 bp, Homo sapiens
ggctctggagcacagacgtctg

SEQ ID NO: 8567224 - DNA, 22 bp, Homo sapiens
ggctctggcggctctttcaata

SEQ ID NO: 8567225 - DNA, 22 bp, Homo sapiens
ggctctggcaaggggaggctac

SEQ ID NO: 8567226 - DNA, 22 bp, Homo sapiens
ggctctggcgagctttagtaca

SEQ ID NO: 8567227 - DNA, 22 bp, Homo sapiens
ggctgaaggatgaaagctgcag

SEQ ID NO: 8567228 - DNA, 22 bp, Homo sapiens
ggctgaaattcagagtaaattc

SEQ ID NO: 8567229 - DNA, 20 bp, Homo sapiens
ggctgaaagtagaaagtatt

SEQ ID NO: 8567230 - DNA, 22 bp, Homo sapiens
ggctgaagaactgggagtctca

SEQ ID NO: 8567231 - DNA, 22 bp, Homo sapiens
ggctgaaaccgttatccactga

SEQ ID NO: 8567232 - DNA, 22 bp, Homo sapiens
ggctcttgttcgtaccatggct

SEQ ID NO: 8567233 - DNA, 22 bp, Homo sapiens
ggctctgggccagagttggctt

SEQ ID NO: 8567234 - DNA, 23 bp, Homo sapiens
ggctgagactacaggcgcttgcc

SEQ ID NO: 8567235 - DNA, 22 bp, Homo sapiens
ggctgagactagagtgaggcat

SEQ ID NO: 8567236 - DNA, 22 bp, Homo sapiens
ggctgagactagagtgaggcat

SEQ ID NO: 8567237 - DNA, 22 bp, Homo sapiens
ggctgagactagagtgaggcat

SEQ ID NO: 8567238 - DNA, 22 bp, Homo sapiens
ggctgagaaggagtgggtgagg

SEQ ID NO: 8567239 - DNA, 22 bp, Homo sapiens
ggctgagaaggagtgggtgagg

SEQ ID NO: 8567240 - DNA, 23 bp, Homo sapiens
ggctgagaagtcccatgataggt

SEQ ID NO: 8567241 - DNA, 23 bp, Homo sapiens
ggctgagaagtcccatgataggt

SEQ ID NO: 8567242 - DNA, 22 bp, Homo sapiens
ggctgagaatcaacaacctgct

SEQ ID NO: 8567243 - DNA, 22 bp, Homo sapiens
ggctgagacaacctgggaccca

SEQ ID NO: 8567244 - DNA, 22 bp, Homo sapiens
ggctgagaacaggcccagcctc

SEQ ID NO: 8567245 - DNA, 22 bp, Homo sapiens
ggctgagaaggagtgggtgagg

SEQ ID NO: 8567246 - DNA, 22 bp, Homo sapiens
ggctgagaagacagtggggtgg

SEQ ID NO: 8567247 - DNA, 22 bp, Homo sapiens
ggctgaagtgtagtggctcact

SEQ ID NO: 8567248 - DNA, 22 bp, Homo sapiens
ggctgaaggatgaaagctgcag

SEQ ID NO: 8567249 - DNA, 18 bp, Homo sapiens
ggctccaggacctaccca

SEQ ID NO: 8567250 - DNA, 18 bp, Homo sapiens
ggctccaggacctaccca

SEQ ID NO: 8567251 - DNA, 18 bp, Homo sapiens
ggctccaggacctaccca

SEQ ID NO: 8567252 - DNA, 22 bp, Homo sapiens
ggctccaggagatgctgggcag

SEQ ID NO: 8567253 - DNA, 22 bp, Homo sapiens
ggctccagctaatggtttctat

SEQ ID NO: 8567254 - DNA, 22 bp, Homo sapiens
ggctccaggaacctcctctcct

SEQ ID NO: 8567255 - DNA, 22 bp, Homo sapiens
ggctccagatgtctcctggcaa

SEQ ID NO: 8567256 - DNA, 22 bp, Homo sapiens
ggctccagccctggctcttcac

SEQ ID NO: 8567257 - DNA, 22 bp, Homo sapiens
ggctccagccctggctcttcac

SEQ ID NO: 8567258 - DNA, 22 bp, Homo sapiens
ggctccagctaatggtttctat

SEQ ID NO: 8567259 - DNA, 22 bp, Homo sapiens
ggctctggaatgtgtagtcagg

SEQ ID NO: 8567260 - DNA, 22 bp, Homo sapiens
ggctctgctgcacccttggctc

SEQ ID NO: 8567261 - DNA, 22 bp, Homo sapiens
ggctctggaatgtgtagtcagg

SEQ ID NO: 8567262 - DNA, 22 bp, Homo sapiens
ggctccaggagatgctgggcag

SEQ ID NO: 8567263 - DNA, 22 bp, Homo sapiens
ggctccaggagatgctgggcag

SEQ ID NO: 8567264 - DNA, 23 bp, Homo sapiens
ggctccaggcctgacgggcgcgg

SEQ ID NO: 8567265 - DNA, 22 bp, Homo sapiens
ggctccaggagggccttggcca

SEQ ID NO: 8567266 - DNA, 22 bp, Homo sapiens
ggctccaggagggccttggcca

SEQ ID NO: 8567267 - DNA, 22 bp, Homo sapiens
ggctccagaggccttacctgca

SEQ ID NO: 8567268 - DNA, 16 bp, Homo sapiens
ggctccagaatagcga

SEQ ID NO: 8567269 - DNA, 22 bp, Homo sapiens
ggctccagaggccttacctgca

SEQ ID NO: 8567270 - DNA, 22 bp, Homo sapiens
ggctccagatgtcccctggcaa

SEQ ID NO: 8567271 - DNA, 22 bp, Homo sapiens
ggctccagatgtcccctggcaa

SEQ ID NO: 8567272 - DNA, 22 bp, Homo sapiens
ggctccagaaatcatagagcag

SEQ ID NO: 8567273 - DNA, 22 bp, Homo sapiens
ggctccagaaacttcagtccat

SEQ ID NO: 8567274 - DNA, 22 bp, Homo sapiens
ggctccagaaacttcagtccat

SEQ ID NO: 8567275 - DNA, 22 bp, Homo sapiens
ggctccaccctgcttccagaag

SEQ ID NO: 8567276 - DNA, 22 bp, Homo sapiens
ggctccaccctgcttccagaag

SEQ ID NO: 8567277 - DNA, 22 bp, Homo sapiens
ggcggcttattcactctgggga

SEQ ID NO: 8567278 - DNA, 22 bp, Homo sapiens
ggcggcgcgtagccggagactt

SEQ ID NO: 8567279 - DNA, 22 bp, Homo sapiens
ggcggctactcctcctggtgag

SEQ ID NO: 8567280 - DNA, 22 bp, Homo sapiens
ggcgggagatggggccgttcag

SEQ ID NO: 8567281 - DNA, 22 bp, Homo sapiens
ggcggcctgtgggtcggcctca

SEQ ID NO: 8567282 - DNA, 22 bp, Homo sapiens
ggcggccctgcacgtgctgagg

SEQ ID NO: 8567283 - DNA, 22 bp, Homo sapiens
ggcgctgtcgtgagctcgcccg

SEQ ID NO: 8567284 - DNA, 22 bp, Homo sapiens
ggcggaggttgcagtaagccga

SEQ ID NO: 8567285 - DNA, 22 bp, Homo sapiens
ggcggggcctcgcgaacggcct

SEQ ID NO: 8567286 - DNA, 22 bp, Homo sapiens
ggcgggggtccaggagcctgca

SEQ ID NO: 8567287 - DNA, 22 bp, Homo sapiens
ggcgggggtccaggagcctgca

SEQ ID NO: 8567288 - DNA, 22 bp, Homo sapiens
ggcttctgagtgctctgctgtt

SEQ ID NO: 8567289 - DNA, 22 bp, Homo sapiens
ggcttctgagtgctctgctgtt

SEQ ID NO: 8567290 - DNA, 22 bp, Homo sapiens
ggcttctgagtgctctgctgtt

SEQ ID NO: 8567291 - DNA, 22 bp, Homo sapiens
ggcttctgaaccaggccctgga

SEQ ID NO: 8567292 - DNA, 22 bp, Homo sapiens
ggcttctgagtgctctgctgtt

SEQ ID NO: 8567293 - DNA, 22 bp, Homo sapiens
ggcttctgaaactgtattgaga

SEQ ID NO: 8567294 - DNA, 22 bp, Homo sapiens
ggcttctgaaatctctgtgcgt

SEQ ID NO: 8567295 - DNA, 22 bp, Homo sapiens
ggcttctgaaatctctgtgcgt

SEQ ID NO: 8567296 - DNA, 22 bp, Homo sapiens
ggcttctgtcctctggatctgt

SEQ ID NO: 8567297 - DNA, 22 bp, Homo sapiens
ggcttctgctcagcctgcacgc

SEQ ID NO: 8567298 - DNA, 22 bp, Homo sapiens
ggcttctctcccccagctccac

SEQ ID NO: 8567299 - DNA, 22 bp, Homo sapiens
ggcttctctcttcacatggctt

SEQ ID NO: 8567300 - DNA, 22 bp, Homo sapiens
ggcttctctcttcacatggctt

SEQ ID NO: 8567301 - DNA, 22 bp, Homo sapiens
ggcttctctccagtatgcattc

SEQ ID NO: 8567302 - DNA, 22 bp, Homo sapiens
ggcttctctcccccagctccac

SEQ ID NO: 8567303 - DNA, 22 bp, Homo sapiens
ggcttctctaaagatcatgcgt

SEQ ID NO: 8567304 - DNA, 22 bp, Homo sapiens
ggcttctcgtgccgaagcaaga

SEQ ID NO: 8567305 - DNA, 22 bp, Homo sapiens
ggcttctccaggtactgagcat

SEQ ID NO: 8567306 - DNA, 22 bp, Homo sapiens
ggcttctcccctttgagtcttc

SEQ ID NO: 8567307 - DNA, 22 bp, Homo sapiens
ggcttctcccctttgagtcttc

SEQ ID NO: 8567308 - DNA, 22 bp, Homo sapiens
ggcttctcccattcttcagggg

SEQ ID NO: 8567309 - DNA, 22 bp, Homo sapiens
ggcttctcccttcttctgattg

SEQ ID NO: 8567310 - DNA, 22 bp, Homo sapiens
ggcttctcccttcttctgattg

SEQ ID NO: 8567311 - DNA, 22 bp, Homo sapiens
ggcttctcccctttgagtcttc

SEQ ID NO: 8567312 - DNA, 22 bp, Homo sapiens
ggctgggctgcggctgtacctg

SEQ ID NO: 8567313 - DNA, 22 bp, Homo sapiens
ggctgggctgcggctgtacctg

SEQ ID NO: 8567314 - DNA, 22 bp, Homo sapiens
ggctgggctgctgggtcagagc

SEQ ID NO: 8567315 - DNA, 22 bp, Homo sapiens
ggctgggctgctgggtcagagc

SEQ ID NO: 8567316 - DNA, 22 bp, Homo sapiens
ggcttctccaggtactgagcat

SEQ ID NO: 8567317 - DNA, 22 bp, Homo sapiens
ggcttctccaggtactgagcat

SEQ ID NO: 8567318 - DNA, 22 bp, Homo sapiens
ggctgggccgcggctacccaga

SEQ ID NO: 8567319 - DNA, 19 bp, Homo sapiens
ggctgggccctgtttctcc

SEQ ID NO: 8567320 - DNA, 22 bp, Homo sapiens
ggctgggcctctccctcagctg

SEQ ID NO: 8567321 - DNA, 22 bp, Homo sapiens
ggctgggcctctccctcagctg

SEQ ID NO: 8567322 - DNA, 22 bp, Homo sapiens
ggctgggcctctccctcagctg

SEQ ID NO: 8567323 - DNA, 22 bp, Homo sapiens
ggctgggcctctccctcagctg

SEQ ID NO: 8567324 - DNA, 22 bp, Homo sapiens
ggctgggccgcggctacccaga

SEQ ID NO: 8567325 - DNA, 22 bp, Homo sapiens
ggctgggctcgctgattggctg

SEQ ID NO: 8567326 - DNA, 22 bp, Homo sapiens
ggctgggctcgctgattggctg

SEQ ID NO: 8567327 - DNA, 22 bp, Homo sapiens
ggctgggctccgggagcatgcg

SEQ ID NO: 8567328 - DNA, 22 bp, Homo sapiens
ggctgggctccgggagcatgcg

SEQ ID NO: 8567329 - DNA, 22 bp, Homo sapiens
ggctgggctccgggagcatgcg

SEQ ID NO: 8567330 - DNA, 22 bp, Homo sapiens
ggctgggctccgggagcatgcg

SEQ ID NO: 8567331 - DNA, 22 bp, Homo sapiens
ggctgggcatccatccatgaga

SEQ ID NO: 8567332 - DNA, 22 bp, Homo sapiens
ggctgggcatccatccatgaga

SEQ ID NO: 8567333 - DNA, 22 bp, Homo sapiens
ggctgggcatccatccatgaga

SEQ ID NO: 8567334 - DNA, 22 bp, Homo sapiens
ggctgggcatccatccatgaga

SEQ ID NO: 8567335 - DNA, 22 bp, Homo sapiens
ggctgggccagggcctgtggac

SEQ ID NO: 8567336 - DNA, 19 bp, Homo sapiens
ggctgggccctgtttctcc

SEQ ID NO: 8567337 - DNA, 22 bp, Homo sapiens
ggctgggccagggcctgtggac

SEQ ID NO: 8567338 - DNA, 22 bp, Homo sapiens
ggctgggccagggcctgtggac

SEQ ID NO: 8567339 - DNA, 22 bp, Homo sapiens
ggctgggcaggtctgcacaggg

SEQ ID NO: 8567340 - DNA, 22 bp, Homo sapiens
ggctgggcaggtctgcacaggg

SEQ ID NO: 8567341 - DNA, 22 bp, Homo sapiens
ggctgggcaggtctgcacaggg

SEQ ID NO: 8567342 - DNA, 21 bp, Homo sapiens
ggctgggcaggacccacccct

SEQ ID NO: 8567343 - DNA, 21 bp, Homo sapiens
ggctgggcaggacccacccct

SEQ ID NO: 8567344 - DNA, 22 bp, Homo sapiens
ggctgggaggccgtgctgacct

SEQ ID NO: 8567345 - DNA, 22 bp, Homo sapiens
ggctgggcaaacaagactcttc

SEQ ID NO: 8567346 - DNA, 22 bp, Homo sapiens
ggctgggcagcagctgttaagc

SEQ ID NO: 8567347 - DNA, 22 bp, Homo sapiens
ggctgggcaaacaagactcttc

SEQ ID NO: 8567348 - DNA, 22 bp, Homo sapiens
ggctgggcaaacaagactcttc

SEQ ID NO: 8567349 - DNA, 22 bp, Homo sapiens
ggctgctggcattgaggtaggt

SEQ ID NO: 8567350 - DNA, 22 bp, Homo sapiens
ggctgctggattgtgtatctgt

SEQ ID NO: 8567351 - DNA, 22 bp, Homo sapiens
ggctgctggcagatgtagttta

SEQ ID NO: 8567352 - DNA, 22 bp, Homo sapiens
ggctgctgggaatatgccagct

SEQ ID NO: 8567353 - DNA, 22 bp, Homo sapiens
ggctgctggccagcctaggagt

SEQ ID NO: 8567354 - DNA, 22 bp, Homo sapiens
ggctgctgctgtgtaggcctgt

SEQ ID NO: 8567355 - DNA, 22 bp, Homo sapiens
ggctgctggaagactgaacaag

SEQ ID NO: 8567356 - DNA, 22 bp, Homo sapiens
ggctgctgcccacccctgcatg

SEQ ID NO: 8567357 - DNA, 22 bp, Homo sapiens
ggctgctgcccacccctgcatg

SEQ ID NO: 8567358 - DNA, 22 bp, Homo sapiens
ggctgctgagttggccaggaga

SEQ ID NO: 8567359 - DNA, 22 bp, Homo sapiens
ggctgctgagtcacgacagtga

SEQ ID NO: 8567360 - DNA, 22 bp, Homo sapiens
ggctgctgagtcacgacagtga

SEQ ID NO: 8567361 - DNA, 22 bp, Homo sapiens
ggctgagagtggatcccaggga

SEQ ID NO: 8567362 - DNA, 21 bp, Homo sapiens
ggctgagatggcagaatcacc

SEQ ID NO: 8567363 - DNA, 22 bp, Homo sapiens
ggctgagagtttcctctggggc

SEQ ID NO: 8567364 - DNA, 22 bp, Homo sapiens
ggctgagagtggatcccaggga

SEQ ID NO: 8567365 - DNA, 22 bp, Homo sapiens
ggctgagaggacgtcgggctca

SEQ ID NO: 8567366 - DNA, 21 bp, Homo sapiens
ggctgagatggcagaatcacc

SEQ ID NO: 8567367 - DNA, 22 bp, Homo sapiens
ggctgagcaattttgatgacat

SEQ ID NO: 8567368 - DNA, 22 bp, Homo sapiens
ggctgagcaattttgatgacat

SEQ ID NO: 8567369 - DNA, 22 bp, Homo sapiens
ggctgctgacttcatccagctt

SEQ ID NO: 8567370 - DNA, 22 bp, Homo sapiens
ggctgctgacaaacatgatcat

SEQ ID NO: 8567371 - DNA, 22 bp, Homo sapiens
ggctgagcactttaggcaggag

SEQ ID NO: 8567372 - DNA, 22 bp, Homo sapiens
ggctgagcactttaggcaggag

SEQ ID NO: 8567373 - DNA, 22 bp, Homo sapiens
ggctgagcactttaggcaggag

SEQ ID NO: 8567374 - DNA, 22 bp, Homo sapiens
ggctgctgaagtgtggcaatct

SEQ ID NO: 8567375 - DNA, 22 bp, Homo sapiens
gggcagctgccagaggccatgg

SEQ ID NO: 8567376 - DNA, 22 bp, Homo sapiens
gggcagctgccagaggccatgg

SEQ ID NO: 8567377 - DNA, 22 bp, Homo sapiens
gggcagctgccagaggccatgg

SEQ ID NO: 8567378 - DNA, 22 bp, Homo sapiens
gggcagctgcccctctctgggc

SEQ ID NO: 8567379 - DNA, 22 bp, Homo sapiens
gggcagctgcagggatggtgac

SEQ ID NO: 8567380 - DNA, 22 bp, Homo sapiens
gggcagctgccaagtgcatcgc

SEQ ID NO: 8567381 - DNA, 22 bp, Homo sapiens
gggcagctgccaagtgcatcgc

SEQ ID NO: 8567382 - DNA, 22 bp, Homo sapiens
gggcagctggccaggtattctg

SEQ ID NO: 8567383 - DNA, 22 bp, Homo sapiens
gggcacagctgctacccagtgc

SEQ ID NO: 8567384 - DNA, 22 bp, Homo sapiens
gggcacagctgctacccagtgc

SEQ ID NO: 8567385 - DNA, 22 bp, Homo sapiens
gggcacaggaatttgggatgtg

SEQ ID NO: 8567386 - DNA, 22 bp, Homo sapiens
gggcagctctggctgtgggaag

SEQ ID NO: 8567387 - DNA, 22 bp, Homo sapiens
gggcagctctcacagcagccaa

SEQ ID NO: 8567388 - DNA, 22 bp, Homo sapiens
gggcagctgcagggatggtgac

SEQ ID NO: 8567389 - DNA, 22 bp, Homo sapiens
gggcagctgcagggatggtgac

SEQ ID NO: 8567390 - DNA, 22 bp, Homo sapiens
gggcagctctggctgtgggaag

SEQ ID NO: 8567391 - DNA, 22 bp, Homo sapiens
gggcaggctgagcatgtcacct

SEQ ID NO: 8567392 - DNA, 17 bp, Homo sapiens
gggcagggactcctggg

SEQ ID NO: 8567393 - DNA, 22 bp, Homo sapiens
gggcaggctgagcatgtcacct

SEQ ID NO: 8567394 - DNA, 22 bp, Homo sapiens
gggcaggatgcagtttcagaga

SEQ ID NO: 8567395 - DNA, 22 bp, Homo sapiens
gggcaggaggctaattctgcat

SEQ ID NO: 8567396 - DNA, 22 bp, Homo sapiens
gggcaggatgcagtttcagaga

SEQ ID NO: 8567397 - DNA, 19 bp, Homo sapiens
gggcatggatgagcttacc

SEQ ID NO: 8567398 - DNA, 18 bp, Homo sapiens
gggcatggatgcagcatc

SEQ ID NO: 8567399 - DNA, 22 bp, Homo sapiens
gggcatggaggtctgtctgcag

SEQ ID NO: 8567400 - DNA, 22 bp, Homo sapiens
gggcaggagaaggtggatgtcc

SEQ ID NO: 8567401 - DNA, 22 bp, Homo sapiens
gggcaggagaaggtggatgtcc

SEQ ID NO: 8567402 - DNA, 22 bp, Homo sapiens
gggcaggagaaggtggatgtcc

SEQ ID NO: 8567403 - DNA, 22 bp, Homo sapiens
gggcaggagagaacagtcatgg

SEQ ID NO: 8567404 - DNA, 16 bp, Homo sapiens
gggcaggaatcagggt

SEQ ID NO: 8567405 - DNA, 22 bp, Homo sapiens
gggcaggaacaaatcaaatgat

SEQ ID NO: 8567406 - DNA, 22 bp, Homo sapiens
gggcaggagagggccacctgga

SEQ ID NO: 8567407 - DNA, 22 bp, Homo sapiens
gggcaggagagggccacctgga

SEQ ID NO: 8567408 - DNA, 22 bp, Homo sapiens
gggcaggagagggccacctgga

SEQ ID NO: 8567409 - DNA, 22 bp, Homo sapiens
gggcaggagagggccacctgga

SEQ ID NO: 8567410 - DNA, 22 bp, Homo sapiens
gggcaggagagaacagtcatgg

SEQ ID NO: 8567411 - DNA, 22 bp, Homo sapiens
gggcaggagagaacagtcatgg

SEQ ID NO: 8567412 - DNA, 22 bp, Homo sapiens
gggcaggagagaacagtcatgg

SEQ ID NO: 8567413 - DNA, 22 bp, Homo sapiens
gggcaggagagaacagtcatgg

SEQ ID NO: 8567414 - DNA, 22 bp, Homo sapiens
gggaggaaatgtgcagcgaatt

SEQ ID NO: 8567415 - DNA, 22 bp, Homo sapiens
gggaggaaatgtgcagcgaatt

SEQ ID NO: 8567416 - DNA, 21 bp, Homo sapiens
gggaggaagctgcttctctct

SEQ ID NO: 8567417 - DNA, 22 bp, Homo sapiens
gggaggaaggcttgggtgagta

SEQ ID NO: 8567418 - DNA, 19 bp, Homo sapiens
gggagctgtctgcccgtgg

SEQ ID NO: 8567419 - DNA, 22 bp, Homo sapiens
gggaggaaagagaagtggtcca

SEQ ID NO: 8567420 - DNA, 19 bp, Homo sapiens
gggagctttccatctgtcc

SEQ ID NO: 8567421 - DNA, 22 bp, Homo sapiens
gggagcttaagacagttccaat

SEQ ID NO: 8567422 - DNA, 22 bp, Homo sapiens
gggaggacggtccagggcaaag

SEQ ID NO: 8567423 - DNA, 22 bp, Homo sapiens
gggaggagcttggagattcact

SEQ ID NO: 8567424 - DNA, 22 bp, Homo sapiens
gggaggagctgagtgtgtgtgc

SEQ ID NO: 8567425 - DNA, 22 bp, Homo sapiens
gggatggggggaagcgtccatg

SEQ ID NO: 8567426 - DNA, 22 bp, Homo sapiens
gggatggggggaagcgtccatg

SEQ ID NO: 8567427 - DNA, 22 bp, Homo sapiens
gggatggggagctggaaagggg

SEQ ID NO: 8567428 - DNA, 22 bp, Homo sapiens
gggatggggggaagcgtccatg

SEQ ID NO: 8567429 - DNA, 22 bp, Homo sapiens
gggatggggagctggaaagggg

SEQ ID NO: 8567430 - DNA, 22 bp, Homo sapiens
gggatggggagctggaaagggg

SEQ ID NO: 8567431 - DNA, 22 bp, Homo sapiens
gggatggggagctggaaagggg

SEQ ID NO: 8567432 - DNA, 22 bp, Homo sapiens
gggattacagatgtgagccatt

SEQ ID NO: 8567433 - DNA, 22 bp, Homo sapiens
gggatttgtgggatggccagtg

SEQ ID NO: 8567434 - DNA, 22 bp, Homo sapiens
gggatttgtgggatggccagtg

SEQ ID NO: 8567435 - DNA, 19 bp, Homo sapiens
gggcaaagtgatcgtcctg

SEQ ID NO: 8567436 - DNA, 22 bp, Homo sapiens
gggatggggtcgggaccctgct

SEQ ID NO: 8567437 - DNA, 22 bp, Homo sapiens
gggatggggtcaacatgtacct

SEQ ID NO: 8567438 - DNA, 22 bp, Homo sapiens
gggatggggtcaacatgtacct

SEQ ID NO: 8567439 - DNA, 22 bp, Homo sapiens
gggatggggtcaacatgtacct

SEQ ID NO: 8567440 - DNA, 22 bp, Homo sapiens
gggatggggtcgggaccctgct

SEQ ID NO: 8567441 - DNA, 22 bp, Homo sapiens
gggatgtcactgtgcctggcac

SEQ ID NO: 8567442 - DNA, 22 bp, Homo sapiens
gggatggggtcgggaccctgct

SEQ ID NO: 8567443 - DNA, 22 bp, Homo sapiens
gggcacagcccagtggggtccc

SEQ ID NO: 8567444 - DNA, 19 bp, Homo sapiens
gggcacagcctccccccag

SEQ ID NO: 8567445 - DNA, 22 bp, Homo sapiens
gggcaaagtggtggaggcagtt

SEQ ID NO: 8567446 - DNA, 22 bp, Homo sapiens
gggcaaagtggtggaggcagtt

SEQ ID NO: 8567447 - DNA, 22 bp, Homo sapiens
gggcaaagtggtggaggcagtt

SEQ ID NO: 8567448 - DNA, 22 bp, Homo sapiens
gggagacacgctgcaggcataa

SEQ ID NO: 8567449 - DNA, 22 bp, Homo sapiens
gggagacacgctgcaggcataa

SEQ ID NO: 8567450 - DNA, 19 bp, Homo sapiens
gggagacagctctgggctg

SEQ ID NO: 8567451 - DNA, 22 bp, Homo sapiens
gggagacaagaagtagcctgct

SEQ ID NO: 8567452 - DNA, 22 bp, Homo sapiens
gggagacagttcagatagtttc

SEQ ID NO: 8567453 - DNA, 22 bp, Homo sapiens
gggagacccccaatgccaggtc

SEQ ID NO: 8567454 - DNA, 20 bp, Homo sapiens
gggagacagggccagtgtcc

SEQ ID NO: 8567455 - DNA, 22 bp, Homo sapiens
gggagacagttcagatagtttc

SEQ ID NO: 8567456 - DNA, 22 bp, Homo sapiens
gggagagaaattatagcaatga

SEQ ID NO: 8567457 - DNA, 22 bp, Homo sapiens
gggagagaattattgccagacc

SEQ ID NO: 8567458 - DNA, 19 bp, Homo sapiens
gggagagccaggctcaccc

SEQ ID NO: 8567459 - DNA, 19 bp, Homo sapiens
gggagagccaggctcaccc

SEQ ID NO: 8567460 - DNA, 22 bp, Homo sapiens
gggagagagagctcatgttgaa

SEQ ID NO: 8567461 - DNA, 22 bp, Homo sapiens
gggagagagaaaacgtggcgca

SEQ ID NO: 8567462 - DNA, 22 bp, Homo sapiens
gggagagagaaaacgtggcgca

SEQ ID NO: 8567463 - DNA, 22 bp, Homo sapiens
gggagagcgcgctagggccgag

SEQ ID NO: 8567464 - DNA, 22 bp, Homo sapiens
gggagagcgcgctagggccgag

SEQ ID NO: 8567465 - DNA, 22 bp, Homo sapiens
gggagagcgggaggtgccacag

SEQ ID NO: 8567466 - DNA, 18 bp, Homo sapiens
gggagctgggaagctggt

SEQ ID NO: 8567467 - DNA, 17 bp, Homo sapiens
gggagatgaagggatat

SEQ ID NO: 8567468 - DNA, 22 bp, Homo sapiens
gggagaggttacccgagcaact

SEQ ID NO: 8567469 - DNA, 22 bp, Homo sapiens
gggagaggttacccgagcaact

SEQ ID NO: 8567470 - DNA, 22 bp, Homo sapiens
gggagaggttacccgagcaact

SEQ ID NO: 8567471 - DNA, 22 bp, Homo sapiens
gggagaggttacccgagcaact

SEQ ID NO: 8567472 - DNA, 22 bp, Homo sapiens
gggagaggttacccgagcaact

SEQ ID NO: 8567473 - DNA, 22 bp, Homo sapiens
gggagaggttacccgagcaact

SEQ ID NO: 8567474 - DNA, 22 bp, Homo sapiens
gggagaggttacccgagcaact

SEQ ID NO: 8567475 - DNA, 22 bp, Homo sapiens
gggagagtagctggaaggttct

SEQ ID NO: 8567476 - DNA, 22 bp, Homo sapiens
gggagctgtagtccagataccg

SEQ ID NO: 8567477 - DNA, 22 bp, Homo sapiens
gggagctgtagtccagataccg

SEQ ID NO: 8567478 - DNA, 22 bp, Homo sapiens
gggagctgtaagggacaggtag

SEQ ID NO: 8567479 - DNA, 22 bp, Homo sapiens
gggagctgtaagggacaggtag

SEQ ID NO: 8567480 - DNA, 22 bp, Homo sapiens
gggagctggttcctgccctcca

SEQ ID NO: 8567481 - DNA, 22 bp, Homo sapiens
gggagctggttcctgccctcca

SEQ ID NO: 8567482 - DNA, 22 bp, Homo sapiens
gggacatgaggccatagtgatt

SEQ ID NO: 8567483 - DNA, 22 bp, Homo sapiens
gggacaggctgagacttgagct

SEQ ID NO: 8567484 - DNA, 22 bp, Homo sapiens
gggacatctttctagtcagggt

SEQ ID NO: 8567485 - DNA, 22 bp, Homo sapiens
gggacatctttctagtcagggt

SEQ ID NO: 8567486 - DNA, 22 bp, Homo sapiens
gggacaggcccctcgctagctt

SEQ ID NO: 8567487 - DNA, 22 bp, Homo sapiens
gggacaggctgagacttgagct

SEQ ID NO: 8567488 - DNA, 22 bp, Homo sapiens
gggacaggcccctcgctagctt

SEQ ID NO: 8567489 - DNA, 22 bp, Homo sapiens
gggacatgcccctcagtgggtg

SEQ ID NO: 8567490 - DNA, 22 bp, Homo sapiens
gggacatgcccctcagtgggtg

SEQ ID NO: 8567491 - DNA, 23 bp, Homo sapiens
gggaccagctagggctgtgacct

SEQ ID NO: 8567492 - DNA, 23 bp, Homo sapiens
gggaccagctagggctgtgacct

SEQ ID NO: 8567493 - DNA, 23 bp, Homo sapiens
gggaccagctagggctgtgacct

SEQ ID NO: 8567494 - DNA, 22 bp, Homo sapiens
ggcttgtcatgttgatgttctt

SEQ ID NO: 8567495 - DNA, 22 bp, Homo sapiens
ggcttgtggcaagtgttttaag

SEQ ID NO: 8567496 - DNA, 22 bp, Homo sapiens
ggcttgttgaaacacagattgt

SEQ ID NO: 8567497 - DNA, 20 bp, Homo sapiens
ggcttggctgcctggggagg

SEQ ID NO: 8567498 - DNA, 22 bp, Homo sapiens
ggcttgggagcaggcatgtgac

SEQ ID NO: 8567499 - DNA, 22 bp, Homo sapiens
gggacaggcaaaggtatgcttc

SEQ ID NO: 8567500 - DNA, 22 bp, Homo sapiens
gggacagcagaaagaaggcaag

SEQ ID NO: 8567501 - DNA, 22 bp, Homo sapiens
gggaatgtaatcatggaatgct

SEQ ID NO: 8567502 - DNA, 22 bp, Homo sapiens
gggaatgtgaaacagtaaggga

SEQ ID NO: 8567503 - DNA, 22 bp, Homo sapiens
gggaatgtgaaacagtaaggga

SEQ ID NO: 8567504 - DNA, 22 bp, Homo sapiens
ggcagaggaggggtgaatttgc

SEQ ID NO: 8567505 - DNA, 22 bp, Homo sapiens
ggcagaggaggggtgaatttgc

SEQ ID NO: 8567506 - DNA, 22 bp, Homo sapiens
ggcagaggaggggtgaatttgc

SEQ ID NO: 8567507 - DNA, 20 bp, Homo sapiens
ggcagagggcctgggagaag

SEQ ID NO: 8567508 - DNA, 20 bp, Homo sapiens
ggcagagggcctgggagaag

SEQ ID NO: 8567509 - DNA, 22 bp, Homo sapiens
ggcagaggagctggaaacatgg

SEQ ID NO: 8567510 - DNA, 22 bp, Homo sapiens
ggcagaggagctggaaacatgg

SEQ ID NO: 8567511 - DNA, 22 bp, Homo sapiens
ggcagaggagctggaaacatgg

SEQ ID NO: 8567512 - DNA, 22 bp, Homo sapiens
ggcagaggagctggaaacatgg

SEQ ID NO: 8567513 - DNA, 22 bp, Homo sapiens
ggcagaggagctggaaacatgg

SEQ ID NO: 8567514 - DNA, 22 bp, Homo sapiens
ggcagaggagctggaaacatgg

SEQ ID NO: 8567515 - DNA, 22 bp, Homo sapiens
ggcagaggagctggaaacatgg

SEQ ID NO: 8567516 - DNA, 22 bp, Homo sapiens
ggcagaggaaggatgaattcac

SEQ ID NO: 8567517 - DNA, 22 bp, Homo sapiens
ggcagaggaaggatgaattcac

SEQ ID NO: 8567518 - DNA, 22 bp, Homo sapiens
ggcagaggaaggatgaattcac

SEQ ID NO: 8567519 - DNA, 22 bp, Homo sapiens
ggcagaggaaggatgaattcac

SEQ ID NO: 8567520 - DNA, 22 bp, Homo sapiens
ggcaccaggatcagtctgtcat

SEQ ID NO: 8567521 - DNA, 22 bp, Homo sapiens
ggcaccaggacatgactcccag

SEQ ID NO: 8567522 - DNA, 22 bp, Homo sapiens
ggcaccaggacatgactcccag

SEQ ID NO: 8567523 - DNA, 23 bp, Homo sapiens
ggcaccaggccatggagcgggag

SEQ ID NO: 8567524 - DNA, 23 bp, Homo sapiens
ggcaccaggccatggagcgggag

SEQ ID NO: 8567525 - DNA, 22 bp, Homo sapiens
ggcaccaggctgggcataggcc

SEQ ID NO: 8567526 - DNA, 20 bp, Homo sapiens
ggcaccaggctaggattgga

SEQ ID NO: 8567527 - DNA, 20 bp, Homo sapiens
ggcaccaggctaggattgga

SEQ ID NO: 8567528 - DNA, 22 bp, Homo sapiens
ggcacaggaatctgtgaagtgc

SEQ ID NO: 8567529 - DNA, 22 bp, Homo sapiens
ggcacagctcaggtcccagctc

SEQ ID NO: 8567530 - DNA, 22 bp, Homo sapiens
ggcacagctcaggtcccagctc

SEQ ID NO: 8567531 - DNA, 22 bp, Homo sapiens
ggcaccagccacctatttctag

SEQ ID NO: 8567532 - DNA, 22 bp, Homo sapiens
ggcaccagcaggcaccgatgcc

SEQ ID NO: 8567533 - DNA, 22 bp, Homo sapiens
ggcaccagcaggcaccgatgcc

SEQ ID NO: 8567534 - DNA, 17 bp, Homo sapiens
ggcaccagacggagagt

SEQ ID NO: 8567535 - DNA, 22 bp, Homo sapiens
ggcaccagcacttgggatggct

SEQ ID NO: 8567536 - DNA, 22 bp, Homo sapiens
ggcaccagcacttgggatggct

SEQ ID NO: 8567537 - DNA, 17 bp, Homo sapiens
ggcaccagacggagagt

SEQ ID NO: 8567538 - DNA, 22 bp, Homo sapiens
ggcacaggagctagtcaaagcc

SEQ ID NO: 8567539 - DNA, 22 bp, Homo sapiens
ggcacaggagctagtcaaagcc

SEQ ID NO: 8567540 - DNA, 22 bp, Homo sapiens
ggcacagcaggagctatgtgaa

SEQ ID NO: 8567541 - DNA, 22 bp, Homo sapiens
ggcacagccctctctgtggaca

SEQ ID NO: 8567542 - DNA, 22 bp, Homo sapiens
ggcacagccctctctgtggaca

SEQ ID NO: 8567543 - DNA, 22 bp, Homo sapiens
ggcacagcgactaccatcgaaa

SEQ ID NO: 8567544 - DNA, 22 bp, Homo sapiens
ggcacagcgactaccatcgaaa

SEQ ID NO: 8567545 - DNA, 22 bp, Homo sapiens
ggcagaggtagctggaaccagg

SEQ ID NO: 8567546 - DNA, 22 bp, Homo sapiens
ggcagaggtagctggaaccagg

SEQ ID NO: 8567547 - DNA, 22 bp, Homo sapiens
ggcaggaggaagagttagcacc

SEQ ID NO: 8567548 - DNA, 22 bp, Homo sapiens
ggcaggagggcggacaatgacc

SEQ ID NO: 8567549 - DNA, 22 bp, Homo sapiens
ggcaggaggtgagtggcgggtg

SEQ ID NO: 8567550 - DNA, 22 bp, Homo sapiens
ggcaggaggtgagtggcgggtg

SEQ ID NO: 8567551 - DNA, 22 bp, Homo sapiens
ggcaggagggcggacaatgacc

SEQ ID NO: 8567552 - DNA, 22 bp, Homo sapiens
ggcagaggtagctggaaccagg

SEQ ID NO: 8567553 - DNA, 22 bp, Homo sapiens
ggcagaggtagctggaaccagg

SEQ ID NO: 8567554 - DNA, 22 bp, Homo sapiens
ggcagaggtagctggaaccagg

SEQ ID NO: 8567555 - DNA, 22 bp, Homo sapiens
ggcagaggtagctggaaccagg

SEQ ID NO: 8567556 - DNA, 22 bp, Homo sapiens
ggcagaggtagctggaaccagg

SEQ ID NO: 8567557 - DNA, 22 bp, Homo sapiens
ggcagaggtagctggaaccagg

SEQ ID NO: 8567558 - DNA, 22 bp, Homo sapiens
ggcagaggtagctggaaccagg

SEQ ID NO: 8567559 - DNA, 20 bp, Homo sapiens
ggcagagggcctgggagaag

SEQ ID NO: 8567560 - DNA, 20 bp, Homo sapiens
ggcagagggcctgggagaag

SEQ ID NO: 8567561 - DNA, 20 bp, Homo sapiens
ggcagagggcctgggagaag

SEQ ID NO: 8567562 - DNA, 20 bp, Homo sapiens
ggcagagggcctgggagaag

SEQ ID NO: 8567563 - DNA, 22 bp, Homo sapiens
ggcaggcaatgaggatgggaag

SEQ ID NO: 8567564 - DNA, 22 bp, Homo sapiens
ggcaggcaccagctcagcaata

SEQ ID NO: 8567565 - DNA, 22 bp, Homo sapiens
ggcaggcaagtctgctctgtga

SEQ ID NO: 8567566 - DNA, 22 bp, Homo sapiens
ggcaggcaacggaccactagtc

SEQ ID NO: 8567567 - DNA, 22 bp, Homo sapiens
ggcaggaggtgagtggcgggtg

SEQ ID NO: 8567568 - DNA, 22 bp, Homo sapiens
ggagtcccagcaaagccttccc

SEQ ID NO: 8567569 - DNA, 22 bp, Homo sapiens
ggagtcagcctgtcagagtgta

SEQ ID NO: 8567570 - DNA, 22 bp, Homo sapiens
ggagtcagcctgtcagagtgta

SEQ ID NO: 8567571 - DNA, 22 bp, Homo sapiens
ggagtcagcctgtcagagtgta

SEQ ID NO: 8567572 - DNA, 22 bp, Homo sapiens
ggagtcagcctgtcagagtgta

SEQ ID NO: 8567573 - DNA, 22 bp, Homo sapiens
ggagtcaggagcaggctgggct

SEQ ID NO: 8567574 - DNA, 22 bp, Homo sapiens
ggagtcaggatcctggggatgg

SEQ ID NO: 8567575 - DNA, 22 bp, Homo sapiens
ggagtcaggagcaggctgggct

SEQ ID NO: 8567576 - DNA, 21 bp, Homo sapiens
ggagtcagggtctggctgggg

SEQ ID NO: 8567577 - DNA, 21 bp, Homo sapiens
ggagtcagggtctggctgggg

SEQ ID NO: 8567578 - DNA, 22 bp, Homo sapiens
ggagtcacctgggaggactggg

SEQ ID NO: 8567579 - DNA, 22 bp, Homo sapiens
ggagtcacctgggaggactggg

SEQ ID NO: 8567580 - DNA, 22 bp, Homo sapiens
ggagtcaccaagtaggagtctt

SEQ ID NO: 8567581 - DNA, 20 bp, Homo sapiens
ggagtcacattctttactgc

SEQ ID NO: 8567582 - DNA, 22 bp, Homo sapiens
ggagtcagaatggcagggtggt

SEQ ID NO: 8567583 - DNA, 22 bp, Homo sapiens
ggagtcagaatggcagggtggt

SEQ ID NO: 8567584 - DNA, 22 bp, Homo sapiens
ggagccagaggctgctgctgtg

SEQ ID NO: 8567585 - DNA, 22 bp, Homo sapiens
ggagccagaggctgctgctgtg

SEQ ID NO: 8567586 - DNA, 22 bp, Homo sapiens
ggagccagaggctgctgctgtg

SEQ ID NO: 8567587 - DNA, 22 bp, Homo sapiens
ggagccagaggctgctgctgtg

SEQ ID NO: 8567588 - DNA, 22 bp, Homo sapiens
ggagccagagcactggggagcc

SEQ ID NO: 8567589 - DNA, 22 bp, Homo sapiens
ggagccagagcactggggagcc

SEQ ID NO: 8567590 - DNA, 22 bp, Homo sapiens
ggagccagagggatgcagttga

SEQ ID NO: 8567591 - DNA, 22 bp, Homo sapiens
ggagccagagggatgcagttga

SEQ ID NO: 8567592 - DNA, 22 bp, Homo sapiens
ggagccagagtctgcagtgtaa

SEQ ID NO: 8567593 - DNA, 22 bp, Homo sapiens
ggagccagagtctgcagtgtaa

SEQ ID NO: 8567594 - DNA, 22 bp, Homo sapiens
ggagccagagtttaatgtggag

SEQ ID NO: 8567595 - DNA, 22 bp, Homo sapiens
ggagccagagtttaatgtggag

SEQ ID NO: 8567596 - DNA, 19 bp, Homo sapiens
ggagccagctgtggaaggc

SEQ ID NO: 8567597 - DNA, 19 bp, Homo sapiens
ggagccagctgtggaaggc

SEQ ID NO: 8567598 - DNA, 19 bp, Homo sapiens
ggagccagctgtggaaggc

SEQ ID NO: 8567599 - DNA, 22 bp, Homo sapiens
ggagtattgtagcttccagttc

SEQ ID NO: 8567600 - DNA, 17 bp, Homo sapiens
ggagccaggagcccacc

SEQ ID NO: 8567601 - DNA, 22 bp, Homo sapiens
ggagccagcagggtgacactga

SEQ ID NO: 8567602 - DNA, 23 bp, Homo sapiens
ggagccagcctgtggggagcggg

SEQ ID NO: 8567603 - DNA, 22 bp, Homo sapiens
ggagccagcagggtgacactga

SEQ ID NO: 8567604 - DNA, 19 bp, Homo sapiens
ggagccagctgtggaaggc

SEQ ID NO: 8567605 - DNA, 22 bp, Homo sapiens
ggagccagctccctccttgtga

SEQ ID NO: 8567606 - DNA, 23 bp, Homo sapiens
ggagccagcctgtggggagcggg

SEQ ID NO: 8567607 - DNA, 23 bp, Homo sapiens
ggagccagcctgtggggagcggg

SEQ ID NO: 8567608 - DNA, 23 bp, Homo sapiens
ggagtgcaatggcgccatctcgg

SEQ ID NO: 8567609 - DNA, 23 bp, Homo sapiens
ggagtgcaatggcgccatctcgg

SEQ ID NO: 8567610 - DNA, 22 bp, Homo sapiens
ggagtgagtactggagtagctg

SEQ ID NO: 8567611 - DNA, 22 bp, Homo sapiens
ggagtgagtactggagtagctg

SEQ ID NO: 8567612 - DNA, 22 bp, Homo sapiens
ggagtgagtggccttgtcactg

SEQ ID NO: 8567613 - DNA, 23 bp, Homo sapiens
ggagtgcaatggcgccatctcgg

SEQ ID NO: 8567614 - DNA, 23 bp, Homo sapiens
ggagtgcaatggcgccatctcgg

SEQ ID NO: 8567615 - DNA, 23 bp, Homo sapiens
ggagtgcaatggcgccatctcgg

SEQ ID NO: 8567616 - DNA, 23 bp, Homo sapiens
ggagtgcaatggcgccatctcgg

SEQ ID NO: 8567617 - DNA, 22 bp, Homo sapiens
ggcaaacagacttgaccatctt

SEQ ID NO: 8567618 - DNA, 22 bp, Homo sapiens
ggcaaagccctgcctggttcaa

SEQ ID NO: 8567619 - DNA, 22 bp, Homo sapiens
ggcaaagccttactctaactga

SEQ ID NO: 8567620 - DNA, 22 bp, Homo sapiens
ggcaaagagacatgcatcgggg

SEQ ID NO: 8567621 - DNA, 22 bp, Homo sapiens
ggattttagagtacctaagtgt

SEQ ID NO: 8567622 - DNA, 22 bp, Homo sapiens
ggcaagaggtccaagaggtctc

SEQ ID NO: 8567623 - DNA, 22 bp, Homo sapiens
ggcaagaggtccaagaggtctc

SEQ ID NO: 8567624 - DNA, 22 bp, Homo sapiens
ggcaagagggcagatggagtgc

SEQ ID NO: 8567625 - DNA, 22 bp, Homo sapiens
ggcaagagggcagatggagtgc

SEQ ID NO: 8567626 - DNA, 22 bp, Homo sapiens
ggcaagaggtccaagaggtctc

SEQ ID NO: 8567627 - DNA, 22 bp, Homo sapiens
ggcaagaggtccaagaggtctc

SEQ ID NO: 8567628 - DNA, 22 bp, Homo sapiens
ggcaagagtgaggagtgtctct

SEQ ID NO: 8567629 - DNA, 22 bp, Homo sapiens
ggcaagagttgaagctccagga

SEQ ID NO: 8567630 - DNA, 22 bp, Homo sapiens
ggcaacaactggacatagctgg

SEQ ID NO: 8567631 - DNA, 22 bp, Homo sapiens
ggcaaagctgggattcaaaccc

SEQ ID NO: 8567632 - DNA, 22 bp, Homo sapiens
ggcaaagttttcatctcataac

SEQ ID NO: 8567633 - DNA, 22 bp, Homo sapiens
ggcaaagttttcatctcataac

SEQ ID NO: 8567634 - DNA, 22 bp, Homo sapiens
ggcaaaggaaaacgtctcagct

SEQ ID NO: 8567635 - DNA, 21 bp, Homo sapiens
ggcaagaaacacaatcaagta

SEQ ID NO: 8567636 - DNA, 22 bp, Homo sapiens
ggccagggggcttcagactcca

SEQ ID NO: 8567637 - DNA, 22 bp, Homo sapiens
ggccagggggcttcagactcca

SEQ ID NO: 8567638 - DNA, 22 bp, Homo sapiens
ggccaggtccagtggaaggccc

SEQ ID NO: 8567639 - DNA, 22 bp, Homo sapiens
ggccagggggcttcagactcca

SEQ ID NO: 8567640 - DNA, 23 bp, Homo sapiens
ggccaggtgcaccttagagagcc

SEQ ID NO: 8567641 - DNA, 23 bp, Homo sapiens
ggccaggtgcaccttagagagcc

SEQ ID NO: 8567642 - DNA, 22 bp, Homo sapiens
ggccagggcctggggactgtcc

SEQ ID NO: 8567643 - DNA, 22 bp, Homo sapiens
ggccagggcctggggactgtcc

SEQ ID NO: 8567644 - DNA, 22 bp, Homo sapiens
ggccagggcctggggactgtcc

SEQ ID NO: 8567645 - DNA, 22 bp, Homo sapiens
ggccagggcctggggactgtcc

SEQ ID NO: 8567646 - DNA, 22 bp, Homo sapiens
ggccagggggcttcagactcca

SEQ ID NO: 8567647 - DNA, 22 bp, Homo sapiens
ggccatgccaggctgcctggga

SEQ ID NO: 8567648 - DNA, 22 bp, Homo sapiens
ggccatgcaggtcagaggtggg

SEQ ID NO: 8567649 - DNA, 22 bp, Homo sapiens
ggccagtcccctaatccagggc

SEQ ID NO: 8567650 - DNA, 22 bp, Homo sapiens
ggccaggttgggtggaagtggc

SEQ ID NO: 8567651 - DNA, 22 bp, Homo sapiens
ggccagtctgggccacggtcgg

SEQ ID NO: 8567652 - DNA, 22 bp, Homo sapiens
ggccaggttgggtggaagtggc

SEQ ID NO: 8567653 - DNA, 22 bp, Homo sapiens
ggccacagaacagctacaggac

SEQ ID NO: 8567654 - DNA, 19 bp, Homo sapiens
ggccaggctgactgtggtc

SEQ ID NO: 8567655 - DNA, 22 bp, Homo sapiens
ggccaaggtgttctgatatgcc

SEQ ID NO: 8567656 - DNA, 22 bp, Homo sapiens
ggccaattccaggagccggcgg

SEQ ID NO: 8567657 - DNA, 21 bp, Homo sapiens
ggccacaagcggaggagccgc

SEQ ID NO: 8567658 - DNA, 22 bp, Homo sapiens
ggccacacagatgactgctttc

SEQ ID NO: 8567659 - DNA, 20 bp, Homo sapiens
ggcatgggtggggctcccag

SEQ ID NO: 8567660 - DNA, 18 bp, Homo sapiens
ggcatgtgagtgctgagg

SEQ ID NO: 8567661 - DNA, 18 bp, Homo sapiens
ggcatgtgagtgctgagg

SEQ ID NO: 8567662 - DNA, 18 bp, Homo sapiens
ggcatgtgagtgctgagg

SEQ ID NO: 8567663 - DNA, 22 bp, Homo sapiens
ggcatgtgcctgaggtcacaca

SEQ ID NO: 8567664 - DNA, 22 bp, Homo sapiens
ggcatgtatgtgcatttttgta

SEQ ID NO: 8567665 - DNA, 22 bp, Homo sapiens
ggccaaggctcttgagggctga

SEQ ID NO: 8567666 - DNA, 22 bp, Homo sapiens
ggccaaggctcttgagggctga

SEQ ID NO: 8567667 - DNA, 22 bp, Homo sapiens
ggccaaggtggagaaggcactg

SEQ ID NO: 8567668 - DNA, 22 bp, Homo sapiens
ggcatgtttcatcacatcaaga

SEQ ID NO: 8567669 - DNA, 22 bp, Homo sapiens
ggcatgtgcctgaggtcacaca

SEQ ID NO: 8567670 - DNA, 22 bp, Homo sapiens
ggcattaactctgtttcaattt

SEQ ID NO: 8567671 - DNA, 22 bp, Homo sapiens
ggcagtgaatgaaacagaggct

SEQ ID NO: 8567672 - DNA, 22 bp, Homo sapiens
ggcagtctttcccttgagctct

SEQ ID NO: 8567673 - DNA, 22 bp, Homo sapiens
ggcagtgaaaaagtatgtttcc

SEQ ID NO: 8567674 - DNA, 22 bp, Homo sapiens
ggcagtgaacagaaatgcagaa

SEQ ID NO: 8567675 - DNA, 22 bp, Homo sapiens
ggcatggctgggttctggtgag

SEQ ID NO: 8567676 - DNA, 22 bp, Homo sapiens
ggcatgggagtgagcaacctta

SEQ ID NO: 8567677 - DNA, 22 bp, Homo sapiens
ggcatggctcggagtcagaaca

SEQ ID NO: 8567678 - DNA, 22 bp, Homo sapiens
ggcatggctcggagtcagaaca

SEQ ID NO: 8567679 - DNA, 21 bp, Homo sapiens
ggcatggcacctctgggcagg

SEQ ID NO: 8567680 - DNA, 22 bp, Homo sapiens
ggcatgggccgaggtgcctcct

SEQ ID NO: 8567681 - DNA, 22 bp, Homo sapiens
ggcatgggccgaggtgcctcct

SEQ ID NO: 8567682 - DNA, 22 bp, Homo sapiens
ggcatgggccgaggtgcctcct

SEQ ID NO: 8567683 - DNA, 22 bp, Homo sapiens
ggcatggggtgtatgtggcacg

SEQ ID NO: 8567684 - DNA, 22 bp, Homo sapiens
ggcatggggtgtatgtggcacg

SEQ ID NO: 8567685 - DNA, 22 bp, Homo sapiens
ggcatggggtgtatgtggcacg

SEQ ID NO: 8567686 - DNA, 22 bp, Homo sapiens
ggcaggcagaggctgagacagg

SEQ ID NO: 8567687 - DNA, 22 bp, Homo sapiens
ggcaggtggcactgctgctccc

SEQ ID NO: 8567688 - DNA, 22 bp, Homo sapiens
ggcaggtgtgagatcgaggcca

SEQ ID NO: 8567689 - DNA, 22 bp, Homo sapiens
ggcagtcacttttgcttgtgcc

SEQ ID NO: 8567690 - DNA, 22 bp, Homo sapiens
ggcagtcatttaatccctgcat

SEQ ID NO: 8567691 - DNA, 22 bp, Homo sapiens
ggcagtcatttaatccctgcat

SEQ ID NO: 8567692 - DNA, 20 bp, Homo sapiens
ggccttgggtttcgcctgtt

SEQ ID NO: 8567693 - DNA, 22 bp, Homo sapiens
ggccttgggtataggtgggtat

SEQ ID NO: 8567694 - DNA, 17 bp, Homo sapiens
ggccttggggcctcagt

SEQ ID NO: 8567695 - DNA, 22 bp, Homo sapiens
ggccttggggaggatggtgtcc

SEQ ID NO: 8567696 - DNA, 17 bp, Homo sapiens
ggccttgggctgctctt

SEQ ID NO: 8567697 - DNA, 22 bp, Homo sapiens
ggccttggggaggatggtgtcc

SEQ ID NO: 8567698 - DNA, 22 bp, Homo sapiens
ggccttgggctggctgcagtat

SEQ ID NO: 8567699 - DNA, 22 bp, Homo sapiens
ggccttggtgctctgtgttgca

SEQ ID NO: 8567700 - DNA, 22 bp, Homo sapiens
ggccttggtgccatggccagtt

SEQ ID NO: 8567701 - DNA, 22 bp, Homo sapiens
ggccttggtgccatggccagtt

SEQ ID NO: 8567702 - DNA, 22 bp, Homo sapiens
ggccttggtgccatggccagtt

SEQ ID NO: 8567703 - DNA, 22 bp, Homo sapiens
ggccttggtaaagggatgcatg

SEQ ID NO: 8567704 - DNA, 22 bp, Homo sapiens
ggccttggtggctttgctgatg

SEQ ID NO: 8567705 - DNA, 22 bp, Homo sapiens
ggccttggttccaaagcaggca

SEQ ID NO: 8567706 - DNA, 22 bp, Homo sapiens
ggccttggttctgtcacagccg

SEQ ID NO: 8567707 - DNA, 22 bp, Homo sapiens
ggccttggttctgtcacagccg

SEQ ID NO: 8567708 - DNA, 19 bp, Homo sapiens
ggcctttcacctggatgct

SEQ ID NO: 8567709 - DNA, 22 bp, Homo sapiens
ggcctttgcgtccacgccgctt

SEQ ID NO: 8567710 - DNA, 22 bp, Homo sapiens
ggcgctggccacggtggctctg

SEQ ID NO: 8567711 - DNA, 22 bp, Homo sapiens
ggcgaggccgggacaggctgga

SEQ ID NO: 8567712 - DNA, 22 bp, Homo sapiens
ggcgaggccgggacaggctgga

SEQ ID NO: 8567713 - DNA, 22 bp, Homo sapiens
ggcgaggccgggacaggctgga

SEQ ID NO: 8567714 - DNA, 22 bp, Homo sapiens
ggcctgagggtgggctctcagt

SEQ ID NO: 8567715 - DNA, 22 bp, Homo sapiens
ggcctgaggcgtcccagctgtg

SEQ ID NO: 8567716 - DNA, 22 bp, Homo sapiens
ggcctgagaatgtaccagatct

SEQ ID NO: 8567717 - DNA, 22 bp, Homo sapiens
ggcctgagaatgtaccagatct

SEQ ID NO: 8567718 - DNA, 22 bp, Homo sapiens
ggcctgagaaccatggggccaa

SEQ ID NO: 8567719 - DNA, 22 bp, Homo sapiens
ggcctgaggcgtcccagctgtg

SEQ ID NO: 8567720 - DNA, 21 bp, Homo sapiens
ggcctgagcacctgtccacct

SEQ ID NO: 8567721 - DNA, 22 bp, Homo sapiens
ggcctgaggcgtcccagctgtg

SEQ ID NO: 8567722 - DNA, 22 bp, Homo sapiens
ggcctgaatgcctgagtgtggg

SEQ ID NO: 8567723 - DNA, 22 bp, Homo sapiens
ggcctgagaaccatggggccaa

SEQ ID NO: 8567724 - DNA, 22 bp, Homo sapiens
ggcctcttctgctcatactttc

SEQ ID NO: 8567725 - DNA, 22 bp, Homo sapiens
ggcctcttctgctcatactttc

SEQ ID NO: 8567726 - DNA, 22 bp, Homo sapiens
ggcctcttatctggctcctgca

SEQ ID NO: 8567727 - DNA, 22 bp, Homo sapiens
ggcctgaaatagctctgaggtt

SEQ ID NO: 8567728 - DNA, 22 bp, Homo sapiens
ggcctgaaatagctctgaggtt

SEQ ID NO: 8567729 - DNA, 22 bp, Homo sapiens
ggcctgaaataaagtagcagaa

SEQ ID NO: 8567730 - DNA, 21 bp, Homo sapiens
ggcctgaaaaagtgaatgctt

SEQ ID NO: 8567731 - DNA, 22 bp, Homo sapiens
ggcctgcacagaggtggctcta

SEQ ID NO: 8567732 - DNA, 18 bp, Homo sapiens
ggcctgcagtgaagcaag

SEQ ID NO: 8567733 - DNA, 18 bp, Homo sapiens
ggcctgcagtgaagcaag

SEQ ID NO: 8567734 - DNA, 22 bp, Homo sapiens
ggccttgggatgtggctgcagc

SEQ ID NO: 8567735 - DNA, 22 bp, Homo sapiens
ggccttgggatgtggctgcagc

SEQ ID NO: 8567736 - DNA, 22 bp, Homo sapiens
ggccttgggatgtggctgcagc

SEQ ID NO: 8567737 - DNA, 22 bp, Homo sapiens
ggccttgggcagacacgtcaca

SEQ ID NO: 8567738 - DNA, 21 bp, Homo sapiens
ggcctgagtataggacaggcc

SEQ ID NO: 8567739 - DNA, 21 bp, Homo sapiens
ggcctgagtataggacaggcc

SEQ ID NO: 8567740 - DNA, 21 bp, Homo sapiens
ggcctgagtataggacaggcc

SEQ ID NO: 8567741 - DNA, 22 bp, Homo sapiens
ggcctgagtcacatcaggagag

SEQ ID NO: 8567742 - DNA, 22 bp, Homo sapiens
ggcctgagtcacatcaggagag

SEQ ID NO: 8567743 - DNA, 22 bp, Homo sapiens
ggcctgagtcccacctggctgt

SEQ ID NO: 8567744 - DNA, 22 bp, Homo sapiens
ggcctgagtcccacctggctgt

SEQ ID NO: 8567745 - DNA, 22 bp, Homo sapiens
ggcctcagtttcttcaactgta

SEQ ID NO: 8567746 - DNA, 22 bp, Homo sapiens
ggcctcagtttcttcaactgta

SEQ ID NO: 8567747 - DNA, 22 bp, Homo sapiens
ggcctcagtttcttcaactgta

SEQ ID NO: 8567748 - DNA, 22 bp, Homo sapiens
ggcctcagtttcttcaactgta

SEQ ID NO: 8567749 - DNA, 22 bp, Homo sapiens
ggcctcatcacagtgcattagt

SEQ ID NO: 8567750 - DNA, 22 bp, Homo sapiens
ggcctcagtttctccatgggtt

SEQ ID NO: 8567751 - DNA, 22 bp, Homo sapiens
ggcctcagtttctccatgggtt

SEQ ID NO: 8567752 - DNA, 20 bp, Homo sapiens
ggcctcagtgtccttgtttg

SEQ ID NO: 8567753 - DNA, 22 bp, Homo sapiens
ggcctcagtttctccatgggtt

SEQ ID NO: 8567754 - DNA, 22 bp, Homo sapiens
ggcctcagtttctccatgggtt

SEQ ID NO: 8567755 - DNA, 22 bp, Homo sapiens
ggcctcagtttctccatgggtt

SEQ ID NO: 8567756 - DNA, 22 bp, Homo sapiens
ggcctcagggttgggcccatta

SEQ ID NO: 8567757 - DNA, 22 bp, Homo sapiens
ggcctcagggttgggcccatta

SEQ ID NO: 8567758 - DNA, 23 bp, Homo sapiens
ggcctcagtgatgatgggttaaa

SEQ ID NO: 8567759 - DNA, 23 bp, Homo sapiens
ggcctcagtgatgatgggttaaa

SEQ ID NO: 8567760 - DNA, 20 bp, Homo sapiens
ggcctcagtgtccttgtttg

SEQ ID NO: 8567761 - DNA, 22 bp, Homo sapiens
ggcctcagtgggccgctgcagg

SEQ ID NO: 8567762 - DNA, 22 bp, Homo sapiens
ggcctcagtgggccgctgcagg

SEQ ID NO: 8567763 - DNA, 22 bp, Homo sapiens
ggcctctgttctgcattcctcc

SEQ ID NO: 8567764 - DNA, 22 bp, Homo sapiens
ggcctctgtttggagccaggat

SEQ ID NO: 8567765 - DNA, 22 bp, Homo sapiens
ggcctctgttctgcattcctcc

SEQ ID NO: 8567766 - DNA, 23 bp, Homo sapiens
ggcctctgtgttctgcccacatg

SEQ ID NO: 8567767 - DNA, 22 bp, Homo sapiens
ggcctctgttctgcattcctcc

SEQ ID NO: 8567768 - DNA, 23 bp, Homo sapiens
ggcctctgtgttctgcccacatg

SEQ ID NO: 8567769 - DNA, 23 bp, Homo sapiens
ggcctctgtgttctgcccacatg

SEQ ID NO: 8567770 - DNA, 22 bp, Homo sapiens
ggcctcttatctggctcctgca

SEQ ID NO: 8567771 - DNA, 22 bp, Homo sapiens
ggcctctgtttggagccaggat

SEQ ID NO: 8567772 - DNA, 22 bp, Homo sapiens
ggcctctgtttggagccaggat

SEQ ID NO: 8567773 - DNA, 22 bp, Homo sapiens
ggcctctgtttggagccaggat

SEQ ID NO: 8567774 - DNA, 21 bp, Homo sapiens
ggcctctgtcatcctgggaag

SEQ ID NO: 8567775 - DNA, 21 bp, Homo sapiens
ggcctctgtcatcctgggaag

SEQ ID NO: 8567776 - DNA, 22 bp, Homo sapiens
ggcctctggttcacagggagga

SEQ ID NO: 8567777 - DNA, 21 bp, Homo sapiens
ggcctctgtcatcctgggaag

SEQ ID NO: 8567778 - DNA, 21 bp, Homo sapiens
ggcctctgtcatcctgggaag

SEQ ID NO: 8567779 - DNA, 22 bp, Homo sapiens
ggcctctggttcgtggtgacct

SEQ ID NO: 8567780 - DNA, 21 bp, Homo sapiens
ggcctctgtcatcctgggaag

SEQ ID NO: 8567781 - DNA, 22 bp, Homo sapiens
ggcctctggttcacagggagga

SEQ ID NO: 8567782 - DNA, 22 bp, Homo sapiens
ggcctctggttcacagggagga

SEQ ID NO: 8567783 - DNA, 22 bp, Homo sapiens
ggcctctggttcacagggagga

SEQ ID NO: 8567784 - DNA, 22 bp, Homo sapiens
ggcctctggttcgtggtgacct

SEQ ID NO: 8567785 - DNA, 21 bp, Homo sapiens
ggcctcagccacctggctctg

SEQ ID NO: 8567786 - DNA, 21 bp, Homo sapiens
ggcctcagccacctggctctg

SEQ ID NO: 8567787 - DNA, 22 bp, Homo sapiens
ggcctcagaggaggtgtgagtc

SEQ ID NO: 8567788 - DNA, 22 bp, Homo sapiens
ggcctcagaggaggtgtgagtc

SEQ ID NO: 8567789 - DNA, 22 bp, Homo sapiens
ggcctcagaggaggtgtgagtc

SEQ ID NO: 8567790 - DNA, 23 bp, Homo sapiens
ggcctcagcgcacagaaactgct

SEQ ID NO: 8567791 - DNA, 23 bp, Homo sapiens
ggcctcagcgcacagaaactgct

SEQ ID NO: 8567792 - DNA, 18 bp, Homo sapiens
ggcctcagcctggccgga

SEQ ID NO: 8567793 - DNA, 22 bp, Homo sapiens
ggcctcagggtcactctgtaga

SEQ ID NO: 8567794 - DNA, 22 bp, Homo sapiens
ggcctcagggtcactctgtaga

SEQ ID NO: 8567795 - DNA, 22 bp, Homo sapiens
ggccatgctgttgcctgctggt

SEQ ID NO: 8567796 - DNA, 22 bp, Homo sapiens
ggccatggaccccgagctgacc

SEQ ID NO: 8567797 - DNA, 22 bp, Homo sapiens
ggccatggaccccgagctgacc

SEQ ID NO: 8567798 - DNA, 23 bp, Homo sapiens
ggccatggagacttagaatgggc

SEQ ID NO: 8567799 - DNA, 22 bp, Homo sapiens
ggcctcagaccggagctggcca

SEQ ID NO: 8567800 - DNA, 22 bp, Homo sapiens
ggcctcagagaaggctgtgcgg

SEQ ID NO: 8567801 - DNA, 22 bp, Homo sapiens
ggcctcagagaaggctgtgcgg

SEQ ID NO: 8567802 - DNA, 22 bp, Homo sapiens
ggtttggttttggccatcttcc

SEQ ID NO: 8567803 - DNA, 22 bp, Homo sapiens
ggtttgttggggtccaggccca

SEQ ID NO: 8567804 - DNA, 22 bp, Homo sapiens
ggttttaaccattcacaagtga

SEQ ID NO: 8567805 - DNA, 22 bp, Homo sapiens
ggtttgaacagctttggagaag

SEQ ID NO: 8567806 - DNA, 19 bp, Homo sapiens
ggtttgaagaaaatcttgc

SEQ ID NO: 8567807 - DNA, 22 bp, Homo sapiens
ggtttgacagcttggggctgtc

SEQ ID NO: 8567808 - DNA, 22 bp, Homo sapiens
ggtttgacagcttggggctgtc

SEQ ID NO: 8567809 - DNA, 22 bp, Homo sapiens
ggtttctagcagagtctcttta

SEQ ID NO: 8567810 - DNA, 22 bp, Homo sapiens
ggtttcagccctgctgttcctg

SEQ ID NO: 8567811 - DNA, 22 bp, Homo sapiens
ggttttaactacagaattgcaa

SEQ ID NO: 8567812 - DNA, 22 bp, Homo sapiens
ggttttatagcagtactatcag

SEQ ID NO: 8567813 - DNA, 22 bp, Homo sapiens
ggttttatcctacccacacagc

SEQ ID NO: 8567814 - DNA, 22 bp, Homo sapiens
ggttttattaccccttaaacac

SEQ ID NO: 8567815 - DNA, 22 bp, Homo sapiens
ggttttattaactttaacatca

SEQ ID NO: 8567816 - DNA, 23 bp, Homo sapiens
ggttttcatggcattccttgcct

SEQ ID NO: 8567817 - DNA, 22 bp, Homo sapiens
ggttttcaaagaggcatttcat

SEQ ID NO: 8567818 - DNA, 22 bp, Homo sapiens
ggttttcagtttgtgagctctg

SEQ ID NO: 8567819 - DNA, 22 bp, Homo sapiens
gtaaaacaagctttatggttcc

SEQ ID NO: 8567820 - DNA, 22 bp, Homo sapiens
gtaaaacatgttttaactagga

SEQ ID NO: 8567821 - DNA, 23 bp, Homo sapiens
gtaaaatacgcagtgcagtgtga

SEQ ID NO: 8567822 - DNA, 23 bp, Homo sapiens
gtaaaatacgcagtgcagtgtga

SEQ ID NO: 8567823 - DNA, 22 bp, Homo sapiens
gtacatttatttttgcagcata

SEQ ID NO: 8567824 - DNA, 22 bp, Homo sapiens
gtaaaacctgcttttcaacacc

SEQ ID NO: 8567825 - DNA, 22 bp, Homo sapiens
gtaaaactgcagaacttggagg

SEQ ID NO: 8567826 - DNA, 22 bp, Homo sapiens
gtaaaactgtctaatggtatat

SEQ ID NO: 8567827 - DNA, 22 bp, Homo sapiens
gtaaaactgtctaatggtatat

SEQ ID NO: 8567828 - DNA, 22 bp, Homo sapiens
gtaaaactgtctaatggtatat

SEQ ID NO: 8567829 - DNA, 22 bp, Homo sapiens
gtacatttcatttaaatgatgt

SEQ ID NO: 8567830 - DNA, 22 bp, Homo sapiens
gtacatttatttttgcagcata

SEQ ID NO: 8567831 - DNA, 22 bp, Homo sapiens
gtacatttcagtttccttaaga

SEQ ID NO: 8567832 - DNA, 22 bp, Homo sapiens
gtacatttctcccaacactaaa

SEQ ID NO: 8567833 - DNA, 22 bp, Homo sapiens
gtacatttctcttgttcttatt

SEQ ID NO: 8567834 - DNA, 22 bp, Homo sapiens
gtacatttctcttgttcttatt

SEQ ID NO: 8567835 - DNA, 22 bp, Homo sapiens
gtacattttactttgtttgaat

SEQ ID NO: 8567836 - DNA, 22 bp, Homo sapiens
gtacattttactttgtttgaat

SEQ ID NO: 8567837 - DNA, 22 bp, Homo sapiens
gtacattttactttgtttgaat

SEQ ID NO: 8567838 - DNA, 22 bp, Homo sapiens
gtacattttactttgtttgaat

SEQ ID NO: 8567839 - DNA, 22 bp, Homo sapiens
gtacattttgaggttaaaacaa

SEQ ID NO: 8567840 - DNA, 22 bp, Homo sapiens
gtacattttgaggttaaaacaa

SEQ ID NO: 8567841 - DNA, 22 bp, Homo sapiens
gtaccagtctctgtgggcacct

SEQ ID NO: 8567842 - DNA, 22 bp, Homo sapiens
gtattcttgagtggcaactagg

SEQ ID NO: 8567843 - DNA, 21 bp, Homo sapiens
gtattctttatgaagtgaaaa

SEQ ID NO: 8567844 - DNA, 22 bp, Homo sapiens
gtattcttggttatcaaaatac

SEQ ID NO: 8567845 - DNA, 22 bp, Homo sapiens
gtattcctaagtcatgacaaat

SEQ ID NO: 8567846 - DNA, 22 bp, Homo sapiens
gtattctgggccgattacaaaa

SEQ ID NO: 8567847 - DNA, 22 bp, Homo sapiens
gtattccttcagaagacgttta

SEQ ID NO: 8567848 - DNA, 22 bp, Homo sapiens
gtattcctgcaaatagcagtga

SEQ ID NO: 8567849 - DNA, 22 bp, Homo sapiens
gtattcagggctagtcagagga

SEQ ID NO: 8567850 - DNA, 22 bp, Homo sapiens
gtattcagaaggatgatctagt

SEQ ID NO: 8567851 - DNA, 22 bp, Homo sapiens
gtatttataggggaatgagagt

SEQ ID NO: 8567852 - DNA, 22 bp, Homo sapiens
gtatttaattctgtgcttctag

SEQ ID NO: 8567853 - DNA, 22 bp, Homo sapiens
gtatttataggggaatgagagt

SEQ ID NO: 8567854 - DNA, 22 bp, Homo sapiens
gtatttataggggaatgagagt

SEQ ID NO: 8567855 - DNA, 23 bp, Homo sapiens
gtatttcagcattctcagttaaa

SEQ ID NO: 8567856 - DNA, 22 bp, Homo sapiens
gtatttaattccattaagttag

SEQ ID NO: 8567857 - DNA, 22 bp, Homo sapiens
gtattgcaattactcttcttct

SEQ ID NO: 8567858 - DNA, 22 bp, Homo sapiens
gtagaaattccatttactttga

SEQ ID NO: 8567859 - DNA, 22 bp, Homo sapiens
gtagaaatggtgtgtttcttct

SEQ ID NO: 8567860 - DNA, 22 bp, Homo sapiens
gtacctgggggatccacttctt

SEQ ID NO: 8567861 - DNA, 22 bp, Homo sapiens
gtacgtgcatgcacgtgtgcct

SEQ ID NO: 8567862 - DNA, 22 bp, Homo sapiens
gtagaactaggacttcaggtat

SEQ ID NO: 8567863 - DNA, 22 bp, Homo sapiens
gtagaactcccagtggtattgt

SEQ ID NO: 8567864 - DNA, 22 bp, Homo sapiens
gtagaactaggacttcaggtat

SEQ ID NO: 8567865 - DNA, 22 bp, Homo sapiens
gtagaagtgatgtcatgttata

SEQ ID NO: 8567866 - DNA, 22 bp, Homo sapiens
gtagaataaatgtacacatctg

SEQ ID NO: 8567867 - DNA, 22 bp, Homo sapiens
gtagaatatatggttagtattg

SEQ ID NO: 8567868 - DNA, 22 bp, Homo sapiens
gtagaatatatggttagtattg

SEQ ID NO: 8567869 - DNA, 22 bp, Homo sapiens
gtagacagcaaccaaaccaggt

SEQ ID NO: 8567870 - DNA, 22 bp, Homo sapiens
gtattagaagaaattataggta

SEQ ID NO: 8567871 - DNA, 22 bp, Homo sapiens
gtattagaagaaattataggta

SEQ ID NO: 8567872 - DNA, 22 bp, Homo sapiens
gtagacaagcacaggactcaga

SEQ ID NO: 8567873 - DNA, 22 bp, Homo sapiens
gtagacagaaagcggaatcata

SEQ ID NO: 8567874 - DNA, 22 bp, Homo sapiens
gtattagactgagaaatggagt

SEQ ID NO: 8567875 - DNA, 22 bp, Homo sapiens
gtattattctcagctttgggat

SEQ ID NO: 8567876 - DNA, 22 bp, Homo sapiens
gtattattgggtagtatggtaa

SEQ ID NO: 8567877 - DNA, 22 bp, Homo sapiens
gtattattctcagctttgggat

SEQ ID NO: 8567878 - DNA, 22 bp, Homo sapiens
gtccaagagtcaagaagggggc

SEQ ID NO: 8567879 - DNA, 22 bp, Homo sapiens
gtccaagagtcaagaagggggc

SEQ ID NO: 8567880 - DNA, 22 bp, Homo sapiens
gtccaagagtcaagaagggggc

SEQ ID NO: 8567881 - DNA, 22 bp, Homo sapiens
gtcatttttttcgtaatagtgg

SEQ ID NO: 8567882 - DNA, 22 bp, Homo sapiens
gtccaaatttttcacatgtaga

SEQ ID NO: 8567883 - DNA, 22 bp, Homo sapiens
gtccaaattccacagatttctc

SEQ ID NO: 8567884 - DNA, 22 bp, Homo sapiens
gtccaaaagagccagccgggcg

SEQ ID NO: 8567885 - DNA, 22 bp, Homo sapiens
gtcatttttttcgtaatagtgg

SEQ ID NO: 8567886 - DNA, 22 bp, Homo sapiens
gtcatttttgactttgaagtga

SEQ ID NO: 8567887 - DNA, 22 bp, Homo sapiens
gtcatttttgactttgaagtga

SEQ ID NO: 8567888 - DNA, 22 bp, Homo sapiens
gtcattttctagaattatttga

SEQ ID NO: 8567889 - DNA, 22 bp, Homo sapiens
gtcattttctagaattatttga

SEQ ID NO: 8567890 - DNA, 22 bp, Homo sapiens
gtcatttttcactgcatataga

SEQ ID NO: 8567891 - DNA, 22 bp, Homo sapiens
gtcattttgctgcatatttaga

SEQ ID NO: 8567892 - DNA, 22 bp, Homo sapiens
gtatttccattagtgtgtgcac

SEQ ID NO: 8567893 - DNA, 22 bp, Homo sapiens
gtatttcatcttgaaaaccagt

SEQ ID NO: 8567894 - DNA, 22 bp, Homo sapiens
gtccacagctggccagggcctc

SEQ ID NO: 8567895 - DNA, 18 bp, Homo sapiens
gtccacagccctcacagc

SEQ ID NO: 8567896 - DNA, 22 bp, Homo sapiens
gtccacagctctgaggtctccc

SEQ ID NO: 8567897 - DNA, 18 bp, Homo sapiens
gtccacagattcttcact

SEQ ID NO: 8567898 - DNA, 18 bp, Homo sapiens
gtccacagattcttcact

SEQ ID NO: 8567899 - DNA, 18 bp, Homo sapiens
gtccacagccctcacagc

SEQ ID NO: 8567900 - DNA, 22 bp, Homo sapiens
gtccactcccagtgcctgaggc

SEQ ID NO: 8567901 - DNA, 22 bp, Homo sapiens
gtccactcccagtgcctgaggc

SEQ ID NO: 8567902 - DNA, 22 bp, Homo sapiens
gtccactcactcttagtcactc

SEQ ID NO: 8567903 - DNA, 19 bp, Homo sapiens
gtccactccactcggtctc

SEQ ID NO: 8567904 - DNA, 22 bp, Homo sapiens
gtccacagggatggccacacat

SEQ ID NO: 8567905 - DNA, 22 bp, Homo sapiens
gtccacagctggccagggcctc

SEQ ID NO: 8567906 - DNA, 22 bp, Homo sapiens
gtccacataggaacccagcttc

SEQ ID NO: 8567907 - DNA, 22 bp, Homo sapiens
gtccacagggatggccacacat

SEQ ID NO: 8567908 - DNA, 21 bp, Homo sapiens
gtccacaggggtttgtcctgg

SEQ ID NO: 8567909 - DNA, 22 bp, Homo sapiens
gtccactgctgtgtgcttcacc

SEQ ID NO: 8567910 - DNA, 22 bp, Homo sapiens
gtccactctagggcagctctcg

SEQ ID NO: 8567911 - DNA, 22 bp, Homo sapiens
gtccactctctgccgtgcctgt

SEQ ID NO: 8567912 - DNA, 22 bp, Homo sapiens
gtccactgctgtgtgcttcacc

SEQ ID NO: 8567913 - DNA, 22 bp, Homo sapiens
gtccccagctgtgacgagagcc

SEQ ID NO: 8567914 - DNA, 22 bp, Homo sapiens
gtccccagctaatctctttgcc

SEQ ID NO: 8567915 - DNA, 22 bp, Homo sapiens
gtccccgacgtttggcttgatg

SEQ ID NO: 8567916 - DNA, 22 bp, Homo sapiens
gtcccctcaaaattcatatgtt

SEQ ID NO: 8567917 - DNA, 22 bp, Homo sapiens
gtcccctcagccacccatgggg

SEQ ID NO: 8567918 - DNA, 22 bp, Homo sapiens
gtcccctgtccagggccagcca

SEQ ID NO: 8567919 - DNA, 22 bp, Homo sapiens
gtcccctcagccacccatgggg

SEQ ID NO: 8567920 - DNA, 22 bp, Homo sapiens
gtcccctggcccccagcgtcgg

SEQ ID NO: 8567921 - DNA, 22 bp, Homo sapiens
gtcccctcattttagagaaaga

SEQ ID NO: 8567922 - DNA, 23 bp, Homo sapiens
gtccctcacccctaggcaatgcc

SEQ ID NO: 8567923 - DNA, 22 bp, Homo sapiens
gtccctcactggaccatatgaa

SEQ ID NO: 8567924 - DNA, 22 bp, Homo sapiens
gtccctcactggaccatatgaa

SEQ ID NO: 8567925 - DNA, 22 bp, Homo sapiens
gtccctcagtagtgcacagtgg

SEQ ID NO: 8567926 - DNA, 22 bp, Homo sapiens
gtccctcagtagtgcacagtgg

SEQ ID NO: 8567927 - DNA, 22 bp, Homo sapiens
gtccctcagtagtgcacagtgg

SEQ ID NO: 8567928 - DNA, 22 bp, Homo sapiens
gtccctcacccagatgctccca

SEQ ID NO: 8567929 - DNA, 22 bp, Homo sapiens
gtccctcacccagatgctccca

SEQ ID NO: 8567930 - DNA, 23 bp, Homo sapiens
gtccctcacccctaggcaatgcc

SEQ ID NO: 8567931 - DNA, 22 bp, Homo sapiens
gtccctcaaggtccagtcatgg

SEQ ID NO: 8567932 - DNA, 22 bp, Homo sapiens
gtccctcaaggtccagtcatgg

SEQ ID NO: 8567933 - DNA, 22 bp, Homo sapiens
gtccctagtggaaagacatgat

SEQ ID NO: 8567934 - DNA, 22 bp, Homo sapiens
gtccctagtggaaagacatgat

SEQ ID NO: 8567935 - DNA, 22 bp, Homo sapiens
gtccctgacacccgggtggagg

SEQ ID NO: 8567936 - DNA, 22 bp, Homo sapiens
gtccctgcatcaccacgggact

SEQ ID NO: 8567937 - DNA, 22 bp, Homo sapiens
gtccctgcatcaccacgggact

SEQ ID NO: 8567938 - DNA, 22 bp, Homo sapiens
gtccctctgctctagagagcca

SEQ ID NO: 8567939 - DNA, 22 bp, Homo sapiens
gtccctctgtgtccctgcagtc

SEQ ID NO: 8567940 - DNA, 22 bp, Homo sapiens
gtccctctgtgtccctgcagtc

SEQ ID NO: 8567941 - DNA, 17 bp, Homo sapiens
gtcctgggaggagagag

SEQ ID NO: 8567942 - DNA, 17 bp, Homo sapiens
gtcctgggaggagagag

SEQ ID NO: 8567943 - DNA, 17 bp, Homo sapiens
gtcctgggaggagagag

SEQ ID NO: 8567944 - DNA, 22 bp, Homo sapiens
gtcctgggaggggctggtcctg

SEQ ID NO: 8567945 - DNA, 22 bp, Homo sapiens
gtcctgggcctgctgaggctga

SEQ ID NO: 8567946 - DNA, 22 bp, Homo sapiens
gtcctgggcccaggggctgcct

SEQ ID NO: 8567947 - DNA, 22 bp, Homo sapiens
gtcctgggcccaggggctgcct

SEQ ID NO: 8567948 - DNA, 22 bp, Homo sapiens
gtcctgggcatgcagggctttc

SEQ ID NO: 8567949 - DNA, 22 bp, Homo sapiens
gtcctgggcccaggggctgcct

SEQ ID NO: 8567950 - DNA, 22 bp, Homo sapiens
gtcctgggcatgcagggctttc

SEQ ID NO: 8567951 - DNA, 20 bp, Homo sapiens
gtcctgggagccacagcaca

SEQ ID NO: 8567952 - DNA, 20 bp, Homo sapiens
gtcctgggagccacagcaca

SEQ ID NO: 8567953 - DNA, 20 bp, Homo sapiens
gtcctgggagccacagcaca

SEQ ID NO: 8567954 - DNA, 22 bp, Homo sapiens
gtcctgggaaggaagccaggga

SEQ ID NO: 8567955 - DNA, 22 bp, Homo sapiens
gtcctgggaaggaagccaggga

SEQ ID NO: 8567956 - DNA, 22 bp, Homo sapiens
gtcctgggaaggaagccaggga

SEQ ID NO: 8567957 - DNA, 22 bp, Homo sapiens
gtcctgggaactggacagctaa

SEQ ID NO: 8567958 - DNA, 22 bp, Homo sapiens
gtcctgggaactggacagctaa

SEQ ID NO: 8567959 - DNA, 22 bp, Homo sapiens
gtccctggaatggactctgcgc

SEQ ID NO: 8567960 - DNA, 22 bp, Homo sapiens
gtccctggaaaagagctggtga

SEQ ID NO: 8567961 - DNA, 22 bp, Homo sapiens
gtccctgccctcctgggactca

SEQ ID NO: 8567962 - DNA, 22 bp, Homo sapiens
gtccctgccctcctgggactca

SEQ ID NO: 8567963 - DNA, 22 bp, Homo sapiens
gtccctgcatctgcaggccatg

SEQ ID NO: 8567964 - DNA, 22 bp, Homo sapiens
gtccctgcatctgcaggccatg

SEQ ID NO: 8567965 - DNA, 22 bp, Homo sapiens
gtctgctgcagtcgtggctcta

SEQ ID NO: 8567966 - DNA, 22 bp, Homo sapiens
gtctgctgcagagcatggcttt

SEQ ID NO: 8567967 - DNA, 22 bp, Homo sapiens
gtctgctgacagagcatggacc

SEQ ID NO: 8567968 - DNA, 22 bp, Homo sapiens
gtctgctcatgctaccgcgggc

SEQ ID NO: 8567969 - DNA, 22 bp, Homo sapiens
gtctggagcctgggtccctgct

SEQ ID NO: 8567970 - DNA, 22 bp, Homo sapiens
gtctggaggaaaaggttaaatg

SEQ ID NO: 8567971 - DNA, 22 bp, Homo sapiens
gtctggaggaggaagaaggcac

SEQ ID NO: 8567972 - DNA, 22 bp, Homo sapiens
gtctggaggaggaagaaggcac

SEQ ID NO: 8567973 - DNA, 22 bp, Homo sapiens
gtctggaggcactttctcatga

SEQ ID NO: 8567974 - DNA, 22 bp, Homo sapiens
gtctggaggagggctctgcggc

SEQ ID NO: 8567975 - DNA, 22 bp, Homo sapiens
gtctggaggagggctctgcggc

SEQ ID NO: 8567976 - DNA, 22 bp, Homo sapiens
gtctgctggcacgtcacagata

SEQ ID NO: 8567977 - DNA, 22 bp, Homo sapiens
gtctgctggtgcctggcctgcg

SEQ ID NO: 8567978 - DNA, 22 bp, Homo sapiens
gtctgctgcttctgttgaagca

SEQ ID NO: 8567979 - DNA, 22 bp, Homo sapiens
gtctgctggcacgtcacagata

SEQ ID NO: 8567980 - DNA, 22 bp, Homo sapiens
gtctgctgtgggtccccaggag

SEQ ID NO: 8567981 - DNA, 22 bp, Homo sapiens
gtctgctggtgcctggcctgcg

SEQ ID NO: 8567982 - DNA, 22 bp, Homo sapiens
gtctgccctgcagacatgcctc

SEQ ID NO: 8567983 - DNA, 22 bp, Homo sapiens
gtctgccctgctgatctcaccc

SEQ ID NO: 8567984 - DNA, 22 bp, Homo sapiens
gtctgccctcacatgcactctt

SEQ ID NO: 8567985 - DNA, 22 bp, Homo sapiens
gtctgccctcacgccagctggg

SEQ ID NO: 8567986 - DNA, 22 bp, Homo sapiens
gtctgcccggccttcctccacc

SEQ ID NO: 8567987 - DNA, 22 bp, Homo sapiens
gtcctgggtccccgcaggtcag

SEQ ID NO: 8567988 - DNA, 22 bp, Homo sapiens
gtcctgggggcagctgtgtcca

SEQ ID NO: 8567989 - DNA, 22 bp, Homo sapiens
gtcctgggggcagctgtgtcca

SEQ ID NO: 8567990 - DNA, 22 bp, Homo sapiens
gtcctgggggcagctgtgtcca

SEQ ID NO: 8567991 - DNA, 22 bp, Homo sapiens
gtcctggggatacagaagtgaa

SEQ ID NO: 8567992 - DNA, 22 bp, Homo sapiens
gtcctggggatacagaagtgaa

SEQ ID NO: 8567993 - DNA, 22 bp, Homo sapiens
gtcctggggatacagaagtgaa

SEQ ID NO: 8567994 - DNA, 22 bp, Homo sapiens
gtcctggggatacagaagtgaa

SEQ ID NO: 8567995 - DNA, 22 bp, Homo sapiens
gtcctggggattatagagtgtt

SEQ ID NO: 8567996 - DNA, 22 bp, Homo sapiens
gtcctggggattatagagtgtt

SEQ ID NO: 8567997 - DNA, 22 bp, Homo sapiens
gtcctggggattatagagtgtt

SEQ ID NO: 8567998 - DNA, 22 bp, Homo sapiens
gtcctggggaatacagaagccg

SEQ ID NO: 8567999 - DNA, 22 bp, Homo sapiens
gtcctggggaatacagaagccg

SEQ ID NO: 8568000 - DNA, 22 bp, Homo sapiens
gtcctggggaatacagaagccg

SEQ ID NO: 8568001 - DNA, 22 bp, Homo sapiens
gtcctgggcctgctgaggctga

SEQ ID NO: 8568002 - DNA, 22 bp, Homo sapiens
gtcctgggcggagggctgctgt

SEQ ID NO: 8568003 - DNA, 22 bp, Homo sapiens
gtcctgggcctgctgaggctga

SEQ ID NO: 8568004 - DNA, 22 bp, Homo sapiens
gtcctgggcggagggctgctgt

SEQ ID NO: 8568005 - DNA, 22 bp, Homo sapiens
gtgaagcagggaaggaaaggat

SEQ ID NO: 8568006 - DNA, 22 bp, Homo sapiens
gtgaagatgcctcaggtgaccc

SEQ ID NO: 8568007 - DNA, 22 bp, Homo sapiens
gtgaagagctgttgcagagatt

SEQ ID NO: 8568008 - DNA, 22 bp, Homo sapiens
gtgaagatctgagccctcaggt

SEQ ID NO: 8568009 - DNA, 22 bp, Homo sapiens
gtgaagagctgttgcagagatt

SEQ ID NO: 8568010 - DNA, 21 bp, Homo sapiens
gtgaagactttgcctttaaga

SEQ ID NO: 8568011 - DNA, 22 bp, Homo sapiens
gtgaagacttggagaagttaag

SEQ ID NO: 8568012 - DNA, 22 bp, Homo sapiens
gtgaagaaggcaatacaaagaa

SEQ ID NO: 8568013 - DNA, 22 bp, Homo sapiens
gtgaagaccagggaacgctggc

SEQ ID NO: 8568014 - DNA, 22 bp, Homo sapiens
gtgaacctctgaaaggcagtga

SEQ ID NO: 8568015 - DNA, 22 bp, Homo sapiens
gtgaactctgactctcatgcct

SEQ ID NO: 8568016 - DNA, 22 bp, Homo sapiens
gtgaactcagtctctcttgcta

SEQ ID NO: 8568017 - DNA, 22 bp, Homo sapiens
gtgaacttccagatgataaaca

SEQ ID NO: 8568018 - DNA, 22 bp, Homo sapiens
gtgaactgctgagttttatcat

SEQ ID NO: 8568019 - DNA, 22 bp, Homo sapiens
gtgaaggactagcatggagggc

SEQ ID NO: 8568020 - DNA, 22 bp, Homo sapiens
gtgaaggactgaatgaaaatgt

SEQ ID NO: 8568021 - DNA, 22 bp, Homo sapiens
gtgaaggaggggccacagatat

SEQ ID NO: 8568022 - DNA, 22 bp, Homo sapiens
gtgaaggaggggccacagatat

SEQ ID NO: 8568023 - DNA, 22 bp, Homo sapiens
gtgaaggaggggccacagatat

SEQ ID NO: 8568024 - DNA, 22 bp, Homo sapiens
gtgaaggagttatcagtggtta

SEQ ID NO: 8568025 - DNA, 22 bp, Homo sapiens
gtgaagcatatgcttctctgcc

SEQ ID NO: 8568026 - DNA, 18 bp, Homo sapiens
gtgaagctttattgaatg

SEQ ID NO: 8568027 - DNA, 22 bp, Homo sapiens
gtgaaggactagcatggagggc

SEQ ID NO: 8568028 - DNA, 22 bp, Homo sapiens
gtgaaggactagcatggagggc

SEQ ID NO: 8568029 - DNA, 22 bp, Homo sapiens
gtgaccatcagagaataacaaa

SEQ ID NO: 8568030 - DNA, 22 bp, Homo sapiens
gtgaccatcatctcagctagtt

SEQ ID NO: 8568031 - DNA, 22 bp, Homo sapiens
gtgaaggagttatcagtggtta

SEQ ID NO: 8568032 - DNA, 22 bp, Homo sapiens
gtgaccatcatctcagctagtt

SEQ ID NO: 8568033 - DNA, 22 bp, Homo sapiens
gtgaccatcatctcagctagtt

SEQ ID NO: 8568034 - DNA, 22 bp, Homo sapiens
gtgaccatcatctcagctagtt

SEQ ID NO: 8568035 - DNA, 22 bp, Homo sapiens
gtgaccatcatctcagctagtt

SEQ ID NO: 8568036 - DNA, 18 bp, Homo sapiens
gtctggaggtcaggagct

SEQ ID NO: 8568037 - DNA, 18 bp, Homo sapiens
gtctggaggtcaggagct

SEQ ID NO: 8568038 - DNA, 18 bp, Homo sapiens
gtctggaggtcaggagct

SEQ ID NO: 8568039 - DNA, 22 bp, Homo sapiens
gtctggagggaagagatgtcag

SEQ ID NO: 8568040 - DNA, 22 bp, Homo sapiens
gtctggaggggagatttgggtt

SEQ ID NO: 8568041 - DNA, 22 bp, Homo sapiens
gtctggagtggggcctgagaat

SEQ ID NO: 8568042 - DNA, 22 bp, Homo sapiens
gtgaaaataaggctggttcttg

SEQ ID NO: 8568043 - DNA, 22 bp, Homo sapiens
gtctggagtggggcctgagaat

SEQ ID NO: 8568044 - DNA, 22 bp, Homo sapiens
gtctggagtggggcctgagaat

SEQ ID NO: 8568045 - DNA, 22 bp, Homo sapiens
gtgaaactgctttgtaaactgt

SEQ ID NO: 8568046 - DNA, 22 bp, Homo sapiens
gtgaaacttcacattttgatag

SEQ ID NO: 8568047 - DNA, 22 bp, Homo sapiens
gtgaaacttcacattttgatag

SEQ ID NO: 8568048 - DNA, 22 bp, Homo sapiens
gtgaacagttcattttatcatg

SEQ ID NO: 8568049 - DNA, 22 bp, Homo sapiens
gtgaacagataatagaaatgaa

SEQ ID NO: 8568050 - DNA, 22 bp, Homo sapiens
gtgaacaggagaaagtgatgga

SEQ ID NO: 8568051 - DNA, 22 bp, Homo sapiens
gtgaacaaaatagcacatatta

SEQ ID NO: 8568052 - DNA, 22 bp, Homo sapiens
gtgaacaaaatagcacatatta

SEQ ID NO: 8568053 - DNA, 22 bp, Homo sapiens
gtgaacaaggagactacaactt

SEQ ID NO: 8568054 - DNA, 22 bp, Homo sapiens
gtgaacatcagattacatgaga

SEQ ID NO: 8568055 - DNA, 22 bp, Homo sapiens
gtgaacattgaggcagaaagga

SEQ ID NO: 8568056 - DNA, 22 bp, Homo sapiens
gtgaactattgggtatcataaa

SEQ ID NO: 8568057 - DNA, 22 bp, Homo sapiens
gtgaactaaggattcaaacttc

SEQ ID NO: 8568058 - DNA, 22 bp, Homo sapiens
gtgaaatatttaacgtccaggt

SEQ ID NO: 8568059 - DNA, 22 bp, Homo sapiens
gtgaaatattttgtttatgtca

SEQ ID NO: 8568060 - DNA, 22 bp, Homo sapiens
gtgaaatattttgtttatgtca

SEQ ID NO: 8568061 - DNA, 22 bp, Homo sapiens
gtgcagagaggtggagggactt

SEQ ID NO: 8568062 - DNA, 22 bp, Homo sapiens
gtgcagagaggtggagggactt

SEQ ID NO: 8568063 - DNA, 22 bp, Homo sapiens
gtgcagagaggtggagggactt

SEQ ID NO: 8568064 - DNA, 22 bp, Homo sapiens
gtgcagagaaggagcagtagtt

SEQ ID NO: 8568065 - DNA, 22 bp, Homo sapiens
gtgcagagaaatgagaagtcga

SEQ ID NO: 8568066 - DNA, 22 bp, Homo sapiens
gtgcagacttacagattatccc

SEQ ID NO: 8568067 - DNA, 22 bp, Homo sapiens
gtgcagaccttagttcaagcca

SEQ ID NO: 8568068 - DNA, 22 bp, Homo sapiens
gtgcagaccttccagaaagaac

SEQ ID NO: 8568069 - DNA, 22 bp, Homo sapiens
gtgcacatcgtgcaggtttgtt

SEQ ID NO: 8568070 - DNA, 22 bp, Homo sapiens
gtgcacatcgtgcaggtttgtt

SEQ ID NO: 8568071 - DNA, 22 bp, Homo sapiens
gtgcacatcgtgcaggtttgtt

SEQ ID NO: 8568072 - DNA, 22 bp, Homo sapiens
gtgcacatcgtgcaggtttgtt

SEQ ID NO: 8568073 - DNA, 22 bp, Homo sapiens
gtgcacatcgtgcaggtttgtt

SEQ ID NO: 8568074 - DNA, 21 bp, Homo sapiens
gtgcacagtcctgcacacagg

SEQ ID NO: 8568075 - DNA, 21 bp, Homo sapiens
gtgcacagtcctgcacacagg

SEQ ID NO: 8568076 - DNA, 22 bp, Homo sapiens
gtgcacagatttaattttattc

SEQ ID NO: 8568077 - DNA, 22 bp, Homo sapiens
gtgcacaggtgggaaaatgagt

SEQ ID NO: 8568078 - DNA, 23 bp, Homo sapiens
gtgcacagtcaagcccagcttag

SEQ ID NO: 8568079 - DNA, 22 bp, Homo sapiens
gtgcacagattcagaggttttg

SEQ ID NO: 8568080 - DNA, 22 bp, Homo sapiens
gtgcacagagcccagggccgcg

SEQ ID NO: 8568081 - DNA, 22 bp, Homo sapiens
gtgcacagaagcagaagctaga

SEQ ID NO: 8568082 - DNA, 22 bp, Homo sapiens
gtgagcaggatttcatggtgta

SEQ ID NO: 8568083 - DNA, 22 bp, Homo sapiens
gtgagcaggatttcatggtgta

SEQ ID NO: 8568084 - DNA, 22 bp, Homo sapiens
gtgagagaatttgagttaaatt

SEQ ID NO: 8568085 - DNA, 23 bp, Homo sapiens
gtgagcagcccactaggaatgcc

SEQ ID NO: 8568086 - DNA, 22 bp, Homo sapiens
gtgagagaatttgagttaaatt

SEQ ID NO: 8568087 - DNA, 22 bp, Homo sapiens
gtgagagaaattggagggaatg

SEQ ID NO: 8568088 - DNA, 22 bp, Homo sapiens
gtgagacacgtgtgtgacctgg

SEQ ID NO: 8568089 - DNA, 19 bp, Homo sapiens
gtgagaccctgcatagggc

SEQ ID NO: 8568090 - DNA, 22 bp, Homo sapiens
gtgagactcgcctttgtgtagc

SEQ ID NO: 8568091 - DNA, 22 bp, Homo sapiens
gtgagcaggataggggctccct

SEQ ID NO: 8568092 - DNA, 22 bp, Homo sapiens
gtgagcagctcagggtggtctc

SEQ ID NO: 8568093 - DNA, 22 bp, Homo sapiens
gtgagcagctcagggtggtctc

SEQ ID NO: 8568094 - DNA, 23 bp, Homo sapiens
gtgagcagcccactaggaatgcc

SEQ ID NO: 8568095 - DNA, 23 bp, Homo sapiens
gtgagcagcccactaggaatgcc

SEQ ID NO: 8568096 - DNA, 22 bp, Homo sapiens
gtgagcagcctcacctgagggt

SEQ ID NO: 8568097 - DNA, 22 bp, Homo sapiens
gtgagcagcctcacctgagggt

SEQ ID NO: 8568098 - DNA, 22 bp, Homo sapiens
gtgactgtgaactgtttctgat

SEQ ID NO: 8568099 - DNA, 22 bp, Homo sapiens
gtgactgtgagtcgctgtgaca

SEQ ID NO: 8568100 - DNA, 22 bp, Homo sapiens
gtgactgtgatcttatttgcaa

SEQ ID NO: 8568101 - DNA, 22 bp, Homo sapiens
gtgactcttacctacccagcct

SEQ ID NO: 8568102 - DNA, 22 bp, Homo sapiens
gtgactctgtttctgaaaacag

SEQ ID NO: 8568103 - DNA, 22 bp, Homo sapiens
gtgactcttaaagcaaatcttg

SEQ ID NO: 8568104 - DNA, 22 bp, Homo sapiens
gtgactcttacctacccagcct

SEQ ID NO: 8568105 - DNA, 22 bp, Homo sapiens
gtgacgtgaggggctcctgttg

SEQ ID NO: 8568106 - DNA, 22 bp, Homo sapiens
gtgactctccactagtatgaaa

SEQ ID NO: 8568107 - DNA, 22 bp, Homo sapiens
gtgactctgcattttatggatc

SEQ ID NO: 8568108 - DNA, 22 bp, Homo sapiens
gtgactctcactttacctgact

SEQ ID NO: 8568109 - DNA, 22 bp, Homo sapiens
gtgactcacacaggcctgggct

SEQ ID NO: 8568110 - DNA, 22 bp, Homo sapiens
gtgactctacttaagattaagc

SEQ ID NO: 8568111 - DNA, 22 bp, Homo sapiens
gtgagaagataagtattgcaaa

SEQ ID NO: 8568112 - DNA, 22 bp, Homo sapiens
gtgagaaatggaacttcatacg

SEQ ID NO: 8568113 - DNA, 22 bp, Homo sapiens
gtgagaaatgacaaatgtgtcg

SEQ ID NO: 8568114 - DNA, 22 bp, Homo sapiens
gtgagacaagatttgtaggcag

SEQ ID NO: 8568115 - DNA, 22 bp, Homo sapiens
gtgagacaattcctcagtagac

SEQ ID NO: 8568116 - DNA, 22 bp, Homo sapiens
gtgcatttctcatacactaaat

SEQ ID NO: 8568117 - DNA, 22 bp, Homo sapiens
gtgcatttgacgaatactcact

SEQ ID NO: 8568118 - DNA, 20 bp, Homo sapiens
gtgcatttcacctgtactgt

SEQ ID NO: 8568119 - DNA, 20 bp, Homo sapiens
gtgcatttcacctgtactgt

SEQ ID NO: 8568120 - DNA, 20 bp, Homo sapiens
gtgcatttcacctgtactgt

SEQ ID NO: 8568121 - DNA, 22 bp, Homo sapiens
gtgcatttgtgcatgcacatgt

SEQ ID NO: 8568122 - DNA, 22 bp, Homo sapiens
gtgcatttgtgcatgcacatgt

SEQ ID NO: 8568123 - DNA, 22 bp, Homo sapiens
gtgcatttgtgcatgcacatgt

SEQ ID NO: 8568124 - DNA, 22 bp, Homo sapiens
gtgcatttggtgactctcaccc

SEQ ID NO: 8568125 - DNA, 22 bp, Homo sapiens
gtgcatttgacgaatactcact

SEQ ID NO: 8568126 - DNA, 22 bp, Homo sapiens
gtgcatttggtgactctcaccc

SEQ ID NO: 8568127 - DNA, 22 bp, Homo sapiens
gtgcatttggtgactctcaccc

SEQ ID NO: 8568128 - DNA, 22 bp, Homo sapiens
gtgcatttgtgcatgcacatgt

SEQ ID NO: 8568129 - DNA, 22 bp, Homo sapiens
gtgctaggattacaggcatggg

SEQ ID NO: 8568130 - DNA, 22 bp, Homo sapiens
gtgccacctctgccccagaggg

SEQ ID NO: 8568131 - DNA, 22 bp, Homo sapiens
gtgccacctctgccccagaggg

SEQ ID NO: 8568132 - DNA, 22 bp, Homo sapiens
gtgctatgattggacagaatag

SEQ ID NO: 8568133 - DNA, 22 bp, Homo sapiens
gtgcatatatatgggagggagc

SEQ ID NO: 8568134 - DNA, 22 bp, Homo sapiens
gtgcatatatgcacatatgtgt

SEQ ID NO: 8568135 - DNA, 22 bp, Homo sapiens
gtgcatatatgcacatatgtgt

SEQ ID NO: 8568136 - DNA, 22 bp, Homo sapiens
gtgcatatatgtgcagcatcaa

SEQ ID NO: 8568137 - DNA, 22 bp, Homo sapiens
gtgcatatggttacagcaccgc

SEQ ID NO: 8568138 - DNA, 22 bp, Homo sapiens
gtgcatatgtgtgtatacaaac

SEQ ID NO: 8568139 - DNA, 22 bp, Homo sapiens
gtgcatatgtacctgtgatcat

SEQ ID NO: 8568140 - DNA, 22 bp, Homo sapiens
gtgcatttatatttgcctttgg

SEQ ID NO: 8568141 - DNA, 22 bp, Homo sapiens
gtgcatttatatttgcctttgg

SEQ ID NO: 8568142 - DNA, 22 bp, Homo sapiens
gtgcatttaggtcacatgatgt

SEQ ID NO: 8568143 - DNA, 22 bp, Homo sapiens
gtgcagagcaagggctgagggc

SEQ ID NO: 8568144 - DNA, 21 bp, Homo sapiens
gtgcagaggaatgtagggggc

SEQ ID NO: 8568145 - DNA, 22 bp, Homo sapiens
gtgcagaggtcacaaaagtgaa

SEQ ID NO: 8568146 - DNA, 22 bp, Homo sapiens
gtgcagatcctgattgcagttc

SEQ ID NO: 8568147 - DNA, 22 bp, Homo sapiens
gtgcagtgaaaaaagaatgtcc

SEQ ID NO: 8568148 - DNA, 22 bp, Homo sapiens
gtgcagtgaccctggagagctg

SEQ ID NO: 8568149 - DNA, 22 bp, Homo sapiens
gtgcagtgaccctggagagctg

SEQ ID NO: 8568150 - DNA, 22 bp, Homo sapiens
gtgcagtgaaaaaagaatgtcc

SEQ ID NO: 8568151 - DNA, 22 bp, Homo sapiens
gtgcagtgagcagtgcagcacc

SEQ ID NO: 8568152 - DNA, 22 bp, Homo sapiens
gtgcagtggcagatcctagctc

SEQ ID NO: 8568153 - DNA, 22 bp, Homo sapiens
gtgcagtgagcagtgcagcacc

SEQ ID NO: 8568154 - DNA, 22 bp, Homo sapiens
gtgcagtgagcagtgcagcacc

SEQ ID NO: 8568155 - DNA, 22 bp, Homo sapiens
gtgcaggtggttggcccagccg

SEQ ID NO: 8568156 - DNA, 22 bp, Homo sapiens
gtgcagggtagcgacggcagga

SEQ ID NO: 8568157 - DNA, 22 bp, Homo sapiens
ggtctcagctggagtccttggt

SEQ ID NO: 8568158 - DNA, 22 bp, Homo sapiens
ggtctccaaagcttaggactac

SEQ ID NO: 8568159 - DNA, 22 bp, Homo sapiens
ggtctccaaagctgcattgatg

SEQ ID NO: 8568160 - DNA, 22 bp, Homo sapiens
ggtctcatctttcagcgtcgag

SEQ ID NO: 8568161 - DNA, 22 bp, Homo sapiens
ggtctcatgtcctatgtgctta

SEQ ID NO: 8568162 - DNA, 22 bp, Homo sapiens
ggtctcaggtagggcctaggaa

SEQ ID NO: 8568163 - DNA, 22 bp, Homo sapiens
ggtctcaggtagggcctaggaa

SEQ ID NO: 8568164 - DNA, 22 bp, Homo sapiens
ggtctctggccttggagattga

SEQ ID NO: 8568165 - DNA, 22 bp, Homo sapiens
ggtctctgtcactgagtggccc

SEQ ID NO: 8568166 - DNA, 22 bp, Homo sapiens
ggtctctgagtgaggacctggg

SEQ ID NO: 8568167 - DNA, 22 bp, Homo sapiens
ggtctctgacttagagatggat

SEQ ID NO: 8568168 - DNA, 22 bp, Homo sapiens
ggtctcctgaggctgccacacc

SEQ ID NO: 8568169 - DNA, 22 bp, Homo sapiens
ggtctccaaagcttaggactac

SEQ ID NO: 8568170 - DNA, 22 bp, Homo sapiens
ggtctccagctgggaccctgca

SEQ ID NO: 8568171 - DNA, 22 bp, Homo sapiens
ggtcagaggtcacaagctggca

SEQ ID NO: 8568172 - DNA, 22 bp, Homo sapiens
ggtcagaggtcccagaagaagc

SEQ ID NO: 8568173 - DNA, 22 bp, Homo sapiens
ggtcagaggtcccagaagaagc

SEQ ID NO: 8568174 - DNA, 22 bp, Homo sapiens
ggtccctggttccctctgagct

SEQ ID NO: 8568175 - DNA, 18 bp, Homo sapiens
ggtcctgggcctggctca

SEQ ID NO: 8568176 - DNA, 22 bp, Homo sapiens
ggtccttcagtaggttccagac

SEQ ID NO: 8568177 - DNA, 22 bp, Homo sapiens
ggtctagaggatgttcctttcc

SEQ ID NO: 8568178 - DNA, 22 bp, Homo sapiens
ggtcgtgaattgaatcagtggc

SEQ ID NO: 8568179 - DNA, 22 bp, Homo sapiens
ggtcggggatggccaggctccc

SEQ ID NO: 8568180 - DNA, 22 bp, Homo sapiens
ggtctagatcaagaacagaact

SEQ ID NO: 8568181 - DNA, 22 bp, Homo sapiens
ggtctcaaggaatataatgagt

SEQ ID NO: 8568182 - DNA, 22 bp, Homo sapiens
ggtctcaaggaatataatgagt

SEQ ID NO: 8568183 - DNA, 22 bp, Homo sapiens
ggtccttgggtctcctgtgttt

SEQ ID NO: 8568184 - DNA, 22 bp, Homo sapiens
ggtcgctgtgtaggttcagcta

SEQ ID NO: 8568185 - DNA, 22 bp, Homo sapiens
ggtcgctgtgtaggttcagcta

SEQ ID NO: 8568186 - DNA, 22 bp, Homo sapiens
ggtcgctgtgtaggttcagcta

SEQ ID NO: 8568187 - DNA, 19 bp, Homo sapiens
ggtcacaggggttacaagg

SEQ ID NO: 8568188 - DNA, 22 bp, Homo sapiens
ggtcactggtctctgcttccat

SEQ ID NO: 8568189 - DNA, 22 bp, Homo sapiens
ggtcactgagctgtaattctgt

SEQ ID NO: 8568190 - DNA, 22 bp, Homo sapiens
ggtcagaggtcacaagctggca

SEQ ID NO: 8568191 - DNA, 22 bp, Homo sapiens
ggtcagaggtcacaagctggca

SEQ ID NO: 8568192 - DNA, 22 bp, Homo sapiens
ggtcagaggaggaataggacat

SEQ ID NO: 8568193 - DNA, 22 bp, Homo sapiens
ggtcagaggaggaataggacat

SEQ ID NO: 8568194 - DNA, 22 bp, Homo sapiens
ggtcagagccgttagcattcag

SEQ ID NO: 8568195 - DNA, 22 bp, Homo sapiens
ggtcagagccatggagcaactg

SEQ ID NO: 8568196 - DNA, 22 bp, Homo sapiens
ggtcagagctggagagataggg

SEQ ID NO: 8568197 - DNA, 22 bp, Homo sapiens
ggtcagagctggagagataggg

SEQ ID NO: 8568198 - DNA, 19 bp, Homo sapiens
ggtcagagagatccaggct

SEQ ID NO: 8568199 - DNA, 19 bp, Homo sapiens
ggtcagagagatccaggct

SEQ ID NO: 8568200 - DNA, 22 bp, Homo sapiens
ggtcagagaaaagtagggtgtt

SEQ ID NO: 8568201 - DNA, 22 bp, Homo sapiens
ggtcagagaaaagtagggtgtt

SEQ ID NO: 8568202 - DNA, 22 bp, Homo sapiens
ggtcagagaaaagtagggtgtt

SEQ ID NO: 8568203 - DNA, 22 bp, Homo sapiens
ggtcagaacaagggtaaataaa

SEQ ID NO: 8568204 - DNA, 22 bp, Homo sapiens
ggtcagaaggcagttaaacaaa

SEQ ID NO: 8568205 - DNA, 22 bp, Homo sapiens
ggtcagaacaagcaaataatag

SEQ ID NO: 8568206 - DNA, 22 bp, Homo sapiens
ggtcagaacaagggtaaataaa

SEQ ID NO: 8568207 - DNA, 22 bp, Homo sapiens
ggtcagaacaagcaaataatag

SEQ ID NO: 8568208 - DNA, 22 bp, Homo sapiens
ggtcagaagtgcaaaatcagtt

SEQ ID NO: 8568209 - DNA, 22 bp, Homo sapiens
ggtcagaagtgcaaaatcagtt

SEQ ID NO: 8568210 - DNA, 22 bp, Homo sapiens
gggtggcaggattggcaggagt

SEQ ID NO: 8568211 - DNA, 22 bp, Homo sapiens
gggtggcaggattggcaggagt

SEQ ID NO: 8568212 - DNA, 22 bp, Homo sapiens
gggtggcacaggtgcagagggt

SEQ ID NO: 8568213 - DNA, 22 bp, Homo sapiens
gggtggcacaggtgcagagggt

SEQ ID NO: 8568214 - DNA, 22 bp, Homo sapiens
gggtggcacaggtgcagagggt

SEQ ID NO: 8568215 - DNA, 22 bp, Homo sapiens
gggtggcacaggtgcagagggt

SEQ ID NO: 8568216 - DNA, 22 bp, Homo sapiens
gggtggcagctgttgccaaggt

SEQ ID NO: 8568217 - DNA, 22 bp, Homo sapiens
gggtggcactgataatgagacg

SEQ ID NO: 8568218 - DNA, 22 bp, Homo sapiens
gggtggcacaggtgcagagggt

SEQ ID NO: 8568219 - DNA, 22 bp, Homo sapiens
gggtggcacaggtgcagagggt

SEQ ID NO: 8568220 - DNA, 22 bp, Homo sapiens
gggtggcacaggtgcagagggt

SEQ ID NO: 8568221 - DNA, 20 bp, Homo sapiens
gggtggagttgcggtctgtg

SEQ ID NO: 8568222 - DNA, 20 bp, Homo sapiens
gggtggagttgcggtctgtg

SEQ ID NO: 8568223 - DNA, 22 bp, Homo sapiens
gggtggccttcatagctcaggg

SEQ ID NO: 8568224 - DNA, 22 bp, Homo sapiens
gggtggccttaggcaagtcact

SEQ ID NO: 8568225 - DNA, 21 bp, Homo sapiens
gggtggccgcatgggtgcgtg

SEQ ID NO: 8568226 - DNA, 21 bp, Homo sapiens
gggtggccgcatgggtgcgtg

SEQ ID NO: 8568227 - DNA, 22 bp, Homo sapiens
gggtggcatagggtgatggctt

SEQ ID NO: 8568228 - DNA, 22 bp, Homo sapiens
gggtggcatagggtgatggctt

SEQ ID NO: 8568229 - DNA, 22 bp, Homo sapiens
gggtggcaggattggcaggagt

SEQ ID NO: 8568230 - DNA, 22 bp, Homo sapiens
gggtggcaggattggcaggagt

SEQ ID NO: 8568231 - DNA, 22 bp, Homo sapiens
gggtggctgactgttttgtgga

SEQ ID NO: 8568232 - DNA, 22 bp, Homo sapiens
ggtaggggaagacaagtgaaaa

SEQ ID NO: 8568233 - DNA, 22 bp, Homo sapiens
ggtaggggcagggccaagctgt

SEQ ID NO: 8568234 - DNA, 22 bp, Homo sapiens
ggtaggggaagacaagtgaaaa

SEQ ID NO: 8568235 - DNA, 22 bp, Homo sapiens
ggtaggggaagacaagtgaaaa

SEQ ID NO: 8568236 - DNA, 22 bp, Homo sapiens
gggtggctcctatgggcatagc

SEQ ID NO: 8568237 - DNA, 22 bp, Homo sapiens
gggtggccttcatagctcaggg

SEQ ID NO: 8568238 - DNA, 22 bp, Homo sapiens
ggtgtgggccctgatgtcagca

SEQ ID NO: 8568239 - DNA, 22 bp, Homo sapiens
ggtgtgggccctgatgtcagca

SEQ ID NO: 8568240 - DNA, 22 bp, Homo sapiens
ggtgtgggagagattctttcct

SEQ ID NO: 8568241 - DNA, 22 bp, Homo sapiens
ggtgtggctgtgagtttttgat

SEQ ID NO: 8568242 - DNA, 22 bp, Homo sapiens
ggtgtgggaactacaggttttt

SEQ ID NO: 8568243 - DNA, 22 bp, Homo sapiens
ggtgtggcagtggacctgtgaa

SEQ ID NO: 8568244 - DNA, 22 bp, Homo sapiens
ggtgtgggaactacaggttttt

SEQ ID NO: 8568245 - DNA, 22 bp, Homo sapiens
ggtgtggggaggttctgcttct

SEQ ID NO: 8568246 - DNA, 22 bp, Homo sapiens
ggtgtggggaggttctgcttct

SEQ ID NO: 8568247 - DNA, 22 bp, Homo sapiens
ggtgtgggccctgatgtcagca

SEQ ID NO: 8568248 - DNA, 22 bp, Homo sapiens
ggtgtgggggcaagtttgagat

SEQ ID NO: 8568249 - DNA, 22 bp, Homo sapiens
ggtgtgggggcagctctgatat

SEQ ID NO: 8568250 - DNA, 22 bp, Homo sapiens
ggtgtgggggcaagtttgagat

SEQ ID NO: 8568251 - DNA, 22 bp, Homo sapiens
ggtgtgggtccttgtgcttgct

SEQ ID NO: 8568252 - DNA, 22 bp, Homo sapiens
ggtgtgggtccttgtgcttgct

SEQ ID NO: 8568253 - DNA, 22 bp, Homo sapiens
ggtgtgggggcagctctgatat

SEQ ID NO: 8568254 - DNA, 22 bp, Homo sapiens
ggtggctctcttaagggcagcg

SEQ ID NO: 8568255 - DNA, 22 bp, Homo sapiens
ggtggctctctgtcagtgacag

SEQ ID NO: 8568256 - DNA, 22 bp, Homo sapiens
ggtgttgcagttgaagactggt

SEQ ID NO: 8568257 - DNA, 22 bp, Homo sapiens
ggtgttaacttgtttatgacaa

SEQ ID NO: 8568258 - DNA, 22 bp, Homo sapiens
ggtgttaacaaagattgaaatg

SEQ ID NO: 8568259 - DNA, 22 bp, Homo sapiens
ggtgttaaacatgatccattac

SEQ ID NO: 8568260 - DNA, 22 bp, Homo sapiens
ggtgttggaacatggtgagatt

SEQ ID NO: 8568261 - DNA, 22 bp, Homo sapiens
ggtgttcttagtggcactggca

SEQ ID NO: 8568262 - DNA, 22 bp, Homo sapiens
ggtgttgggagagctggttttg

SEQ ID NO: 8568263 - DNA, 22 bp, Homo sapiens
ggtgttgggctcactggtcctt

SEQ ID NO: 8568264 - DNA, 22 bp, Homo sapiens
ggtttaattggtccaggatggg

SEQ ID NO: 8568265 - DNA, 22 bp, Homo sapiens
ggtttaattacctgcatctcaa

SEQ ID NO: 8568266 - DNA, 22 bp, Homo sapiens
ggtgtgtgtggattagcatgcc

SEQ ID NO: 8568267 - DNA, 22 bp, Homo sapiens
ggtgtgtgtggattagcatgcc

SEQ ID NO: 8568268 - DNA, 22 bp, Homo sapiens
ggtgtgtggttttgatacagtc

SEQ ID NO: 8568269 - DNA, 22 bp, Homo sapiens
ggtgtgtgtggattagcatgcc

SEQ ID NO: 8568270 - DNA, 22 bp, Homo sapiens
ggtgtgtggtcctctcacttag

SEQ ID NO: 8568271 - DNA, 19 bp, Homo sapiens
ggtgtgtgctggggcctgt

SEQ ID NO: 8568272 - DNA, 22 bp, Homo sapiens
ggtgtgtggtcctctcacttag

SEQ ID NO: 8568273 - DNA, 22 bp, Homo sapiens
ggtgtgtggttttgatacagtc

SEQ ID NO: 8568274 - DNA, 22 bp, Homo sapiens
ggtgtgtggttttgatacagtc

SEQ ID NO: 8568275 - DNA, 22 bp, Homo sapiens
ggtgtgtagcatgtttaagacc

SEQ ID NO: 8568276 - DNA, 22 bp, Homo sapiens
ggtgtgtctgccaggaactgca

SEQ ID NO: 8568277 - DNA, 22 bp, Homo sapiens
ggtgtggtttgaagggagatgg

SEQ ID NO: 8568278 - DNA, 18 bp, Homo sapiens
ggtgtgtaacgtgttttc

SEQ ID NO: 8568279 - DNA, 22 bp, Homo sapiens
ggtgtgtgaggagtcacttagt

SEQ ID NO: 8568280 - DNA, 22 bp, Homo sapiens
ggtgtgtgaggagtcacttagt

SEQ ID NO: 8568281 - DNA, 22 bp, Homo sapiens
ggtgtgtgaggagtcacttagt

SEQ ID NO: 8568282 - DNA, 19 bp, Homo sapiens
ggtgtgtgctggggcctgt

SEQ ID NO: 8568283 - DNA, 19 bp, Homo sapiens
ggtgtgtgctggggcctgt

SEQ ID NO: 8568284 - DNA, 22 bp, Homo sapiens
ggtggcctcagcaaggctggca

SEQ ID NO: 8568285 - DNA, 22 bp, Homo sapiens
ggtggcctagggcccagcctgt

SEQ ID NO: 8568286 - DNA, 22 bp, Homo sapiens
ggtctggataattccagtacct

SEQ ID NO: 8568287 - DNA, 22 bp, Homo sapiens
ggtctggagtagatgagtcatg

SEQ ID NO: 8568288 - DNA, 22 bp, Homo sapiens
ggtctggattttgaacaaaatt

SEQ ID NO: 8568289 - DNA, 22 bp, Homo sapiens
ggtctggatgctgaggttccca

SEQ ID NO: 8568290 - DNA, 22 bp, Homo sapiens
ggtctggatttctgcttctttc

SEQ ID NO: 8568291 - DNA, 22 bp, Homo sapiens
ggtctctgttgcctccatcaag

SEQ ID NO: 8568292 - DNA, 22 bp, Homo sapiens
ggtctctgtttggggctggcaa

SEQ ID NO: 8568293 - DNA, 22 bp, Homo sapiens
ggtctcttcaggagcttgagcg

SEQ ID NO: 8568294 - DNA, 22 bp, Homo sapiens
ggtctctttgcttcagctacag

SEQ ID NO: 8568295 - DNA, 22 bp, Homo sapiens
ggtctctttgcttcagctacag

SEQ ID NO: 8568296 - DNA, 22 bp, Homo sapiens
ggtctgaaaatggtgaccacca

SEQ ID NO: 8568297 - DNA, 22 bp, Homo sapiens
ggtctggagctaatcttgttgg

SEQ ID NO: 8568298 - DNA, 22 bp, Homo sapiens
ggtctggaccctcctggagtgg

SEQ ID NO: 8568299 - DNA, 22 bp, Homo sapiens
ggtctggaccatggacgccggg

SEQ ID NO: 8568300 - DNA, 22 bp, Homo sapiens
ggtctgaattccagcccctctg

SEQ ID NO: 8568301 - DNA, 22 bp, Homo sapiens
ggtctgagagccactgaatccc

SEQ ID NO: 8568302 - DNA, 22 bp, Homo sapiens
ggtctgagagccactgaatccc

SEQ ID NO: 8568303 - DNA, 22 bp, Homo sapiens
ggtctgaaattatgtcactgct

SEQ ID NO: 8568304 - DNA, 22 bp, Homo sapiens
ggtctgaaatgtgacttttgaa

SEQ ID NO: 8568305 - DNA, 22 bp, Homo sapiens
ggtctgaatcactgtgcctatc

SEQ ID NO: 8568306 - DNA, 22 bp, Homo sapiens
ggtctgaatatagaacttaagt

SEQ ID NO: 8568307 - DNA, 22 bp, Homo sapiens
ggtctgaagcccacgtggtacc

SEQ ID NO: 8568308 - DNA, 22 bp, Homo sapiens
ggtggcctcggtggtgcacagg

SEQ ID NO: 8568309 - DNA, 22 bp, Homo sapiens
ggtggcctctcatgcaaggtag

SEQ ID NO: 8568310 - DNA, 22 bp, Homo sapiens
ggtggcctctgcaggcctcgac

SEQ ID NO: 8568311 - DNA, 22 bp, Homo sapiens
ggtggcctccagggcataggtg

SEQ ID NO: 8568312 - DNA, 22 bp, Homo sapiens
ggtggcctcggtggtgcacagg

SEQ ID NO: 8568313 - DNA, 22 bp, Homo sapiens
ggtggcctcggtggtgcacagg

SEQ ID NO: 8568314 - DNA, 22 bp, Homo sapiens
ggtggcctttcagtggatcagg

SEQ ID NO: 8568315 - DNA, 22 bp, Homo sapiens
ggtggcctgccctgatccctgg

SEQ ID NO: 8568316 - DNA, 17 bp, Homo sapiens
ggtggcctgcagtggct

SEQ ID NO: 8568317 - DNA, 22 bp, Homo sapiens
ggtggcctgccctgatccctgg

SEQ ID NO: 8568318 - DNA, 17 bp, Homo sapiens
ggtggcctgcagtggct

SEQ ID NO: 8568319 - DNA, 22 bp, Homo sapiens
ggtggcctgaattagctcaggg

SEQ ID NO: 8568320 - DNA, 21 bp, Homo sapiens
ggtggctagaaagcagtgaga

SEQ ID NO: 8568321 - DNA, 18 bp, Homo sapiens
ggtggcggggatggaggt

SEQ ID NO: 8568322 - DNA, 22 bp, Homo sapiens
ggtggcggccacttcagccctg

SEQ ID NO: 8568323 - DNA, 18 bp, Homo sapiens
ggtggctcagtcatgggg

SEQ ID NO: 8568324 - DNA, 22 bp, Homo sapiens
gggctgagcacatactgacagc

SEQ ID NO: 8568325 - DNA, 22 bp, Homo sapiens
gggctgagcacatactgacagc

SEQ ID NO: 8568326 - DNA, 22 bp, Homo sapiens
gggctgagccacagcttttgtt

SEQ ID NO: 8568327 - DNA, 22 bp, Homo sapiens
gggctgagccacagcttttgtt

SEQ ID NO: 8568328 - DNA, 22 bp, Homo sapiens
gggctgagccatttgaaccttg

SEQ ID NO: 8568329 - DNA, 22 bp, Homo sapiens
gggctgagccatttgaaccttg

SEQ ID NO: 8568330 - DNA, 22 bp, Homo sapiens
gggctgaggctaccactggtct

SEQ ID NO: 8568331 - DNA, 22 bp, Homo sapiens
gggctgaggaacatattttgtt

SEQ ID NO: 8568332 - DNA, 22 bp, Homo sapiens
gggctgagctgttctgagttta

SEQ ID NO: 8568333 - DNA, 22 bp, Homo sapiens
gggctgagctgttctgagttta

SEQ ID NO: 8568334 - DNA, 22 bp, Homo sapiens
gggctgagctaagctgggttga

SEQ ID NO: 8568335 - DNA, 22 bp, Homo sapiens
gggctgagagtgactgttctgt

SEQ ID NO: 8568336 - DNA, 22 bp, Homo sapiens
gggctgagagtgactgttctgt

SEQ ID NO: 8568337 - DNA, 22 bp, Homo sapiens
gggctgagattggtgccctgtc

SEQ ID NO: 8568338 - DNA, 22 bp, Homo sapiens
gggctgagattggtgccctgtc

SEQ ID NO: 8568339 - DNA, 22 bp, Homo sapiens
gggctgagagctggaatctgag

SEQ ID NO: 8568340 - DNA, 22 bp, Homo sapiens
gggctgagagctggaatctgag

SEQ ID NO: 8568341 - DNA, 22 bp, Homo sapiens
gggctgagagctggaatctgag

SEQ ID NO: 8568342 - DNA, 21 bp, Homo sapiens
gggccacaccttctgcagacc

SEQ ID NO: 8568343 - DNA, 22 bp, Homo sapiens
gggcatggccaggtgaggggtc

SEQ ID NO: 8568344 - DNA, 22 bp, Homo sapiens
gggcatggccaggtgaggggtc

SEQ ID NO: 8568345 - DNA, 18 bp, Homo sapiens
gggcatggatgcagcatc

SEQ ID NO: 8568346 - DNA, 18 bp, Homo sapiens
gggcatggatgcagcatc

SEQ ID NO: 8568347 - DNA, 22 bp, Homo sapiens
gggcatggccaggtgaggggtc

SEQ ID NO: 8568348 - DNA, 22 bp, Homo sapiens
gggcatggtgatgtgcacctgt

SEQ ID NO: 8568349 - DNA, 22 bp, Homo sapiens
gggcatggtgatgtgcacctgt

SEQ ID NO: 8568350 - DNA, 22 bp, Homo sapiens
gggcatggtgatgtgcacctgt

SEQ ID NO: 8568351 - DNA, 22 bp, Homo sapiens
gggcatggtgctggtgttcatg

SEQ ID NO: 8568352 - DNA, 22 bp, Homo sapiens
gggcatggtgagggatatgaag

SEQ ID NO: 8568353 - DNA, 22 bp, Homo sapiens
gggccaaggggagctggaaggg

SEQ ID NO: 8568354 - DNA, 22 bp, Homo sapiens
gggccaaggggagctggaaggg

SEQ ID NO: 8568355 - DNA, 22 bp, Homo sapiens
gggcatggtggtgcacacctgt

SEQ ID NO: 8568356 - DNA, 22 bp, Homo sapiens
gggcatggtggcaggcacctgt

SEQ ID NO: 8568357 - DNA, 22 bp, Homo sapiens
gggccaagggtgcgtggcagga

SEQ ID NO: 8568358 - DNA, 22 bp, Homo sapiens
gggccaaggggagctggaaggg

SEQ ID NO: 8568359 - DNA, 22 bp, Homo sapiens
gggccacacagaacctcctggt

SEQ ID NO: 8568360 - DNA, 22 bp, Homo sapiens
gggccacacagaacctcctggt

SEQ ID NO: 8568361 - DNA, 22 bp, Homo sapiens
gggctgagggccaattcctact

SEQ ID NO: 8568362 - DNA, 22 bp, Homo sapiens
gggctgaggctaccactggtct

SEQ ID NO: 8568363 - DNA, 22 bp, Homo sapiens
gggctgagtgggcctcttactt

SEQ ID NO: 8568364 - DNA, 22 bp, Homo sapiens
gggctgagggccaattcctact

SEQ ID NO: 8568365 - DNA, 22 bp, Homo sapiens
gggctgagggccaattcctact

SEQ ID NO: 8568366 - DNA, 22 bp, Homo sapiens
gggctgagtgtcccaggccgaa

SEQ ID NO: 8568367 - DNA, 22 bp, Homo sapiens
gggctgagttcctgcctcactc

SEQ ID NO: 8568368 - DNA, 22 bp, Homo sapiens
gggctgagttcctgcctcactc

SEQ ID NO: 8568369 - DNA, 22 bp, Homo sapiens
gggctgagttcctgcctcactc

SEQ ID NO: 8568370 - DNA, 22 bp, Homo sapiens
gggctgagtgtcccaggccgaa

SEQ ID NO: 8568371 - DNA, 22 bp, Homo sapiens
gggctgagtgtcccaggccgaa

SEQ ID NO: 8568372 - DNA, 22 bp, Homo sapiens
gggctgagtgtcccaggccgaa

SEQ ID NO: 8568373 - DNA, 22 bp, Homo sapiens
gggctgagtgtcccaggccgaa

SEQ ID NO: 8568374 - DNA, 23 bp, Homo sapiens
gggctgctccaggccaaggctgg

SEQ ID NO: 8568375 - DNA, 22 bp, Homo sapiens
gggctgctgccaatcacagcct

SEQ ID NO: 8568376 - DNA, 22 bp, Homo sapiens
gggctgcgtgtggaggatgtaa

SEQ ID NO: 8568377 - DNA, 22 bp, Homo sapiens
gggctgcctttcttctgggagc

SEQ ID NO: 8568378 - DNA, 22 bp, Homo sapiens
gggctgcctttcttctgggagc

SEQ ID NO: 8568379 - DNA, 22 bp, Homo sapiens
gggctgcctttcttctgggagc

SEQ ID NO: 8568380 - DNA, 22 bp, Homo sapiens
gggctgcatcagcaggacccgg

SEQ ID NO: 8568381 - DNA, 22 bp, Homo sapiens
gggctgccaagcctgcctgcct

SEQ ID NO: 8568382 - DNA, 22 bp, Homo sapiens
gggctgcacgtattctgctcac

SEQ ID NO: 8568383 - DNA, 22 bp, Homo sapiens
gggctgattcgatgggggtaga

SEQ ID NO: 8568384 - DNA, 22 bp, Homo sapiens
gggctgcacagatcttcaaggg

SEQ ID NO: 8568385 - DNA, 22 bp, Homo sapiens
gggctgctgccaccaggtggat

SEQ ID NO: 8568386 - DNA, 22 bp, Homo sapiens
gggctgctgcccaggaggcacc

SEQ ID NO: 8568387 - DNA, 22 bp, Homo sapiens
gggctgctgcccaggaggcacc

SEQ ID NO: 8568388 - DNA, 22 bp, Homo sapiens
gggctgctgtagagaacatgtt

SEQ ID NO: 8568389 - DNA, 22 bp, Homo sapiens
gggctgctgctgccagcgacac

SEQ ID NO: 8568390 - DNA, 22 bp, Homo sapiens
gggcttcttgccatggggacgg

SEQ ID NO: 8568391 - DNA, 19 bp, Homo sapiens
gggcttggggctgaagcct

SEQ ID NO: 8568392 - DNA, 22 bp, Homo sapiens
gggcttggcacatgggctcagc

SEQ ID NO: 8568393 - DNA, 22 bp, Homo sapiens
gggcttggcacatgggctcagc

SEQ ID NO: 8568394 - DNA, 22 bp, Homo sapiens
gggtaggagaggtgtctgtgtg

SEQ ID NO: 8568395 - DNA, 22 bp, Homo sapiens
gggtaggatggtagaagggacc

SEQ ID NO: 8568396 - DNA, 22 bp, Homo sapiens
gggtaggatggtagaagggacc

SEQ ID NO: 8568397 - DNA, 22 bp, Homo sapiens
gggtaggatggtagaagggacc

SEQ ID NO: 8568398 - DNA, 22 bp, Homo sapiens
gggtaggcaaagcaatgacgtt

SEQ ID NO: 8568399 - DNA, 22 bp, Homo sapiens
gggtaggcagtgcgtcctgcct

SEQ ID NO: 8568400 - DNA, 22 bp, Homo sapiens
gggtagggtgacttaggctggc

SEQ ID NO: 8568401 - DNA, 22 bp, Homo sapiens
gggtaggctgctcctggggccc

SEQ ID NO: 8568402 - DNA, 22 bp, Homo sapiens
gggtaggccagaagggcctgga

SEQ ID NO: 8568403 - DNA, 22 bp, Homo sapiens
gggtaggccgtgggtcaccagg

SEQ ID NO: 8568404 - DNA, 22 bp, Homo sapiens
gggtaggctctgcaggctgggt

SEQ ID NO: 8568405 - DNA, 22 bp, Homo sapiens
gggtaggccgtgggtcaccagg

SEQ ID NO: 8568406 - DNA, 22 bp, Homo sapiens
gggtggagcctgagaatttgca

SEQ ID NO: 8568407 - DNA, 22 bp, Homo sapiens
gggtagtgtggtctctgggctg

SEQ ID NO: 8568408 - DNA, 22 bp, Homo sapiens
gggtggagcttggacaccagta

SEQ ID NO: 8568409 - DNA, 22 bp, Homo sapiens
gggtggagcttggacaccagta

SEQ ID NO: 8568410 - DNA, 22 bp, Homo sapiens
gggtggagcttggacaccagta

SEQ ID NO: 8568411 - DNA, 22 bp, Homo sapiens
gggtggaggagaacaggcccca

SEQ ID NO: 8568412 - DNA, 22 bp, Homo sapiens
gggtggagcttggacaccagta

SEQ ID NO: 8568413 - DNA, 22 bp, Homo sapiens
gggtggaggagaacaggcccca

SEQ ID NO: 8568414 - DNA, 22 bp, Homo sapiens
gggtggaggagaacaggcccca

SEQ ID NO: 8568415 - DNA, 22 bp, Homo sapiens
gggtggaggagaacaggcccca

SEQ ID NO: 8568416 - DNA, 22 bp, Homo sapiens
gggtggaggtgggttttgagat

SEQ ID NO: 8568417 - DNA, 22 bp, Homo sapiens
gggtggagtagaaagatgaatt

SEQ ID NO: 8568418 - DNA, 22 bp, Homo sapiens
gggtggagtagaaagatgaatt

SEQ ID NO: 8568419 - DNA, 22 bp, Homo sapiens
gggtggagtgtgaaatctggct

SEQ ID NO: 8568420 - DNA, 20 bp, Homo sapiens
gggtggagttgcggtctgtg

SEQ ID NO: 8568421 - DNA, 22 bp, Homo sapiens
gggtggagtgtgaaatctggct

SEQ ID NO: 8568422 - DNA, 22 bp, Homo sapiens
gggtggagtagaaagatgaatt

SEQ ID NO: 8568423 - DNA, 22 bp, Homo sapiens
ggggctggtggtggtttctcca

SEQ ID NO: 8568424 - DNA, 22 bp, Homo sapiens
ggggctgggatttgaacccagg

SEQ ID NO: 8568425 - DNA, 22 bp, Homo sapiens
ggggtgggcgtgcagggacacc

SEQ ID NO: 8568426 - DNA, 22 bp, Homo sapiens
ggggctggtggtggtttctcca

SEQ ID NO: 8568427 - DNA, 22 bp, Homo sapiens
ggggctggtggtggtttctcca

SEQ ID NO: 8568428 - DNA, 22 bp, Homo sapiens
ggggtgggcgtgcagggacacc

SEQ ID NO: 8568429 - DNA, 22 bp, Homo sapiens
ggggtgggcgtgcagggacacc

SEQ ID NO: 8568430 - DNA, 22 bp, Homo sapiens
ggggtgggcgtgcagggacacc

SEQ ID NO: 8568431 - DNA, 22 bp, Homo sapiens
ggggtgggcgtgcagggacacc

SEQ ID NO: 8568432 - DNA, 22 bp, Homo sapiens
ggggtgggcgtgcagggacacc

SEQ ID NO: 8568433 - DNA, 22 bp, Homo sapiens
ggggtgggcgtgcagggacacc

SEQ ID NO: 8568434 - DNA, 22 bp, Homo sapiens
ggggtgggcgtgcagggacacc

SEQ ID NO: 8568435 - DNA, 22 bp, Homo sapiens
ggggtgggcgtgcagggacacc

SEQ ID NO: 8568436 - DNA, 22 bp, Homo sapiens
ggggtggggttactcattgtgc

SEQ ID NO: 8568437 - DNA, 22 bp, Homo sapiens
ggggtggggttactcattgtgc

SEQ ID NO: 8568438 - DNA, 22 bp, Homo sapiens
ggggtggggttactcattgtgc

SEQ ID NO: 8568439 - DNA, 22 bp, Homo sapiens
ggggtggggttactcattgtgc

SEQ ID NO: 8568440 - DNA, 22 bp, Homo sapiens
ggggtggggttactcattgtgc

SEQ ID NO: 8568441 - DNA, 22 bp, Homo sapiens
ggggtggggttactcattgtgc

SEQ ID NO: 8568442 - DNA, 22 bp, Homo sapiens
ggggtgtgagtagagctgggga

SEQ ID NO: 8568443 - DNA, 22 bp, Homo sapiens
ggggtgtgagtagagctgggga

SEQ ID NO: 8568444 - DNA, 21 bp, Homo sapiens
ggggttggcaagagcagagac

SEQ ID NO: 8568445 - DNA, 22 bp, Homo sapiens
gggtaggaaatccagaggtggc

SEQ ID NO: 8568446 - DNA, 22 bp, Homo sapiens
ggggaaggaaagttattagcag

SEQ ID NO: 8568447 - DNA, 22 bp, Homo sapiens
ggggaaggatatgattagacta

SEQ ID NO: 8568448 - DNA, 22 bp, Homo sapiens
ggggccgaccgcggttcaggcc

SEQ ID NO: 8568449 - DNA, 22 bp, Homo sapiens
ggggctcacacctccctaaggg

SEQ ID NO: 8568450 - DNA, 22 bp, Homo sapiens
ggggcggggctctgagaagcat

SEQ ID NO: 8568451 - DNA, 22 bp, Homo sapiens
ggggcctccagcactaggcagc

SEQ ID NO: 8568452 - DNA, 22 bp, Homo sapiens
ggggaagatggccctccatgtg

SEQ ID NO: 8568453 - DNA, 22 bp, Homo sapiens
ggggaagatggccctccatgtg

SEQ ID NO: 8568454 - DNA, 22 bp, Homo sapiens
ggggaagaggcgtgatggatcc

SEQ ID NO: 8568455 - DNA, 22 bp, Homo sapiens
ggggaagacctggcactacagc

SEQ ID NO: 8568456 - DNA, 22 bp, Homo sapiens
ggggaagaatggcagaaaacat

SEQ ID NO: 8568457 - DNA, 22 bp, Homo sapiens
ggggaagaatgctctctagaga

SEQ ID NO: 8568458 - DNA, 20 bp, Homo sapiens
ggggctgcatgcagagaaga

SEQ ID NO: 8568459 - DNA, 22 bp, Homo sapiens
ggggctgatggaactcaggcct

SEQ ID NO: 8568460 - DNA, 22 bp, Homo sapiens
ggggctgctcccacccctgagg

SEQ ID NO: 8568461 - DNA, 22 bp, Homo sapiens
ggggctgagaattcagtctcgg

SEQ ID NO: 8568462 - DNA, 22 bp, Homo sapiens
ggggctgagtcagtgggaagag

SEQ ID NO: 8568463 - DNA, 22 bp, Homo sapiens
ggggctggctcactaagagact

SEQ ID NO: 8568464 - DNA, 22 bp, Homo sapiens
ggggctgggatttgaacccagg

SEQ ID NO: 8568465 - DNA, 22 bp, Homo sapiens
ggggctggctcactaagagact

SEQ ID NO: 8568466 - DNA, 22 bp, Homo sapiens
ggggctgctggtatttccagtt

SEQ ID NO: 8568467 - DNA, 22 bp, Homo sapiens
ggggctccagtcttcacatttt

SEQ ID NO: 8568468 - DNA, 22 bp, Homo sapiens
ggggctcagttcggacagcctg

SEQ ID NO: 8568469 - DNA, 22 bp, Homo sapiens
ggggctcaggggaagtgtccag

SEQ ID NO: 8568470 - DNA, 22 bp, Homo sapiens
ggggctcagttcggacagcctg

SEQ ID NO: 8568471 - DNA, 22 bp, Homo sapiens
ggggctgacgggcatgtggctt

SEQ ID NO: 8568472 - DNA, 22 bp, Homo sapiens
gcggtagctcaagcttgtaatc

SEQ ID NO: 8568473 - DNA, 22 bp, Homo sapiens
gcggtgggggaaaggagcggtt

SEQ ID NO: 8568474 - DNA, 22 bp, Homo sapiens
gcgtctcatcctcccgctaatt

SEQ ID NO: 8568475 - DNA, 22 bp, Homo sapiens
gcgtgcatggccgtgtgtatgc

SEQ ID NO: 8568476 - DNA, 22 bp, Homo sapiens
gcgtctcaaggcccccaggcca

SEQ ID NO: 8568477 - DNA, 22 bp, Homo sapiens
gcgtctcaaggcccccaggcca

SEQ ID NO: 8568478 - DNA, 22 bp, Homo sapiens
gcgtggcttagagtggggtacc

SEQ ID NO: 8568479 - DNA, 22 bp, Homo sapiens
gcgtggggcagcccagggcttc

SEQ ID NO: 8568480 - DNA, 22 bp, Homo sapiens
gctacagagctctgtgaagaga

SEQ ID NO: 8568481 - DNA, 22 bp, Homo sapiens
gctacagagctctgtgaagaga

SEQ ID NO: 8568482 - DNA, 22 bp, Homo sapiens
gctacaggagataaaggcctct

SEQ ID NO: 8568483 - DNA, 22 bp, Homo sapiens
gctacaggagctgtcacatgct

SEQ ID NO: 8568484 - DNA, 22 bp, Homo sapiens
gctacaggtatatagatgaaac

SEQ ID NO: 8568485 - DNA, 22 bp, Homo sapiens
gctacaggtatatagatgaaac

SEQ ID NO: 8568486 - DNA, 22 bp, Homo sapiens
gctacaggtgacagcctctgca

SEQ ID NO: 8568487 - DNA, 22 bp, Homo sapiens
gctacaggagctgtcacatgct

SEQ ID NO: 8568488 - DNA, 22 bp, Homo sapiens
gctacaggggtcagtcctttgc

SEQ ID NO: 8568489 - DNA, 22 bp, Homo sapiens
gctacaggtatatagatgaaac

SEQ ID NO: 8568490 - DNA, 22 bp, Homo sapiens
gctacaggggtcagtcctttgc

SEQ ID NO: 8568491 - DNA, 22 bp, Homo sapiens
gcgggtggatcatgaggtcagg

SEQ ID NO: 8568492 - DNA, 22 bp, Homo sapiens
gcgggtggatcatgaggtcagg

SEQ ID NO: 8568493 - DNA, 22 bp, Homo sapiens
gcgggtggatcatgaggtcagg

SEQ ID NO: 8568494 - DNA, 22 bp, Homo sapiens
gcggggggcaggcagtacgttg

SEQ ID NO: 8568495 - DNA, 22 bp, Homo sapiens
gcctttggatatattcagggat

SEQ ID NO: 8568496 - DNA, 22 bp, Homo sapiens
gcctttggatggtttttctatt

SEQ ID NO: 8568497 - DNA, 21 bp, Homo sapiens
gcctttggtttcttgtcctgc

SEQ ID NO: 8568498 - DNA, 19 bp, Homo sapiens
gcctttgggcgttgttggg

SEQ ID NO: 8568499 - DNA, 22 bp, Homo sapiens
gcctttggtgacaggcatgtgt

SEQ ID NO: 8568500 - DNA, 22 bp, Homo sapiens
gcctttggatatattcagggat

SEQ ID NO: 8568501 - DNA, 18 bp, Homo sapiens
gcctttggactgctccca

SEQ ID NO: 8568502 - DNA, 22 bp, Homo sapiens
gcctttggactgaggtagtcag

SEQ ID NO: 8568503 - DNA, 22 bp, Homo sapiens
gccttgtttcattacacgtggt

SEQ ID NO: 8568504 - DNA, 22 bp, Homo sapiens
gcctttcagttccatcaaagga

SEQ ID NO: 8568505 - DNA, 22 bp, Homo sapiens
gcctttcagtgccttctgttca

SEQ ID NO: 8568506 - DNA, 22 bp, Homo sapiens
gccttggctgatgtgcgaatga

SEQ ID NO: 8568507 - DNA, 22 bp, Homo sapiens
gccttggccaacaccttgcaaa

SEQ ID NO: 8568508 - DNA, 22 bp, Homo sapiens
gccttggccttcctaggcctga

SEQ ID NO: 8568509 - DNA, 22 bp, Homo sapiens
gccttgggattcttggatgctc

SEQ ID NO: 8568510 - DNA, 22 bp, Homo sapiens
gccttggactcgggtggactca

SEQ ID NO: 8568511 - DNA, 22 bp, Homo sapiens
gccttggaacaattattgctgc

SEQ ID NO: 8568512 - DNA, 21 bp, Homo sapiens
gccttgccgtgaaagcccttt

SEQ ID NO: 8568513 - DNA, 22 bp, Homo sapiens
gccttgctaatttctcctcaac

SEQ ID NO: 8568514 - DNA, 22 bp, Homo sapiens
gccttgctgattaccttccttt

SEQ ID NO: 8568515 - DNA, 22 bp, Homo sapiens
gccttggaaagctggagcagtt

SEQ ID NO: 8568516 - DNA, 22 bp, Homo sapiens
gcctgagctactagggagtctg

SEQ ID NO: 8568517 - DNA, 22 bp, Homo sapiens
gcctgagccgcctgagcggcgg

SEQ ID NO: 8568518 - DNA, 20 bp, Homo sapiens
gcctgagctattgccaggat

SEQ ID NO: 8568519 - DNA, 20 bp, Homo sapiens
gcctgagctattgccaggat

SEQ ID NO: 8568520 - DNA, 22 bp, Homo sapiens
gccttgccgctcagcagtgggg

SEQ ID NO: 8568521 - DNA, 20 bp, Homo sapiens
gcctgagctccgcctcctgt

SEQ ID NO: 8568522 - DNA, 22 bp, Homo sapiens
gcctctggtccctcatgctgtg

SEQ ID NO: 8568523 - DNA, 22 bp, Homo sapiens
gcctctggtccctcatgctgtg

SEQ ID NO: 8568524 - DNA, 22 bp, Homo sapiens
gcctctgggttggtgacaggct

SEQ ID NO: 8568525 - DNA, 22 bp, Homo sapiens
gcctctgggttggtgacaggct

SEQ ID NO: 8568526 - DNA, 22 bp, Homo sapiens
gcctctggggcagctgagtcat

SEQ ID NO: 8568527 - DNA, 22 bp, Homo sapiens
gcctctggggcagctgagtcat

SEQ ID NO: 8568528 - DNA, 22 bp, Homo sapiens
gcctctggggtggagcccagca

SEQ ID NO: 8568529 - DNA, 22 bp, Homo sapiens
gcctgagcaggcgtggaccatg

SEQ ID NO: 8568530 - DNA, 22 bp, Homo sapiens
gcctgagcaggcgtggaccatg

SEQ ID NO: 8568531 - DNA, 22 bp, Homo sapiens
gcctgagcaggcgtggaccatg

SEQ ID NO: 8568532 - DNA, 21 bp, Homo sapiens
gcctgagcatgtcttcaggtc

SEQ ID NO: 8568533 - DNA, 22 bp, Homo sapiens
gcctgagcccaggtgtgcagag

SEQ ID NO: 8568534 - DNA, 19 bp, Homo sapiens
gcctgagccagccatgcaa

SEQ ID NO: 8568535 - DNA, 19 bp, Homo sapiens
gcctgagccagccatgcaa

SEQ ID NO: 8568536 - DNA, 22 bp, Homo sapiens
gcctgagattggacattattta

SEQ ID NO: 8568537 - DNA, 18 bp, Homo sapiens
gcctctgttgcttgcctg

SEQ ID NO: 8568538 - DNA, 22 bp, Homo sapiens
gcctctgtaggagtgagagcat

SEQ ID NO: 8568539 - DNA, 22 bp, Homo sapiens
gcctctggtccctcatgctgtg

SEQ ID NO: 8568540 - DNA, 22 bp, Homo sapiens
gcctctggtccctcatgctgtg

SEQ ID NO: 8568541 - DNA, 22 bp, Homo sapiens
gcctctgtggctcagccttgct

SEQ ID NO: 8568542 - DNA, 22 bp, Homo sapiens
gcctctgtcatagctcatgtga

SEQ ID NO: 8568543 - DNA, 21 bp, Homo sapiens
gctccctggctgtgtgacctg

SEQ ID NO: 8568544 - DNA, 22 bp, Homo sapiens
gctccctggaatgttggctgcc

SEQ ID NO: 8568545 - DNA, 22 bp, Homo sapiens
gctccctggtagccatgctctc

SEQ ID NO: 8568546 - DNA, 20 bp, Homo sapiens
gctccctggtagaaatgttt

SEQ ID NO: 8568547 - DNA, 22 bp, Homo sapiens
gctccctggcttttacagtgta

SEQ ID NO: 8568548 - DNA, 23 bp, Homo sapiens
gctccctgtgctccaggagatgc

SEQ ID NO: 8568549 - DNA, 23 bp, Homo sapiens
gctccctgtgctccaggagatgc

SEQ ID NO: 8568550 - DNA, 22 bp, Homo sapiens
gctccctggtattgctgccact

SEQ ID NO: 8568551 - DNA, 22 bp, Homo sapiens
gctccctggtagccatgctctc

SEQ ID NO: 8568552 - DNA, 17 bp, Homo sapiens
gctccctgaggacagct

SEQ ID NO: 8568553 - DNA, 17 bp, Homo sapiens
gctccctgaggacagct

SEQ ID NO: 8568554 - DNA, 17 bp, Homo sapiens
gctccctgaggacagct

SEQ ID NO: 8568555 - DNA, 22 bp, Homo sapiens
gctccctgactcagttcctgag

SEQ ID NO: 8568556 - DNA, 22 bp, Homo sapiens
gctccctgactcagttcctgag

SEQ ID NO: 8568557 - DNA, 17 bp, Homo sapiens
gctccctgaggacagct

SEQ ID NO: 8568558 - DNA, 22 bp, Homo sapiens
gctccctgcctacacggacctt

SEQ ID NO: 8568559 - DNA, 21 bp, Homo sapiens
gctccctgctcagctcctggg

SEQ ID NO: 8568560 - DNA, 21 bp, Homo sapiens
gctccctgctcagctcctggg

SEQ ID NO: 8568561 - DNA, 22 bp, Homo sapiens
gctccctgcatttcccaccctt

SEQ ID NO: 8568562 - DNA, 22 bp, Homo sapiens
gctccctgcagctgagagttcc

SEQ ID NO: 8568563 - DNA, 22 bp, Homo sapiens
gctccctgcagctgagagttcc

SEQ ID NO: 8568564 - DNA, 22 bp, Homo sapiens
gctccctgcactctgcagccct

SEQ ID NO: 8568565 - DNA, 22 bp, Homo sapiens
gctccctgcactctgcagccct

SEQ ID NO: 8568566 - DNA, 22 bp, Homo sapiens
gctccaggtgtcccaggtaaaa

SEQ ID NO: 8568567 - DNA, 22 bp, Homo sapiens
gctccaggtggcttatttgtat

SEQ ID NO: 8568568 - DNA, 22 bp, Homo sapiens
gctccaggtggcttatttgtat

SEQ ID NO: 8568569 - DNA, 22 bp, Homo sapiens
gctccaggtggcttatttgtat

SEQ ID NO: 8568570 - DNA, 22 bp, Homo sapiens
gctccaggtgaatcctctcacc

SEQ ID NO: 8568571 - DNA, 22 bp, Homo sapiens
gctccaggtgtcccaggtaaaa

SEQ ID NO: 8568572 - DNA, 22 bp, Homo sapiens
gctccaggtgtcccaggtaaaa

SEQ ID NO: 8568573 - DNA, 22 bp, Homo sapiens
gctcccaactcaggcctcctcc

SEQ ID NO: 8568574 - DNA, 22 bp, Homo sapiens
gctcccacaaccttcttgctcc

SEQ ID NO: 8568575 - DNA, 22 bp, Homo sapiens
gctcccacaaccttcttgctcc

SEQ ID NO: 8568576 - DNA, 22 bp, Homo sapiens
gctccaggtatttgccctttta

SEQ ID NO: 8568577 - DNA, 22 bp, Homo sapiens
gctccaggtatttgccctttta

SEQ ID NO: 8568578 - DNA, 22 bp, Homo sapiens
gctccaggtatttgccctttta

SEQ ID NO: 8568579 - DNA, 20 bp, Homo sapiens
gctccaggtcagagaggacg

SEQ ID NO: 8568580 - DNA, 20 bp, Homo sapiens
gctccaggtcagagaggacg

SEQ ID NO: 8568581 - DNA, 22 bp, Homo sapiens
gctccaggtgaatcctctcacc

SEQ ID NO: 8568582 - DNA, 22 bp, Homo sapiens
gctccaggtgaatcctctcacc

SEQ ID NO: 8568583 - DNA, 20 bp, Homo sapiens
gctccaggtcagagaggacg

SEQ ID NO: 8568584 - DNA, 20 bp, Homo sapiens
gctccaggtcagagaggacg

SEQ ID NO: 8568585 - DNA, 22 bp, Homo sapiens
gctcccagaaccaaggctgggg

SEQ ID NO: 8568586 - DNA, 22 bp, Homo sapiens
gctcccagaaccaaggctgggg

SEQ ID NO: 8568587 - DNA, 22 bp, Homo sapiens
gctccctgaaaagaacaaagtc

SEQ ID NO: 8568588 - DNA, 22 bp, Homo sapiens
gctcccactgcagccctgagcc

SEQ ID NO: 8568589 - DNA, 22 bp, Homo sapiens
gctcccacgcaattcttttcag

SEQ ID NO: 8568590 - DNA, 22 bp, Homo sapiens
gctcccactgcagccctgagcc

SEQ ID NO: 8568591 - DNA, 22 bp, Homo sapiens
gctcccacgcaattcttttcag

SEQ ID NO: 8568592 - DNA, 22 bp, Homo sapiens
gctcccaccttaaccttcacat

SEQ ID NO: 8568593 - DNA, 22 bp, Homo sapiens
gctcccacctttgctatcagta

SEQ ID NO: 8568594 - DNA, 22 bp, Homo sapiens
gctcccacctccagcctgagtt

SEQ ID NO: 8568595 - DNA, 22 bp, Homo sapiens
gctcccacctccagcctgagtt

SEQ ID NO: 8568596 - DNA, 22 bp, Homo sapiens
gctcccacctccagcctgagtt

SEQ ID NO: 8568597 - DNA, 22 bp, Homo sapiens
gctcccaccaggcagacctacc

SEQ ID NO: 8568598 - DNA, 22 bp, Homo sapiens
gctcccaccaggcagacctacc

SEQ ID NO: 8568599 - DNA, 22 bp, Homo sapiens
gctcccacctccagcctgagtt

SEQ ID NO: 8568600 - DNA, 22 bp, Homo sapiens
gctcccaccgccgctatgggta

SEQ ID NO: 8568601 - DNA, 22 bp, Homo sapiens
gctcccaccgccgctatgggta

SEQ ID NO: 8568602 - DNA, 22 bp, Homo sapiens
gctccagggacccaagagaaaa

SEQ ID NO: 8568603 - DNA, 22 bp, Homo sapiens
gctccagggacccaagagaaaa

SEQ ID NO: 8568604 - DNA, 22 bp, Homo sapiens
gctccagggtcagctcagaact

SEQ ID NO: 8568605 - DNA, 22 bp, Homo sapiens
gctccagggtcagctcagaact

SEQ ID NO: 8568606 - DNA, 22 bp, Homo sapiens
gctccagggagtacatttatca

SEQ ID NO: 8568607 - DNA, 22 bp, Homo sapiens
gctccagggagtacatttatca

SEQ ID NO: 8568608 - DNA, 22 bp, Homo sapiens
gctccagggtggatgacaattc

SEQ ID NO: 8568609 - DNA, 22 bp, Homo sapiens
gctccagggtggatgacaattc

SEQ ID NO: 8568610 - DNA, 22 bp, Homo sapiens
gctccagggtcagctcagaact

SEQ ID NO: 8568611 - DNA, 22 bp, Homo sapiens
gctccagggtcagctcagaact

SEQ ID NO: 8568612 - DNA, 22 bp, Homo sapiens
gctccaggaggctcccgcgtct

SEQ ID NO: 8568613 - DNA, 22 bp, Homo sapiens
gctccaggaggctcccgcgtct

SEQ ID NO: 8568614 - DNA, 22 bp, Homo sapiens
gctccaggaggctcccgcgtct

SEQ ID NO: 8568615 - DNA, 22 bp, Homo sapiens
gctcagctgagcgaaggacatg

SEQ ID NO: 8568616 - DNA, 22 bp, Homo sapiens
gctcagctgcacctggagagcc

SEQ ID NO: 8568617 - DNA, 22 bp, Homo sapiens
gctccaggcagagcctctttcg

SEQ ID NO: 8568618 - DNA, 22 bp, Homo sapiens
gctccaggcagagcctctttcg

SEQ ID NO: 8568619 - DNA, 22 bp, Homo sapiens
gctccaggataataaagttgtt

SEQ ID NO: 8568620 - DNA, 22 bp, Homo sapiens
gctccaggataataaagttgtt

SEQ ID NO: 8568621 - DNA, 22 bp, Homo sapiens
gctcagccgaacttcagagcag

SEQ ID NO: 8568622 - DNA, 22 bp, Homo sapiens
gctcagccgaacttcagagcag

SEQ ID NO: 8568623 - DNA, 22 bp, Homo sapiens
gctcagcactttctccaaccac

SEQ ID NO: 8568624 - DNA, 22 bp, Homo sapiens
gctcagagttaattggatgggt

SEQ ID NO: 8568625 - DNA, 22 bp, Homo sapiens
gctcagagttaattggatgggt

SEQ ID NO: 8568626 - DNA, 23 bp, Homo sapiens
gctcagcctcagcaggcccagga

SEQ ID NO: 8568627 - DNA, 22 bp, Homo sapiens
gctcagctacttacaggtggct

SEQ ID NO: 8568628 - DNA, 22 bp, Homo sapiens
gctcagctctatggacacaaag

SEQ ID NO: 8568629 - DNA, 22 bp, Homo sapiens
gctcagctctatggacacaaag

SEQ ID NO: 8568630 - DNA, 18 bp, Homo sapiens
gctcagctatgggaggtt

SEQ ID NO: 8568631 - DNA, 22 bp, Homo sapiens
gctcagaggagcatcataagga

SEQ ID NO: 8568632 - DNA, 22 bp, Homo sapiens
gctcagagcttgaagttccact

SEQ ID NO: 8568633 - DNA, 22 bp, Homo sapiens
gctcagaggccactgttggaaa

SEQ ID NO: 8568634 - DNA, 22 bp, Homo sapiens
gctcagagggaacaaggggctg

SEQ ID NO: 8568635 - DNA, 22 bp, Homo sapiens
gctcagagggaacaaggggctg

SEQ ID NO: 8568636 - DNA, 22 bp, Homo sapiens
gctacctgagcaagagcttcaa

SEQ ID NO: 8568637 - DNA, 22 bp, Homo sapiens
gctacagtagataaggacggtc

SEQ ID NO: 8568638 - DNA, 22 bp, Homo sapiens
gctacatagtaacccacaaatc

SEQ ID NO: 8568639 - DNA, 20 bp, Homo sapiens
gctaccagaacaaggccatt

SEQ ID NO: 8568640 - DNA, 22 bp, Homo sapiens
gctactttgcagctagctagga

SEQ ID NO: 8568641 - DNA, 17 bp, Homo sapiens
gctactggttacctcta

SEQ ID NO: 8568642 - DNA, 22 bp, Homo sapiens
gctactgattgaccttggagag

SEQ ID NO: 8568643 - DNA, 19 bp, Homo sapiens
gctcagagtccccctgcgg

SEQ ID NO: 8568644 - DNA, 22 bp, Homo sapiens
gctcagagtggcctggctaggg

SEQ ID NO: 8568645 - DNA, 21 bp, Homo sapiens
gctcagagtattgcactgttt

SEQ ID NO: 8568646 - DNA, 23 bp, Homo sapiens
gctcagaggtttttctctggatg

SEQ ID NO: 8568647 - DNA, 17 bp, Homo sapiens
gctcagagtacacgtgt

SEQ ID NO: 8568648 - DNA, 19 bp, Homo sapiens
gctcagagggccctgtgct

SEQ ID NO: 8568649 - DNA, 22 bp, Homo sapiens
gctcagaggttgttcttgggtt

SEQ ID NO: 8568650 - DNA, 23 bp, Homo sapiens
gctcagaggtttttctctggatg

SEQ ID NO: 8568651 - DNA, 23 bp, Homo sapiens
gctcagaggtttttctctggatg

SEQ ID NO: 8568652 - DNA, 17 bp, Homo sapiens
gctgagaaggggaagag

SEQ ID NO: 8568653 - DNA, 22 bp, Homo sapiens
gctgagaacagagctctgagct

SEQ ID NO: 8568654 - DNA, 22 bp, Homo sapiens
gctgagaatgttcctactggta

SEQ ID NO: 8568655 - DNA, 22 bp, Homo sapiens
gctgagaatcaagatggagagg

SEQ ID NO: 8568656 - DNA, 22 bp, Homo sapiens
gctgagaatgttcctactggta

SEQ ID NO: 8568657 - DNA, 22 bp, Homo sapiens
gctgagactggcagcaggaagt

SEQ ID NO: 8568658 - DNA, 22 bp, Homo sapiens
gctgagactggcagcaggaagt

SEQ ID NO: 8568659 - DNA, 22 bp, Homo sapiens
gctgagagaaaagtgaggttct

SEQ ID NO: 8568660 - DNA, 22 bp, Homo sapiens
gctgagagatcaaggcaggatt

SEQ ID NO: 8568661 - DNA, 22 bp, Homo sapiens
gctgagagatcaaggcaggatt

SEQ ID NO: 8568662 - DNA, 22 bp, Homo sapiens
gctgagaggcagccagaccctc

SEQ ID NO: 8568663 - DNA, 17 bp, Homo sapiens
gctgagaggcagcacag

SEQ ID NO: 8568664 - DNA, 22 bp, Homo sapiens
gctgagagcggccagctgggaa

SEQ ID NO: 8568665 - DNA, 22 bp, Homo sapiens
gctgagagcggccagctgggaa

SEQ ID NO: 8568666 - DNA, 22 bp, Homo sapiens
gctgagagcacatagaaggggc

SEQ ID NO: 8568667 - DNA, 22 bp, Homo sapiens
gctgagagcaaggacaaagcat

SEQ ID NO: 8568668 - DNA, 22 bp, Homo sapiens
gctgagagatcaaggcaggatt

SEQ ID NO: 8568669 - DNA, 22 bp, Homo sapiens
gctgaggctgggagcagcctgt

SEQ ID NO: 8568670 - DNA, 22 bp, Homo sapiens
gctgaggctgggagcagcctgt

SEQ ID NO: 8568671 - DNA, 22 bp, Homo sapiens
gctgagggaggctgaactgagt

SEQ ID NO: 8568672 - DNA, 22 bp, Homo sapiens
gctgaggctcaagtcatgggtc

SEQ ID NO: 8568673 - DNA, 22 bp, Homo sapiens
gctgaggctcctcgggaggaca

SEQ ID NO: 8568674 - DNA, 22 bp, Homo sapiens
gctgaggctcctcgggaggaca

SEQ ID NO: 8568675 - DNA, 22 bp, Homo sapiens
gctgaggctgggagcagcctgt

SEQ ID NO: 8568676 - DNA, 22 bp, Homo sapiens
gctgaggctgggagcagcctgt

SEQ ID NO: 8568677 - DNA, 22 bp, Homo sapiens
gctgaggctcctcgggaggaca

SEQ ID NO: 8568678 - DNA, 22 bp, Homo sapiens
gctgaggccaggccccaccgga

SEQ ID NO: 8568679 - DNA, 22 bp, Homo sapiens
gctgaggccccagggtgatggg

SEQ ID NO: 8568680 - DNA, 22 bp, Homo sapiens
gctgaggccccagggtgatggg

SEQ ID NO: 8568681 - DNA, 22 bp, Homo sapiens
gctgaggccccagggtgatggg

SEQ ID NO: 8568682 - DNA, 22 bp, Homo sapiens
gctgaggcctcagaaggctgag

SEQ ID NO: 8568683 - DNA, 22 bp, Homo sapiens
gctgaggcctcagaaggctgag

SEQ ID NO: 8568684 - DNA, 22 bp, Homo sapiens
gctgaggcggaaggattgctag

SEQ ID NO: 8568685 - DNA, 22 bp, Homo sapiens
gctgaggctcaagtcatgggtc

SEQ ID NO: 8568686 - DNA, 22 bp, Homo sapiens
gctccctgttctcagccatgat

SEQ ID NO: 8568687 - DNA, 22 bp, Homo sapiens
gctccctgttctcagccatgat

SEQ ID NO: 8568688 - DNA, 23 bp, Homo sapiens
gctccctgtgctccaggagatgc

SEQ ID NO: 8568689 - DNA, 22 bp, Homo sapiens
gctccctgtgctctgagtgata

SEQ ID NO: 8568690 - DNA, 22 bp, Homo sapiens
gctccctgtgctctgagtgata

SEQ ID NO: 8568691 - DNA, 22 bp, Homo sapiens
gctccgtgggcattgctaggtg

SEQ ID NO: 8568692 - DNA, 22 bp, Homo sapiens
gctccctgttctcagccatgat

SEQ ID NO: 8568693 - DNA, 22 bp, Homo sapiens
gctcccttaggccttgccggga

SEQ ID NO: 8568694 - DNA, 22 bp, Homo sapiens
gctcccttagtccttgccggga

SEQ ID NO: 8568695 - DNA, 22 bp, Homo sapiens
gctcctccaatatggactcctc

SEQ ID NO: 8568696 - DNA, 22 bp, Homo sapiens
gctcctccctgtgcagacccag

SEQ ID NO: 8568697 - DNA, 22 bp, Homo sapiens
gctcctctattccccacatttt

SEQ ID NO: 8568698 - DNA, 22 bp, Homo sapiens
gctctggctcaaaccaccggct

SEQ ID NO: 8568699 - DNA, 22 bp, Homo sapiens
gctctggcttggggcactcgtc

SEQ ID NO: 8568700 - DNA, 18 bp, Homo sapiens
gctctggctcacctccag

SEQ ID NO: 8568701 - DNA, 22 bp, Homo sapiens
gctctgggaactgactgccttc

SEQ ID NO: 8568702 - DNA, 22 bp, Homo sapiens
gctctgggaagtcctttaccat

SEQ ID NO: 8568703 - DNA, 22 bp, Homo sapiens
gctctgggaactgactgccttc

SEQ ID NO: 8568704 - DNA, 22 bp, Homo sapiens
gctctgggaactgactgccttc

SEQ ID NO: 8568705 - DNA, 22 bp, Homo sapiens
gctctgggattaccagccttag

SEQ ID NO: 8568706 - DNA, 22 bp, Homo sapiens
gctctgggccatcctggccggg

SEQ ID NO: 8568707 - DNA, 20 bp, Homo sapiens
gctctgggagggatgtgatg

SEQ ID NO: 8568708 - DNA, 22 bp, Homo sapiens
gctctgggattaccagccttag

SEQ ID NO: 8568709 - DNA, 22 bp, Homo sapiens
gctctgggattaccagccttag

SEQ ID NO: 8568710 - DNA, 22 bp, Homo sapiens
gctctgggattaccagccttag

SEQ ID NO: 8568711 - DNA, 22 bp, Homo sapiens
gctctggggatgcttctgccgt

SEQ ID NO: 8568712 - DNA, 22 bp, Homo sapiens
gctgaataggggtcccaaagat

SEQ ID NO: 8568713 - DNA, 22 bp, Homo sapiens
gctgaataggcacagagggcat

SEQ ID NO: 8568714 - DNA, 22 bp, Homo sapiens
gctgaatgaatgtattttaaaa

SEQ ID NO: 8568715 - DNA, 22 bp, Homo sapiens
gctctgggctgccctctggaca

SEQ ID NO: 8568716 - DNA, 22 bp, Homo sapiens
gctgccctgtggtccagcaggt

SEQ ID NO: 8568717 - DNA, 22 bp, Homo sapiens
gctgccctaatatcacatgtta

SEQ ID NO: 8568718 - DNA, 22 bp, Homo sapiens
gctgccctacccgaggcactct

SEQ ID NO: 8568719 - DNA, 22 bp, Homo sapiens
gctgccctacccgaggcactct

SEQ ID NO: 8568720 - DNA, 22 bp, Homo sapiens
gctgccctagaagtacagagag

SEQ ID NO: 8568721 - DNA, 22 bp, Homo sapiens
gctgcccattccactggatggt

SEQ ID NO: 8568722 - DNA, 22 bp, Homo sapiens
gctgccccccggactcggcggg

SEQ ID NO: 8568723 - DNA, 22 bp, Homo sapiens
gctgccccgagccatccttcag

SEQ ID NO: 8568724 - DNA, 22 bp, Homo sapiens
gctgccctaatatcacatgtta

SEQ ID NO: 8568725 - DNA, 22 bp, Homo sapiens
gctgccctgtggtccagcaggt

SEQ ID NO: 8568726 - DNA, 22 bp, Homo sapiens
gctgccctgtggtccagcaggt

SEQ ID NO: 8568727 - DNA, 22 bp, Homo sapiens
gctgccctgtttagccagggtt

SEQ ID NO: 8568728 - DNA, 22 bp, Homo sapiens
gctgcctcactccagcccaata

SEQ ID NO: 8568729 - DNA, 22 bp, Homo sapiens
gctgccgttggctcttcaggcc

SEQ ID NO: 8568730 - DNA, 22 bp, Homo sapiens
gctgcctcaggcacctcctggc

SEQ ID NO: 8568731 - DNA, 22 bp, Homo sapiens
gctgcctcaggcacctcctggc

SEQ ID NO: 8568732 - DNA, 22 bp, Homo sapiens
gctgcctcaggcacctcctggc

SEQ ID NO: 8568733 - DNA, 22 bp, Homo sapiens
gctgcctccaatctgtgccccg

SEQ ID NO: 8568734 - DNA, 22 bp, Homo sapiens
gctgcctccaatctgtgccccg

SEQ ID NO: 8568735 - DNA, 22 bp, Homo sapiens
gctgcctgtcctgaggagtccg

SEQ ID NO: 8568736 - DNA, 22 bp, Homo sapiens
gctgcctgtcctgaggagtccg

SEQ ID NO: 8568737 - DNA, 22 bp, Homo sapiens
gctgcctgtcctgaggagtccg

SEQ ID NO: 8568738 - DNA, 22 bp, Homo sapiens
gctgcccaattacagggccgtg

SEQ ID NO: 8568739 - DNA, 22 bp, Homo sapiens
gctgcccaattacagggccgtg

SEQ ID NO: 8568740 - DNA, 22 bp, Homo sapiens
gctgagggctgtaacagcagag

SEQ ID NO: 8568741 - DNA, 22 bp, Homo sapiens
gctgagggctgtaacagcagag

SEQ ID NO: 8568742 - DNA, 22 bp, Homo sapiens
gctgagggccgcatagggtcat

SEQ ID NO: 8568743 - DNA, 22 bp, Homo sapiens
gctgagggctgtaacagcagag

SEQ ID NO: 8568744 - DNA, 22 bp, Homo sapiens
gctgagggctgtaacagcagag

SEQ ID NO: 8568745 - DNA, 22 bp, Homo sapiens
gctgagggatagctgctcactg

SEQ ID NO: 8568746 - DNA, 22 bp, Homo sapiens
gctgagggcatgtgtggcgact

SEQ ID NO: 8568747 - DNA, 22 bp, Homo sapiens
gctgagggcatgtgtggcgact

SEQ ID NO: 8568748 - DNA, 22 bp, Homo sapiens
gctgagggcatgtgtggcgact

SEQ ID NO: 8568749 - DNA, 22 bp, Homo sapiens
gctgagggcatgtgtggcgact

SEQ ID NO: 8568750 - DNA, 19 bp, Homo sapiens
gctgagggccacccagccc

SEQ ID NO: 8568751 - DNA, 22 bp, Homo sapiens
gctgcccagggtggagccggct

SEQ ID NO: 8568752 - DNA, 22 bp, Homo sapiens
gctgcccagggtggagccggct

SEQ ID NO: 8568753 - DNA, 22 bp, Homo sapiens
gctgcccaggcaacattgactt

SEQ ID NO: 8568754 - DNA, 22 bp, Homo sapiens
gctgcccagggctgagtgtcct

SEQ ID NO: 8568755 - DNA, 22 bp, Homo sapiens
gctgcccagggctgagtgtcct

SEQ ID NO: 8568756 - DNA, 22 bp, Homo sapiens
gctgcccagggtggagccggct

SEQ ID NO: 8568757 - DNA, 22 bp, Homo sapiens
gctgcccagttctgctgctgcc

SEQ ID NO: 8568758 - DNA, 22 bp, Homo sapiens
gctgcccagcaggccccagggg

SEQ ID NO: 8568759 - DNA, 22 bp, Homo sapiens
gctgcccagcaggccccagggg

SEQ ID NO: 8568760 - DNA, 22 bp, Homo sapiens
gctgcccaggaagcctggggtt

SEQ ID NO: 8568761 - DNA, 22 bp, Homo sapiens
gctgcccaggagaggtggggct

SEQ ID NO: 8568762 - DNA, 22 bp, Homo sapiens
gctgcccaggagaggtggggct

SEQ ID NO: 8568763 - DNA, 22 bp, Homo sapiens
gctgcccagcaggccccagggg

SEQ ID NO: 8568764 - DNA, 22 bp, Homo sapiens
gctgcccacagcgggtgtttcg

SEQ ID NO: 8568765 - DNA, 22 bp, Homo sapiens
gctgcccacaaccccgtgtcta

SEQ ID NO: 8568766 - DNA, 22 bp, Homo sapiens
gctgcccacaaccccgtgtcta

SEQ ID NO: 8568767 - DNA, 22 bp, Homo sapiens
gctgctccgtctgagctctggt

SEQ ID NO: 8568768 - DNA, 22 bp, Homo sapiens
gctgctccagctgtgctgcaga

SEQ ID NO: 8568769 - DNA, 21 bp, Homo sapiens
gctgctgtgggccagggaggc

SEQ ID NO: 8568770 - DNA, 21 bp, Homo sapiens
gctgctgtgggccagggaggc

SEQ ID NO: 8568771 - DNA, 22 bp, Homo sapiens
gctgctgtgcctggcgtcctgt

SEQ ID NO: 8568772 - DNA, 22 bp, Homo sapiens
gctgctgtgaattttttaaatg

SEQ ID NO: 8568773 - DNA, 22 bp, Homo sapiens
gctgctgttgatttagtccaat

SEQ ID NO: 8568774 - DNA, 22 bp, Homo sapiens
gctgctgttgatttagtccaat

SEQ ID NO: 8568775 - DNA, 22 bp, Homo sapiens
gctgcttcagggacgtgccagc

SEQ ID NO: 8568776 - DNA, 22 bp, Homo sapiens
gctgcttcctttcctgctgacc

SEQ ID NO: 8568777 - DNA, 22 bp, Homo sapiens
gctgcttctctgatggagtcca

SEQ ID NO: 8568778 - DNA, 22 bp, Homo sapiens
gctgcttctctgatggagtcca

SEQ ID NO: 8568779 - DNA, 22 bp, Homo sapiens
gctgcttcctttcctgctgacc

SEQ ID NO: 8568780 - DNA, 22 bp, Homo sapiens
gctgcttgattaggttgacact

SEQ ID NO: 8568781 - DNA, 22 bp, Homo sapiens
gctgctgtgtgggagacaggcg

SEQ ID NO: 8568782 - DNA, 21 bp, Homo sapiens
gctgctgtgggccagggaggc

SEQ ID NO: 8568783 - DNA, 22 bp, Homo sapiens
gctgctgtgttggagagggact

SEQ ID NO: 8568784 - DNA, 22 bp, Homo sapiens
gctgctgttcctccagtggatc

SEQ ID NO: 8568785 - DNA, 22 bp, Homo sapiens
gctgctgttatgatgttacttt

SEQ ID NO: 8568786 - DNA, 22 bp, Homo sapiens
gctgcctgtgtggccactcact

SEQ ID NO: 8568787 - DNA, 22 bp, Homo sapiens
gctgcctgtgtggccactcact

SEQ ID NO: 8568788 - DNA, 22 bp, Homo sapiens
gctgcctgtgtggccactcact

SEQ ID NO: 8568789 - DNA, 22 bp, Homo sapiens
gctgcctgttgaagggtctgtg

SEQ ID NO: 8568790 - DNA, 22 bp, Homo sapiens
gctgcctgttgaagggtctgtg

SEQ ID NO: 8568791 - DNA, 22 bp, Homo sapiens
gctgcctgtgtggccactcact

SEQ ID NO: 8568792 - DNA, 22 bp, Homo sapiens
gctgcctgtggcccttctgggt

SEQ ID NO: 8568793 - DNA, 22 bp, Homo sapiens
gctgcctgtggcccttctgggt

SEQ ID NO: 8568794 - DNA, 22 bp, Homo sapiens
gctgcctgtggcccttctgggt

SEQ ID NO: 8568795 - DNA, 22 bp, Homo sapiens
gctgcctgtggcccttctgggt

SEQ ID NO: 8568796 - DNA, 22 bp, Homo sapiens
gctgcctgtgcgggtcgctagg

SEQ ID NO: 8568797 - DNA, 19 bp, Homo sapiens
gctgcctgtcttagccagt

SEQ ID NO: 8568798 - DNA, 22 bp, Homo sapiens
gctgcctgtgcactttctcgta

SEQ ID NO: 8568799 - DNA, 22 bp, Homo sapiens
gctgcctgtctgctgacccagg

SEQ ID NO: 8568800 - DNA, 22 bp, Homo sapiens
gctgcctgtctgctgacccagg

SEQ ID NO: 8568801 - DNA, 22 bp, Homo sapiens
gctgcctgtctgctgacccagg

SEQ ID NO: 8568802 - DNA, 22 bp, Homo sapiens
gctgcctgtctgtttcttttat

SEQ ID NO: 8568803 - DNA, 22 bp, Homo sapiens
gctgcctgtcctgaggagtccg

SEQ ID NO: 8568804 - DNA, 22 bp, Homo sapiens
gctgcctgtcctgaggagtccg

SEQ ID NO: 8568805 - DNA, 18 bp, Homo sapiens
gctgcgtgggatgtgacc

SEQ ID NO: 8568806 - DNA, 18 bp, Homo sapiens
gctgcgtgggatgtgacc

SEQ ID NO: 8568807 - DNA, 22 bp, Homo sapiens
gctgctaagcgtttctgttcca

SEQ ID NO: 8568808 - DNA, 22 bp, Homo sapiens
gctgcgccggatcccacgttcc

SEQ ID NO: 8568809 - DNA, 22 bp, Homo sapiens
gctgcgtcgagacagcctggca

SEQ ID NO: 8568810 - DNA, 22 bp, Homo sapiens
gctgcgtcgagacagcctggca

SEQ ID NO: 8568811 - DNA, 20 bp, Homo sapiens
gctgcctgtttctgtaagta

SEQ ID NO: 8568812 - DNA, 20 bp, Homo sapiens
gctgcctgtttctgtaagta

SEQ ID NO: 8568813 - DNA, 20 bp, Homo sapiens
gctgcctgtttctgtaagta

SEQ ID NO: 8568814 - DNA, 22 bp, Homo sapiens
gctgcctgttgaagggtctgtg

SEQ ID NO: 8568815 - DNA, 22 bp, Homo sapiens
gctgccttagagggagtggttc

SEQ ID NO: 8568816 - DNA, 22 bp, Homo sapiens
gctgccttatgtctattagtat

SEQ ID NO: 8568817 - DNA, 22 bp, Homo sapiens
gctgccttccaaagagttttat

SEQ ID NO: 8568818 - DNA, 20 bp, Homo sapiens
gctgcctgtttctgtaagta

SEQ ID NO: 8568819 - DNA, 22 bp, Homo sapiens
gctggctggaactagcagttgg

SEQ ID NO: 8568820 - DNA, 22 bp, Homo sapiens
gctggctggaactagcagttgg

SEQ ID NO: 8568821 - DNA, 22 bp, Homo sapiens
gctggctggaatgggagaagaa

SEQ ID NO: 8568822 - DNA, 22 bp, Homo sapiens
gctggctggaatgggagaagaa

SEQ ID NO: 8568823 - DNA, 22 bp, Homo sapiens
gctggctggaatgggagaagaa

SEQ ID NO: 8568824 - DNA, 22 bp, Homo sapiens
gctggctggaatgggagaagaa

SEQ ID NO: 8568825 - DNA, 19 bp, Homo sapiens
gctggctggaggagggaca

SEQ ID NO: 8568826 - DNA, 19 bp, Homo sapiens
gctggctggaggagggaca

SEQ ID NO: 8568827 - DNA, 22 bp, Homo sapiens
gctggctggaggagggaggttg

SEQ ID NO: 8568828 - DNA, 22 bp, Homo sapiens
gctggctggaggtgaggaagaa

SEQ ID NO: 8568829 - DNA, 22 bp, Homo sapiens
gctggctggagtaaggagggag

SEQ ID NO: 8568830 - DNA, 22 bp, Homo sapiens
gctggctggagtaaggagggag

SEQ ID NO: 8568831 - DNA, 22 bp, Homo sapiens
gctggctggagtgagctaccct

SEQ ID NO: 8568832 - DNA, 22 bp, Homo sapiens
gctggctggagtgagctaccct

SEQ ID NO: 8568833 - DNA, 22 bp, Homo sapiens
gctggctggaggtgaggaagaa

SEQ ID NO: 8568834 - DNA, 22 bp, Homo sapiens
gctggctggaggtgaggaagaa

SEQ ID NO: 8568835 - DNA, 22 bp, Homo sapiens
gctggctggaggtgaggaagaa

SEQ ID NO: 8568836 - DNA, 23 bp, Homo sapiens
gctggctggcagtaaaggttgtt

SEQ ID NO: 8568837 - DNA, 22 bp, Homo sapiens
gctggctggcgggtgcgtcctc

SEQ ID NO: 8568838 - DNA, 22 bp, Homo sapiens
gctggctggatggttggttcgc

SEQ ID NO: 8568839 - DNA, 22 bp, Homo sapiens
gctggctgcgtcatcacagggc

SEQ ID NO: 8568840 - DNA, 22 bp, Homo sapiens
gctggctgcgtcatcacagggc

SEQ ID NO: 8568841 - DNA, 22 bp, Homo sapiens
gctggctgcgtcatcacagggc

SEQ ID NO: 8568842 - DNA, 22 bp, Homo sapiens
gctggctgcgtcatcacagggc

SEQ ID NO: 8568843 - DNA, 22 bp, Homo sapiens
gctggctgctaggacagctaca

SEQ ID NO: 8568844 - DNA, 22 bp, Homo sapiens
gctggctgctgttgagacttgt

SEQ ID NO: 8568845 - DNA, 22 bp, Homo sapiens
gctggctgctgttgagacttgt

SEQ ID NO: 8568846 - DNA, 22 bp, Homo sapiens
gctggctgctaggacagctaca

SEQ ID NO: 8568847 - DNA, 22 bp, Homo sapiens
gctggctgctaggacagctaca

SEQ ID NO: 8568848 - DNA, 22 bp, Homo sapiens
gctggctgctaggacagctaca

SEQ ID NO: 8568849 - DNA, 22 bp, Homo sapiens
gctggctgccttactttgtgga

SEQ ID NO: 8568850 - DNA, 22 bp, Homo sapiens
gctggctgcgtcatcacagggc

SEQ ID NO: 8568851 - DNA, 22 bp, Homo sapiens
gctggctgccttactttgtgga

SEQ ID NO: 8568852 - DNA, 22 bp, Homo sapiens
gctggagagataggcatggggt

SEQ ID NO: 8568853 - DNA, 22 bp, Homo sapiens
gctggagagataggcatggggt

SEQ ID NO: 8568854 - DNA, 22 bp, Homo sapiens
gctggagagataggcatggggt

SEQ ID NO: 8568855 - DNA, 22 bp, Homo sapiens
gctggagagataggcatggggt

SEQ ID NO: 8568856 - DNA, 22 bp, Homo sapiens
gctggagaaacaggaggaggaa

SEQ ID NO: 8568857 - DNA, 22 bp, Homo sapiens
gctggagaaacaggaggaggaa

SEQ ID NO: 8568858 - DNA, 20 bp, Homo sapiens
gctgctttcaaatgacacgt

SEQ ID NO: 8568859 - DNA, 22 bp, Homo sapiens
gctgctttagaattgaaacaga

SEQ ID NO: 8568860 - DNA, 22 bp, Homo sapiens
gctgctttagaattgaaacaga

SEQ ID NO: 8568861 - DNA, 22 bp, Homo sapiens
gctggagaaactgcagctgagg

SEQ ID NO: 8568862 - DNA, 22 bp, Homo sapiens
gctggagaaactgcagctgagg

SEQ ID NO: 8568863 - DNA, 22 bp, Homo sapiens
gctggagaaactgcagctgagg

SEQ ID NO: 8568864 - DNA, 22 bp, Homo sapiens
gctggagaaactgcagctgagg

SEQ ID NO: 8568865 - DNA, 22 bp, Homo sapiens
gctggagaaacaggaggaggaa

SEQ ID NO: 8568866 - DNA, 22 bp, Homo sapiens
gctggagacctcagagaaccca

SEQ ID NO: 8568867 - DNA, 22 bp, Homo sapiens
gctggagacctcagagaaccca

SEQ ID NO: 8568868 - DNA, 22 bp, Homo sapiens
gctggagaacccaggaggaaga

SEQ ID NO: 8568869 - DNA, 22 bp, Homo sapiens
gctggagaacccaggaggaaga

SEQ ID NO: 8568870 - DNA, 22 bp, Homo sapiens
gctggctttgtcaagggcagca

SEQ ID NO: 8568871 - DNA, 22 bp, Homo sapiens
gctggctttgcactgggtgcat

SEQ ID NO: 8568872 - DNA, 22 bp, Homo sapiens
gctggctttgatcttcccatct

SEQ ID NO: 8568873 - DNA, 21 bp, Homo sapiens
gctggctttattctgcgtttg

SEQ ID NO: 8568874 - DNA, 22 bp, Homo sapiens
gctggctttatggggcttgtgg

SEQ ID NO: 8568875 - DNA, 22 bp, Homo sapiens
gctggctttatcgtcagactcc

SEQ ID NO: 8568876 - DNA, 22 bp, Homo sapiens
gctgggctggaaggccaaggca

SEQ ID NO: 8568877 - DNA, 22 bp, Homo sapiens
gctgggctggaaggccaaggca

SEQ ID NO: 8568878 - DNA, 22 bp, Homo sapiens
gctggctttgtggtctctcctc

SEQ ID NO: 8568879 - DNA, 22 bp, Homo sapiens
gctggcttttgaagtctagcta

SEQ ID NO: 8568880 - DNA, 22 bp, Homo sapiens
gctggcttttgaagtctagcta

SEQ ID NO: 8568881 - DNA, 22 bp, Homo sapiens
gctgggcttcacagagccttta

SEQ ID NO: 8568882 - DNA, 23 bp, Homo sapiens
gctgggcttactctttcagtgag

SEQ ID NO: 8568883 - DNA, 22 bp, Homo sapiens
gctgggctgtagtttgctgacc

SEQ ID NO: 8568884 - DNA, 22 bp, Homo sapiens
gctgggctgtagtttgctgacc

SEQ ID NO: 8568885 - DNA, 22 bp, Homo sapiens
gctgggcttcacctccagagtt

SEQ ID NO: 8568886 - DNA, 22 bp, Homo sapiens
gctgggcttcacctccagagtt

SEQ ID NO: 8568887 - DNA, 22 bp, Homo sapiens
gctgggcttctcaatgctgcct

SEQ ID NO: 8568888 - DNA, 22 bp, Homo sapiens
gctggctgtgttccttctgcca

SEQ ID NO: 8568889 - DNA, 22 bp, Homo sapiens
gctggctgtgtttcatctctga

SEQ ID NO: 8568890 - DNA, 21 bp, Homo sapiens
gctggctggctgaccggcctt

SEQ ID NO: 8568891 - DNA, 21 bp, Homo sapiens
gctggctggctgaccggcctt

SEQ ID NO: 8568892 - DNA, 21 bp, Homo sapiens
gctggctggctgaccggcctt

SEQ ID NO: 8568893 - DNA, 21 bp, Homo sapiens
gctggctggctgaccggcctt

SEQ ID NO: 8568894 - DNA, 22 bp, Homo sapiens
gctggctgtgattttgccaaca

SEQ ID NO: 8568895 - DNA, 21 bp, Homo sapiens
gctggcttcctgagggctgag

SEQ ID NO: 8568896 - DNA, 21 bp, Homo sapiens
gctggcttcctgagggctgag

SEQ ID NO: 8568897 - DNA, 22 bp, Homo sapiens
gctggcttccctacctgcacct

SEQ ID NO: 8568898 - DNA, 22 bp, Homo sapiens
gctggcttccatcagagggtga

SEQ ID NO: 8568899 - DNA, 22 bp, Homo sapiens
gctggcttaatagggatgggct

SEQ ID NO: 8568900 - DNA, 22 bp, Homo sapiens
gctggctgttggaggtacctgc

SEQ ID NO: 8568901 - DNA, 22 bp, Homo sapiens
gctggctgttggaggtacctgc

SEQ ID NO: 8568902 - DNA, 22 bp, Homo sapiens
gctggctgttggaggtacctgc

SEQ ID NO: 8568903 - DNA, 22 bp, Homo sapiens
gctggcttgacagaggcctggg

SEQ ID NO: 8568904 - DNA, 22 bp, Homo sapiens
gctggcttgatagtttctgctt

SEQ ID NO: 8568905 - DNA, 22 bp, Homo sapiens
gctggcttgtcccaggacaaag

SEQ ID NO: 8568906 - DNA, 22 bp, Homo sapiens
gctggcttccttctgcagctag

SEQ ID NO: 8568907 - DNA, 22 bp, Homo sapiens
gctggcttccttctgcagctag

SEQ ID NO: 8568908 - DNA, 17 bp, Homo sapiens
gctggcttctccttgct

SEQ ID NO: 8568909 - DNA, 22 bp, Homo sapiens
gctggcttgacagaggcctggg

SEQ ID NO: 8568910 - DNA, 22 bp, Homo sapiens
gctggcttgacagaggcctggg

SEQ ID NO: 8568911 - DNA, 22 bp, Homo sapiens
gctgggcttggtttccctgctt

SEQ ID NO: 8568912 - DNA, 22 bp, Homo sapiens
gctgggcttggtttccctgctt

SEQ ID NO: 8568913 - DNA, 22 bp, Homo sapiens
gctggggaggcagcagagaaca

SEQ ID NO: 8568914 - DNA, 22 bp, Homo sapiens
gctggggaggcagcagagaaca

SEQ ID NO: 8568915 - DNA, 22 bp, Homo sapiens
gctggggagggcgtcaaggcca

SEQ ID NO: 8568916 - DNA, 22 bp, Homo sapiens
gctggggagggcgtcaaggcca

SEQ ID NO: 8568917 - DNA, 22 bp, Homo sapiens
gctggggaggcagcagagaaca

SEQ ID NO: 8568918 - DNA, 22 bp, Homo sapiens
gctggggcctgaacagtcagct

SEQ ID NO: 8568919 - DNA, 22 bp, Homo sapiens
gctggggcctctgtgaggttaa

SEQ ID NO: 8568920 - DNA, 22 bp, Homo sapiens
gctggggcctgaacagtcagct

SEQ ID NO: 8568921 - DNA, 19 bp, Homo sapiens
gctggggcctgaccagaca

SEQ ID NO: 8568922 - DNA, 19 bp, Homo sapiens
gctggggcctgaccagaca

SEQ ID NO: 8568923 - DNA, 19 bp, Homo sapiens
gctggggcctgaccagaca

SEQ ID NO: 8568924 - DNA, 22 bp, Homo sapiens
gctggggctgggctgaggaaga

SEQ ID NO: 8568925 - DNA, 22 bp, Homo sapiens
gctggggctgggctgaggaaga

SEQ ID NO: 8568926 - DNA, 22 bp, Homo sapiens
gctggggctgggctgaggaaga

SEQ ID NO: 8568927 - DNA, 22 bp, Homo sapiens
gctgtgctgattcattccctgc

SEQ ID NO: 8568928 - DNA, 22 bp, Homo sapiens
gctgtgctatatctctgagtgt

SEQ ID NO: 8568929 - DNA, 19 bp, Homo sapiens
gctgtgcctctctcctgct

SEQ ID NO: 8568930 - DNA, 22 bp, Homo sapiens
gctgtgctatatctctgagtgt

SEQ ID NO: 8568931 - DNA, 22 bp, Homo sapiens
gctgtggctgaagatgcaggga

SEQ ID NO: 8568932 - DNA, 22 bp, Homo sapiens
gctgtggctccaatggtgagcc

SEQ ID NO: 8568933 - DNA, 22 bp, Homo sapiens
gctgtggcggcagcagctggtg

SEQ ID NO: 8568934 - DNA, 22 bp, Homo sapiens
gctgtggctgaccaccaggggg

SEQ ID NO: 8568935 - DNA, 22 bp, Homo sapiens
gctgtggctgaccaccaggggg

SEQ ID NO: 8568936 - DNA, 22 bp, Homo sapiens
gctgtggctttctgtttctgtt

SEQ ID NO: 8568937 - DNA, 22 bp, Homo sapiens
gctgtggctttctgtttctgtt

SEQ ID NO: 8568938 - DNA, 22 bp, Homo sapiens
gctgtggtctgtgagctccaaa

SEQ ID NO: 8568939 - DNA, 22 bp, Homo sapiens
gcttctgtcttagctacctccc

SEQ ID NO: 8568940 - DNA, 22 bp, Homo sapiens
gcttctgtgagtgcagatgctg

SEQ ID NO: 8568941 - DNA, 22 bp, Homo sapiens
gcttctgtggattggctggctt

SEQ ID NO: 8568942 - DNA, 22 bp, Homo sapiens
gcttctgtgagtgcagatgctg

SEQ ID NO: 8568943 - DNA, 22 bp, Homo sapiens
gcttctgtggattggctggctt

SEQ ID NO: 8568944 - DNA, 22 bp, Homo sapiens
gcttctgtggattggctggctt

SEQ ID NO: 8568945 - DNA, 22 bp, Homo sapiens
gcttctgtggtgaggtcacctt

SEQ ID NO: 8568946 - DNA, 22 bp, Homo sapiens
gcttctgtggtgaggtcacctt

SEQ ID NO: 8568947 - DNA, 22 bp, Homo sapiens
gcttctgtcttagctacctccc

SEQ ID NO: 8568948 - DNA, 22 bp, Homo sapiens
gcttctgtatttattgtccttt

SEQ ID NO: 8568949 - DNA, 22 bp, Homo sapiens
gcttctgtcttagctacctccc

SEQ ID NO: 8568950 - DNA, 22 bp, Homo sapiens
gcttctgtatttattgtccttt

SEQ ID NO: 8568951 - DNA, 21 bp, Homo sapiens
gcttctgtatctagcaggaac

SEQ ID NO: 8568952 - DNA, 21 bp, Homo sapiens
gcttctgtatctagcaggaac

SEQ ID NO: 8568953 - DNA, 22 bp, Homo sapiens
gcttctgtggtgcatctttgct

SEQ ID NO: 8568954 - DNA, 22 bp, Homo sapiens
gcttctgtggtgcatctttgct

SEQ ID NO: 8568955 - DNA, 22 bp, Homo sapiens
gcttctgtggttgtcacgacta

SEQ ID NO: 8568956 - DNA, 22 bp, Homo sapiens
gcttctgtggttgtcacgacta

SEQ ID NO: 8568957 - DNA, 22 bp, Homo sapiens
gcttctgttaacttatgttccc

SEQ ID NO: 8568958 - DNA, 22 bp, Homo sapiens
gcttctgttaacttatgttccc

SEQ ID NO: 8568959 - DNA, 19 bp, Homo sapiens
gcttctgtttgggcttaga

SEQ ID NO: 8568960 - DNA, 22 bp, Homo sapiens
gcttctgttcaaggatataagg

SEQ ID NO: 8568961 - DNA, 22 bp, Homo sapiens
gcttctgttcaaggatataagg

SEQ ID NO: 8568962 - DNA, 22 bp, Homo sapiens
gcttctttccttgggctggaac

SEQ ID NO: 8568963 - DNA, 19 bp, Homo sapiens
gcttctgtttgggcttaga

SEQ ID NO: 8568964 - DNA, 19 bp, Homo sapiens
gcttctgtttgggcttaga

SEQ ID NO: 8568965 - DNA, 22 bp, Homo sapiens
gctgtgtcctcacacagccttt

SEQ ID NO: 8568966 - DNA, 22 bp, Homo sapiens
gctgtgtgaaaactgggcctgg

SEQ ID NO: 8568967 - DNA, 22 bp, Homo sapiens
gctgtgtgaaaactgggcctgg

SEQ ID NO: 8568968 - DNA, 22 bp, Homo sapiens
gctgtgtgaaaactgggcctgg

SEQ ID NO: 8568969 - DNA, 22 bp, Homo sapiens
gctgtgtgaccctagccagtag

SEQ ID NO: 8568970 - DNA, 22 bp, Homo sapiens
gctgtgtgaccctagccagtag

SEQ ID NO: 8568971 - DNA, 22 bp, Homo sapiens
gcttctggtgaggcctcaggaa

SEQ ID NO: 8568972 - DNA, 21 bp, Homo sapiens
gcttctgtatctagcaggaac

SEQ ID NO: 8568973 - DNA, 20 bp, Homo sapiens
gctgtgtagcagtgtgcagt

SEQ ID NO: 8568974 - DNA, 22 bp, Homo sapiens
gctgtgtacctactaactgctt

SEQ ID NO: 8568975 - DNA, 22 bp, Homo sapiens
gctgtgtaggatcctgttgtat

SEQ ID NO: 8568976 - DNA, 22 bp, Homo sapiens
gctgtgtatcagatgccacggg

SEQ ID NO: 8568977 - DNA, 22 bp, Homo sapiens
gctgtgtatcagatgccacggg

SEQ ID NO: 8568978 - DNA, 22 bp, Homo sapiens
gctgtgtcagaaactctgggga

SEQ ID NO: 8568979 - DNA, 22 bp, Homo sapiens
gctgtgtccaggtgggggtgac

SEQ ID NO: 8568980 - DNA, 22 bp, Homo sapiens
gctgtgtcctcacacagccttt

SEQ ID NO: 8568981 - DNA, 22 bp, Homo sapiens
gcttctttggcaaccctgacat

SEQ ID NO: 8568982 - DNA, 20 bp, Homo sapiens
gcttcttttctggcccatga

SEQ ID NO: 8568983 - DNA, 20 bp, Homo sapiens
gcttcttttctggcccatga

SEQ ID NO: 8568984 - DNA, 22 bp, Homo sapiens
gcttgagaacttcaactcagtg

SEQ ID NO: 8568985 - DNA, 22 bp, Homo sapiens
gcttgagttttgggacaaagcc

SEQ ID NO: 8568986 - DNA, 22 bp, Homo sapiens
gcttgcctatctggtggtcgtt

SEQ ID NO: 8568987 - DNA, 22 bp, Homo sapiens
gcttgcctggcatttctggggc

SEQ ID NO: 8568988 - DNA, 23 bp, Homo sapiens
gcttgcctggtgtgtggctgacc

SEQ ID NO: 8568989 - DNA, 22 bp, Homo sapiens
gcttgctcaacccccgtctctc

SEQ ID NO: 8568990 - DNA, 21 bp, Homo sapiens
gcttgccttcctatctttggc

SEQ ID NO: 8568991 - DNA, 17 bp, Homo sapiens
gcttgccttgtcttcct

SEQ ID NO: 8568992 - DNA, 22 bp, Homo sapiens
gcttgcatgattggagtgggtg

SEQ ID NO: 8568993 - DNA, 20 bp, Homo sapiens
gcttgctttgtctgatgggc

SEQ ID NO: 8568994 - DNA, 19 bp, Homo sapiens
gcttgctttatgaaggggg

SEQ ID NO: 8568995 - DNA, 22 bp, Homo sapiens
gcttgctttgtaaatatctgtg

SEQ ID NO: 8568996 - DNA, 20 bp, Homo sapiens
gcttgctttgtctgatgggc

SEQ ID NO: 8568997 - DNA, 22 bp, Homo sapiens
gcttgctggtgcctgcaggctc

SEQ ID NO: 8568998 - DNA, 18 bp, Homo sapiens
gctttatttcttggggaa

SEQ ID NO: 8568999 - DNA, 22 bp, Homo sapiens
gcttggaagtaggattgggaga

SEQ ID NO: 8569000 - DNA, 22 bp, Homo sapiens
gctttatgtaagtccaaaggca

SEQ ID NO: 8569001 - DNA, 22 bp, Homo sapiens
ggaagatgagaagtggggctcc

SEQ ID NO: 8569002 - DNA, 22 bp, Homo sapiens
ggaagatgagaagtggggctcc

SEQ ID NO: 8569003 - DNA, 22 bp, Homo sapiens
ggaagatgcccaacccagcttt

SEQ ID NO: 8569004 - DNA, 22 bp, Homo sapiens
ggaagaggctggtagtgcccgt

SEQ ID NO: 8569005 - DNA, 22 bp, Homo sapiens
ggaagagggaaccacgactgta

SEQ ID NO: 8569006 - DNA, 22 bp, Homo sapiens
ggaagagggaaccacgactgta

SEQ ID NO: 8569007 - DNA, 22 bp, Homo sapiens
ggaagagtaacaggaggtggaa

SEQ ID NO: 8569008 - DNA, 22 bp, Homo sapiens
ggaagcagcctgaagccaaggg

SEQ ID NO: 8569009 - DNA, 22 bp, Homo sapiens
ggaagcagcctgaagccaaggg

SEQ ID NO: 8569010 - DNA, 22 bp, Homo sapiens
ggaagcactgaggcagagaggg

SEQ ID NO: 8569011 - DNA, 22 bp, Homo sapiens
ggaatcagagcagaggctgtta

SEQ ID NO: 8569012 - DNA, 22 bp, Homo sapiens
ggaatcagatgaggggcagagc

SEQ ID NO: 8569013 - DNA, 22 bp, Homo sapiens
ggaatgctcagttcttggtgct

SEQ ID NO: 8569014 - DNA, 22 bp, Homo sapiens
ggaatgttgtcatttacattat

SEQ ID NO: 8569015 - DNA, 22 bp, Homo sapiens
ggaatgtagaatctctggtctc

SEQ ID NO: 8569016 - DNA, 22 bp, Homo sapiens
ggaatgggagctattagtggaa

SEQ ID NO: 8569017 - DNA, 22 bp, Homo sapiens
ggaatgctcagttcttggtgct

SEQ ID NO: 8569018 - DNA, 22 bp, Homo sapiens
ggacacagccacttagggtacc

SEQ ID NO: 8569019 - DNA, 18 bp, Homo sapiens
ggacacagataggtacag

SEQ ID NO: 8569020 - DNA, 22 bp, Homo sapiens
ggaattggtttcaagggaaagt

SEQ ID NO: 8569021 - DNA, 22 bp, Homo sapiens
ggaattgtctagtactcacggc

SEQ ID NO: 8569022 - DNA, 22 bp, Homo sapiens
ggaattctctatgctctgttcc

SEQ ID NO: 8569023 - DNA, 22 bp, Homo sapiens
ggaattctgcatgttcagttgg

SEQ ID NO: 8569024 - DNA, 22 bp, Homo sapiens
ggaattctgtagctcttcctct

SEQ ID NO: 8569025 - DNA, 22 bp, Homo sapiens
ggaagaggaggagccaggcttt

SEQ ID NO: 8569026 - DNA, 22 bp, Homo sapiens
ggaagacagaagcctacagctt

SEQ ID NO: 8569027 - DNA, 22 bp, Homo sapiens
ggaagacagaagcctacagctt

SEQ ID NO: 8569028 - DNA, 22 bp, Homo sapiens
ggaagacaagcagtggctgagc

SEQ ID NO: 8569029 - DNA, 22 bp, Homo sapiens
ggaagaagggtcattggcagcc

SEQ ID NO: 8569030 - DNA, 22 bp, Homo sapiens
ggaagacaagcagtggctgagc

SEQ ID NO: 8569031 - DNA, 22 bp, Homo sapiens
ggaagaagggtcattggcagcc

SEQ ID NO: 8569032 - DNA, 22 bp, Homo sapiens
ggaagacagaagcctacagctt

SEQ ID NO: 8569033 - DNA, 22 bp, Homo sapiens
ggaagacaagcagtggctgagc

SEQ ID NO: 8569034 - DNA, 17 bp, Homo sapiens
gctttggaagggtagac

SEQ ID NO: 8569035 - DNA, 19 bp, Homo sapiens
gctttggagggaggttcta

SEQ ID NO: 8569036 - DNA, 22 bp, Homo sapiens
gctttggagcctgtgttctgcc

SEQ ID NO: 8569037 - DNA, 22 bp, Homo sapiens
ggaagaagcagggcatttgaat

SEQ ID NO: 8569038 - DNA, 22 bp, Homo sapiens
ggaagaagcagggcatttgaat

SEQ ID NO: 8569039 - DNA, 22 bp, Homo sapiens
ggaagaggctctcattgagggc

SEQ ID NO: 8569040 - DNA, 22 bp, Homo sapiens
ggaagaggctgagccaggtccc

SEQ ID NO: 8569041 - DNA, 22 bp, Homo sapiens
ggaagaggctctcattgagggc

SEQ ID NO: 8569042 - DNA, 22 bp, Homo sapiens
ggaagaggctctcattgagggc

SEQ ID NO: 8569043 - DNA, 22 bp, Homo sapiens
ggaagaggctgaggccatgctg

SEQ ID NO: 8569044 - DNA, 22 bp, Homo sapiens
ggaagaggctgagccaggtccc

SEQ ID NO: 8569045 - DNA, 22 bp, Homo sapiens
ggaagaggctgaggccatgctg

SEQ ID NO: 8569046 - DNA, 22 bp, Homo sapiens
gctttctgaagcagtgtttctc

SEQ ID NO: 8569047 - DNA, 22 bp, Homo sapiens
gctttctgatgagcttaagaaa

SEQ ID NO: 8569048 - DNA, 22 bp, Homo sapiens
gctttctcttcactgatgttca

SEQ ID NO: 8569049 - DNA, 20 bp, Homo sapiens
gctttctatgagatggactg

SEQ ID NO: 8569050 - DNA, 22 bp, Homo sapiens
gctttctgattgcgaaaacaaa

SEQ ID NO: 8569051 - DNA, 22 bp, Homo sapiens
gctttctgattgcgaaaacaaa

SEQ ID NO: 8569052 - DNA, 22 bp, Homo sapiens
gctttctgcctgggctccattt

SEQ ID NO: 8569053 - DNA, 22 bp, Homo sapiens
gctttctgcctgggctccattt

SEQ ID NO: 8569054 - DNA, 22 bp, Homo sapiens
gctttgctggcttgaaatgctg

SEQ ID NO: 8569055 - DNA, 22 bp, Homo sapiens
gctttggaaggggctggtggag

SEQ ID NO: 8569056 - DNA, 22 bp, Homo sapiens
gctttgcttcctgttctagcct

SEQ ID NO: 8569057 - DNA, 22 bp, Homo sapiens
gctttcctggccctgtccctgc

SEQ ID NO: 8569058 - DNA, 21 bp, Homo sapiens
gctttcagaagtctcatagtt

SEQ ID NO: 8569059 - DNA, 22 bp, Homo sapiens
gctttcctggccctgtccctgc

SEQ ID NO: 8569060 - DNA, 17 bp, Homo sapiens
gctttccttgcccctcc

SEQ ID NO: 8569061 - DNA, 22 bp, Homo sapiens
gctttattttgtgagggattac

SEQ ID NO: 8569062 - DNA, 22 bp, Homo sapiens
ggagagagacctccatgcccag

SEQ ID NO: 8569063 - DNA, 22 bp, Homo sapiens
ggagcagatgtcttcatggcct

SEQ ID NO: 8569064 - DNA, 22 bp, Homo sapiens
ggagcagatgtcttcatggcct

SEQ ID NO: 8569065 - DNA, 22 bp, Homo sapiens
ggagcagcactgattagcggtt

SEQ ID NO: 8569066 - DNA, 22 bp, Homo sapiens
ggagcagcactgccacacagag

SEQ ID NO: 8569067 - DNA, 22 bp, Homo sapiens
ggagcagcactgccacacagag

SEQ ID NO: 8569068 - DNA, 22 bp, Homo sapiens
ggagcaggctctgtggtttcca

SEQ ID NO: 8569069 - DNA, 22 bp, Homo sapiens
ggagcaggctctgtggtttcca

SEQ ID NO: 8569070 - DNA, 22 bp, Homo sapiens
ggagcagggcagtgaattctgg

SEQ ID NO: 8569071 - DNA, 22 bp, Homo sapiens
ggagcatgcgctctgtgaccga

SEQ ID NO: 8569072 - DNA, 22 bp, Homo sapiens
ggagcatctgaacagggagaag

SEQ ID NO: 8569073 - DNA, 22 bp, Homo sapiens
ggagccagaaatgctgtggttg

SEQ ID NO: 8569074 - DNA, 22 bp, Homo sapiens
ggagccagaaatgctgtggttg

SEQ ID NO: 8569075 - DNA, 22 bp, Homo sapiens
ggagccagagcactggggagcc

SEQ ID NO: 8569076 - DNA, 22 bp, Homo sapiens
ggagccagagcactggggagcc

SEQ ID NO: 8569077 - DNA, 22 bp, Homo sapiens
ggagcatgtggggtgagcaggg

SEQ ID NO: 8569078 - DNA, 22 bp, Homo sapiens
ggagcatgtggggtgagcaggg

SEQ ID NO: 8569079 - DNA, 22 bp, Homo sapiens
ggagactgatctgagtgataac

SEQ ID NO: 8569080 - DNA, 19 bp, Homo sapiens
ggagactcagcccatgcct

SEQ ID NO: 8569081 - DNA, 22 bp, Homo sapiens
ggagactacctagcaggctgtt

SEQ ID NO: 8569082 - DNA, 22 bp, Homo sapiens
ggagaccagaaggaagcttcga

SEQ ID NO: 8569083 - DNA, 22 bp, Homo sapiens
ggagacagtggtagggcctaag

SEQ ID NO: 8569084 - DNA, 22 bp, Homo sapiens
ggagacagtggtagggcctaag

SEQ ID NO: 8569085 - DNA, 22 bp, Homo sapiens
ggagacagtggtagggcctaag

SEQ ID NO: 8569086 - DNA, 22 bp, Homo sapiens
ggagacagtggtagggcctaag

SEQ ID NO: 8569087 - DNA, 22 bp, Homo sapiens
ggagacagtgacttagagactg

SEQ ID NO: 8569088 - DNA, 22 bp, Homo sapiens
ggagacagtgacttagagactg

SEQ ID NO: 8569089 - DNA, 22 bp, Homo sapiens
ggagacagtgacttagagactg

SEQ ID NO: 8569090 - DNA, 22 bp, Homo sapiens
ggagacagtgacttagagactg

SEQ ID NO: 8569091 - DNA, 22 bp, Homo sapiens
ggagagaaattgaggtagcaag

SEQ ID NO: 8569092 - DNA, 22 bp, Homo sapiens
ggagagaactgacctgaaagga

SEQ ID NO: 8569093 - DNA, 22 bp, Homo sapiens
ggagagaaattgaggtagcaag

SEQ ID NO: 8569094 - DNA, 19 bp, Homo sapiens
ggaccaggtcctgggcagc

SEQ ID NO: 8569095 - DNA, 20 bp, Homo sapiens
ggaccaggtggggcggtggc

SEQ ID NO: 8569096 - DNA, 20 bp, Homo sapiens
ggaccaggtggggcggtggc

SEQ ID NO: 8569097 - DNA, 20 bp, Homo sapiens
ggaccaggtggggcggtggc

SEQ ID NO: 8569098 - DNA, 22 bp, Homo sapiens
ggagacagggttgaaccacgca

SEQ ID NO: 8569099 - DNA, 22 bp, Homo sapiens
ggagacagggttgaaccacgca

SEQ ID NO: 8569100 - DNA, 22 bp, Homo sapiens
ggaccatctctagccagagctt

SEQ ID NO: 8569101 - DNA, 22 bp, Homo sapiens
ggagacagtatggcttgtagct

SEQ ID NO: 8569102 - DNA, 22 bp, Homo sapiens
ggagacagtatggcttgtagct

SEQ ID NO: 8569103 - DNA, 22 bp, Homo sapiens
ggagacagtatggcttgtagct

SEQ ID NO: 8569104 - DNA, 22 bp, Homo sapiens
ggaccaggctgagcacctgcct

SEQ ID NO: 8569105 - DNA, 22 bp, Homo sapiens
ggaccaggccagcctccctgcg

SEQ ID NO: 8569106 - DNA, 22 bp, Homo sapiens
ggaccaggcaagctgaggcggg

SEQ ID NO: 8569107 - DNA, 19 bp, Homo sapiens
ggaccagctttcaggaggc

SEQ ID NO: 8569108 - DNA, 22 bp, Homo sapiens
ggaccaggagctcagagccctc

SEQ ID NO: 8569109 - DNA, 22 bp, Homo sapiens
ggaccaggagctcagagccctc

SEQ ID NO: 8569110 - DNA, 22 bp, Homo sapiens
ggacatgaagcaaaatgggagg

SEQ ID NO: 8569111 - DNA, 18 bp, Homo sapiens
ggacatcatcaggtgctt

SEQ ID NO: 8569112 - DNA, 19 bp, Homo sapiens
ggacatcactctaagcctt

SEQ ID NO: 8569113 - DNA, 22 bp, Homo sapiens
ggacatggaaatcggcttgctc

SEQ ID NO: 8569114 - DNA, 20 bp, Homo sapiens
ggaccagctgtctgaggggc

SEQ ID NO: 8569115 - DNA, 22 bp, Homo sapiens
ggacatggaagtatggagtgga

SEQ ID NO: 8569116 - DNA, 22 bp, Homo sapiens
ggacatgatatttcaggaagac

SEQ ID NO: 8569117 - DNA, 22 bp, Homo sapiens
ggacagggtaagtactagtgtg

SEQ ID NO: 8569118 - DNA, 22 bp, Homo sapiens
ggacacagtggaagacagcttg

SEQ ID NO: 8569119 - DNA, 22 bp, Homo sapiens
ggacagggtaagtactagtgtg

SEQ ID NO: 8569120 - DNA, 22 bp, Homo sapiens
ggacagggtaagtactagtgtg

SEQ ID NO: 8569121 - DNA, 22 bp, Homo sapiens
ggacagggttggggcatataaa

SEQ ID NO: 8569122 - DNA, 22 bp, Homo sapiens
ggacacagctgcagccacaccc

SEQ ID NO: 8569123 - DNA, 20 bp, Homo sapiens
ggacagtgagacatatctca

SEQ ID NO: 8569124 - DNA, 22 bp, Homo sapiens
ggacagtgaatgtggggatgca

SEQ ID NO: 8569125 - DNA, 22 bp, Homo sapiens
ggacagtgcgagacacagtaac

SEQ ID NO: 8569126 - DNA, 22 bp, Homo sapiens
ggacatagaggccctgcatggc

SEQ ID NO: 8569127 - DNA, 22 bp, Homo sapiens
ggacaggtgactgcccagagtg

SEQ ID NO: 8569128 - DNA, 22 bp, Homo sapiens
ggacaggtgactgcccagagtg

SEQ ID NO: 8569129 - DNA, 22 bp, Homo sapiens
ggacaggtgtgaggctggcaca

SEQ ID NO: 8569130 - DNA, 22 bp, Homo sapiens
ggacaggtgcaaagggcacatg

SEQ ID NO: 8569131 - DNA, 22 bp, Homo sapiens
gccagcctgtgcttggccaggc

SEQ ID NO: 8569132 - DNA, 22 bp, Homo sapiens
gccagcctgtgggggctctgtg

SEQ ID NO: 8569133 - DNA, 22 bp, Homo sapiens
gccagcctgtgcttggccaggc

SEQ ID NO: 8569134 - DNA, 22 bp, Homo sapiens
gccagcctgtgcttggccaggc

SEQ ID NO: 8569135 - DNA, 22 bp, Homo sapiens
gccagcctgtgcttggccaggc

SEQ ID NO: 8569136 - DNA, 22 bp, Homo sapiens
gccagcctgtgggggctctgtg

SEQ ID NO: 8569137 - DNA, 22 bp, Homo sapiens
gccagcctgtgggggctctgtg

SEQ ID NO: 8569138 - DNA, 21 bp, Homo sapiens
gccagcctgtttacctgtggt

SEQ ID NO: 8569139 - DNA, 21 bp, Homo sapiens
gccagcctgtttacctgtggt

SEQ ID NO: 8569140 - DNA, 23 bp, Homo sapiens
gccagccttgctctcctgcagcc

SEQ ID NO: 8569141 - DNA, 23 bp, Homo sapiens
gccagccttgctctcctgcagcc

SEQ ID NO: 8569142 - DNA, 23 bp, Homo sapiens
gccagccttgctctcctgcagcc

SEQ ID NO: 8569143 - DNA, 23 bp, Homo sapiens
gccagccttgctctcctgcagcc

SEQ ID NO: 8569144 - DNA, 21 bp, Homo sapiens
gccagcctgtttacctgtggt

SEQ ID NO: 8569145 - DNA, 22 bp, Homo sapiens
gccagccttctgtggcctgcaa

SEQ ID NO: 8569146 - DNA, 22 bp, Homo sapiens
gccagccttctgtggcctgcaa

SEQ ID NO: 8569147 - DNA, 22 bp, Homo sapiens
gccagccttctgtggcctgcaa

SEQ ID NO: 8569148 - DNA, 20 bp, Homo sapiens
gccagccctgacacaggagc

SEQ ID NO: 8569149 - DNA, 22 bp, Homo sapiens
gccaccatgtctggctgagttt

SEQ ID NO: 8569150 - DNA, 22 bp, Homo sapiens
gccaccatgtctggctgagttt

SEQ ID NO: 8569151 - DNA, 22 bp, Homo sapiens
gccacccccaagtaggtggtct

SEQ ID NO: 8569152 - DNA, 21 bp, Homo sapiens
gccacccctggcacaggtgct

SEQ ID NO: 8569153 - DNA, 22 bp, Homo sapiens
gccagctgaatttccaactgtt

SEQ ID NO: 8569154 - DNA, 22 bp, Homo sapiens
gccagctgacaccttgattttg

SEQ ID NO: 8569155 - DNA, 22 bp, Homo sapiens
gccagctgaagggaagctcctg

SEQ ID NO: 8569156 - DNA, 22 bp, Homo sapiens
gccagctgaagccctggtggaa

SEQ ID NO: 8569157 - DNA, 22 bp, Homo sapiens
gccagctgaaatttcagttctg

SEQ ID NO: 8569158 - DNA, 22 bp, Homo sapiens
gccagctgaaatttcagttctg

SEQ ID NO: 8569159 - DNA, 22 bp, Homo sapiens
gccaggcactgctctaagccct

SEQ ID NO: 8569160 - DNA, 22 bp, Homo sapiens
gccaggcagacaggtcatcagg

SEQ ID NO: 8569161 - DNA, 20 bp, Homo sapiens
gccaggcactgttctcaata

SEQ ID NO: 8569162 - DNA, 22 bp, Homo sapiens
gccagctcagtgccaggcccct

SEQ ID NO: 8569163 - DNA, 22 bp, Homo sapiens
gccagctcagtgccaggcccct

SEQ ID NO: 8569164 - DNA, 22 bp, Homo sapiens
gccagctcagtgccaggcccct

SEQ ID NO: 8569165 - DNA, 22 bp, Homo sapiens
gccagctcagtttcaaagtagg

SEQ ID NO: 8569166 - DNA, 22 bp, Homo sapiens
gccagctcagatgcaggaagga

SEQ ID NO: 8569167 - DNA, 22 bp, Homo sapiens
gccagctcagatgcaggaagga

SEQ ID NO: 8569168 - DNA, 22 bp, Homo sapiens
gccagctcagatgcaggaagga

SEQ ID NO: 8569169 - DNA, 22 bp, Homo sapiens
gccagctctgtggctgtacttg

SEQ ID NO: 8569170 - DNA, 22 bp, Homo sapiens
gccagctccgcaggatggcgcg

SEQ ID NO: 8569171 - DNA, 22 bp, Homo sapiens
gccagctctcattgtataggct

SEQ ID NO: 8569172 - DNA, 22 bp, Homo sapiens
gccagctctgtggctgtacttg

SEQ ID NO: 8569173 - DNA, 22 bp, Homo sapiens
gccagctctgtggctgtacttg

SEQ ID NO: 8569174 - DNA, 22 bp, Homo sapiens
gccagctcttgatgggtgggta

SEQ ID NO: 8569175 - DNA, 22 bp, Homo sapiens
gccagctcttgatgggtgggta

SEQ ID NO: 8569176 - DNA, 22 bp, Homo sapiens
gccagctcccaagtgagcccct

SEQ ID NO: 8569177 - DNA, 22 bp, Homo sapiens
gccagctcccaagtgagcccct

SEQ ID NO: 8569178 - DNA, 22 bp, Homo sapiens
gccagctcccaagtgagcccct

SEQ ID NO: 8569179 - DNA, 22 bp, Homo sapiens
gccagctcccaagtgagcccct

SEQ ID NO: 8569180 - DNA, 22 bp, Homo sapiens
gccagctccgcaggatggcgcg

SEQ ID NO: 8569181 - DNA, 21 bp, Homo sapiens
gccagggagttaaagagtctt

SEQ ID NO: 8569182 - DNA, 22 bp, Homo sapiens
gccagggcaggggagcatctgc

SEQ ID NO: 8569183 - DNA, 22 bp, Homo sapiens
gccagggcaggggagcatctgc

SEQ ID NO: 8569184 - DNA, 22 bp, Homo sapiens
gccagggagtctgggccacaga

SEQ ID NO: 8569185 - DNA, 22 bp, Homo sapiens
gccagggaggctgtagggtcct

SEQ ID NO: 8569186 - DNA, 22 bp, Homo sapiens
gccagggctcgcggtccctcgt

SEQ ID NO: 8569187 - DNA, 22 bp, Homo sapiens
gccagggctcgcggtccctcgt

SEQ ID NO: 8569188 - DNA, 22 bp, Homo sapiens
gccagggcaggggagcatctgc

SEQ ID NO: 8569189 - DNA, 22 bp, Homo sapiens
gccagggctcgcggtccctcgt

SEQ ID NO: 8569190 - DNA, 22 bp, Homo sapiens
gccagggctcgcggtccctcgt

SEQ ID NO: 8569191 - DNA, 22 bp, Homo sapiens
gccagggctcgcggtccctcgt

SEQ ID NO: 8569192 - DNA, 22 bp, Homo sapiens
gccagggctgtgcaggtttgtt

SEQ ID NO: 8569193 - DNA, 22 bp, Homo sapiens
gccagggctgtgcaggtttgtt

SEQ ID NO: 8569194 - DNA, 22 bp, Homo sapiens
gccagggctgtgcaggtttgtt

SEQ ID NO: 8569195 - DNA, 22 bp, Homo sapiens
gccagggaacccaagggcctca

SEQ ID NO: 8569196 - DNA, 22 bp, Homo sapiens
gccagggaacccaagggcctca

SEQ ID NO: 8569197 - DNA, 21 bp, Homo sapiens
gccagggaagagagttggctg

SEQ ID NO: 8569198 - DNA, 17 bp, Homo sapiens
gccagggagaggaagcc

SEQ ID NO: 8569199 - DNA, 22 bp, Homo sapiens
gccagggaggctgtagggtcct

SEQ ID NO: 8569200 - DNA, 22 bp, Homo sapiens
gccagggaggctgtagggtcct

SEQ ID NO: 8569201 - DNA, 22 bp, Homo sapiens
gccagggaacccaagggcctca

SEQ ID NO: 8569202 - DNA, 22 bp, Homo sapiens
gccaggcaggccacgctgtgtt

SEQ ID NO: 8569203 - DNA, 22 bp, Homo sapiens
gccaggcagctgggagggtgcc

SEQ ID NO: 8569204 - DNA, 22 bp, Homo sapiens
gccaggcagccaccctctgcga

SEQ ID NO: 8569205 - DNA, 22 bp, Homo sapiens
gccaggcagctagcaacccctg

SEQ ID NO: 8569206 - DNA, 22 bp, Homo sapiens
gccaggcaggtgtcggagccct

SEQ ID NO: 8569207 - DNA, 18 bp, Homo sapiens
gccaggcagggtggggaa

SEQ ID NO: 8569208 - DNA, 22 bp, Homo sapiens
gccaggcagcagcgaggatggt

SEQ ID NO: 8569209 - DNA, 22 bp, Homo sapiens
gccaggcagcagcgaggatggt

SEQ ID NO: 8569210 - DNA, 22 bp, Homo sapiens
gccaggcagcaggaagccagtg

SEQ ID NO: 8569211 - DNA, 22 bp, Homo sapiens
gccaggcagccaccctctgcga

SEQ ID NO: 8569212 - DNA, 22 bp, Homo sapiens
gccaggcagccaccctctgcga

SEQ ID NO: 8569213 - DNA, 22 bp, Homo sapiens
gccaggcagcaggaagccagtg

SEQ ID NO: 8569214 - DNA, 22 bp, Homo sapiens
gccaggcagatatgtgagctta

SEQ ID NO: 8569215 - DNA, 22 bp, Homo sapiens
gccaggcagatatgtgagctta

SEQ ID NO: 8569216 - DNA, 22 bp, Homo sapiens
gccaggcagatatgtgagctta

SEQ ID NO: 8569217 - DNA, 22 bp, Homo sapiens
gccaggcagatatgtgagctta

SEQ ID NO: 8569218 - DNA, 22 bp, Homo sapiens
gccaggcagagccccgtgcagc

SEQ ID NO: 8569219 - DNA, 22 bp, Homo sapiens
gccacaggcttaggagggaggt

SEQ ID NO: 8569220 - DNA, 22 bp, Homo sapiens
gccacaggcttaggagggaggt

SEQ ID NO: 8569221 - DNA, 22 bp, Homo sapiens
gccacaggcttaggagggaggt

SEQ ID NO: 8569222 - DNA, 22 bp, Homo sapiens
gcatggcttccaaaagtgctaa

SEQ ID NO: 8569223 - DNA, 22 bp, Homo sapiens
gccacatagaggaggatattaa

SEQ ID NO: 8569224 - DNA, 22 bp, Homo sapiens
gccacagggaggcgttttcagg

SEQ ID NO: 8569225 - DNA, 22 bp, Homo sapiens
gccacaggcttaggagggaggt

SEQ ID NO: 8569226 - DNA, 22 bp, Homo sapiens
gccacatgcaattgcagcacgt

SEQ ID NO: 8569227 - DNA, 22 bp, Homo sapiens
gccacatgtcatgtgctcagta

SEQ ID NO: 8569228 - DNA, 22 bp, Homo sapiens
gccaccagggggtgcaaggtcc

SEQ ID NO: 8569229 - DNA, 22 bp, Homo sapiens
gccaccaggttagatccagcct

SEQ ID NO: 8569230 - DNA, 22 bp, Homo sapiens
gccaccaggttagatccagcct

SEQ ID NO: 8569231 - DNA, 22 bp, Homo sapiens
gccaccaggttctgggttaagc

SEQ ID NO: 8569232 - DNA, 22 bp, Homo sapiens
gccaccagtgggggcctgggca

SEQ ID NO: 8569233 - DNA, 22 bp, Homo sapiens
gccaccagtgggggcctgggca

SEQ ID NO: 8569234 - DNA, 22 bp, Homo sapiens
gccaccagccccatgcgctgtg

SEQ ID NO: 8569235 - DNA, 22 bp, Homo sapiens
gccaccaggagcccagtccaaa

SEQ ID NO: 8569236 - DNA, 22 bp, Homo sapiens
gccaccaggagcccagtccaaa

SEQ ID NO: 8569237 - DNA, 22 bp, Homo sapiens
gccaccaggagcccagtccaaa

SEQ ID NO: 8569238 - DNA, 22 bp, Homo sapiens
gccaccaggagcccagtccaaa

SEQ ID NO: 8569239 - DNA, 22 bp, Homo sapiens
gccaccagggggctccagtgag

SEQ ID NO: 8569240 - DNA, 22 bp, Homo sapiens
gccaccagggggctccagtgag

SEQ ID NO: 8569241 - DNA, 22 bp, Homo sapiens
gccaccagggggctccagtgag

SEQ ID NO: 8569242 - DNA, 22 bp, Homo sapiens
gcatggctcctgtcttactccc

SEQ ID NO: 8569243 - DNA, 22 bp, Homo sapiens
gcatggctattctaactcacat

SEQ ID NO: 8569244 - DNA, 22 bp, Homo sapiens
gcatggcttacagaggctgcag

SEQ ID NO: 8569245 - DNA, 22 bp, Homo sapiens
gcatggctgttgaagtcagctc

SEQ ID NO: 8569246 - DNA, 20 bp, Homo sapiens
gcatggctaatctgtactga

SEQ ID NO: 8569247 - DNA, 22 bp, Homo sapiens
gcatgcagtaaaattcagcaac

SEQ ID NO: 8569248 - DNA, 22 bp, Homo sapiens
gcatgcagtaaaattcagcaac

SEQ ID NO: 8569249 - DNA, 22 bp, Homo sapiens
gcatgcagtaaaattcagcaac

SEQ ID NO: 8569250 - DNA, 22 bp, Homo sapiens
gcatgcatctagatatgcagac

SEQ ID NO: 8569251 - DNA, 22 bp, Homo sapiens
gcatgcagtgcaattcaatgta

SEQ ID NO: 8569252 - DNA, 22 bp, Homo sapiens
gcatgcagtcaaccagtaaggg

SEQ ID NO: 8569253 - DNA, 22 bp, Homo sapiens
gcatgcattacatgggatatgc

SEQ ID NO: 8569254 - DNA, 22 bp, Homo sapiens
gcatgcatttcactaggtatgt

SEQ ID NO: 8569255 - DNA, 22 bp, Homo sapiens
gcatgcatttccattctcacat

SEQ ID NO: 8569256 - DNA, 22 bp, Homo sapiens
gcatgcatggtttgtgactgtg

SEQ ID NO: 8569257 - DNA, 22 bp, Homo sapiens
gcatgcatgtgtgcagacagtc

SEQ ID NO: 8569258 - DNA, 22 bp, Homo sapiens
gcatgcatgatgttggcagtgg

SEQ ID NO: 8569259 - DNA, 22 bp, Homo sapiens
gcatgcatttgtacttgatttt

SEQ ID NO: 8569260 - DNA, 22 bp, Homo sapiens
gcatgcattttctgagagtcag

SEQ ID NO: 8569261 - DNA, 22 bp, Homo sapiens
gcatgctgcaccagagcctctc

SEQ ID NO: 8569262 - DNA, 22 bp, Homo sapiens
gcatgctgcaccagagcctctc

SEQ ID NO: 8569263 - DNA, 22 bp, Homo sapiens
gcatgcagacagtctgagacca

SEQ ID NO: 8569264 - DNA, 22 bp, Homo sapiens
gcatgcagaaaatgaacaacga

SEQ ID NO: 8569265 - DNA, 22 bp, Homo sapiens
gcagtgggagcttaggcagtgc

SEQ ID NO: 8569266 - DNA, 22 bp, Homo sapiens
gcatgcagacagtctgagacca

SEQ ID NO: 8569267 - DNA, 22 bp, Homo sapiens
gcatgcagagaatacctgtgat

SEQ ID NO: 8569268 - DNA, 19 bp, Homo sapiens
gcatgcagagtaagaaggt

SEQ ID NO: 8569269 - DNA, 22 bp, Homo sapiens
gcatgcaggaagttttttggga

SEQ ID NO: 8569270 - DNA, 22 bp, Homo sapiens
gcatgcaggagagaaagacggc

SEQ ID NO: 8569271 - DNA, 22 bp, Homo sapiens
gcatgcaggataggttgagctc

SEQ ID NO: 8569272 - DNA, 22 bp, Homo sapiens
gcatgcagggagggtctggctg

SEQ ID NO: 8569273 - DNA, 22 bp, Homo sapiens
gcagtggctaggagtctggcgt

SEQ ID NO: 8569274 - DNA, 22 bp, Homo sapiens
gcagtgggaaggttggcacatg

SEQ ID NO: 8569275 - DNA, 22 bp, Homo sapiens
gcagtgggagcttaggcagtgc

SEQ ID NO: 8569276 - DNA, 22 bp, Homo sapiens
gcagtggctaggagtctggcgt

SEQ ID NO: 8569277 - DNA, 22 bp, Homo sapiens
gcagtggctaagctcgcatgca

SEQ ID NO: 8569278 - DNA, 22 bp, Homo sapiens
gcagtggcatgatgtgggctca

SEQ ID NO: 8569279 - DNA, 22 bp, Homo sapiens
gcagtggcatgatgtgggctca

SEQ ID NO: 8569280 - DNA, 22 bp, Homo sapiens
gcagtggcagctgagggggtat

SEQ ID NO: 8569281 - DNA, 22 bp, Homo sapiens
gcagtggcaccgctggctctgg

SEQ ID NO: 8569282 - DNA, 22 bp, Homo sapiens
gcagtggcaccgctggctctgg

SEQ ID NO: 8569283 - DNA, 22 bp, Homo sapiens
gcagtggatccaatggtatctt

SEQ ID NO: 8569284 - DNA, 22 bp, Homo sapiens
gcagtggaagcctctttaagca

SEQ ID NO: 8569285 - DNA, 22 bp, Homo sapiens
gcagtgacagggctgctgcctt

SEQ ID NO: 8569286 - DNA, 21 bp, Homo sapiens
gcaggggatagaaatggtctg

SEQ ID NO: 8569287 - DNA, 22 bp, Homo sapiens
gcaggggagtggcaggcccgga

SEQ ID NO: 8569288 - DNA, 22 bp, Homo sapiens
gcaggggagtggcaggcccgga

SEQ ID NO: 8569289 - DNA, 22 bp, Homo sapiens
gcaggggagtccactctatgca

SEQ ID NO: 8569290 - DNA, 22 bp, Homo sapiens
gcaggggagtggatgatggatt

SEQ ID NO: 8569291 - DNA, 22 bp, Homo sapiens
gcaggggagtggatgatggatt

SEQ ID NO: 8569292 - DNA, 22 bp, Homo sapiens
gcaggggagtggatgatggatt

SEQ ID NO: 8569293 - DNA, 22 bp, Homo sapiens
gcaggggagtggatgatggatt

SEQ ID NO: 8569294 - DNA, 22 bp, Homo sapiens
gcccatggcttccctaggcaca

SEQ ID NO: 8569295 - DNA, 22 bp, Homo sapiens
gcccatgggcctgaggccctag

SEQ ID NO: 8569296 - DNA, 22 bp, Homo sapiens
gcccatgggcctgaggccctag

SEQ ID NO: 8569297 - DNA, 18 bp, Homo sapiens
gcccatggtaaatgctgt

SEQ ID NO: 8569298 - DNA, 22 bp, Homo sapiens
gcccatggcttccctaggcaca

SEQ ID NO: 8569299 - DNA, 22 bp, Homo sapiens
gcccatggcttccctaggcaca

SEQ ID NO: 8569300 - DNA, 22 bp, Homo sapiens
gcccatggcagaactgtgagca

SEQ ID NO: 8569301 - DNA, 22 bp, Homo sapiens
gcccaggagaggccagggctga

SEQ ID NO: 8569302 - DNA, 22 bp, Homo sapiens
gcccaggagaggccagggctga

SEQ ID NO: 8569303 - DNA, 22 bp, Homo sapiens
gcccaggactcagggtgtcgcg

SEQ ID NO: 8569304 - DNA, 22 bp, Homo sapiens
gcccaggactcagggtgtcgcg

SEQ ID NO: 8569305 - DNA, 22 bp, Homo sapiens
gcccaggactcagggtgtcgcg

SEQ ID NO: 8569306 - DNA, 22 bp, Homo sapiens
gcccaggagcctggagatgtgt

SEQ ID NO: 8569307 - DNA, 22 bp, Homo sapiens
gcccaggagcctggagatgtgt

SEQ ID NO: 8569308 - DNA, 22 bp, Homo sapiens
gccccacctgctaccttccagc

SEQ ID NO: 8569309 - DNA, 22 bp, Homo sapiens
gccccacagcctgcggtctcag

SEQ ID NO: 8569310 - DNA, 22 bp, Homo sapiens
gccccaccgagggtgcagtcct

SEQ ID NO: 8569311 - DNA, 22 bp, Homo sapiens
gccccacctgctaccttccagc

SEQ ID NO: 8569312 - DNA, 22 bp, Homo sapiens
gccccaccttgagagcagaaac

SEQ ID NO: 8569313 - DNA, 22 bp, Homo sapiens
gccccactgtggaacctaagtc

SEQ ID NO: 8569314 - DNA, 22 bp, Homo sapiens
gcccatggtcagggaggcaggg

SEQ ID NO: 8569315 - DNA, 22 bp, Homo sapiens
gcccatggtccaggaagacaga

SEQ ID NO: 8569316 - DNA, 22 bp, Homo sapiens
gcccatggtccaggaagacaga

SEQ ID NO: 8569317 - DNA, 22 bp, Homo sapiens
gcccatggtcagggaggcaggg

SEQ ID NO: 8569318 - DNA, 22 bp, Homo sapiens
gccccaagggagcccagcacac

SEQ ID NO: 8569319 - DNA, 22 bp, Homo sapiens
gcccaggaagtgactcagatgt

SEQ ID NO: 8569320 - DNA, 22 bp, Homo sapiens
gcccaggaagtgactcagatgt

SEQ ID NO: 8569321 - DNA, 22 bp, Homo sapiens
gcccaggaagccaccgggaagt

SEQ ID NO: 8569322 - DNA, 22 bp, Homo sapiens
gcccaggaagccaccgggaagt

SEQ ID NO: 8569323 - DNA, 17 bp, Homo sapiens
gcccaggaaggacggcc

SEQ ID NO: 8569324 - DNA, 17 bp, Homo sapiens
gcccaggaaggacggcc

SEQ ID NO: 8569325 - DNA, 22 bp, Homo sapiens
gcccaggaagttgaggctgccg

SEQ ID NO: 8569326 - DNA, 22 bp, Homo sapiens
gcccaggaagttgaggctgccg

SEQ ID NO: 8569327 - DNA, 16 bp, Homo sapiens
gcccaggacgggaggc

SEQ ID NO: 8569328 - DNA, 16 bp, Homo sapiens
gcccaggacgggaggc

SEQ ID NO: 8569329 - DNA, 20 bp, Homo sapiens
gcccaggaatttgcatttct

SEQ ID NO: 8569330 - DNA, 20 bp, Homo sapiens
gcccaggaatttgcatttct

SEQ ID NO: 8569331 - DNA, 20 bp, Homo sapiens
gcccaggaatttgcatttct

SEQ ID NO: 8569332 - DNA, 22 bp, Homo sapiens
gcccaggaaatgccccgtggtg

SEQ ID NO: 8569333 - DNA, 22 bp, Homo sapiens
gcccaggaaatgccccgtggtg

SEQ ID NO: 8569334 - DNA, 22 bp, Homo sapiens
gcccaggaaatgccccgtggtg

SEQ ID NO: 8569335 - DNA, 22 bp, Homo sapiens
gcccaggaaataaaagtgggct

SEQ ID NO: 8569336 - DNA, 22 bp, Homo sapiens
gcccaggaaataaaagtgggct

SEQ ID NO: 8569337 - DNA, 22 bp, Homo sapiens
gcccaggaaagatagggcctca

SEQ ID NO: 8569338 - DNA, 22 bp, Homo sapiens
gcccagctttttgaggcaggca

SEQ ID NO: 8569339 - DNA, 22 bp, Homo sapiens
gcccaggaaagatagggcctca

SEQ ID NO: 8569340 - DNA, 22 bp, Homo sapiens
gcccagctggcttccagcacat

SEQ ID NO: 8569341 - DNA, 22 bp, Homo sapiens
gcccagctggcttccagcacat

SEQ ID NO: 8569342 - DNA, 22 bp, Homo sapiens
gcccagctgtctggcagggatg

SEQ ID NO: 8569343 - DNA, 22 bp, Homo sapiens
gcccagctgtctggcagggatg

SEQ ID NO: 8569344 - DNA, 22 bp, Homo sapiens
gcccagctgtctggcagggatg

SEQ ID NO: 8569345 - DNA, 22 bp, Homo sapiens
gcccagctttttgaggcaggca

SEQ ID NO: 8569346 - DNA, 22 bp, Homo sapiens
gcccagctttttgaggcaggca

SEQ ID NO: 8569347 - DNA, 22 bp, Homo sapiens
gcccagctttttgaggcaggca

SEQ ID NO: 8569348 - DNA, 22 bp, Homo sapiens
gcccagcttttcacttccacac

SEQ ID NO: 8569349 - DNA, 22 bp, Homo sapiens
gcccagcttttcacttccacac

SEQ ID NO: 8569350 - DNA, 22 bp, Homo sapiens
gccagggttcgaatccgtatgg

SEQ ID NO: 8569351 - DNA, 22 bp, Homo sapiens
gccagggttcgaatccgtatgg

SEQ ID NO: 8569352 - DNA, 22 bp, Homo sapiens
gccagggggtcagcaggcactt

SEQ ID NO: 8569353 - DNA, 22 bp, Homo sapiens
gccagggggtcagcaggcactt

SEQ ID NO: 8569354 - DNA, 22 bp, Homo sapiens
gccagggggtcagcaggcactt

SEQ ID NO: 8569355 - DNA, 22 bp, Homo sapiens
gccagggggtcagcaggcactt

SEQ ID NO: 8569356 - DNA, 22 bp, Homo sapiens
gccaggggacgcggagcgacga

SEQ ID NO: 8569357 - DNA, 22 bp, Homo sapiens
gccaggggacgcggagcgacga

SEQ ID NO: 8569358 - DNA, 22 bp, Homo sapiens
gccaggggacgcggagcgacga

SEQ ID NO: 8569359 - DNA, 22 bp, Homo sapiens
gccaggggacgcggagcgacga

SEQ ID NO: 8569360 - DNA, 21 bp, Homo sapiens
gcccagcaaggtgagaaggcc

SEQ ID NO: 8569361 - DNA, 22 bp, Homo sapiens
gcccagcacagctggaagagtc

SEQ ID NO: 8569362 - DNA, 22 bp, Homo sapiens
gcccagcacagctggaagagtc

SEQ ID NO: 8569363 - DNA, 21 bp, Homo sapiens
gcccagcaaggtgagaaggcc

SEQ ID NO: 8569364 - DNA, 22 bp, Homo sapiens
gccaggtacatttaagaagcct

SEQ ID NO: 8569365 - DNA, 22 bp, Homo sapiens
gcccagcacattgctgaggacc

SEQ ID NO: 8569366 - DNA, 22 bp, Homo sapiens
gcccagcacattgctgaggacc

SEQ ID NO: 8569367 - DNA, 22 bp, Homo sapiens
gcccagcacattgctgaggacc

SEQ ID NO: 8569368 - DNA, 22 bp, Homo sapiens
gcccagccctgaggtcacagct

SEQ ID NO: 8569369 - DNA, 22 bp, Homo sapiens
gcccagcctccaagctccaagg

SEQ ID NO: 8569370 - DNA, 22 bp, Homo sapiens
gcccagcctccaagctccaagg

SEQ ID NO: 8569371 - DNA, 22 bp, Homo sapiens
gcccagcctccaagctccaagg

SEQ ID NO: 8569372 - DNA, 22 bp, Homo sapiens
gcccagcgagcagaggtggacg

SEQ ID NO: 8569373 - DNA, 22 bp, Homo sapiens
gcccagcctccaagctccaagg

SEQ ID NO: 8569374 - DNA, 22 bp, Homo sapiens
gcccagctggcttccagcacat

SEQ ID NO: 8569375 - DNA, 22 bp, Homo sapiens
gcccagctgcaccctggtgggt

SEQ ID NO: 8569376 - DNA, 22 bp, Homo sapiens
gcccagctgagaagcgcggggc

SEQ ID NO: 8569377 - DNA, 22 bp, Homo sapiens
gcccagctgagaagcgcggggc

SEQ ID NO: 8569378 - DNA, 22 bp, Homo sapiens
gcccagctgagaagcgcggggc

SEQ ID NO: 8569379 - DNA, 22 bp, Homo sapiens
gcccagctgcaccctggtgggt

SEQ ID NO: 8569380 - DNA, 22 bp, Homo sapiens
gcccagctcctctgcagaccct

SEQ ID NO: 8569381 - DNA, 22 bp, Homo sapiens
gcccagctcctctgcagaccct

SEQ ID NO: 8569382 - DNA, 22 bp, Homo sapiens
gcccagctccattcttggtgag

SEQ ID NO: 8569383 - DNA, 22 bp, Homo sapiens
gcccagctccattcttggtgag

SEQ ID NO: 8569384 - DNA, 22 bp, Homo sapiens
gcccagctcctctgcagaccct

SEQ ID NO: 8569385 - DNA, 22 bp, Homo sapiens
gcccagcacctctctcagggtt

SEQ ID NO: 8569386 - DNA, 22 bp, Homo sapiens
gcccagcactaaaagctttgct

SEQ ID NO: 8569387 - DNA, 22 bp, Homo sapiens
gcccagcacctctctcagggtt

SEQ ID NO: 8569388 - DNA, 22 bp, Homo sapiens
gcccagcacctctctcagggtt

SEQ ID NO: 8569389 - DNA, 22 bp, Homo sapiens
gcccagcacctctctcagggtt

SEQ ID NO: 8569390 - DNA, 22 bp, Homo sapiens
gcccagcagctggtggagaagg

SEQ ID NO: 8569391 - DNA, 22 bp, Homo sapiens
gcccagcagatctcagtgtctc

SEQ ID NO: 8569392 - DNA, 22 bp, Homo sapiens
gcccagcagatctcagtgtctc

SEQ ID NO: 8569393 - DNA, 22 bp, Homo sapiens
gcccagcagatctcagtgtctc

SEQ ID NO: 8569394 - DNA, 22 bp, Homo sapiens
gcccagcagctccacttggctt

SEQ ID NO: 8569395 - DNA, 22 bp, Homo sapiens
gcctcctgaagtgctgggatta

SEQ ID NO: 8569396 - DNA, 22 bp, Homo sapiens
gcctcctgacttacactgagct

SEQ ID NO: 8569397 - DNA, 22 bp, Homo sapiens
gcctcctgaaaggaagagctcc

SEQ ID NO: 8569398 - DNA, 22 bp, Homo sapiens
gcctcctgaaaggaagagctcc

SEQ ID NO: 8569399 - DNA, 22 bp, Homo sapiens
gcctcctaccacaccctcagtc

SEQ ID NO: 8569400 - DNA, 22 bp, Homo sapiens
gccctgtggttccaggaagcaa

SEQ ID NO: 8569401 - DNA, 22 bp, Homo sapiens
gccctgtgtatcccctgtgctt

SEQ ID NO: 8569402 - DNA, 22 bp, Homo sapiens
gccctgtgtgatcacatgaaca

SEQ ID NO: 8569403 - DNA, 22 bp, Homo sapiens
gccctgtgtatcccctgtgctt

SEQ ID NO: 8569404 - DNA, 22 bp, Homo sapiens
gcctccggagttgcagtgtctt

SEQ ID NO: 8569405 - DNA, 22 bp, Homo sapiens
gcctccggagttgcagtgtctt

SEQ ID NO: 8569406 - DNA, 22 bp, Homo sapiens
gcctccggagttgcagtgtctt

SEQ ID NO: 8569407 - DNA, 22 bp, Homo sapiens
gcctccggagtcacagtgtctt

SEQ ID NO: 8569408 - DNA, 22 bp, Homo sapiens
gcctccggagtcacagtgtctt

SEQ ID NO: 8569409 - DNA, 22 bp, Homo sapiens
gcctccggagtcacagtgtctt

SEQ ID NO: 8569410 - DNA, 22 bp, Homo sapiens
gcctcctgagtagctgggattg

SEQ ID NO: 8569411 - DNA, 22 bp, Homo sapiens
gcctcctgagaagccacaggct

SEQ ID NO: 8569412 - DNA, 22 bp, Homo sapiens
gcctcctgagaagccacaggct

SEQ ID NO: 8569413 - DNA, 22 bp, Homo sapiens
gcctcctgacttacactgagct

SEQ ID NO: 8569414 - DNA, 22 bp, Homo sapiens
gcctcctggattttagtgccat

SEQ ID NO: 8569415 - DNA, 22 bp, Homo sapiens
gcctcctgcccagatgagtgat

SEQ ID NO: 8569416 - DNA, 22 bp, Homo sapiens
gcctctgggctctgcccctggc

SEQ ID NO: 8569417 - DNA, 22 bp, Homo sapiens
gcctctgggctctgcccctggc

SEQ ID NO: 8569418 - DNA, 22 bp, Homo sapiens
gcctctgggctctgcccctggc

SEQ ID NO: 8569419 - DNA, 22 bp, Homo sapiens
gcctctgggctctgcccctggc

SEQ ID NO: 8569420 - DNA, 22 bp, Homo sapiens
gcctctggcttctgcatcagtg

SEQ ID NO: 8569421 - DNA, 22 bp, Homo sapiens
gcctcctggttgcttctccaac

SEQ ID NO: 8569422 - DNA, 22 bp, Homo sapiens
gcctcctggcctttgctcctca

SEQ ID NO: 8569423 - DNA, 22 bp, Homo sapiens
gcctcctggcctttgctcctca

SEQ ID NO: 8569424 - DNA, 22 bp, Homo sapiens
gcctcctggcctttgctcctca

SEQ ID NO: 8569425 - DNA, 22 bp, Homo sapiens
gccctgtgcttggatggcagat

SEQ ID NO: 8569426 - DNA, 22 bp, Homo sapiens
gccctgtggacagtgagaagtg

SEQ ID NO: 8569427 - DNA, 22 bp, Homo sapiens
gccctgtggacccaggaactct

SEQ ID NO: 8569428 - DNA, 22 bp, Homo sapiens
gccctgggattgggtggaggct

SEQ ID NO: 8569429 - DNA, 22 bp, Homo sapiens
gccctgggcaaggttctggcca

SEQ ID NO: 8569430 - DNA, 22 bp, Homo sapiens
gccctgggcaaggttctggcca

SEQ ID NO: 8569431 - DNA, 22 bp, Homo sapiens
gccctgtgcgactctagaggtt

SEQ ID NO: 8569432 - DNA, 22 bp, Homo sapiens
gccctgtgcgactctagaggtt

SEQ ID NO: 8569433 - DNA, 22 bp, Homo sapiens
gccctgtgccagtcacgctgtg

SEQ ID NO: 8569434 - DNA, 22 bp, Homo sapiens
gccctgtgccagtcacgctgtg

SEQ ID NO: 8569435 - DNA, 22 bp, Homo sapiens
gccctggatggcaggagccatc

SEQ ID NO: 8569436 - DNA, 22 bp, Homo sapiens
gccctggatgtacaggcatgtt

SEQ ID NO: 8569437 - DNA, 22 bp, Homo sapiens
gccctggccttcatctcagaca

SEQ ID NO: 8569438 - DNA, 22 bp, Homo sapiens
gccctggccttcatctcagaca

SEQ ID NO: 8569439 - DNA, 22 bp, Homo sapiens
gccctggcctcctggaacaggc

SEQ ID NO: 8569440 - DNA, 22 bp, Homo sapiens
gccctggcctggcgcgttgtca

SEQ ID NO: 8569441 - DNA, 22 bp, Homo sapiens
gccctggcctcctggaacaggc

SEQ ID NO: 8569442 - DNA, 22 bp, Homo sapiens
gccctgggattgggtggaggct

SEQ ID NO: 8569443 - DNA, 22 bp, Homo sapiens
gccctgggattgggtggaggct

SEQ ID NO: 8569444 - DNA, 22 bp, Homo sapiens
gccccagccctgtggaccatgg

SEQ ID NO: 8569445 - DNA, 22 bp, Homo sapiens
gccccagccaaggtgacacgaa

SEQ ID NO: 8569446 - DNA, 22 bp, Homo sapiens
gccccagcctcccgagtagctg

SEQ ID NO: 8569447 - DNA, 22 bp, Homo sapiens
gccccagcctcccgagtagctg

SEQ ID NO: 8569448 - DNA, 22 bp, Homo sapiens
gccccagcctcccgagtagctg

SEQ ID NO: 8569449 - DNA, 22 bp, Homo sapiens
gccccagaaagttcaaggcaca

SEQ ID NO: 8569450 - DNA, 22 bp, Homo sapiens
gccccagaaggggaaagcctgg

SEQ ID NO: 8569451 - DNA, 22 bp, Homo sapiens
gccccagccaaggtgacacgaa

SEQ ID NO: 8569452 - DNA, 22 bp, Homo sapiens
gccccagccaaggtgacacgaa

SEQ ID NO: 8569453 - DNA, 22 bp, Homo sapiens
gccccagccaaggtgacacgaa

SEQ ID NO: 8569454 - DNA, 22 bp, Homo sapiens
gccccagcagcaatgcggttga

SEQ ID NO: 8569455 - DNA, 20 bp, Homo sapiens
gccctggagccttgtcctgg

SEQ ID NO: 8569456 - DNA, 22 bp, Homo sapiens
gccccaggggaggtgccctgca

SEQ ID NO: 8569457 - DNA, 22 bp, Homo sapiens
gccccagctctgccacaactag

SEQ ID NO: 8569458 - DNA, 22 bp, Homo sapiens
gccccagctctgccacaactag

SEQ ID NO: 8569459 - DNA, 22 bp, Homo sapiens
gccccagcgtggctgtgttagg

SEQ ID NO: 8569460 - DNA, 22 bp, Homo sapiens
gcagatggatcacctgaggtcg

SEQ ID NO: 8569461 - DNA, 22 bp, Homo sapiens
gcagatggcagcccaggctggg

SEQ ID NO: 8569462 - DNA, 22 bp, Homo sapiens
gcagatggcagcccaggctggg

SEQ ID NO: 8569463 - DNA, 22 bp, Homo sapiens
gcagatggcagcccaggctggg

SEQ ID NO: 8569464 - DNA, 22 bp, Homo sapiens
gcagatggcagcccaggctggg

SEQ ID NO: 8569465 - DNA, 23 bp, Homo sapiens
gcagatggccccagagtgctgcc

SEQ ID NO: 8569466 - DNA, 23 bp, Homo sapiens
gcagatggccccagagtgctgcc

SEQ ID NO: 8569467 - DNA, 22 bp, Homo sapiens
gcagatggcagcccaggctggg

SEQ ID NO: 8569468 - DNA, 23 bp, Homo sapiens
gcagatggccccagagtgctgcc

SEQ ID NO: 8569469 - DNA, 21 bp, Homo sapiens
gcagatgggagtcatcaggct

SEQ ID NO: 8569470 - DNA, 21 bp, Homo sapiens
gcagatgggagtcatcaggct

SEQ ID NO: 8569471 - DNA, 22 bp, Homo sapiens
gcagatggtgccatgtcttgtg

SEQ ID NO: 8569472 - DNA, 22 bp, Homo sapiens
gcagatggtggggcaggaaaat

SEQ ID NO: 8569473 - DNA, 22 bp, Homo sapiens
gcagatggtggggcaggaaaat

SEQ ID NO: 8569474 - DNA, 22 bp, Homo sapiens
gcagatgggagccccaggggag

SEQ ID NO: 8569475 - DNA, 22 bp, Homo sapiens
gcagatggctgagcctgcagat

SEQ ID NO: 8569476 - DNA, 22 bp, Homo sapiens
gcagatggctcagacactgggg

SEQ ID NO: 8569477 - DNA, 22 bp, Homo sapiens
gcagatggctcagacactgggg

SEQ ID NO: 8569478 - DNA, 18 bp, Homo sapiens
gcagcccctcttccttcc

SEQ ID NO: 8569479 - DNA, 22 bp, Homo sapiens
gcagcccataacatttgaggcc

SEQ ID NO: 8569480 - DNA, 22 bp, Homo sapiens
gcagccctgcagctccacaccg

SEQ ID NO: 8569481 - DNA, 22 bp, Homo sapiens
gcagccctcgggtactcacgtg

SEQ ID NO: 8569482 - DNA, 22 bp, Homo sapiens
gcagccctcgctagctctcccc

SEQ ID NO: 8569483 - DNA, 22 bp, Homo sapiens
gcagcccaggctcgctcactgc

SEQ ID NO: 8569484 - DNA, 22 bp, Homo sapiens
gcagcccaggctcgctcactgc

SEQ ID NO: 8569485 - DNA, 22 bp, Homo sapiens
gcagcccaggtctctctcactc

SEQ ID NO: 8569486 - DNA, 22 bp, Homo sapiens
gcagcccaggtggagtaatcta

SEQ ID NO: 8569487 - DNA, 22 bp, Homo sapiens
gcagcccaggtgtagctctttg

SEQ ID NO: 8569488 - DNA, 22 bp, Homo sapiens
gcagcccaggtgtagctctttg

SEQ ID NO: 8569489 - DNA, 22 bp, Homo sapiens
gcagcccaggagcaggcgaccc

SEQ ID NO: 8569490 - DNA, 22 bp, Homo sapiens
gcagcccaggagcaggcgaccc

SEQ ID NO: 8569491 - DNA, 22 bp, Homo sapiens
gcagcccaggaggcgggagccc

SEQ ID NO: 8569492 - DNA, 22 bp, Homo sapiens
gcagcccaggaccctggacaga

SEQ ID NO: 8569493 - DNA, 22 bp, Homo sapiens
gcagcccaggagcaggcgaccc

SEQ ID NO: 8569494 - DNA, 22 bp, Homo sapiens
gcagatggtgggggaggagtac

SEQ ID NO: 8569495 - DNA, 22 bp, Homo sapiens
gcagatggtgggggaggagtac

SEQ ID NO: 8569496 - DNA, 22 bp, Homo sapiens
gcagcccagcagggcccggagc

SEQ ID NO: 8569497 - DNA, 22 bp, Homo sapiens
gcagcccagagcgcaggacccc

SEQ ID NO: 8569498 - DNA, 22 bp, Homo sapiens
gcagcccagagcgcaggacccc

SEQ ID NO: 8569499 - DNA, 22 bp, Homo sapiens
gcaggacaaaatttccagggtg

SEQ ID NO: 8569500 - DNA, 22 bp, Homo sapiens
gcaggaagggaaaggttgactc

SEQ ID NO: 8569501 - DNA, 22 bp, Homo sapiens
gcaggaatatagtatttcgagg

SEQ ID NO: 8569502 - DNA, 22 bp, Homo sapiens
gcaggaagccttaccaagccca

SEQ ID NO: 8569503 - DNA, 22 bp, Homo sapiens
gcaggaagcatagaagaatgcc

SEQ ID NO: 8569504 - DNA, 22 bp, Homo sapiens
gcaggaagcatagaagaatgcc

SEQ ID NO: 8569505 - DNA, 22 bp, Homo sapiens
gcaggaagcatagaagaatgcc

SEQ ID NO: 8569506 - DNA, 22 bp, Homo sapiens
gcaggaagatgagctcaggtaa

SEQ ID NO: 8569507 - DNA, 22 bp, Homo sapiens
gcaggaagaggctcgaagcccc

SEQ ID NO: 8569508 - DNA, 22 bp, Homo sapiens
gcaggaagatgagctcaggtaa

SEQ ID NO: 8569509 - DNA, 22 bp, Homo sapiens
gcaggaactggagctggatgtt

SEQ ID NO: 8569510 - DNA, 22 bp, Homo sapiens
gcagctttgtggagaggcccat

SEQ ID NO: 8569511 - DNA, 22 bp, Homo sapiens
gcagctttgtggagaggcccat

SEQ ID NO: 8569512 - DNA, 22 bp, Homo sapiens
gcagctttttggatgtcagtta

SEQ ID NO: 8569513 - DNA, 22 bp, Homo sapiens
gcaggaaaggttgagactttgc

SEQ ID NO: 8569514 - DNA, 22 bp, Homo sapiens
gcaggaaaggttgagactttgc

SEQ ID NO: 8569515 - DNA, 19 bp, Homo sapiens
gcaggaaatgagtgattgc

SEQ ID NO: 8569516 - DNA, 22 bp, Homo sapiens
gcagccctttctgggcagggga

SEQ ID NO: 8569517 - DNA, 22 bp, Homo sapiens
gcagccctgcaggcagctccag

SEQ ID NO: 8569518 - DNA, 22 bp, Homo sapiens
gcagcctcaaactccccagctc

SEQ ID NO: 8569519 - DNA, 22 bp, Homo sapiens
gcagcctcaaactccccagctc

SEQ ID NO: 8569520 - DNA, 20 bp, Homo sapiens
gcagcctcaacaggcacagc

SEQ ID NO: 8569521 - DNA, 20 bp, Homo sapiens
gcagcctcaacaggcacagc

SEQ ID NO: 8569522 - DNA, 22 bp, Homo sapiens
gcagcctcaaactccccagctc

SEQ ID NO: 8569523 - DNA, 22 bp, Homo sapiens
gcagcctcagggcactcagatg

SEQ ID NO: 8569524 - DNA, 22 bp, Homo sapiens
gcagcctcagggcactcagatg

SEQ ID NO: 8569525 - DNA, 20 bp, Homo sapiens
gcagcctcaacaggcacagc

SEQ ID NO: 8569526 - DNA, 22 bp, Homo sapiens
gcagctgtcgctaggagctgtg

SEQ ID NO: 8569527 - DNA, 22 bp, Homo sapiens
gcagcctccgcactgcgagtcc

SEQ ID NO: 8569528 - DNA, 22 bp, Homo sapiens
gcagcctctgatgatggccgta

SEQ ID NO: 8569529 - DNA, 22 bp, Homo sapiens
gcagcctccgcactgcgagtcc

SEQ ID NO: 8569530 - DNA, 22 bp, Homo sapiens
gcagcctcagggcactcagatg

SEQ ID NO: 8569531 - DNA, 22 bp, Homo sapiens
gcagcctcagggcactcagatg

SEQ ID NO: 8569532 - DNA, 22 bp, Homo sapiens
gcagctttcttgccctaatctt

SEQ ID NO: 8569533 - DNA, 22 bp, Homo sapiens
gcaggcagccacgattcccttg

SEQ ID NO: 8569534 - DNA, 22 bp, Homo sapiens
gcaggcagccacgattcccttg

SEQ ID NO: 8569535 - DNA, 22 bp, Homo sapiens
gcaggcagccacgattcccttg

SEQ ID NO: 8569536 - DNA, 22 bp, Homo sapiens
gcaggcaggtggcatcttgtga

SEQ ID NO: 8569537 - DNA, 22 bp, Homo sapiens
gcaggcaggtggcatcttgtga

SEQ ID NO: 8569538 - DNA, 19 bp, Homo sapiens
gcaggcagctggggtatcc

SEQ ID NO: 8569539 - DNA, 22 bp, Homo sapiens
gcaggcagatcacctgtcagga

SEQ ID NO: 8569540 - DNA, 22 bp, Homo sapiens
gcaggcagatcacctgtcagga

SEQ ID NO: 8569541 - DNA, 22 bp, Homo sapiens
gcaggcagatcacctgtcagga

SEQ ID NO: 8569542 - DNA, 22 bp, Homo sapiens
gcaggcagatcacctgtcagga

SEQ ID NO: 8569543 - DNA, 22 bp, Homo sapiens
gcaggcagatcacctgtcagga

SEQ ID NO: 8569544 - DNA, 22 bp, Homo sapiens
gcaggcagatcacctgtcagga

SEQ ID NO: 8569545 - DNA, 22 bp, Homo sapiens
gcaggcagagtcaatttgatcc

SEQ ID NO: 8569546 - DNA, 16 bp, Homo sapiens
gcaggcagatcacatg

SEQ ID NO: 8569547 - DNA, 16 bp, Homo sapiens
gcaggcagatcacatg

SEQ ID NO: 8569548 - DNA, 22 bp, Homo sapiens
gcaggcagaggtggaggagaca

SEQ ID NO: 8569549 - DNA, 22 bp, Homo sapiens
gcaggcagaggtggaggagaca

SEQ ID NO: 8569550 - DNA, 22 bp, Homo sapiens
gcaggcagaggtggaggagaca

SEQ ID NO: 8569551 - DNA, 22 bp, Homo sapiens
gcaggcagaggtggaggagaca

SEQ ID NO: 8569552 - DNA, 22 bp, Homo sapiens
gcaggcagaggtggaggagaca

SEQ ID NO: 8569553 - DNA, 22 bp, Homo sapiens
gcaggacacagatgcaaggcca

SEQ ID NO: 8569554 - DNA, 22 bp, Homo sapiens
gcaggacacagatgcaaggcca

SEQ ID NO: 8569555 - DNA, 22 bp, Homo sapiens
gcaggcagaggtggaggagaca

SEQ ID NO: 8569556 - DNA, 22 bp, Homo sapiens
gcaggcagtcatctttcatatt

SEQ ID NO: 8569557 - DNA, 22 bp, Homo sapiens
gcaggcaggtggcatcttgtga

SEQ ID NO: 8569558 - DNA, 22 bp, Homo sapiens
gcaggcagtcatctttcatatt

SEQ ID NO: 8569559 - DNA, 19 bp, Homo sapiens
gcaggcagtggcattcgga

SEQ ID NO: 8569560 - DNA, 22 bp, Homo sapiens
gcaggcagttatttagtagaat

SEQ ID NO: 8569561 - DNA, 19 bp, Homo sapiens
gcaggcagtggcattcgga

SEQ ID NO: 8569562 - DNA, 22 bp, Homo sapiens
gcaggcagttgcagttttctag

SEQ ID NO: 8569563 - DNA, 22 bp, Homo sapiens
gcagggaagacccggagcagcg

SEQ ID NO: 8569564 - DNA, 22 bp, Homo sapiens
gcagggaagacccggagcagcg

SEQ ID NO: 8569565 - DNA, 22 bp, Homo sapiens
gcaggcagttatttagtagaat

SEQ ID NO: 8569566 - DNA, 22 bp, Homo sapiens
gcaggcagttatttagtagaat

SEQ ID NO: 8569567 - DNA, 22 bp, Homo sapiens
gcagggaagatcttggagctgc

SEQ ID NO: 8569568 - DNA, 22 bp, Homo sapiens
gcagggaagatcttggagctgc

SEQ ID NO: 8569569 - DNA, 22 bp, Homo sapiens
gcagggaagggaaacagagacc

SEQ ID NO: 8569570 - DNA, 22 bp, Homo sapiens
gcagggaagacccggagcagcg

SEQ ID NO: 8569571 - DNA, 21 bp, Homo sapiens
gcagggacaaagcttcaggag

SEQ ID NO: 8569572 - DNA, 21 bp, Homo sapiens
gcagggacaaagcttcaggag

SEQ ID NO: 8569573 - DNA, 21 bp, Homo sapiens
gcagggacaaagcttcaggag

SEQ ID NO: 8569574 - DNA, 22 bp, Homo sapiens
gcagggaaggggcatgctggag

SEQ ID NO: 8569575 - DNA, 22 bp, Homo sapiens
gcagggaaggggcatgctggag

SEQ ID NO: 8569576 - DNA, 22 bp, Homo sapiens
gcagggacacctttgtgaagct

SEQ ID NO: 8569577 - DNA, 22 bp, Homo sapiens
gcagggacaaggcaggtgttct

SEQ ID NO: 8569578 - DNA, 18 bp, Homo sapiens
gcagggacacagggtcac

SEQ ID NO: 8569579 - DNA, 22 bp, Homo sapiens
gcagggacaactgtgcacctga

SEQ ID NO: 8569580 - DNA, 22 bp, Homo sapiens
gcagggacaactgtgcacctga

SEQ ID NO: 8569581 - DNA, 22 bp, Homo sapiens
gcagggacaaggcaggtgttct

SEQ ID NO: 8569582 - DNA, 22 bp, Homo sapiens
gcagggacagggcagggccttt

SEQ ID NO: 8569583 - DNA, 22 bp, Homo sapiens
gcagggacagggcagggccttt

SEQ ID NO: 8569584 - DNA, 22 bp, Homo sapiens
gcagggacacctttgtgaagct

SEQ ID NO: 8569585 - DNA, 22 bp, Homo sapiens
gcagggacatctttgtctagta

SEQ ID NO: 8569586 - DNA, 22 bp, Homo sapiens
gcagggaccaaaagaggcagta

SEQ ID NO: 8569587 - DNA, 21 bp, Homo sapiens
gcagggaccgcgacttctggg

SEQ ID NO: 8569588 - DNA, 22 bp, Homo sapiens
gcagggacctgccactgctgtc

SEQ ID NO: 8569589 - DNA, 22 bp, Homo sapiens
gcagggctctgctgtagtccta

SEQ ID NO: 8569590 - DNA, 22 bp, Homo sapiens
gcagggctctgctgtagtccta

SEQ ID NO: 8569591 - DNA, 22 bp, Homo sapiens
gcagggctctgctgtagtccta

SEQ ID NO: 8569592 - DNA, 22 bp, Homo sapiens
gcagggctgggtgggagacaga

SEQ ID NO: 8569593 - DNA, 22 bp, Homo sapiens
gcagggctgggtgggagacaga

SEQ ID NO: 8569594 - DNA, 22 bp, Homo sapiens
gcagggctgtaatttgagcctg

SEQ ID NO: 8569595 - DNA, 22 bp, Homo sapiens
gcagggctgtaatttgagcctg

SEQ ID NO: 8569596 - DNA, 22 bp, Homo sapiens
gcagggctgggtgggagacaga

SEQ ID NO: 8569597 - DNA, 22 bp, Homo sapiens
gcagggctgggtgggagacaga

SEQ ID NO: 8569598 - DNA, 22 bp, Homo sapiens
gcagggctgggtcctgtctcat

SEQ ID NO: 8569599 - DNA, 22 bp, Homo sapiens
gcagggctggggctgctcctga

SEQ ID NO: 8569600 - DNA, 22 bp, Homo sapiens
gcagggctgaaggtcccaggcc

SEQ ID NO: 8569601 - DNA, 22 bp, Homo sapiens
gcagggctggggctgctcctga

SEQ ID NO: 8569602 - DNA, 22 bp, Homo sapiens
gcaggggagtccactctatgca

SEQ ID NO: 8569603 - DNA, 22 bp, Homo sapiens
gcagggcttgcagcagctagac

SEQ ID NO: 8569604 - DNA, 22 bp, Homo sapiens
gcagggcttagaaatggtggct

SEQ ID NO: 8569605 - DNA, 22 bp, Homo sapiens
gcagggcttagaaatggtggct

SEQ ID NO: 8569606 - DNA, 22 bp, Homo sapiens
gcagggctgttcaggagggtgg

SEQ ID NO: 8569607 - DNA, 22 bp, Homo sapiens
gcagggctgttcaggagggtgg

SEQ ID NO: 8569608 - DNA, 22 bp, Homo sapiens
gcagggctgtggacactttggt

SEQ ID NO: 8569609 - DNA, 22 bp, Homo sapiens
gcagggctgtggacactttggt

SEQ ID NO: 8569610 - DNA, 22 bp, Homo sapiens
gcagggctgttcaggagggtgg

SEQ ID NO: 8569611 - DNA, 22 bp, Homo sapiens
gcagaggagtgattatgccgtg

SEQ ID NO: 8569612 - DNA, 22 bp, Homo sapiens
gcagagcagtactctcttgact

SEQ ID NO: 8569613 - DNA, 22 bp, Homo sapiens
gcagagcaggggctgaacctgg

SEQ ID NO: 8569614 - DNA, 22 bp, Homo sapiens
gcagagcagggattttgccata

SEQ ID NO: 8569615 - DNA, 22 bp, Homo sapiens
gcagagcagcaaatggaaagga

SEQ ID NO: 8569616 - DNA, 22 bp, Homo sapiens
gcagagcaggaaggaagtcagg

SEQ ID NO: 8569617 - DNA, 22 bp, Homo sapiens
gcagagcaggaaggaagtcagg

SEQ ID NO: 8569618 - DNA, 22 bp, Homo sapiens
gcagagcaggaaggaagtcagg

SEQ ID NO: 8569619 - DNA, 22 bp, Homo sapiens
gcagagcagaggtgcaggttgg

SEQ ID NO: 8569620 - DNA, 22 bp, Homo sapiens
gcagagcagaggtgcaggttgg

SEQ ID NO: 8569621 - DNA, 22 bp, Homo sapiens
gcagaggatcaggctctggaaa

SEQ ID NO: 8569622 - DNA, 22 bp, Homo sapiens
gcagaggatcaggctctggaaa

SEQ ID NO: 8569623 - DNA, 22 bp, Homo sapiens
gcagaggatcaggctctggaaa

SEQ ID NO: 8569624 - DNA, 22 bp, Homo sapiens
gcagaggatagcatatgaacct

SEQ ID NO: 8569625 - DNA, 22 bp, Homo sapiens
gcagaggcacagccccagatga

SEQ ID NO: 8569626 - DNA, 21 bp, Homo sapiens
gcagaggcacggcaccaaggg

SEQ ID NO: 8569627 - DNA, 21 bp, Homo sapiens
gcagaggcacggcaccaaggg

SEQ ID NO: 8569628 - DNA, 22 bp, Homo sapiens
gcagaggcatttctgacgctgc

SEQ ID NO: 8569629 - DNA, 22 bp, Homo sapiens
gcagaggcagggccctcctcca

SEQ ID NO: 8569630 - DNA, 22 bp, Homo sapiens
gcagagggtcctgtgccagcag

SEQ ID NO: 8569631 - DNA, 22 bp, Homo sapiens
gcagagggtcctgtgccagcag

SEQ ID NO: 8569632 - DNA, 22 bp, Homo sapiens
gcagaggtcaaatacctcattt

SEQ ID NO: 8569633 - DNA, 22 bp, Homo sapiens
gcagagggtcctgtgccagcag

SEQ ID NO: 8569634 - DNA, 22 bp, Homo sapiens
gcagaggtcctagccaggagtc

SEQ ID NO: 8569635 - DNA, 22 bp, Homo sapiens
gcagaggccatcaactttgcca

SEQ ID NO: 8569636 - DNA, 22 bp, Homo sapiens
gcagaggccaggccaccagcaa

SEQ ID NO: 8569637 - DNA, 22 bp, Homo sapiens
gcagaggcatttctgacgctgc

SEQ ID NO: 8569638 - DNA, 22 bp, Homo sapiens
gcagaggccaggccaccagcaa

SEQ ID NO: 8569639 - DNA, 22 bp, Homo sapiens
gcagaggtgaccagcagcaggg

SEQ ID NO: 8569640 - DNA, 22 bp, Homo sapiens
gcagaggtgaccagcagcaggg

SEQ ID NO: 8569641 - DNA, 22 bp, Homo sapiens
gcagaggtctcttcaaaataat

SEQ ID NO: 8569642 - DNA, 22 bp, Homo sapiens
gcagaggtctagcaccaagaat

SEQ ID NO: 8569643 - DNA, 22 bp, Homo sapiens
gcagaggtctagcaccaagaat

SEQ ID NO: 8569644 - DNA, 22 bp, Homo sapiens
gcagatggaaagtgcttgaggg

SEQ ID NO: 8569645 - DNA, 22 bp, Homo sapiens
gcagatggaaagtgcttgaggg

SEQ ID NO: 8569646 - DNA, 22 bp, Homo sapiens
gcagatggactgtatgacctga

SEQ ID NO: 8569647 - DNA, 20 bp, Homo sapiens
gcagagtgtgagagggtgaa

SEQ ID NO: 8569648 - DNA, 22 bp, Homo sapiens
gcagacctcaggacatcattag

SEQ ID NO: 8569649 - DNA, 21 bp, Homo sapiens
gcagactgccctgctgtcccc

SEQ ID NO: 8569650 - DNA, 19 bp, Homo sapiens
gcagacaggtccagagagg

SEQ ID NO: 8569651 - DNA, 22 bp, Homo sapiens
gcagaccagcccctggagctgc

SEQ ID NO: 8569652 - DNA, 22 bp, Homo sapiens
gcagactggtcttcagccttgg

SEQ ID NO: 8569653 - DNA, 22 bp, Homo sapiens
gcagactgtatcaatgtcagta

SEQ ID NO: 8569654 - DNA, 21 bp, Homo sapiens
gcagactgccctgctgtcccc

SEQ ID NO: 8569655 - DNA, 21 bp, Homo sapiens
gcagactgccctgctgtcccc

SEQ ID NO: 8569656 - DNA, 22 bp, Homo sapiens
gcagagaacccagcagattggc

SEQ ID NO: 8569657 - DNA, 22 bp, Homo sapiens
gcagagaacccagcagattggc

SEQ ID NO: 8569658 - DNA, 22 bp, Homo sapiens
gcagagaagatgcccaggcttc

SEQ ID NO: 8569659 - DNA, 22 bp, Homo sapiens
gcagagaaagttttgtcctcag

SEQ ID NO: 8569660 - DNA, 22 bp, Homo sapiens
gcagagaaagttttgtcctcag

SEQ ID NO: 8569661 - DNA, 22 bp, Homo sapiens
gcagagaaagttttgtcctcag

SEQ ID NO: 8569662 - DNA, 22 bp, Homo sapiens
gcagagaagatgcccaggcttc

SEQ ID NO: 8569663 - DNA, 22 bp, Homo sapiens
gcagagcaccctgcagtggtat

SEQ ID NO: 8569664 - DNA, 22 bp, Homo sapiens
gcagagcaccaaagtgaaagat

SEQ ID NO: 8569665 - DNA, 22 bp, Homo sapiens
gcagagcaccctgcagtggtat

SEQ ID NO: 8569666 - DNA, 18 bp, Homo sapiens
gcagagcagaagctcaag

SEQ ID NO: 8569667 - DNA, 18 bp, Homo sapiens
gcagagcagaagctcaag

SEQ ID NO: 8569668 - DNA, 22 bp, Homo sapiens
gcacagtgggtggtcatgtaca

SEQ ID NO: 8569669 - DNA, 22 bp, Homo sapiens
gcacagtgggtggtcatgtaca

SEQ ID NO: 8569670 - DNA, 22 bp, Homo sapiens
gcacagtggagtgtgtccaggg

SEQ ID NO: 8569671 - DNA, 22 bp, Homo sapiens
gcacagtgcaccactttgaaaa

SEQ ID NO: 8569672 - DNA, 17 bp, Homo sapiens
gcacagtgatattattt

SEQ ID NO: 8569673 - DNA, 21 bp, Homo sapiens
gcacagtgccaggcacacagt

SEQ ID NO: 8569674 - DNA, 21 bp, Homo sapiens
gcacagtgccaggcacacagt

SEQ ID NO: 8569675 - DNA, 21 bp, Homo sapiens
gcacagtgccaggcacacagt

SEQ ID NO: 8569676 - DNA, 22 bp, Homo sapiens
gcacagtgcaccactttgaaaa

SEQ ID NO: 8569677 - DNA, 22 bp, Homo sapiens
gcacagttaaagggtcatgtga

SEQ ID NO: 8569678 - DNA, 22 bp, Homo sapiens
gcacagttaaagggtcatgtga

SEQ ID NO: 8569679 - DNA, 22 bp, Homo sapiens
gcacagttgtgacaaccatcgc

SEQ ID NO: 8569680 - DNA, 20 bp, Homo sapiens
gcacagtttgggaaccatgg

SEQ ID NO: 8569681 - DNA, 20 bp, Homo sapiens
gcacagtttgggaaccatgg

SEQ ID NO: 8569682 - DNA, 22 bp, Homo sapiens
gcacataactgaccacatctaa

SEQ ID NO: 8569683 - DNA, 22 bp, Homo sapiens
gcacataaagggcatgggaggt

SEQ ID NO: 8569684 - DNA, 22 bp, Homo sapiens
gcacatgactttgaggaaacca

SEQ ID NO: 8569685 - DNA, 22 bp, Homo sapiens
gcacatgacagtaagtagagca

SEQ ID NO: 8569686 - DNA, 22 bp, Homo sapiens
gcacatgactttgaggaaacca

SEQ ID NO: 8569687 - DNA, 22 bp, Homo sapiens
gcacatgagaagctggcgatgc

SEQ ID NO: 8569688 - DNA, 22 bp, Homo sapiens
gcacatgagctgctgggatggg

SEQ ID NO: 8569689 - DNA, 22 bp, Homo sapiens
gcacatgagctgctgggatggg

SEQ ID NO: 8569690 - DNA, 22 bp, Homo sapiens
gcacatgaggctgtctttgtct

SEQ ID NO: 8569691 - DNA, 22 bp, Homo sapiens
gcacatgagttaagctggggca

SEQ ID NO: 8569692 - DNA, 21 bp, Homo sapiens
gcacatgagggagggcatgcc

SEQ ID NO: 8569693 - DNA, 21 bp, Homo sapiens
gcacatgagggagggcatgcc

SEQ ID NO: 8569694 - DNA, 22 bp, Homo sapiens
gcacatatgctgtaagcacatg

SEQ ID NO: 8569695 - DNA, 22 bp, Homo sapiens
gcacatccaatgattgttttga

SEQ ID NO: 8569696 - DNA, 22 bp, Homo sapiens
gcacatccaatgattgttttga

SEQ ID NO: 8569697 - DNA, 22 bp, Homo sapiens
gcacatacccactgtcaagcac

SEQ ID NO: 8569698 - DNA, 22 bp, Homo sapiens
gcacatactgcaaagattacta

SEQ ID NO: 8569699 - DNA, 22 bp, Homo sapiens
gcaaagacggactcaggagtgc

SEQ ID NO: 8569700 - DNA, 22 bp, Homo sapiens
gcaaagaatgcagatttgcctc

SEQ ID NO: 8569701 - DNA, 22 bp, Homo sapiens
gcaaagaaatgtcagtgagagg

SEQ ID NO: 8569702 - DNA, 22 bp, Homo sapiens
gcaaagaaatgtcagtgagagg

SEQ ID NO: 8569703 - DNA, 22 bp, Homo sapiens
gaggcccagcagcgcaggtctt

SEQ ID NO: 8569704 - DNA, 22 bp, Homo sapiens
gcaaactgttggagtagagtct

SEQ ID NO: 8569705 - DNA, 22 bp, Homo sapiens
gcaaactgttggagtagagtct

SEQ ID NO: 8569706 - DNA, 22 bp, Homo sapiens
gcaaagaaagccaaggtctaac

SEQ ID NO: 8569707 - DNA, 22 bp, Homo sapiens
gcaaagaaagccaaggtctaac

SEQ ID NO: 8569708 - DNA, 22 bp, Homo sapiens
gcaaagaaagccaaggtctaac

SEQ ID NO: 8569709 - DNA, 22 bp, Homo sapiens
gcaaagaaagttttaatgaggt

SEQ ID NO: 8569710 - DNA, 22 bp, Homo sapiens
gcaaagaaagttttaatgaggt

SEQ ID NO: 8569711 - DNA, 20 bp, Homo sapiens
gaggcccagagaggtgaagc

SEQ ID NO: 8569712 - DNA, 20 bp, Homo sapiens
gaggcccagagaggtgaagc

SEQ ID NO: 8569713 - DNA, 22 bp, Homo sapiens
gaggcccagcagcgcaggtctt

SEQ ID NO: 8569714 - DNA, 22 bp, Homo sapiens
gaggcccaatgcttccctcctt

SEQ ID NO: 8569715 - DNA, 22 bp, Homo sapiens
gaggcccacagggagtaccaag

SEQ ID NO: 8569716 - DNA, 22 bp, Homo sapiens
gaggcccacagggagtaccaag

SEQ ID NO: 8569717 - DNA, 22 bp, Homo sapiens
gaggccatgcctcctgatcagt

SEQ ID NO: 8569718 - DNA, 22 bp, Homo sapiens
gaggccatgaatggatgttcct

SEQ ID NO: 8569719 - DNA, 22 bp, Homo sapiens
gaggcccaaggactctgtcccg

SEQ ID NO: 8569720 - DNA, 22 bp, Homo sapiens
gaggccaggaggatctctctaa

SEQ ID NO: 8569721 - DNA, 22 bp, Homo sapiens
gcaaagcatcagtagaaatgtt

SEQ ID NO: 8569722 - DNA, 22 bp, Homo sapiens
gcaaagctgggtgtgaatgcac

SEQ ID NO: 8569723 - DNA, 22 bp, Homo sapiens
gcaaagctgggtgtgaatgcac

SEQ ID NO: 8569724 - DNA, 22 bp, Homo sapiens
gcaaagcattctgtggagtcta

SEQ ID NO: 8569725 - DNA, 22 bp, Homo sapiens
gcaaagtattaaccaacaggat

SEQ ID NO: 8569726 - DNA, 22 bp, Homo sapiens
gcaaaggtagccaaggagctca

SEQ ID NO: 8569727 - DNA, 17 bp, Homo sapiens
gcaaaggtgaggagaga

SEQ ID NO: 8569728 - DNA, 22 bp, Homo sapiens
gcaaagggaaagtggcagggtc

SEQ ID NO: 8569729 - DNA, 22 bp, Homo sapiens
gcaaagggaaagtggcagggtc

SEQ ID NO: 8569730 - DNA, 22 bp, Homo sapiens
gcaaagggaaagtggcagggtc

SEQ ID NO: 8569731 - DNA, 22 bp, Homo sapiens
gcaaagtctcaagacccaagtg

SEQ ID NO: 8569732 - DNA, 22 bp, Homo sapiens
gcaaagtctgcatctggatcag

SEQ ID NO: 8569733 - DNA, 22 bp, Homo sapiens
gcaaatacatgttgagcaccta

SEQ ID NO: 8569734 - DNA, 22 bp, Homo sapiens
gcaaataatatactttgatctc

SEQ ID NO: 8569735 - DNA, 22 bp, Homo sapiens
gcaaataatatactttgatctc

SEQ ID NO: 8569736 - DNA, 22 bp, Homo sapiens
gcacacatgcatgtgtgcatcc

SEQ ID NO: 8569737 - DNA, 22 bp, Homo sapiens
gcacacatgcatgcacaggagt

SEQ ID NO: 8569738 - DNA, 22 bp, Homo sapiens
gcacacattcggattcttaacc

SEQ ID NO: 8569739 - DNA, 22 bp, Homo sapiens
gcacacattcggattcttaacc

SEQ ID NO: 8569740 - DNA, 22 bp, Homo sapiens
gcacacattctagccttttgtg

SEQ ID NO: 8569741 - DNA, 22 bp, Homo sapiens
gcacacattcggattcttaacc

SEQ ID NO: 8569742 - DNA, 22 bp, Homo sapiens
gcacacatgcgtgtatatgggt

SEQ ID NO: 8569743 - DNA, 20 bp, Homo sapiens
gcacacatagaaatgcatat

SEQ ID NO: 8569744 - DNA, 22 bp, Homo sapiens
gcacacagtatatgctcattaa

SEQ ID NO: 8569745 - DNA, 22 bp, Homo sapiens
gcacacagtatatgctcattaa

SEQ ID NO: 8569746 - DNA, 22 bp, Homo sapiens
gcacacagtatatgctcattaa

SEQ ID NO: 8569747 - DNA, 19 bp, Homo sapiens
gcacacatacaccctttgg

SEQ ID NO: 8569748 - DNA, 22 bp, Homo sapiens
gcacacagtatatgctcattaa

SEQ ID NO: 8569749 - DNA, 22 bp, Homo sapiens
gcacacagtagggattcaatga

SEQ ID NO: 8569750 - DNA, 22 bp, Homo sapiens
gcacacagtactatatgctaca

SEQ ID NO: 8569751 - DNA, 22 bp, Homo sapiens
gcacacaggggagttctcagaa

SEQ ID NO: 8569752 - DNA, 22 bp, Homo sapiens
gcacacagtagggattcaatga

SEQ ID NO: 8569753 - DNA, 22 bp, Homo sapiens
gcacacagtagggattcaatga

SEQ ID NO: 8569754 - DNA, 19 bp, Homo sapiens
gcacacagtagggctggca

SEQ ID NO: 8569755 - DNA, 19 bp, Homo sapiens
gcacacagtagggctggca

SEQ ID NO: 8569756 - DNA, 22 bp, Homo sapiens
gcacacactgttttcctcacat

SEQ ID NO: 8569757 - DNA, 22 bp, Homo sapiens
gcacacagaacatttggatcct

SEQ ID NO: 8569758 - DNA, 22 bp, Homo sapiens
gcacacagaatcagtgggcata

SEQ ID NO: 8569759 - DNA, 22 bp, Homo sapiens
gcacacagaatcagtgggcata

SEQ ID NO: 8569760 - DNA, 22 bp, Homo sapiens
gcacagtgataggcagttgtgc

SEQ ID NO: 8569761 - DNA, 22 bp, Homo sapiens
gcacagtgataggcagttgtgc

SEQ ID NO: 8569762 - DNA, 22 bp, Homo sapiens
gcacaggttgcaaaagttcaca

SEQ ID NO: 8569763 - DNA, 22 bp, Homo sapiens
gcacaggttgcaaaagttcaca

SEQ ID NO: 8569764 - DNA, 22 bp, Homo sapiens
gcacaggctccggaggagagct

SEQ ID NO: 8569765 - DNA, 22 bp, Homo sapiens
gcacaggctccggaggagagct

SEQ ID NO: 8569766 - DNA, 22 bp, Homo sapiens
gcacagggctgccaggcggctt

SEQ ID NO: 8569767 - DNA, 22 bp, Homo sapiens
gcacagggctgccaggcggctt

SEQ ID NO: 8569768 - DNA, 22 bp, Homo sapiens
gcacagggctgccaggcggctt

SEQ ID NO: 8569769 - DNA, 19 bp, Homo sapiens
gcacaccctgcaccaccat

SEQ ID NO: 8569770 - DNA, 19 bp, Homo sapiens
gcacaccctgcaccaccat

SEQ ID NO: 8569771 - DNA, 22 bp, Homo sapiens
gcacaccttagaggggagctgc

SEQ ID NO: 8569772 - DNA, 22 bp, Homo sapiens
gcacaccctctcaccagcactg

SEQ ID NO: 8569773 - DNA, 19 bp, Homo sapiens
gcacaccctgcaccaccat

SEQ ID NO: 8569774 - DNA, 22 bp, Homo sapiens
gcacaccctctcaccagcactg

SEQ ID NO: 8569775 - DNA, 22 bp, Homo sapiens
gcacacttaatactcactgtgc

SEQ ID NO: 8569776 - DNA, 22 bp, Homo sapiens
gcacactgtgaatttgcatatg

SEQ ID NO: 8569777 - DNA, 22 bp, Homo sapiens
gcacacttaatactcactgtgc

SEQ ID NO: 8569778 - DNA, 22 bp, Homo sapiens
gcacactggagcctggaagatt

SEQ ID NO: 8569779 - DNA, 22 bp, Homo sapiens
gcacactgcggtgatgtgagtc

SEQ ID NO: 8569780 - DNA, 22 bp, Homo sapiens
gcacactgcggtgatgtgagtc

SEQ ID NO: 8569781 - DNA, 22 bp, Homo sapiens
gcacactgcggtgatgtgagtc

SEQ ID NO: 8569782 - DNA, 22 bp, Homo sapiens
gcacagaacagagaaatagcca

SEQ ID NO: 8569783 - DNA, 22 bp, Homo sapiens
gcacagaaatgtctacacatgt

SEQ ID NO: 8569784 - DNA, 22 bp, Homo sapiens
gcacagaaatgtctacacatgt

SEQ ID NO: 8569785 - DNA, 22 bp, Homo sapiens
tcagtcttccctccagtgcaac

SEQ ID NO: 8569786 - DNA, 17 bp, Homo sapiens
tcagtctctgtcctgga

SEQ ID NO: 8569787 - DNA, 22 bp, Homo sapiens
tcagtcttccctccagtgcaac

SEQ ID NO: 8569788 - DNA, 23 bp, Homo sapiens
tcagtcttccctgtcagtaatag

SEQ ID NO: 8569789 - DNA, 22 bp, Homo sapiens
tcagtcttccctccagtgcaac

SEQ ID NO: 8569790 - DNA, 23 bp, Homo sapiens
tcagtcttggcttctgattttcc

SEQ ID NO: 8569791 - DNA, 22 bp, Homo sapiens
tcagtcttgcttctcttgggtc

SEQ ID NO: 8569792 - DNA, 22 bp, Homo sapiens
tcagtcttctaaagggatgcaa

SEQ ID NO: 8569793 - DNA, 22 bp, Homo sapiens
tcaggttcagactagtcccagt

SEQ ID NO: 8569794 - DNA, 22 bp, Homo sapiens
tcagtctctggggcttctgttt

SEQ ID NO: 8569795 - DNA, 22 bp, Homo sapiens
tcaggtttttctcaaatcaggt

SEQ ID NO: 8569796 - DNA, 22 bp, Homo sapiens
tcaggtgttagaagaaatttca

SEQ ID NO: 8569797 - DNA, 21 bp, Homo sapiens
tcagggaagtgtgcagaaggg

SEQ ID NO: 8569798 - DNA, 22 bp, Homo sapiens
tcagggaagagagatctcctag

SEQ ID NO: 8569799 - DNA, 18 bp, Homo sapiens
tcagggaagagaatatga

SEQ ID NO: 8569800 - DNA, 22 bp, Homo sapiens
tcagggaacctctcctgtttct

SEQ ID NO: 8569801 - DNA, 22 bp, Homo sapiens
tcagggaagaaatgggacttta

SEQ ID NO: 8569802 - DNA, 17 bp, Homo sapiens
tcagggaatgaggttgt

SEQ ID NO: 8569803 - DNA, 17 bp, Homo sapiens
tcagggaatgaggttgt

SEQ ID NO: 8569804 - DNA, 17 bp, Homo sapiens
tcagggaatgaggttgt

SEQ ID NO: 8569805 - DNA, 19 bp, Homo sapiens
tcagggaagttcaaagctc

SEQ ID NO: 8569806 - DNA, 22 bp, Homo sapiens
tcagggacaggatgggcatttc

SEQ ID NO: 8569807 - DNA, 22 bp, Homo sapiens
tcagggacatttagacactgat

SEQ ID NO: 8569808 - DNA, 22 bp, Homo sapiens
tcagggaccaccactcacccag

SEQ ID NO: 8569809 - DNA, 22 bp, Homo sapiens
tcagggaatgatgcacacagtt

SEQ ID NO: 8569810 - DNA, 22 bp, Homo sapiens
tcagggacccctctgagtggag

SEQ ID NO: 8569811 - DNA, 22 bp, Homo sapiens
tcagggacccctctgagtggag

SEQ ID NO: 8569812 - DNA, 22 bp, Homo sapiens
tcagggacgtgagctcagagtc

SEQ ID NO: 8569813 - DNA, 22 bp, Homo sapiens
tcaggtgtcaagcagggagctg

SEQ ID NO: 8569814 - DNA, 22 bp, Homo sapiens
tcagtgcagggtgggagagaga

SEQ ID NO: 8569815 - DNA, 22 bp, Homo sapiens
tcagtggttaagttctgtccac

SEQ ID NO: 8569816 - DNA, 22 bp, Homo sapiens
tcagtgtaagttatgtagatgt

SEQ ID NO: 8569817 - DNA, 22 bp, Homo sapiens
tcagtgtagcagacttgtagcc

SEQ ID NO: 8569818 - DNA, 22 bp, Homo sapiens
tcagtgtcatcacttaatataa

SEQ ID NO: 8569819 - DNA, 22 bp, Homo sapiens
tcagtgtccggagcctgagtgc

SEQ ID NO: 8569820 - DNA, 22 bp, Homo sapiens
tcagtgttacattatatagaac

SEQ ID NO: 8569821 - DNA, 22 bp, Homo sapiens
tcagtgttagacaagtttggaa

SEQ ID NO: 8569822 - DNA, 22 bp, Homo sapiens
tcagtgttaatcagtggtacct

SEQ ID NO: 8569823 - DNA, 22 bp, Homo sapiens
tcagtgtgttcaattggatagg

SEQ ID NO: 8569824 - DNA, 22 bp, Homo sapiens
tcagtgtgttattctactttca

SEQ ID NO: 8569825 - DNA, 22 bp, Homo sapiens
tcagtgtgttactttctcctat

SEQ ID NO: 8569826 - DNA, 22 bp, Homo sapiens
tcagtgtgttactttctcctat

SEQ ID NO: 8569827 - DNA, 22 bp, Homo sapiens
tcagtctttcgaattcagccag

SEQ ID NO: 8569828 - DNA, 22 bp, Homo sapiens
tcagtgaaatgcatattcttcg

SEQ ID NO: 8569829 - DNA, 22 bp, Homo sapiens
tcagtgaaatgcatattcttcg

SEQ ID NO: 8569830 - DNA, 22 bp, Homo sapiens
tcagtgaaatgcatattcttcg

SEQ ID NO: 8569831 - DNA, 22 bp, Homo sapiens
tcagtgactgggtattaaatca

SEQ ID NO: 8569832 - DNA, 22 bp, Homo sapiens
tcagtgaagtaatggtgagaga

SEQ ID NO: 8569833 - DNA, 22 bp, Homo sapiens
tcagtgattggtggactgccta

SEQ ID NO: 8569834 - DNA, 22 bp, Homo sapiens
tcagtgatttctggggtgaggg

SEQ ID NO: 8569835 - DNA, 22 bp, Homo sapiens
tcagtgcagaatagtgatgcat

SEQ ID NO: 8569836 - DNA, 22 bp, Homo sapiens
tcagtgcacccaattctctcca

SEQ ID NO: 8569837 - DNA, 22 bp, Homo sapiens
tcagtgcacagagatttttgtt

SEQ ID NO: 8569838 - DNA, 22 bp, Homo sapiens
tcatgctctggtttagctgttt

SEQ ID NO: 8569839 - DNA, 22 bp, Homo sapiens
tcatgctcatcattagagtgac

SEQ ID NO: 8569840 - DNA, 21 bp, Homo sapiens
tcatatttctcttgctattgt

SEQ ID NO: 8569841 - DNA, 22 bp, Homo sapiens
tcatgccacttacaaaataatg

SEQ ID NO: 8569842 - DNA, 19 bp, Homo sapiens
tcatgcatttctaagtgca

SEQ ID NO: 8569843 - DNA, 22 bp, Homo sapiens
tcatatttatatgttggcacag

SEQ ID NO: 8569844 - DNA, 22 bp, Homo sapiens
tcatatttatatgttggcacag

SEQ ID NO: 8569845 - DNA, 22 bp, Homo sapiens
tcatatttcaaaatggctggag

SEQ ID NO: 8569846 - DNA, 22 bp, Homo sapiens
tcatatttcaaaatggctggag

SEQ ID NO: 8569847 - DNA, 22 bp, Homo sapiens
tcatatttatatgttggcacag

SEQ ID NO: 8569848 - DNA, 22 bp, Homo sapiens
tcatatttagttcacgctcaat

SEQ ID NO: 8569849 - DNA, 22 bp, Homo sapiens
tcatatttagttcacgctcaat

SEQ ID NO: 8569850 - DNA, 21 bp, Homo sapiens
tcatatttctcttgctattgt

SEQ ID NO: 8569851 - DNA, 21 bp, Homo sapiens
tcatatttctcttgctattgt

SEQ ID NO: 8569852 - DNA, 21 bp, Homo sapiens
tcatatttctcttgctattgt

SEQ ID NO: 8569853 - DNA, 21 bp, Homo sapiens
tcatatttctcttgctattgt

SEQ ID NO: 8569854 - DNA, 21 bp, Homo sapiens
tcatatttctcttgctattgt

SEQ ID NO: 8569855 - DNA, 22 bp, Homo sapiens
tcatatttaggcctttaattca

SEQ ID NO: 8569856 - DNA, 22 bp, Homo sapiens
tcatatttaggcctttaattca

SEQ ID NO: 8569857 - DNA, 22 bp, Homo sapiens
tcatatttaggcctttaattca

SEQ ID NO: 8569858 - DNA, 22 bp, Homo sapiens
tcatattagggtaatgataaga

SEQ ID NO: 8569859 - DNA, 22 bp, Homo sapiens
tcatattagggtaatgataaga

SEQ ID NO: 8569860 - DNA, 22 bp, Homo sapiens
tcatattagggtaatgataaga

SEQ ID NO: 8569861 - DNA, 22 bp, Homo sapiens
tcatattagggtaatgataaga

SEQ ID NO: 8569862 - DNA, 22 bp, Homo sapiens
tcatataagtttaaaactatct

SEQ ID NO: 8569863 - DNA, 22 bp, Homo sapiens
tcatataagtttaaaactatct

SEQ ID NO: 8569864 - DNA, 22 bp, Homo sapiens
tcatataactggatattttcaa

SEQ ID NO: 8569865 - DNA, 22 bp, Homo sapiens
tcataggagtagcagtgagagg

SEQ ID NO: 8569866 - DNA, 22 bp, Homo sapiens
tcagtgttcgctcagggactcc

SEQ ID NO: 8569867 - DNA, 22 bp, Homo sapiens
tcagtgttcagggaccaggtcc

SEQ ID NO: 8569868 - DNA, 16 bp, Homo sapiens
tcagtgttccagaata

SEQ ID NO: 8569869 - DNA, 22 bp, Homo sapiens
tcagtgttcagcggtgtgtgca

SEQ ID NO: 8569870 - DNA, 22 bp, Homo sapiens
tcagtgttattagatgaggttt

SEQ ID NO: 8569871 - DNA, 22 bp, Homo sapiens
tcatattaacaatgaaactcag

SEQ ID NO: 8569872 - DNA, 22 bp, Homo sapiens
tcatattaacaatgaaactcag

SEQ ID NO: 8569873 - DNA, 22 bp, Homo sapiens
tcatataagtttaaaactatct

SEQ ID NO: 8569874 - DNA, 22 bp, Homo sapiens
tcatataccagagagtttatat

SEQ ID NO: 8569875 - DNA, 22 bp, Homo sapiens
tcatataagtttaaaactatct

SEQ ID NO: 8569876 - DNA, 22 bp, Homo sapiens
tcatatagagggcatacaaatg

SEQ ID NO: 8569877 - DNA, 23 bp, Homo sapiens
tcatggaactgggcaatcttgaa

SEQ ID NO: 8569878 - DNA, 22 bp, Homo sapiens
tcatggaaacagcaatgctaat

SEQ ID NO: 8569879 - DNA, 23 bp, Homo sapiens
tcatggaactgggcaatcttgaa

SEQ ID NO: 8569880 - DNA, 19 bp, Homo sapiens
tcatggaagaaatgtgata

SEQ ID NO: 8569881 - DNA, 23 bp, Homo sapiens
tcatggaactgggcaatcttgaa

SEQ ID NO: 8569882 - DNA, 22 bp, Homo sapiens
tcatggaagaggtattttttgt

SEQ ID NO: 8569883 - DNA, 22 bp, Homo sapiens
tcatggaagaaaggtttgtttc

SEQ ID NO: 8569884 - DNA, 19 bp, Homo sapiens
tcatggaagaaatgtgata

SEQ ID NO: 8569885 - DNA, 22 bp, Homo sapiens
tcatggaatagagcagtggcaa

SEQ ID NO: 8569886 - DNA, 20 bp, Homo sapiens
tcatggaatctcactctagt

SEQ ID NO: 8569887 - DNA, 20 bp, Homo sapiens
tcatggaatctcactctagt

SEQ ID NO: 8569888 - DNA, 20 bp, Homo sapiens
tcatggaatctcactctagt

SEQ ID NO: 8569889 - DNA, 22 bp, Homo sapiens
tcatggaagatgtagggtcagg

SEQ ID NO: 8569890 - DNA, 21 bp, Homo sapiens
tcatggaagtaacaaacatat

SEQ ID NO: 8569891 - DNA, 22 bp, Homo sapiens
tcatggaaggagtggccaagtg

SEQ ID NO: 8569892 - DNA, 22 bp, Homo sapiens
tcatggaatagagcagtggcaa

SEQ ID NO: 8569893 - DNA, 21 bp, Homo sapiens
tcatggaagtaacaaacatat

SEQ ID NO: 8569894 - DNA, 22 bp, Homo sapiens
tcatggaaggatgccctgcaag

SEQ ID NO: 8569895 - DNA, 22 bp, Homo sapiens
tcatgctttgttaatgtggcac

SEQ ID NO: 8569896 - DNA, 22 bp, Homo sapiens
tcatgctttggttgctgtcctt

SEQ ID NO: 8569897 - DNA, 22 bp, Homo sapiens
tcatggaaacagcaatgctaat

SEQ ID NO: 8569898 - DNA, 22 bp, Homo sapiens
tcatggaaacagcaatgctaat

SEQ ID NO: 8569899 - DNA, 22 bp, Homo sapiens
tcatggaaacaatgcggaaaaa

SEQ ID NO: 8569900 - DNA, 22 bp, Homo sapiens
tcatggaaacaatgcggaaaaa

SEQ ID NO: 8569901 - DNA, 22 bp, Homo sapiens
tcatgcttattgcatatttgga

SEQ ID NO: 8569902 - DNA, 22 bp, Homo sapiens
tcatgcttaaaagacacttgag

SEQ ID NO: 8569903 - DNA, 22 bp, Homo sapiens
tcatgctgtgaactgtatacat

SEQ ID NO: 8569904 - DNA, 22 bp, Homo sapiens
tcatggcagtttaataagtggt

SEQ ID NO: 8569905 - DNA, 22 bp, Homo sapiens
tcatggcacttagcacagtcct

SEQ ID NO: 8569906 - DNA, 22 bp, Homo sapiens
tcatggctctaaagacatagat

SEQ ID NO: 8569907 - DNA, 22 bp, Homo sapiens
tcatggctaaccaaggcctgat

SEQ ID NO: 8569908 - DNA, 22 bp, Homo sapiens
tcatggcattgttaagggtttt

SEQ ID NO: 8569909 - DNA, 22 bp, Homo sapiens
tcatggcacttagcacagtcct

SEQ ID NO: 8569910 - DNA, 21 bp, Homo sapiens
tcatggattttctctgctttt

SEQ ID NO: 8569911 - DNA, 22 bp, Homo sapiens
tcatggattaaattattaagtt

SEQ ID NO: 8569912 - DNA, 22 bp, Homo sapiens
tcatggagactttgagcctgtt

SEQ ID NO: 8569913 - DNA, 23 bp, Homo sapiens
tcatggaatgaattcttctgtta

SEQ ID NO: 8569914 - DNA, 23 bp, Homo sapiens
tcatggaatgaattcttctgtta

SEQ ID NO: 8569915 - DNA, 22 bp, Homo sapiens
tcatggagactttgagcctgtt

SEQ ID NO: 8569916 - DNA, 22 bp, Homo sapiens
tcatggataaaatattggttaa

SEQ ID NO: 8569917 - DNA, 22 bp, Homo sapiens
tcatggatgatagcttcattgc

SEQ ID NO: 8569918 - DNA, 22 bp, Homo sapiens
tcatggatgggcccagctctgt

SEQ ID NO: 8569919 - DNA, 22 bp, Homo sapiens
tcatggatgatagcttcattgc

SEQ ID NO: 8569920 - DNA, 22 bp, Homo sapiens
tcattataaacatatgctaaag

SEQ ID NO: 8569921 - DNA, 22 bp, Homo sapiens
tcattatcctagtatcttgaat

SEQ ID NO: 8569922 - DNA, 22 bp, Homo sapiens
tcattattctctttaatgttct

SEQ ID NO: 8569923 - DNA, 18 bp, Homo sapiens
tcattagggattgcaaag

SEQ ID NO: 8569924 - DNA, 22 bp, Homo sapiens
tcattacagtgtttatatgtct

SEQ ID NO: 8569925 - DNA, 20 bp, Homo sapiens
tcattacagtgctaagatgt

SEQ ID NO: 8569926 - DNA, 22 bp, Homo sapiens
tcattacagtgtttatatgtct

SEQ ID NO: 8569927 - DNA, 22 bp, Homo sapiens
tcattacacagttcagtggaaa

SEQ ID NO: 8569928 - DNA, 22 bp, Homo sapiens
tcattacagagatataatctac

SEQ ID NO: 8569929 - DNA, 22 bp, Homo sapiens
tcattacagagatataatctac

SEQ ID NO: 8569930 - DNA, 18 bp, Homo sapiens
tcattcaaagtctactga

SEQ ID NO: 8569931 - DNA, 18 bp, Homo sapiens
tcattcaaagtctactga

SEQ ID NO: 8569932 - DNA, 23 bp, Homo sapiens
tcattcaaggctggtatctttca

SEQ ID NO: 8569933 - DNA, 23 bp, Homo sapiens
tcattcaaggctggtatctttca

SEQ ID NO: 8569934 - DNA, 22 bp, Homo sapiens
tcattattttggactggagtgt

SEQ ID NO: 8569935 - DNA, 18 bp, Homo sapiens
tcattcaaagtctactga

SEQ ID NO: 8569936 - DNA, 22 bp, Homo sapiens
tcattcagagagaatgttccag

SEQ ID NO: 8569937 - DNA, 22 bp, Homo sapiens
tcattcaggttgggcaagtgtc

SEQ ID NO: 8569938 - DNA, 19 bp, Homo sapiens
tcattcaggaccagtggat

SEQ ID NO: 8569939 - DNA, 22 bp, Homo sapiens
tcattcataaaaattagttggc

SEQ ID NO: 8569940 - DNA, 22 bp, Homo sapiens
tcattcatactcttttctatta

SEQ ID NO: 8569941 - DNA, 22 bp, Homo sapiens
tcattgaacgaagagctccatt

SEQ ID NO: 8569942 - DNA, 16 bp, Homo sapiens
tcattgaagacagtac

SEQ ID NO: 8569943 - DNA, 22 bp, Homo sapiens
tcagctctacacacacctgtgt

SEQ ID NO: 8569944 - DNA, 22 bp, Homo sapiens
tcagctctacctgggagctgtc

SEQ ID NO: 8569945 - DNA, 22 bp, Homo sapiens
tcagctctacacacacctgtgt

SEQ ID NO: 8569946 - DNA, 22 bp, Homo sapiens
tcagctctacacacacctgtgt

SEQ ID NO: 8569947 - DNA, 22 bp, Homo sapiens
tcagctctacacacacctgtgt

SEQ ID NO: 8569948 - DNA, 22 bp, Homo sapiens
tcagctctaagttttatgcaaa

SEQ ID NO: 8569949 - DNA, 22 bp, Homo sapiens
tcagctctctgggctcgaacct

SEQ ID NO: 8569950 - DNA, 22 bp, Homo sapiens
tcagctctctgggctcgaacct

SEQ ID NO: 8569951 - DNA, 22 bp, Homo sapiens
tcagctctcacagatctcaacc

SEQ ID NO: 8569952 - DNA, 22 bp, Homo sapiens
tcagctctcacagatctcaacc

SEQ ID NO: 8569953 - DNA, 22 bp, Homo sapiens
tcagctcctcatgcaggggata

SEQ ID NO: 8569954 - DNA, 22 bp, Homo sapiens
tcagctctaagttttatgcaaa

SEQ ID NO: 8569955 - DNA, 22 bp, Homo sapiens
tcagctcctcatgcaggggata

SEQ ID NO: 8569956 - DNA, 22 bp, Homo sapiens
tcagctcctcagagcctcagtt

SEQ ID NO: 8569957 - DNA, 22 bp, Homo sapiens
tcagctccagagttgcacagtg

SEQ ID NO: 8569958 - DNA, 22 bp, Homo sapiens
tcagctcactctgcttcctggg

SEQ ID NO: 8569959 - DNA, 17 bp, Homo sapiens
tcagctcagagcacctg

SEQ ID NO: 8569960 - DNA, 16 bp, Homo sapiens
tcagctatagggattg

SEQ ID NO: 8569961 - DNA, 22 bp, Homo sapiens
tcagctatgaggtggtggttct

SEQ ID NO: 8569962 - DNA, 22 bp, Homo sapiens
tcagctattgagggtggtgagt

SEQ ID NO: 8569963 - DNA, 18 bp, Homo sapiens
tcagcctgttgtctgcct

SEQ ID NO: 8569964 - DNA, 18 bp, Homo sapiens
tcagcctgttgtctgcct

SEQ ID NO: 8569965 - DNA, 22 bp, Homo sapiens
tcagccttgtggccctgctcca

SEQ ID NO: 8569966 - DNA, 22 bp, Homo sapiens
tcagcctggtgattcctctgtc

SEQ ID NO: 8569967 - DNA, 22 bp, Homo sapiens
tcagcctggcaggatggcctgg

SEQ ID NO: 8569968 - DNA, 22 bp, Homo sapiens
tcagcctggcaggatggcctgg

SEQ ID NO: 8569969 - DNA, 22 bp, Homo sapiens
tcagcctggtgattcctctgtc

SEQ ID NO: 8569970 - DNA, 22 bp, Homo sapiens
tcagcctggtgattcctctgtc

SEQ ID NO: 8569971 - DNA, 22 bp, Homo sapiens
tcagcctggtgattcctctgtc

SEQ ID NO: 8569972 - DNA, 22 bp, Homo sapiens
tcagcctgcgtcatggtgacac

SEQ ID NO: 8569973 - DNA, 22 bp, Homo sapiens
tcagcaggcacggacaggctgc

SEQ ID NO: 8569974 - DNA, 22 bp, Homo sapiens
tcagcctgctccaagtgctgcc

SEQ ID NO: 8569975 - DNA, 22 bp, Homo sapiens
tcagcctgctccaagtgctgcc

SEQ ID NO: 8569976 - DNA, 22 bp, Homo sapiens
tcagcctgctccaagtgctgcc

SEQ ID NO: 8569977 - DNA, 22 bp, Homo sapiens
tcagcagaagtatagaggccat

SEQ ID NO: 8569978 - DNA, 21 bp, Homo sapiens
tcagcagaaggaccactaggg

SEQ ID NO: 8569979 - DNA, 21 bp, Homo sapiens
tcagcagcttttgcagtccct

SEQ ID NO: 8569980 - DNA, 21 bp, Homo sapiens
tcagcagcttttgcagtccct

SEQ ID NO: 8569981 - DNA, 22 bp, Homo sapiens
tcagcactttgaagcagaagga

SEQ ID NO: 8569982 - DNA, 22 bp, Homo sapiens
tcagcacttttactctctttgc

SEQ ID NO: 8569983 - DNA, 22 bp, Homo sapiens
tcaggaacttctaggaaagctg

SEQ ID NO: 8569984 - DNA, 22 bp, Homo sapiens
tcaggaaccctggtctcctgct

SEQ ID NO: 8569985 - DNA, 22 bp, Homo sapiens
tcaggaacatttaaccacaggg

SEQ ID NO: 8569986 - DNA, 22 bp, Homo sapiens
tcaggaacataatgtgagtcag

SEQ ID NO: 8569987 - DNA, 22 bp, Homo sapiens
tcagctctgcaaggtcacctcc

SEQ ID NO: 8569988 - DNA, 22 bp, Homo sapiens
tcagctctgcaaggtcacctcc

SEQ ID NO: 8569989 - DNA, 22 bp, Homo sapiens
tcagctctgcaaggtcacctcc

SEQ ID NO: 8569990 - DNA, 22 bp, Homo sapiens
tcagctctgcactccactgtgg

SEQ ID NO: 8569991 - DNA, 22 bp, Homo sapiens
tcagctctgcactccactgtgg

SEQ ID NO: 8569992 - DNA, 22 bp, Homo sapiens
tcaggaacacaggggcccatgc

SEQ ID NO: 8569993 - DNA, 22 bp, Homo sapiens
tcaggaagaaagaagggagtgt

SEQ ID NO: 8569994 - DNA, 22 bp, Homo sapiens
tcaggaagaaattctgtatctt

SEQ ID NO: 8569995 - DNA, 22 bp, Homo sapiens
tcaggaagaagacggggcagga

SEQ ID NO: 8569996 - DNA, 22 bp, Homo sapiens
tcaggaagacaatctttggctc

SEQ ID NO: 8569997 - DNA, 22 bp, Homo sapiens
tcaggaagcatcctgaggtgtc

SEQ ID NO: 8569998 - DNA, 22 bp, Homo sapiens
tcaggaagattagtttcctacc

SEQ ID NO: 8569999 - DNA, 21 bp, Homo sapiens
tcaggaagagcttctcccact

SEQ ID NO: 8570000 - DNA, 21 bp, Homo sapiens
tcaggaagagccagttcatgc

SEQ ID NO: 8570001 - DNA, 21 bp, Homo sapiens
tcaggaagagccagttcatgc

SEQ ID NO: 8570002 - DNA, 22 bp, Homo sapiens
tcaggaagccactccacagaga

SEQ ID NO: 8570003 - DNA, 22 bp, Homo sapiens
tcaggaagccggttaaatagat

SEQ ID NO: 8570004 - DNA, 22 bp, Homo sapiens
tcaggaagctcttgctgattct

SEQ ID NO: 8570005 - DNA, 22 bp, Homo sapiens
tcaggaagctactgccagcagc

SEQ ID NO: 8570006 - DNA, 22 bp, Homo sapiens
tcaggaaggagctggcctgcca

SEQ ID NO: 8570007 - DNA, 22 bp, Homo sapiens
tcaggaaggcaaattgcatgat

SEQ ID NO: 8570008 - DNA, 22 bp, Homo sapiens
tcaggaagctgctctgggtggt

SEQ ID NO: 8570009 - DNA, 22 bp, Homo sapiens
tcaggaagctgaattacaaaaa

SEQ ID NO: 8570010 - DNA, 22 bp, Homo sapiens
tcaggaaggcgccccatcagga

SEQ ID NO: 8570011 - DNA, 22 bp, Homo sapiens
tcaggaaggcttcacacgagtg

SEQ ID NO: 8570012 - DNA, 22 bp, Homo sapiens
tcaggaaggcacttggtgtgtt

SEQ ID NO: 8570013 - DNA, 22 bp, Homo sapiens
tcaggaagggctcagtctgtgc

SEQ ID NO: 8570014 - DNA, 22 bp, Homo sapiens
tcaggaggttgaccacggggca

SEQ ID NO: 8570015 - DNA, 22 bp, Homo sapiens
tcaggagtaaagaagacttgac

SEQ ID NO: 8570016 - DNA, 22 bp, Homo sapiens
tcaggagtaaagaagacttgac

SEQ ID NO: 8570017 - DNA, 22 bp, Homo sapiens
tcaggagtaagggtaacccaga

SEQ ID NO: 8570018 - DNA, 22 bp, Homo sapiens
tcaggagtaaagacagagttcc

SEQ ID NO: 8570019 - DNA, 22 bp, Homo sapiens
tcaggagtcctgcctgcagcct

SEQ ID NO: 8570020 - DNA, 22 bp, Homo sapiens
tcaggagtctgtgcagttccac

SEQ ID NO: 8570021 - DNA, 22 bp, Homo sapiens
tcaggagtcctgcctgcagcct

SEQ ID NO: 8570022 - DNA, 22 bp, Homo sapiens
tcaggagtcctgcctgcagcct

SEQ ID NO: 8570023 - DNA, 22 bp, Homo sapiens
tcaggagtactggtgtctacag

SEQ ID NO: 8570024 - DNA, 22 bp, Homo sapiens
tcaggagtaagttataagtatt

SEQ ID NO: 8570025 - DNA, 22 bp, Homo sapiens
tcaggagtactggtgtctacag

SEQ ID NO: 8570026 - DNA, 22 bp, Homo sapiens
tcaggctgggctcctctcccca

SEQ ID NO: 8570027 - DNA, 22 bp, Homo sapiens
tcaggctggggtgctaaggtgt

SEQ ID NO: 8570028 - DNA, 22 bp, Homo sapiens
tcaggctggggtgctaaggtgt

SEQ ID NO: 8570029 - DNA, 22 bp, Homo sapiens
tcaggctggggtgctaaggtgt

SEQ ID NO: 8570030 - DNA, 22 bp, Homo sapiens
tcaggctttttctcaacctctt

SEQ ID NO: 8570031 - DNA, 22 bp, Homo sapiens
tcaggctttttctcaacctctt

SEQ ID NO: 8570032 - DNA, 17 bp, Homo sapiens
tcaggctgggtgcagtg

SEQ ID NO: 8570033 - DNA, 18 bp, Homo sapiens
tcaggctgggcctccttc

SEQ ID NO: 8570034 - DNA, 18 bp, Homo sapiens
tcaggctgggcctccttc

SEQ ID NO: 8570035 - DNA, 22 bp, Homo sapiens
tcaggctgggctcctctcccca

SEQ ID NO: 8570036 - DNA, 22 bp, Homo sapiens
tcaggctgggagacaatcactg

SEQ ID NO: 8570037 - DNA, 22 bp, Homo sapiens
tcaggctgggagacaatcactg

SEQ ID NO: 8570038 - DNA, 22 bp, Homo sapiens
tcaggctggagtgcagtggcgc

SEQ ID NO: 8570039 - DNA, 22 bp, Homo sapiens
tcaggctggagtgcagtggcgc

SEQ ID NO: 8570040 - DNA, 22 bp, Homo sapiens
tcagggaacatcgttaaactag

SEQ ID NO: 8570041 - DNA, 22 bp, Homo sapiens
tcagggaacctctcctgtttct

SEQ ID NO: 8570042 - DNA, 22 bp, Homo sapiens
tcagggaacaatgttatggctt

SEQ ID NO: 8570043 - DNA, 22 bp, Homo sapiens
tcagggaaatttccatgtgttt

SEQ ID NO: 8570044 - DNA, 22 bp, Homo sapiens
tcagggaaacctaaggaagcca

SEQ ID NO: 8570045 - DNA, 22 bp, Homo sapiens
tcagggaaaggggagagtcatt

SEQ ID NO: 8570046 - DNA, 22 bp, Homo sapiens
tcaggctggaatgcagtggggc

SEQ ID NO: 8570047 - DNA, 22 bp, Homo sapiens
tcaggctggaatgcagtggggc

SEQ ID NO: 8570048 - DNA, 22 bp, Homo sapiens
tcaggctggaatgcagtggggc

SEQ ID NO: 8570049 - DNA, 22 bp, Homo sapiens
tcaggctggaatgcagtggggc

SEQ ID NO: 8570050 - DNA, 22 bp, Homo sapiens
tcaggctggaatgcagtggggc

SEQ ID NO: 8570051 - DNA, 22 bp, Homo sapiens
tcaggctggaatgcagtggggc

SEQ ID NO: 8570052 - DNA, 22 bp, Homo sapiens
tcaggctggagtgcagtggcgc

SEQ ID NO: 8570053 - DNA, 22 bp, Homo sapiens
tcaggctggagtgcagtggcgc

SEQ ID NO: 8570054 - DNA, 22 bp, Homo sapiens
tcaggctggagtgcagtggcgc

SEQ ID NO: 8570055 - DNA, 18 bp, Homo sapiens
tcaggctggaagtttgcc

SEQ ID NO: 8570056 - DNA, 18 bp, Homo sapiens
tcaggctggaagtttgcc

SEQ ID NO: 8570057 - DNA, 22 bp, Homo sapiens
tcaggctgctttcatgcttaga

SEQ ID NO: 8570058 - DNA, 22 bp, Homo sapiens
tcaggctgctttcatgcttaga

SEQ ID NO: 8570059 - DNA, 22 bp, Homo sapiens
tcaggctgctgtactgtgaatg

SEQ ID NO: 8570060 - DNA, 22 bp, Homo sapiens
tcaggctgaggtcatctgcatc

SEQ ID NO: 8570061 - DNA, 22 bp, Homo sapiens
tcaggctgctggccagcaggct

SEQ ID NO: 8570062 - DNA, 22 bp, Homo sapiens
tcaggctgataggaggaactga

SEQ ID NO: 8570063 - DNA, 22 bp, Homo sapiens
tcaggctgctggccagcaggct

SEQ ID NO: 8570064 - DNA, 22 bp, Homo sapiens
tcaggctgctggccagcaggct

SEQ ID NO: 8570065 - DNA, 22 bp, Homo sapiens
tcaggctgctggccagcaggct

SEQ ID NO: 8570066 - DNA, 20 bp, Homo sapiens
tcaggcagtggggaaaggca

SEQ ID NO: 8570067 - DNA, 20 bp, Homo sapiens
tcaggcagtggggaaaggca

SEQ ID NO: 8570068 - DNA, 20 bp, Homo sapiens
tcaggcagtggggaaaggca

SEQ ID NO: 8570069 - DNA, 20 bp, Homo sapiens
tcaggcagtggggaaaggca

SEQ ID NO: 8570070 - DNA, 22 bp, Homo sapiens
tcaggcagtggtaaatgagtta

SEQ ID NO: 8570071 - DNA, 19 bp, Homo sapiens
tcaggcagttattcacaaa

SEQ ID NO: 8570072 - DNA, 19 bp, Homo sapiens
tcaggcagttattcacaaa

SEQ ID NO: 8570073 - DNA, 22 bp, Homo sapiens
tcaggccaaagaaacagcatga

SEQ ID NO: 8570074 - DNA, 22 bp, Homo sapiens
tcaggccaaggtagacatgact

SEQ ID NO: 8570075 - DNA, 22 bp, Homo sapiens
tcaggcatggctcttcctcagg

SEQ ID NO: 8570076 - DNA, 19 bp, Homo sapiens
tcaggcagttattcacaaa

SEQ ID NO: 8570077 - DNA, 19 bp, Homo sapiens
tcaggcagttattcacaaa

SEQ ID NO: 8570078 - DNA, 19 bp, Homo sapiens
tcaggcagttattcacaaa

SEQ ID NO: 8570079 - DNA, 22 bp, Homo sapiens
tcaggcatgcattctgcaggtt

SEQ ID NO: 8570080 - DNA, 22 bp, Homo sapiens
tcaggcctgcagtgccaaccca

SEQ ID NO: 8570081 - DNA, 22 bp, Homo sapiens
tcaggccagcaccatccctatc

SEQ ID NO: 8570082 - DNA, 22 bp, Homo sapiens
tcaggccacttcacaggtgatt

SEQ ID NO: 8570083 - DNA, 22 bp, Homo sapiens
tcaggccacttcacaggtgatt

SEQ ID NO: 8570084 - DNA, 22 bp, Homo sapiens
tcaggccacggctcactgagac

SEQ ID NO: 8570085 - DNA, 22 bp, Homo sapiens
tcaggccacggctcactgagac

SEQ ID NO: 8570086 - DNA, 22 bp, Homo sapiens
tcaggagtgataccatttgtca

SEQ ID NO: 8570087 - DNA, 21 bp, Homo sapiens
tcaggagtggagagaattggt

SEQ ID NO: 8570088 - DNA, 22 bp, Homo sapiens
tcaggagtgccagtaccttttg

SEQ ID NO: 8570089 - DNA, 22 bp, Homo sapiens
tcaggagtgcagcagtttggag

SEQ ID NO: 8570090 - DNA, 19 bp, Homo sapiens
tcaggagttagttgtgctc

SEQ ID NO: 8570091 - DNA, 22 bp, Homo sapiens
tcaggagttgaaggggatcctg

SEQ ID NO: 8570092 - DNA, 22 bp, Homo sapiens
tcaggagtttggcctacagagg

SEQ ID NO: 8570093 - DNA, 22 bp, Homo sapiens
tcaggagtttcaggtgtaagtg

SEQ ID NO: 8570094 - DNA, 18 bp, Homo sapiens
tcaggagtttgtggatgg

SEQ ID NO: 8570095 - DNA, 22 bp, Homo sapiens
tcaggagtttggcctacagagg

SEQ ID NO: 8570096 - DNA, 22 bp, Homo sapiens
tcaggatgaagtcagaggggtc

SEQ ID NO: 8570097 - DNA, 22 bp, Homo sapiens
tcaggatgacttcaaggaggaa

SEQ ID NO: 8570098 - DNA, 22 bp, Homo sapiens
tcaggatgaccacgagcctcta

SEQ ID NO: 8570099 - DNA, 22 bp, Homo sapiens
tcaggcagtctgactccggagg

SEQ ID NO: 8570100 - DNA, 21 bp, Homo sapiens
tcaggcagtgcaaatacatgg

SEQ ID NO: 8570101 - DNA, 21 bp, Homo sapiens
tcaggcagtgcaaatacatgg

SEQ ID NO: 8570102 - DNA, 22 bp, Homo sapiens
tcaggcagtagaattgcttgaa

SEQ ID NO: 8570103 - DNA, 22 bp, Homo sapiens
tcaggcagtctgactccggagg

SEQ ID NO: 8570104 - DNA, 22 bp, Homo sapiens
tcaggatggcttctgcatcaaa

SEQ ID NO: 8570105 - DNA, 22 bp, Homo sapiens
tcaggatggagggaagcacaga

SEQ ID NO: 8570106 - DNA, 22 bp, Homo sapiens
tcacaagatacagttagaagca

SEQ ID NO: 8570107 - DNA, 22 bp, Homo sapiens
tcacaagagtaagttcatgcct

SEQ ID NO: 8570108 - DNA, 22 bp, Homo sapiens
tcacaagatatttcagtccttt

SEQ ID NO: 8570109 - DNA, 22 bp, Homo sapiens
tcacaagatatttcagtccttt

SEQ ID NO: 8570110 - DNA, 22 bp, Homo sapiens
tcacaatactcactcaatggct

SEQ ID NO: 8570111 - DNA, 22 bp, Homo sapiens
tcacaagagctggactgtcttt

SEQ ID NO: 8570112 - DNA, 22 bp, Homo sapiens
tcacaagagctggactgtcttt

SEQ ID NO: 8570113 - DNA, 22 bp, Homo sapiens
tcacaagagtaagttcatgcct

SEQ ID NO: 8570114 - DNA, 22 bp, Homo sapiens
tcacaaatagctatattaagga

SEQ ID NO: 8570115 - DNA, 22 bp, Homo sapiens
tcacaaacaatgctttggaatt

SEQ ID NO: 8570116 - DNA, 22 bp, Homo sapiens
tcacaaagctttgataagcaga

SEQ ID NO: 8570117 - DNA, 22 bp, Homo sapiens
tcacaaagctttgataagcaga

SEQ ID NO: 8570118 - DNA, 22 bp, Homo sapiens
tcacaaaagcttttgaatttgg

SEQ ID NO: 8570119 - DNA, 22 bp, Homo sapiens
tcacaaaagcttttgaatttgg

SEQ ID NO: 8570120 - DNA, 20 bp, Homo sapiens
tcaattttctacaacatttg

SEQ ID NO: 8570121 - DNA, 20 bp, Homo sapiens
tcaattttctacaacatttg

SEQ ID NO: 8570122 - DNA, 22 bp, Homo sapiens
tcacagaaaagctgagcatcag

SEQ ID NO: 8570123 - DNA, 22 bp, Homo sapiens
tcacagaaaagctgagcatcag

SEQ ID NO: 8570124 - DNA, 20 bp, Homo sapiens
tcacacatggtaagctatga

SEQ ID NO: 8570125 - DNA, 22 bp, Homo sapiens
tcacactttccatggctgttaa

SEQ ID NO: 8570126 - DNA, 22 bp, Homo sapiens
tcacacatgctaagccagagat

SEQ ID NO: 8570127 - DNA, 22 bp, Homo sapiens
tcacacatgagtaaatacaggg

SEQ ID NO: 8570128 - DNA, 22 bp, Homo sapiens
tcacaattcagaaaccaagtag

SEQ ID NO: 8570129 - DNA, 20 bp, Homo sapiens
tcacaatatgagctcataca

SEQ ID NO: 8570130 - DNA, 20 bp, Homo sapiens
tcacaatatgagctcataca

SEQ ID NO: 8570131 - DNA, 22 bp, Homo sapiens
tcacaatactcactcaatggct

SEQ ID NO: 8570132 - DNA, 22 bp, Homo sapiens
tcacaatactcactcaatggct

SEQ ID NO: 8570133 - DNA, 22 bp, Homo sapiens
tcacaatatttatcttccaatt

SEQ ID NO: 8570134 - DNA, 22 bp, Homo sapiens
tcacaatatttatcttccaatt

SEQ ID NO: 8570135 - DNA, 22 bp, Homo sapiens
tcacaatgaaaaacactacata

SEQ ID NO: 8570136 - DNA, 22 bp, Homo sapiens
tcacaatatgggtgtgggaact

SEQ ID NO: 8570137 - DNA, 22 bp, Homo sapiens
tcacaatatttatcttccaatt

SEQ ID NO: 8570138 - DNA, 22 bp, Homo sapiens
tcacaatatttatcttccaatt

SEQ ID NO: 8570139 - DNA, 22 bp, Homo sapiens
tcacagaagaagtagattgcat

SEQ ID NO: 8570140 - DNA, 22 bp, Homo sapiens
tcacagaacaatgtttagttct

SEQ ID NO: 8570141 - DNA, 22 bp, Homo sapiens
tcacagaacacaaatgccactt

SEQ ID NO: 8570142 - DNA, 22 bp, Homo sapiens
tcacagaagagcattaagatga

SEQ ID NO: 8570143 - DNA, 22 bp, Homo sapiens
tcacagaaataagatagttatt

SEQ ID NO: 8570144 - DNA, 22 bp, Homo sapiens
tcacagaaagctgtgtcctgac

SEQ ID NO: 8570145 - DNA, 22 bp, Homo sapiens
tcacagaaagctgtgtcctgac

SEQ ID NO: 8570146 - DNA, 22 bp, Homo sapiens
tcacagaaataagatagttatt

SEQ ID NO: 8570147 - DNA, 22 bp, Homo sapiens
tcacagaacaagcctggtggag

SEQ ID NO: 8570148 - DNA, 22 bp, Homo sapiens
tcacagaacaagcctggtggag

SEQ ID NO: 8570149 - DNA, 22 bp, Homo sapiens
tcacagtacatgattcagtggt

SEQ ID NO: 8570150 - DNA, 22 bp, Homo sapiens
tcacagtaaaagcatggaagag

SEQ ID NO: 8570151 - DNA, 22 bp, Homo sapiens
tcacagtactgtgactattgac

SEQ ID NO: 8570152 - DNA, 23 bp, Homo sapiens
tcacaggggccagcgctctgtgg

SEQ ID NO: 8570153 - DNA, 20 bp, Homo sapiens
tcacaggggaccaggagcag

SEQ ID NO: 8570154 - DNA, 22 bp, Homo sapiens
tcacagggcattatggctccag

SEQ ID NO: 8570155 - DNA, 22 bp, Homo sapiens
tcacagggtttggaagcctcct

SEQ ID NO: 8570156 - DNA, 21 bp, Homo sapiens
tcacaggtcaatgtgtgaagg

SEQ ID NO: 8570157 - DNA, 22 bp, Homo sapiens
tcacagggtgtacatcacctat

SEQ ID NO: 8570158 - DNA, 22 bp, Homo sapiens
tcacagggtatctgggatggat

SEQ ID NO: 8570159 - DNA, 22 bp, Homo sapiens
tcacaggctaaatttatgcagg

SEQ ID NO: 8570160 - DNA, 21 bp, Homo sapiens
tcacaggctcagggagagagt

SEQ ID NO: 8570161 - DNA, 22 bp, Homo sapiens
tcacaggctccagggcctggat

SEQ ID NO: 8570162 - DNA, 22 bp, Homo sapiens
tcacaggcctggggcagagggc

SEQ ID NO: 8570163 - DNA, 22 bp, Homo sapiens
tcacagggatggaatagaaata

SEQ ID NO: 8570164 - DNA, 23 bp, Homo sapiens
tcacagggcactggctggggttg

SEQ ID NO: 8570165 - DNA, 22 bp, Homo sapiens
tcacaggagtcaaggaatagta

SEQ ID NO: 8570166 - DNA, 19 bp, Homo sapiens
tcacaggcatctccccaga

SEQ ID NO: 8570167 - DNA, 22 bp, Homo sapiens
tcacagctccagactgcaactc

SEQ ID NO: 8570168 - DNA, 22 bp, Homo sapiens
tcacagctctgtcaattttata

SEQ ID NO: 8570169 - DNA, 22 bp, Homo sapiens
tcacagctgagtttccatttct

SEQ ID NO: 8570170 - DNA, 22 bp, Homo sapiens
tcacagctgagtttccatttct

SEQ ID NO: 8570171 - DNA, 22 bp, Homo sapiens
tcacagaataaatgtactggcc

SEQ ID NO: 8570172 - DNA, 22 bp, Homo sapiens
tcacagaataaatgtactggcc

SEQ ID NO: 8570173 - DNA, 22 bp, Homo sapiens
tcacagaataaattgagaagac

SEQ ID NO: 8570174 - DNA, 22 bp, Homo sapiens
tcacagctattctcatgtattt

SEQ ID NO: 8570175 - DNA, 22 bp, Homo sapiens
tcacagaataaattgagaagac

SEQ ID NO: 8570176 - DNA, 22 bp, Homo sapiens
tcacagaagggaaagatgccaa

SEQ ID NO: 8570177 - DNA, 22 bp, Homo sapiens
tcacagaagggaaagatgccaa

SEQ ID NO: 8570178 - DNA, 22 bp, Homo sapiens
tcacagaagggaaagatgccaa

SEQ ID NO: 8570179 - DNA, 22 bp, Homo sapiens
tcacagaagtgtagtgaggaaa

SEQ ID NO: 8570180 - DNA, 22 bp, Homo sapiens
tcacagaaggtggccatagctg

SEQ ID NO: 8570181 - DNA, 22 bp, Homo sapiens
tcacagaagtgtgtttcaggag

SEQ ID NO: 8570182 - DNA, 22 bp, Homo sapiens
tcacagaagttgaatttgcatg

SEQ ID NO: 8570183 - DNA, 22 bp, Homo sapiens
tcacagaagcatcatacccgga

SEQ ID NO: 8570184 - DNA, 22 bp, Homo sapiens
tcacagaagatgctggatgttg

SEQ ID NO: 8570185 - DNA, 22 bp, Homo sapiens
tcacagaagatgctggatgttg

SEQ ID NO: 8570186 - DNA, 22 bp, Homo sapiens
tcacagaagccctcgcaaacta

SEQ ID NO: 8570187 - DNA, 22 bp, Homo sapiens
tcacagaaggagggaagctagt

SEQ ID NO: 8570188 - DNA, 22 bp, Homo sapiens
tcacagaaggcatcacagaaga

SEQ ID NO: 8570189 - DNA, 22 bp, Homo sapiens
tcacagaaggaccttgtttcat

SEQ ID NO: 8570190 - DNA, 22 bp, Homo sapiens
tcaagtctggagatctggaact

SEQ ID NO: 8570191 - DNA, 19 bp, Homo sapiens
tcaagtcctaggcccacaa

SEQ ID NO: 8570192 - DNA, 22 bp, Homo sapiens
tcaagtatttatttctgctggc

SEQ ID NO: 8570193 - DNA, 22 bp, Homo sapiens
tcaaggtgctgtgctgtgctag

SEQ ID NO: 8570194 - DNA, 22 bp, Homo sapiens
tcaagggaggagacacagccct

SEQ ID NO: 8570195 - DNA, 22 bp, Homo sapiens
tcaaggctattaattctgtgag

SEQ ID NO: 8570196 - DNA, 19 bp, Homo sapiens
tcaaggctccctgagggat

SEQ ID NO: 8570197 - DNA, 22 bp, Homo sapiens
tcaaggctaaactttcagagta

SEQ ID NO: 8570198 - DNA, 22 bp, Homo sapiens
tcaaggaggtgcttggcttcac

SEQ ID NO: 8570199 - DNA, 22 bp, Homo sapiens
tcaagtcttgatgagacaaacc

SEQ ID NO: 8570200 - DNA, 22 bp, Homo sapiens
tcaagttaggtggttgttagga

SEQ ID NO: 8570201 - DNA, 22 bp, Homo sapiens
tcaagtgtagtggtgtcaggtc

SEQ ID NO: 8570202 - DNA, 22 bp, Homo sapiens
tcaagtgcttgtgaggtatttg

SEQ ID NO: 8570203 - DNA, 20 bp, Homo sapiens
tcaagttttgcttgacaaga

SEQ ID NO: 8570204 - DNA, 22 bp, Homo sapiens
tcaagttaggtggttgttagga

SEQ ID NO: 8570205 - DNA, 22 bp, Homo sapiens
tcaagttcacagtctggtcgct

SEQ ID NO: 8570206 - DNA, 23 bp, Homo sapiens
tcaataactcgggttaaaataga

SEQ ID NO: 8570207 - DNA, 20 bp, Homo sapiens
tcaagttttgcttgacaaga

SEQ ID NO: 8570208 - DNA, 22 bp, Homo sapiens
tcaataaaattgttttcctatc

SEQ ID NO: 8570209 - DNA, 22 bp, Homo sapiens
tcaatttcccctattgatagac

SEQ ID NO: 8570210 - DNA, 22 bp, Homo sapiens
tcaatttcttggtttgataata

SEQ ID NO: 8570211 - DNA, 22 bp, Homo sapiens
tcaatttcttggtttgataata

SEQ ID NO: 8570212 - DNA, 22 bp, Homo sapiens
tcaattttatgaaacaaagtga

SEQ ID NO: 8570213 - DNA, 21 bp, Homo sapiens
tcaatacaggtgcatgtgtct

SEQ ID NO: 8570214 - DNA, 17 bp, Homo sapiens
tcaatacactgctttta

SEQ ID NO: 8570215 - DNA, 22 bp, Homo sapiens
tcaatacagaaaggatattttg

SEQ ID NO: 8570216 - DNA, 22 bp, Homo sapiens
tcaataatggcaggataaattt

SEQ ID NO: 8570217 - DNA, 22 bp, Homo sapiens
tcaatacacatgccgctgttct

SEQ ID NO: 8570218 - DNA, 20 bp, Homo sapiens
tcaagacagacatggagttt

SEQ ID NO: 8570219 - DNA, 20 bp, Homo sapiens
tcaagacagacatggagttt

SEQ ID NO: 8570220 - DNA, 22 bp, Homo sapiens
tcaagaatttggataagaaatg

SEQ ID NO: 8570221 - DNA, 22 bp, Homo sapiens
tatttcttgagtggtcagtttc

SEQ ID NO: 8570222 - DNA, 22 bp, Homo sapiens
tatttcttgagactcgtcttcc

SEQ ID NO: 8570223 - DNA, 22 bp, Homo sapiens
tatttcttgagactcgtcttcc

SEQ ID NO: 8570224 - DNA, 22 bp, Homo sapiens
tatttcttcgggattcaagcta

SEQ ID NO: 8570225 - DNA, 22 bp, Homo sapiens
tatttcttcgggattcaagcta

SEQ ID NO: 8570226 - DNA, 22 bp, Homo sapiens
tatttctgtcagccagatatgg

SEQ ID NO: 8570227 - DNA, 22 bp, Homo sapiens
tatttctgtatgcataaaagga

SEQ ID NO: 8570228 - DNA, 22 bp, Homo sapiens
tatttctgtatgcataaaagga

SEQ ID NO: 8570229 - DNA, 22 bp, Homo sapiens
tatttctgtaactcagggtctg

SEQ ID NO: 8570230 - DNA, 22 bp, Homo sapiens
tatttctgtatgcataaaagga

SEQ ID NO: 8570231 - DNA, 22 bp, Homo sapiens
tatttctgtcagccagatatgg

SEQ ID NO: 8570232 - DNA, 22 bp, Homo sapiens
tatttctgtcagccagatatgg

SEQ ID NO: 8570233 - DNA, 22 bp, Homo sapiens
tatttctgtttatttgtacatc

SEQ ID NO: 8570234 - DNA, 22 bp, Homo sapiens
tatttctgtttatttgtacatc

SEQ ID NO: 8570235 - DNA, 22 bp, Homo sapiens
tatttctgggagttcagaaatt

SEQ ID NO: 8570236 - DNA, 22 bp, Homo sapiens
tatttctgggagttcagaaatt

SEQ ID NO: 8570237 - DNA, 22 bp, Homo sapiens
tatttctgggagttcagaaatt

SEQ ID NO: 8570238 - DNA, 20 bp, Homo sapiens
tatttctgggcaaccattta

SEQ ID NO: 8570239 - DNA, 20 bp, Homo sapiens
tatttctgggcaaccattta

SEQ ID NO: 8570240 - DNA, 20 bp, Homo sapiens
tatttctgggcaaccattta

SEQ ID NO: 8570241 - DNA, 20 bp, Homo sapiens
tatttctgggcaaccattta

SEQ ID NO: 8570242 - DNA, 22 bp, Homo sapiens
tatttctggctttgagggtgat

SEQ ID NO: 8570243 - DNA, 22 bp, Homo sapiens
tatttctgattgctcatgaggc

SEQ ID NO: 8570244 - DNA, 22 bp, Homo sapiens
tatttctgggagttcagaaatt

SEQ ID NO: 8570245 - DNA, 22 bp, Homo sapiens
tatttctgaggcccaggaagtg

SEQ ID NO: 8570246 - DNA, 22 bp, Homo sapiens
tatttctgattgctcatgaggc

SEQ ID NO: 8570247 - DNA, 22 bp, Homo sapiens
tatttctgattgctcatgaggc

SEQ ID NO: 8570248 - DNA, 22 bp, Homo sapiens
tatttctgaggcccaggaagtg

SEQ ID NO: 8570249 - DNA, 22 bp, Homo sapiens
tatttctgaggcccaggaagtg

SEQ ID NO: 8570250 - DNA, 22 bp, Homo sapiens
tcaagagttggtcaaatccaaa

SEQ ID NO: 8570251 - DNA, 22 bp, Homo sapiens
tcaagctggctgttgctatttc

SEQ ID NO: 8570252 - DNA, 22 bp, Homo sapiens
tcaaggaaggtctgttgctcca

SEQ ID NO: 8570253 - DNA, 22 bp, Homo sapiens
tcaaggaagggatattcttgaa

SEQ ID NO: 8570254 - DNA, 22 bp, Homo sapiens
tcaaggagacagaaagcaatgg

SEQ ID NO: 8570255 - DNA, 22 bp, Homo sapiens
tcaaggactattgcatgactcc

SEQ ID NO: 8570256 - DNA, 22 bp, Homo sapiens
tcaagacagatgggtaacttgg

SEQ ID NO: 8570257 - DNA, 22 bp, Homo sapiens
tcaagacagatgggtaacttgg

SEQ ID NO: 8570258 - DNA, 21 bp, Homo sapiens
tcaagacagcatatttaagaa

SEQ ID NO: 8570259 - DNA, 22 bp, Homo sapiens
tcaagacagggtttaaggttga

SEQ ID NO: 8570260 - DNA, 22 bp, Homo sapiens
tcaagacatcactgtgcatttt

SEQ ID NO: 8570261 - DNA, 22 bp, Homo sapiens
tcaagacatattaaatgtgcga

SEQ ID NO: 8570262 - DNA, 22 bp, Homo sapiens
tcaagacatcactgtgcatttt

SEQ ID NO: 8570263 - DNA, 22 bp, Homo sapiens
tcaagacagtgtgatactggcc

SEQ ID NO: 8570264 - DNA, 22 bp, Homo sapiens
tcaagacagtgtgatactggcc

SEQ ID NO: 8570265 - DNA, 22 bp, Homo sapiens
tcaagacatattaaatgtgcga

SEQ ID NO: 8570266 - DNA, 22 bp, Homo sapiens
tcaagagagtgctgcttggggt

SEQ ID NO: 8570267 - DNA, 22 bp, Homo sapiens
tcaagagattgaataataactg

SEQ ID NO: 8570268 - DNA, 22 bp, Homo sapiens
tcaagagattgaataataactg

SEQ ID NO: 8570269 - DNA, 18 bp, Homo sapiens
tcaagacatcatgaaata

SEQ ID NO: 8570270 - DNA, 22 bp, Homo sapiens
tcaagagaaggggaaatagact

SEQ ID NO: 8570271 - DNA, 18 bp, Homo sapiens
tcaagacatcatgaaata

SEQ ID NO: 8570272 - DNA, 18 bp, Homo sapiens
tcaagacatcatgaaata

SEQ ID NO: 8570273 - DNA, 22 bp, Homo sapiens
tcaagagaaggggaaatagact

SEQ ID NO: 8570274 - DNA, 22 bp, Homo sapiens
tcaagagaagtgctccacagta

SEQ ID NO: 8570275 - DNA, 22 bp, Homo sapiens
tcaagagacaggacgtgtttca

SEQ ID NO: 8570276 - DNA, 22 bp, Homo sapiens
tcactacattttagacagtaaa

SEQ ID NO: 8570277 - DNA, 22 bp, Homo sapiens
tcactactgacagagatgtgta

SEQ ID NO: 8570278 - DNA, 22 bp, Homo sapiens
tcactacaacctccgcctcctg

SEQ ID NO: 8570279 - DNA, 22 bp, Homo sapiens
tcactacaacctccgcctcctg

SEQ ID NO: 8570280 - DNA, 22 bp, Homo sapiens
tcactacaacctccgcctcctg

SEQ ID NO: 8570281 - DNA, 22 bp, Homo sapiens
tcactagtcatcaacttccatt

SEQ ID NO: 8570282 - DNA, 20 bp, Homo sapiens
tcactagtaaccatctgctt

SEQ ID NO: 8570283 - DNA, 21 bp, Homo sapiens
tcactagtgccttctgtcatt

SEQ ID NO: 8570284 - DNA, 22 bp, Homo sapiens
tcactacaacctccgcctcctg

SEQ ID NO: 8570285 - DNA, 22 bp, Homo sapiens
tcacccaggctggtatgcagtg

SEQ ID NO: 8570286 - DNA, 22 bp, Homo sapiens
tcacccaggctggagtgtagtg

SEQ ID NO: 8570287 - DNA, 22 bp, Homo sapiens
tcacccaggctggactgcagtg

SEQ ID NO: 8570288 - DNA, 22 bp, Homo sapiens
tcacccaggctggagtgcagtg

SEQ ID NO: 8570289 - DNA, 22 bp, Homo sapiens
tcacccaggctggagtgcagtg

SEQ ID NO: 8570290 - DNA, 22 bp, Homo sapiens
tcacccagccttggcgggtttg

SEQ ID NO: 8570291 - DNA, 22 bp, Homo sapiens
tcacccagccttggcgggtttg

SEQ ID NO: 8570292 - DNA, 22 bp, Homo sapiens
tcacccagcgggcgcacactcg

SEQ ID NO: 8570293 - DNA, 22 bp, Homo sapiens
tcacccaggatattgaagtcag

SEQ ID NO: 8570294 - DNA, 22 bp, Homo sapiens
tcacccaggctggactgcagtg

SEQ ID NO: 8570295 - DNA, 22 bp, Homo sapiens
tcacccaggctggactgcagtg

SEQ ID NO: 8570296 - DNA, 19 bp, Homo sapiens
tcacccaggctgctggctc

SEQ ID NO: 8570297 - DNA, 22 bp, Homo sapiens
tcacccagcagctgcttctgct

SEQ ID NO: 8570298 - DNA, 22 bp, Homo sapiens
tcaccaataataacttgagaat

SEQ ID NO: 8570299 - DNA, 22 bp, Homo sapiens
tcaccaccagaagagctattct

SEQ ID NO: 8570300 - DNA, 22 bp, Homo sapiens
tcaccactcactcaggcaagtc

SEQ ID NO: 8570301 - DNA, 22 bp, Homo sapiens
tcaccactaggaattgtgtagt

SEQ ID NO: 8570302 - DNA, 22 bp, Homo sapiens
tcaccaaggcattttcacagca

SEQ ID NO: 8570303 - DNA, 22 bp, Homo sapiens
tcaccactgaacagacctttgg

SEQ ID NO: 8570304 - DNA, 22 bp, Homo sapiens
tcaccactgaacagacctttgg

SEQ ID NO: 8570305 - DNA, 22 bp, Homo sapiens
tcacagtagttgttctctgttt

SEQ ID NO: 8570306 - DNA, 22 bp, Homo sapiens
tcacagtataacctcatatagg

SEQ ID NO: 8570307 - DNA, 22 bp, Homo sapiens
tcacagtagttgttctctgttt

SEQ ID NO: 8570308 - DNA, 22 bp, Homo sapiens
tcacagtagttgttctctgttt

SEQ ID NO: 8570309 - DNA, 22 bp, Homo sapiens
tcacagtataacctcatatagg

SEQ ID NO: 8570310 - DNA, 22 bp, Homo sapiens
tcacattttatctgagattgac

SEQ ID NO: 8570311 - DNA, 22 bp, Homo sapiens
tcacattttcatattctctgag

SEQ ID NO: 8570312 - DNA, 22 bp, Homo sapiens
tcacagtatagagttattttgg

SEQ ID NO: 8570313 - DNA, 22 bp, Homo sapiens
tcacattttatctattttaagt

SEQ ID NO: 8570314 - DNA, 22 bp, Homo sapiens
tcacattttccttggtatctgt

SEQ ID NO: 8570315 - DNA, 22 bp, Homo sapiens
tcacattttcatattctctgag

SEQ ID NO: 8570316 - DNA, 22 bp, Homo sapiens
tcacattttctactactgtacg

SEQ ID NO: 8570317 - DNA, 22 bp, Homo sapiens
tcacattttctactactgtacg

SEQ ID NO: 8570318 - DNA, 22 bp, Homo sapiens
tcacattttctactactgtacg

SEQ ID NO: 8570319 - DNA, 22 bp, Homo sapiens
tcactctgttttactcactgtt

SEQ ID NO: 8570320 - DNA, 22 bp, Homo sapiens
tcactctgttttactcactgtt

SEQ ID NO: 8570321 - DNA, 22 bp, Homo sapiens
tcactgaaaaccatacttcttt

SEQ ID NO: 8570322 - DNA, 22 bp, Homo sapiens
tcactgaaacctccacctctcg

SEQ ID NO: 8570323 - DNA, 22 bp, Homo sapiens
tcactgaaaaccatacttcttt

SEQ ID NO: 8570324 - DNA, 22 bp, Homo sapiens
tcactctttatcttttatgtct

SEQ ID NO: 8570325 - DNA, 22 bp, Homo sapiens
tcactgaactctcatagagaaa

SEQ ID NO: 8570326 - DNA, 22 bp, Homo sapiens
tcactgaactctcatagagaaa

SEQ ID NO: 8570327 - DNA, 22 bp, Homo sapiens
tcactgaaccagggatctctag

SEQ ID NO: 8570328 - DNA, 22 bp, Homo sapiens
tcactgaaccagggatctctag

SEQ ID NO: 8570329 - DNA, 22 bp, Homo sapiens
tcactgaaagaatgacattatg

SEQ ID NO: 8570330 - DNA, 22 bp, Homo sapiens
tcactgaaagtaattctagtga

SEQ ID NO: 8570331 - DNA, 22 bp, Homo sapiens
tcactctgtgtttccctgggac

SEQ ID NO: 8570332 - DNA, 22 bp, Homo sapiens
tcactctgtgtttgaactcaag

SEQ ID NO: 8570333 - DNA, 22 bp, Homo sapiens
tcactgatgcttatgaaagtgt

SEQ ID NO: 8570334 - DNA, 22 bp, Homo sapiens
tcactgacgtggggctacttga

SEQ ID NO: 8570335 - DNA, 22 bp, Homo sapiens
tcactgaatttcaagctagtgg

SEQ ID NO: 8570336 - DNA, 22 bp, Homo sapiens
tcactgaatacttgtctcatcc

SEQ ID NO: 8570337 - DNA, 22 bp, Homo sapiens
tcactgaatacttgtctcatcc

SEQ ID NO: 8570338 - DNA, 22 bp, Homo sapiens
tcactgaatgcagatacgtgac

SEQ ID NO: 8570339 - DNA, 22 bp, Homo sapiens
tcactgaatacttgtctcatcc

SEQ ID NO: 8570340 - DNA, 22 bp, Homo sapiens
tcactgaagtcttcaagtagga

SEQ ID NO: 8570341 - DNA, 22 bp, Homo sapiens
tcactgaagtcttcaagtagga

SEQ ID NO: 8570342 - DNA, 22 bp, Homo sapiens
tcactgaaggaagacactgtca

SEQ ID NO: 8570343 - DNA, 21 bp, Homo sapiens
tcactgaagcctaagatgttt

SEQ ID NO: 8570344 - DNA, 21 bp, Homo sapiens
tcactgaagcctaagatgttt

SEQ ID NO: 8570345 - DNA, 21 bp, Homo sapiens
tcactgaagcctaagatgttt

SEQ ID NO: 8570346 - DNA, 22 bp, Homo sapiens
tcactgaagactgggctctaaa

SEQ ID NO: 8570347 - DNA, 22 bp, Homo sapiens
tcactgaagactgggctctaaa

SEQ ID NO: 8570348 - DNA, 21 bp, Homo sapiens
tcactgaagcctaagatgttt

SEQ ID NO: 8570349 - DNA, 22 bp, Homo sapiens
tcactgaactctcatagagaaa

SEQ ID NO: 8570350 - DNA, 22 bp, Homo sapiens
tcacttcttcccttgcacatat

SEQ ID NO: 8570351 - DNA, 22 bp, Homo sapiens
tcacttcttcagctttccttga

SEQ ID NO: 8570352 - DNA, 19 bp, Homo sapiens
tcacttctgttagcatgga

SEQ ID NO: 8570353 - DNA, 22 bp, Homo sapiens
tcactgttagagcaaacgtatg

SEQ ID NO: 8570354 - DNA, 22 bp, Homo sapiens
tcacttctgaaggtagttggca

SEQ ID NO: 8570355 - DNA, 22 bp, Homo sapiens
tcactgttaataaatagcaaag

SEQ ID NO: 8570356 - DNA, 23 bp, Homo sapiens
tcacttgaagctagaatctgccc

SEQ ID NO: 8570357 - DNA, 23 bp, Homo sapiens
tcacttgaagctagaatctgccc

SEQ ID NO: 8570358 - DNA, 22 bp, Homo sapiens
tcacttgaacctgggaggcaga

SEQ ID NO: 8570359 - DNA, 22 bp, Homo sapiens
tcacttgacccttctctagcct

SEQ ID NO: 8570360 - DNA, 22 bp, Homo sapiens
tcacttgacccttctctagcct

SEQ ID NO: 8570361 - DNA, 22 bp, Homo sapiens
tcacttgacctcttgaactcct

SEQ ID NO: 8570362 - DNA, 19 bp, Homo sapiens
tcacttgaagttcagaaat

SEQ ID NO: 8570363 - DNA, 22 bp, Homo sapiens
tcacttgaattcattctgcgaa

SEQ ID NO: 8570364 - DNA, 22 bp, Homo sapiens
tcacttgaattcattctgcgaa

SEQ ID NO: 8570365 - DNA, 22 bp, Homo sapiens
tcacttgactccagtttcttct

SEQ ID NO: 8570366 - DNA, 22 bp, Homo sapiens
tcacttgactttccagtcttgg

SEQ ID NO: 8570367 - DNA, 22 bp, Homo sapiens
tcacttgagagatattagaagt

SEQ ID NO: 8570368 - DNA, 22 bp, Homo sapiens
tcacttgactttccagtcttgg

SEQ ID NO: 8570369 - DNA, 22 bp, Homo sapiens
tcacttgagatgtaccacaaac

SEQ ID NO: 8570370 - DNA, 22 bp, Homo sapiens
tcacttgatccttccctgaaat

SEQ ID NO: 8570371 - DNA, 22 bp, Homo sapiens
tcacttgcctagcccagttcag

SEQ ID NO: 8570372 - DNA, 22 bp, Homo sapiens
tcactttgacagagaaatgaat

SEQ ID NO: 8570373 - DNA, 22 bp, Homo sapiens
tcactttgacggccaacttcta

SEQ ID NO: 8570374 - DNA, 22 bp, Homo sapiens
tcactttggattatgtaatttc

SEQ ID NO: 8570375 - DNA, 22 bp, Homo sapiens
tcactttggattatgtaatttc

SEQ ID NO: 8570376 - DNA, 22 bp, Homo sapiens
tcactttgccctgtaccttggg

SEQ ID NO: 8570377 - DNA, 22 bp, Homo sapiens
tcactttacagctaaggttgtt

SEQ ID NO: 8570378 - DNA, 22 bp, Homo sapiens
tcactttacagatgggaaaact

SEQ ID NO: 8570379 - DNA, 22 bp, Homo sapiens
tcactttactttgttaatctgg

SEQ ID NO: 8570380 - DNA, 22 bp, Homo sapiens
tcactttactttgttaatctgg

SEQ ID NO: 8570381 - DNA, 22 bp, Homo sapiens
tcactttagaggaaacattgag

SEQ ID NO: 8570382 - DNA, 22 bp, Homo sapiens
tcactttagaggaaacattgag

SEQ ID NO: 8570383 - DNA, 22 bp, Homo sapiens
tcagaggaaacaatctttagta

SEQ ID NO: 8570384 - DNA, 22 bp, Homo sapiens
tcagaggaaagggaacatagtc

SEQ ID NO: 8570385 - DNA, 22 bp, Homo sapiens
tcagaggaaacaatctttagta

SEQ ID NO: 8570386 - DNA, 22 bp, Homo sapiens
tcagaggaaagggaacatagtc

SEQ ID NO: 8570387 - DNA, 22 bp, Homo sapiens
tcagaggaaagggaacatagtc

SEQ ID NO: 8570388 - DNA, 22 bp, Homo sapiens
tcagaggaacactgtttcatgc

SEQ ID NO: 8570389 - DNA, 22 bp, Homo sapiens
tcagaggaacactgtttcatgc

SEQ ID NO: 8570390 - DNA, 22 bp, Homo sapiens
tcagaggaaaggtcagatggct

SEQ ID NO: 8570391 - DNA, 22 bp, Homo sapiens
tcagaggaacactgtttcatgc

SEQ ID NO: 8570392 - DNA, 22 bp, Homo sapiens
tcagaggaaaggtcagatggct

SEQ ID NO: 8570393 - DNA, 22 bp, Homo sapiens
tcagaggaaaggtcagatggct

SEQ ID NO: 8570394 - DNA, 22 bp, Homo sapiens
tcagaggaagcatcaagttctc

SEQ ID NO: 8570395 - DNA, 22 bp, Homo sapiens
tcagcaagcagggggatgttca

SEQ ID NO: 8570396 - DNA, 22 bp, Homo sapiens
tcagaggaactggactaaagcc

SEQ ID NO: 8570397 - DNA, 22 bp, Homo sapiens
tcagcaagtggaccatcctggg

SEQ ID NO: 8570398 - DNA, 22 bp, Homo sapiens
tcagcacaggtcttgcaaaaca

SEQ ID NO: 8570399 - DNA, 22 bp, Homo sapiens
tcagcaccagttatcctcaggg

SEQ ID NO: 8570400 - DNA, 22 bp, Homo sapiens
tcagcactatacattttgaata

SEQ ID NO: 8570401 - DNA, 22 bp, Homo sapiens
tcagcactatacattttgaata

SEQ ID NO: 8570402 - DNA, 22 bp, Homo sapiens
tcagcaccagttatcctcaggg

SEQ ID NO: 8570403 - DNA, 22 bp, Homo sapiens
tcagcaatgtgatactgtgcaa

SEQ ID NO: 8570404 - DNA, 22 bp, Homo sapiens
tcagcactgtcttttatttgaa

SEQ ID NO: 8570405 - DNA, 22 bp, Homo sapiens
tcagcactgatgtttcagaaga

SEQ ID NO: 8570406 - DNA, 22 bp, Homo sapiens
tcagcactgtctattagtgaga

SEQ ID NO: 8570407 - DNA, 22 bp, Homo sapiens
tcagagcttatctcttgctgga

SEQ ID NO: 8570408 - DNA, 22 bp, Homo sapiens
tcagagctttggagaccaggaa

SEQ ID NO: 8570409 - DNA, 22 bp, Homo sapiens
tcagagctgtgcttcaggaaag

SEQ ID NO: 8570410 - DNA, 22 bp, Homo sapiens
tcagagctgcccatgcaagggg

SEQ ID NO: 8570411 - DNA, 22 bp, Homo sapiens
tcagagcccctccgctgtccca

SEQ ID NO: 8570412 - DNA, 22 bp, Homo sapiens
tcagagctaaggggagagcaaa

SEQ ID NO: 8570413 - DNA, 22 bp, Homo sapiens
tcagagctaaggggagagcaaa

SEQ ID NO: 8570414 - DNA, 22 bp, Homo sapiens
tcagagcacttggctcatggca

SEQ ID NO: 8570415 - DNA, 22 bp, Homo sapiens
tcagagcagactttgaaggagg

SEQ ID NO: 8570416 - DNA, 22 bp, Homo sapiens
tcagagcagcattttacaggat

SEQ ID NO: 8570417 - DNA, 22 bp, Homo sapiens
tcagagcattcgggtgacaaat

SEQ ID NO: 8570418 - DNA, 22 bp, Homo sapiens
tcagagccaatcatggtgcatt

SEQ ID NO: 8570419 - DNA, 22 bp, Homo sapiens
tcagagcattcgggtgacaaat

SEQ ID NO: 8570420 - DNA, 22 bp, Homo sapiens
tcagagcactggtgctaccttg

SEQ ID NO: 8570421 - DNA, 23 bp, Homo sapiens
tcagagaggccccctgcagagat

SEQ ID NO: 8570422 - DNA, 20 bp, Homo sapiens
tcagagaaggagctttcctg

SEQ ID NO: 8570423 - DNA, 20 bp, Homo sapiens
tcagagaaggagctttcctg

SEQ ID NO: 8570424 - DNA, 22 bp, Homo sapiens
tcagagaaggctgagtcacggc

SEQ ID NO: 8570425 - DNA, 22 bp, Homo sapiens
tcagagaggcaatactgtttaa

SEQ ID NO: 8570426 - DNA, 22 bp, Homo sapiens
tcagagaagctgccaggcgagc

SEQ ID NO: 8570427 - DNA, 22 bp, Homo sapiens
tcagagaactgcagcccttcct

SEQ ID NO: 8570428 - DNA, 22 bp, Homo sapiens
tcagagaactggcatgtttaga

SEQ ID NO: 8570429 - DNA, 22 bp, Homo sapiens
tcagacatgggatatgaagctc

SEQ ID NO: 8570430 - DNA, 22 bp, Homo sapiens
tcagaccatcctgctgttagtg

SEQ ID NO: 8570431 - DNA, 22 bp, Homo sapiens
tcagacatggggagagagacct

SEQ ID NO: 8570432 - DNA, 22 bp, Homo sapiens
tcagacagtttgcagtgtgcct

SEQ ID NO: 8570433 - DNA, 22 bp, Homo sapiens
tcagacagtttgcagtgtgcct

SEQ ID NO: 8570434 - DNA, 22 bp, Homo sapiens
tcagacagtgtgatcagtctct

SEQ ID NO: 8570435 - DNA, 22 bp, Homo sapiens
tcagacagtgtgatcagtctct

SEQ ID NO: 8570436 - DNA, 22 bp, Homo sapiens
tcagagaactccacaccttagg

SEQ ID NO: 8570437 - DNA, 23 bp, Homo sapiens
tcagagaactcgggcagatgacc

SEQ ID NO: 8570438 - DNA, 23 bp, Homo sapiens
tcagagaactcgggcagatgacc

SEQ ID NO: 8570439 - DNA, 22 bp, Homo sapiens
tcagacctctgaccttgccaaa

SEQ ID NO: 8570440 - DNA, 22 bp, Homo sapiens
tcagacccaggtgccaagctgt

SEQ ID NO: 8570441 - DNA, 22 bp, Homo sapiens
tcagaccatcctgctgttagtg

SEQ ID NO: 8570442 - DNA, 22 bp, Homo sapiens
tcagaaaagaccacattattct

SEQ ID NO: 8570443 - DNA, 22 bp, Homo sapiens
tcagaaaagaccacattattct

SEQ ID NO: 8570444 - DNA, 22 bp, Homo sapiens
tcagaaaagaccacattattct

SEQ ID NO: 8570445 - DNA, 22 bp, Homo sapiens
tcactttttgatatcattctgc

SEQ ID NO: 8570446 - DNA, 22 bp, Homo sapiens
tcacttttgggtttccagtaga

SEQ ID NO: 8570447 - DNA, 22 bp, Homo sapiens
tcacttttgatccctatgcagt

SEQ ID NO: 8570448 - DNA, 22 bp, Homo sapiens
tcagaaaagagaaaatcttata

SEQ ID NO: 8570449 - DNA, 22 bp, Homo sapiens
tcagaaaagactcaggggctga

SEQ ID NO: 8570450 - DNA, 22 bp, Homo sapiens
tcagaaaagaccacattattct

SEQ ID NO: 8570451 - DNA, 22 bp, Homo sapiens
tcagaaaagagaaaatcttata

SEQ ID NO: 8570452 - DNA, 22 bp, Homo sapiens
tcagaaaagagaaaatcttata

SEQ ID NO: 8570453 - DNA, 22 bp, Homo sapiens
tcagaaaagagaaaatcttata

SEQ ID NO: 8570454 - DNA, 22 bp, Homo sapiens
tcagaaaaggtagctgtgacaa

SEQ ID NO: 8570455 - DNA, 22 bp, Homo sapiens
tcagacaggcttctttctccct

SEQ ID NO: 8570456 - DNA, 22 bp, Homo sapiens
tcagacagggagtcagaaaata

SEQ ID NO: 8570457 - DNA, 22 bp, Homo sapiens
tcagacagggcttctcaaactt

SEQ ID NO: 8570458 - DNA, 22 bp, Homo sapiens
tcagacagtcatcagagcttgt

SEQ ID NO: 8570459 - DNA, 20 bp, Homo sapiens
tcagacagtcgcagttctgg

SEQ ID NO: 8570460 - DNA, 20 bp, Homo sapiens
tcagacagtcgcagttctgg

SEQ ID NO: 8570461 - DNA, 22 bp, Homo sapiens
tcagaaaaggtagctgtgacaa

SEQ ID NO: 8570462 - DNA, 22 bp, Homo sapiens
tcagaaaataactgttagtttg

SEQ ID NO: 8570463 - DNA, 22 bp, Homo sapiens
tcagacaggcctctccagcctc

SEQ ID NO: 8570464 - DNA, 22 bp, Homo sapiens
tcagacagcttgggataactga

SEQ ID NO: 8570465 - DNA, 22 bp, Homo sapiens
tcagacagattttgacacttgc

SEQ ID NO: 8570466 - DNA, 22 bp, Homo sapiens
tcagacagcttgcagggaggtg

SEQ ID NO: 8570467 - DNA, 22 bp, Homo sapiens
tccagctggggacatgggcttc

SEQ ID NO: 8570468 - DNA, 22 bp, Homo sapiens
tccagctggggcagtggctggg

SEQ ID NO: 8570469 - DNA, 22 bp, Homo sapiens
tccagctcttcagttctgcaaa

SEQ ID NO: 8570470 - DNA, 22 bp, Homo sapiens
tccagctggggcagtggctggg

SEQ ID NO: 8570471 - DNA, 22 bp, Homo sapiens
tccagctggggccgaagtggat

SEQ ID NO: 8570472 - DNA, 21 bp, Homo sapiens
tccagctcttatgttcatgaa

SEQ ID NO: 8570473 - DNA, 21 bp, Homo sapiens
tccagctcttatgttcatgaa

SEQ ID NO: 8570474 - DNA, 22 bp, Homo sapiens
tccagctctggcttggctagct

SEQ ID NO: 8570475 - DNA, 22 bp, Homo sapiens
tccagctctggcttggctagct

SEQ ID NO: 8570476 - DNA, 22 bp, Homo sapiens
tccagctctggcttggctagct

SEQ ID NO: 8570477 - DNA, 19 bp, Homo sapiens
tccagctggtatgcccaga

SEQ ID NO: 8570478 - DNA, 19 bp, Homo sapiens
tccagctggtatgcccaga

SEQ ID NO: 8570479 - DNA, 22 bp, Homo sapiens
tccagctgtagtggatttgaga

SEQ ID NO: 8570480 - DNA, 22 bp, Homo sapiens
tccagctgtactttgtcctggc

SEQ ID NO: 8570481 - DNA, 20 bp, Homo sapiens
tccagctgtctttcagagac

SEQ ID NO: 8570482 - DNA, 20 bp, Homo sapiens
tccagctgtctttcagagac

SEQ ID NO: 8570483 - DNA, 21 bp, Homo sapiens
tccagctgtgattatgaatgt

SEQ ID NO: 8570484 - DNA, 22 bp, Homo sapiens
tccagctgtgctccaggaggtg

SEQ ID NO: 8570485 - DNA, 22 bp, Homo sapiens
tccagctgttccatcagctctt

SEQ ID NO: 8570486 - DNA, 21 bp, Homo sapiens
tccagctcctgccactcctta

SEQ ID NO: 8570487 - DNA, 21 bp, Homo sapiens
tccagctcctgccactcctta

SEQ ID NO: 8570488 - DNA, 21 bp, Homo sapiens
tccagctcctgccactcctta

SEQ ID NO: 8570489 - DNA, 22 bp, Homo sapiens
tccagctcctgagttcactgct

SEQ ID NO: 8570490 - DNA, 22 bp, Homo sapiens
tccagctcctgagttcactgct

SEQ ID NO: 8570491 - DNA, 22 bp, Homo sapiens
tccagctctaaggctgatagcc

SEQ ID NO: 8570492 - DNA, 22 bp, Homo sapiens
tccagctctaaggctgatagcc

SEQ ID NO: 8570493 - DNA, 22 bp, Homo sapiens
tccagctctaaggctgatagcc

SEQ ID NO: 8570494 - DNA, 22 bp, Homo sapiens
tccagctctaaggctgatagcc

SEQ ID NO: 8570495 - DNA, 22 bp, Homo sapiens
tccagctctaaggctgatagcc

SEQ ID NO: 8570496 - DNA, 22 bp, Homo sapiens
tccagctctaacatgctgggcc

SEQ ID NO: 8570497 - DNA, 22 bp, Homo sapiens
tccagctctaacatgctgggcc

SEQ ID NO: 8570498 - DNA, 22 bp, Homo sapiens
tccagctctgcttcacagtctc

SEQ ID NO: 8570499 - DNA, 22 bp, Homo sapiens
tccagctctggcttggctagct

SEQ ID NO: 8570500 - DNA, 22 bp, Homo sapiens
tccagctctgctgtgcgccggt

SEQ ID NO: 8570501 - DNA, 22 bp, Homo sapiens
tccagctctgcttcacagtctc

SEQ ID NO: 8570502 - DNA, 22 bp, Homo sapiens
tccagctctgattctcactagc

SEQ ID NO: 8570503 - DNA, 22 bp, Homo sapiens
tccagctctgattctcactagc

SEQ ID NO: 8570504 - DNA, 22 bp, Homo sapiens
tccagctctgattctcactagc

SEQ ID NO: 8570505 - DNA, 18 bp, Homo sapiens
tccagctctgccacttac

SEQ ID NO: 8570506 - DNA, 22 bp, Homo sapiens
tccagctctgattctcactagc

SEQ ID NO: 8570507 - DNA, 21 bp, Homo sapiens
tccagctctcatagtgttcca

SEQ ID NO: 8570508 - DNA, 21 bp, Homo sapiens
tccagctctcatagtgttcca

SEQ ID NO: 8570509 - DNA, 19 bp, Homo sapiens
tccagctgttttgagtcac

SEQ ID NO: 8570510 - DNA, 22 bp, Homo sapiens
tccagcttataggtagatttaa

SEQ ID NO: 8570511 - DNA, 22 bp, Homo sapiens
tccagctgttgttttatctcag

SEQ ID NO: 8570512 - DNA, 19 bp, Homo sapiens
tccagctgttttgagtcac

SEQ ID NO: 8570513 - DNA, 22 bp, Homo sapiens
tccagctgttgatattctaggt

SEQ ID NO: 8570514 - DNA, 20 bp, Homo sapiens
tccagctgttgagatctgag

SEQ ID NO: 8570515 - DNA, 22 bp, Homo sapiens
tccagcttcttgacttggtggt

SEQ ID NO: 8570516 - DNA, 22 bp, Homo sapiens
tccagcttgacaaatgatttta

SEQ ID NO: 8570517 - DNA, 22 bp, Homo sapiens
tccagcttgcctggtcttttgg

SEQ ID NO: 8570518 - DNA, 22 bp, Homo sapiens
tccagctttgagattttatgga

SEQ ID NO: 8570519 - DNA, 22 bp, Homo sapiens
tccaggagggattgggctgtgg

SEQ ID NO: 8570520 - DNA, 22 bp, Homo sapiens
tccagctcagggttggctcaag

SEQ ID NO: 8570521 - DNA, 20 bp, Homo sapiens
tccagctcagtttttttgtc

SEQ ID NO: 8570522 - DNA, 22 bp, Homo sapiens
tccagctcatctgtctccatta

SEQ ID NO: 8570523 - DNA, 22 bp, Homo sapiens
tccagctcatctgtctccatta

SEQ ID NO: 8570524 - DNA, 22 bp, Homo sapiens
tccagctcatctgtctccatta

SEQ ID NO: 8570525 - DNA, 22 bp, Homo sapiens
tccagctcatctgtctccatta

SEQ ID NO: 8570526 - DNA, 22 bp, Homo sapiens
tccagctccacagcctccctgt

SEQ ID NO: 8570527 - DNA, 22 bp, Homo sapiens
tccagctccacagcctccctgt

SEQ ID NO: 8570528 - DNA, 22 bp, Homo sapiens
tccagctcccactctcactgct

SEQ ID NO: 8570529 - DNA, 22 bp, Homo sapiens
tccagctcccactctcactgct

SEQ ID NO: 8570530 - DNA, 22 bp, Homo sapiens
tccagctcccactctcactgct

SEQ ID NO: 8570531 - DNA, 22 bp, Homo sapiens
tccagctcccactctcactgct

SEQ ID NO: 8570532 - DNA, 22 bp, Homo sapiens
tccagctcccactctcactgct

SEQ ID NO: 8570533 - DNA, 23 bp, Homo sapiens
tccagctcccttcaatggcactg

SEQ ID NO: 8570534 - DNA, 23 bp, Homo sapiens
tccagctcccttcaatggcactg

SEQ ID NO: 8570535 - DNA, 20 bp, Homo sapiens
tccagctccgtgttcttcct

SEQ ID NO: 8570536 - DNA, 20 bp, Homo sapiens
tccagctccgtgttcttcct

SEQ ID NO: 8570537 - DNA, 17 bp, Homo sapiens
tccagctcctcattgtt

SEQ ID NO: 8570538 - DNA, 17 bp, Homo sapiens
tccagctcctcattgtt

SEQ ID NO: 8570539 - DNA, 17 bp, Homo sapiens
tccagctcctcattgtt

SEQ ID NO: 8570540 - DNA, 22 bp, Homo sapiens
tccagctcctgagttcactgct

SEQ ID NO: 8570541 - DNA, 22 bp, Homo sapiens
tccagctcctctacccgatgcg

SEQ ID NO: 8570542 - DNA, 22 bp, Homo sapiens
tccagctcctctacccgatgcg

SEQ ID NO: 8570543 - DNA, 22 bp, Homo sapiens
tccagcctttctactcactgag

SEQ ID NO: 8570544 - DNA, 22 bp, Homo sapiens
tccagcctttctactcactgag

SEQ ID NO: 8570545 - DNA, 18 bp, Homo sapiens
tccagcgtgctccagggc

SEQ ID NO: 8570546 - DNA, 22 bp, Homo sapiens
tccagctcaaagtgctcctgtc

SEQ ID NO: 8570547 - DNA, 22 bp, Homo sapiens
tccagctcaaagtgctcctgtc

SEQ ID NO: 8570548 - DNA, 22 bp, Homo sapiens
tccagctcaaagtgctcctgtc

SEQ ID NO: 8570549 - DNA, 22 bp, Homo sapiens
tccagctcaaattcagcttcca

SEQ ID NO: 8570550 - DNA, 22 bp, Homo sapiens
tccagctcaaattcagcttcca

SEQ ID NO: 8570551 - DNA, 22 bp, Homo sapiens
tccagctcacagatagcgtggg

SEQ ID NO: 8570552 - DNA, 22 bp, Homo sapiens
tccagctcagggttggctcaag

SEQ ID NO: 8570553 - DNA, 22 bp, Homo sapiens
tccagctcagggttggctcaag

SEQ ID NO: 8570554 - DNA, 22 bp, Homo sapiens
tccagctcagatgcagggatca

SEQ ID NO: 8570555 - DNA, 22 bp, Homo sapiens
tccagctcagatgcagggatca

SEQ ID NO: 8570556 - DNA, 22 bp, Homo sapiens
tccagctcagatgcagggatca

SEQ ID NO: 8570557 - DNA, 18 bp, Homo sapiens
tccagctcacagatgggc

SEQ ID NO: 8570558 - DNA, 18 bp, Homo sapiens
tccagctcacagatgggc

SEQ ID NO: 8570559 - DNA, 22 bp, Homo sapiens
tccagctcacagatagcgtggg

SEQ ID NO: 8570560 - DNA, 18 bp, Homo sapiens
tccagctcacagatgggc

SEQ ID NO: 8570561 - DNA, 22 bp, Homo sapiens
tccagcatgaaggggcttttat

SEQ ID NO: 8570562 - DNA, 22 bp, Homo sapiens
tccagcatatatagagaatgag

SEQ ID NO: 8570563 - DNA, 22 bp, Homo sapiens
tccagcatatatagagaatgag

SEQ ID NO: 8570564 - DNA, 20 bp, Homo sapiens
tccagcatataaactcctct

SEQ ID NO: 8570565 - DNA, 22 bp, Homo sapiens
tccagcattcttagacctctat

SEQ ID NO: 8570566 - DNA, 22 bp, Homo sapiens
tccagcattagatgtgaaattg

SEQ ID NO: 8570567 - DNA, 22 bp, Homo sapiens
tccagcattagatgtgaaattg

SEQ ID NO: 8570568 - DNA, 22 bp, Homo sapiens
tccagccaactgcctagggagc

SEQ ID NO: 8570569 - DNA, 22 bp, Homo sapiens
tccagcatttttcaatagaatt

SEQ ID NO: 8570570 - DNA, 22 bp, Homo sapiens
tccagcatttttcaatagaatt

SEQ ID NO: 8570571 - DNA, 22 bp, Homo sapiens
tccagccaatcagagctgaggc

SEQ ID NO: 8570572 - DNA, 22 bp, Homo sapiens
tccagccaatcagagctgaggc

SEQ ID NO: 8570573 - DNA, 22 bp, Homo sapiens
tccagcctttctactcactgag

SEQ ID NO: 8570574 - DNA, 22 bp, Homo sapiens
tccagcctttctactcactgag

SEQ ID NO: 8570575 - DNA, 22 bp, Homo sapiens
tccagcctttctactcactgag

SEQ ID NO: 8570576 - DNA, 22 bp, Homo sapiens
tccagccaagccttggtagctg

SEQ ID NO: 8570577 - DNA, 22 bp, Homo sapiens
tccagccaagccttggtagctg

SEQ ID NO: 8570578 - DNA, 22 bp, Homo sapiens
tccagccaagggaggttactag

SEQ ID NO: 8570579 - DNA, 22 bp, Homo sapiens
tccagcagtgctcaggactcac

SEQ ID NO: 8570580 - DNA, 22 bp, Homo sapiens
tccagcagtccatgtgagacac

SEQ ID NO: 8570581 - DNA, 19 bp, Homo sapiens
tccagcagtgcttgaaatc

SEQ ID NO: 8570582 - DNA, 19 bp, Homo sapiens
tccagcagtgcttgaaatc

SEQ ID NO: 8570583 - DNA, 22 bp, Homo sapiens
tccagcagtgctctagagcgtg

SEQ ID NO: 8570584 - DNA, 22 bp, Homo sapiens
tccagcagtgctctagagcgtg

SEQ ID NO: 8570585 - DNA, 22 bp, Homo sapiens
tccagcaggttggtcaggtgca

SEQ ID NO: 8570586 - DNA, 22 bp, Homo sapiens
tccagcaggttggtcaggtgca

SEQ ID NO: 8570587 - DNA, 22 bp, Homo sapiens
tccagcaggttggtcaggtgca

SEQ ID NO: 8570588 - DNA, 22 bp, Homo sapiens
tccagcaggttggtcaggtgca

SEQ ID NO: 8570589 - DNA, 22 bp, Homo sapiens
tccagagcctgcgcactggctg

SEQ ID NO: 8570590 - DNA, 22 bp, Homo sapiens
tccagagcctgcgcactggctg

SEQ ID NO: 8570591 - DNA, 22 bp, Homo sapiens
tccagagcctgcgcactggctg

SEQ ID NO: 8570592 - DNA, 22 bp, Homo sapiens
tccagagcctatatgttcaact

SEQ ID NO: 8570593 - DNA, 22 bp, Homo sapiens
tccagagcctatatgttcaact

SEQ ID NO: 8570594 - DNA, 22 bp, Homo sapiens
tccagagcctgcgcactggctg

SEQ ID NO: 8570595 - DNA, 22 bp, Homo sapiens
tccagagcctggggtttgtaac

SEQ ID NO: 8570596 - DNA, 22 bp, Homo sapiens
tccagagccttcgataagaaga

SEQ ID NO: 8570597 - DNA, 22 bp, Homo sapiens
tccagagcctttctgcttgaca

SEQ ID NO: 8570598 - DNA, 22 bp, Homo sapiens
tccagagcctttctgcttgaca

SEQ ID NO: 8570599 - DNA, 22 bp, Homo sapiens
tccagagcctttccacccactt

SEQ ID NO: 8570600 - DNA, 18 bp, Homo sapiens
tccagagctactgtggtg

SEQ ID NO: 8570601 - DNA, 18 bp, Homo sapiens
tccagagctactgtggtg

SEQ ID NO: 8570602 - DNA, 22 bp, Homo sapiens
tccagagctaattcagcagctg

SEQ ID NO: 8570603 - DNA, 18 bp, Homo sapiens
tccagagctactgtggtg

SEQ ID NO: 8570604 - DNA, 18 bp, Homo sapiens
tccagagctactgtggtg

SEQ ID NO: 8570605 - DNA, 22 bp, Homo sapiens
tccagagctacttgctcaactt

SEQ ID NO: 8570606 - DNA, 23 bp, Homo sapiens
tccagagctcatgctctcaacca

SEQ ID NO: 8570607 - DNA, 22 bp, Homo sapiens
tccagagctacttgctcaactt

SEQ ID NO: 8570608 - DNA, 22 bp, Homo sapiens
tccagagctacttgctcaactt

SEQ ID NO: 8570609 - DNA, 22 bp, Homo sapiens
tccagagctacttgctcaactt

SEQ ID NO: 8570610 - DNA, 17 bp, Homo sapiens
tccagagcacagagctc

SEQ ID NO: 8570611 - DNA, 17 bp, Homo sapiens
tccagagcacagagctc

SEQ ID NO: 8570612 - DNA, 17 bp, Homo sapiens
tccagagcacagagctc

SEQ ID NO: 8570613 - DNA, 17 bp, Homo sapiens
tccagagcacagagctc

SEQ ID NO: 8570614 - DNA, 22 bp, Homo sapiens
tccagagcaaagtttgctaaca

SEQ ID NO: 8570615 - DNA, 22 bp, Homo sapiens
tccagagatctctcttccctgt

SEQ ID NO: 8570616 - DNA, 22 bp, Homo sapiens
tccagagatcacactgggcagg

SEQ ID NO: 8570617 - DNA, 22 bp, Homo sapiens
tccagagataactatttaggag

SEQ ID NO: 8570618 - DNA, 22 bp, Homo sapiens
tccagagatcacactgggcagg

SEQ ID NO: 8570619 - DNA, 22 bp, Homo sapiens
tccagagcaggtggtcagaagg

SEQ ID NO: 8570620 - DNA, 22 bp, Homo sapiens
tccagagcaggtggtcagaagg

SEQ ID NO: 8570621 - DNA, 22 bp, Homo sapiens
tccagagcaggtgtctacacag

SEQ ID NO: 8570622 - DNA, 18 bp, Homo sapiens
tccagagcagtctttggc

SEQ ID NO: 8570623 - DNA, 22 bp, Homo sapiens
tccagagccccagtctagtggg

SEQ ID NO: 8570624 - DNA, 22 bp, Homo sapiens
tccagagccccagtctagtggg

SEQ ID NO: 8570625 - DNA, 22 bp, Homo sapiens
tccagagcctatatgttcaact

SEQ ID NO: 8570626 - DNA, 22 bp, Homo sapiens
tccagagcatgcagatcatcaa

SEQ ID NO: 8570627 - DNA, 22 bp, Homo sapiens
tccagagccccaattcacctct

SEQ ID NO: 8570628 - DNA, 19 bp, Homo sapiens
tccagaagtccctgagcgg

SEQ ID NO: 8570629 - DNA, 22 bp, Homo sapiens
tcattgcaggcattcccctgcc

SEQ ID NO: 8570630 - DNA, 22 bp, Homo sapiens
tcattgcagttgagttgtgtta

SEQ ID NO: 8570631 - DNA, 22 bp, Homo sapiens
tcattgcagtagggagagaccc

SEQ ID NO: 8570632 - DNA, 22 bp, Homo sapiens
tcattgcactccagcctgggca

SEQ ID NO: 8570633 - DNA, 22 bp, Homo sapiens
tccagagaggtttctccatgct

SEQ ID NO: 8570634 - DNA, 22 bp, Homo sapiens
tccagagaggtttctccatgct

SEQ ID NO: 8570635 - DNA, 20 bp, Homo sapiens
tccagagagtggcaaagctc

SEQ ID NO: 8570636 - DNA, 20 bp, Homo sapiens
tccagagagtggcaaagctc

SEQ ID NO: 8570637 - DNA, 22 bp, Homo sapiens
tccagaatactctgaaatcatt

SEQ ID NO: 8570638 - DNA, 22 bp, Homo sapiens
tccagaatactctgaaatcatt

SEQ ID NO: 8570639 - DNA, 22 bp, Homo sapiens
tccagacattttatagcagtct

SEQ ID NO: 8570640 - DNA, 22 bp, Homo sapiens
tcattgaatacatatttgggat

SEQ ID NO: 8570641 - DNA, 22 bp, Homo sapiens
tcattgaagtgactgaaagatt

SEQ ID NO: 8570642 - DNA, 22 bp, Homo sapiens
tcattgaagtgactgaaagatt

SEQ ID NO: 8570643 - DNA, 22 bp, Homo sapiens
tcattgaagcccttgacaagcc

SEQ ID NO: 8570644 - DNA, 22 bp, Homo sapiens
tcattgaagacttactggcttc

SEQ ID NO: 8570645 - DNA, 22 bp, Homo sapiens
tcattgaagcattttgtgtatt

SEQ ID NO: 8570646 - DNA, 22 bp, Homo sapiens
tcattgaatgagatgcaataga

SEQ ID NO: 8570647 - DNA, 22 bp, Homo sapiens
tcattgaatatggggccataca

SEQ ID NO: 8570648 - DNA, 22 bp, Homo sapiens
tcattgaatgctctgcaggttg

SEQ ID NO: 8570649 - DNA, 22 bp, Homo sapiens
tcattgaatgctctgcaggttg

SEQ ID NO: 8570650 - DNA, 22 bp, Homo sapiens
tcattgaatttcacagctttat

SEQ ID NO: 8570651 - DNA, 22 bp, Homo sapiens
tcattgaattctgggggttgag

SEQ ID NO: 8570652 - DNA, 22 bp, Homo sapiens
tcattgaatttggttcaatatg

SEQ ID NO: 8570653 - DNA, 22 bp, Homo sapiens
tcattgaatttggttcaatatg

SEQ ID NO: 8570654 - DNA, 22 bp, Homo sapiens
tcattgagttcaaatccttcat

SEQ ID NO: 8570655 - DNA, 22 bp, Homo sapiens
tcattgacagttgtttcaaata

SEQ ID NO: 8570656 - DNA, 22 bp, Homo sapiens
tcattgagcggttcttaaccca

SEQ ID NO: 8570657 - DNA, 22 bp, Homo sapiens
tcattgatggcttctttcttgc

SEQ ID NO: 8570658 - DNA, 22 bp, Homo sapiens
tcattgagttgcacttttacta

SEQ ID NO: 8570659 - DNA, 22 bp, Homo sapiens
tcattgataaagtactgctttt

SEQ ID NO: 8570660 - DNA, 18 bp, Homo sapiens
tccagcaggtctgaggtg

SEQ ID NO: 8570661 - DNA, 22 bp, Homo sapiens
tccagcaggtccgagacaagtt

SEQ ID NO: 8570662 - DNA, 22 bp, Homo sapiens
tccagcagggaattagtagtct

SEQ ID NO: 8570663 - DNA, 22 bp, Homo sapiens
tccagcaggtccgagacaagtt

SEQ ID NO: 8570664 - DNA, 18 bp, Homo sapiens
tccagcaggtctgaggtg

SEQ ID NO: 8570665 - DNA, 18 bp, Homo sapiens
tccagcaggtctgaggtg

SEQ ID NO: 8570666 - DNA, 22 bp, Homo sapiens
tccagcagccacacctctggac

SEQ ID NO: 8570667 - DNA, 22 bp, Homo sapiens
tccagcagggaattagtagtct

SEQ ID NO: 8570668 - DNA, 22 bp, Homo sapiens
tccagcagcccgaaggcccatc

SEQ ID NO: 8570669 - DNA, 23 bp, Homo sapiens
tccagcagccaagaagggtagaa

SEQ ID NO: 8570670 - DNA, 23 bp, Homo sapiens
tccagcagccaagaagggtagaa

SEQ ID NO: 8570671 - DNA, 22 bp, Homo sapiens
tccagcagagtctctgaggggg

SEQ ID NO: 8570672 - DNA, 18 bp, Homo sapiens
tccagcagcatagtttcc

SEQ ID NO: 8570673 - DNA, 22 bp, Homo sapiens
tccagcagagtctctgaggggg

SEQ ID NO: 8570674 - DNA, 22 bp, Homo sapiens
tccagcagaccatcaaggctca

SEQ ID NO: 8570675 - DNA, 23 bp, Homo sapiens
tccagcagagccttccaggaggg

SEQ ID NO: 8570676 - DNA, 23 bp, Homo sapiens
tccagcagagccttccaggaggg

SEQ ID NO: 8570677 - DNA, 23 bp, Homo sapiens
tccagcagagccttccaggaggg

SEQ ID NO: 8570678 - DNA, 22 bp, Homo sapiens
tccagagctgggtctgtgctca

SEQ ID NO: 8570679 - DNA, 22 bp, Homo sapiens
tccagagctgagggtcagtaga

SEQ ID NO: 8570680 - DNA, 22 bp, Homo sapiens
tccagagctgggtctgtgctca

SEQ ID NO: 8570681 - DNA, 22 bp, Homo sapiens
tccagagctgggtctgtgctca

SEQ ID NO: 8570682 - DNA, 23 bp, Homo sapiens
tccagagctcatgctctcaacca

SEQ ID NO: 8570683 - DNA, 22 bp, Homo sapiens
tccagagctctgggcatagctg

SEQ ID NO: 8570684 - DNA, 22 bp, Homo sapiens
tccagagctctgggcatagctg

SEQ ID NO: 8570685 - DNA, 22 bp, Homo sapiens
tccagagctgagcagtcattct

SEQ ID NO: 8570686 - DNA, 22 bp, Homo sapiens
tccagaggcaaaaaggtatgga

SEQ ID NO: 8570687 - DNA, 14 bp, Homo sapiens
tccagagctttccg

SEQ ID NO: 8570688 - DNA, 21 bp, Homo sapiens
tccagaggaggacagactcag

SEQ ID NO: 8570689 - DNA, 22 bp, Homo sapiens
tccagagctgtcctactgtgag

SEQ ID NO: 8570690 - DNA, 22 bp, Homo sapiens
tccagagctgtcctactgtgag

SEQ ID NO: 8570691 - DNA, 22 bp, Homo sapiens
tccagagctgtcctactgtgag

SEQ ID NO: 8570692 - DNA, 18 bp, Homo sapiens
tccagagctggtgcttct

SEQ ID NO: 8570693 - DNA, 22 bp, Homo sapiens
tccagagctgtatgattttttt

SEQ ID NO: 8570694 - DNA, 22 bp, Homo sapiens
tccagaggctctgagggagagt

SEQ ID NO: 8570695 - DNA, 22 bp, Homo sapiens
tccagaggctctgagggagagt

SEQ ID NO: 8570696 - DNA, 22 bp, Homo sapiens
tccagaggctccaaagggagat

SEQ ID NO: 8570697 - DNA, 22 bp, Homo sapiens
tccagaggctccaaagggagat

SEQ ID NO: 8570698 - DNA, 22 bp, Homo sapiens
tccagaggctccaaagggagat

SEQ ID NO: 8570699 - DNA, 22 bp, Homo sapiens
tccagaggctccaaagggagat

SEQ ID NO: 8570700 - DNA, 20 bp, Homo sapiens
tccagaggccacatccagtg

SEQ ID NO: 8570701 - DNA, 22 bp, Homo sapiens
tccagagggcgatggctggggg

SEQ ID NO: 8570702 - DNA, 22 bp, Homo sapiens
tccagagggcgatggctggggg

SEQ ID NO: 8570703 - DNA, 22 bp, Homo sapiens
tccagagggcgatggctggggg

SEQ ID NO: 8570704 - DNA, 22 bp, Homo sapiens
tccagagggcgatggctggggg

SEQ ID NO: 8570705 - DNA, 22 bp, Homo sapiens
tccagagggcgatggctggggg

SEQ ID NO: 8570706 - DNA, 22 bp, Homo sapiens
tccagaggggcagccctgtgct

SEQ ID NO: 8570707 - DNA, 22 bp, Homo sapiens
tccagaggggcagccctgtgct

SEQ ID NO: 8570708 - DNA, 22 bp, Homo sapiens
tccagcagaaccagagacctgg

SEQ ID NO: 8570709 - DNA, 22 bp, Homo sapiens
tccatctgtttactataaagat

SEQ ID NO: 8570710 - DNA, 22 bp, Homo sapiens
tccatctggtggcttccttttg

SEQ ID NO: 8570711 - DNA, 22 bp, Homo sapiens
tccatctgtctttcccatccac

SEQ ID NO: 8570712 - DNA, 22 bp, Homo sapiens
tccatctggagacttcctggtc

SEQ ID NO: 8570713 - DNA, 22 bp, Homo sapiens
tccatctgcatttggtttctgt

SEQ ID NO: 8570714 - DNA, 22 bp, Homo sapiens
tccatctggtgagtgaggagcc

SEQ ID NO: 8570715 - DNA, 18 bp, Homo sapiens
tccatcctctgctcttca

SEQ ID NO: 8570716 - DNA, 22 bp, Homo sapiens
tccatccatggatggaaatgtg

SEQ ID NO: 8570717 - DNA, 22 bp, Homo sapiens
tccatccatgtaggaagatggt

SEQ ID NO: 8570718 - DNA, 22 bp, Homo sapiens
tccatccaggccagcagtaatc

SEQ ID NO: 8570719 - DNA, 22 bp, Homo sapiens
tccatccaggccagcagtaatc

SEQ ID NO: 8570720 - DNA, 22 bp, Homo sapiens
tccatccaccctgcattatatt

SEQ ID NO: 8570721 - DNA, 22 bp, Homo sapiens
tccatgcaaacagtggctagct

SEQ ID NO: 8570722 - DNA, 22 bp, Homo sapiens
tccatgcagagaactgaagtac

SEQ ID NO: 8570723 - DNA, 22 bp, Homo sapiens
tccatgagggacactggatgct

SEQ ID NO: 8570724 - DNA, 22 bp, Homo sapiens
tccatgagggacactggatgct

SEQ ID NO: 8570725 - DNA, 22 bp, Homo sapiens
tccatgagaggtaactttacaa

SEQ ID NO: 8570726 - DNA, 22 bp, Homo sapiens
tccatgagaacccttggagata

SEQ ID NO: 8570727 - DNA, 22 bp, Homo sapiens
tccatgaggcagggaggctggc

SEQ ID NO: 8570728 - DNA, 22 bp, Homo sapiens
tcccaagtgtcttggaccaggg

SEQ ID NO: 8570729 - DNA, 22 bp, Homo sapiens
tcccacacagcccgctcaccgg

SEQ ID NO: 8570730 - DNA, 22 bp, Homo sapiens
tcccaattaacaggtatcaggc

SEQ ID NO: 8570731 - DNA, 22 bp, Homo sapiens
tcccacacagcccgctcaccgg

SEQ ID NO: 8570732 - DNA, 22 bp, Homo sapiens
tcccacactacacggttgttgg

SEQ ID NO: 8570733 - DNA, 22 bp, Homo sapiens
tcccacacctgtctattcctag

SEQ ID NO: 8570734 - DNA, 22 bp, Homo sapiens
tcccacacttgaaacaaggctg

SEQ ID NO: 8570735 - DNA, 22 bp, Homo sapiens
tcccacagatgctgtccagagt

SEQ ID NO: 8570736 - DNA, 22 bp, Homo sapiens
tcccacagatgctgtccagagt

SEQ ID NO: 8570737 - DNA, 22 bp, Homo sapiens
tcccacagagtggctcacctag

SEQ ID NO: 8570738 - DNA, 21 bp, Homo sapiens
tcccacagaaactgcgaaatt

SEQ ID NO: 8570739 - DNA, 22 bp, Homo sapiens
tcccacagagtggctcacctag

SEQ ID NO: 8570740 - DNA, 22 bp, Homo sapiens
tcccacagagtggctcacctag

SEQ ID NO: 8570741 - DNA, 22 bp, Homo sapiens
tcccacagaccatgagtggaag

SEQ ID NO: 8570742 - DNA, 21 bp, Homo sapiens
tcccacagcgccagctcctgt

SEQ ID NO: 8570743 - DNA, 22 bp, Homo sapiens
tcccacagcatgagtaactctc

SEQ ID NO: 8570744 - DNA, 21 bp, Homo sapiens
tcccacagcgccagctcctgt

SEQ ID NO: 8570745 - DNA, 22 bp, Homo sapiens
tcccacagcttcgtgcttcccc

SEQ ID NO: 8570746 - DNA, 21 bp, Homo sapiens
tcccacagcgccagctcctgt

SEQ ID NO: 8570747 - DNA, 20 bp, Homo sapiens
tccatgcagtttccatacag

SEQ ID NO: 8570748 - DNA, 20 bp, Homo sapiens
tccatgcagtttccatacag

SEQ ID NO: 8570749 - DNA, 22 bp, Homo sapiens
tccatgcagagtccaggcctca

SEQ ID NO: 8570750 - DNA, 22 bp, Homo sapiens
tccatgcagaggagctggtggc

SEQ ID NO: 8570751 - DNA, 22 bp, Homo sapiens
tcccaagcttagggctctcagt

SEQ ID NO: 8570752 - DNA, 22 bp, Homo sapiens
tcccaagcttagggctctcagt

SEQ ID NO: 8570753 - DNA, 22 bp, Homo sapiens
tcccaagcttagggctctcagt

SEQ ID NO: 8570754 - DNA, 21 bp, Homo sapiens
tcccaagctgctggctcagct

SEQ ID NO: 8570755 - DNA, 21 bp, Homo sapiens
tcccaagctgctggctcagct

SEQ ID NO: 8570756 - DNA, 22 bp, Homo sapiens
tcccaagccctggatgcctcag

SEQ ID NO: 8570757 - DNA, 22 bp, Homo sapiens
tcccaagccctggatgcctcag

SEQ ID NO: 8570758 - DNA, 22 bp, Homo sapiens
tcccaaggcctctagttgatta

SEQ ID NO: 8570759 - DNA, 20 bp, Homo sapiens
tcccaagggctgagaggatc

SEQ ID NO: 8570760 - DNA, 22 bp, Homo sapiens
tcccaaggccaggcatctagaa

SEQ ID NO: 8570761 - DNA, 22 bp, Homo sapiens
tcccaaggccaggcatctagaa

SEQ ID NO: 8570762 - DNA, 20 bp, Homo sapiens
tcccaaggatgcctgggtgt

SEQ ID NO: 8570763 - DNA, 20 bp, Homo sapiens
tcccaaggatgcctgggtgt

SEQ ID NO: 8570764 - DNA, 22 bp, Homo sapiens
tcccaaggataagagagtctga

SEQ ID NO: 8570765 - DNA, 22 bp, Homo sapiens
tcccaaggcacagggcagggac

SEQ ID NO: 8570766 - DNA, 22 bp, Homo sapiens
tcccaaggcacagggcagggac

SEQ ID NO: 8570767 - DNA, 20 bp, Homo sapiens
tccagggctagggagctcat

SEQ ID NO: 8570768 - DNA, 20 bp, Homo sapiens
tccagggctagggagctcat

SEQ ID NO: 8570769 - DNA, 20 bp, Homo sapiens
tccagggctagggagctcat

SEQ ID NO: 8570770 - DNA, 22 bp, Homo sapiens
tccagggctacaaggcaccaga

SEQ ID NO: 8570771 - DNA, 22 bp, Homo sapiens
tccagggctacaaggcaccaga

SEQ ID NO: 8570772 - DNA, 22 bp, Homo sapiens
tccagggctacaaggcaccaga

SEQ ID NO: 8570773 - DNA, 22 bp, Homo sapiens
tccagggctacaaggcaccaga

SEQ ID NO: 8570774 - DNA, 22 bp, Homo sapiens
tccagggcctgaggttgaagtg

SEQ ID NO: 8570775 - DNA, 22 bp, Homo sapiens
tccagggcctgaggttgaagtg

SEQ ID NO: 8570776 - DNA, 22 bp, Homo sapiens
tccagggccttacctcttcaga

SEQ ID NO: 8570777 - DNA, 22 bp, Homo sapiens
tccagggccttacctcttcaga

SEQ ID NO: 8570778 - DNA, 22 bp, Homo sapiens
tccagggcgtgtgtgaaggaaa

SEQ ID NO: 8570779 - DNA, 21 bp, Homo sapiens
tccagggcgggcgcacggaga

SEQ ID NO: 8570780 - DNA, 22 bp, Homo sapiens
tccagggctcattccctctgca

SEQ ID NO: 8570781 - DNA, 22 bp, Homo sapiens
tccagggctcattccctctgca

SEQ ID NO: 8570782 - DNA, 22 bp, Homo sapiens
tccagggctcattccctctgca

SEQ ID NO: 8570783 - DNA, 22 bp, Homo sapiens
tccagttgcccatctctcttct

SEQ ID NO: 8570784 - DNA, 22 bp, Homo sapiens
tccatcaggctcgtgggctctc

SEQ ID NO: 8570785 - DNA, 22 bp, Homo sapiens
tccatccacattaacagatacg

SEQ ID NO: 8570786 - DNA, 22 bp, Homo sapiens
tccagtttcatagctaaggaac

SEQ ID NO: 8570787 - DNA, 22 bp, Homo sapiens
tccagtttatttttggcagggt

SEQ ID NO: 8570788 - DNA, 20 bp, Homo sapiens
tccagggccctggctcctct

SEQ ID NO: 8570789 - DNA, 20 bp, Homo sapiens
tccagggccctggctcctct

SEQ ID NO: 8570790 - DNA, 22 bp, Homo sapiens
tccagggccccccagttgcacg

SEQ ID NO: 8570791 - DNA, 22 bp, Homo sapiens
tccagggccccccagttgcacg

SEQ ID NO: 8570792 - DNA, 22 bp, Homo sapiens
tccagggccatgaagttgcaca

SEQ ID NO: 8570793 - DNA, 22 bp, Homo sapiens
tccagggccatctccatgaggc

SEQ ID NO: 8570794 - DNA, 22 bp, Homo sapiens
tccagggccatctccatgaggc

SEQ ID NO: 8570795 - DNA, 22 bp, Homo sapiens
tccagggccatgaagttgcaca

SEQ ID NO: 8570796 - DNA, 22 bp, Homo sapiens
tccagggccacagaggatgcta

SEQ ID NO: 8570797 - DNA, 22 bp, Homo sapiens
tccagggccacagaggatgcta

SEQ ID NO: 8570798 - DNA, 22 bp, Homo sapiens
tccagggccacagaggatgcta

SEQ ID NO: 8570799 - DNA, 22 bp, Homo sapiens
tccagggccacagaggatgcta

SEQ ID NO: 8570800 - DNA, 22 bp, Homo sapiens
tccaggctgcagtcttgccctc

SEQ ID NO: 8570801 - DNA, 22 bp, Homo sapiens
tccaggctgcagtcttgccctc

SEQ ID NO: 8570802 - DNA, 22 bp, Homo sapiens
tccaggctgccacagtgcaacg

SEQ ID NO: 8570803 - DNA, 22 bp, Homo sapiens
tccaggctggaaatgtcaaact

SEQ ID NO: 8570804 - DNA, 22 bp, Homo sapiens
tccagggcagggtgcgcatggg

SEQ ID NO: 8570805 - DNA, 22 bp, Homo sapiens
tccagggccaagtcatggaacc

SEQ ID NO: 8570806 - DNA, 22 bp, Homo sapiens
tccagggccacagaggatgcta

SEQ ID NO: 8570807 - DNA, 19 bp, Homo sapiens
tccagggcaggaacatgta

SEQ ID NO: 8570808 - DNA, 22 bp, Homo sapiens
tccagggcagccgcgggtgcgc

SEQ ID NO: 8570809 - DNA, 21 bp, Homo sapiens
tccaggagtggctgggcaggg

SEQ ID NO: 8570810 - DNA, 21 bp, Homo sapiens
tccaggagtggctgggcaggg

SEQ ID NO: 8570811 - DNA, 21 bp, Homo sapiens
tccaggagtggctgggcaggg

SEQ ID NO: 8570812 - DNA, 22 bp, Homo sapiens
tccaggagtttgagactgcagt

SEQ ID NO: 8570813 - DNA, 22 bp, Homo sapiens
tccaggagtttgagactgcagt

SEQ ID NO: 8570814 - DNA, 22 bp, Homo sapiens
tccaggagtttgagactgcagt

SEQ ID NO: 8570815 - DNA, 21 bp, Homo sapiens
tccaggagttctaataggtgt

SEQ ID NO: 8570816 - DNA, 22 bp, Homo sapiens
tccaggagtggggcagaggtct

SEQ ID NO: 8570817 - DNA, 22 bp, Homo sapiens
tccaggagtgtgtgctaatggg

SEQ ID NO: 8570818 - DNA, 22 bp, Homo sapiens
tccaggagtgtgtgctaatggg

SEQ ID NO: 8570819 - DNA, 22 bp, Homo sapiens
tccaggcagttttccaggttgt

SEQ ID NO: 8570820 - DNA, 22 bp, Homo sapiens
tccaggcagggcagccatcaag

SEQ ID NO: 8570821 - DNA, 22 bp, Homo sapiens
tccaggcataagccttgagtgt

SEQ ID NO: 8570822 - DNA, 22 bp, Homo sapiens
tccaggagtttgagactgcagt

SEQ ID NO: 8570823 - DNA, 22 bp, Homo sapiens
tccaggcagggcagccatcaag

SEQ ID NO: 8570824 - DNA, 22 bp, Homo sapiens
tccaggcagggcagccatcaag

SEQ ID NO: 8570825 - DNA, 22 bp, Homo sapiens
tccaggagtctagcctcaggcc

SEQ ID NO: 8570826 - DNA, 22 bp, Homo sapiens
tccaggagtctagcctcaggcc

SEQ ID NO: 8570827 - DNA, 22 bp, Homo sapiens
tccaggagtcctgggtggcccc

SEQ ID NO: 8570828 - DNA, 22 bp, Homo sapiens
tccaggagtcctgggtggcccc

SEQ ID NO: 8570829 - DNA, 22 bp, Homo sapiens
tccaggagtcagacagatggtg

SEQ ID NO: 8570830 - DNA, 22 bp, Homo sapiens
tccaggagtcctgggagtgatt

SEQ ID NO: 8570831 - DNA, 22 bp, Homo sapiens
tccaggagtcagacagatggtg

SEQ ID NO: 8570832 - DNA, 22 bp, Homo sapiens
tccaggaggtttggaggaagca

SEQ ID NO: 8570833 - DNA, 22 bp, Homo sapiens
tccaggaggtttggaggaagca

SEQ ID NO: 8570834 - DNA, 22 bp, Homo sapiens
tccaggaggttgagactgcagt

SEQ ID NO: 8570835 - DNA, 22 bp, Homo sapiens
tccaggaggttgagactgcagt

SEQ ID NO: 8570836 - DNA, 22 bp, Homo sapiens
tccaggaggttgagactgcagt

SEQ ID NO: 8570837 - DNA, 22 bp, Homo sapiens
tccaggaggttgagactgcagt

SEQ ID NO: 8570838 - DNA, 20 bp, Homo sapiens
tccaggaggttagtgtggct

SEQ ID NO: 8570839 - DNA, 22 bp, Homo sapiens
tccaggaggtgaggggaccaaa

SEQ ID NO: 8570840 - DNA, 22 bp, Homo sapiens
tccaggaggtatgagtggcccc

SEQ ID NO: 8570841 - DNA, 22 bp, Homo sapiens
tccaggaggtgaggggaccaaa

SEQ ID NO: 8570842 - DNA, 22 bp, Homo sapiens
tccaggagggattgggctgtgg

SEQ ID NO: 8570843 - DNA, 22 bp, Homo sapiens
tccaggagggggagccgtgccg

SEQ ID NO: 8570844 - DNA, 22 bp, Homo sapiens
tccaggagggttttctgccttc

SEQ ID NO: 8570845 - DNA, 22 bp, Homo sapiens
tccaggagggttttctgccttc

SEQ ID NO: 8570846 - DNA, 22 bp, Homo sapiens
tccaggctgatccatgaagaat

SEQ ID NO: 8570847 - DNA, 22 bp, Homo sapiens
tccaggctgcaaggccacaggg

SEQ ID NO: 8570848 - DNA, 22 bp, Homo sapiens
tccaggctgcaaggccacaggg

SEQ ID NO: 8570849 - DNA, 19 bp, Homo sapiens
tccaggctgagagtcagct

SEQ ID NO: 8570850 - DNA, 21 bp, Homo sapiens
tccaggctgatgatgtcaact

SEQ ID NO: 8570851 - DNA, 23 bp, Homo sapiens
tccaggctgaaggagcagatttt

SEQ ID NO: 8570852 - DNA, 22 bp, Homo sapiens
tccaggctgacgcagctattta

SEQ ID NO: 8570853 - DNA, 19 bp, Homo sapiens
tccaggctgagagtcagct

SEQ ID NO: 8570854 - DNA, 22 bp, Homo sapiens
tccaggctctaggctgctctcc

SEQ ID NO: 8570855 - DNA, 22 bp, Homo sapiens
tccaggctctcaggtgtcagca

SEQ ID NO: 8570856 - DNA, 22 bp, Homo sapiens
tccaggctctcaggtgtcagca

SEQ ID NO: 8570857 - DNA, 22 bp, Homo sapiens
tccaggccactgcagaggctct

SEQ ID NO: 8570858 - DNA, 22 bp, Homo sapiens
tccaggccactgcagaggctct

SEQ ID NO: 8570859 - DNA, 22 bp, Homo sapiens
tccaggctaggtttacaggaca

SEQ ID NO: 8570860 - DNA, 22 bp, Homo sapiens
tccaggctcagcacttgctact

SEQ ID NO: 8570861 - DNA, 22 bp, Homo sapiens
tccaggctaggtttacaggaca

SEQ ID NO: 8570862 - DNA, 22 bp, Homo sapiens
tccaggctaggtttacaggaca

SEQ ID NO: 8570863 - DNA, 22 bp, Homo sapiens
tccaggccacgacctcctggat

SEQ ID NO: 8570864 - DNA, 22 bp, Homo sapiens
tccaggccacgacctcctggat

SEQ ID NO: 8570865 - DNA, 22 bp, Homo sapiens
tccaggccacgacctcctggat

SEQ ID NO: 8570866 - DNA, 22 bp, Homo sapiens
tccaggccaatgtagcaggccc

SEQ ID NO: 8570867 - DNA, 22 bp, Homo sapiens
tccaggccacatggatggcgat

SEQ ID NO: 8570868 - DNA, 22 bp, Homo sapiens
tccaggccacatggatggcgat

SEQ ID NO: 8570869 - DNA, 22 bp, Homo sapiens
tccaggccaatgtagcaggccc

SEQ ID NO: 8570870 - DNA, 22 bp, Homo sapiens
tccaggcatgtggccagtactc

SEQ ID NO: 8570871 - DNA, 22 bp, Homo sapiens
tccaggcatctgtattttttaa

SEQ ID NO: 8570872 - DNA, 22 bp, Homo sapiens
tccaggcatggtgtaattttgc

SEQ ID NO: 8570873 - DNA, 22 bp, Homo sapiens
tccccacactttcactcctggc

SEQ ID NO: 8570874 - DNA, 22 bp, Homo sapiens
tccccacagcagaagatctgag

SEQ ID NO: 8570875 - DNA, 22 bp, Homo sapiens
tccccacactttcactcctggc

SEQ ID NO: 8570876 - DNA, 21 bp, Homo sapiens
tccccacatttctaaacagac

SEQ ID NO: 8570877 - DNA, 22 bp, Homo sapiens
tccccacatctctgcatcaggc

SEQ ID NO: 8570878 - DNA, 22 bp, Homo sapiens
tccccaagtaaagatcctgaga

SEQ ID NO: 8570879 - DNA, 22 bp, Homo sapiens
tccccaagcaggcaatctcccg

SEQ ID NO: 8570880 - DNA, 22 bp, Homo sapiens
tccccacacagatacagagtag

SEQ ID NO: 8570881 - DNA, 22 bp, Homo sapiens
tccccacacagatacagagtag

SEQ ID NO: 8570882 - DNA, 19 bp, Homo sapiens
tccccaagagttctagctc

SEQ ID NO: 8570883 - DNA, 22 bp, Homo sapiens
tccccaggagcaatgattcagt

SEQ ID NO: 8570884 - DNA, 22 bp, Homo sapiens
tccccaggaatcaggtggttgc

SEQ ID NO: 8570885 - DNA, 22 bp, Homo sapiens
tccccaggaaattctgattctt

SEQ ID NO: 8570886 - DNA, 22 bp, Homo sapiens
tccccaggaaggcccttcctgg

SEQ ID NO: 8570887 - DNA, 22 bp, Homo sapiens
tccccaggaaggcccttcctgg

SEQ ID NO: 8570888 - DNA, 22 bp, Homo sapiens
tccccaggaaattctgattctt

SEQ ID NO: 8570889 - DNA, 22 bp, Homo sapiens
tccccacctacacactgctcct

SEQ ID NO: 8570890 - DNA, 22 bp, Homo sapiens
tccccacctacacactgctcct

SEQ ID NO: 8570891 - DNA, 22 bp, Homo sapiens
tccccaccccagaactactagg

SEQ ID NO: 8570892 - DNA, 22 bp, Homo sapiens
tccccaccccagaactactagg

SEQ ID NO: 8570893 - DNA, 22 bp, Homo sapiens
tccccacctaagatacccatct

SEQ ID NO: 8570894 - DNA, 22 bp, Homo sapiens
tccccacctaagatacccatct

SEQ ID NO: 8570895 - DNA, 22 bp, Homo sapiens
tccccaggggcatctctctgct

SEQ ID NO: 8570896 - DNA, 22 bp, Homo sapiens
tccccaggggcctgggcacagt

SEQ ID NO: 8570897 - DNA, 22 bp, Homo sapiens
tccccaggggcatctctctgct

SEQ ID NO: 8570898 - DNA, 22 bp, Homo sapiens
tccccagggtccctgcttccat

SEQ ID NO: 8570899 - DNA, 22 bp, Homo sapiens
tccccaggggcctgggcacagt

SEQ ID NO: 8570900 - DNA, 22 bp, Homo sapiens
tccccaggggcctgggcacagt

SEQ ID NO: 8570901 - DNA, 22 bp, Homo sapiens
tccccaggagcaatgattcagt

SEQ ID NO: 8570902 - DNA, 22 bp, Homo sapiens
tccccaggagttttactttgca

SEQ ID NO: 8570903 - DNA, 20 bp, Homo sapiens
tccccagggcatcaggagca

SEQ ID NO: 8570904 - DNA, 20 bp, Homo sapiens
tccccagggcatcaggagca

SEQ ID NO: 8570905 - DNA, 22 bp, Homo sapiens
tccccaggggcatctctctgct

SEQ ID NO: 8570906 - DNA, 22 bp, Homo sapiens
tcccagggtgcgcctgccctcg

SEQ ID NO: 8570907 - DNA, 22 bp, Homo sapiens
tcccagggtgcgcctgccctcg

SEQ ID NO: 8570908 - DNA, 22 bp, Homo sapiens
tcccagggtgcgcctgccctcg

SEQ ID NO: 8570909 - DNA, 22 bp, Homo sapiens
tcccagggtgcgcctgccctcg

SEQ ID NO: 8570910 - DNA, 22 bp, Homo sapiens
tcccagggttacagccagggca

SEQ ID NO: 8570911 - DNA, 22 bp, Homo sapiens
tcccagggttacagccagggca

SEQ ID NO: 8570912 - DNA, 22 bp, Homo sapiens
tcccagggttacagccagggca

SEQ ID NO: 8570913 - DNA, 22 bp, Homo sapiens
tcccagggattaggacatggat

SEQ ID NO: 8570914 - DNA, 22 bp, Homo sapiens
tcccagggatcctccgggtcgc

SEQ ID NO: 8570915 - DNA, 22 bp, Homo sapiens
tcccagggatcctccgggtcgc

SEQ ID NO: 8570916 - DNA, 22 bp, Homo sapiens
tcccagggattaggacatggat

SEQ ID NO: 8570917 - DNA, 21 bp, Homo sapiens
tcccagggtcttatgggatgt

SEQ ID NO: 8570918 - DNA, 22 bp, Homo sapiens
tcccagggtgaaatgcagtagg

SEQ ID NO: 8570919 - DNA, 22 bp, Homo sapiens
tcccagggtgaaatgcagtagg

SEQ ID NO: 8570920 - DNA, 22 bp, Homo sapiens
tcccacagtgaagttcatgata

SEQ ID NO: 8570921 - DNA, 22 bp, Homo sapiens
tcccagggatcctccgggtcgc

SEQ ID NO: 8570922 - DNA, 22 bp, Homo sapiens
tcccagggactgggctaggctt

SEQ ID NO: 8570923 - DNA, 22 bp, Homo sapiens
tcccagggactgggctaggctt

SEQ ID NO: 8570924 - DNA, 22 bp, Homo sapiens
tcccacaggggctctgtgggtt

SEQ ID NO: 8570925 - DNA, 22 bp, Homo sapiens
tcccacaggtggagcttgcagt

SEQ ID NO: 8570926 - DNA, 22 bp, Homo sapiens
tcccacagtgaagttcatgata

SEQ ID NO: 8570927 - DNA, 22 bp, Homo sapiens
tcccacagtgaagttcatgata

SEQ ID NO: 8570928 - DNA, 22 bp, Homo sapiens
tcccagggactggatgatgcag

SEQ ID NO: 8570929 - DNA, 22 bp, Homo sapiens
tcccacagtctcacaatgcata

SEQ ID NO: 8570930 - DNA, 22 bp, Homo sapiens
tcccacaggtggagcttgcagt

SEQ ID NO: 8570931 - DNA, 22 bp, Homo sapiens
tcccacagggcttctctgtaca

SEQ ID NO: 8570932 - DNA, 22 bp, Homo sapiens
tcccacagggcttctctgtaca

SEQ ID NO: 8570933 - DNA, 22 bp, Homo sapiens
tcccacaggcccagggcggaaa

SEQ ID NO: 8570934 - DNA, 22 bp, Homo sapiens
tcccacagggcttctctgtaca

SEQ ID NO: 8570935 - DNA, 22 bp, Homo sapiens
tcccacaggcccagggcggaaa

SEQ ID NO: 8570936 - DNA, 22 bp, Homo sapiens
tcccacaggagcctgagtccca

SEQ ID NO: 8570937 - DNA, 22 bp, Homo sapiens
tcccacaggaggagttggaaat

SEQ ID NO: 8570938 - DNA, 22 bp, Homo sapiens
tcccacaggaggagttggaaat

SEQ ID NO: 8570939 - DNA, 22 bp, Homo sapiens
tcccacaggaaagtagacattg

SEQ ID NO: 8570940 - DNA, 22 bp, Homo sapiens
tcccacaggaaagtagacattg

SEQ ID NO: 8570941 - DNA, 22 bp, Homo sapiens
tcccacaggagcctgagtccca

SEQ ID NO: 8570942 - DNA, 22 bp, Homo sapiens
tcccatgtgttcctctagtcta

SEQ ID NO: 8570943 - DNA, 22 bp, Homo sapiens
tcccatgttaggtgtttctgtt

SEQ ID NO: 8570944 - DNA, 22 bp, Homo sapiens
tcccattgccatagataggaca

SEQ ID NO: 8570945 - DNA, 22 bp, Homo sapiens
tcccattctgccaaggacattg

SEQ ID NO: 8570946 - DNA, 22 bp, Homo sapiens
tcccatctccaacatttttctt

SEQ ID NO: 8570947 - DNA, 22 bp, Homo sapiens
tcccatctccaacatttttctt

SEQ ID NO: 8570948 - DNA, 22 bp, Homo sapiens
tcccatggtctatatagaggca

SEQ ID NO: 8570949 - DNA, 22 bp, Homo sapiens
tcccatggtctatatagaggca

SEQ ID NO: 8570950 - DNA, 22 bp, Homo sapiens
tcccatcactagcatctgcacc

SEQ ID NO: 8570951 - DNA, 22 bp, Homo sapiens
tcccagtttttctccactaagg

SEQ ID NO: 8570952 - DNA, 22 bp, Homo sapiens
tcccagtgggtgactggaggct

SEQ ID NO: 8570953 - DNA, 19 bp, Homo sapiens
tcccagtggggagaggtgt

SEQ ID NO: 8570954 - DNA, 22 bp, Homo sapiens
tcccagtggtgggtgcacattt

SEQ ID NO: 8570955 - DNA, 22 bp, Homo sapiens
tcccagtgctgctaaagaggta

SEQ ID NO: 8570956 - DNA, 22 bp, Homo sapiens
tcccagtgctacagacagggca

SEQ ID NO: 8570957 - DNA, 22 bp, Homo sapiens
tcccagtgctacagacagggca

SEQ ID NO: 8570958 - DNA, 22 bp, Homo sapiens
tcccagtgaggtcctggctgtc

SEQ ID NO: 8570959 - DNA, 22 bp, Homo sapiens
tcccagtgagatgaaacaggta

SEQ ID NO: 8570960 - DNA, 22 bp, Homo sapiens
taaacaagggttactgagcatg

SEQ ID NO: 8570961 - DNA, 22 bp, Homo sapiens
taaacaagggttactgagcatg

SEQ ID NO: 8570962 - DNA, 22 bp, Homo sapiens
taaacactcacttcatagccat

SEQ ID NO: 8570963 - DNA, 22 bp, Homo sapiens
taaacaagctgtctgatattct

SEQ ID NO: 8570964 - DNA, 22 bp, Homo sapiens
taaacagaattcaggcaagata

SEQ ID NO: 8570965 - DNA, 22 bp, Homo sapiens
taaagggtaggttttactgtaa

SEQ ID NO: 8570966 - DNA, 22 bp, Homo sapiens
taaagggtaggttttactgtaa

SEQ ID NO: 8570967 - DNA, 22 bp, Homo sapiens
taaacactgccttggtgggtca

SEQ ID NO: 8570968 - DNA, 22 bp, Homo sapiens
taaacagaaagcagatgtactt

SEQ ID NO: 8570969 - DNA, 22 bp, Homo sapiens
taaacagaatgcgtaagaagtg

SEQ ID NO: 8570970 - DNA, 22 bp, Homo sapiens
taaacaagaaacattttctgtt

SEQ ID NO: 8570971 - DNA, 22 bp, Homo sapiens
taaacaagctggactgataagt

SEQ ID NO: 8570972 - DNA, 22 bp, Homo sapiens
taaaattgcggtgaatatttcc

SEQ ID NO: 8570973 - DNA, 22 bp, Homo sapiens
taaaattgcggtgaatatttcc

SEQ ID NO: 8570974 - DNA, 22 bp, Homo sapiens
taaaattgcggtgaatatttcc

SEQ ID NO: 8570975 - DNA, 22 bp, Homo sapiens
taaaatttgtccctgagtgttg

SEQ ID NO: 8570976 - DNA, 22 bp, Homo sapiens
taaaattgcggtgaatatttcc

SEQ ID NO: 8570977 - DNA, 22 bp, Homo sapiens
taaaatgtttgcaagagaccag

SEQ ID NO: 8570978 - DNA, 22 bp, Homo sapiens
taaaatgtttgcaagagaccag

SEQ ID NO: 8570979 - DNA, 22 bp, Homo sapiens
taaaatgtgtttctgtatggtt

SEQ ID NO: 8570980 - DNA, 22 bp, Homo sapiens
taaaatgtgtttctgtatggtt

SEQ ID NO: 8570981 - DNA, 22 bp, Homo sapiens
taaaatgatctctcatgttctt

SEQ ID NO: 8570982 - DNA, 22 bp, Homo sapiens
taaaatagaggatgtcatgcta

SEQ ID NO: 8570983 - DNA, 22 bp, Homo sapiens
taaaatgcacagcagttgaaag

SEQ ID NO: 8570984 - DNA, 22 bp, Homo sapiens
taaaagttttagttgtacataa

SEQ ID NO: 8570985 - DNA, 22 bp, Homo sapiens
taaaatagaggatgtcatgcta

SEQ ID NO: 8570986 - DNA, 22 bp, Homo sapiens
taaaatgtgtttctgtatggtt

SEQ ID NO: 8570987 - DNA, 19 bp, Homo sapiens
taaaatgtctgtggtcagt

SEQ ID NO: 8570988 - DNA, 19 bp, Homo sapiens
taaaatgtctgtggtcagt

SEQ ID NO: 8570989 - DNA, 22 bp, Homo sapiens
taaaatgtagcttctaggctgg

SEQ ID NO: 8570990 - DNA, 22 bp, Homo sapiens
taaaatgtagcttctaggctgg

SEQ ID NO: 8570991 - DNA, 22 bp, Homo sapiens
gtttttatctaatagcagttat

SEQ ID NO: 8570992 - DNA, 22 bp, Homo sapiens
gtttttatctaatagcagttat

SEQ ID NO: 8570993 - DNA, 22 bp, Homo sapiens
gtttttatctaatagcagttat

SEQ ID NO: 8570994 - DNA, 22 bp, Homo sapiens
gtttttattgtgtaaatgtggg

SEQ ID NO: 8570995 - DNA, 22 bp, Homo sapiens
gtttttattgtgtaaatgtggg

SEQ ID NO: 8570996 - DNA, 22 bp, Homo sapiens
gtttttattgtgtaaatgtggg

SEQ ID NO: 8570997 - DNA, 22 bp, Homo sapiens
gttttgttttgagtcaactcca

SEQ ID NO: 8570998 - DNA, 22 bp, Homo sapiens
gtttttatatcctgtggagtgt

SEQ ID NO: 8570999 - DNA, 22 bp, Homo sapiens
gtttttatatcctgtggagtgt

SEQ ID NO: 8571000 - DNA, 22 bp, Homo sapiens
gtttttatatcctgtggagtgt

SEQ ID NO: 8571001 - DNA, 22 bp, Homo sapiens
gtttttatatcctgtggagtgt

SEQ ID NO: 8571002 - DNA, 22 bp, Homo sapiens
gttttgtgaggcacccacaggt

SEQ ID NO: 8571003 - DNA, 22 bp, Homo sapiens
gttttggagtcaggcttagatg

SEQ ID NO: 8571004 - DNA, 22 bp, Homo sapiens
gttttggcagccgtgttcacat

SEQ ID NO: 8571005 - DNA, 22 bp, Homo sapiens
gttttggctctggcatgtggaa

SEQ ID NO: 8571006 - DNA, 22 bp, Homo sapiens
gttttgttgctgcagagctcaa

SEQ ID NO: 8571007 - DNA, 18 bp, Homo sapiens
gttttgaattgtcttaca

SEQ ID NO: 8571008 - DNA, 22 bp, Homo sapiens
gttttgcagagtgcaataaatc

SEQ ID NO: 8571009 - DNA, 18 bp, Homo sapiens
gttttgaattgtcttaca

SEQ ID NO: 8571010 - DNA, 19 bp, Homo sapiens
gttttgcaggcagagggga

SEQ ID NO: 8571011 - DNA, 22 bp, Homo sapiens
gttttgaatactactagaactt

SEQ ID NO: 8571012 - DNA, 22 bp, Homo sapiens
gttttgaatactactagaactt

SEQ ID NO: 8571013 - DNA, 22 bp, Homo sapiens
gttttgaatcactgcgcttcac

SEQ ID NO: 8571014 - DNA, 22 bp, Homo sapiens
gttttgaaatgaaagaaccaag

SEQ ID NO: 8571015 - DNA, 22 bp, Homo sapiens
gttttgaagaagaccttgaaac

SEQ ID NO: 8571016 - DNA, 22 bp, Homo sapiens
gttttgaaatgaaagaaccaag

SEQ ID NO: 8571017 - DNA, 21 bp, Homo sapiens
gttttctttgatagagggaag

SEQ ID NO: 8571018 - DNA, 22 bp, Homo sapiens
gttttctttgaatgcttctaga

SEQ ID NO: 8571019 - DNA, 22 bp, Homo sapiens
gttttctttgaatgcttctaga

SEQ ID NO: 8571020 - DNA, 22 bp, Homo sapiens
gttttcttcctgcaattggcat

SEQ ID NO: 8571021 - DNA, 22 bp, Homo sapiens
gttttcttcctgcaattggcat

SEQ ID NO: 8571022 - DNA, 22 bp, Homo sapiens
gttttcattactgctgtgattt

SEQ ID NO: 8571023 - DNA, 22 bp, Homo sapiens
gttttcattactgctgtgattt

SEQ ID NO: 8571024 - DNA, 22 bp, Homo sapiens
gttttcatgtctattgggcata

SEQ ID NO: 8571025 - DNA, 22 bp, Homo sapiens
gttttcatgtctattgggcata

SEQ ID NO: 8571026 - DNA, 22 bp, Homo sapiens
gtttcccagtctgcagagttct

SEQ ID NO: 8571027 - DNA, 22 bp, Homo sapiens
gtttcccaggctgtggggccct

SEQ ID NO: 8571028 - DNA, 22 bp, Homo sapiens
gtttccatggctctgttaatgg

SEQ ID NO: 8571029 - DNA, 22 bp, Homo sapiens
gtttccatggctctgttaatgg

SEQ ID NO: 8571030 - DNA, 22 bp, Homo sapiens
gtttcccaaattgttcacaggg

SEQ ID NO: 8571031 - DNA, 22 bp, Homo sapiens
gtttccatctccaggacataat

SEQ ID NO: 8571032 - DNA, 22 bp, Homo sapiens
gtttccagtcaacttgtgtgtg

SEQ ID NO: 8571033 - DNA, 22 bp, Homo sapiens
gtttccaggcgatatcagctgc

SEQ ID NO: 8571034 - DNA, 22 bp, Homo sapiens
gtttccacttgagaggactcct

SEQ ID NO: 8571035 - DNA, 22 bp, Homo sapiens
gtttccacttatatggtaccta

SEQ ID NO: 8571036 - DNA, 22 bp, Homo sapiens
gtttccacgtctcagttccaaa

SEQ ID NO: 8571037 - DNA, 22 bp, Homo sapiens
gtttccagctttctgatgcttg

SEQ ID NO: 8571038 - DNA, 22 bp, Homo sapiens
taaattcccaactctgctcttc

SEQ ID NO: 8571039 - DNA, 22 bp, Homo sapiens
taaattgaaaatctacagaaca

SEQ ID NO: 8571040 - DNA, 22 bp, Homo sapiens
taaattcagtgagtaatttctg

SEQ ID NO: 8571041 - DNA, 22 bp, Homo sapiens
taaattcagtgagtaatttctg

SEQ ID NO: 8571042 - DNA, 22 bp, Homo sapiens
taaattcagtgagtaatttctg

SEQ ID NO: 8571043 - DNA, 22 bp, Homo sapiens
taaatttacccaaggaacatgt

SEQ ID NO: 8571044 - DNA, 22 bp, Homo sapiens
taaatttacccaaggaacatgt

SEQ ID NO: 8571045 - DNA, 22 bp, Homo sapiens
taaattgttttctagaagttgt

SEQ ID NO: 8571046 - DNA, 22 bp, Homo sapiens
taaattgtcctccccctggtat

SEQ ID NO: 8571047 - DNA, 22 bp, Homo sapiens
taaattgatcgtttgggatgaa

SEQ ID NO: 8571048 - DNA, 22 bp, Homo sapiens
taaattgagattattagggtaa

SEQ ID NO: 8571049 - DNA, 23 bp, Homo sapiens
taaattgatggtatgggttaagc

SEQ ID NO: 8571050 - DNA, 22 bp, Homo sapiens
taaattgatcgtttgggatgaa

SEQ ID NO: 8571051 - DNA, 23 bp, Homo sapiens
taaatttcttgattcttatgtga

SEQ ID NO: 8571052 - DNA, 22 bp, Homo sapiens
taacattaaaagagataattga

SEQ ID NO: 8571053 - DNA, 18 bp, Homo sapiens
taacatgttttcattaag

SEQ ID NO: 8571054 - DNA, 22 bp, Homo sapiens
taacattacggacatctgtcag

SEQ ID NO: 8571055 - DNA, 22 bp, Homo sapiens
taaccagcatgaaatctgcagc

SEQ ID NO: 8571056 - DNA, 22 bp, Homo sapiens
taaccatattttccattaagtt

SEQ ID NO: 8571057 - DNA, 22 bp, Homo sapiens
taacctgaacacacaataggga

SEQ ID NO: 8571058 - DNA, 22 bp, Homo sapiens
taacctctgagctccagcttct

SEQ ID NO: 8571059 - DNA, 22 bp, Homo sapiens
taacctctatttttataaaagt

SEQ ID NO: 8571060 - DNA, 17 bp, Homo sapiens
taacctctctgaacctg

SEQ ID NO: 8571061 - DNA, 22 bp, Homo sapiens
taacctctctgtgcctcagttt

SEQ ID NO: 8571062 - DNA, 22 bp, Homo sapiens
taaccatgcatgtctctagttt

SEQ ID NO: 8571063 - DNA, 22 bp, Homo sapiens
taacctacatgagaactttaaa

SEQ ID NO: 8571064 - DNA, 22 bp, Homo sapiens
taactgatgttcccttactgta

SEQ ID NO: 8571065 - DNA, 22 bp, Homo sapiens
taactgaatgtattacaacaga

SEQ ID NO: 8571066 - DNA, 22 bp, Homo sapiens
taactgaatgtattacaacaga

SEQ ID NO: 8571067 - DNA, 22 bp, Homo sapiens
taactgaagctggaagcgctgg

SEQ ID NO: 8571068 - DNA, 22 bp, Homo sapiens
taactcttccaacactccttcc

SEQ ID NO: 8571069 - DNA, 19 bp, Homo sapiens
taactctttccttttcccc

SEQ ID NO: 8571070 - DNA, 22 bp, Homo sapiens
taactctttactatacatttat

SEQ ID NO: 8571071 - DNA, 22 bp, Homo sapiens
taactctgaatcctcacagcag

SEQ ID NO: 8571072 - DNA, 22 bp, Homo sapiens
taactctcacagtgcaacatga

SEQ ID NO: 8571073 - DNA, 23 bp, Homo sapiens
taactctgtgaagggtgactggg

SEQ ID NO: 8571074 - DNA, 22 bp, Homo sapiens
taactctgcttgttctctgagt

SEQ ID NO: 8571075 - DNA, 22 bp, Homo sapiens
taactctgaatcctcacagcag

SEQ ID NO: 8571076 - DNA, 22 bp, Homo sapiens
taacctgaggagaacagtgctt

SEQ ID NO: 8571077 - DNA, 23 bp, Homo sapiens
taacctgagattgcaagggagct

SEQ ID NO: 8571078 - DNA, 22 bp, Homo sapiens
taacctgactgctctttagaat

SEQ ID NO: 8571079 - DNA, 22 bp, Homo sapiens
taacctgactgctctttagaat

SEQ ID NO: 8571080 - DNA, 23 bp, Homo sapiens
taacctgagttttttagatgcaa

SEQ ID NO: 8571081 - DNA, 22 bp, Homo sapiens
taacctggatgtgccaacgtga

SEQ ID NO: 8571082 - DNA, 22 bp, Homo sapiens
taacctggggcctgaagaccat

SEQ ID NO: 8571083 - DNA, 22 bp, Homo sapiens
taacctgctgtgctggtcagtc

SEQ ID NO: 8571084 - DNA, 22 bp, Homo sapiens
taacctgcaacagatctgtctt

SEQ ID NO: 8571085 - DNA, 22 bp, Homo sapiens
taacctggatgtgccaacgtga

SEQ ID NO: 8571086 - DNA, 22 bp, Homo sapiens
taacctggggcggtttcccaat

SEQ ID NO: 8571087 - DNA, 22 bp, Homo sapiens
taacctgggatctgacgggatg

SEQ ID NO: 8571088 - DNA, 22 bp, Homo sapiens
taacctggggcctgaagaccat

SEQ ID NO: 8571089 - DNA, 22 bp, Homo sapiens
taacctggggcggtttcccaat

SEQ ID NO: 8571090 - DNA, 22 bp, Homo sapiens
taacctgttaagggctgaccca

SEQ ID NO: 8571091 - DNA, 22 bp, Homo sapiens
taacctttggtgaaatattaac

SEQ ID NO: 8571092 - DNA, 22 bp, Homo sapiens
taacctttgaccttgcttgtgc

SEQ ID NO: 8571093 - DNA, 22 bp, Homo sapiens
taactacatttcactgcaatta

SEQ ID NO: 8571094 - DNA, 22 bp, Homo sapiens
taactacaagggcggtctctgt

SEQ ID NO: 8571095 - DNA, 22 bp, Homo sapiens
taacgtttgataacttctgttc

SEQ ID NO: 8571096 - DNA, 22 bp, Homo sapiens
taacctttgttcaatgtaagat

SEQ ID NO: 8571097 - DNA, 22 bp, Homo sapiens
taacctttttatcttacctcca

SEQ ID NO: 8571098 - DNA, 22 bp, Homo sapiens
taaaggtttattcaacaaaata

SEQ ID NO: 8571099 - DNA, 22 bp, Homo sapiens
taaaggttgaaaactgactgcc

SEQ ID NO: 8571100 - DNA, 22 bp, Homo sapiens
taaaggttattgcactggagtt

SEQ ID NO: 8571101 - DNA, 22 bp, Homo sapiens
taaagtagcaagtttagactga

SEQ ID NO: 8571102 - DNA, 22 bp, Homo sapiens
taaaggtagtgtgacatattgt

SEQ ID NO: 8571103 - DNA, 22 bp, Homo sapiens
taaaggtagtgtgacatattgt

SEQ ID NO: 8571104 - DNA, 22 bp, Homo sapiens
taaaggtagtgtgacatattgt

SEQ ID NO: 8571105 - DNA, 22 bp, Homo sapiens
taaaggtagtgtgacatattgt

SEQ ID NO: 8571106 - DNA, 22 bp, Homo sapiens
taaaggtaacatgaactgcttt

SEQ ID NO: 8571107 - DNA, 22 bp, Homo sapiens
taaaggtaacatgaactgcttt

SEQ ID NO: 8571108 - DNA, 22 bp, Homo sapiens
taaaggtacgaagtgagggatt

SEQ ID NO: 8571109 - DNA, 22 bp, Homo sapiens
taaaggtagcatgaaactgcaa

SEQ ID NO: 8571110 - DNA, 22 bp, Homo sapiens
taaaggtagcatgaaactgcaa

SEQ ID NO: 8571111 - DNA, 22 bp, Homo sapiens
taaaggtatgtcttaatcaaac

SEQ ID NO: 8571112 - DNA, 22 bp, Homo sapiens
taaaggtagttttaaaggtgct

SEQ ID NO: 8571113 - DNA, 22 bp, Homo sapiens
taaaggtatgtcttaatcaaac

SEQ ID NO: 8571114 - DNA, 22 bp, Homo sapiens
taaaggttagtagcagggaaac

SEQ ID NO: 8571115 - DNA, 22 bp, Homo sapiens
taaaggttataaaggttagggg

SEQ ID NO: 8571116 - DNA, 22 bp, Homo sapiens
taaagtatccagttattcttct

SEQ ID NO: 8571117 - DNA, 22 bp, Homo sapiens
taaagtcaaggtactgtttcac

SEQ ID NO: 8571118 - DNA, 22 bp, Homo sapiens
taaagtgcccagggaaagcggg

SEQ ID NO: 8571119 - DNA, 22 bp, Homo sapiens
taaagtgcttatgataaccaag

SEQ ID NO: 8571120 - DNA, 22 bp, Homo sapiens
taaagtgctgggattataggcc

SEQ ID NO: 8571121 - DNA, 22 bp, Homo sapiens
taaagtgctgggattataggcc

SEQ ID NO: 8571122 - DNA, 22 bp, Homo sapiens
taaagtgctggatttgagtaaa

SEQ ID NO: 8571123 - DNA, 22 bp, Homo sapiens
taaagtgctggatttgagtaaa

SEQ ID NO: 8571124 - DNA, 22 bp, Homo sapiens
taaagtgcctcaggtcctgggt

SEQ ID NO: 8571125 - DNA, 22 bp, Homo sapiens
taaagtgcgacccagtccccag

SEQ ID NO: 8571126 - DNA, 23 bp, Homo sapiens
taaagtgctgatggtgagggagc

SEQ ID NO: 8571127 - DNA, 22 bp, Homo sapiens
taaagtgctcataaaaatggat

SEQ ID NO: 8571128 - DNA, 20 bp, Homo sapiens
taaattagccttgaagatta

SEQ ID NO: 8571129 - DNA, 22 bp, Homo sapiens
taaattatggctggcagagcag

SEQ ID NO: 8571130 - DNA, 22 bp, Homo sapiens
taaattatggctggcagagcag

SEQ ID NO: 8571131 - DNA, 22 bp, Homo sapiens
taaattatggctggcagagcag

SEQ ID NO: 8571132 - DNA, 22 bp, Homo sapiens
taaattatgttccatgtccttt

SEQ ID NO: 8571133 - DNA, 22 bp, Homo sapiens
taaattcactcctggtagacct

SEQ ID NO: 8571134 - DNA, 22 bp, Homo sapiens
taaattatgttccatgtccttt

SEQ ID NO: 8571135 - DNA, 23 bp, Homo sapiens
taaattacctttccagtgcaggg

SEQ ID NO: 8571136 - DNA, 22 bp, Homo sapiens
taaattaaagattggagaagga

SEQ ID NO: 8571137 - DNA, 22 bp, Homo sapiens
taaattactcaatgcacataaa

SEQ ID NO: 8571138 - DNA, 22 bp, Homo sapiens
taaagtgtctgcctcagctcag

SEQ ID NO: 8571139 - DNA, 22 bp, Homo sapiens
taaagtgtatgccatctctcat

SEQ ID NO: 8571140 - DNA, 22 bp, Homo sapiens
taaattaaagattggagaagga

SEQ ID NO: 8571141 - DNA, 22 bp, Homo sapiens
taaattaaagattggagaagga

SEQ ID NO: 8571142 - DNA, 22 bp, Homo sapiens
taaagtgtgcatggtcaaatat

SEQ ID NO: 8571143 - DNA, 22 bp, Homo sapiens
taaagtgcttcctaacccagag

SEQ ID NO: 8571144 - DNA, 22 bp, Homo sapiens
taaagtgcttcctaacccagag

SEQ ID NO: 8571145 - DNA, 22 bp, Homo sapiens
taaagtgcttatgataaccaag

SEQ ID NO: 8571146 - DNA, 22 bp, Homo sapiens
gttaataaaggtatagaatcag

SEQ ID NO: 8571147 - DNA, 22 bp, Homo sapiens
gttaataaaggtatagaatcag

SEQ ID NO: 8571148 - DNA, 22 bp, Homo sapiens
gttaagtgaatgtcatgtcagg

SEQ ID NO: 8571149 - DNA, 22 bp, Homo sapiens
gttaaggatcttgagatgagga

SEQ ID NO: 8571150 - DNA, 21 bp, Homo sapiens
gttaagccttgaggtgattgt

SEQ ID NO: 8571151 - DNA, 22 bp, Homo sapiens
gttaaggctgagcaggacactg

SEQ ID NO: 8571152 - DNA, 22 bp, Homo sapiens
gttaatgtcactttatgtggct

SEQ ID NO: 8571153 - DNA, 22 bp, Homo sapiens
gttaatgcctacatattaagca

SEQ ID NO: 8571154 - DNA, 22 bp, Homo sapiens
gttaatgtcttcctattctaca

SEQ ID NO: 8571155 - DNA, 22 bp, Homo sapiens
gttaatgtcttcctattctaca

SEQ ID NO: 8571156 - DNA, 22 bp, Homo sapiens
gttaatacaaccatgatcttct

SEQ ID NO: 8571157 - DNA, 22 bp, Homo sapiens
gttaatgccattaggaaattta

SEQ ID NO: 8571158 - DNA, 22 bp, Homo sapiens
gttaatgtggtagtgcatatct

SEQ ID NO: 8571159 - DNA, 22 bp, Homo sapiens
gttaatgtgtctgacacaatgg

SEQ ID NO: 8571160 - DNA, 22 bp, Homo sapiens
gttaatgtgtctgacacaatgg

SEQ ID NO: 8571161 - DNA, 22 bp, Homo sapiens
gttaatgttatctgaagacagt

SEQ ID NO: 8571162 - DNA, 22 bp, Homo sapiens
gttacaaagcacttcaagtgaa

SEQ ID NO: 8571163 - DNA, 22 bp, Homo sapiens
gttacaaagcacttcaagtgaa

SEQ ID NO: 8571164 - DNA, 22 bp, Homo sapiens
gttacaaaggaagcttcactgc

SEQ ID NO: 8571165 - DNA, 22 bp, Homo sapiens
gttacaaaggaagcttcactgc

SEQ ID NO: 8571166 - DNA, 22 bp, Homo sapiens
gttacaaactcaggtgccaaaa

SEQ ID NO: 8571167 - DNA, 22 bp, Homo sapiens
gttacaaactcaggtgccaaaa

SEQ ID NO: 8571168 - DNA, 22 bp, Homo sapiens
gttacaaactcaggtgccaaaa

SEQ ID NO: 8571169 - DNA, 22 bp, Homo sapiens
gtgtgcctcccattagggtgta

SEQ ID NO: 8571170 - DNA, 22 bp, Homo sapiens
gtgtgcctcccattagggtgta

SEQ ID NO: 8571171 - DNA, 22 bp, Homo sapiens
gtgtgcctcgccaagctgtcgg

SEQ ID NO: 8571172 - DNA, 22 bp, Homo sapiens
gtgtggctacctcagaggagca

SEQ ID NO: 8571173 - DNA, 22 bp, Homo sapiens
gtgtggccttgggagaggtctg

SEQ ID NO: 8571174 - DNA, 22 bp, Homo sapiens
gtgtggcctcaacgggatgcaa

SEQ ID NO: 8571175 - DNA, 23 bp, Homo sapiens
gtgtgcctttatcttctgtactc

SEQ ID NO: 8571176 - DNA, 22 bp, Homo sapiens
gtgtggctacctcagaggagca

SEQ ID NO: 8571177 - DNA, 18 bp, Homo sapiens
gtgtggctgagatgaggc

SEQ ID NO: 8571178 - DNA, 22 bp, Homo sapiens
gtgtggctaggatggctttgct

SEQ ID NO: 8571179 - DNA, 22 bp, Homo sapiens
gtgtggctgaaatcaaggcagg

SEQ ID NO: 8571180 - DNA, 22 bp, Homo sapiens
gtgtggctagaagtgtcttgtt

SEQ ID NO: 8571181 - DNA, 22 bp, Homo sapiens
gtgtggctgccagccaagaggc

SEQ ID NO: 8571182 - DNA, 22 bp, Homo sapiens
gtgtggctgattgacatggtca

SEQ ID NO: 8571183 - DNA, 22 bp, Homo sapiens
gtgtggctgtgggagatgttca

SEQ ID NO: 8571184 - DNA, 22 bp, Homo sapiens
gtgtggctgattgacatggtca

SEQ ID NO: 8571185 - DNA, 22 bp, Homo sapiens
gtgtggctgccagccaagaggc

SEQ ID NO: 8571186 - DNA, 22 bp, Homo sapiens
gtgtggctgtgggagatgttca

SEQ ID NO: 8571187 - DNA, 22 bp, Homo sapiens
gtgtggctgtttagtgactttc

SEQ ID NO: 8571188 - DNA, 22 bp, Homo sapiens
gtgtggcttgggtgaggcgcct

SEQ ID NO: 8571189 - DNA, 22 bp, Homo sapiens
gtgtggctttctgggtttaatt

SEQ ID NO: 8571190 - DNA, 22 bp, Homo sapiens
gtgtgggaatggcggtcgtgca

SEQ ID NO: 8571191 - DNA, 22 bp, Homo sapiens
gttaagaagctagagatgaaca

SEQ ID NO: 8571192 - DNA, 22 bp, Homo sapiens
gttaacatttctaggtgcaggg

SEQ ID NO: 8571193 - DNA, 22 bp, Homo sapiens
gttaacattcaattaaacagtc

SEQ ID NO: 8571194 - DNA, 22 bp, Homo sapiens
gttaagaacttgttgaaggtct

SEQ ID NO: 8571195 - DNA, 22 bp, Homo sapiens
gttaactttttacagaaatgaa

SEQ ID NO: 8571196 - DNA, 22 bp, Homo sapiens
gttaactttttacagaaatgaa

SEQ ID NO: 8571197 - DNA, 22 bp, Homo sapiens
gttaacttccccatgtctgcat

SEQ ID NO: 8571198 - DNA, 22 bp, Homo sapiens
gttaactttcaggtgcatgttt

SEQ ID NO: 8571199 - DNA, 22 bp, Homo sapiens
gttaacttggtagtctaagtgt

SEQ ID NO: 8571200 - DNA, 22 bp, Homo sapiens
gtgctcactgtgagacgtcctg

SEQ ID NO: 8571201 - DNA, 22 bp, Homo sapiens
gtgctccaggtcgctcagagag

SEQ ID NO: 8571202 - DNA, 22 bp, Homo sapiens
gtgctccctccttcctcaagga

SEQ ID NO: 8571203 - DNA, 22 bp, Homo sapiens
gtgctccctccttcctcaagga

SEQ ID NO: 8571204 - DNA, 22 bp, Homo sapiens
gtgctccctccttcctcaagga

SEQ ID NO: 8571205 - DNA, 22 bp, Homo sapiens
gtgctcctggccacatgaagct

SEQ ID NO: 8571206 - DNA, 22 bp, Homo sapiens
gtgctctcctggctgccctgac

SEQ ID NO: 8571207 - DNA, 22 bp, Homo sapiens
gtgctctgcctggggtcatggc

SEQ ID NO: 8571208 - DNA, 23 bp, Homo sapiens
gtgctctgcggtctgctagtctg

SEQ ID NO: 8571209 - DNA, 22 bp, Homo sapiens
gtgctcctggccacatgaagct

SEQ ID NO: 8571210 - DNA, 22 bp, Homo sapiens
gtgctctgagtttgcatgtcag

SEQ ID NO: 8571211 - DNA, 22 bp, Homo sapiens
gtgctctgggctgcctgacatg

SEQ ID NO: 8571212 - DNA, 21 bp, Homo sapiens
gtgctctgggcagcagagggc

SEQ ID NO: 8571213 - DNA, 21 bp, Homo sapiens
gtgctctgggcagcagagggc

SEQ ID NO: 8571214 - DNA, 22 bp, Homo sapiens
gtgctctggctggtctcccggt

SEQ ID NO: 8571215 - DNA, 22 bp, Homo sapiens
gtgctctggctggtctcccggt

SEQ ID NO: 8571216 - DNA, 22 bp, Homo sapiens
gtgctctggctggtctcccggt

SEQ ID NO: 8571217 - DNA, 22 bp, Homo sapiens
gtgctctgtggattgagttgaa

SEQ ID NO: 8571218 - DNA, 22 bp, Homo sapiens
gtgctctgtgtattaggatgtc

SEQ ID NO: 8571219 - DNA, 22 bp, Homo sapiens
gtgctctgtggattgagttgaa

SEQ ID NO: 8571220 - DNA, 22 bp, Homo sapiens
gtgctctgtgtattaggatgtc

SEQ ID NO: 8571221 - DNA, 23 bp, Homo sapiens
gtgctcttcagttttagggtcat

SEQ ID NO: 8571222 - DNA, 22 bp, Homo sapiens
gtgtgcatatgtgtggctctcc

SEQ ID NO: 8571223 - DNA, 22 bp, Homo sapiens
gtgtgcagtgagcaaaagatct

SEQ ID NO: 8571224 - DNA, 22 bp, Homo sapiens
gtgctgaagtgaaattcatcaa

SEQ ID NO: 8571225 - DNA, 18 bp, Homo sapiens
gtgtgcagttgcaggggt

SEQ ID NO: 8571226 - DNA, 22 bp, Homo sapiens
gtgctgaactataaaaagcttt

SEQ ID NO: 8571227 - DNA, 22 bp, Homo sapiens
gtgctgaaatggacctcaggaa

SEQ ID NO: 8571228 - DNA, 22 bp, Homo sapiens
gtgtgccagacatgatgctatg

SEQ ID NO: 8571229 - DNA, 22 bp, Homo sapiens
gtgtgccaggaactggctgctg

SEQ ID NO: 8571230 - DNA, 22 bp, Homo sapiens
gtgtgccaccactgacaggatt

SEQ ID NO: 8571231 - DNA, 22 bp, Homo sapiens
gtgtgccaccagtcaaggtgaa

SEQ ID NO: 8571232 - DNA, 23 bp, Homo sapiens
gtgtgccaagcactgtgccagga

SEQ ID NO: 8571233 - DNA, 23 bp, Homo sapiens
gtgtgccaagcactgtgccagga

SEQ ID NO: 8571234 - DNA, 22 bp, Homo sapiens
gtgtgccaacaaaagacagtgc

SEQ ID NO: 8571235 - DNA, 22 bp, Homo sapiens
gtgtgccaacaaaagacagtgc

SEQ ID NO: 8571236 - DNA, 22 bp, Homo sapiens
gtgtgcatgcatagacaccaca

SEQ ID NO: 8571237 - DNA, 22 bp, Homo sapiens
gtgtgcatgtgcttgcacagat

SEQ ID NO: 8571238 - DNA, 22 bp, Homo sapiens
gtgtgcatgtggaagcatgtat

SEQ ID NO: 8571239 - DNA, 22 bp, Homo sapiens
gtgtgcatgtggaagcatgtat

SEQ ID NO: 8571240 - DNA, 22 bp, Homo sapiens
gttgaggtgatgccagccctgc

SEQ ID NO: 8571241 - DNA, 22 bp, Homo sapiens
gttgaggtgatgccagccctgc

SEQ ID NO: 8571242 - DNA, 22 bp, Homo sapiens
gttgaggtgatgccagccctgc

SEQ ID NO: 8571243 - DNA, 22 bp, Homo sapiens
gttgagtgggttaggatgctga

SEQ ID NO: 8571244 - DNA, 22 bp, Homo sapiens
gttcatttatgatgtaacatgt

SEQ ID NO: 8571245 - DNA, 22 bp, Homo sapiens
gttgaggagcaagcatgtgtct

SEQ ID NO: 8571246 - DNA, 22 bp, Homo sapiens
gttgaggaggttcagggtggtt

SEQ ID NO: 8571247 - DNA, 22 bp, Homo sapiens
gttgaggaggcactcactgtca

SEQ ID NO: 8571248 - DNA, 22 bp, Homo sapiens
gttcatgtggaaatttaaaaca

SEQ ID NO: 8571249 - DNA, 22 bp, Homo sapiens
gttcatgtggtttttaaaggat

SEQ ID NO: 8571250 - DNA, 22 bp, Homo sapiens
gttcatgctaccctttcctaat

SEQ ID NO: 8571251 - DNA, 22 bp, Homo sapiens
gttcattcatcaaatatttact

SEQ ID NO: 8571252 - DNA, 22 bp, Homo sapiens
gttcattgtgtgtggtcttctt

SEQ ID NO: 8571253 - DNA, 22 bp, Homo sapiens
gttcatattactttgagtgcag

SEQ ID NO: 8571254 - DNA, 22 bp, Homo sapiens
gttcataatttgaaggaatagg

SEQ ID NO: 8571255 - DNA, 22 bp, Homo sapiens
gttcatcctgacttggattagt

SEQ ID NO: 8571256 - DNA, 22 bp, Homo sapiens
gttcatccatgtcagcgtatat

SEQ ID NO: 8571257 - DNA, 22 bp, Homo sapiens
gttcatccatattatagcatgt

SEQ ID NO: 8571258 - DNA, 22 bp, Homo sapiens
gttcatatttaactaagatagg

SEQ ID NO: 8571259 - DNA, 22 bp, Homo sapiens
gttcagtattaatgagatgatt

SEQ ID NO: 8571260 - DNA, 22 bp, Homo sapiens
gttacaaaggtcataaaagtgt

SEQ ID NO: 8571261 - DNA, 22 bp, Homo sapiens
gttacaaaggtcataaaagtgt

SEQ ID NO: 8571262 - DNA, 22 bp, Homo sapiens
gttacaaaggactgggggccac

SEQ ID NO: 8571263 - DNA, 22 bp, Homo sapiens
gttacaaaggactgggggccac

SEQ ID NO: 8571264 - DNA, 21 bp, Homo sapiens
gttcaatagctctttgaatgc

SEQ ID NO: 8571265 - DNA, 22 bp, Homo sapiens
gttcacatccttgtgaggattt

SEQ ID NO: 8571266 - DNA, 22 bp, Homo sapiens
gttcagatttgactggtttctc

SEQ ID NO: 8571267 - DNA, 22 bp, Homo sapiens
gttcagcagcagtgattttgtg

SEQ ID NO: 8571268 - DNA, 22 bp, Homo sapiens
gttcagggagggacagatgaag

SEQ ID NO: 8571269 - DNA, 22 bp, Homo sapiens
gttcacatggcattttcacatc

SEQ ID NO: 8571270 - DNA, 22 bp, Homo sapiens
gttgggctcattacagcctgct

SEQ ID NO: 8571271 - DNA, 22 bp, Homo sapiens
gttgggctgggagctgccctga

SEQ ID NO: 8571272 - DNA, 22 bp, Homo sapiens
gttggggtaccttgaggctggg

SEQ ID NO: 8571273 - DNA, 22 bp, Homo sapiens
gttggggtccaatgaagcgagc

SEQ ID NO: 8571274 - DNA, 22 bp, Homo sapiens
gttgctcaggcaggagtacagt

SEQ ID NO: 8571275 - DNA, 22 bp, Homo sapiens
gttgctcaggcaggagtacagt

SEQ ID NO: 8571276 - DNA, 22 bp, Homo sapiens
gttgctcaggcaggagtacagt

SEQ ID NO: 8571277 - DNA, 22 bp, Homo sapiens
gttgcctaggctggagtgcagt

SEQ ID NO: 8571278 - DNA, 22 bp, Homo sapiens
gttgccgtttgttctaccagac

SEQ ID NO: 8571279 - DNA, 22 bp, Homo sapiens
gttgcaggaggatggctgcata

SEQ ID NO: 8571280 - DNA, 22 bp, Homo sapiens
gttgcagatgtggaactcgtgc

SEQ ID NO: 8571281 - DNA, 22 bp, Homo sapiens
gttgcaggaggatggctgcata

SEQ ID NO: 8571282 - DNA, 22 bp, Homo sapiens
gttgcagacactccacagtcga

SEQ ID NO: 8571283 - DNA, 22 bp, Homo sapiens
gttgcagacggggtgcactgaa

SEQ ID NO: 8571284 - DNA, 22 bp, Homo sapiens
gttgagtgttgtgcatgcacca

SEQ ID NO: 8571285 - DNA, 22 bp, Homo sapiens
gttgagtgggttaggatgctga

SEQ ID NO: 8571286 - DNA, 18 bp, Homo sapiens
gtttcatgcatgtgaaac

SEQ ID NO: 8571287 - DNA, 22 bp, Homo sapiens
gtttcatttacatctgtaggta

SEQ ID NO: 8571288 - DNA, 22 bp, Homo sapiens
gtttcattacctgacccatgag

SEQ ID NO: 8571289 - DNA, 22 bp, Homo sapiens
gtttcattacctgacccatgag

SEQ ID NO: 8571290 - DNA, 23 bp, Homo sapiens
gttgtaatggataatgcaaattg

SEQ ID NO: 8571291 - DNA, 22 bp, Homo sapiens
gttgtacaattgtttcacatgc

SEQ ID NO: 8571292 - DNA, 22 bp, Homo sapiens
gttgtaaatacagtactgaaac

SEQ ID NO: 8571293 - DNA, 22 bp, Homo sapiens
gtttcagaacaccccatttggg

SEQ ID NO: 8571294 - DNA, 22 bp, Homo sapiens
gtttcagaggtgttcattttca

SEQ ID NO: 8571295 - DNA, 22 bp, Homo sapiens
gtttcagatatatttgtactta

SEQ ID NO: 8571296 - DNA, 22 bp, Homo sapiens
gtttcagatttggtttcagaag

SEQ ID NO: 8571297 - DNA, 22 bp, Homo sapiens
gtttcagatttggtttcagaag

SEQ ID NO: 8571298 - DNA, 22 bp, Homo sapiens
tacaaaaaattgatactgacga

SEQ ID NO: 8571299 - DNA, 22 bp, Homo sapiens
tacaaaaaattgatactgacga

SEQ ID NO: 8571300 - DNA, 22 bp, Homo sapiens
taattatagccgctattttgct

SEQ ID NO: 8571301 - DNA, 22 bp, Homo sapiens
taattatagccgctattttgct

SEQ ID NO: 8571302 - DNA, 22 bp, Homo sapiens
tacaaactctttatatttcata

SEQ ID NO: 8571303 - DNA, 22 bp, Homo sapiens
tacaaactccgaagtttgtacc

SEQ ID NO: 8571304 - DNA, 22 bp, Homo sapiens
tacaaactgttattattattgt

SEQ ID NO: 8571305 - DNA, 22 bp, Homo sapiens
tacaaagaggtaattgcatata

SEQ ID NO: 8571306 - DNA, 22 bp, Homo sapiens
tacaaagaggtaattgcatata

SEQ ID NO: 8571307 - DNA, 22 bp, Homo sapiens
tacaaagaggtaattgcatata

SEQ ID NO: 8571308 - DNA, 22 bp, Homo sapiens
tacaaagaggtaattgcatata

SEQ ID NO: 8571309 - DNA, 22 bp, Homo sapiens
tacaaagagtttggtctctaga

SEQ ID NO: 8571310 - DNA, 22 bp, Homo sapiens
tacaaagagtttggtctctaga

SEQ ID NO: 8571311 - DNA, 22 bp, Homo sapiens
tacaaagagtttggtctctaga

SEQ ID NO: 8571312 - DNA, 22 bp, Homo sapiens
tacaaacttgttttaagtaagt

SEQ ID NO: 8571313 - DNA, 20 bp, Homo sapiens
tacaaagaatgaggttcagg

SEQ ID NO: 8571314 - DNA, 20 bp, Homo sapiens
tacaaagagcccctctcttc

SEQ ID NO: 8571315 - DNA, 22 bp, Homo sapiens
tacaaagaggcagctccatttt

SEQ ID NO: 8571316 - DNA, 22 bp, Homo sapiens
tacaaagataaaatctcaccat

SEQ ID NO: 8571317 - DNA, 22 bp, Homo sapiens
tacaaagatagtgttagagtaa

SEQ ID NO: 8571318 - DNA, 22 bp, Homo sapiens
tacaaagatggaaggttatgtt

SEQ ID NO: 8571319 - DNA, 22 bp, Homo sapiens
tacaaagcaaatcatctaagag

SEQ ID NO: 8571320 - DNA, 22 bp, Homo sapiens
tacaaagctgtatagcctggtc

SEQ ID NO: 8571321 - DNA, 22 bp, Homo sapiens
tacaaagcctggtagatatctg

SEQ ID NO: 8571322 - DNA, 22 bp, Homo sapiens
tacaaagcctggtagatatctg

SEQ ID NO: 8571323 - DNA, 22 bp, Homo sapiens
tacaaagtcacattgaaatgaa

SEQ ID NO: 8571324 - DNA, 22 bp, Homo sapiens
tacaaagtatatttctagctgt

SEQ ID NO: 8571325 - DNA, 22 bp, Homo sapiens
tacaaagtagaaattcagtaaa

SEQ ID NO: 8571326 - DNA, 22 bp, Homo sapiens
tacaaagtaatgtataatatcg

SEQ ID NO: 8571327 - DNA, 22 bp, Homo sapiens
tacaaaggagtagagaaggctt

SEQ ID NO: 8571328 - DNA, 22 bp, Homo sapiens
taatacttaccttgcagagtct

SEQ ID NO: 8571329 - DNA, 22 bp, Homo sapiens
taatacttgtcataaaggcatt

SEQ ID NO: 8571330 - DNA, 22 bp, Homo sapiens
taatacttgctttggatgtatg

SEQ ID NO: 8571331 - DNA, 22 bp, Homo sapiens
taatactttgaatgagagctaa

SEQ ID NO: 8571332 - DNA, 22 bp, Homo sapiens
taatacttttgccttgtattca

SEQ ID NO: 8571333 - DNA, 22 bp, Homo sapiens
taatagaatagtggaaacattg

SEQ ID NO: 8571334 - DNA, 22 bp, Homo sapiens
taatacttaccttgcagagtct

SEQ ID NO: 8571335 - DNA, 22 bp, Homo sapiens
taatagaatagtggaaacattg

SEQ ID NO: 8571336 - DNA, 22 bp, Homo sapiens
taatagaatagtggaaacattg

SEQ ID NO: 8571337 - DNA, 22 bp, Homo sapiens
taatagaatagtggaaacattg

SEQ ID NO: 8571338 - DNA, 22 bp, Homo sapiens
taatagaatagtggaaacattg

SEQ ID NO: 8571339 - DNA, 22 bp, Homo sapiens
taatggctaaaattcagaagaa

SEQ ID NO: 8571340 - DNA, 22 bp, Homo sapiens
taatggctaaaattcagaagaa

SEQ ID NO: 8571341 - DNA, 22 bp, Homo sapiens
taatggttttttggagactgct

SEQ ID NO: 8571342 - DNA, 22 bp, Homo sapiens
taattacagaggtttgccagtt

SEQ ID NO: 8571343 - DNA, 22 bp, Homo sapiens
taattacaggtccaaaacaatc

SEQ ID NO: 8571344 - DNA, 22 bp, Homo sapiens
taattataacagttacatctta

SEQ ID NO: 8571345 - DNA, 22 bp, Homo sapiens
taattataacagttacatctta

SEQ ID NO: 8571346 - DNA, 22 bp, Homo sapiens
taattataacagttacatctta

SEQ ID NO: 8571347 - DNA, 22 bp, Homo sapiens
taattataacagttacatctta

SEQ ID NO: 8571348 - DNA, 22 bp, Homo sapiens
taattataacagttacatctta

SEQ ID NO: 8571349 - DNA, 23 bp, Homo sapiens
taattagatgttgattcctgaga

SEQ ID NO: 8571350 - DNA, 22 bp, Homo sapiens
taattagagtcacaagtaacca

SEQ ID NO: 8571351 - DNA, 22 bp, Homo sapiens
taattataacatgctttctggc

SEQ ID NO: 8571352 - DNA, 22 bp, Homo sapiens
taattatacaaaaaggcatgca

SEQ ID NO: 8571353 - DNA, 22 bp, Homo sapiens
taattataacatgctttctggc

SEQ ID NO: 8571354 - DNA, 22 bp, Homo sapiens
taattatagccgctattttgct

SEQ ID NO: 8571355 - DNA, 22 bp, Homo sapiens
taattatagccgctattttgct

SEQ ID NO: 8571356 - DNA, 22 bp, Homo sapiens
taattatagcattggagtggcc

SEQ ID NO: 8571357 - DNA, 22 bp, Homo sapiens
taattatacaaaaaggcatgca

SEQ ID NO: 8571358 - DNA, 22 bp, Homo sapiens
taattatacaaaaaggcatgca

SEQ ID NO: 8571359 - DNA, 22 bp, Homo sapiens
taatacatcattcatctaagga

SEQ ID NO: 8571360 - DNA, 22 bp, Homo sapiens
taatacatcattcatctaagga

SEQ ID NO: 8571361 - DNA, 22 bp, Homo sapiens
taatacattacctaacctctct

SEQ ID NO: 8571362 - DNA, 22 bp, Homo sapiens
taatactgaaaggagtatcagc

SEQ ID NO: 8571363 - DNA, 22 bp, Homo sapiens
taatacctagagatgatacaaa

SEQ ID NO: 8571364 - DNA, 22 bp, Homo sapiens
taatacctggccttgatacagt

SEQ ID NO: 8571365 - DNA, 22 bp, Homo sapiens
taataccttgatctctcttgtc

SEQ ID NO: 8571366 - DNA, 22 bp, Homo sapiens
taataagcgtagaaggtatatc

SEQ ID NO: 8571367 - DNA, 22 bp, Homo sapiens
taagtgtctctcgaattatgct

SEQ ID NO: 8571368 - DNA, 22 bp, Homo sapiens
taagtgtctaaaaggcagaact

SEQ ID NO: 8571369 - DNA, 22 bp, Homo sapiens
taagtgtccctattgtgatttt

SEQ ID NO: 8571370 - DNA, 22 bp, Homo sapiens
taataatagcagtagctgccac

SEQ ID NO: 8571371 - DNA, 22 bp, Homo sapiens
taataattaacagtgatgggtc

SEQ ID NO: 8571372 - DNA, 22 bp, Homo sapiens
taaggttttgagaccagaacgt

SEQ ID NO: 8571373 - DNA, 22 bp, Homo sapiens
taaggttttgagaccagaacgt

SEQ ID NO: 8571374 - DNA, 22 bp, Homo sapiens
taaggtttgtggggagcaaaag

SEQ ID NO: 8571375 - DNA, 22 bp, Homo sapiens
taaggtttggctgtctcttggt

SEQ ID NO: 8571376 - DNA, 22 bp, Homo sapiens
taaggtttcttcagatactagt

SEQ ID NO: 8571377 - DNA, 22 bp, Homo sapiens
taagtaaatttataatgtgatt

SEQ ID NO: 8571378 - DNA, 22 bp, Homo sapiens
taagtaaatttataatgtgatt

SEQ ID NO: 8571379 - DNA, 22 bp, Homo sapiens
taagtaaaacattcaagaagtc

SEQ ID NO: 8571380 - DNA, 22 bp, Homo sapiens
taagtaaatttataatgtgatt

SEQ ID NO: 8571381 - DNA, 22 bp, Homo sapiens
taagtacaaatgtatacataag

SEQ ID NO: 8571382 - DNA, 22 bp, Homo sapiens
taagtacaaatgtatacataag

SEQ ID NO: 8571383 - DNA, 22 bp, Homo sapiens
taagtacatttgggaccacctg

SEQ ID NO: 8571384 - DNA, 22 bp, Homo sapiens
taagtaactgcataattaaatt

SEQ ID NO: 8571385 - DNA, 22 bp, Homo sapiens
taagtgcatgattgaacttggc

SEQ ID NO: 8571386 - DNA, 22 bp, Homo sapiens
taagtgaatccttgagaagaaa

SEQ ID NO: 8571387 - DNA, 22 bp, Homo sapiens
taagtgaatattttcttctgta

SEQ ID NO: 8571388 - DNA, 22 bp, Homo sapiens
taagtgaatattttcttctgta

SEQ ID NO: 8571389 - DNA, 22 bp, Homo sapiens
taagtgaattgtccgaggacac

SEQ ID NO: 8571390 - DNA, 22 bp, Homo sapiens
taagtgaattgtccgaggacac

SEQ ID NO: 8571391 - DNA, 22 bp, Homo sapiens
taagggttcagaatgcagtggt

SEQ ID NO: 8571392 - DNA, 22 bp, Homo sapiens
taagggttcagaatgcagtggt

SEQ ID NO: 8571393 - DNA, 22 bp, Homo sapiens
taagggttcagaatgcagtggt

SEQ ID NO: 8571394 - DNA, 22 bp, Homo sapiens
taaggtttctagtttctaaact

SEQ ID NO: 8571395 - DNA, 19 bp, Homo sapiens
taaggtttaccagcaaaat

SEQ ID NO: 8571396 - DNA, 22 bp, Homo sapiens
taaggtttcttcagatactagt

SEQ ID NO: 8571397 - DNA, 22 bp, Homo sapiens
taaggtttgaagaagactgagc

SEQ ID NO: 8571398 - DNA, 22 bp, Homo sapiens
taaggtttgcttatcttcgcct

SEQ ID NO: 8571399 - DNA, 22 bp, Homo sapiens
taaggtttaacgccctgtctcg

SEQ ID NO: 8571400 - DNA, 22 bp, Homo sapiens
taaggccaccgttatagaacca

SEQ ID NO: 8571401 - DNA, 22 bp, Homo sapiens
taaggcttatgatcagaaggtt

SEQ ID NO: 8571402 - DNA, 22 bp, Homo sapiens
taaggcttatatacttagacat

SEQ ID NO: 8571403 - DNA, 22 bp, Homo sapiens
taaggcattagagtgaaagcaa

SEQ ID NO: 8571404 - DNA, 22 bp, Homo sapiens
taaggcattctcatgctgtgaa

SEQ ID NO: 8571405 - DNA, 22 bp, Homo sapiens
taaggcagtgaaactattctgt

SEQ ID NO: 8571406 - DNA, 22 bp, Homo sapiens
taaggcataaggccagaggcta

SEQ ID NO: 8571407 - DNA, 22 bp, Homo sapiens
taaggcaaagtgatttcttaaa

SEQ ID NO: 8571408 - DNA, 22 bp, Homo sapiens
taactggcttaaattttatcaa

SEQ ID NO: 8571409 - DNA, 22 bp, Homo sapiens
taaggcaggaactggctgtttt

SEQ ID NO: 8571410 - DNA, 22 bp, Homo sapiens
taaggcaatggcattcttgaca

SEQ ID NO: 8571411 - DNA, 22 bp, Homo sapiens
taaggcaagagcagggtctttg

SEQ ID NO: 8571412 - DNA, 22 bp, Homo sapiens
tacagaaattgccaccagctct

SEQ ID NO: 8571413 - DNA, 22 bp, Homo sapiens
tacagaactgaagtagtgaaaa

SEQ ID NO: 8571414 - DNA, 22 bp, Homo sapiens
tacagaagctgagacactgaga

SEQ ID NO: 8571415 - DNA, 23 bp, Homo sapiens
tacagaaggagtagtcactaaga

SEQ ID NO: 8571416 - DNA, 23 bp, Homo sapiens
tacagaaggagtagtcactaaga

SEQ ID NO: 8571417 - DNA, 22 bp, Homo sapiens
tacagaagcttttgaaaagatg

SEQ ID NO: 8571418 - DNA, 22 bp, Homo sapiens
tacagaagctgagacactgaga

SEQ ID NO: 8571419 - DNA, 22 bp, Homo sapiens
tacagaaattgccaccagctct

SEQ ID NO: 8571420 - DNA, 22 bp, Homo sapiens
tacagaaattgccaccagctct

SEQ ID NO: 8571421 - DNA, 22 bp, Homo sapiens
tacagaaatcacatcgctttga

SEQ ID NO: 8571422 - DNA, 22 bp, Homo sapiens
tacagaaatcacatcgctttga

SEQ ID NO: 8571423 - DNA, 22 bp, Homo sapiens
tacagaaatcacatcgctttga

SEQ ID NO: 8571424 - DNA, 22 bp, Homo sapiens
tacagaaatacagtcaggccta

SEQ ID NO: 8571425 - DNA, 22 bp, Homo sapiens
tacagaaatacagtcaggccta

SEQ ID NO: 8571426 - DNA, 22 bp, Homo sapiens
tacagaaatcacatcgctttga

SEQ ID NO: 8571427 - DNA, 22 bp, Homo sapiens
tacagaaatactggggggttct

SEQ ID NO: 8571428 - DNA, 22 bp, Homo sapiens
tacagagtggtgagatcttttg

SEQ ID NO: 8571429 - DNA, 22 bp, Homo sapiens
tacagagttttcctgccaagaa

SEQ ID NO: 8571430 - DNA, 22 bp, Homo sapiens
tacagagttttcctgccaagaa

SEQ ID NO: 8571431 - DNA, 22 bp, Homo sapiens
tacagaagttggttttagttta

SEQ ID NO: 8571432 - DNA, 22 bp, Homo sapiens
tacagagtatttttaatatggt

SEQ ID NO: 8571433 - DNA, 17 bp, Homo sapiens
tacagaaggcaccacaa

SEQ ID NO: 8571434 - DNA, 22 bp, Homo sapiens
tacagatacagatctagataca

SEQ ID NO: 8571435 - DNA, 22 bp, Homo sapiens
tacagatacagatctagataca

SEQ ID NO: 8571436 - DNA, 22 bp, Homo sapiens
tacagatagaattagtgagtta

SEQ ID NO: 8571437 - DNA, 22 bp, Homo sapiens
tacagataactgaatgcagact

SEQ ID NO: 8571438 - DNA, 22 bp, Homo sapiens
tacagagttttcctgccaagaa

SEQ ID NO: 8571439 - DNA, 22 bp, Homo sapiens
tacagatatagagatttataga

SEQ ID NO: 8571440 - DNA, 22 bp, Homo sapiens
tacagataggaggaatctgaaa

SEQ ID NO: 8571441 - DNA, 22 bp, Homo sapiens
tacagatatatagtgtgtgcct

SEQ ID NO: 8571442 - DNA, 22 bp, Homo sapiens
tacagatatgtatgcacttttt

SEQ ID NO: 8571443 - DNA, 22 bp, Homo sapiens
tacagatattgtacagttatag

SEQ ID NO: 8571444 - DNA, 21 bp, Homo sapiens
tacagatgaggagaccaaggc

SEQ ID NO: 8571445 - DNA, 22 bp, Homo sapiens
tacagcaaagaaaccctcagtc

SEQ ID NO: 8571446 - DNA, 22 bp, Homo sapiens
tacagattttgtgaagaagtgt

SEQ ID NO: 8571447 - DNA, 22 bp, Homo sapiens
tacagcaatgctacaagatgac

SEQ ID NO: 8571448 - DNA, 22 bp, Homo sapiens
tacagcaatgctacaagatgac

SEQ ID NO: 8571449 - DNA, 22 bp, Homo sapiens
tacagcaatgcctgaaatagta

SEQ ID NO: 8571450 - DNA, 22 bp, Homo sapiens
tacagcaatgcctgaaatagta

SEQ ID NO: 8571451 - DNA, 22 bp, Homo sapiens
tacagcaatgcctgaaatagta

SEQ ID NO: 8571452 - DNA, 22 bp, Homo sapiens
tacaacagacaggaataagatt

SEQ ID NO: 8571453 - DNA, 22 bp, Homo sapiens
tacaacagacaggaataagatt

SEQ ID NO: 8571454 - DNA, 22 bp, Homo sapiens
tacaacagacaggaataagatt

SEQ ID NO: 8571455 - DNA, 22 bp, Homo sapiens
tacaacagacaggaataagatt

SEQ ID NO: 8571456 - DNA, 22 bp, Homo sapiens
tacaacaatttccacattagaa

SEQ ID NO: 8571457 - DNA, 22 bp, Homo sapiens
tacaacaatttccacattagaa

SEQ ID NO: 8571458 - DNA, 20 bp, Homo sapiens
tacaacaagtagagacatac

SEQ ID NO: 8571459 - DNA, 22 bp, Homo sapiens
tacaaatcagatcatgagttta

SEQ ID NO: 8571460 - DNA, 22 bp, Homo sapiens
tacaaatcagatcatgagttta

SEQ ID NO: 8571461 - DNA, 22 bp, Homo sapiens
tacaaagtgtgcccatgctgag

SEQ ID NO: 8571462 - DNA, 22 bp, Homo sapiens
tacaaagtttgagaatgctttc

SEQ ID NO: 8571463 - DNA, 22 bp, Homo sapiens
tacaaagtttgagaatgctttc

SEQ ID NO: 8571464 - DNA, 22 bp, Homo sapiens
tacaaagtttgagaatgctttc

SEQ ID NO: 8571465 - DNA, 22 bp, Homo sapiens
tacaaagttttcttggattgag

SEQ ID NO: 8571466 - DNA, 22 bp, Homo sapiens
tacaaagtttggggtcctcaaa

SEQ ID NO: 8571467 - DNA, 22 bp, Homo sapiens
tacaaagtgagcaacctctttt

SEQ ID NO: 8571468 - DNA, 22 bp, Homo sapiens
tacaaagtcagaataacaggtg

SEQ ID NO: 8571469 - DNA, 22 bp, Homo sapiens
tacaaagtcaccagcttcttgc

SEQ ID NO: 8571470 - DNA, 20 bp, Homo sapiens
tacagaaacaggacttttgg

SEQ ID NO: 8571471 - DNA, 20 bp, Homo sapiens
tacagaaacaggacttttgg

SEQ ID NO: 8571472 - DNA, 20 bp, Homo sapiens
tacagaaacaggacttttgg

SEQ ID NO: 8571473 - DNA, 22 bp, Homo sapiens
tacagaaagacctctcgggaaa

SEQ ID NO: 8571474 - DNA, 22 bp, Homo sapiens
tacagaaagggatgattgatct

SEQ ID NO: 8571475 - DNA, 22 bp, Homo sapiens
tacagaaagggatgattgatct

SEQ ID NO: 8571476 - DNA, 22 bp, Homo sapiens
tacagaaagggatgattgatct

SEQ ID NO: 8571477 - DNA, 22 bp, Homo sapiens
tacagaaaaactggcattgaag

SEQ ID NO: 8571478 - DNA, 22 bp, Homo sapiens
tacagaaaaacttggaggcttt

SEQ ID NO: 8571479 - DNA, 22 bp, Homo sapiens
tacagaaaaactggcattgaag

SEQ ID NO: 8571480 - DNA, 22 bp, Homo sapiens
tacagaaacagcgtggttagaa

SEQ ID NO: 8571481 - DNA, 20 bp, Homo sapiens
tacagaaacaggacttttgg

SEQ ID NO: 8571482 - DNA, 22 bp, Homo sapiens
tacagaaacagcgtggttagaa

SEQ ID NO: 8571483 - DNA, 22 bp, Homo sapiens
tacagaaaaacttggaggcttt

SEQ ID NO: 8571484 - DNA, 22 bp, Homo sapiens
tacaacagttcatgaaatgaaa

SEQ ID NO: 8571485 - DNA, 22 bp, Homo sapiens
tacactattttactgatacaaa

SEQ ID NO: 8571486 - DNA, 22 bp, Homo sapiens
tacaacagtaatcaaggttttt

SEQ ID NO: 8571487 - DNA, 22 bp, Homo sapiens
tacactgaagtgtcttggtata

SEQ ID NO: 8571488 - DNA, 22 bp, Homo sapiens
tacactgaaagagaggattgaa

SEQ ID NO: 8571489 - DNA, 22 bp, Homo sapiens
tacactgaagtgtcttggtata

SEQ ID NO: 8571490 - DNA, 22 bp, Homo sapiens
tacactattttactgatacaaa

SEQ ID NO: 8571491 - DNA, 22 bp, Homo sapiens
tacagaaaaacatctggagccg

SEQ ID NO: 8571492 - DNA, 22 bp, Homo sapiens
tacactttttactacagattct

SEQ ID NO: 8571493 - DNA, 22 bp, Homo sapiens
tacactttttactacagattct

SEQ ID NO: 8571494 - DNA, 22 bp, Homo sapiens
tacacttttctggttactcttg

SEQ ID NO: 8571495 - DNA, 22 bp, Homo sapiens
tacactgagatgactttggttt

SEQ ID NO: 8571496 - DNA, 22 bp, Homo sapiens
tacactgaatactagttttcct

SEQ ID NO: 8571497 - DNA, 22 bp, Homo sapiens
tacattctactttttcactccc

SEQ ID NO: 8571498 - DNA, 22 bp, Homo sapiens
tacattctatatctgttacatc

SEQ ID NO: 8571499 - DNA, 22 bp, Homo sapiens
tacattctggaaaggcacagac

SEQ ID NO: 8571500 - DNA, 22 bp, Homo sapiens
tacattctgaaataaatggttt

SEQ ID NO: 8571501 - DNA, 22 bp, Homo sapiens
tacattgaaagtcatttaatcc

SEQ ID NO: 8571502 - DNA, 22 bp, Homo sapiens
tacattgaaatcaatggatgtg

SEQ ID NO: 8571503 - DNA, 22 bp, Homo sapiens
tacattgaaatcaatggatgtg

SEQ ID NO: 8571504 - DNA, 22 bp, Homo sapiens
tacattgaaagtcatttaatcc

SEQ ID NO: 8571505 - DNA, 22 bp, Homo sapiens
tacattctggtggagaaagtaa

SEQ ID NO: 8571506 - DNA, 23 bp, Homo sapiens
tacattctgtatttttatagagt

SEQ ID NO: 8571507 - DNA, 22 bp, Homo sapiens
tacattgagcacgtactatgtg

SEQ ID NO: 8571508 - DNA, 22 bp, Homo sapiens
tacattgagaaccactgcttag

SEQ ID NO: 8571509 - DNA, 22 bp, Homo sapiens
tacattgagaaccactgcttag

SEQ ID NO: 8571510 - DNA, 22 bp, Homo sapiens
tacattgactctctgtccctaa

SEQ ID NO: 8571511 - DNA, 22 bp, Homo sapiens
tacattgacttggattgttaga

SEQ ID NO: 8571512 - DNA, 22 bp, Homo sapiens
tacattgaattttttagcatgt

SEQ ID NO: 8571513 - DNA, 22 bp, Homo sapiens
tacattgaattttttagcatgt

SEQ ID NO: 8571514 - DNA, 21 bp, Homo sapiens
tacattgaagaatgggaatga

SEQ ID NO: 8571515 - DNA, 21 bp, Homo sapiens
tacattgactacaaataaagc

SEQ ID NO: 8571516 - DNA, 22 bp, Homo sapiens
tacatttgctttgattttcagc

SEQ ID NO: 8571517 - DNA, 22 bp, Homo sapiens
tacatttgctttgattttcagc

SEQ ID NO: 8571518 - DNA, 22 bp, Homo sapiens
tacattgatggagtacctagct

SEQ ID NO: 8571519 - DNA, 22 bp, Homo sapiens
tacattgaggcagtagctggag

SEQ ID NO: 8571520 - DNA, 22 bp, Homo sapiens
tacattgaggcagtagctggag

SEQ ID NO: 8571521 - DNA, 22 bp, Homo sapiens
tacatagttccatttacaggaa

SEQ ID NO: 8571522 - DNA, 22 bp, Homo sapiens
tacatatactgagtgatttgct

SEQ ID NO: 8571523 - DNA, 22 bp, Homo sapiens
tacatagcaaggaaatgacaga

SEQ ID NO: 8571524 - DNA, 22 bp, Homo sapiens
tacatagcaaggaaatgacaga

SEQ ID NO: 8571525 - DNA, 22 bp, Homo sapiens
tacatagtattcacattgtttt

SEQ ID NO: 8571526 - DNA, 22 bp, Homo sapiens
tacatagtattcacattgtttt

SEQ ID NO: 8571527 - DNA, 22 bp, Homo sapiens
tacatatagacagttactctag

SEQ ID NO: 8571528 - DNA, 22 bp, Homo sapiens
tacatatagacagttactctag

SEQ ID NO: 8571529 - DNA, 22 bp, Homo sapiens
tacatatagacagttactctag

SEQ ID NO: 8571530 - DNA, 22 bp, Homo sapiens
tacatatactgagtgatttgct

SEQ ID NO: 8571531 - DNA, 22 bp, Homo sapiens
tacatatactgagtgatttgct

SEQ ID NO: 8571532 - DNA, 22 bp, Homo sapiens
tacatatagacagttactctag

SEQ ID NO: 8571533 - DNA, 22 bp, Homo sapiens
tacatatagacagttactctag

SEQ ID NO: 8571534 - DNA, 22 bp, Homo sapiens
tacatatagacagttactctag

SEQ ID NO: 8571535 - DNA, 22 bp, Homo sapiens
tacatcatggcttcatgctgca

SEQ ID NO: 8571536 - DNA, 22 bp, Homo sapiens
tacatcatgtaagcagaatcat

SEQ ID NO: 8571537 - DNA, 22 bp, Homo sapiens
tacatctgatttacctactgaa

SEQ ID NO: 8571538 - DNA, 22 bp, Homo sapiens
tacatctgatttacctactgaa

SEQ ID NO: 8571539 - DNA, 22 bp, Homo sapiens
tacatctcatctgtgctctccg

SEQ ID NO: 8571540 - DNA, 22 bp, Homo sapiens
tacatctatttgacagatacag

SEQ ID NO: 8571541 - DNA, 22 bp, Homo sapiens
tacatctcatctgtgctctccg

SEQ ID NO: 8571542 - DNA, 22 bp, Homo sapiens
tacatctatactgatctacatt

SEQ ID NO: 8571543 - DNA, 22 bp, Homo sapiens
tacatctttgtctatgaccagc

SEQ ID NO: 8571544 - DNA, 22 bp, Homo sapiens
tacatctttgtctatgaccagc

SEQ ID NO: 8571545 - DNA, 22 bp, Homo sapiens
tacatgaaataggattctggag

SEQ ID NO: 8571546 - DNA, 22 bp, Homo sapiens
tacattcctgttagcatctaag

SEQ ID NO: 8571547 - DNA, 22 bp, Homo sapiens
tacatgaacaaaatagcagaaa

SEQ ID NO: 8571548 - DNA, 22 bp, Homo sapiens
tacatccaaatgaattagaatt

SEQ ID NO: 8571549 - DNA, 22 bp, Homo sapiens
tacatccaaagttgaggtgcct

SEQ ID NO: 8571550 - DNA, 22 bp, Homo sapiens
tacatcattttggagatgagca

SEQ ID NO: 8571551 - DNA, 22 bp, Homo sapiens
tacatcatgtaagcagaatcat

SEQ ID NO: 8571552 - DNA, 22 bp, Homo sapiens
tacatctagccttacaattatt

SEQ ID NO: 8571553 - DNA, 22 bp, Homo sapiens
tacatctagccttacaattatt

SEQ ID NO: 8571554 - DNA, 19 bp, Homo sapiens
tacatcctcttcctctttg

SEQ ID NO: 8571555 - DNA, 19 bp, Homo sapiens
tacatccgggttacttaag

SEQ ID NO: 8571556 - DNA, 22 bp, Homo sapiens
tacaggagcatggggaagggat

SEQ ID NO: 8571557 - DNA, 22 bp, Homo sapiens
tacaggagcatggggaagggat

SEQ ID NO: 8571558 - DNA, 22 bp, Homo sapiens
tacaggagctgctctgtgatac

SEQ ID NO: 8571559 - DNA, 22 bp, Homo sapiens
tacaggagcacaaaagagttga

SEQ ID NO: 8571560 - DNA, 22 bp, Homo sapiens
tacaggagcacaaaagagttga

SEQ ID NO: 8571561 - DNA, 17 bp, Homo sapiens
tacaggagagcaggaac

SEQ ID NO: 8571562 - DNA, 21 bp, Homo sapiens
tacagcaccgagtaggccctc

SEQ ID NO: 8571563 - DNA, 20 bp, Homo sapiens
tacaggagtgagtgggtggg

SEQ ID NO: 8571564 - DNA, 19 bp, Homo sapiens
tacaggaggcctgcaatct

SEQ ID NO: 8571565 - DNA, 20 bp, Homo sapiens
tacaggagtgagtgggtggg

SEQ ID NO: 8571566 - DNA, 19 bp, Homo sapiens
tacaggaggcctgcaatct

SEQ ID NO: 8571567 - DNA, 22 bp, Homo sapiens
tacaggaggattatcaaaggat

SEQ ID NO: 8571568 - DNA, 22 bp, Homo sapiens
tacaggaggattatcaaaggat

SEQ ID NO: 8571569 - DNA, 19 bp, Homo sapiens
tacaggcagtttctacaat

SEQ ID NO: 8571570 - DNA, 19 bp, Homo sapiens
tacaggcagtttctacaat

SEQ ID NO: 8571571 - DNA, 22 bp, Homo sapiens
tacaggatatcacttcatttct

SEQ ID NO: 8571572 - DNA, 22 bp, Homo sapiens
tacaggcactgaaatgcttatt

SEQ ID NO: 8571573 - DNA, 22 bp, Homo sapiens
tacaggcactgaaatgcttatt

SEQ ID NO: 8571574 - DNA, 22 bp, Homo sapiens
tacaggcatgtagcatggtgat

SEQ ID NO: 8571575 - DNA, 22 bp, Homo sapiens
tacagtaaccttatttgtcatt

SEQ ID NO: 8571576 - DNA, 22 bp, Homo sapiens
tacagggactcccgcagagata

SEQ ID NO: 8571577 - DNA, 22 bp, Homo sapiens
tacagggacatggaacaggctc

SEQ ID NO: 8571578 - DNA, 22 bp, Homo sapiens
tacagtaactggaattcttctt

SEQ ID NO: 8571579 - DNA, 22 bp, Homo sapiens
tacagtaagatgaaatagcaat

SEQ ID NO: 8571580 - DNA, 22 bp, Homo sapiens
tacagtaagatgaaatagcaat

SEQ ID NO: 8571581 - DNA, 22 bp, Homo sapiens
tacagtaataaaatgagctaca

SEQ ID NO: 8571582 - DNA, 22 bp, Homo sapiens
tacagtaatctggacatgattt

SEQ ID NO: 8571583 - DNA, 22 bp, Homo sapiens
tacagtaataaaatgagctaca

SEQ ID NO: 8571584 - DNA, 22 bp, Homo sapiens
tacagtaataaaatgagctaca

SEQ ID NO: 8571585 - DNA, 22 bp, Homo sapiens
tacagtaataaaatgagctaca

SEQ ID NO: 8571586 - DNA, 22 bp, Homo sapiens
tacagtagaatgcggtgccagt

SEQ ID NO: 8571587 - DNA, 22 bp, Homo sapiens
tacagtagacaatgttagtatg

SEQ ID NO: 8571588 - DNA, 22 bp, Homo sapiens
tacagtagaatttttagtaact

SEQ ID NO: 8571589 - DNA, 22 bp, Homo sapiens
tacagtagacaatgttagtatg

SEQ ID NO: 8571590 - DNA, 22 bp, Homo sapiens
tacagtagctactcaataacta

SEQ ID NO: 8571591 - DNA, 22 bp, Homo sapiens
tacagtagctgaggttctcagg

SEQ ID NO: 8571592 - DNA, 22 bp, Homo sapiens
tacagtagctgaggttctcagg

SEQ ID NO: 8571593 - DNA, 22 bp, Homo sapiens
tacagtagaatcttatagccca

SEQ ID NO: 8571594 - DNA, 22 bp, Homo sapiens
tacagtagaatcttatagccca

SEQ ID NO: 8571595 - DNA, 22 bp, Homo sapiens
tacatagaacatgtttaatgtc

SEQ ID NO: 8571596 - DNA, 22 bp, Homo sapiens
tacatagagggtaatagcatca

SEQ ID NO: 8571597 - DNA, 22 bp, Homo sapiens
tacatagagggtaatagcatca

SEQ ID NO: 8571598 - DNA, 22 bp, Homo sapiens
tacatagattttgaaactggac

SEQ ID NO: 8571599 - DNA, 22 bp, Homo sapiens
tacatacatgtatgtgtgtatt

SEQ ID NO: 8571600 - DNA, 22 bp, Homo sapiens
tacatacattacctcatttagt

SEQ ID NO: 8571601 - DNA, 22 bp, Homo sapiens
tacatacattacctcatttagt

SEQ ID NO: 8571602 - DNA, 22 bp, Homo sapiens
tacatacatgtatgtgtgtatt

SEQ ID NO: 8571603 - DNA, 22 bp, Homo sapiens
tacatacattacctcatttagt

SEQ ID NO: 8571604 - DNA, 22 bp, Homo sapiens
tacatacattacctcatttagt

SEQ ID NO: 8571605 - DNA, 22 bp, Homo sapiens
tatccaaagtggcatattatag

SEQ ID NO: 8571606 - DNA, 22 bp, Homo sapiens
tatccaattcaccattgatggg

SEQ ID NO: 8571607 - DNA, 22 bp, Homo sapiens
tatccatagtttatagatcaag

SEQ ID NO: 8571608 - DNA, 22 bp, Homo sapiens
tatccatattaagatgcctctg

SEQ ID NO: 8571609 - DNA, 22 bp, Homo sapiens
tatccatattcagactgtgaat

SEQ ID NO: 8571610 - DNA, 22 bp, Homo sapiens
tatccatagtttatagatcaag

SEQ ID NO: 8571611 - DNA, 22 bp, Homo sapiens
tatccataccactacttccctt

SEQ ID NO: 8571612 - DNA, 22 bp, Homo sapiens
tatatcatggagattaacattc

SEQ ID NO: 8571613 - DNA, 22 bp, Homo sapiens
tatatcatggagattaacattc

SEQ ID NO: 8571614 - DNA, 22 bp, Homo sapiens
tatatcatggagattaacattc

SEQ ID NO: 8571615 - DNA, 22 bp, Homo sapiens
tatatcttatatgtgcaggtac

SEQ ID NO: 8571616 - DNA, 22 bp, Homo sapiens
tatatcttatatgtgcaggtac

SEQ ID NO: 8571617 - DNA, 22 bp, Homo sapiens
tatatcaccaaaaacagttctg

SEQ ID NO: 8571618 - DNA, 19 bp, Homo sapiens
tatatattttggggttgtg

SEQ ID NO: 8571619 - DNA, 22 bp, Homo sapiens
tatatcagcaaagcatttaaaa

SEQ ID NO: 8571620 - DNA, 22 bp, Homo sapiens
tatatattcttaagtagtgtag

SEQ ID NO: 8571621 - DNA, 22 bp, Homo sapiens
tatagttagtttcataatcatg

SEQ ID NO: 8571622 - DNA, 22 bp, Homo sapiens
tatagtgcattatttacagtaa

SEQ ID NO: 8571623 - DNA, 22 bp, Homo sapiens
tatagtacatggaatcttcata

SEQ ID NO: 8571624 - DNA, 22 bp, Homo sapiens
tataggtatgtcgagaaatgaa

SEQ ID NO: 8571625 - DNA, 22 bp, Homo sapiens
tatagtaaaattttcatttatg

SEQ ID NO: 8571626 - DNA, 22 bp, Homo sapiens
tatagtacacttaggtacttca

SEQ ID NO: 8571627 - DNA, 22 bp, Homo sapiens
tatagtaaaattttcatttatg

SEQ ID NO: 8571628 - DNA, 22 bp, Homo sapiens
tatagtaaaattttcatttatg

SEQ ID NO: 8571629 - DNA, 22 bp, Homo sapiens
tataggctcttgttaacctttt

SEQ ID NO: 8571630 - DNA, 22 bp, Homo sapiens
tataggcagatctgagaatatt

SEQ ID NO: 8571631 - DNA, 22 bp, Homo sapiens
tataggactgatcacattttca

SEQ ID NO: 8571632 - DNA, 21 bp, Homo sapiens
tataggcttccatatgaaggg

SEQ ID NO: 8571633 - DNA, 22 bp, Homo sapiens
tataggcttttgttgcagaaca

SEQ ID NO: 8571634 - DNA, 22 bp, Homo sapiens
tataggcttttgcctgaagcta

SEQ ID NO: 8571635 - DNA, 22 bp, Homo sapiens
tataggaaataggtcttctgtg

SEQ ID NO: 8571636 - DNA, 22 bp, Homo sapiens
tataggaaatttatctcctggg

SEQ ID NO: 8571637 - DNA, 22 bp, Homo sapiens
tataggaaataggtcttctgtg

SEQ ID NO: 8571638 - DNA, 22 bp, Homo sapiens
tataggaaatttatctcctggg

SEQ ID NO: 8571639 - DNA, 22 bp, Homo sapiens
tataggaaggcagattttagct

SEQ ID NO: 8571640 - DNA, 22 bp, Homo sapiens
tataggaagtaattgttgcctg

SEQ ID NO: 8571641 - DNA, 22 bp, Homo sapiens
tataggaaggcagattttagct

SEQ ID NO: 8571642 - DNA, 22 bp, Homo sapiens
tataggaagtattcaaagactg

SEQ ID NO: 8571643 - DNA, 22 bp, Homo sapiens
tatagcacacagtttataaaag

SEQ ID NO: 8571644 - DNA, 22 bp, Homo sapiens
tatagcaattcagaatacatgt

SEQ ID NO: 8571645 - DNA, 22 bp, Homo sapiens
tatagcatctaggatgattgca

SEQ ID NO: 8571646 - DNA, 22 bp, Homo sapiens
tatagccatttccagtggcatc

SEQ ID NO: 8571647 - DNA, 22 bp, Homo sapiens
tatagctaaggtcagactgttt

SEQ ID NO: 8571648 - DNA, 22 bp, Homo sapiens
tataggaaacatacgtgactag

SEQ ID NO: 8571649 - DNA, 22 bp, Homo sapiens
tataggaaaggagtggtcacaa

SEQ ID NO: 8571650 - DNA, 22 bp, Homo sapiens
tatgagaaaataaatatctgtt

SEQ ID NO: 8571651 - DNA, 22 bp, Homo sapiens
tatgagaaaataaatatctgtt

SEQ ID NO: 8571652 - DNA, 22 bp, Homo sapiens
tatgagaaaggagaatgacttt

SEQ ID NO: 8571653 - DNA, 22 bp, Homo sapiens
tatgagaaaggagaatgacttt

SEQ ID NO: 8571654 - DNA, 22 bp, Homo sapiens
tatgagaacaagaacaatctcc

SEQ ID NO: 8571655 - DNA, 22 bp, Homo sapiens
tatgagaataatctggtaaata

SEQ ID NO: 8571656 - DNA, 22 bp, Homo sapiens
tatgactatagggcttagtgtt

SEQ ID NO: 8571657 - DNA, 22 bp, Homo sapiens
tatgacattgctttttagaact

SEQ ID NO: 8571658 - DNA, 22 bp, Homo sapiens
tatgacagtgaaaaaaatcaga

SEQ ID NO: 8571659 - DNA, 22 bp, Homo sapiens
tatgacaggcatgagatcctaa

SEQ ID NO: 8571660 - DNA, 22 bp, Homo sapiens
tatgacagcaaatatccatgag

SEQ ID NO: 8571661 - DNA, 20 bp, Homo sapiens
tatctaaatgcttacattac

SEQ ID NO: 8571662 - DNA, 22 bp, Homo sapiens
tatctaaaggatttaatttagt

SEQ ID NO: 8571663 - DNA, 22 bp, Homo sapiens
tatctaaaggatttaatttagt

SEQ ID NO: 8571664 - DNA, 22 bp, Homo sapiens
tatctaaaggatttaatttagt

SEQ ID NO: 8571665 - DNA, 22 bp, Homo sapiens
tatctaaaggatttaatttagt

SEQ ID NO: 8571666 - DNA, 22 bp, Homo sapiens
tatctaaatggaatattccaga

SEQ ID NO: 8571667 - DNA, 22 bp, Homo sapiens
tatcggtaagatggaaatcagg

SEQ ID NO: 8571668 - DNA, 22 bp, Homo sapiens
tatcctgtgtactgtctagtac

SEQ ID NO: 8571669 - DNA, 22 bp, Homo sapiens
tatcctgttttgcacaattata

SEQ ID NO: 8571670 - DNA, 22 bp, Homo sapiens
tatccttgtactatagtattta

SEQ ID NO: 8571671 - DNA, 22 bp, Homo sapiens
tatccgttgttaccagataaga

SEQ ID NO: 8571672 - DNA, 23 bp, Homo sapiens
tatcctaaaggcaacaggaagtc

SEQ ID NO: 8571673 - DNA, 22 bp, Homo sapiens
tatccgttagaatcatgctggg

SEQ ID NO: 8571674 - DNA, 22 bp, Homo sapiens
tatctacagttaatatgtcatc

SEQ ID NO: 8571675 - DNA, 22 bp, Homo sapiens
tatctacatgtaggtatgtatg

SEQ ID NO: 8571676 - DNA, 22 bp, Homo sapiens
tatctacaggtgtcaggtaaga

SEQ ID NO: 8571677 - DNA, 21 bp, Homo sapiens
tatctacagtgtccattcagt

SEQ ID NO: 8571678 - DNA, 22 bp, Homo sapiens
tatctagaaacagagttttact

SEQ ID NO: 8571679 - DNA, 21 bp, Homo sapiens
tatctactggtgtctttcaga

SEQ ID NO: 8571680 - DNA, 22 bp, Homo sapiens
tatctactcctctttcagatgc

SEQ ID NO: 8571681 - DNA, 19 bp, Homo sapiens
tatgacaagtactagttct

SEQ ID NO: 8571682 - DNA, 22 bp, Homo sapiens
taggtctgatttccattcagtc

SEQ ID NO: 8571683 - DNA, 22 bp, Homo sapiens
taggtctctcttcttgatggga

SEQ ID NO: 8571684 - DNA, 22 bp, Homo sapiens
taggtctcctggcctagagatt

SEQ ID NO: 8571685 - DNA, 22 bp, Homo sapiens
taggtcccttctgtcctggtct

SEQ ID NO: 8571686 - DNA, 20 bp, Homo sapiens
taggtgagggcagatagagg

SEQ ID NO: 8571687 - DNA, 22 bp, Homo sapiens
taggtgagggagcattgtgaga

SEQ ID NO: 8571688 - DNA, 22 bp, Homo sapiens
taggtgaggttacaagagttca

SEQ ID NO: 8571689 - DNA, 22 bp, Homo sapiens
taggtctggcagaagaaaaatg

SEQ ID NO: 8571690 - DNA, 22 bp, Homo sapiens
taggtctgtaccctgtccttct

SEQ ID NO: 8571691 - DNA, 22 bp, Homo sapiens
taggggtgtttcgagagaggtt

SEQ ID NO: 8571692 - DNA, 21 bp, Homo sapiens
taggtatttctatcatgtctc

SEQ ID NO: 8571693 - DNA, 22 bp, Homo sapiens
taggggtgaggccaggcatcag

SEQ ID NO: 8571694 - DNA, 22 bp, Homo sapiens
taggggtgaggccaggcatcag

SEQ ID NO: 8571695 - DNA, 22 bp, Homo sapiens
taggggtggagctaagagtccc

SEQ ID NO: 8571696 - DNA, 22 bp, Homo sapiens
taggggtgggatccaggaatta

SEQ ID NO: 8571697 - DNA, 22 bp, Homo sapiens
taggtgagtttggggaagatag

SEQ ID NO: 8571698 - DNA, 22 bp, Homo sapiens
taggtgctggataaagaatggt

SEQ ID NO: 8571699 - DNA, 22 bp, Homo sapiens
taggtgtctgctcttatttaac

SEQ ID NO: 8571700 - DNA, 22 bp, Homo sapiens
tataaattaatgtgcccatgag

SEQ ID NO: 8571701 - DNA, 22 bp, Homo sapiens
tataaatgcacttttgaaatat

SEQ ID NO: 8571702 - DNA, 22 bp, Homo sapiens
tataaatctttgttcctagaat

SEQ ID NO: 8571703 - DNA, 22 bp, Homo sapiens
tataaatgcacttttgaaatat

SEQ ID NO: 8571704 - DNA, 22 bp, Homo sapiens
tataaagtttcgaaagatgtat

SEQ ID NO: 8571705 - DNA, 22 bp, Homo sapiens
tataaattattaggctgctaaa

SEQ ID NO: 8571706 - DNA, 20 bp, Homo sapiens
tataaattcagagctttggt

SEQ ID NO: 8571707 - DNA, 22 bp, Homo sapiens
tataattagtaaatggcagatt

SEQ ID NO: 8571708 - DNA, 18 bp, Homo sapiens
tataacctgttttgatgg

SEQ ID NO: 8571709 - DNA, 22 bp, Homo sapiens
tataaccttttctttatcctcc

SEQ ID NO: 8571710 - DNA, 22 bp, Homo sapiens
tataacctggattctggcacta

SEQ ID NO: 8571711 - DNA, 18 bp, Homo sapiens
tataacctctgttactca

SEQ ID NO: 8571712 - DNA, 20 bp, Homo sapiens
tataacagtgttgggtgtgt

SEQ ID NO: 8571713 - DNA, 22 bp, Homo sapiens
tataacagtttaggtggtgtca

SEQ ID NO: 8571714 - DNA, 20 bp, Homo sapiens
tataacagtgttgggtgtgt

SEQ ID NO: 8571715 - DNA, 22 bp, Homo sapiens
tataacaggaagtattcaaaca

SEQ ID NO: 8571716 - DNA, 22 bp, Homo sapiens
tataacactcagaaagaatcat

SEQ ID NO: 8571717 - DNA, 22 bp, Homo sapiens
tatacaatggctgaatcatcca

SEQ ID NO: 8571718 - DNA, 22 bp, Homo sapiens
tatacaatggctgaatcatcca

SEQ ID NO: 8571719 - DNA, 22 bp, Homo sapiens
tatacaatggctgaatcatcca

SEQ ID NO: 8571720 - DNA, 22 bp, Homo sapiens
tatacaatggctgaatcatcca

SEQ ID NO: 8571721 - DNA, 22 bp, Homo sapiens
tatacacaaacaaggggttaag

SEQ ID NO: 8571722 - DNA, 22 bp, Homo sapiens
tatacaatggctgaatcatcca

SEQ ID NO: 8571723 - DNA, 22 bp, Homo sapiens
tatacaatggctgaatcatcca

SEQ ID NO: 8571724 - DNA, 22 bp, Homo sapiens
tatacacaaggtgtgcatttgt

SEQ ID NO: 8571725 - DNA, 22 bp, Homo sapiens
tatacacaaggtgtgcatttgt

SEQ ID NO: 8571726 - DNA, 22 bp, Homo sapiens
tatacacacctccaaagcagga

SEQ ID NO: 8571727 - DNA, 22 bp, Homo sapiens
tatacacacctccaaagcagga

SEQ ID NO: 8571728 - DNA, 22 bp, Homo sapiens
tatacaatgagtacattctggg

SEQ ID NO: 8571729 - DNA, 22 bp, Homo sapiens
tatacaatgagtacattctggg

SEQ ID NO: 8571730 - DNA, 22 bp, Homo sapiens
tatacaagtaatgctgaatgat

SEQ ID NO: 8571731 - DNA, 22 bp, Homo sapiens
tatacaagtaatgctgaatgat

SEQ ID NO: 8571732 - DNA, 22 bp, Homo sapiens
tataattttagaagagatggaa

SEQ ID NO: 8571733 - DNA, 22 bp, Homo sapiens
tataatttttctgtggccagtt

SEQ ID NO: 8571734 - DNA, 23 bp, Homo sapiens
tatacacatgtggcagtatagtg

SEQ ID NO: 8571735 - DNA, 22 bp, Homo sapiens
tatacacatcctccaaagatag

SEQ ID NO: 8571736 - DNA, 22 bp, Homo sapiens
tatacacatcctccaaagatag

SEQ ID NO: 8571737 - DNA, 22 bp, Homo sapiens
tatacacatatcttctaggcct

SEQ ID NO: 8571738 - DNA, 22 bp, Homo sapiens
tatacacatatcttctaggcct

SEQ ID NO: 8571739 - DNA, 22 bp, Homo sapiens
tatacacatcctccaaagatag

SEQ ID NO: 8571740 - DNA, 22 bp, Homo sapiens
tatacacatcctccaaagatag

SEQ ID NO: 8571741 - DNA, 17 bp, Homo sapiens
tatacacagacagactg

SEQ ID NO: 8571742 - DNA, 17 bp, Homo sapiens
tatacacagacagactg

SEQ ID NO: 8571743 - DNA, 17 bp, Homo sapiens
tatacacagacagactg

SEQ ID NO: 8571744 - DNA, 22 bp, Homo sapiens
tatacacatatacgtttgtgtg

SEQ ID NO: 8571745 - DNA, 22 bp, Homo sapiens
tatacacaggaatctgtgaaaa

SEQ ID NO: 8571746 - DNA, 22 bp, Homo sapiens
tatacacattacagtttcagga

SEQ ID NO: 8571747 - DNA, 22 bp, Homo sapiens
tatacacatgtgtgtattcata

SEQ ID NO: 8571748 - DNA, 22 bp, Homo sapiens
tatacacatgtgtgtattcata

SEQ ID NO: 8571749 - DNA, 22 bp, Homo sapiens
tatacacatgtgtgtattcata

SEQ ID NO: 8571750 - DNA, 23 bp, Homo sapiens
tatacacatgtggcagtatagtg

SEQ ID NO: 8571751 - DNA, 22 bp, Homo sapiens
tatacacatttttacctatagt

SEQ ID NO: 8571752 - DNA, 22 bp, Homo sapiens
tatacacatttttacctatagt

SEQ ID NO: 8571753 - DNA, 22 bp, Homo sapiens
tatacacatttttacctatagt

SEQ ID NO: 8571754 - DNA, 22 bp, Homo sapiens
tattgaaattcttcatgtcctc

SEQ ID NO: 8571755 - DNA, 22 bp, Homo sapiens
tattgaaattcttcatgtcctc

SEQ ID NO: 8571756 - DNA, 22 bp, Homo sapiens
tattgaaattcttcatgtcctc

SEQ ID NO: 8571757 - DNA, 22 bp, Homo sapiens
tattgaaatgaatgacagtgat

SEQ ID NO: 8571758 - DNA, 22 bp, Homo sapiens
tattgaaattcttcatgtcctc

SEQ ID NO: 8571759 - DNA, 22 bp, Homo sapiens
tattgaagattttgtggttgct

SEQ ID NO: 8571760 - DNA, 22 bp, Homo sapiens
tattgaattagaccctaaaatg

SEQ ID NO: 8571761 - DNA, 22 bp, Homo sapiens
tattgacaataggcaactgagg

SEQ ID NO: 8571762 - DNA, 22 bp, Homo sapiens
tattgacaatttgtgaaactat

SEQ ID NO: 8571763 - DNA, 22 bp, Homo sapiens
tattcttgtatactacaatctt

SEQ ID NO: 8571764 - DNA, 22 bp, Homo sapiens
tattgaaatccattacgttctt

SEQ ID NO: 8571765 - DNA, 22 bp, Homo sapiens
tattgaaatgaatgacagtgat

SEQ ID NO: 8571766 - DNA, 22 bp, Homo sapiens
tattgaaatccattacgttctt

SEQ ID NO: 8571767 - DNA, 22 bp, Homo sapiens
tattcttgtatactacaatctt

SEQ ID NO: 8571768 - DNA, 22 bp, Homo sapiens
tattcttgtcttttccagaaat

SEQ ID NO: 8571769 - DNA, 22 bp, Homo sapiens
tattcttgtaccttaaatgatt

SEQ ID NO: 8571770 - DNA, 22 bp, Homo sapiens
tattcttgtaccttaaatgatt

SEQ ID NO: 8571771 - DNA, 22 bp, Homo sapiens
tattcttgactgcttactatgt

SEQ ID NO: 8571772 - DNA, 22 bp, Homo sapiens
tattcttgtaccttaaatgatt

SEQ ID NO: 8571773 - DNA, 22 bp, Homo sapiens
tattctctgcagctgaatgttt

SEQ ID NO: 8571774 - DNA, 22 bp, Homo sapiens
tattctgggtaccaaacttcaa

SEQ ID NO: 8571775 - DNA, 22 bp, Homo sapiens
tattctgtgtgatatgtaaatg

SEQ ID NO: 8571776 - DNA, 18 bp, Homo sapiens
tattctgtcctatgaagc

SEQ ID NO: 8571777 - DNA, 22 bp, Homo sapiens
tattctggtttccggatctcta

SEQ ID NO: 8571778 - DNA, 22 bp, Homo sapiens
tattctcagcaacacacatgga

SEQ ID NO: 8571779 - DNA, 22 bp, Homo sapiens
tattctagaagtccaccagtct

SEQ ID NO: 8571780 - DNA, 22 bp, Homo sapiens
tattctctccccaatcttgctt

SEQ ID NO: 8571781 - DNA, 22 bp, Homo sapiens
tattccaaaatagttaagcact

SEQ ID NO: 8571782 - DNA, 22 bp, Homo sapiens
tattcattatgaccaaatctag

SEQ ID NO: 8571783 - DNA, 22 bp, Homo sapiens
tattcattatgaccaaatctag

SEQ ID NO: 8571784 - DNA, 22 bp, Homo sapiens
tattcattatgaccaaatctag

SEQ ID NO: 8571785 - DNA, 22 bp, Homo sapiens
tattcattatgaccaaatctag

SEQ ID NO: 8571786 - DNA, 22 bp, Homo sapiens
tattccaactgtcatagtcata

SEQ ID NO: 8571787 - DNA, 22 bp, Homo sapiens
tattccttggcaaaaaatatat

SEQ ID NO: 8571788 - DNA, 22 bp, Homo sapiens
tattctacagtgttagtgttag

SEQ ID NO: 8571789 - DNA, 22 bp, Homo sapiens
tattattttagcactgaggatt

SEQ ID NO: 8571790 - DNA, 19 bp, Homo sapiens
tattatttgtagcaaggcc

SEQ ID NO: 8571791 - DNA, 22 bp, Homo sapiens
tattcatgagataggcagtttt

SEQ ID NO: 8571792 - DNA, 22 bp, Homo sapiens
tattcaaagtaccttcattgcc

SEQ ID NO: 8571793 - DNA, 22 bp, Homo sapiens
tattattgaatcagttctttga

SEQ ID NO: 8571794 - DNA, 22 bp, Homo sapiens
tattattatgcatagcatgaaa

SEQ ID NO: 8571795 - DNA, 22 bp, Homo sapiens
tattattatattggatgagact

SEQ ID NO: 8571796 - DNA, 22 bp, Homo sapiens
tattattgacatttacttggtg

SEQ ID NO: 8571797 - DNA, 22 bp, Homo sapiens
tattattgaatcagttctttga

SEQ ID NO: 8571798 - DNA, 22 bp, Homo sapiens
tattattgactattcagaatgt

SEQ ID NO: 8571799 - DNA, 22 bp, Homo sapiens
tattattgcaagtatataaagt

SEQ ID NO: 8571800 - DNA, 22 bp, Homo sapiens
tattattgcaagtatataaagt

SEQ ID NO: 8571801 - DNA, 22 bp, Homo sapiens
tattattaaatggcagaatttt

SEQ ID NO: 8571802 - DNA, 22 bp, Homo sapiens
tattaggtagattttactgatt

SEQ ID NO: 8571803 - DNA, 22 bp, Homo sapiens
tatttctattccccaggcaagt

SEQ ID NO: 8571804 - DNA, 22 bp, Homo sapiens
tatttctaagctgtaagtctga

SEQ ID NO: 8571805 - DNA, 22 bp, Homo sapiens
tatttctattccccaggcaagt

SEQ ID NO: 8571806 - DNA, 22 bp, Homo sapiens
tatttctcagcattttacatcc

SEQ ID NO: 8571807 - DNA, 22 bp, Homo sapiens
tatttctaagctgtaagtctga

SEQ ID NO: 8571808 - DNA, 22 bp, Homo sapiens
tatttctaagctgtaagtctga

SEQ ID NO: 8571809 - DNA, 22 bp, Homo sapiens
tatttctgaatccaaaaggtca

SEQ ID NO: 8571810 - DNA, 22 bp, Homo sapiens
tatttctgaatccaaaaggtca

SEQ ID NO: 8571811 - DNA, 22 bp, Homo sapiens
tatttctgaatccaaaaggtca

SEQ ID NO: 8571812 - DNA, 22 bp, Homo sapiens
tatttctgagaaccaacttacc

SEQ ID NO: 8571813 - DNA, 22 bp, Homo sapiens
tatttctctcacggttgcctgg

SEQ ID NO: 8571814 - DNA, 22 bp, Homo sapiens
tatttctcttcaaaattgatgt

SEQ ID NO: 8571815 - DNA, 22 bp, Homo sapiens
tatttattggacagtgttgctg

SEQ ID NO: 8571816 - DNA, 22 bp, Homo sapiens
tatttattctttgtactgcctt

SEQ ID NO: 8571817 - DNA, 22 bp, Homo sapiens
tatttattggacagtgttgctg

SEQ ID NO: 8571818 - DNA, 22 bp, Homo sapiens
tatttattggacagtgttgctg

SEQ ID NO: 8571819 - DNA, 22 bp, Homo sapiens
tatttattggacagtgttgctg

SEQ ID NO: 8571820 - DNA, 22 bp, Homo sapiens
tatttattcattcagcaagcat

SEQ ID NO: 8571821 - DNA, 22 bp, Homo sapiens
tatttattctttgtactgcctt

SEQ ID NO: 8571822 - DNA, 22 bp, Homo sapiens
tatttataccaggtgatcggag

SEQ ID NO: 8571823 - DNA, 22 bp, Homo sapiens
tatttatcaaggtaggagaata

SEQ ID NO: 8571824 - DNA, 22 bp, Homo sapiens
tatttatattctgccttctgct

SEQ ID NO: 8571825 - DNA, 22 bp, Homo sapiens
tatttatattctgccttctgct

SEQ ID NO: 8571826 - DNA, 22 bp, Homo sapiens
tatttataccaggtgatcggag

SEQ ID NO: 8571827 - DNA, 22 bp, Homo sapiens
tatttataatctgccaaagaga

SEQ ID NO: 8571828 - DNA, 22 bp, Homo sapiens
tatttatgtctctgcagagaat

SEQ ID NO: 8571829 - DNA, 22 bp, Homo sapiens
tatttatcgagtgtctactatg

SEQ ID NO: 8571830 - DNA, 22 bp, Homo sapiens
tatttatcgagtgtctactatg

SEQ ID NO: 8571831 - DNA, 22 bp, Homo sapiens
tatttatgtggaccataagcct

SEQ ID NO: 8571832 - DNA, 22 bp, Homo sapiens
tatttatgtggaccataagcct

SEQ ID NO: 8571833 - DNA, 21 bp, Homo sapiens
tatttattaatttgtaaggct

SEQ ID NO: 8571834 - DNA, 22 bp, Homo sapiens
tatttaattagtgattgtagag

SEQ ID NO: 8571835 - DNA, 22 bp, Homo sapiens
tattgacagtgactattggtag

SEQ ID NO: 8571836 - DNA, 22 bp, Homo sapiens
tattgacatttttatagcttga

SEQ ID NO: 8571837 - DNA, 22 bp, Homo sapiens
tattgacagatgcattatgttg

SEQ ID NO: 8571838 - DNA, 22 bp, Homo sapiens
tattgacactttttgtgtagcc

SEQ ID NO: 8571839 - DNA, 22 bp, Homo sapiens
tattgacagagggtcagaagag

SEQ ID NO: 8571840 - DNA, 22 bp, Homo sapiens
tatttaattagtgattgtagag

SEQ ID NO: 8571841 - DNA, 22 bp, Homo sapiens
tatttaatttgctcattgtgat

SEQ ID NO: 8571842 - DNA, 22 bp, Homo sapiens
tatttataacagtgagaacggg

SEQ ID NO: 8571843 - DNA, 22 bp, Homo sapiens
tatttataatctgccaaagaga

SEQ ID NO: 8571844 - DNA, 22 bp, Homo sapiens
tatttataacagtgagaacggg

SEQ ID NO: 8571845 - DNA, 22 bp, Homo sapiens
tatttataatctgccaaagaga

SEQ ID NO: 8571846 - DNA, 22 bp, Homo sapiens
tatttataatctgccaaagaga

SEQ ID NO: 8571847 - DNA, 22 bp, Homo sapiens
tatgaggcacttcattagctgg

SEQ ID NO: 8571848 - DNA, 22 bp, Homo sapiens
tatgaggtattacaggaaatat

SEQ ID NO: 8571849 - DNA, 22 bp, Homo sapiens
tatgaggtaggtattatactta

SEQ ID NO: 8571850 - DNA, 22 bp, Homo sapiens
tatgaggtaggtattatactta

SEQ ID NO: 8571851 - DNA, 20 bp, Homo sapiens
tatgagtattactttcagga

SEQ ID NO: 8571852 - DNA, 22 bp, Homo sapiens
tatgagtacaaggactctgtct

SEQ ID NO: 8571853 - DNA, 22 bp, Homo sapiens
tatgagtggttgaatggtaaac

SEQ ID NO: 8571854 - DNA, 22 bp, Homo sapiens
tatgagtgtgtgtagaaggtac

SEQ ID NO: 8571855 - DNA, 22 bp, Homo sapiens
tatgagtggcgtagaggtaggg

SEQ ID NO: 8571856 - DNA, 22 bp, Homo sapiens
tatgagttcagttatcttaagt

SEQ ID NO: 8571857 - DNA, 22 bp, Homo sapiens
tatgagcaagagtttgtgaagg

SEQ ID NO: 8571858 - DNA, 22 bp, Homo sapiens
tatgagataatagatgtgtaaa

SEQ ID NO: 8571859 - DNA, 22 bp, Homo sapiens
tatgtacaatcagcagttcata

SEQ ID NO: 8571860 - DNA, 22 bp, Homo sapiens
tatgtacaatcagcagttcata

SEQ ID NO: 8571861 - DNA, 22 bp, Homo sapiens
tatgtacaatcagcagttcata

SEQ ID NO: 8571862 - DNA, 22 bp, Homo sapiens
tatgtacaatcagcagttcata

SEQ ID NO: 8571863 - DNA, 22 bp, Homo sapiens
tatgtacaatcagcagttcata

SEQ ID NO: 8571864 - DNA, 22 bp, Homo sapiens
tatgtacaagcacacatgtgac

SEQ ID NO: 8571865 - DNA, 22 bp, Homo sapiens
tatgtacacacacatgcatgta

SEQ ID NO: 8571866 - DNA, 22 bp, Homo sapiens
tatgtacacacacatgcatgta

SEQ ID NO: 8571867 - DNA, 22 bp, Homo sapiens
tatgtacacacacatgcatgta

SEQ ID NO: 8571868 - DNA, 22 bp, Homo sapiens
tatgtacacacacatgcatgta

SEQ ID NO: 8571869 - DNA, 22 bp, Homo sapiens
tatgtacaatttgttgtatgtc

SEQ ID NO: 8571870 - DNA, 22 bp, Homo sapiens
tatgtacaatcagcagttcata

SEQ ID NO: 8571871 - DNA, 22 bp, Homo sapiens
tatgtacaatcagcagttcata

SEQ ID NO: 8571872 - DNA, 22 bp, Homo sapiens
tatgtacataacatgaaatgca

SEQ ID NO: 8571873 - DNA, 22 bp, Homo sapiens
tatgtacagtccttaacttaaa

SEQ ID NO: 8571874 - DNA, 22 bp, Homo sapiens
tatgtacagtccttaacttaaa

SEQ ID NO: 8571875 - DNA, 22 bp, Homo sapiens
tatgtacagggatagaacttga

SEQ ID NO: 8571876 - DNA, 22 bp, Homo sapiens
tatgtcctgctactctctcatg

SEQ ID NO: 8571877 - DNA, 22 bp, Homo sapiens
tatgtacatacatgtgcatacg

SEQ ID NO: 8571878 - DNA, 22 bp, Homo sapiens
tatgtacataacatgaaatgca

SEQ ID NO: 8571879 - DNA, 22 bp, Homo sapiens
tatgtacataacatgaaatgca

SEQ ID NO: 8571880 - DNA, 22 bp, Homo sapiens
tatgtcctgctactctctcatg

SEQ ID NO: 8571881 - DNA, 22 bp, Homo sapiens
tatgtctgaatcttatttaaat

SEQ ID NO: 8571882 - DNA, 22 bp, Homo sapiens
tatgtacaccggggaaggtggg

SEQ ID NO: 8571883 - DNA, 22 bp, Homo sapiens
tatgtacagggatagaacttga

SEQ ID NO: 8571884 - DNA, 22 bp, Homo sapiens
tatgtacagggatagaacttga

SEQ ID NO: 8571885 - DNA, 22 bp, Homo sapiens
tatgtacagggatagaacttga

SEQ ID NO: 8571886 - DNA, 22 bp, Homo sapiens
tatgtacaccaaggattgaaaa

SEQ ID NO: 8571887 - DNA, 22 bp, Homo sapiens
tatgtacacatacacttgtaat

SEQ ID NO: 8571888 - DNA, 22 bp, Homo sapiens
tatgtacacacacatgcatgta

SEQ ID NO: 8571889 - DNA, 22 bp, Homo sapiens
tatgtacacatacacttgtaat

SEQ ID NO: 8571890 - DNA, 22 bp, Homo sapiens
tatgtctttttctcactatagt

SEQ ID NO: 8571891 - DNA, 22 bp, Homo sapiens
tatgtgaatacagcagtggatg

SEQ ID NO: 8571892 - DNA, 22 bp, Homo sapiens
tatgtgaatacagcagtggatg

SEQ ID NO: 8571893 - DNA, 22 bp, Homo sapiens
tatgtctttagtatcttttgga

SEQ ID NO: 8571894 - DNA, 22 bp, Homo sapiens
tatgtcttttccaatgctgtct

SEQ ID NO: 8571895 - DNA, 22 bp, Homo sapiens
tatgtcttgtgtttgctaatct

SEQ ID NO: 8571896 - DNA, 22 bp, Homo sapiens
tatgtcttcgtcacctatctca

SEQ ID NO: 8571897 - DNA, 22 bp, Homo sapiens
tatgtcttaatccttccttagg

SEQ ID NO: 8571898 - DNA, 22 bp, Homo sapiens
tatgtcttaatccttccttagg

SEQ ID NO: 8571899 - DNA, 22 bp, Homo sapiens
tatgtcttaatccttccttagg

SEQ ID NO: 8571900 - DNA, 22 bp, Homo sapiens
tatgtgatataggctatttgat

SEQ ID NO: 8571901 - DNA, 22 bp, Homo sapiens
tatgtgatagagttactttata

SEQ ID NO: 8571902 - DNA, 22 bp, Homo sapiens
tatgtgcatatgcatacacaca

SEQ ID NO: 8571903 - DNA, 22 bp, Homo sapiens
tatgtgcagtttgctcttaaca

SEQ ID NO: 8571904 - DNA, 19 bp, Homo sapiens
tatgtgtgcatttgtgcat

SEQ ID NO: 8571905 - DNA, 22 bp, Homo sapiens
tatgtgtgcatgtatacattaa

SEQ ID NO: 8571906 - DNA, 22 bp, Homo sapiens
tattacagttcgagtttctagg

SEQ ID NO: 8571907 - DNA, 22 bp, Homo sapiens
tattacatccacttttattgca

SEQ ID NO: 8571908 - DNA, 22 bp, Homo sapiens
tattacagctttgattatctgg

SEQ ID NO: 8571909 - DNA, 22 bp, Homo sapiens
tattacagaatcaggcataact

SEQ ID NO: 8571910 - DNA, 22 bp, Homo sapiens
tattacagctttgattatctgg

SEQ ID NO: 8571911 - DNA, 19 bp, Homo sapiens
tatgtgtgcatttgtgcat

SEQ ID NO: 8571912 - DNA, 22 bp, Homo sapiens
tatgtgtgctttttccatgcat

SEQ ID NO: 8571913 - DNA, 22 bp, Homo sapiens
tatgtgtggcagctgggagtgt

SEQ ID NO: 8571914 - DNA, 22 bp, Homo sapiens
tatgtgtgctttttccatgcat

SEQ ID NO: 8571915 - DNA, 22 bp, Homo sapiens
tatgtgtggcagctgggagtgt

SEQ ID NO: 8571916 - DNA, 22 bp, Homo sapiens
tatgtgtggcagctgggagtgt

SEQ ID NO: 8571917 - DNA, 23 bp, Homo sapiens
tatgtgtgggtctactagaagtc

SEQ ID NO: 8571918 - DNA, 22 bp, Homo sapiens
tattacactttcttcttcaagc

SEQ ID NO: 8571919 - DNA, 22 bp, Homo sapiens
tattacacagtgaaagcatgga

SEQ ID NO: 8571920 - DNA, 20 bp, Homo sapiens
tattacacacaatgagcagt

SEQ ID NO: 8571921 - DNA, 22 bp, Homo sapiens
tattagaggaaccaaggtggag

SEQ ID NO: 8571922 - DNA, 22 bp, Homo sapiens
tattagaaaggctattgcatag

SEQ ID NO: 8571923 - DNA, 22 bp, Homo sapiens
tattagaaaggctattgcatag

SEQ ID NO: 8571924 - DNA, 22 bp, Homo sapiens
tattagaaaggctattgcatag

SEQ ID NO: 8571925 - DNA, 22 bp, Homo sapiens
tattagaaagcttaatatcgtg

SEQ ID NO: 8571926 - DNA, 22 bp, Homo sapiens
tattactgaggttttatggagt

SEQ ID NO: 8571927 - DNA, 22 bp, Homo sapiens
tattactgaggttttatggagt

SEQ ID NO: 8571928 - DNA, 23 bp, Homo sapiens
tattagcaattcccacagagcag

SEQ ID NO: 8571929 - DNA, 22 bp, Homo sapiens
tattagcacaaagcaaggtatt

SEQ ID NO: 8571930 - DNA, 22 bp, Homo sapiens
tattagattaactttaatgtct

SEQ ID NO: 8571931 - DNA, 22 bp, Homo sapiens
tattagcagttgtatgtgtctg

SEQ ID NO: 8571932 - DNA, 22 bp, Homo sapiens
tattagcagccaacttagctgt

SEQ ID NO: 8571933 - DNA, 22 bp, Homo sapiens
tattagcagacaagctgctgga

SEQ ID NO: 8571934 - DNA, 22 bp, Homo sapiens
taggaaaaatacagaattatat

SEQ ID NO: 8571935 - DNA, 22 bp, Homo sapiens
taggaaaacgtgattttctcac

SEQ ID NO: 8571936 - DNA, 22 bp, Homo sapiens
taggaaaacgtgattttctcac

SEQ ID NO: 8571937 - DNA, 22 bp, Homo sapiens
taggaaaacgtgattttctcac

SEQ ID NO: 8571938 - DNA, 22 bp, Homo sapiens
taggaaaagcacaggatgttct

SEQ ID NO: 8571939 - DNA, 22 bp, Homo sapiens
taggaaaagtctagattgatga

SEQ ID NO: 8571940 - DNA, 22 bp, Homo sapiens
taggaaaagcacaggatgttct

SEQ ID NO: 8571941 - DNA, 22 bp, Homo sapiens
taggaaaagtctagattgatga

SEQ ID NO: 8571942 - DNA, 22 bp, Homo sapiens
taggaaaaagaggctggcaagg

SEQ ID NO: 8571943 - DNA, 22 bp, Homo sapiens
taggaaaaatacagaattatat

SEQ ID NO: 8571944 - DNA, 22 bp, Homo sapiens
tagcttttatccactgcttttg

SEQ ID NO: 8571945 - DNA, 22 bp, Homo sapiens
tagctttagaaatattctcaga

SEQ ID NO: 8571946 - DNA, 22 bp, Homo sapiens
tagctttaggatggttctcttg

SEQ ID NO: 8571947 - DNA, 22 bp, Homo sapiens
tagctttaccatagaagagtat

SEQ ID NO: 8571948 - DNA, 22 bp, Homo sapiens
tagctttacaaagtgctgcacc

SEQ ID NO: 8571949 - DNA, 22 bp, Homo sapiens
tagctttaccatagaagagtat

SEQ ID NO: 8571950 - DNA, 22 bp, Homo sapiens
tagctttacaaagtgctgcacc

SEQ ID NO: 8571951 - DNA, 22 bp, Homo sapiens
tagctttccttgttgcctgtgc

SEQ ID NO: 8571952 - DNA, 22 bp, Homo sapiens
tagctttagtgaaaaatatcag

SEQ ID NO: 8571953 - DNA, 22 bp, Homo sapiens
tagctttaggcacgtttgaatt

SEQ ID NO: 8571954 - DNA, 22 bp, Homo sapiens
taggaaacaaagtggatgaaat

SEQ ID NO: 8571955 - DNA, 22 bp, Homo sapiens
taggaaacaaagtaatgcaact

SEQ ID NO: 8571956 - DNA, 22 bp, Homo sapiens
taggaaaatatctcttattggg

SEQ ID NO: 8571957 - DNA, 22 bp, Homo sapiens
taggaaactaatacagtctgga

SEQ ID NO: 8571958 - DNA, 22 bp, Homo sapiens
taggaaactcaaagggaagtgg

SEQ ID NO: 8571959 - DNA, 22 bp, Homo sapiens
taggacagtagctggtgcacag

SEQ ID NO: 8571960 - DNA, 22 bp, Homo sapiens
taggagggccctgaaaatggca

SEQ ID NO: 8571961 - DNA, 22 bp, Homo sapiens
taggagggggaacaaggcatac

SEQ ID NO: 8571962 - DNA, 22 bp, Homo sapiens
taggagggttagagggaaatat

SEQ ID NO: 8571963 - DNA, 22 bp, Homo sapiens
taggagtgcataaaactatatt

SEQ ID NO: 8571964 - DNA, 22 bp, Homo sapiens
taggatacaaattctgtaattt

SEQ ID NO: 8571965 - DNA, 22 bp, Homo sapiens
taggatttaggctttaacatct

SEQ ID NO: 8571966 - DNA, 22 bp, Homo sapiens
taggatttaataaaagaataga

SEQ ID NO: 8571967 - DNA, 22 bp, Homo sapiens
taggatggtcacagagatggac

SEQ ID NO: 8571968 - DNA, 22 bp, Homo sapiens
taggatttggctttagtcaggt

SEQ ID NO: 8571969 - DNA, 22 bp, Homo sapiens
taggattttttggattctggat

SEQ ID NO: 8571970 - DNA, 20 bp, Homo sapiens
taggcaattagtagataaca

SEQ ID NO: 8571971 - DNA, 22 bp, Homo sapiens
taggcacaaaatgaaaatggca

SEQ ID NO: 8571972 - DNA, 22 bp, Homo sapiens
taggcaccacctagggtgaccc

SEQ ID NO: 8571973 - DNA, 22 bp, Homo sapiens
taggcacaagaccatgcaaagg

SEQ ID NO: 8571974 - DNA, 22 bp, Homo sapiens
taggcactgaggggagcaaggt

SEQ ID NO: 8571975 - DNA, 22 bp, Homo sapiens
taggcactgggctaggacaggt

SEQ ID NO: 8571976 - DNA, 22 bp, Homo sapiens
taggcactgggctaggacaggt

SEQ ID NO: 8571977 - DNA, 22 bp, Homo sapiens
taggcactgaggggagcaaggt

SEQ ID NO: 8571978 - DNA, 22 bp, Homo sapiens
taggcagaaaggaaggcaagtt

SEQ ID NO: 8571979 - DNA, 22 bp, Homo sapiens
taggcactggggaggcagcatg

SEQ ID NO: 8571980 - DNA, 22 bp, Homo sapiens
taggctgggagcctgaggctag

SEQ ID NO: 8571981 - DNA, 22 bp, Homo sapiens
taggctgggcattctggccagg

SEQ ID NO: 8571982 - DNA, 22 bp, Homo sapiens
taggctgggagcctgaggctag

SEQ ID NO: 8571983 - DNA, 22 bp, Homo sapiens
tagggagaaacaccaatttatt

SEQ ID NO: 8571984 - DNA, 22 bp, Homo sapiens
tagggacactgctcatgagttc

SEQ ID NO: 8571985 - DNA, 22 bp, Homo sapiens
taggctgggcattctggccagg

SEQ ID NO: 8571986 - DNA, 22 bp, Homo sapiens
taggctgggcctgccttccagg

SEQ ID NO: 8571987 - DNA, 22 bp, Homo sapiens
tagggcaatatttcccagaaaa

SEQ ID NO: 8571988 - DNA, 22 bp, Homo sapiens
tagggcagagcttgtacacgat

SEQ ID NO: 8571989 - DNA, 22 bp, Homo sapiens
tagggcagagcttgtacacgat

SEQ ID NO: 8571990 - DNA, 22 bp, Homo sapiens
tagggatgagccagtgggtagt

SEQ ID NO: 8571991 - DNA, 22 bp, Homo sapiens
tagggatgatggagcctatgta

SEQ ID NO: 8571992 - DNA, 22 bp, Homo sapiens
tagggaggctacttcttgtagg

SEQ ID NO: 8571993 - DNA, 22 bp, Homo sapiens
tagcccctgcctttgaacctgg

SEQ ID NO: 8571994 - DNA, 22 bp, Homo sapiens
tagcccatgatggtggaaggca

SEQ ID NO: 8571995 - DNA, 17 bp, Homo sapiens
tagcccatggctgccag

SEQ ID NO: 8571996 - DNA, 22 bp, Homo sapiens
tagccccagctactcggaagct

SEQ ID NO: 8571997 - DNA, 22 bp, Homo sapiens
tagccctgtccttggcctgtgc

SEQ ID NO: 8571998 - DNA, 19 bp, Homo sapiens
tagccctggccatcatgag

SEQ ID NO: 8571999 - DNA, 22 bp, Homo sapiens
tagccgcttaattatttggtga

SEQ ID NO: 8572000 - DNA, 21 bp, Homo sapiens
tagcccttctccacctcgccc

SEQ ID NO: 8572001 - DNA, 22 bp, Homo sapiens
tagccctgtccttggcctgtgc

SEQ ID NO: 8572002 - DNA, 22 bp, Homo sapiens
tagccctggagcagggaaatac

SEQ ID NO: 8572003 - DNA, 19 bp, Homo sapiens
tagccctggccatcatgag

SEQ ID NO: 8572004 - DNA, 22 bp, Homo sapiens
tagccctgctgtgatgtgaagt

SEQ ID NO: 8572005 - DNA, 22 bp, Homo sapiens
tagcccaggagaattgtctttc

SEQ ID NO: 8572006 - DNA, 22 bp, Homo sapiens
tagcccagctcaaatgaccggt

SEQ ID NO: 8572007 - DNA, 22 bp, Homo sapiens
tagcccaggctggagggcagtg

SEQ ID NO: 8572008 - DNA, 22 bp, Homo sapiens
tagcccaggctgtagtgcagtg

SEQ ID NO: 8572009 - DNA, 22 bp, Homo sapiens
tagcccaggctggagtgcaggg

SEQ ID NO: 8572010 - DNA, 22 bp, Homo sapiens
tagcagctcacagcctcccatt

SEQ ID NO: 8572011 - DNA, 22 bp, Homo sapiens
tagcccagcatgagcagagctg

SEQ ID NO: 8572012 - DNA, 22 bp, Homo sapiens
tagctctggagtcttctcagaa

SEQ ID NO: 8572013 - DNA, 22 bp, Homo sapiens
tagctctggcattctttccaaa

SEQ ID NO: 8572014 - DNA, 22 bp, Homo sapiens
tagctctgaggccatctccggt

SEQ ID NO: 8572015 - DNA, 22 bp, Homo sapiens
tagctctgtgctctggatctgt

SEQ ID NO: 8572016 - DNA, 19 bp, Homo sapiens
tagctctgtcttattccaa

SEQ ID NO: 8572017 - DNA, 22 bp, Homo sapiens
tagctcttcaatcactgtctcc

SEQ ID NO: 8572018 - DNA, 22 bp, Homo sapiens
tagccttctcaagacaaagttg

SEQ ID NO: 8572019 - DNA, 22 bp, Homo sapiens
tagccgggtgtggtggaactcc

SEQ ID NO: 8572020 - DNA, 22 bp, Homo sapiens
tagccgggtgttgtgtcatgca

SEQ ID NO: 8572021 - DNA, 22 bp, Homo sapiens
tagctctctttatctttctata

SEQ ID NO: 8572022 - DNA, 22 bp, Homo sapiens
tagctcctggtgagcctactct

SEQ ID NO: 8572023 - DNA, 22 bp, Homo sapiens
tagctcctggtgagcctactct

SEQ ID NO: 8572024 - DNA, 22 bp, Homo sapiens
tagctcttcatttcatctgatt

SEQ ID NO: 8572025 - DNA, 22 bp, Homo sapiens
tagctgttttttgtgaggaaat

SEQ ID NO: 8572026 - DNA, 21 bp, Homo sapiens
tagctttaatattcccacatt

SEQ ID NO: 8572027 - DNA, 22 bp, Homo sapiens
tagcttaaaccaatctgaataa

SEQ ID NO: 8572028 - DNA, 22 bp, Homo sapiens
tagctttaatgagttggtaaga

SEQ ID NO: 8572029 - DNA, 22 bp, Homo sapiens
tagctgttcccagctctgtgta

SEQ ID NO: 8572030 - DNA, 22 bp, Homo sapiens
tagctgttggcttacatctgtt

SEQ ID NO: 8572031 - DNA, 22 bp, Homo sapiens
tagctgttgcaataaacagttc

SEQ ID NO: 8572032 - DNA, 22 bp, Homo sapiens
tagagggttattaggacagaag

SEQ ID NO: 8572033 - DNA, 18 bp, Homo sapiens
tagagggggcctgggcat

SEQ ID NO: 8572034 - DNA, 22 bp, Homo sapiens
tagaggtactcccctcaaagtt

SEQ ID NO: 8572035 - DNA, 22 bp, Homo sapiens
tagagggttattaggacagaag

SEQ ID NO: 8572036 - DNA, 22 bp, Homo sapiens
tagaggtagcaacaggactaga

SEQ ID NO: 8572037 - DNA, 22 bp, Homo sapiens
tagaggtagagttacattagtc

SEQ ID NO: 8572038 - DNA, 22 bp, Homo sapiens
tagaggtagatggtcagccaat

SEQ ID NO: 8572039 - DNA, 18 bp, Homo sapiens
tagaggggaagaccttta

SEQ ID NO: 8572040 - DNA, 22 bp, Homo sapiens
tagaggggaatctgcctcctct

SEQ ID NO: 8572041 - DNA, 20 bp, Homo sapiens
tagaggggacaatcattgcc

SEQ ID NO: 8572042 - DNA, 22 bp, Homo sapiens
tagaggtgacactgagaccata

SEQ ID NO: 8572043 - DNA, 22 bp, Homo sapiens
tagaggtgagacttcagtgaca

SEQ ID NO: 8572044 - DNA, 22 bp, Homo sapiens
tagaggtataccaaaaaggcat

SEQ ID NO: 8572045 - DNA, 22 bp, Homo sapiens
tagaggtatttttgatggtcat

SEQ ID NO: 8572046 - DNA, 22 bp, Homo sapiens
tagaggtgagccatcaaggggc

SEQ ID NO: 8572047 - DNA, 22 bp, Homo sapiens
tagaggtgagatattttatttt

SEQ ID NO: 8572048 - DNA, 22 bp, Homo sapiens
tagaggtgttcattctctccat

SEQ ID NO: 8572049 - DNA, 22 bp, Homo sapiens
tagaggtgtcactttgggaagt

SEQ ID NO: 8572050 - DNA, 22 bp, Homo sapiens
tagaggtgttcattctctccat

SEQ ID NO: 8572051 - DNA, 22 bp, Homo sapiens
tagaggtgttgacgccaaggta

SEQ ID NO: 8572052 - DNA, 22 bp, Homo sapiens
tagcagaaccagtcagtgagcc

SEQ ID NO: 8572053 - DNA, 22 bp, Homo sapiens
tagcagaaccagtcagtgagcc

SEQ ID NO: 8572054 - DNA, 22 bp, Homo sapiens
tagcagagaggggacagtggca

SEQ ID NO: 8572055 - DNA, 22 bp, Homo sapiens
tagcagagaggggacagtggca

SEQ ID NO: 8572056 - DNA, 22 bp, Homo sapiens
tagcagagaggggacagtggca

SEQ ID NO: 8572057 - DNA, 22 bp, Homo sapiens
tagcagaagaacaacatgatct

SEQ ID NO: 8572058 - DNA, 23 bp, Homo sapiens
tagcagcatttttagcctctgtc

SEQ ID NO: 8572059 - DNA, 23 bp, Homo sapiens
tagcagcatttttagcctctgtc

SEQ ID NO: 8572060 - DNA, 17 bp, Homo sapiens
tagcagcagtaattgtg

SEQ ID NO: 8572061 - DNA, 22 bp, Homo sapiens
tagcagagcgggtgcgaggcgg

SEQ ID NO: 8572062 - DNA, 22 bp, Homo sapiens
tagcagagcagggatcagagcc

SEQ ID NO: 8572063 - DNA, 22 bp, Homo sapiens
tagcagagcagggatcagagcc

SEQ ID NO: 8572064 - DNA, 22 bp, Homo sapiens
tagcagaggaaaagagaacatt

SEQ ID NO: 8572065 - DNA, 22 bp, Homo sapiens
tagaaacccatgtttattcagt

SEQ ID NO: 8572066 - DNA, 22 bp, Homo sapiens
tagaaactagattgatagcgga

SEQ ID NO: 8572067 - DNA, 22 bp, Homo sapiens
tagaaaccatctcactgctcag

SEQ ID NO: 8572068 - DNA, 22 bp, Homo sapiens
tagaaacattcagttgcagtcc

SEQ ID NO: 8572069 - DNA, 22 bp, Homo sapiens
tagaaacattcagttgcagtcc

SEQ ID NO: 8572070 - DNA, 22 bp, Homo sapiens
tagaaactctcacgagtgaaac

SEQ ID NO: 8572071 - DNA, 22 bp, Homo sapiens
tagaaactgatagtcttgtgct

SEQ ID NO: 8572072 - DNA, 22 bp, Homo sapiens
tagaaactgatagtcttgtgct

SEQ ID NO: 8572073 - DNA, 22 bp, Homo sapiens
tagaaactcaggatactcttcc

SEQ ID NO: 8572074 - DNA, 22 bp, Homo sapiens
tagaaactcacgttatcattgc

SEQ ID NO: 8572075 - DNA, 22 bp, Homo sapiens
tagaaactcacgttatcattgc

SEQ ID NO: 8572076 - DNA, 22 bp, Homo sapiens
tagaaacatatgtttgagacat

SEQ ID NO: 8572077 - DNA, 22 bp, Homo sapiens
tagaaacatatgtttgagacat

SEQ ID NO: 8572078 - DNA, 22 bp, Homo sapiens
tagaaacatcagctaaccaaaa

SEQ ID NO: 8572079 - DNA, 22 bp, Homo sapiens
tagaaacatcagctaaccaaaa

SEQ ID NO: 8572080 - DNA, 22 bp, Homo sapiens
tagaaacatcagctaaccaaaa

SEQ ID NO: 8572081 - DNA, 22 bp, Homo sapiens
tagaaacatcagctaaccaaaa

SEQ ID NO: 8572082 - DNA, 22 bp, Homo sapiens
tagaaacatgagagaaactctt

SEQ ID NO: 8572083 - DNA, 22 bp, Homo sapiens
tagaaacatgagagaaactctt

SEQ ID NO: 8572084 - DNA, 22 bp, Homo sapiens
tagaaacattcagttgcagtcc

SEQ ID NO: 8572085 - DNA, 22 bp, Homo sapiens
tagaaacatgttctgttctgtt

SEQ ID NO: 8572086 - DNA, 22 bp, Homo sapiens
tagaaacatgttctgttctgtt

SEQ ID NO: 8572087 - DNA, 22 bp, Homo sapiens
tagaaacagaatatgagtgaga

SEQ ID NO: 8572088 - DNA, 22 bp, Homo sapiens
tagaaacagaatatgagtgaga

SEQ ID NO: 8572089 - DNA, 22 bp, Homo sapiens
tagaaacagagagatatgcccc

SEQ ID NO: 8572090 - DNA, 22 bp, Homo sapiens
tagaaacagatgtttttgaaga

SEQ ID NO: 8572091 - DNA, 22 bp, Homo sapiens
tagaaacagagcaggtggccca

SEQ ID NO: 8572092 - DNA, 22 bp, Homo sapiens
tagaaacatataggatggcagg

SEQ ID NO: 8572093 - DNA, 22 bp, Homo sapiens
tagaaacagcatatattagccc

SEQ ID NO: 8572094 - DNA, 22 bp, Homo sapiens
tagaaacaatgacatgcttgta

SEQ ID NO: 8572095 - DNA, 22 bp, Homo sapiens
tagaaacaatgacatgcttgta

SEQ ID NO: 8572096 - DNA, 22 bp, Homo sapiens
tagaaaagccccagctggaggg

SEQ ID NO: 8572097 - DNA, 22 bp, Homo sapiens
tagaaaagccccagctggaggg

SEQ ID NO: 8572098 - DNA, 22 bp, Homo sapiens
tagaaacagaaaactgtaatag

SEQ ID NO: 8572099 - DNA, 22 bp, Homo sapiens
tagaaacacagatctggtgtca

SEQ ID NO: 8572100 - DNA, 22 bp, Homo sapiens
tagaaacagaaaactgtaatag

SEQ ID NO: 8572101 - DNA, 22 bp, Homo sapiens
tagaaacagaatatgagtgaga

SEQ ID NO: 8572102 - DNA, 22 bp, Homo sapiens
tacattttctaggggaccaaga

SEQ ID NO: 8572103 - DNA, 22 bp, Homo sapiens
taccaaaaccaagccattatct

SEQ ID NO: 8572104 - DNA, 22 bp, Homo sapiens
taccaaaaccaagccattatct

SEQ ID NO: 8572105 - DNA, 19 bp, Homo sapiens
tacatttgtgtacacttgt

SEQ ID NO: 8572106 - DNA, 22 bp, Homo sapiens
taccaaaagcttgtttcataca

SEQ ID NO: 8572107 - DNA, 22 bp, Homo sapiens
taccaaaagcttgtttcataca

SEQ ID NO: 8572108 - DNA, 22 bp, Homo sapiens
taccaaaagcttgtttcataca

SEQ ID NO: 8572109 - DNA, 22 bp, Homo sapiens
taccaaagaatattttaaatag

SEQ ID NO: 8572110 - DNA, 22 bp, Homo sapiens
tactttgaattaaatatttcag

SEQ ID NO: 8572111 - DNA, 22 bp, Homo sapiens
tactttgaccaccatctgatta

SEQ ID NO: 8572112 - DNA, 22 bp, Homo sapiens
tactttggatccttacaatagc

SEQ ID NO: 8572113 - DNA, 22 bp, Homo sapiens
tactttgggtttagaataaact

SEQ ID NO: 8572114 - DNA, 22 bp, Homo sapiens
tactttggtatcaaactaaaac

SEQ ID NO: 8572115 - DNA, 20 bp, Homo sapiens
tactttgatctgataagcaa

SEQ ID NO: 8572116 - DNA, 22 bp, Homo sapiens
tacttttagcctatttgattct

SEQ ID NO: 8572117 - DNA, 22 bp, Homo sapiens
tactttgtggagattaaaaata

SEQ ID NO: 8572118 - DNA, 22 bp, Homo sapiens
tactttgtggagattaaaaata

SEQ ID NO: 8572119 - DNA, 22 bp, Homo sapiens
tactttgtcattctaaccttcc

SEQ ID NO: 8572120 - DNA, 22 bp, Homo sapiens
tactttggttgaatatgtaatg

SEQ ID NO: 8572121 - DNA, 22 bp, Homo sapiens
tactttttagcacagtgtgtgc

SEQ ID NO: 8572122 - DNA, 22 bp, Homo sapiens
tactttttagcacagtgtgtgc

SEQ ID NO: 8572123 - DNA, 22 bp, Homo sapiens
tacttttctgtgtggcagtcac

SEQ ID NO: 8572124 - DNA, 22 bp, Homo sapiens
tactttttatgataagaactga

SEQ ID NO: 8572125 - DNA, 22 bp, Homo sapiens
tactttttatgataagaactga

SEQ ID NO: 8572126 - DNA, 22 bp, Homo sapiens
tacttttatgtgatgaaatctg

SEQ ID NO: 8572127 - DNA, 22 bp, Homo sapiens
tacttttagcctatttgattct

SEQ ID NO: 8572128 - DNA, 22 bp, Homo sapiens
tacttttagcctatttgattct

SEQ ID NO: 8572129 - DNA, 22 bp, Homo sapiens
tacttttagcctatttgattct

SEQ ID NO: 8572130 - DNA, 22 bp, Homo sapiens
tacttttatgtgatgaaatctg

SEQ ID NO: 8572131 - DNA, 22 bp, Homo sapiens
tacttttatgtgatgaaatctg

SEQ ID NO: 8572132 - DNA, 22 bp, Homo sapiens
tacttttatgtgatgaaatctg

SEQ ID NO: 8572133 - DNA, 22 bp, Homo sapiens
tacttttcaagcagctggttat

SEQ ID NO: 8572134 - DNA, 22 bp, Homo sapiens
tacttttccagggctggctgag

SEQ ID NO: 8572135 - DNA, 22 bp, Homo sapiens
tacttttcctggaaccactgct

SEQ ID NO: 8572136 - DNA, 22 bp, Homo sapiens
tactttttgtctctttgaatgt

SEQ ID NO: 8572137 - DNA, 22 bp, Homo sapiens
tactttttgtctctttgaatgt

SEQ ID NO: 8572138 - DNA, 22 bp, Homo sapiens
tactttttgtctctttgaatgt

SEQ ID NO: 8572139 - DNA, 22 bp, Homo sapiens
tactttttgtctctttgaatgt

SEQ ID NO: 8572140 - DNA, 19 bp, Homo sapiens
tactttttcaggacagagt

SEQ ID NO: 8572141 - DNA, 19 bp, Homo sapiens
tactttttcaggacagagt

SEQ ID NO: 8572142 - DNA, 22 bp, Homo sapiens
tagaaaactaatacatgcttga

SEQ ID NO: 8572143 - DNA, 22 bp, Homo sapiens
tagaaaactaatacatgcttga

SEQ ID NO: 8572144 - DNA, 22 bp, Homo sapiens
tagaaaagataacattctgtgc

SEQ ID NO: 8572145 - DNA, 22 bp, Homo sapiens
tagaaaagaattttatttgata

SEQ ID NO: 8572146 - DNA, 22 bp, Homo sapiens
tagaaaagaattttatttgata

SEQ ID NO: 8572147 - DNA, 22 bp, Homo sapiens
tagaaaagaattttatttgata

SEQ ID NO: 8572148 - DNA, 22 bp, Homo sapiens
tagaaagcttggggtgtttaaa

SEQ ID NO: 8572149 - DNA, 22 bp, Homo sapiens
tagaaaggcaagcgtgaaatat

SEQ ID NO: 8572150 - DNA, 22 bp, Homo sapiens
tagaaaggatattgagatgaat

SEQ ID NO: 8572151 - DNA, 22 bp, Homo sapiens
tagaaagcgttaaatctacaga

SEQ ID NO: 8572152 - DNA, 22 bp, Homo sapiens
tagaaagcgttaaatctacaga

SEQ ID NO: 8572153 - DNA, 22 bp, Homo sapiens
tagaaagcgttaaatctacaga

SEQ ID NO: 8572154 - DNA, 22 bp, Homo sapiens
tagaaagctgagtaatacattt

SEQ ID NO: 8572155 - DNA, 22 bp, Homo sapiens
tagaaagaacttcatgtaaaac

SEQ ID NO: 8572156 - DNA, 22 bp, Homo sapiens
tagaaagtaaatcagttttatt

SEQ ID NO: 8572157 - DNA, 22 bp, Homo sapiens
tagaaagtaaacacgaagtctc

SEQ ID NO: 8572158 - DNA, 22 bp, Homo sapiens
tagaaagtaaatcagttttatt

SEQ ID NO: 8572159 - DNA, 22 bp, Homo sapiens
tagaaagtaaacacgaagtctc

SEQ ID NO: 8572160 - DNA, 22 bp, Homo sapiens
tagaaagtagccacttacagag

SEQ ID NO: 8572161 - DNA, 22 bp, Homo sapiens
tagaaagtactaaatttaactg

SEQ ID NO: 8572162 - DNA, 22 bp, Homo sapiens
tagaaagtactaaatttaactg

SEQ ID NO: 8572163 - DNA, 22 bp, Homo sapiens
tagaaagtaaatcagttttatt

SEQ ID NO: 8572164 - DNA, 22 bp, Homo sapiens
tagaaagtgaaggttaattaat

SEQ ID NO: 8572165 - DNA, 22 bp, Homo sapiens
tagaaagtcatgaattacacca

SEQ ID NO: 8572166 - DNA, 22 bp, Homo sapiens
tagaaagtcatgaattacacca

SEQ ID NO: 8572167 - DNA, 21 bp, Homo sapiens
tagaaagtcaaagctatcagc

SEQ ID NO: 8572168 - DNA, 21 bp, Homo sapiens
tagaaagtcaaagctatcagc

SEQ ID NO: 8572169 - DNA, 22 bp, Homo sapiens
tagaaagtcaaaacactgtgtt

SEQ ID NO: 8572170 - DNA, 22 bp, Homo sapiens
tagaaagtagggaaggtaggat

SEQ ID NO: 8572171 - DNA, 22 bp, Homo sapiens
tagaaagtcaaaacactgtgtt

SEQ ID NO: 8572172 - DNA, 22 bp, Homo sapiens
tagaaagtagggaaggtaggat

SEQ ID NO: 8572173 - DNA, 22 bp, Homo sapiens
tagaaagtagccacttacagag

SEQ ID NO: 8572174 - DNA, 22 bp, Homo sapiens
tagaaatgaatgtttaaaagtc

SEQ ID NO: 8572175 - DNA, 22 bp, Homo sapiens
tagaaatgaatgtttaaaagtc

SEQ ID NO: 8572176 - DNA, 22 bp, Homo sapiens
tagaaatgaatgtttaaaagtc

SEQ ID NO: 8572177 - DNA, 22 bp, Homo sapiens
tagaaatgattggttgagctct

SEQ ID NO: 8572178 - DNA, 22 bp, Homo sapiens
tagaaatgattgagctgtaata

SEQ ID NO: 8572179 - DNA, 22 bp, Homo sapiens
tagaaatgattttgatgcttca

SEQ ID NO: 8572180 - DNA, 22 bp, Homo sapiens
tagaaatgcccagattctgcta

SEQ ID NO: 8572181 - DNA, 22 bp, Homo sapiens
tagaaatgcccagattctgcta

SEQ ID NO: 8572182 - DNA, 22 bp, Homo sapiens
tagaaatgcagtgtactgtgtc

SEQ ID NO: 8572183 - DNA, 22 bp, Homo sapiens
tagaaatgcagtgtactgtgtc

SEQ ID NO: 8572184 - DNA, 22 bp, Homo sapiens
tagaaatgcagtgtactgtgtc

SEQ ID NO: 8572185 - DNA, 22 bp, Homo sapiens
tagaaatctacttagactttct

SEQ ID NO: 8572186 - DNA, 20 bp, Homo sapiens
tagaaatcttataaaagact

SEQ ID NO: 8572187 - DNA, 22 bp, Homo sapiens
tagaaatccccagtctcatagt

SEQ ID NO: 8572188 - DNA, 22 bp, Homo sapiens
tagaaatcaggtttttagaaag

SEQ ID NO: 8572189 - DNA, 21 bp, Homo sapiens
tagaaatcagctggtgcctct

SEQ ID NO: 8572190 - DNA, 22 bp, Homo sapiens
tagaaatcatttagaagtattg

SEQ ID NO: 8572191 - DNA, 22 bp, Homo sapiens
tagaaatcagcaggcatatgta

SEQ ID NO: 8572192 - DNA, 22 bp, Homo sapiens
tagaaagtggttgagagtttag

SEQ ID NO: 8572193 - DNA, 22 bp, Homo sapiens
tagaaagtggttgagagtttag

SEQ ID NO: 8572194 - DNA, 22 bp, Homo sapiens
tagaaagtgaaggttaattaat

SEQ ID NO: 8572195 - DNA, 22 bp, Homo sapiens
tagaaagtgaaggttaattaat

SEQ ID NO: 8572196 - DNA, 22 bp, Homo sapiens
tagaatgtggaggtaacagact

SEQ ID NO: 8572197 - DNA, 23 bp, Homo sapiens
tagaatgtcattcaatgatatgg

SEQ ID NO: 8572198 - DNA, 22 bp, Homo sapiens
tagaatgtgcctggaatacagt

SEQ ID NO: 8572199 - DNA, 22 bp, Homo sapiens
tagaattatgccttgctgtcca

SEQ ID NO: 8572200 - DNA, 22 bp, Homo sapiens
tagaattgagtttcactgttcc

SEQ ID NO: 8572201 - DNA, 22 bp, Homo sapiens
tagaatgagaaagtgtagcagg

SEQ ID NO: 8572202 - DNA, 19 bp, Homo sapiens
tagaatgcccacttaaaaa

SEQ ID NO: 8572203 - DNA, 22 bp, Homo sapiens
tagaattgggcctaacttccat

SEQ ID NO: 8572204 - DNA, 22 bp, Homo sapiens
tagacaatgccatcttgtggtt

SEQ ID NO: 8572205 - DNA, 22 bp, Homo sapiens
tagacacaaatctcagtgacac

SEQ ID NO: 8572206 - DNA, 22 bp, Homo sapiens
tagacaatgccatcttgtggtt

SEQ ID NO: 8572207 - DNA, 22 bp, Homo sapiens
tagacaatctcagcaaacacac

SEQ ID NO: 8572208 - DNA, 22 bp, Homo sapiens
tagacaatatttgaaagtagtg

SEQ ID NO: 8572209 - DNA, 22 bp, Homo sapiens
tagaggcattaatgaataaaca

SEQ ID NO: 8572210 - DNA, 22 bp, Homo sapiens
tagaggctactagaggcacctg

SEQ ID NO: 8572211 - DNA, 22 bp, Homo sapiens
tagaggctactagaggcacctg

SEQ ID NO: 8572212 - DNA, 22 bp, Homo sapiens
tagaggctcctgtgtgtaggtt

SEQ ID NO: 8572213 - DNA, 22 bp, Homo sapiens
tagaggctcttcattgcagtag

SEQ ID NO: 8572214 - DNA, 22 bp, Homo sapiens
tagaggctcctgtgtgtaggtt

SEQ ID NO: 8572215 - DNA, 22 bp, Homo sapiens
tagaggggaaaatgcgtattaa

SEQ ID NO: 8572216 - DNA, 22 bp, Homo sapiens
tagaggctttcagcggtaggtc

SEQ ID NO: 8572217 - DNA, 22 bp, Homo sapiens
tagaggcttctactgctcactt

SEQ ID NO: 8572218 - DNA, 22 bp, Homo sapiens
tagaggctgggaattattttca

SEQ ID NO: 8572219 - DNA, 22 bp, Homo sapiens
tagacacatcttcatccacaat

SEQ ID NO: 8572220 - DNA, 22 bp, Homo sapiens
tagacacatcttcatccacaat

SEQ ID NO: 8572221 - DNA, 22 bp, Homo sapiens
tagacactagggatttagtact

SEQ ID NO: 8572222 - DNA, 23 bp, Homo sapiens
tagacactcctttgtctgtcctt

SEQ ID NO: 8572223 - DNA, 22 bp, Homo sapiens
tagacactgtatgagctgggtg

SEQ ID NO: 8572224 - DNA, 22 bp, Homo sapiens
tagacacatcttcatccacaat

SEQ ID NO: 8572225 - DNA, 22 bp, Homo sapiens
tagaggcagaagaaattgacaa

SEQ ID NO: 8572226 - DNA, 22 bp, Homo sapiens
tagacagatttaaaggaatgga

SEQ ID NO: 8572227 - DNA, 22 bp, Homo sapiens
tagacactgtatgagctgggtg

SEQ ID NO: 8572228 - DNA, 22 bp, Homo sapiens
tagacactttagaagtaagggt

SEQ ID NO: 8572229 - DNA, 22 bp, Homo sapiens
tagacagaatccagcccacgcc

SEQ ID NO: 8572230 - DNA, 22 bp, Homo sapiens
ttaataaacaggtgcagctgaa

SEQ ID NO: 8572231 - DNA, 22 bp, Homo sapiens
ttaattaattagttaagcatgt

SEQ ID NO: 8572232 - DNA, 22 bp, Homo sapiens
ttaataaacaggtgcagctgaa

SEQ ID NO: 8572233 - DNA, 22 bp, Homo sapiens
ttaataaacaggtgcagctgaa

SEQ ID NO: 8572234 - DNA, 22 bp, Homo sapiens
ttaataaacaggtgcagctgaa

SEQ ID NO: 8572235 - DNA, 22 bp, Homo sapiens
ttaataaacaggtgcagctgaa

SEQ ID NO: 8572236 - DNA, 22 bp, Homo sapiens
ttaattatgagaaagggaaaag

SEQ ID NO: 8572237 - DNA, 22 bp, Homo sapiens
ttaattatgagaaagggaaaag

SEQ ID NO: 8572238 - DNA, 22 bp, Homo sapiens
ttaattcagtcaaagaaaccat

SEQ ID NO: 8572239 - DNA, 22 bp, Homo sapiens
ttaattcagtcaaagaaaccat

SEQ ID NO: 8572240 - DNA, 22 bp, Homo sapiens
ttaattatgcaaaaggccccat

SEQ ID NO: 8572241 - DNA, 22 bp, Homo sapiens
ttaattcagtcaaagaaaccat

SEQ ID NO: 8572242 - DNA, 22 bp, Homo sapiens
ttaattgatataaagaacttca

SEQ ID NO: 8572243 - DNA, 22 bp, Homo sapiens
ttaattgggtgcaacagctgaa

SEQ ID NO: 8572244 - DNA, 22 bp, Homo sapiens
ttaattggcctcttagaggtta

SEQ ID NO: 8572245 - DNA, 22 bp, Homo sapiens
ttaattgtaaagtttgcctgtt

SEQ ID NO: 8572246 - DNA, 22 bp, Homo sapiens
ttaattggtaacctctggacta

SEQ ID NO: 8572247 - DNA, 22 bp, Homo sapiens
ttaattgtctgtgagtacctga

SEQ ID NO: 8572248 - DNA, 22 bp, Homo sapiens
ttaattgagccagaaagtatct

SEQ ID NO: 8572249 - DNA, 22 bp, Homo sapiens
ttaatttatacataatcacagg

SEQ ID NO: 8572250 - DNA, 22 bp, Homo sapiens
ttaatttatacataatcacagg

SEQ ID NO: 8572251 - DNA, 22 bp, Homo sapiens
ttaatttatacataatcacagg

SEQ ID NO: 8572252 - DNA, 22 bp, Homo sapiens
ttaatttatgtccaaaccagat

SEQ ID NO: 8572253 - DNA, 22 bp, Homo sapiens
ttaatttatgtccaaaccagat

SEQ ID NO: 8572254 - DNA, 22 bp, Homo sapiens
ttaatttatacataatcacagg

SEQ ID NO: 8572255 - DNA, 22 bp, Homo sapiens
ttaagggccattatggatgggt

SEQ ID NO: 8572256 - DNA, 21 bp, Homo sapiens
ttaaggtcacttctgagccta

SEQ ID NO: 8572257 - DNA, 22 bp, Homo sapiens
ttaaggctggtcccctctgcgt

SEQ ID NO: 8572258 - DNA, 22 bp, Homo sapiens
ttaaggttgagctcacttttat

SEQ ID NO: 8572259 - DNA, 22 bp, Homo sapiens
ttaaggcattctcctactaata

SEQ ID NO: 8572260 - DNA, 22 bp, Homo sapiens
ttaagtaacttgtccaaatgag

SEQ ID NO: 8572261 - DNA, 22 bp, Homo sapiens
ttaagtatatccatttgactgg

SEQ ID NO: 8572262 - DNA, 22 bp, Homo sapiens
ttaagtgagcttgaataatctt

SEQ ID NO: 8572263 - DNA, 22 bp, Homo sapiens
ttaagtcatttctgattataga

SEQ ID NO: 8572264 - DNA, 22 bp, Homo sapiens
ttaagtccttggtaattttctt

SEQ ID NO: 8572265 - DNA, 22 bp, Homo sapiens
ttaagtcacttatctaaagaca

SEQ ID NO: 8572266 - DNA, 22 bp, Homo sapiens
ttaagttgtgaataatccagtc

SEQ ID NO: 8572267 - DNA, 18 bp, Homo sapiens
ttaagttttactgcttta

SEQ ID NO: 8572268 - DNA, 22 bp, Homo sapiens
ttaagtgagcttgaataatctt

SEQ ID NO: 8572269 - DNA, 22 bp, Homo sapiens
ttaagtgcaaaaatgaaagtat

SEQ ID NO: 8572270 - DNA, 22 bp, Homo sapiens
ttaacattgtccttagcagatt

SEQ ID NO: 8572271 - DNA, 22 bp, Homo sapiens
ttaacatttcttttccactcat

SEQ ID NO: 8572272 - DNA, 22 bp, Homo sapiens
ttaacatttagtgtacccctgt

SEQ ID NO: 8572273 - DNA, 22 bp, Homo sapiens
ttaacattgtccttagcagatt

SEQ ID NO: 8572274 - DNA, 22 bp, Homo sapiens
ttaacattaaaagcagcatttt

SEQ ID NO: 8572275 - DNA, 22 bp, Homo sapiens
ttaacatgtcttgacttcatct

SEQ ID NO: 8572276 - DNA, 22 bp, Homo sapiens
ttaacatgtcttgacttcatct

SEQ ID NO: 8572277 - DNA, 22 bp, Homo sapiens
ttaacatgtcttgacttcatct

SEQ ID NO: 8572278 - DNA, 22 bp, Homo sapiens
ttaacatttgtgaagcatttag

SEQ ID NO: 8572279 - DNA, 22 bp, Homo sapiens
ttaacatttcttttccactcat

SEQ ID NO: 8572280 - DNA, 22 bp, Homo sapiens
ttaacctgtaaaatgggagaag

SEQ ID NO: 8572281 - DNA, 22 bp, Homo sapiens
ttaactctccctccttacatcc

SEQ ID NO: 8572282 - DNA, 22 bp, Homo sapiens
ttaactgagaggatctgagtag

SEQ ID NO: 8572283 - DNA, 22 bp, Homo sapiens
ttaactctccctccttacatcc

SEQ ID NO: 8572284 - DNA, 22 bp, Homo sapiens
ttaactattattagcatctttg

SEQ ID NO: 8572285 - DNA, 22 bp, Homo sapiens
ttaacctgttatgcccccagag

SEQ ID NO: 8572286 - DNA, 22 bp, Homo sapiens
ttaactgtatcatactgtttca

SEQ ID NO: 8572287 - DNA, 22 bp, Homo sapiens
ttaactggggaagcatttcatg

SEQ ID NO: 8572288 - DNA, 22 bp, Homo sapiens
ttaactgtgacagtttctcaga

SEQ ID NO: 8572289 - DNA, 22 bp, Homo sapiens
ttaacagagtgcctggcatgta

SEQ ID NO: 8572290 - DNA, 22 bp, Homo sapiens
ttaacagagaacatagaagtag

SEQ ID NO: 8572291 - DNA, 22 bp, Homo sapiens
ttaacagacatatatatttgta

SEQ ID NO: 8572292 - DNA, 22 bp, Homo sapiens
ttaacactgattgtagagacac

SEQ ID NO: 8572293 - DNA, 22 bp, Homo sapiens
ttaacacttgaactctacatgt

SEQ ID NO: 8572294 - DNA, 22 bp, Homo sapiens
ttaacacttgaactctacatgt

SEQ ID NO: 8572295 - DNA, 22 bp, Homo sapiens
ttaacactcctaactacagtct

SEQ ID NO: 8572296 - DNA, 22 bp, Homo sapiens
ttaacactatctgtcataatta

SEQ ID NO: 8572297 - DNA, 22 bp, Homo sapiens
ttaacactatctgtcataatta

SEQ ID NO: 8572298 - DNA, 22 bp, Homo sapiens
ttaacactatctgtcataatta

SEQ ID NO: 8572299 - DNA, 22 bp, Homo sapiens
ttaacatacatcatgaacaatg

SEQ ID NO: 8572300 - DNA, 22 bp, Homo sapiens
ttaacatcctgtttaaatttgg

SEQ ID NO: 8572301 - DNA, 22 bp, Homo sapiens
ttaacatcctgtttaaatttgg

SEQ ID NO: 8572302 - DNA, 19 bp, Homo sapiens
ttaacagtcaccaaggaga

SEQ ID NO: 8572303 - DNA, 22 bp, Homo sapiens
ttaacagtaaagaattgtgcaa

SEQ ID NO: 8572304 - DNA, 22 bp, Homo sapiens
ttaacaggttatattgtacagg

SEQ ID NO: 8572305 - DNA, 22 bp, Homo sapiens
ttaacagatgtttatggagcat

SEQ ID NO: 8572306 - DNA, 22 bp, Homo sapiens
ttaagagatttaggaacattat

SEQ ID NO: 8572307 - DNA, 22 bp, Homo sapiens
ttaagacattcagatatttcta

SEQ ID NO: 8572308 - DNA, 21 bp, Homo sapiens
ttaagacctgcatcatcatta

SEQ ID NO: 8572309 - DNA, 22 bp, Homo sapiens
ttaagagaagagtatctagaac

SEQ ID NO: 8572310 - DNA, 22 bp, Homo sapiens
ttaagagacaggagaatgatgt

SEQ ID NO: 8572311 - DNA, 22 bp, Homo sapiens
ttaagaaggtactcaaagatct

SEQ ID NO: 8572312 - DNA, 22 bp, Homo sapiens
ttaagacacatttctcagacgg

SEQ ID NO: 8572313 - DNA, 22 bp, Homo sapiens
ttaagaatgtgccttttggttg

SEQ ID NO: 8572314 - DNA, 22 bp, Homo sapiens
ttaagaatgtgccttttggttg

SEQ ID NO: 8572315 - DNA, 20 bp, Homo sapiens
ttaagaaaagcacatcctgc

SEQ ID NO: 8572316 - DNA, 22 bp, Homo sapiens
ttaacttttatttctgctcgcc

SEQ ID NO: 8572317 - DNA, 22 bp, Homo sapiens
ttaacttcaacactctcttgta

SEQ ID NO: 8572318 - DNA, 22 bp, Homo sapiens
ttaacttgtcagaaaatacagt

SEQ ID NO: 8572319 - DNA, 20 bp, Homo sapiens
ttaagaaaagcacatcctgc

SEQ ID NO: 8572320 - DNA, 20 bp, Homo sapiens
ttaagaaaagcacatcctgc

SEQ ID NO: 8572321 - DNA, 22 bp, Homo sapiens
tgttttctgtgtagagatcaca

SEQ ID NO: 8572322 - DNA, 22 bp, Homo sapiens
tgttttctgattctcgtgtggt

SEQ ID NO: 8572323 - DNA, 22 bp, Homo sapiens
tgttttctgattctcgtgtggt

SEQ ID NO: 8572324 - DNA, 22 bp, Homo sapiens
tgttttctgatggttaatgagt

SEQ ID NO: 8572325 - DNA, 22 bp, Homo sapiens
tgttttctgatggttaatgagt

SEQ ID NO: 8572326 - DNA, 22 bp, Homo sapiens
tgttttgcttctctgtttccca

SEQ ID NO: 8572327 - DNA, 22 bp, Homo sapiens
tgttttgtctaatctaaattct

SEQ ID NO: 8572328 - DNA, 22 bp, Homo sapiens
tgttttgtctaatctaaattct

SEQ ID NO: 8572329 - DNA, 22 bp, Homo sapiens
tgttttgttagcactctgggaa

SEQ ID NO: 8572330 - DNA, 22 bp, Homo sapiens
tgttttgttcactgcattgtcc

SEQ ID NO: 8572331 - DNA, 22 bp, Homo sapiens
tgttttgtttatgagagcacag

SEQ ID NO: 8572332 - DNA, 19 bp, Homo sapiens
tgttttgttaaagcagtcc

SEQ ID NO: 8572333 - DNA, 19 bp, Homo sapiens
tgttttgttaaagcagtcc

SEQ ID NO: 8572334 - DNA, 22 bp, Homo sapiens
ttaaagcatgttgcttaacagg

SEQ ID NO: 8572335 - DNA, 22 bp, Homo sapiens
tgtttttcaaatattgctctgt

SEQ ID NO: 8572336 - DNA, 22 bp, Homo sapiens
tgtttttcaaatattgctctgt

SEQ ID NO: 8572337 - DNA, 22 bp, Homo sapiens
tgtttttaaataatgatagaaa

SEQ ID NO: 8572338 - DNA, 22 bp, Homo sapiens
tgtttttaaataatgatagaaa

SEQ ID NO: 8572339 - DNA, 22 bp, Homo sapiens
tgtttttaaaatgtcctggtta

SEQ ID NO: 8572340 - DNA, 22 bp, Homo sapiens
tgtttttaaataatgatagaaa

SEQ ID NO: 8572341 - DNA, 22 bp, Homo sapiens
tgtttttatctctgtgtacaac

SEQ ID NO: 8572342 - DNA, 22 bp, Homo sapiens
tgtttttactgtgatccagaaa

SEQ ID NO: 8572343 - DNA, 21 bp, Homo sapiens
ttaaagcctccctcataagga

SEQ ID NO: 8572344 - DNA, 22 bp, Homo sapiens
ttaaagcctgactgtggactac

SEQ ID NO: 8572345 - DNA, 22 bp, Homo sapiens
ttaaagccatctagattttgag

SEQ ID NO: 8572346 - DNA, 22 bp, Homo sapiens
ttaaatagtcaaatcagtggca

SEQ ID NO: 8572347 - DNA, 22 bp, Homo sapiens
ttaaatagtaggtctattttgg

SEQ ID NO: 8572348 - DNA, 22 bp, Homo sapiens
ttaaatattatgttgtctgcaa

SEQ ID NO: 8572349 - DNA, 22 bp, Homo sapiens
ttaaatagtcaaatcagtggca

SEQ ID NO: 8572350 - DNA, 22 bp, Homo sapiens
ttaaatattatgttgtctgcaa

SEQ ID NO: 8572351 - DNA, 22 bp, Homo sapiens
ttaaatattatgttgtctgcaa

SEQ ID NO: 8572352 - DNA, 22 bp, Homo sapiens
ttaaatattatgttgtctgcaa

SEQ ID NO: 8572353 - DNA, 22 bp, Homo sapiens
ttaaatattatgttgtctgcaa

SEQ ID NO: 8572354 - DNA, 22 bp, Homo sapiens
ttaaatattatgttgtctgcaa

SEQ ID NO: 8572355 - DNA, 22 bp, Homo sapiens
ttaaatattatgttgtctgcaa

SEQ ID NO: 8572356 - DNA, 22 bp, Homo sapiens
ttaaatattttcagcagggtca

SEQ ID NO: 8572357 - DNA, 22 bp, Homo sapiens
ttaaatattttcagcagggtca

SEQ ID NO: 8572358 - DNA, 22 bp, Homo sapiens
ttaaatattttcagcagggtca

SEQ ID NO: 8572359 - DNA, 22 bp, Homo sapiens
ttaaatattatgttgtctgcaa

SEQ ID NO: 8572360 - DNA, 22 bp, Homo sapiens
ttaaatattatgttgtctgcaa

SEQ ID NO: 8572361 - DNA, 22 bp, Homo sapiens
ttaaatgatgcatatcatttag

SEQ ID NO: 8572362 - DNA, 22 bp, Homo sapiens
ttaaatgatgcatatcatttag

SEQ ID NO: 8572363 - DNA, 22 bp, Homo sapiens
ttaaatgatgcatatcatttag

SEQ ID NO: 8572364 - DNA, 22 bp, Homo sapiens
ttaaatgtcaatagattgcttg

SEQ ID NO: 8572365 - DNA, 22 bp, Homo sapiens
ttaaatggagggggaaatacgt

SEQ ID NO: 8572366 - DNA, 22 bp, Homo sapiens
ttaaatgctcacataaaggtag

SEQ ID NO: 8572367 - DNA, 22 bp, Homo sapiens
ttaaatgagatgttcagatatt

SEQ ID NO: 8572368 - DNA, 22 bp, Homo sapiens
ttaaatgagatgttcagatatt

SEQ ID NO: 8572369 - DNA, 22 bp, Homo sapiens
ttaaatgagatgttcagatatt

SEQ ID NO: 8572370 - DNA, 22 bp, Homo sapiens
ttaaatgagatgttcagatatt

SEQ ID NO: 8572371 - DNA, 22 bp, Homo sapiens
ttaaatgaggctgatgtagatt

SEQ ID NO: 8572372 - DNA, 22 bp, Homo sapiens
ttaaatgaggctgatgtagatt

SEQ ID NO: 8572373 - DNA, 22 bp, Homo sapiens
ttaaatgaggctgatgtagatt

SEQ ID NO: 8572374 - DNA, 22 bp, Homo sapiens
ttaaatgaggctgatgtagatt

SEQ ID NO: 8572375 - DNA, 22 bp, Homo sapiens
ttaaatgaggctgatgtagatt

SEQ ID NO: 8572376 - DNA, 22 bp, Homo sapiens
ttaaatgacttttattattctc

SEQ ID NO: 8572377 - DNA, 22 bp, Homo sapiens
ttaaatgacttttattattctc

SEQ ID NO: 8572378 - DNA, 22 bp, Homo sapiens
ttaaatgagatgttcagatatt

SEQ ID NO: 8572379 - DNA, 22 bp, Homo sapiens
ttaaatgagatgttcagatatt

SEQ ID NO: 8572380 - DNA, 22 bp, Homo sapiens
ttaaatgacttttattattctc

SEQ ID NO: 8572381 - DNA, 22 bp, Homo sapiens
ttaaatgacgggactgggtttt

SEQ ID NO: 8572382 - DNA, 22 bp, Homo sapiens
ttaaatgaacgagatatgcaac

SEQ ID NO: 8572383 - DNA, 22 bp, Homo sapiens
ttaaatgaacgagatatgcaac

SEQ ID NO: 8572384 - DNA, 22 bp, Homo sapiens
ttaaatcagtaggctactcctt

SEQ ID NO: 8572385 - DNA, 22 bp, Homo sapiens
ttaaatcaggcatcatttcagt

SEQ ID NO: 8572386 - DNA, 22 bp, Homo sapiens
ttaaatcaggcatcatttcagt

SEQ ID NO: 8572387 - DNA, 22 bp, Homo sapiens
ttaaatcaggcatcatttcagt

SEQ ID NO: 8572388 - DNA, 22 bp, Homo sapiens
ttaaatattttcagcagggtca

SEQ ID NO: 8572389 - DNA, 22 bp, Homo sapiens
ttaaatattttcagcagggtca

SEQ ID NO: 8572390 - DNA, 22 bp, Homo sapiens
ttaaatattttcagcagggtca

SEQ ID NO: 8572391 - DNA, 22 bp, Homo sapiens
ttaaatgtgatttcatttatgt

SEQ ID NO: 8572392 - DNA, 22 bp, Homo sapiens
ttaaatgtttaatctaacttga

SEQ ID NO: 8572393 - DNA, 22 bp, Homo sapiens
ttaaatgtgatttcatttatgt

SEQ ID NO: 8572394 - DNA, 22 bp, Homo sapiens
ttaaatgtgatttcatttatgt

SEQ ID NO: 8572395 - DNA, 22 bp, Homo sapiens
ttaaatgtctgtagatgtgctg

SEQ ID NO: 8572396 - DNA, 22 bp, Homo sapiens
ttaaatgtctgtagatgtgctg

SEQ ID NO: 8572397 - DNA, 22 bp, Homo sapiens
ttaaattaggactctagttctg

SEQ ID NO: 8572398 - DNA, 22 bp, Homo sapiens
ttaaattaggactctagttctg

SEQ ID NO: 8572399 - DNA, 22 bp, Homo sapiens
ttaaattaggactctagttctg

SEQ ID NO: 8572400 - DNA, 22 bp, Homo sapiens
ttaaattaggactctagttctg

SEQ ID NO: 8572401 - DNA, 22 bp, Homo sapiens
ttaacaaaaatatcaggcatca

SEQ ID NO: 8572402 - DNA, 22 bp, Homo sapiens
ttaacaaaaatatcaggcatca

SEQ ID NO: 8572403 - DNA, 22 bp, Homo sapiens
ttaacaaaaatatcaggcatca

SEQ ID NO: 8572404 - DNA, 22 bp, Homo sapiens
ttaacaatagagtttcttcagg

SEQ ID NO: 8572405 - DNA, 22 bp, Homo sapiens
ttaacaaggtgactgcattaaa

SEQ ID NO: 8572406 - DNA, 22 bp, Homo sapiens
ttaacaaaaatatcaggcatca

SEQ ID NO: 8572407 - DNA, 22 bp, Homo sapiens
ttaacaaagctctgttcctttt

SEQ ID NO: 8572408 - DNA, 22 bp, Homo sapiens
ttaacaatagagtttcttcagg

SEQ ID NO: 8572409 - DNA, 22 bp, Homo sapiens
ttaacaatagagtttcttcagg

SEQ ID NO: 8572410 - DNA, 22 bp, Homo sapiens
ttaacacatatttatcaattgc

SEQ ID NO: 8572411 - DNA, 22 bp, Homo sapiens
ttacttgatttgaaaatcatag

SEQ ID NO: 8572412 - DNA, 22 bp, Homo sapiens
ttacttgatagggggatggggt

SEQ ID NO: 8572413 - DNA, 22 bp, Homo sapiens
ttacttgatgtatgatgagtag

SEQ ID NO: 8572414 - DNA, 22 bp, Homo sapiens
ttactttagatcatactgtgtg

SEQ ID NO: 8572415 - DNA, 22 bp, Homo sapiens
ttactttagggatgttttgctt

SEQ ID NO: 8572416 - DNA, 21 bp, Homo sapiens
ttactttagaaattgcctttt

SEQ ID NO: 8572417 - DNA, 22 bp, Homo sapiens
ttactttaagggtgtcttatta

SEQ ID NO: 8572418 - DNA, 19 bp, Homo sapiens
ttacttggcaaagtcagtc

SEQ ID NO: 8572419 - DNA, 22 bp, Homo sapiens
ttacttggtgttctgcccagga

SEQ ID NO: 8572420 - DNA, 22 bp, Homo sapiens
ttactttagaaatagtcatcaa

SEQ ID NO: 8572421 - DNA, 22 bp, Homo sapiens
ttactttagaaatagtcatcaa

SEQ ID NO: 8572422 - DNA, 22 bp, Homo sapiens
ttactttaagggtgtcttatta

SEQ ID NO: 8572423 - DNA, 22 bp, Homo sapiens
ttactgttttggtacctcattg

SEQ ID NO: 8572424 - DNA, 22 bp, Homo sapiens
ttacttaaacagaaatgcagaa

SEQ ID NO: 8572425 - DNA, 22 bp, Homo sapiens
ttactgtttgaaaaatgaatgt

SEQ ID NO: 8572426 - DNA, 22 bp, Homo sapiens
ttactgttggtgtatccatagc

SEQ ID NO: 8572427 - DNA, 22 bp, Homo sapiens
ttactgttcatgttgtacactt

SEQ ID NO: 8572428 - DNA, 22 bp, Homo sapiens
ttactgttcatgttgtacactt

SEQ ID NO: 8572429 - DNA, 22 bp, Homo sapiens
ttactgtatgagtgtggtagtc

SEQ ID NO: 8572430 - DNA, 22 bp, Homo sapiens
ttacttgaaaaccaccagtatt

SEQ ID NO: 8572431 - DNA, 22 bp, Homo sapiens
ttactgatggaacagagataga

SEQ ID NO: 8572432 - DNA, 22 bp, Homo sapiens
ttactgatacacataagaattt

SEQ ID NO: 8572433 - DNA, 22 bp, Homo sapiens
ttactgtagcttgacatatgtc

SEQ ID NO: 8572434 - DNA, 20 bp, Homo sapiens
ttactcagttcctgccatgc

SEQ ID NO: 8572435 - DNA, 22 bp, Homo sapiens
ttactcattgctggatctagaa

SEQ ID NO: 8572436 - DNA, 22 bp, Homo sapiens
ttactctgaatgtttctactga

SEQ ID NO: 8572437 - DNA, 22 bp, Homo sapiens
ttactgaaaattcttcaggatt

SEQ ID NO: 8572438 - DNA, 22 bp, Homo sapiens
ttactcagtctcccatacattg

SEQ ID NO: 8572439 - DNA, 20 bp, Homo sapiens
ttactcagttcctgccatgc

SEQ ID NO: 8572440 - DNA, 22 bp, Homo sapiens
ttactcagtctcccatacattg

SEQ ID NO: 8572441 - DNA, 23 bp, Homo sapiens
ttactacacaagtaacgattccc

SEQ ID NO: 8572442 - DNA, 23 bp, Homo sapiens
ttactacacaagtaacgattccc

SEQ ID NO: 8572443 - DNA, 22 bp, Homo sapiens
ttaccaaatgaaatagagattt

SEQ ID NO: 8572444 - DNA, 22 bp, Homo sapiens
ttactacagagagagctccagt

SEQ ID NO: 8572445 - DNA, 18 bp, Homo sapiens
ttactacagcactttctt

SEQ ID NO: 8572446 - DNA, 22 bp, Homo sapiens
ttactacattgtaacacagtac

SEQ ID NO: 8572447 - DNA, 22 bp, Homo sapiens
ttactacattgtaacacagtac

SEQ ID NO: 8572448 - DNA, 22 bp, Homo sapiens
ttaccaaatgaaatagagattt

SEQ ID NO: 8572449 - DNA, 22 bp, Homo sapiens
ttacatgacaaagctttggctc

SEQ ID NO: 8572450 - DNA, 22 bp, Homo sapiens
ttagaaagctttccatagtcaa

SEQ ID NO: 8572451 - DNA, 22 bp, Homo sapiens
ttagaaagctttccatagtcaa

SEQ ID NO: 8572452 - DNA, 21 bp, Homo sapiens
ttagaagctaatgcagctggt

SEQ ID NO: 8572453 - DNA, 21 bp, Homo sapiens
ttagaagctaatgcagctggt

SEQ ID NO: 8572454 - DNA, 22 bp, Homo sapiens
ttagaagtaaggtcagatttct

SEQ ID NO: 8572455 - DNA, 22 bp, Homo sapiens
ttagacatagaatattgtctag

SEQ ID NO: 8572456 - DNA, 22 bp, Homo sapiens
ttagactagaagcttccacttt

SEQ ID NO: 8572457 - DNA, 21 bp, Homo sapiens
ttagacttgggtttttcctgg

SEQ ID NO: 8572458 - DNA, 22 bp, Homo sapiens
ttagagaaattctggtaatgta

SEQ ID NO: 8572459 - DNA, 22 bp, Homo sapiens
ttagaggaaagtgactccgatg

SEQ ID NO: 8572460 - DNA, 22 bp, Homo sapiens
ttagaggacaagaggcctggct

SEQ ID NO: 8572461 - DNA, 22 bp, Homo sapiens
ttagagccagttacaaggtcaa

SEQ ID NO: 8572462 - DNA, 23 bp, Homo sapiens
ttagagatgattaaaaaatcttg

SEQ ID NO: 8572463 - DNA, 22 bp, Homo sapiens
ttagagagaaccatcaggatct

SEQ ID NO: 8572464 - DNA, 22 bp, Homo sapiens
ttagagatacatttgtagcttg

SEQ ID NO: 8572465 - DNA, 22 bp, Homo sapiens
ttagagattggttgacagattt

SEQ ID NO: 8572466 - DNA, 22 bp, Homo sapiens
ttagagatgtcccaaaatgaag

SEQ ID NO: 8572467 - DNA, 22 bp, Homo sapiens
ttagagaattccaaatgactac

SEQ ID NO: 8572468 - DNA, 22 bp, Homo sapiens
ttactttccagctctagcttca

SEQ ID NO: 8572469 - DNA, 22 bp, Homo sapiens
ttactttgatgatcaatgagcg

SEQ ID NO: 8572470 - DNA, 22 bp, Homo sapiens
ttactttatgtgatggattagt

SEQ ID NO: 8572471 - DNA, 22 bp, Homo sapiens
ttactttatctcctagattcca

SEQ ID NO: 8572472 - DNA, 22 bp, Homo sapiens
ttactttatgtgatggattagt

SEQ ID NO: 8572473 - DNA, 22 bp, Homo sapiens
ttactttatctcctagattcca

SEQ ID NO: 8572474 - DNA, 22 bp, Homo sapiens
ttactttatagaacactggggg

SEQ ID NO: 8572475 - DNA, 22 bp, Homo sapiens
ttactttgggtcctgcttataa

SEQ ID NO: 8572476 - DNA, 22 bp, Homo sapiens
ttactttgggtcctgcttataa

SEQ ID NO: 8572477 - DNA, 22 bp, Homo sapiens
ttactttgttctcaagatatgt

SEQ ID NO: 8572478 - DNA, 22 bp, Homo sapiens
ttactttgttctcaagatatgt

SEQ ID NO: 8572479 - DNA, 22 bp, Homo sapiens
ttactttggatggtcaagaaag

SEQ ID NO: 8572480 - DNA, 22 bp, Homo sapiens
ttactttgctttctcattacag

SEQ ID NO: 8572481 - DNA, 22 bp, Homo sapiens
ttactttggatggtcaagaaag

SEQ ID NO: 8572482 - DNA, 22 bp, Homo sapiens
ttactttggatggtcaagaaag

SEQ ID NO: 8572483 - DNA, 22 bp, Homo sapiens
ttactttggcaaactcctgccc

SEQ ID NO: 8572484 - DNA, 22 bp, Homo sapiens
ttagaaaatttgcttctttgga

SEQ ID NO: 8572485 - DNA, 22 bp, Homo sapiens
ttagaaacccagactcttaggt

SEQ ID NO: 8572486 - DNA, 22 bp, Homo sapiens
ttagaaactcaactctgggaat

SEQ ID NO: 8572487 - DNA, 19 bp, Homo sapiens
ttagaaactgttgacactg

SEQ ID NO: 8572488 - DNA, 22 bp, Homo sapiens
ttagaaagaatagcctggctgc

SEQ ID NO: 8572489 - DNA, 22 bp, Homo sapiens
ttagaaagagtataccagaaac

SEQ ID NO: 8572490 - DNA, 22 bp, Homo sapiens
ttagaaactttggaggatagat

SEQ ID NO: 8572491 - DNA, 22 bp, Homo sapiens
ttacaaagaaaattaggcattt

SEQ ID NO: 8572492 - DNA, 22 bp, Homo sapiens
ttacacaaagttagctcttgca

SEQ ID NO: 8572493 - DNA, 22 bp, Homo sapiens
ttacacaaagttagctcttgca

SEQ ID NO: 8572494 - DNA, 22 bp, Homo sapiens
ttacacaaagctccccaaatag

SEQ ID NO: 8572495 - DNA, 22 bp, Homo sapiens
ttacacaacatctgtattatta

SEQ ID NO: 8572496 - DNA, 22 bp, Homo sapiens
ttacacaagttctttaacctat

SEQ ID NO: 8572497 - DNA, 22 bp, Homo sapiens
ttacacaagttctttaacctat

SEQ ID NO: 8572498 - DNA, 22 bp, Homo sapiens
ttacacaatatatggtacttgg

SEQ ID NO: 8572499 - DNA, 22 bp, Homo sapiens
ttacaaacaagatcttattctt

SEQ ID NO: 8572500 - DNA, 22 bp, Homo sapiens
ttacaaacaacagacatttatt

SEQ ID NO: 8572501 - DNA, 22 bp, Homo sapiens
ttacaaagaaaattaggcattt

SEQ ID NO: 8572502 - DNA, 22 bp, Homo sapiens
ttacaaagaaaattaggcattt

SEQ ID NO: 8572503 - DNA, 22 bp, Homo sapiens
ttacaaactgtcatatagtatt

SEQ ID NO: 8572504 - DNA, 22 bp, Homo sapiens
ttaattttaacctgtttgtgtc

SEQ ID NO: 8572505 - DNA, 22 bp, Homo sapiens
ttaattttctcatctgtgaaat

SEQ ID NO: 8572506 - DNA, 22 bp, Homo sapiens
ttaatttgaccataaatatctt

SEQ ID NO: 8572507 - DNA, 21 bp, Homo sapiens
ttaatttattcatgatagcta

SEQ ID NO: 8572508 - DNA, 22 bp, Homo sapiens
ttaatttttatgtatagtgtgt

SEQ ID NO: 8572509 - DNA, 22 bp, Homo sapiens
ttacaaacaacagacatttatt

SEQ ID NO: 8572510 - DNA, 22 bp, Homo sapiens
ttacacatctagacccattttt

SEQ ID NO: 8572511 - DNA, 22 bp, Homo sapiens
ttacacagttggtaggggcaga

SEQ ID NO: 8572512 - DNA, 22 bp, Homo sapiens
ttacacatgaaggtccaatgtt

SEQ ID NO: 8572513 - DNA, 22 bp, Homo sapiens
ttacacatgaaggtccaatgtt

SEQ ID NO: 8572514 - DNA, 22 bp, Homo sapiens
ttacacatgctcacttatttgt

SEQ ID NO: 8572515 - DNA, 22 bp, Homo sapiens
ttacacatgaaggtccaatgtt

SEQ ID NO: 8572516 - DNA, 22 bp, Homo sapiens
ttacacagtgcacaagcagagt

SEQ ID NO: 8572517 - DNA, 22 bp, Homo sapiens
ttacacagtgcacaagcagagt

SEQ ID NO: 8572518 - DNA, 22 bp, Homo sapiens
ttacacagtgcacaagcagagt

SEQ ID NO: 8572519 - DNA, 22 bp, Homo sapiens
ttacacagtgcacaagcagagt

SEQ ID NO: 8572520 - DNA, 22 bp, Homo sapiens
ttacacagtggttaagtctggg

SEQ ID NO: 8572521 - DNA, 22 bp, Homo sapiens
ttacacagttggtaggggcaga

SEQ ID NO: 8572522 - DNA, 22 bp, Homo sapiens
ttacactaagctacttctatat

SEQ ID NO: 8572523 - DNA, 22 bp, Homo sapiens
ttacacgtgtgtgtatctgtat

SEQ ID NO: 8572524 - DNA, 22 bp, Homo sapiens
ttacactctggttgtgggcctt

SEQ ID NO: 8572525 - DNA, 19 bp, Homo sapiens
ttacactcctgggcagtgg

SEQ ID NO: 8572526 - DNA, 22 bp, Homo sapiens
ttacactgacagctgaaaagca

SEQ ID NO: 8572527 - DNA, 22 bp, Homo sapiens
ttacactcatattgcacttacc

SEQ ID NO: 8572528 - DNA, 22 bp, Homo sapiens
ttacacattaacaggcagctaa

SEQ ID NO: 8572529 - DNA, 22 bp, Homo sapiens
ttacacatgtctcagtggaaat

SEQ ID NO: 8572530 - DNA, 22 bp, Homo sapiens
ttacacattaacaggcagctaa

SEQ ID NO: 8572531 - DNA, 22 bp, Homo sapiens
ttacacattgcagatcaaaatg

SEQ ID NO: 8572532 - DNA, 22 bp, Homo sapiens
ttacacagacatggcatcatga

SEQ ID NO: 8572533 - DNA, 22 bp, Homo sapiens
ttacacagaaattttattgcct

SEQ ID NO: 8572534 - DNA, 22 bp, Homo sapiens
ttacacagaaacactgttcaga

SEQ ID NO: 8572535 - DNA, 22 bp, Homo sapiens
ttacacactctgccctgctgtt

SEQ ID NO: 8572536 - DNA, 21 bp, Homo sapiens
ttacacactgcttctagaatg

SEQ ID NO: 8572537 - DNA, 22 bp, Homo sapiens
ttacacagaaacactgttcaga

SEQ ID NO: 8572538 - DNA, 22 bp, Homo sapiens
ttacacaattttattgacctaa

SEQ ID NO: 8572539 - DNA, 22 bp, Homo sapiens
ttacacaattttattgacctaa

SEQ ID NO: 8572540 - DNA, 22 bp, Homo sapiens
ttacacacaattagcatagtaa

SEQ ID NO: 8572541 - DNA, 22 bp, Homo sapiens
ttacacacagagctgggcctgg

SEQ ID NO: 8572542 - DNA, 22 bp, Homo sapiens
ttacacagatggttagtagagg

SEQ ID NO: 8572543 - DNA, 22 bp, Homo sapiens
ttacacagatggttagtagagg

SEQ ID NO: 8572544 - DNA, 17 bp, Homo sapiens
ttacacaggagagctct

SEQ ID NO: 8572545 - DNA, 22 bp, Homo sapiens
ttacacagcttctatccttgaa

SEQ ID NO: 8572546 - DNA, 22 bp, Homo sapiens
ttacacagacatggcatcatga

SEQ ID NO: 8572547 - DNA, 22 bp, Homo sapiens
ttacacagatggttagtagagg

SEQ ID NO: 8572548 - DNA, 22 bp, Homo sapiens
ttacacagtgaatttactcaag

SEQ ID NO: 8572549 - DNA, 22 bp, Homo sapiens
ttacacagtatccaaggttctt

SEQ ID NO: 8572550 - DNA, 22 bp, Homo sapiens
ttacacagtatccaaggttctt

SEQ ID NO: 8572551 - DNA, 22 bp, Homo sapiens
ttacacaggcacttaaaatgca

SEQ ID NO: 8572552 - DNA, 22 bp, Homo sapiens
ttacacaggcacttaaaatgca

SEQ ID NO: 8572553 - DNA, 22 bp, Homo sapiens
ttacacaggcacttaaaatgca

SEQ ID NO: 8572554 - DNA, 17 bp, Homo sapiens
ttacacaggagagctct

SEQ ID NO: 8572555 - DNA, 17 bp, Homo sapiens
ttacacaggagagctct

SEQ ID NO: 8572556 - DNA, 22 bp, Homo sapiens
ttacagtattgttaaactcttt

SEQ ID NO: 8572557 - DNA, 22 bp, Homo sapiens
ttacagtcctttgtattgttta

SEQ ID NO: 8572558 - DNA, 22 bp, Homo sapiens
ttacagtcctttgtattgttta

SEQ ID NO: 8572559 - DNA, 22 bp, Homo sapiens
ttacagtatgatcaacttttca

SEQ ID NO: 8572560 - DNA, 22 bp, Homo sapiens
ttacagtatgatcaacttttca

SEQ ID NO: 8572561 - DNA, 23 bp, Homo sapiens
ttacagtaggagttggaaaacca

SEQ ID NO: 8572562 - DNA, 23 bp, Homo sapiens
ttacagtaggagttggaaaacca

SEQ ID NO: 8572563 - DNA, 22 bp, Homo sapiens
ttacagtattgttaaactcttt

SEQ ID NO: 8572564 - DNA, 22 bp, Homo sapiens
ttacagtattgttaaactcttt

SEQ ID NO: 8572565 - DNA, 22 bp, Homo sapiens
ttacagtattgttaaactcttt

SEQ ID NO: 8572566 - DNA, 22 bp, Homo sapiens
ttacagtatgatcaacttttca

SEQ ID NO: 8572567 - DNA, 22 bp, Homo sapiens
ttacagtattggtcacgtttgt

SEQ ID NO: 8572568 - DNA, 22 bp, Homo sapiens
ttacatagttaaatagtacagc

SEQ ID NO: 8572569 - DNA, 22 bp, Homo sapiens
ttacatagttaaatagtacagc

SEQ ID NO: 8572570 - DNA, 22 bp, Homo sapiens
ttacagtgacagttgctatgat

SEQ ID NO: 8572571 - DNA, 22 bp, Homo sapiens
ttacagtgagggtgacatttac

SEQ ID NO: 8572572 - DNA, 22 bp, Homo sapiens
ttacatctaaactgtgaacaat

SEQ ID NO: 8572573 - DNA, 22 bp, Homo sapiens
ttacatgaatacataaccattc

SEQ ID NO: 8572574 - DNA, 22 bp, Homo sapiens
ttacatgaatacataaccattc

SEQ ID NO: 8572575 - DNA, 22 bp, Homo sapiens
ttacatctaaactgtgaacaat

SEQ ID NO: 8572576 - DNA, 19 bp, Homo sapiens
ttacatctgcaacactggt

SEQ ID NO: 8572577 - DNA, 19 bp, Homo sapiens
ttacatctgcaacactggt

SEQ ID NO: 8572578 - DNA, 19 bp, Homo sapiens
ttacatgacactccagcct

SEQ ID NO: 8572579 - DNA, 22 bp, Homo sapiens
ttacattttggggtaaggataa

SEQ ID NO: 8572580 - DNA, 22 bp, Homo sapiens
ttacatattgtctattgttcaa

SEQ ID NO: 8572581 - DNA, 22 bp, Homo sapiens
ttacatcagaatcacccaggaa

SEQ ID NO: 8572582 - DNA, 22 bp, Homo sapiens
ttacagtaacattttcagtctg

SEQ ID NO: 8572583 - DNA, 22 bp, Homo sapiens
ttacaggtgggaaaactaagct

SEQ ID NO: 8572584 - DNA, 22 bp, Homo sapiens
ttacaggtggagaagtaaggct

SEQ ID NO: 8572585 - DNA, 22 bp, Homo sapiens
ttacaggtacttgctgctgaaa

SEQ ID NO: 8572586 - DNA, 22 bp, Homo sapiens
ttacagtaatcgagtgttgtgg

SEQ ID NO: 8572587 - DNA, 22 bp, Homo sapiens
ttacagtaatgtattatttaac

SEQ ID NO: 8572588 - DNA, 22 bp, Homo sapiens
ttacagtacctgtatggccact

SEQ ID NO: 8572589 - DNA, 22 bp, Homo sapiens
ttacagtacagaaaataacaga

SEQ ID NO: 8572590 - DNA, 22 bp, Homo sapiens
ttacagtacagaaaataacaga

SEQ ID NO: 8572591 - DNA, 22 bp, Homo sapiens
ttacagtacagaaaataacaga

SEQ ID NO: 8572592 - DNA, 22 bp, Homo sapiens
ttacagtagattttgaatgtgg

SEQ ID NO: 8572593 - DNA, 22 bp, Homo sapiens
ttacagtagctttatttggagt

SEQ ID NO: 8572594 - DNA, 22 bp, Homo sapiens
ttacagtagatacaatgagtaa

SEQ ID NO: 8572595 - DNA, 22 bp, Homo sapiens
ttacaggggacattggggacat

SEQ ID NO: 8572596 - DNA, 22 bp, Homo sapiens
ttacaggaggtgctaggtgttt

SEQ ID NO: 8572597 - DNA, 22 bp, Homo sapiens
ttacaggaggtgctaggtgttt

SEQ ID NO: 8572598 - DNA, 22 bp, Homo sapiens
ttacagcttacattttaccttg

SEQ ID NO: 8572599 - DNA, 20 bp, Homo sapiens
ttacactttgtagcattttt

SEQ ID NO: 8572600 - DNA, 22 bp, Homo sapiens
ttacactttggcaagctattaa

SEQ ID NO: 8572601 - DNA, 22 bp, Homo sapiens
ttacactttggcaagctattaa

SEQ ID NO: 8572602 - DNA, 22 bp, Homo sapiens
ttacactttaaatccagcttgt

SEQ ID NO: 8572603 - DNA, 22 bp, Homo sapiens
ttacacttgtaattatataacg

SEQ ID NO: 8572604 - DNA, 22 bp, Homo sapiens
ttacacttgggtgtggatttta

SEQ ID NO: 8572605 - DNA, 22 bp, Homo sapiens
ttacacttgaaaacaggattta

SEQ ID NO: 8572606 - DNA, 22 bp, Homo sapiens
ttacacttatctagagccatgg

SEQ ID NO: 8572607 - DNA, 22 bp, Homo sapiens
ttacacttctaaaaaaagcagg

SEQ ID NO: 8572608 - DNA, 22 bp, Homo sapiens
tgtggcagtataagagctagaa

SEQ ID NO: 8572609 - DNA, 18 bp, Homo sapiens
tgtggcaggggtgggaga

SEQ ID NO: 8572610 - DNA, 22 bp, Homo sapiens
tgtggcagtaaaattgggcaac

SEQ ID NO: 8572611 - DNA, 22 bp, Homo sapiens
tgtggcagctgctgcaggagct

SEQ ID NO: 8572612 - DNA, 22 bp, Homo sapiens
tgtggcagtctcactggagggc

SEQ ID NO: 8572613 - DNA, 21 bp, Homo sapiens
tgtggcatcattgatctgtga

SEQ ID NO: 8572614 - DNA, 22 bp, Homo sapiens
tgtggcatacacatgaggtggt

SEQ ID NO: 8572615 - DNA, 22 bp, Homo sapiens
tgtggcatacacatgaggtggt

SEQ ID NO: 8572616 - DNA, 22 bp, Homo sapiens
tgtggcagtctcactggagggc

SEQ ID NO: 8572617 - DNA, 22 bp, Homo sapiens
tgtggccaccagagctgctatt

SEQ ID NO: 8572618 - DNA, 19 bp, Homo sapiens
tgtggccatggttcagctg

SEQ ID NO: 8572619 - DNA, 22 bp, Homo sapiens
tgtggcccagatgagtgtgcta

SEQ ID NO: 8572620 - DNA, 22 bp, Homo sapiens
tgtggccaggaaaaggagatgg

SEQ ID NO: 8572621 - DNA, 22 bp, Homo sapiens
tgtggccagcaggtggctgtgt

SEQ ID NO: 8572622 - DNA, 22 bp, Homo sapiens
tgtggccagccacaggcatggt

SEQ ID NO: 8572623 - DNA, 22 bp, Homo sapiens
tgtggcagattttataaattgc

SEQ ID NO: 8572624 - DNA, 21 bp, Homo sapiens
tgtggcagatgttgggaggca

SEQ ID NO: 8572625 - DNA, 21 bp, Homo sapiens
tgtggcagagacaatgctagt

SEQ ID NO: 8572626 - DNA, 22 bp, Homo sapiens
tgtggcagacaagattctatgt

SEQ ID NO: 8572627 - DNA, 22 bp, Homo sapiens
tgtggaggtttaagtaatggga

SEQ ID NO: 8572628 - DNA, 22 bp, Homo sapiens
tgtggatgagggagtgaacaaa

SEQ ID NO: 8572629 - DNA, 22 bp, Homo sapiens
tgtggcacatacacaggagggc

SEQ ID NO: 8572630 - DNA, 22 bp, Homo sapiens
tcccctctggttgacccaggag

SEQ ID NO: 8572631 - DNA, 22 bp, Homo sapiens
tcccctctggttgacccaggag

SEQ ID NO: 8572632 - DNA, 22 bp, Homo sapiens
tcccctgagacccctcagcact

SEQ ID NO: 8572633 - DNA, 22 bp, Homo sapiens
tcccctgcagatgagggcagtg

SEQ ID NO: 8572634 - DNA, 22 bp, Homo sapiens
tcccctctggaggctgcagggg

SEQ ID NO: 8572635 - DNA, 22 bp, Homo sapiens
tcccctctggaggctgcagggg

SEQ ID NO: 8572636 - DNA, 22 bp, Homo sapiens
tcccctctctgcgctcccaggt

SEQ ID NO: 8572637 - DNA, 22 bp, Homo sapiens
tcccctctctgcgctcccaggt

SEQ ID NO: 8572638 - DNA, 22 bp, Homo sapiens
tcccctctctgcgctcccaggt

SEQ ID NO: 8572639 - DNA, 22 bp, Homo sapiens
tcccctgcagcgcctgcttcta

SEQ ID NO: 8572640 - DNA, 22 bp, Homo sapiens
tgtggagaagaaggccactgca

SEQ ID NO: 8572641 - DNA, 22 bp, Homo sapiens
tgtggactttagtaggtgagag

SEQ ID NO: 8572642 - DNA, 22 bp, Homo sapiens
tgtggagaagaaggccactgca

SEQ ID NO: 8572643 - DNA, 22 bp, Homo sapiens
tgtggagcccccaggagtgggg

SEQ ID NO: 8572644 - DNA, 22 bp, Homo sapiens
tgtggagctcagaagtagcagt

SEQ ID NO: 8572645 - DNA, 22 bp, Homo sapiens
tgtggactcgcatggctgaggc

SEQ ID NO: 8572646 - DNA, 22 bp, Homo sapiens
tgtggactgtgctgccacagtg

SEQ ID NO: 8572647 - DNA, 22 bp, Homo sapiens
tccccagtaagcctgcactgtg

SEQ ID NO: 8572648 - DNA, 22 bp, Homo sapiens
tccccagtcccggcggtgggtg

SEQ ID NO: 8572649 - DNA, 22 bp, Homo sapiens
tccccaggtcctgtcggctcct

SEQ ID NO: 8572650 - DNA, 22 bp, Homo sapiens
tccccaggtcctgtcggctcct

SEQ ID NO: 8572651 - DNA, 22 bp, Homo sapiens
tccccaggtcctgtcggctcct

SEQ ID NO: 8572652 - DNA, 22 bp, Homo sapiens
tcccccactctaaaggagcctt

SEQ ID NO: 8572653 - DNA, 22 bp, Homo sapiens
tcccccactctaaaggagcctt

SEQ ID NO: 8572654 - DNA, 22 bp, Homo sapiens
tcccccactctaaaggagcctt

SEQ ID NO: 8572655 - DNA, 22 bp, Homo sapiens
tcccccaggctggagtgcagtg

SEQ ID NO: 8572656 - DNA, 22 bp, Homo sapiens
tcccccaggctggagtgcagtg

SEQ ID NO: 8572657 - DNA, 22 bp, Homo sapiens
tcccccaggctggagtgcagtg

SEQ ID NO: 8572658 - DNA, 22 bp, Homo sapiens
tcccctccaactccaactatgg

SEQ ID NO: 8572659 - DNA, 22 bp, Homo sapiens
tcccctccaactccaactatgg

SEQ ID NO: 8572660 - DNA, 23 bp, Homo sapiens
tcccctcaggcagccagtgccct

SEQ ID NO: 8572661 - DNA, 22 bp, Homo sapiens
tcccctcctctcctgatatggg

SEQ ID NO: 8572662 - DNA, 22 bp, Homo sapiens
tcccctcccttccaacagagct

SEQ ID NO: 8572663 - DNA, 22 bp, Homo sapiens
tccccctccaattgccatgtta

SEQ ID NO: 8572664 - DNA, 22 bp, Homo sapiens
tccccctccaattgccatgtta

SEQ ID NO: 8572665 - DNA, 21 bp, Homo sapiens
tcccctcacttgtcttctgag

SEQ ID NO: 8572666 - DNA, 22 bp, Homo sapiens
tgtggggaggctgcagtgctgc

SEQ ID NO: 8572667 - DNA, 17 bp, Homo sapiens
tgtggccttctgagctt

SEQ ID NO: 8572668 - DNA, 19 bp, Homo sapiens
tgtggcctggggacaggcc

SEQ ID NO: 8572669 - DNA, 22 bp, Homo sapiens
tgtggccttatttgtatggggg

SEQ ID NO: 8572670 - DNA, 22 bp, Homo sapiens
tgtggcctctaagctcacgaag

SEQ ID NO: 8572671 - DNA, 22 bp, Homo sapiens
tgtggcctctaagctcacgaag

SEQ ID NO: 8572672 - DNA, 22 bp, Homo sapiens
tgtggcctcaaggctgccctca

SEQ ID NO: 8572673 - DNA, 22 bp, Homo sapiens
tgtggcctcctgttcctgggta

SEQ ID NO: 8572674 - DNA, 22 bp, Homo sapiens
tgtggcctccccacttctgggg

SEQ ID NO: 8572675 - DNA, 22 bp, Homo sapiens
tgtggcctgattttgcatctct

SEQ ID NO: 8572676 - DNA, 22 bp, Homo sapiens
tgtggcctgattttgcatctct

SEQ ID NO: 8572677 - DNA, 22 bp, Homo sapiens
tgtggcctggaaggggctgctc

SEQ ID NO: 8572678 - DNA, 22 bp, Homo sapiens
tgtggcctgggagctgaggtct

SEQ ID NO: 8572679 - DNA, 22 bp, Homo sapiens
tgtggcctgggaaatgagtgtt

SEQ ID NO: 8572680 - DNA, 19 bp, Homo sapiens
tgtggtctctgttctcagg

SEQ ID NO: 8572681 - DNA, 22 bp, Homo sapiens
tgtggtctcgttatgttgccca

SEQ ID NO: 8572682 - DNA, 22 bp, Homo sapiens
tgtggtctccccagtgccagct

SEQ ID NO: 8572683 - DNA, 22 bp, Homo sapiens
tgtggtctccccagtgccagct

SEQ ID NO: 8572684 - DNA, 21 bp, Homo sapiens
tgtggtcttttagttccatca

SEQ ID NO: 8572685 - DNA, 22 bp, Homo sapiens
tgtggtgagaaactggtagatt

SEQ ID NO: 8572686 - DNA, 22 bp, Homo sapiens
tgtggtgccgagagtctggacg

SEQ ID NO: 8572687 - DNA, 18 bp, Homo sapiens
tgtggtggagctgccttc

SEQ ID NO: 8572688 - DNA, 22 bp, Homo sapiens
tgtgggtggagtgatattagct

SEQ ID NO: 8572689 - DNA, 19 bp, Homo sapiens
tgtggggagtcagggggct

SEQ ID NO: 8572690 - DNA, 19 bp, Homo sapiens
tgtggggagtcagggggct

SEQ ID NO: 8572691 - DNA, 22 bp, Homo sapiens
tgtggtagagggcagatgggca

SEQ ID NO: 8572692 - DNA, 22 bp, Homo sapiens
tgtggtagtctcagggcagtat

SEQ ID NO: 8572693 - DNA, 22 bp, Homo sapiens
tgtgggtttgtagttaagttct

SEQ ID NO: 8572694 - DNA, 22 bp, Homo sapiens
tgtgggtgttctcacttagata

SEQ ID NO: 8572695 - DNA, 22 bp, Homo sapiens
tgtgggtggtaaaatacaatga

SEQ ID NO: 8572696 - DNA, 22 bp, Homo sapiens
tgtgtaaatttatttacataaa

SEQ ID NO: 8572697 - DNA, 22 bp, Homo sapiens
tgtgtaaatggcatctctcagc

SEQ ID NO: 8572698 - DNA, 22 bp, Homo sapiens
tgtgtaaatggcatctctcagc

SEQ ID NO: 8572699 - DNA, 22 bp, Homo sapiens
tgtgtaaatggactgtgaatta

SEQ ID NO: 8572700 - DNA, 22 bp, Homo sapiens
tgtgtacaaactaacaacatat

SEQ ID NO: 8572701 - DNA, 22 bp, Homo sapiens
tgtgtacaaactaacaacatat

SEQ ID NO: 8572702 - DNA, 22 bp, Homo sapiens
tgtgtacaaactaacaacatat

SEQ ID NO: 8572703 - DNA, 22 bp, Homo sapiens
tgtgtcagcacagtatcaatta

SEQ ID NO: 8572704 - DNA, 22 bp, Homo sapiens
tgtgtcaggagatagcaaaggg

SEQ ID NO: 8572705 - DNA, 22 bp, Homo sapiens
tgtggtggctattctggtctca

SEQ ID NO: 8572706 - DNA, 22 bp, Homo sapiens
tgtggtggctattctggtctca

SEQ ID NO: 8572707 - DNA, 18 bp, Homo sapiens
tgtggtggagctgccttc

SEQ ID NO: 8572708 - DNA, 22 bp, Homo sapiens
tgtggtggtaatgagccagatg

SEQ ID NO: 8572709 - DNA, 22 bp, Homo sapiens
tgtgtaaaatctgattaatact

SEQ ID NO: 8572710 - DNA, 22 bp, Homo sapiens
tgtgtaaaatctgattaatact

SEQ ID NO: 8572711 - DNA, 22 bp, Homo sapiens
tgtgtaaaatctgattaatact

SEQ ID NO: 8572712 - DNA, 22 bp, Homo sapiens
tgtgtaaaagattagtttacta

SEQ ID NO: 8572713 - DNA, 22 bp, Homo sapiens
tgtgtaaagcttgttccagaaa

SEQ ID NO: 8572714 - DNA, 19 bp, Homo sapiens
tgtgtaaagtctgtggtca

SEQ ID NO: 8572715 - DNA, 21 bp, Homo sapiens
tgtgtaaagttgaaatcctgt

SEQ ID NO: 8572716 - DNA, 22 bp, Homo sapiens
tgtgtccacgcactggcatgat

SEQ ID NO: 8572717 - DNA, 22 bp, Homo sapiens
tgtgtccatctgacaggagagg

SEQ ID NO: 8572718 - DNA, 22 bp, Homo sapiens
tgtgtccattcaggcactgacc

SEQ ID NO: 8572719 - DNA, 22 bp, Homo sapiens
tgtgtcccttggaacctcagct

SEQ ID NO: 8572720 - DNA, 22 bp, Homo sapiens
tgtgtctaggctcatgcttgct

SEQ ID NO: 8572721 - DNA, 22 bp, Homo sapiens
tgtgtctgttttgctcaccatt

SEQ ID NO: 8572722 - DNA, 22 bp, Homo sapiens
tgtgtccttctgggagtcccag

SEQ ID NO: 8572723 - DNA, 20 bp, Homo sapiens
tgtgtgaacacggactctgt

SEQ ID NO: 8572724 - DNA, 20 bp, Homo sapiens
tgtgtcttcctttctttatg

SEQ ID NO: 8572725 - DNA, 22 bp, Homo sapiens
tgtgtcttaagttccaagacat

SEQ ID NO: 8572726 - DNA, 20 bp, Homo sapiens
tgtgtcttcctttctttatg

SEQ ID NO: 8572727 - DNA, 22 bp, Homo sapiens
tgtgtcttacataattacatgt

SEQ ID NO: 8572728 - DNA, 22 bp, Homo sapiens
tgtgtcttaagttccaagacat

SEQ ID NO: 8572729 - DNA, 22 bp, Homo sapiens
tgtgtgaaggaatatatactca

SEQ ID NO: 8572730 - DNA, 22 bp, Homo sapiens
tgtgtgaagcacatgttcaagg

SEQ ID NO: 8572731 - DNA, 22 bp, Homo sapiens
tgtgtgaacatgttttcatttc

SEQ ID NO: 8572732 - DNA, 22 bp, Homo sapiens
tgtgtgaactctctgatgtaca

SEQ ID NO: 8572733 - DNA, 22 bp, Homo sapiens
tgtgtgaactctctgatgtaca

SEQ ID NO: 8572734 - DNA, 22 bp, Homo sapiens
tgtgtgaatctattgaatatat

SEQ ID NO: 8572735 - DNA, 22 bp, Homo sapiens
tgtgtgaatagcagtggctggt

SEQ ID NO: 8572736 - DNA, 22 bp, Homo sapiens
tgtgtgaagtgattttaagtct

SEQ ID NO: 8572737 - DNA, 22 bp, Homo sapiens
tgtgtgaaggagccactgttca

SEQ ID NO: 8572738 - DNA, 22 bp, Homo sapiens
tgtgtgaatggattattctatt

SEQ ID NO: 8572739 - DNA, 22 bp, Homo sapiens
tgtgtgaatctattgaatatat

SEQ ID NO: 8572740 - DNA, 22 bp, Homo sapiens
tgtgtgaatctattgaatatat

SEQ ID NO: 8572741 - DNA, 22 bp, Homo sapiens
tgtgtgaattacgcgtgtcctg

SEQ ID NO: 8572742 - DNA, 22 bp, Homo sapiens
tgtgtgaatggattattctatt

SEQ ID NO: 8572743 - DNA, 22 bp, Homo sapiens
tgtgtgaatggattattctatt

SEQ ID NO: 8572744 - DNA, 22 bp, Homo sapiens
tgtgtgacacattgatatgtgc

SEQ ID NO: 8572745 - DNA, 22 bp, Homo sapiens
tgtgtgacctggggtgagatag

SEQ ID NO: 8572746 - DNA, 22 bp, Homo sapiens
tgtgtgagacaattggctgtgg

SEQ ID NO: 8572747 - DNA, 22 bp, Homo sapiens
tgtgtgagacaattggctgtgg

SEQ ID NO: 8572748 - DNA, 22 bp, Homo sapiens
tgtgtgacacattgatatgtgc

SEQ ID NO: 8572749 - DNA, 22 bp, Homo sapiens
tgtgtgacccccagtgaagcct

SEQ ID NO: 8572750 - DNA, 22 bp, Homo sapiens
tgtgtgacctggggtgagatag

SEQ ID NO: 8572751 - DNA, 22 bp, Homo sapiens
tgtgtgaattctgagcagttta

SEQ ID NO: 8572752 - DNA, 20 bp, Homo sapiens
tgtgtgaattagggcatgtt

SEQ ID NO: 8572753 - DNA, 22 bp, Homo sapiens
tgtgtgattgcaggagatgtgg

SEQ ID NO: 8572754 - DNA, 22 bp, Homo sapiens
tgtgtgattgcacttatatgag

SEQ ID NO: 8572755 - DNA, 22 bp, Homo sapiens
tgtgtgattgcaggagatgtgg

SEQ ID NO: 8572756 - DNA, 22 bp, Homo sapiens
tgtgtgattgcaggagatgtgg

SEQ ID NO: 8572757 - DNA, 22 bp, Homo sapiens
tgtgtgattgcaggagatgtgg

SEQ ID NO: 8572758 - DNA, 22 bp, Homo sapiens
tgtgtgagtaaggctgagagag

SEQ ID NO: 8572759 - DNA, 22 bp, Homo sapiens
tgtgtgattccacttatatggg

SEQ ID NO: 8572760 - DNA, 22 bp, Homo sapiens
tgtgtgaggtggttctgagaag

SEQ ID NO: 8572761 - DNA, 22 bp, Homo sapiens
tgttatttatttcacctccaga

SEQ ID NO: 8572762 - DNA, 22 bp, Homo sapiens
tgttatttatctgagcatttat

SEQ ID NO: 8572763 - DNA, 22 bp, Homo sapiens
tgttatttatttcacctccaga

SEQ ID NO: 8572764 - DNA, 22 bp, Homo sapiens
tgttatttctttgccatatctt

SEQ ID NO: 8572765 - DNA, 22 bp, Homo sapiens
tgttatttctttgccatatctt

SEQ ID NO: 8572766 - DNA, 22 bp, Homo sapiens
tgttattctagtggatcacgtc

SEQ ID NO: 8572767 - DNA, 22 bp, Homo sapiens
tgttattatgtttccagagcct

SEQ ID NO: 8572768 - DNA, 22 bp, Homo sapiens
tgttattatctgttaggtgttc

SEQ ID NO: 8572769 - DNA, 22 bp, Homo sapiens
tgttattgatatctaatgctct

SEQ ID NO: 8572770 - DNA, 22 bp, Homo sapiens
tgttattgatatctaatgctct

SEQ ID NO: 8572771 - DNA, 22 bp, Homo sapiens
tgttatttatctgagcatttat

SEQ ID NO: 8572772 - DNA, 22 bp, Homo sapiens
tgttatgagtcctcatatacta

SEQ ID NO: 8572773 - DNA, 22 bp, Homo sapiens
tgttatgtgccacacttgaggg

SEQ ID NO: 8572774 - DNA, 21 bp, Homo sapiens
tgttatgtgcttcaagaagtg

SEQ ID NO: 8572775 - DNA, 22 bp, Homo sapiens
tgttatgaacttctagaaaaca

SEQ ID NO: 8572776 - DNA, 19 bp, Homo sapiens
tgttatgactttgcctttt

SEQ ID NO: 8572777 - DNA, 22 bp, Homo sapiens
tgttatctggttgtctgattac

SEQ ID NO: 8572778 - DNA, 22 bp, Homo sapiens
tgttaaaaatgcagattcctat

SEQ ID NO: 8572779 - DNA, 22 bp, Homo sapiens
tgttatcctcagctcacctcta

SEQ ID NO: 8572780 - DNA, 22 bp, Homo sapiens
tgttatcacttagacatgctag

SEQ ID NO: 8572781 - DNA, 22 bp, Homo sapiens
tgttatcacttagacatgctag

SEQ ID NO: 8572782 - DNA, 22 bp, Homo sapiens
tgttatcacttgtaaaagcaat

SEQ ID NO: 8572783 - DNA, 21 bp, Homo sapiens
tgttcacatggagcagaatgt

SEQ ID NO: 8572784 - DNA, 20 bp, Homo sapiens
tgttcacagtagttgctgct

SEQ ID NO: 8572785 - DNA, 22 bp, Homo sapiens
tgttcacatcgatggattttgc

SEQ ID NO: 8572786 - DNA, 22 bp, Homo sapiens
tgttcacaagcagatgttgctt

SEQ ID NO: 8572787 - DNA, 22 bp, Homo sapiens
tgttcacaagatgtctgtggct

SEQ ID NO: 8572788 - DNA, 22 bp, Homo sapiens
tgttcacaggggagccatttat

SEQ ID NO: 8572789 - DNA, 22 bp, Homo sapiens
tgttcacaaggtgatgctttga

SEQ ID NO: 8572790 - DNA, 22 bp, Homo sapiens
tgttcaaatcttttgcttattt

SEQ ID NO: 8572791 - DNA, 21 bp, Homo sapiens
tgttcaaacgtacacatttct

SEQ ID NO: 8572792 - DNA, 21 bp, Homo sapiens
tgttcaaacgtacacatttct

SEQ ID NO: 8572793 - DNA, 22 bp, Homo sapiens
tgttcaagtggatgtggctttt

SEQ ID NO: 8572794 - DNA, 22 bp, Homo sapiens
tgttcaaatcttttgcttattt

SEQ ID NO: 8572795 - DNA, 22 bp, Homo sapiens
tgttcaaaaatatcttctgcaa

SEQ ID NO: 8572796 - DNA, 22 bp, Homo sapiens
tgttatttgggaaagttgtaca

SEQ ID NO: 8572797 - DNA, 22 bp, Homo sapiens
tgttatttgggaaagttgtaca

SEQ ID NO: 8572798 - DNA, 22 bp, Homo sapiens
tgttatttgggaaagttgtaca

SEQ ID NO: 8572799 - DNA, 22 bp, Homo sapiens
tgttcagaaaacagataactaa

SEQ ID NO: 8572800 - DNA, 22 bp, Homo sapiens
tgttcagaacaaaggtaaatga

SEQ ID NO: 8572801 - DNA, 22 bp, Homo sapiens
tgttcccattttctgcataatc

SEQ ID NO: 8572802 - DNA, 22 bp, Homo sapiens
tgttcctgaatgcctggctggc

SEQ ID NO: 8572803 - DNA, 22 bp, Homo sapiens
tgttcctgaggcatgtgtcaat

SEQ ID NO: 8572804 - DNA, 22 bp, Homo sapiens
tgttcctgtactgctgtggctt

SEQ ID NO: 8572805 - DNA, 21 bp, Homo sapiens
tgtgtgcatatgcatgtacat

SEQ ID NO: 8572806 - DNA, 21 bp, Homo sapiens
tgtgtgcatatgcatgtacat

SEQ ID NO: 8572807 - DNA, 20 bp, Homo sapiens
tgtgtgcatctgtatgtatt

SEQ ID NO: 8572808 - DNA, 22 bp, Homo sapiens
tgtgtgcagcctctgtctttgg

SEQ ID NO: 8572809 - DNA, 22 bp, Homo sapiens
tgtgtgcagcctctgtctttgg

SEQ ID NO: 8572810 - DNA, 22 bp, Homo sapiens
tgtgtgcagcctctgtctttgg

SEQ ID NO: 8572811 - DNA, 22 bp, Homo sapiens
tgtgtgcagcctctgtctttgg

SEQ ID NO: 8572812 - DNA, 22 bp, Homo sapiens
tgtgtgcaggcactgtgccaga

SEQ ID NO: 8572813 - DNA, 22 bp, Homo sapiens
tgtgtgcacatgatttgaaatg

SEQ ID NO: 8572814 - DNA, 22 bp, Homo sapiens
tgtgtgcacgtacatactgtat

SEQ ID NO: 8572815 - DNA, 22 bp, Homo sapiens
tgtgtgcactgccttttgtgga

SEQ ID NO: 8572816 - DNA, 22 bp, Homo sapiens
tgtgtgcacttaatgcaatcat

SEQ ID NO: 8572817 - DNA, 22 bp, Homo sapiens
tgtgtgcactgccttttgtgga

SEQ ID NO: 8572818 - DNA, 22 bp, Homo sapiens
tgtgtgcacaggagtgtttgaa

SEQ ID NO: 8572819 - DNA, 20 bp, Homo sapiens
tgtgtgcacacatgacattc

SEQ ID NO: 8572820 - DNA, 20 bp, Homo sapiens
tgtgtgcacacatgacattc

SEQ ID NO: 8572821 - DNA, 22 bp, Homo sapiens
tgtgtgcacaggagtgtttgaa

SEQ ID NO: 8572822 - DNA, 22 bp, Homo sapiens
tgtgttcttaaaagcagtgata

SEQ ID NO: 8572823 - DNA, 21 bp, Homo sapiens
tgtgttcttctaggtcagcta

SEQ ID NO: 8572824 - DNA, 22 bp, Homo sapiens
tgtgttgtgacattcttggatg

SEQ ID NO: 8572825 - DNA, 22 bp, Homo sapiens
tgtgttggtagatctgaggtct

SEQ ID NO: 8572826 - DNA, 22 bp, Homo sapiens
tgtgttggaaatagggtctttg

SEQ ID NO: 8572827 - DNA, 22 bp, Homo sapiens
tgtgttggcttgcctgttaggc

SEQ ID NO: 8572828 - DNA, 22 bp, Homo sapiens
tgtgttggctgccggcacagga

SEQ ID NO: 8572829 - DNA, 22 bp, Homo sapiens
tgtgttcaagattagttctagt

SEQ ID NO: 8572830 - DNA, 19 bp, Homo sapiens
tgtgttcaaactccatctc

SEQ ID NO: 8572831 - DNA, 22 bp, Homo sapiens
tgtgttctggaaagctcactga

SEQ ID NO: 8572832 - DNA, 22 bp, Homo sapiens
tgtgttctggaaagctcactga

SEQ ID NO: 8572833 - DNA, 22 bp, Homo sapiens
tgtgttctggaaagctcactga

SEQ ID NO: 8572834 - DNA, 20 bp, Homo sapiens
tgtgtgcatctgtatgtatt

SEQ ID NO: 8572835 - DNA, 22 bp, Homo sapiens
tgtgttaattccacaaacattc

SEQ ID NO: 8572836 - DNA, 22 bp, Homo sapiens
tgtgttaatttattgcctcaga

SEQ ID NO: 8572837 - DNA, 22 bp, Homo sapiens
tgtgttttgaactcatctactg

SEQ ID NO: 8572838 - DNA, 22 bp, Homo sapiens
tgtgttttggaaggaacatgca

SEQ ID NO: 8572839 - DNA, 21 bp, Homo sapiens
tgtgttttaatgatattctgt

SEQ ID NO: 8572840 - DNA, 22 bp, Homo sapiens
tgtgttttacaaattctcttaa

SEQ ID NO: 8572841 - DNA, 22 bp, Homo sapiens
tgtgtttgggggagatgcattt

SEQ ID NO: 8572842 - DNA, 22 bp, Homo sapiens
tgtgttttaaatggaaatttga

SEQ ID NO: 8572843 - DNA, 22 bp, Homo sapiens
tgtgtttgggggagatgcattt

SEQ ID NO: 8572844 - DNA, 22 bp, Homo sapiens
tgtgtttgttagactaatgtta

SEQ ID NO: 8572845 - DNA, 22 bp, Homo sapiens
tgtgtttgttagactaatgtta

SEQ ID NO: 8572846 - DNA, 22 bp, Homo sapiens
tgtgttgtgacattcttggatg

SEQ ID NO: 8572847 - DNA, 22 bp, Homo sapiens
tgtgttgttttaagctgctgca

SEQ ID NO: 8572848 - DNA, 22 bp, Homo sapiens
tgtgttgtgtcacctatcatgc

SEQ ID NO: 8572849 - DNA, 22 bp, Homo sapiens
tgtgttgttttaagctgctgca

SEQ ID NO: 8572850 - DNA, 22 bp, Homo sapiens
tgtgtttacttctatgcagttt

SEQ ID NO: 8572851 - DNA, 22 bp, Homo sapiens
tgtgtttacttctatgcagttt

SEQ ID NO: 8572852 - DNA, 23 bp, Homo sapiens
tgtgtttacctgaggatcttgtt

SEQ ID NO: 8572853 - DNA, 22 bp, Homo sapiens
tgtgtttaaagaggaagtgaga

SEQ ID NO: 8572854 - DNA, 22 bp, Homo sapiens
tgtgtttgagtcctcacagtgc

SEQ ID NO: 8572855 - DNA, 22 bp, Homo sapiens
tgtgtttgaggcatgttgcaga

SEQ ID NO: 8572856 - DNA, 21 bp, Homo sapiens
tgtgtttgagactatgtttcc

SEQ ID NO: 8572857 - DNA, 22 bp, Homo sapiens
tgtgtttgaggcatgttgcaga

SEQ ID NO: 8572858 - DNA, 21 bp, Homo sapiens
tgtgtttgagactatgtttcc

SEQ ID NO: 8572859 - DNA, 22 bp, Homo sapiens
tgtgtttctctgaggggtccct

SEQ ID NO: 8572860 - DNA, 22 bp, Homo sapiens
tgtgtttctgagaatcccacct

SEQ ID NO: 8572861 - DNA, 22 bp, Homo sapiens
tgtgtttatagtgtatcttcca

SEQ ID NO: 8572862 - DNA, 22 bp, Homo sapiens
tgtgtttcagaaccttctttca

SEQ ID NO: 8572863 - DNA, 22 bp, Homo sapiens
tgtttcatgtggacatagttgt

SEQ ID NO: 8572864 - DNA, 22 bp, Homo sapiens
tgtttcatgtggacatagttgt

SEQ ID NO: 8572865 - DNA, 22 bp, Homo sapiens
tgtttcatgtggacatagttgt

SEQ ID NO: 8572866 - DNA, 22 bp, Homo sapiens
tgtttcatgattgctgtcattt

SEQ ID NO: 8572867 - DNA, 22 bp, Homo sapiens
tgtttcatgaagtctggatatc

SEQ ID NO: 8572868 - DNA, 22 bp, Homo sapiens
tgtttcatgattgctgtcattt

SEQ ID NO: 8572869 - DNA, 20 bp, Homo sapiens
tgtttcataagctgtcctat

SEQ ID NO: 8572870 - DNA, 22 bp, Homo sapiens
tgtttcagtccctgtgttcaat

SEQ ID NO: 8572871 - DNA, 22 bp, Homo sapiens
tgtttccagaatgtagctgctt

SEQ ID NO: 8572872 - DNA, 22 bp, Homo sapiens
tgtttccatggtgacagcagct

SEQ ID NO: 8572873 - DNA, 22 bp, Homo sapiens
tgtttcattagtactgacaata

SEQ ID NO: 8572874 - DNA, 22 bp, Homo sapiens
tgtttactagccaacatggaga

SEQ ID NO: 8572875 - DNA, 22 bp, Homo sapiens
tgtttactagccaacatggaga

SEQ ID NO: 8572876 - DNA, 19 bp, Homo sapiens
tgtttacatgtttcttcag

SEQ ID NO: 8572877 - DNA, 22 bp, Homo sapiens
tgtttacatggaggttttcagc

SEQ ID NO: 8572878 - DNA, 22 bp, Homo sapiens
tgtttacatggaggttttcagc

SEQ ID NO: 8572879 - DNA, 22 bp, Homo sapiens
tgtttacatgcataagcttaag

SEQ ID NO: 8572880 - DNA, 22 bp, Homo sapiens
tgtttacatgcataagcttaag

SEQ ID NO: 8572881 - DNA, 22 bp, Homo sapiens
tgtttacatgcataagcttaag

SEQ ID NO: 8572882 - DNA, 22 bp, Homo sapiens
tgtttactatgatgtaacctat

SEQ ID NO: 8572883 - DNA, 22 bp, Homo sapiens
tgtttactccagctgatggaac

SEQ ID NO: 8572884 - DNA, 22 bp, Homo sapiens
tgtttactcactgtatccacaa

SEQ ID NO: 8572885 - DNA, 22 bp, Homo sapiens
tgtttcaagcaatagcatttca

SEQ ID NO: 8572886 - DNA, 22 bp, Homo sapiens
tgttttcagtcatatagcaggt

SEQ ID NO: 8572887 - DNA, 22 bp, Homo sapiens
tgttttcagatgcagggacaca

SEQ ID NO: 8572888 - DNA, 22 bp, Homo sapiens
tgttttcagtcatatagcaggt

SEQ ID NO: 8572889 - DNA, 19 bp, Homo sapiens
tgttttcaagtgggattat

SEQ ID NO: 8572890 - DNA, 22 bp, Homo sapiens
tgttttcacaatgatgtcagat

SEQ ID NO: 8572891 - DNA, 22 bp, Homo sapiens
tgtttgaaaagtggagatttat

SEQ ID NO: 8572892 - DNA, 22 bp, Homo sapiens
tgtttgaaactttgatcactaa

SEQ ID NO: 8572893 - DNA, 22 bp, Homo sapiens
tgtttgaagttcttctgtgact

SEQ ID NO: 8572894 - DNA, 22 bp, Homo sapiens
tgtttgaataacttggatatat

SEQ ID NO: 8572895 - DNA, 22 bp, Homo sapiens
tgtttgagttctagcgcattta

SEQ ID NO: 8572896 - DNA, 22 bp, Homo sapiens
tgtttgagttctagcgcattta

SEQ ID NO: 8572897 - DNA, 18 bp, Homo sapiens
tgtttcctcctggaggct

SEQ ID NO: 8572898 - DNA, 22 bp, Homo sapiens
tgtttcctaagtgtctctgaag

SEQ ID NO: 8572899 - DNA, 22 bp, Homo sapiens
tgtttcctaagtgtctctgaag

SEQ ID NO: 8572900 - DNA, 18 bp, Homo sapiens
tgtttcctcctggaggct

SEQ ID NO: 8572901 - DNA, 22 bp, Homo sapiens
tgtttcctttctggtgagcata

SEQ ID NO: 8572902 - DNA, 22 bp, Homo sapiens
tgtttctttgtagatattcttt

SEQ ID NO: 8572903 - DNA, 20 bp, Homo sapiens
tgtttcttttaatgagcggc

SEQ ID NO: 8572904 - DNA, 20 bp, Homo sapiens
tgtttcttttaatgagcggc

SEQ ID NO: 8572905 - DNA, 22 bp, Homo sapiens
tgtttacagctgatcaggcatc

SEQ ID NO: 8572906 - DNA, 22 bp, Homo sapiens
tgtttacagggtgattttacct

SEQ ID NO: 8572907 - DNA, 22 bp, Homo sapiens
tgtttacagggtgattttacct

SEQ ID NO: 8572908 - DNA, 22 bp, Homo sapiens
tgtttacagctgatcaggcatc

SEQ ID NO: 8572909 - DNA, 22 bp, Homo sapiens
tgtttacaaggagtttatattg

SEQ ID NO: 8572910 - DNA, 22 bp, Homo sapiens
tgtttacaaggagtttatattg

SEQ ID NO: 8572911 - DNA, 22 bp, Homo sapiens
tgtttacaaggagtttatattg

SEQ ID NO: 8572912 - DNA, 22 bp, Homo sapiens
tgtttacaaaaccgtggtactg

SEQ ID NO: 8572913 - DNA, 22 bp, Homo sapiens
tgtttaatttttcatgagccaa

SEQ ID NO: 8572914 - DNA, 22 bp, Homo sapiens
tgtttacaagccacttgttaag

SEQ ID NO: 8572915 - DNA, 22 bp, Homo sapiens
tgtttacaaggagaatttgagg

SEQ ID NO: 8572916 - DNA, 22 bp, Homo sapiens
tgtttaattgggccaacagcgg

SEQ ID NO: 8572917 - DNA, 22 bp, Homo sapiens
tgtttaatttcacaaagttgac

SEQ ID NO: 8572918 - DNA, 22 bp, Homo sapiens
tgtttaatgcattgaccttggg

SEQ ID NO: 8572919 - DNA, 22 bp, Homo sapiens
tgtttaattcaccatcatgttc

SEQ ID NO: 8572920 - DNA, 22 bp, Homo sapiens
tgtttaattcaccatcatgttc

SEQ ID NO: 8572921 - DNA, 22 bp, Homo sapiens
tgtttaattcaccatcatgttc

SEQ ID NO: 8572922 - DNA, 22 bp, Homo sapiens
tgtttaatctataaaatggaga

SEQ ID NO: 8572923 - DNA, 22 bp, Homo sapiens
tgtttaatctataaaatggaga

SEQ ID NO: 8572924 - DNA, 22 bp, Homo sapiens
tgtttaatgaagatggtttttc

SEQ ID NO: 8572925 - DNA, 22 bp, Homo sapiens
tgtttaatcttcaggacagtct

SEQ ID NO: 8572926 - DNA, 21 bp, Homo sapiens
tgtttaatacatatttgtgga

SEQ ID NO: 8572927 - DNA, 22 bp, Homo sapiens
tgtttaataattctatgatagt

SEQ ID NO: 8572928 - DNA, 22 bp, Homo sapiens
tgtttaataattctatgatagt

SEQ ID NO: 8572929 - DNA, 22 bp, Homo sapiens
tgttctgccagcacttctcagc

SEQ ID NO: 8572930 - DNA, 22 bp, Homo sapiens
tgttctcttctcattgaacatg

SEQ ID NO: 8572931 - DNA, 17 bp, Homo sapiens
tgttctcttcagaaatc

SEQ ID NO: 8572932 - DNA, 22 bp, Homo sapiens
tgttctctctccttttgaagtg

SEQ ID NO: 8572933 - DNA, 22 bp, Homo sapiens
tgttctctctggctgccagtac

SEQ ID NO: 8572934 - DNA, 22 bp, Homo sapiens
tgttctctctggctgccagtac

SEQ ID NO: 8572935 - DNA, 21 bp, Homo sapiens
tgtttaagtactcctttctgg

SEQ ID NO: 8572936 - DNA, 20 bp, Homo sapiens
tgttctgtcgtctttcttca

SEQ ID NO: 8572937 - DNA, 22 bp, Homo sapiens
tgtttaagttctgctccttatt

SEQ ID NO: 8572938 - DNA, 22 bp, Homo sapiens
tgtttaagtagtctcagggcct

SEQ ID NO: 8572939 - DNA, 22 bp, Homo sapiens
tgtttaagtgctggtagggttg

SEQ ID NO: 8572940 - DNA, 22 bp, Homo sapiens
tgtttaagtagtctcagggcct

SEQ ID NO: 8572941 - DNA, 22 bp, Homo sapiens
tgttctgtacctgtcctggggc

SEQ ID NO: 8572942 - DNA, 21 bp, Homo sapiens
tgttcctgttctctaggatcc

SEQ ID NO: 8572943 - DNA, 23 bp, Homo sapiens
tgttcctgtcaaattttcttccc

SEQ ID NO: 8572944 - DNA, 22 bp, Homo sapiens
tgttctaagtgttttgttcatg

SEQ ID NO: 8572945 - DNA, 22 bp, Homo sapiens
tgttctcactggatgcttcaca

SEQ ID NO: 8572946 - DNA, 22 bp, Homo sapiens
tgttctcagtaattctatttta

SEQ ID NO: 8572947 - DNA, 22 bp, Homo sapiens
tgttctcactggatgcttcaca

SEQ ID NO: 8572948 - DNA, 21 bp, Homo sapiens
tgttctatcagctcaggtgtc

SEQ ID NO: 8572949 - DNA, 22 bp, Homo sapiens
tgttctatgctctttaaggtga

SEQ ID NO: 8572950 - DNA, 22 bp, Homo sapiens
tgttctagcaacacagttttgg

SEQ ID NO: 8572951 - DNA, 22 bp, Homo sapiens
ttctacactcacccagctgtaa

SEQ ID NO: 8572952 - DNA, 21 bp, Homo sapiens
ttctagaaaagtatgggactg

SEQ ID NO: 8572953 - DNA, 22 bp, Homo sapiens
ttctacacacctctgaggacat

SEQ ID NO: 8572954 - DNA, 22 bp, Homo sapiens
ttctacacagtgcgggttaaca

SEQ ID NO: 8572955 - DNA, 22 bp, Homo sapiens
ttctacaatatgaataatgaag

SEQ ID NO: 8572956 - DNA, 22 bp, Homo sapiens
ttctacaaatatttactgttcc

SEQ ID NO: 8572957 - DNA, 22 bp, Homo sapiens
ttctaattgtgtttgcatatct

SEQ ID NO: 8572958 - DNA, 20 bp, Homo sapiens
ttctaatttgatggagtagc

SEQ ID NO: 8572959 - DNA, 20 bp, Homo sapiens
ttctaatttgatggagtagc

SEQ ID NO: 8572960 - DNA, 22 bp, Homo sapiens
ttctaattattcccttgtccca

SEQ ID NO: 8572961 - DNA, 22 bp, Homo sapiens
ttctaagtctgctgtcttcatc

SEQ ID NO: 8572962 - DNA, 22 bp, Homo sapiens
ttctaatcccagctctactact

SEQ ID NO: 8572963 - DNA, 22 bp, Homo sapiens
ttctaatacacggtatgacttt

SEQ ID NO: 8572964 - DNA, 22 bp, Homo sapiens
ttctaatgaaatctgtacagta

SEQ ID NO: 8572965 - DNA, 22 bp, Homo sapiens
ttctaatctgggcttctgcagt

SEQ ID NO: 8572966 - DNA, 22 bp, Homo sapiens
ttctaatgaaagtggaccatgg

SEQ ID NO: 8572967 - DNA, 20 bp, Homo sapiens
ttctagcatacttacaagga

SEQ ID NO: 8572968 - DNA, 22 bp, Homo sapiens
ttctagggaatgggatgaggat

SEQ ID NO: 8572969 - DNA, 22 bp, Homo sapiens
ttctagaggggagatactagta

SEQ ID NO: 8572970 - DNA, 22 bp, Homo sapiens
ttctagatagagtgcaaattat

SEQ ID NO: 8572971 - DNA, 22 bp, Homo sapiens
ttctagatgcttataggcatat

SEQ ID NO: 8572972 - DNA, 22 bp, Homo sapiens
ttctagcactgcctggaagaca

SEQ ID NO: 8572973 - DNA, 22 bp, Homo sapiens
ttctagcagagggcatctgctg

SEQ ID NO: 8572974 - DNA, 22 bp, Homo sapiens
ttctagcagagggcatctgctg

SEQ ID NO: 8572975 - DNA, 22 bp, Homo sapiens
ttcctgaaaatacagggagacc

SEQ ID NO: 8572976 - DNA, 22 bp, Homo sapiens
ttcctctttctctgtgctatgt

SEQ ID NO: 8572977 - DNA, 22 bp, Homo sapiens
ttcctgaaaatacagggagaga

SEQ ID NO: 8572978 - DNA, 22 bp, Homo sapiens
ttcctgaagtcaaagatctaaa

SEQ ID NO: 8572979 - DNA, 22 bp, Homo sapiens
ttcctgtgaagatctgggtgct

SEQ ID NO: 8572980 - DNA, 22 bp, Homo sapiens
ttcctgtccgcaatggcctggg

SEQ ID NO: 8572981 - DNA, 22 bp, Homo sapiens
ttcctgtccgcaatggcctggg

SEQ ID NO: 8572982 - DNA, 22 bp, Homo sapiens
ttcctgtgcttaattctcactg

SEQ ID NO: 8572983 - DNA, 22 bp, Homo sapiens
ttcctgtggccttacatctgtg

SEQ ID NO: 8572984 - DNA, 19 bp, Homo sapiens
ttcctgtgctgctgtgtcc

SEQ ID NO: 8572985 - DNA, 22 bp, Homo sapiens
ttcctgtgaagccggtggtctc

SEQ ID NO: 8572986 - DNA, 22 bp, Homo sapiens
ttcctgtgtgactcaagtggtt

SEQ ID NO: 8572987 - DNA, 22 bp, Homo sapiens
ttcctgtgtgaccgagacagtg

SEQ ID NO: 8572988 - DNA, 17 bp, Homo sapiens
ttcctgtggtttgatct

SEQ ID NO: 8572989 - DNA, 22 bp, Homo sapiens
ttcctgtgtgttggtggcagaa

SEQ ID NO: 8572990 - DNA, 22 bp, Homo sapiens
ttcctgtgtgttggtggcagaa

SEQ ID NO: 8572991 - DNA, 23 bp, Homo sapiens
ttccttaactgttaagattgtct

SEQ ID NO: 8572992 - DNA, 22 bp, Homo sapiens
ttccttaatgaatcaggccatt

SEQ ID NO: 8572993 - DNA, 22 bp, Homo sapiens
ttccttaatgaatcaggccatt

SEQ ID NO: 8572994 - DNA, 22 bp, Homo sapiens
ttccttacattcatatggcttc

SEQ ID NO: 8572995 - DNA, 22 bp, Homo sapiens
ttccttaatatcccttttggaa

SEQ ID NO: 8572996 - DNA, 22 bp, Homo sapiens
ttccttagatccttcaatcacg

SEQ ID NO: 8572997 - DNA, 22 bp, Homo sapiens
ttccttaggctgtttgcagtgc

SEQ ID NO: 8572998 - DNA, 22 bp, Homo sapiens
ttccttctagcccaagtattgg

SEQ ID NO: 8572999 - DNA, 22 bp, Homo sapiens
ttccttctagcccaagtattgg

SEQ ID NO: 8573000 - DNA, 22 bp, Homo sapiens
ttccttctagagcttgtttagg

SEQ ID NO: 8573001 - DNA, 22 bp, Homo sapiens
ttccttctagagcttgtttagg

SEQ ID NO: 8573002 - DNA, 22 bp, Homo sapiens
ttccttcaaacgcctcctgcac

SEQ ID NO: 8573003 - DNA, 22 bp, Homo sapiens
ttccttagtgttagattctgtg

SEQ ID NO: 8573004 - DNA, 22 bp, Homo sapiens
ttccttagttgactgtcttagt

SEQ ID NO: 8573005 - DNA, 22 bp, Homo sapiens
ttctaagagagtacaagcaatt

SEQ ID NO: 8573006 - DNA, 18 bp, Homo sapiens
ttccttctgatgtatatg

SEQ ID NO: 8573007 - DNA, 18 bp, Homo sapiens
ttccttctgatgtatatg

SEQ ID NO: 8573008 - DNA, 22 bp, Homo sapiens
ttccttctgaagcctttgtgtt

SEQ ID NO: 8573009 - DNA, 22 bp, Homo sapiens
ttccttctgaagcctttgtgtt

SEQ ID NO: 8573010 - DNA, 22 bp, Homo sapiens
ttccttctctgtggggaaggca

SEQ ID NO: 8573011 - DNA, 22 bp, Homo sapiens
ttccttctccagaacttctagg

SEQ ID NO: 8573012 - DNA, 22 bp, Homo sapiens
ttccttctccagaacttctagg

SEQ ID NO: 8573013 - DNA, 22 bp, Homo sapiens
ttccttctcagccctcgaggat

SEQ ID NO: 8573014 - DNA, 22 bp, Homo sapiens
ttccttctcagccctcgaggat

SEQ ID NO: 8573015 - DNA, 22 bp, Homo sapiens
ttccttctagcccaagtattgg

SEQ ID NO: 8573016 - DNA, 22 bp, Homo sapiens
ttccttctattcagctccaaga

SEQ ID NO: 8573017 - DNA, 22 bp, Homo sapiens
ttccacagatgtatgaagtggt

SEQ ID NO: 8573018 - DNA, 22 bp, Homo sapiens
ttccacagatgaaaattaagtt

SEQ ID NO: 8573019 - DNA, 22 bp, Homo sapiens
ttccacagcccaagctggtggc

SEQ ID NO: 8573020 - DNA, 22 bp, Homo sapiens
ttccacaggactaaatgtcatc

SEQ ID NO: 8573021 - DNA, 21 bp, Homo sapiens
ttccacagtcctgaggattca

SEQ ID NO: 8573022 - DNA, 22 bp, Homo sapiens
ttccacaggtttcagactgttc

SEQ ID NO: 8573023 - DNA, 22 bp, Homo sapiens
ttccacagtcatcctgggaatt

SEQ ID NO: 8573024 - DNA, 22 bp, Homo sapiens
ttccacattccttacattcata

SEQ ID NO: 8573025 - DNA, 22 bp, Homo sapiens
ttccagaacaatgtggacgtat

SEQ ID NO: 8573026 - DNA, 20 bp, Homo sapiens
ttccacatctttgcacatgc

SEQ ID NO: 8573027 - DNA, 21 bp, Homo sapiens
ttccacagtgagaactgcaag

SEQ ID NO: 8573028 - DNA, 22 bp, Homo sapiens
ttccacaagtgatatctagctg

SEQ ID NO: 8573029 - DNA, 22 bp, Homo sapiens
ttccacaatggttaagctcgtt

SEQ ID NO: 8573030 - DNA, 22 bp, Homo sapiens
ttccctggctcttctacatcgt

SEQ ID NO: 8573031 - DNA, 22 bp, Homo sapiens
ttcctaacaaggggtattcatc

SEQ ID NO: 8573032 - DNA, 22 bp, Homo sapiens
ttccctggggaaggtgaccttt

SEQ ID NO: 8573033 - DNA, 22 bp, Homo sapiens
ttcctaacaagtctatctttga

SEQ ID NO: 8573034 - DNA, 20 bp, Homo sapiens
ttccctggaaggagaagcag

SEQ ID NO: 8573035 - DNA, 22 bp, Homo sapiens
ttccctggcatgagtgtaagat

SEQ ID NO: 8573036 - DNA, 22 bp, Homo sapiens
ttcctaatgtctactttagttc

SEQ ID NO: 8573037 - DNA, 22 bp, Homo sapiens
ttcctaatcacgaacattattt

SEQ ID NO: 8573038 - DNA, 22 bp, Homo sapiens
ttcctaatggcaaaacatgttt

SEQ ID NO: 8573039 - DNA, 22 bp, Homo sapiens
ttcctaactggcctttatggat

SEQ ID NO: 8573040 - DNA, 22 bp, Homo sapiens
ttcctaactctggcacctagtc

SEQ ID NO: 8573041 - DNA, 22 bp, Homo sapiens
ttcctaacctctagctgcatat

SEQ ID NO: 8573042 - DNA, 22 bp, Homo sapiens
ttcctaacgccagtattttcat

SEQ ID NO: 8573043 - DNA, 22 bp, Homo sapiens
ttcctaacacagtgtaagcaag

SEQ ID NO: 8573044 - DNA, 22 bp, Homo sapiens
ttccagaattgggagccttgag

SEQ ID NO: 8573045 - DNA, 22 bp, Homo sapiens
ttccagaattttgttctgcttg

SEQ ID NO: 8573046 - DNA, 21 bp, Homo sapiens
ttccagagattgtttcacctg

SEQ ID NO: 8573047 - DNA, 22 bp, Homo sapiens
ttccagagcagttttcagatca

SEQ ID NO: 8573048 - DNA, 22 bp, Homo sapiens
ttccagagcagttttcagatca

SEQ ID NO: 8573049 - DNA, 22 bp, Homo sapiens
ttccagagcagttttcagatca

SEQ ID NO: 8573050 - DNA, 20 bp, Homo sapiens
ttccagagatctgcatttta

SEQ ID NO: 8573051 - DNA, 22 bp, Homo sapiens
ttccagagaggctcatgttccc

SEQ ID NO: 8573052 - DNA, 22 bp, Homo sapiens
ttccagagaggctcatgttccc

SEQ ID NO: 8573053 - DNA, 22 bp, Homo sapiens
ttccagagagttattcccctgg

SEQ ID NO: 8573054 - DNA, 22 bp, Homo sapiens
ttccagagaggctcatgttccc

SEQ ID NO: 8573055 - DNA, 22 bp, Homo sapiens
ttcctcagagagacagaaacta

SEQ ID NO: 8573056 - DNA, 22 bp, Homo sapiens
ttcctcagagagacagaaacta

SEQ ID NO: 8573057 - DNA, 22 bp, Homo sapiens
ttcctcagagggcgctggggaa

SEQ ID NO: 8573058 - DNA, 22 bp, Homo sapiens
ttcctcagagggcgctggggaa

SEQ ID NO: 8573059 - DNA, 22 bp, Homo sapiens
ttcctcagaaaatactgtccaa

SEQ ID NO: 8573060 - DNA, 22 bp, Homo sapiens
ttcctcagaccctcattgtgag

SEQ ID NO: 8573061 - DNA, 22 bp, Homo sapiens
ttcctcagaaaatactgtccaa

SEQ ID NO: 8573062 - DNA, 22 bp, Homo sapiens
ttcctcagccaaggctgggatc

SEQ ID NO: 8573063 - DNA, 22 bp, Homo sapiens
ttcctcagccaaggctgggatc

SEQ ID NO: 8573064 - DNA, 22 bp, Homo sapiens
ttcctcagctcagcgagagaga

SEQ ID NO: 8573065 - DNA, 22 bp, Homo sapiens
ttcctcagccagcacttagggg

SEQ ID NO: 8573066 - DNA, 22 bp, Homo sapiens
ttcctagggcagagccgctggg

SEQ ID NO: 8573067 - DNA, 22 bp, Homo sapiens
ttcctagggcagagccgctggg

SEQ ID NO: 8573068 - DNA, 22 bp, Homo sapiens
ttcctagggcagagccgctggg

SEQ ID NO: 8573069 - DNA, 22 bp, Homo sapiens
ttcctcacactcccccattcga

SEQ ID NO: 8573070 - DNA, 22 bp, Homo sapiens
ttcctagctataaagctcttcc

SEQ ID NO: 8573071 - DNA, 22 bp, Homo sapiens
ttcctagggcagagccgctggg

SEQ ID NO: 8573072 - DNA, 22 bp, Homo sapiens
ttcctagggcagagccgctggg

SEQ ID NO: 8573073 - DNA, 22 bp, Homo sapiens
ttcctagaatggttagaaaata

SEQ ID NO: 8573074 - DNA, 22 bp, Homo sapiens
ttcctacatttgtacaataaga

SEQ ID NO: 8573075 - DNA, 22 bp, Homo sapiens
ttcctacatttgtacaataaga

SEQ ID NO: 8573076 - DNA, 22 bp, Homo sapiens
ttcctcagggcggatgggcagg

SEQ ID NO: 8573077 - DNA, 22 bp, Homo sapiens
ttcctcaggcttccctttgtcc

SEQ ID NO: 8573078 - DNA, 22 bp, Homo sapiens
ttcctcagttagtgcctgaggc

SEQ ID NO: 8573079 - DNA, 22 bp, Homo sapiens
ttcctcagggcggatgggcagg

SEQ ID NO: 8573080 - DNA, 20 bp, Homo sapiens
ttcctcaggagaggatgtta

SEQ ID NO: 8573081 - DNA, 22 bp, Homo sapiens
ttcctcaggctgctttcacata

SEQ ID NO: 8573082 - DNA, 22 bp, Homo sapiens
ttcctcagctgtttgggctcat

SEQ ID NO: 8573083 - DNA, 22 bp, Homo sapiens
ttcctcagctggcctgattggg

SEQ ID NO: 8573084 - DNA, 22 bp, Homo sapiens
ttcctctgtatgctttgctgct

SEQ ID NO: 8573085 - DNA, 22 bp, Homo sapiens
ttcctctgtatgctttgctgct

SEQ ID NO: 8573086 - DNA, 22 bp, Homo sapiens
ttcctctgtagttgctgatgaa

SEQ ID NO: 8573087 - DNA, 22 bp, Homo sapiens
ttcctccagcctggagcacttc

SEQ ID NO: 8573088 - DNA, 22 bp, Homo sapiens
ttcctccacgtgacaggagcca

SEQ ID NO: 8573089 - DNA, 22 bp, Homo sapiens
ttcctcatggggttccttcaga

SEQ ID NO: 8573090 - DNA, 22 bp, Homo sapiens
ttcctccacgtgacaggagcca

SEQ ID NO: 8573091 - DNA, 22 bp, Homo sapiens
ttcctccacgtgacaggagcca

SEQ ID NO: 8573092 - DNA, 22 bp, Homo sapiens
ttcctcatctgtgcacctcact

SEQ ID NO: 8573093 - DNA, 22 bp, Homo sapiens
ttcctcatggggttccttcaga

SEQ ID NO: 8573094 - DNA, 22 bp, Homo sapiens
ttcctcatggggttccttcaga

SEQ ID NO: 8573095 - DNA, 22 bp, Homo sapiens
ttcaggagaaagttcagtactt

SEQ ID NO: 8573096 - DNA, 22 bp, Homo sapiens
ttcaggagaattccaagaagta

SEQ ID NO: 8573097 - DNA, 22 bp, Homo sapiens
ttcaggagaattccaagaagta

SEQ ID NO: 8573098 - DNA, 22 bp, Homo sapiens
ttcaggagctagggatgtgaaa

SEQ ID NO: 8573099 - DNA, 22 bp, Homo sapiens
ttcaggagctggctgcgaagga

SEQ ID NO: 8573100 - DNA, 22 bp, Homo sapiens
ttcaggagctggctgcgaagga

SEQ ID NO: 8573101 - DNA, 22 bp, Homo sapiens
ttcaggaggtgagcaagaaggg

SEQ ID NO: 8573102 - DNA, 22 bp, Homo sapiens
ttcaggaggtgagcaagaaggg

SEQ ID NO: 8573103 - DNA, 22 bp, Homo sapiens
ttcagggtctagagtatctacc

SEQ ID NO: 8573104 - DNA, 20 bp, Homo sapiens
ttcagggctttggggacacc

SEQ ID NO: 8573105 - DNA, 18 bp, Homo sapiens
ttcaggtcagaaagatgg

SEQ ID NO: 8573106 - DNA, 21 bp, Homo sapiens
ttcagggtttcacaatactaa

SEQ ID NO: 8573107 - DNA, 22 bp, Homo sapiens
ttcagtaaaacactgcaatgtc

SEQ ID NO: 8573108 - DNA, 22 bp, Homo sapiens
ttcaggtttttaagttctgcct

SEQ ID NO: 8573109 - DNA, 22 bp, Homo sapiens
ttcagtctcctcattttacaaa

SEQ ID NO: 8573110 - DNA, 22 bp, Homo sapiens
ttcagtctcctcattttacaaa

SEQ ID NO: 8573111 - DNA, 22 bp, Homo sapiens
ttcagtctcaatttaagtttaa

SEQ ID NO: 8573112 - DNA, 22 bp, Homo sapiens
ttcagtcctcacaacctcacta

SEQ ID NO: 8573113 - DNA, 22 bp, Homo sapiens
ttcagtatttcatgactttctt

SEQ ID NO: 8573114 - DNA, 22 bp, Homo sapiens
ttcagtattcaaatatgtctta

SEQ ID NO: 8573115 - DNA, 22 bp, Homo sapiens
ttcagtatattactcttgtcaa

SEQ ID NO: 8573116 - DNA, 22 bp, Homo sapiens
ttcagtatgattcctccagtag

SEQ ID NO: 8573117 - DNA, 21 bp, Homo sapiens
ttcagtatgcgtcatgctgtt

SEQ ID NO: 8573118 - DNA, 22 bp, Homo sapiens
ttcagtatgacagacgcattgg

SEQ ID NO: 8573119 - DNA, 22 bp, Homo sapiens
ttcagtatgattcctccagtag

SEQ ID NO: 8573120 - DNA, 22 bp, Homo sapiens
ttcagtatgctgaatgattttt

SEQ ID NO: 8573121 - DNA, 19 bp, Homo sapiens
ttcacattggaagaagtag

SEQ ID NO: 8573122 - DNA, 19 bp, Homo sapiens
ttcacattggaagaagtag

SEQ ID NO: 8573123 - DNA, 22 bp, Homo sapiens
ttcaggactaggggcttcaagg

SEQ ID NO: 8573124 - DNA, 22 bp, Homo sapiens
ttcacattgaaggtgctttctt

SEQ ID NO: 8573125 - DNA, 22 bp, Homo sapiens
ttcacattgaaggtgctttctt

SEQ ID NO: 8573126 - DNA, 22 bp, Homo sapiens
ttcacattccgcggctattttc

SEQ ID NO: 8573127 - DNA, 22 bp, Homo sapiens
ttcacattccgcggctattttc

SEQ ID NO: 8573128 - DNA, 22 bp, Homo sapiens
ttcacattctcacaagaggaaa

SEQ ID NO: 8573129 - DNA, 22 bp, Homo sapiens
ttcacattataatcagttctgc

SEQ ID NO: 8573130 - DNA, 22 bp, Homo sapiens
ttcacattataatcagttctgc

SEQ ID NO: 8573131 - DNA, 22 bp, Homo sapiens
ttcacattataatcagttctgc

SEQ ID NO: 8573132 - DNA, 22 bp, Homo sapiens
ttcacattataatcagttctgc

SEQ ID NO: 8573133 - DNA, 22 bp, Homo sapiens
ttcacattagtggttctatata

SEQ ID NO: 8573134 - DNA, 22 bp, Homo sapiens
ttcacattagtggttctatata

SEQ ID NO: 8573135 - DNA, 22 bp, Homo sapiens
ttcacattcagaaaaagcccgt

SEQ ID NO: 8573136 - DNA, 22 bp, Homo sapiens
ttcacattcagaaaaagcccgt

SEQ ID NO: 8573137 - DNA, 22 bp, Homo sapiens
ttcacattataatcagttctgc

SEQ ID NO: 8573138 - DNA, 22 bp, Homo sapiens
ttcacattatcaggattgtttc

SEQ ID NO: 8573139 - DNA, 22 bp, Homo sapiens
ttcacattatcaggattgtttc

SEQ ID NO: 8573140 - DNA, 21 bp, Homo sapiens
ttcacagtggataactttctg

SEQ ID NO: 8573141 - DNA, 22 bp, Homo sapiens
ttcacagtggccctctctgagt

SEQ ID NO: 8573142 - DNA, 22 bp, Homo sapiens
ttcacagtggccctctctgagt

SEQ ID NO: 8573143 - DNA, 22 bp, Homo sapiens
ttcacagtggccctctctgagt

SEQ ID NO: 8573144 - DNA, 22 bp, Homo sapiens
ttcacagtggctaagttctgca

SEQ ID NO: 8573145 - DNA, 22 bp, Homo sapiens
ttcacattagtggttctatata

SEQ ID NO: 8573146 - DNA, 22 bp, Homo sapiens
ttcacattagtggttctatata

SEQ ID NO: 8573147 - DNA, 22 bp, Homo sapiens
ttcacattagccaagagatgga

SEQ ID NO: 8573148 - DNA, 22 bp, Homo sapiens
ttcacattacaaggccatattt

SEQ ID NO: 8573149 - DNA, 22 bp, Homo sapiens
ttccaatttgtggtgagttaat

SEQ ID NO: 8573150 - DNA, 22 bp, Homo sapiens
ttccaattgttctttggaatct

SEQ ID NO: 8573151 - DNA, 18 bp, Homo sapiens
ttcatgttggcttaggga

SEQ ID NO: 8573152 - DNA, 22 bp, Homo sapiens
ttcatgtgatcacagattgtaa

SEQ ID NO: 8573153 - DNA, 22 bp, Homo sapiens
ttcatgtgtatggaacattttt

SEQ ID NO: 8573154 - DNA, 22 bp, Homo sapiens
ttcatgtgtatggaacattttt

SEQ ID NO: 8573155 - DNA, 23 bp, Homo sapiens
ttcatgtggacctagaggcctgt

SEQ ID NO: 8573156 - DNA, 22 bp, Homo sapiens
ttcatgtaccgtgtaccaggca

SEQ ID NO: 8573157 - DNA, 22 bp, Homo sapiens
ttcatgtaggctgcaatgcaca

SEQ ID NO: 8573158 - DNA, 22 bp, Homo sapiens
ttcatgtatttatcatgtaaat

SEQ ID NO: 8573159 - DNA, 22 bp, Homo sapiens
ttcatgtctgccttttcaagtg

SEQ ID NO: 8573160 - DNA, 22 bp, Homo sapiens
ttcatgtgaatatatttgtctt

SEQ ID NO: 8573161 - DNA, 20 bp, Homo sapiens
ttcatgggagcaaagaggcc

SEQ ID NO: 8573162 - DNA, 20 bp, Homo sapiens
ttcatgggagcaaagaggcc

SEQ ID NO: 8573163 - DNA, 20 bp, Homo sapiens
ttcatgggagcaaagaggcc

SEQ ID NO: 8573164 - DNA, 20 bp, Homo sapiens
ttcatgggagcaaagaggcc

SEQ ID NO: 8573165 - DNA, 20 bp, Homo sapiens
ttcatggtgtatttctttct

SEQ ID NO: 8573166 - DNA, 22 bp, Homo sapiens
ttcatgtaattccataaggtaa

SEQ ID NO: 8573167 - DNA, 20 bp, Homo sapiens
ttcatgctggaggggctggc

SEQ ID NO: 8573168 - DNA, 22 bp, Homo sapiens
ttcatgccagccctgtgtggta

SEQ ID NO: 8573169 - DNA, 22 bp, Homo sapiens
ttcatggagttgagaaggctaa

SEQ ID NO: 8573170 - DNA, 22 bp, Homo sapiens
ttcatggatcatgccttttgtg

SEQ ID NO: 8573171 - DNA, 22 bp, Homo sapiens
ttcatggatgttggtagaaaac

SEQ ID NO: 8573172 - DNA, 22 bp, Homo sapiens
ttcatggcaggagtcagaagct

SEQ ID NO: 8573173 - DNA, 22 bp, Homo sapiens
ttcatggatcatgccttttgtg

SEQ ID NO: 8573174 - DNA, 22 bp, Homo sapiens
ttcatcattgccagtctttaaa

SEQ ID NO: 8573175 - DNA, 22 bp, Homo sapiens
ttcatcattacagtcatgttat

SEQ ID NO: 8573176 - DNA, 22 bp, Homo sapiens
ttcatcatgatgttcccctcta

SEQ ID NO: 8573177 - DNA, 22 bp, Homo sapiens
ttcatgatagtattttttgtga

SEQ ID NO: 8573178 - DNA, 22 bp, Homo sapiens
ttcatgcactatttcttctagc

SEQ ID NO: 8573179 - DNA, 22 bp, Homo sapiens
ttcagtgcagacgccgaagccc

SEQ ID NO: 8573180 - DNA, 22 bp, Homo sapiens
ttcagtgcacagtactgagact

SEQ ID NO: 8573181 - DNA, 22 bp, Homo sapiens
ttcagtgcttacaggtttcttt

SEQ ID NO: 8573182 - DNA, 22 bp, Homo sapiens
ttcagtgctaaaaagtctcaag

SEQ ID NO: 8573183 - DNA, 22 bp, Homo sapiens
ttcagtgcctgtccacagcttc

SEQ ID NO: 8573184 - DNA, 22 bp, Homo sapiens
ttcagtgccgtgctgggtcgct

SEQ ID NO: 8573185 - DNA, 22 bp, Homo sapiens
ttcaactgggcggatctgagaa

SEQ ID NO: 8573186 - DNA, 22 bp, Homo sapiens
ttcaactttggagatttaataa

SEQ ID NO: 8573187 - DNA, 22 bp, Homo sapiens
ttcaactttggagatttaataa

SEQ ID NO: 8573188 - DNA, 22 bp, Homo sapiens
ttcaacaattaagtatcagcct

SEQ ID NO: 8573189 - DNA, 22 bp, Homo sapiens
ttcaacaatgcacttgagtata

SEQ ID NO: 8573190 - DNA, 22 bp, Homo sapiens
ttcaacacaggaacatgatata

SEQ ID NO: 8573191 - DNA, 22 bp, Homo sapiens
ttcaacacaggaacatgatata

SEQ ID NO: 8573192 - DNA, 22 bp, Homo sapiens
ttcaacacaggaacatgatata

SEQ ID NO: 8573193 - DNA, 22 bp, Homo sapiens
ttcaacagacccttctttcttt

SEQ ID NO: 8573194 - DNA, 22 bp, Homo sapiens
ttcaacagcttccaaagtgtgt

SEQ ID NO: 8573195 - DNA, 22 bp, Homo sapiens
ttcaacaggaaagcactttaca

SEQ ID NO: 8573196 - DNA, 22 bp, Homo sapiens
ttcaacatcttggagctggaac

SEQ ID NO: 8573197 - DNA, 22 bp, Homo sapiens
ttcaacatgctttatttctaaa

SEQ ID NO: 8573198 - DNA, 22 bp, Homo sapiens
ttcaacaagtcttttttcactg

SEQ ID NO: 8573199 - DNA, 22 bp, Homo sapiens
ttcaacaaaatatatttttcca

SEQ ID NO: 8573200 - DNA, 22 bp, Homo sapiens
ttcaaagtaccgtacttaatgg

SEQ ID NO: 8573201 - DNA, 17 bp, Homo sapiens
ttcaaagcttatcaagg

SEQ ID NO: 8573202 - DNA, 22 bp, Homo sapiens
ttcaaaggaaaggcagtgtcaa

SEQ ID NO: 8573203 - DNA, 22 bp, Homo sapiens
ttcaaaggcaggatagcagctg

SEQ ID NO: 8573204 - DNA, 22 bp, Homo sapiens
ttagagttaggatttgtcttta

SEQ ID NO: 8573205 - DNA, 20 bp, Homo sapiens
ttagagttagctgttatgca

SEQ ID NO: 8573206 - DNA, 22 bp, Homo sapiens
ttagaggtgtcaggagcacagg

SEQ ID NO: 8573207 - DNA, 22 bp, Homo sapiens
ttagagtgtagcaggaagaggc

SEQ ID NO: 8573208 - DNA, 22 bp, Homo sapiens
ttagagtcaagctgcatgttct

SEQ ID NO: 8573209 - DNA, 22 bp, Homo sapiens
ttagagtagagccatttctgtt

SEQ ID NO: 8573210 - DNA, 22 bp, Homo sapiens
ttagagtcaaaatggcatgtta

SEQ ID NO: 8573211 - DNA, 22 bp, Homo sapiens
ttagataaaagtgttcaataaa

SEQ ID NO: 8573212 - DNA, 23 bp, Homo sapiens
ttcaaagcttaagctctttccac

SEQ ID NO: 8573213 - DNA, 22 bp, Homo sapiens
ttagataaattaagactttaca

SEQ ID NO: 8573214 - DNA, 22 bp, Homo sapiens
ttcacagtgagctatgtcttgt

SEQ ID NO: 8573215 - DNA, 22 bp, Homo sapiens
ttcacagtgctgcacctggctt

SEQ ID NO: 8573216 - DNA, 22 bp, Homo sapiens
ttcacagtgagctatgtcttgt

SEQ ID NO: 8573217 - DNA, 22 bp, Homo sapiens
ttcacagtataggtttccagcg

SEQ ID NO: 8573218 - DNA, 22 bp, Homo sapiens
ttcacagtcacccttctccatg

SEQ ID NO: 8573219 - DNA, 22 bp, Homo sapiens
ttcacagtcacccttctccatg

SEQ ID NO: 8573220 - DNA, 22 bp, Homo sapiens
ttcacaggtgagcattaggccg

SEQ ID NO: 8573221 - DNA, 22 bp, Homo sapiens
ttcacaaagctggagcatttcc

SEQ ID NO: 8573222 - DNA, 22 bp, Homo sapiens
ttcacaaagctggagcatttcc

SEQ ID NO: 8573223 - DNA, 22 bp, Homo sapiens
ttcacaaagctggagcatttcc

SEQ ID NO: 8573224 - DNA, 22 bp, Homo sapiens
ttcacaaagctggttccttctg

SEQ ID NO: 8573225 - DNA, 22 bp, Homo sapiens
ttcacaaacttcatgatggcac

SEQ ID NO: 8573226 - DNA, 22 bp, Homo sapiens
ttcacaaagctggagcatttcc

SEQ ID NO: 8573227 - DNA, 22 bp, Homo sapiens
ttcacaagtcattagctgcata

SEQ ID NO: 8573228 - DNA, 22 bp, Homo sapiens
ttcacaactgccatagccagtg

SEQ ID NO: 8573229 - DNA, 18 bp, Homo sapiens
ttcacaagggcttggttt

SEQ ID NO: 8573230 - DNA, 22 bp, Homo sapiens
ttcacaagtcattagctgcata

SEQ ID NO: 8573231 - DNA, 19 bp, Homo sapiens
ttcacaagtgatgtctctc

SEQ ID NO: 8573232 - DNA, 22 bp, Homo sapiens
ttcacaataatgtccatcctct

SEQ ID NO: 8573233 - DNA, 22 bp, Homo sapiens
ttcacaataggagcatgcaaat

SEQ ID NO: 8573234 - DNA, 22 bp, Homo sapiens
ttcacaataatgtccatcctct

SEQ ID NO: 8573235 - DNA, 22 bp, Homo sapiens
ttcaattcaattctaaatatat

SEQ ID NO: 8573236 - DNA, 22 bp, Homo sapiens
ttcaattcaattctaaatatat

SEQ ID NO: 8573237 - DNA, 22 bp, Homo sapiens
ttcaattctaaactaatattct

SEQ ID NO: 8573238 - DNA, 22 bp, Homo sapiens
ttcaattctaaactaatattct

SEQ ID NO: 8573239 - DNA, 22 bp, Homo sapiens
ttcaattctaaactaatattct

SEQ ID NO: 8573240 - DNA, 22 bp, Homo sapiens
ttcaattctaaactaatattct

SEQ ID NO: 8573241 - DNA, 22 bp, Homo sapiens
ttcaattctgctctgatcttag

SEQ ID NO: 8573242 - DNA, 22 bp, Homo sapiens
ttcaattctgctctgatcttag

SEQ ID NO: 8573243 - DNA, 22 bp, Homo sapiens
ttcaatgtctatgtacatttta

SEQ ID NO: 8573244 - DNA, 22 bp, Homo sapiens
ttcaagaaagagtggctattcc

SEQ ID NO: 8573245 - DNA, 22 bp, Homo sapiens
ttcaagaaagagtggctattcc

SEQ ID NO: 8573246 - DNA, 22 bp, Homo sapiens
ttcacaaaaatgctgaacagtt

SEQ ID NO: 8573247 - DNA, 22 bp, Homo sapiens
ttcaattttgcagaggaatgca

SEQ ID NO: 8573248 - DNA, 22 bp, Homo sapiens
ttcaatttcataatatctagct

SEQ ID NO: 8573249 - DNA, 22 bp, Homo sapiens
ttcacaaaacactattttctgg

SEQ ID NO: 8573250 - DNA, 22 bp, Homo sapiens
ttcacaaaaatgctgaacagtt

SEQ ID NO: 8573251 - DNA, 22 bp, Homo sapiens
ttcacaaaaatgctgaacagtt

SEQ ID NO: 8573252 - DNA, 22 bp, Homo sapiens
ttcacaaaacactattttctgg

SEQ ID NO: 8573253 - DNA, 22 bp, Homo sapiens
ttcacaaaatggtttgttgatg

SEQ ID NO: 8573254 - DNA, 22 bp, Homo sapiens
ttcacaaacaccagaatggcta

SEQ ID NO: 8573255 - DNA, 22 bp, Homo sapiens
ttcacaaacaccagaatggcta

SEQ ID NO: 8573256 - DNA, 22 bp, Homo sapiens
ttcacaaaatggtttgttgatg

SEQ ID NO: 8573257 - DNA, 22 bp, Homo sapiens
ttgagcaaaggagtaaaatgca

SEQ ID NO: 8573258 - DNA, 22 bp, Homo sapiens
ttgagcaaatcagattgtaatt

SEQ ID NO: 8573259 - DNA, 22 bp, Homo sapiens
ttgagcaaatcagaagtttaga

SEQ ID NO: 8573260 - DNA, 22 bp, Homo sapiens
ttgagcaatgctgcaaagagat

SEQ ID NO: 8573261 - DNA, 20 bp, Homo sapiens
ttgagcaatcagtaaaggat

SEQ ID NO: 8573262 - DNA, 22 bp, Homo sapiens
ttgagcaagagtaggaactgaa

SEQ ID NO: 8573263 - DNA, 22 bp, Homo sapiens
ttgagcaattaggaaataaaga

SEQ ID NO: 8573264 - DNA, 19 bp, Homo sapiens
ttgagcagtgcttagcacc

SEQ ID NO: 8573265 - DNA, 22 bp, Homo sapiens
ttgagcaggatggctatgcaca

SEQ ID NO: 8573266 - DNA, 22 bp, Homo sapiens
ttgagcaggatggctatgcaca

SEQ ID NO: 8573267 - DNA, 22 bp, Homo sapiens
ttgagcccaggaggcctgggtg

SEQ ID NO: 8573268 - DNA, 22 bp, Homo sapiens
ttgagcccaggaggcctgggtg

SEQ ID NO: 8573269 - DNA, 22 bp, Homo sapiens
ttgagcatcaattaagtgagtt

SEQ ID NO: 8573270 - DNA, 22 bp, Homo sapiens
ttgagcatcttatagaaagagc

SEQ ID NO: 8573271 - DNA, 22 bp, Homo sapiens
ttgagcccaggaggcctgggtg

SEQ ID NO: 8573272 - DNA, 22 bp, Homo sapiens
ttgagctcagtgactcgacttt

SEQ ID NO: 8573273 - DNA, 23 bp, Homo sapiens
ttgagctcagtagctctgctggt

SEQ ID NO: 8573274 - DNA, 22 bp, Homo sapiens
ttgagcatttgttttgaaagag

SEQ ID NO: 8573275 - DNA, 22 bp, Homo sapiens
ttgaatgaataaaagagtaagg

SEQ ID NO: 8573276 - DNA, 22 bp, Homo sapiens
ttgaaggacatcctatttctag

SEQ ID NO: 8573277 - DNA, 22 bp, Homo sapiens
ttgaagctgccgtttttctcca

SEQ ID NO: 8573278 - DNA, 22 bp, Homo sapiens
ttgaatgaatagttgctagaag

SEQ ID NO: 8573279 - DNA, 22 bp, Homo sapiens
ttgaatgaatggtccatataga

SEQ ID NO: 8573280 - DNA, 22 bp, Homo sapiens
ttgaatgaatggtccatataga

SEQ ID NO: 8573281 - DNA, 20 bp, Homo sapiens
ttgaatgaatgtctggctca

SEQ ID NO: 8573282 - DNA, 22 bp, Homo sapiens
ttgaatgaatttgagcagagat

SEQ ID NO: 8573283 - DNA, 22 bp, Homo sapiens
ttgaatgaattctacttccaga

SEQ ID NO: 8573284 - DNA, 22 bp, Homo sapiens
ttgaatgagaagttattgccat

SEQ ID NO: 8573285 - DNA, 22 bp, Homo sapiens
ttgaatgaccatgatgcaaggg

SEQ ID NO: 8573286 - DNA, 16 bp, Homo sapiens
ttgaatgactgtgtgc

SEQ ID NO: 8573287 - DNA, 22 bp, Homo sapiens
ttgaatgaatttgagcagagat

SEQ ID NO: 8573288 - DNA, 22 bp, Homo sapiens
ttgaatgagtgttttactcatg

SEQ ID NO: 8573289 - DNA, 22 bp, Homo sapiens
ttgaatgaggaagagcactggc

SEQ ID NO: 8573290 - DNA, 22 bp, Homo sapiens
ttgaatgaggaagagcactggc

SEQ ID NO: 8573291 - DNA, 22 bp, Homo sapiens
ttgaatgatcctatctagcaca

SEQ ID NO: 8573292 - DNA, 22 bp, Homo sapiens
ttgaatgatcctatctagcaca

SEQ ID NO: 8573293 - DNA, 22 bp, Homo sapiens
ttgaatgattaaagtcatctga

SEQ ID NO: 8573294 - DNA, 22 bp, Homo sapiens
ttgaatgcatggttcactctgt

SEQ ID NO: 8573295 - DNA, 22 bp, Homo sapiens
ttgaatgcatctttgagctcct

SEQ ID NO: 8573296 - DNA, 22 bp, Homo sapiens
ttgagataggtggaatctcttt

SEQ ID NO: 8573297 - DNA, 22 bp, Homo sapiens
ttgaatgtaggtcttggtgagc

SEQ ID NO: 8573298 - DNA, 19 bp, Homo sapiens
ttctttccacatcttctct

SEQ ID NO: 8573299 - DNA, 22 bp, Homo sapiens
ttctttcccagtagatgtgaaa

SEQ ID NO: 8573300 - DNA, 22 bp, Homo sapiens
ttctttcccagaagatatgttt

SEQ ID NO: 8573301 - DNA, 22 bp, Homo sapiens
ttctttcccagaagatatgttt

SEQ ID NO: 8573302 - DNA, 22 bp, Homo sapiens
ttctttcagaacacaagtgatt

SEQ ID NO: 8573303 - DNA, 20 bp, Homo sapiens
ttctttcatctacacgttgt

SEQ ID NO: 8573304 - DNA, 20 bp, Homo sapiens
ttctttcatctacacgttgt

SEQ ID NO: 8573305 - DNA, 22 bp, Homo sapiens
ttctttccacagaggggatgat

SEQ ID NO: 8573306 - DNA, 22 bp, Homo sapiens
ttctttccaaccagatattggt

SEQ ID NO: 8573307 - DNA, 22 bp, Homo sapiens
ttctttattgagacttcattgt

SEQ ID NO: 8573308 - DNA, 23 bp, Homo sapiens
ttctttcaagaagttcacagtgc

SEQ ID NO: 8573309 - DNA, 23 bp, Homo sapiens
ttctttcaagaagttcacagtgc

SEQ ID NO: 8573310 - DNA, 23 bp, Homo sapiens
ttctttcaagaagttcacagtgc

SEQ ID NO: 8573311 - DNA, 23 bp, Homo sapiens
ttctttcaagaagttcacagtgc

SEQ ID NO: 8573312 - DNA, 22 bp, Homo sapiens
ttctttcaatagctggcatatg

SEQ ID NO: 8573313 - DNA, 22 bp, Homo sapiens
ttctttcaatagctggcatatg

SEQ ID NO: 8573314 - DNA, 22 bp, Homo sapiens
ttctttcaatagctggcatatg

SEQ ID NO: 8573315 - DNA, 22 bp, Homo sapiens
ttctttcagaacacaagtgatt

SEQ ID NO: 8573316 - DNA, 22 bp, Homo sapiens
ttctttcagaacacaagtgatt

SEQ ID NO: 8573317 - DNA, 22 bp, Homo sapiens
ttctttcagaacacaagtgatt

SEQ ID NO: 8573318 - DNA, 22 bp, Homo sapiens
ttctttcactcaagaaggatct

SEQ ID NO: 8573319 - DNA, 22 bp, Homo sapiens
ttctttcactcaagaaggatct

SEQ ID NO: 8573320 - DNA, 22 bp, Homo sapiens
ttctttcactcaagaaggatct

SEQ ID NO: 8573321 - DNA, 22 bp, Homo sapiens
ttctttatgttaatgaatctat

SEQ ID NO: 8573322 - DNA, 22 bp, Homo sapiens
ttctttatgttaatgaatctat

SEQ ID NO: 8573323 - DNA, 22 bp, Homo sapiens
ttctttatgttaatgaatctat

SEQ ID NO: 8573324 - DNA, 22 bp, Homo sapiens
ttctttattgagacttcattgt

SEQ ID NO: 8573325 - DNA, 22 bp, Homo sapiens
ttctttatgcttctgtttaggc

SEQ ID NO: 8573326 - DNA, 22 bp, Homo sapiens
ttgaagactaatttagataatg

SEQ ID NO: 8573327 - DNA, 22 bp, Homo sapiens
ttctttctcaacatgaatgttt

SEQ ID NO: 8573328 - DNA, 22 bp, Homo sapiens
ttgaagaacataatagctactt

SEQ ID NO: 8573329 - DNA, 21 bp, Homo sapiens
ttctttccccagaggactaaa

SEQ ID NO: 8573330 - DNA, 22 bp, Homo sapiens
ttctttcccttccagcagctcc

SEQ ID NO: 8573331 - DNA, 22 bp, Homo sapiens
ttctttccccatggagttcgga

SEQ ID NO: 8573332 - DNA, 22 bp, Homo sapiens
ttctttcccttccagcagctcc

SEQ ID NO: 8573333 - DNA, 22 bp, Homo sapiens
ttctttccttgcctcagtgaag

SEQ ID NO: 8573334 - DNA, 22 bp, Homo sapiens
ttctttccttgcctcagtgaag

SEQ ID NO: 8573335 - DNA, 22 bp, Homo sapiens
ttctttcctcccagcctttgga

SEQ ID NO: 8573336 - DNA, 22 bp, Homo sapiens
ttctttccttgcctcagtgaag

SEQ ID NO: 8573337 - DNA, 22 bp, Homo sapiens
ttgaagagtctagattggttat

SEQ ID NO: 8573338 - DNA, 22 bp, Homo sapiens
ttgaagattattctattaaaag

SEQ ID NO: 8573339 - DNA, 22 bp, Homo sapiens
ttgaagatgctgtctcttccag

SEQ ID NO: 8573340 - DNA, 22 bp, Homo sapiens
ttgaagatctttgcattgcagg

SEQ ID NO: 8573341 - DNA, 22 bp, Homo sapiens
ttgatgtaaagtgattcatggg

SEQ ID NO: 8573342 - DNA, 22 bp, Homo sapiens
ttgatgagaccattgccgcgtc

SEQ ID NO: 8573343 - DNA, 22 bp, Homo sapiens
ttgatgagttatccatttgact

SEQ ID NO: 8573344 - DNA, 22 bp, Homo sapiens
ttgatctcattgttctcctcag

SEQ ID NO: 8573345 - DNA, 22 bp, Homo sapiens
ttgatctgcctcattcttgttc

SEQ ID NO: 8573346 - DNA, 22 bp, Homo sapiens
ttgatcttacagtgttcttcca

SEQ ID NO: 8573347 - DNA, 22 bp, Homo sapiens
ttgatcttcatcgaaatattgt

SEQ ID NO: 8573348 - DNA, 22 bp, Homo sapiens
ttgatctttataatagttttga

SEQ ID NO: 8573349 - DNA, 22 bp, Homo sapiens
ttgatcttggactttccagcct

SEQ ID NO: 8573350 - DNA, 22 bp, Homo sapiens
ttgagtctctgccaaaacacaa

SEQ ID NO: 8573351 - DNA, 22 bp, Homo sapiens
ttgaggccccatggatgagaac

SEQ ID NO: 8573352 - DNA, 22 bp, Homo sapiens
ttgaggccaaaaagtcctatga

SEQ ID NO: 8573353 - DNA, 22 bp, Homo sapiens
ttgagtctgtgccctatgctgt

SEQ ID NO: 8573354 - DNA, 17 bp, Homo sapiens
ttgagtctggggtctac

SEQ ID NO: 8573355 - DNA, 22 bp, Homo sapiens
ttgagtgtactttagtcatctg

SEQ ID NO: 8573356 - DNA, 22 bp, Homo sapiens
ttgagtgtaaggaatgtggggc

SEQ ID NO: 8573357 - DNA, 22 bp, Homo sapiens
ttgagtgtaaggaatgtggggc

SEQ ID NO: 8573358 - DNA, 22 bp, Homo sapiens
ttgagttcaggggttgattgga

SEQ ID NO: 8573359 - DNA, 22 bp, Homo sapiens
ttgagttccaggatggttgtta

SEQ ID NO: 8573360 - DNA, 22 bp, Homo sapiens
ttgatcatctaagagtaatagt

SEQ ID NO: 8573361 - DNA, 22 bp, Homo sapiens
ttgatctctgttgctgtctttg

SEQ ID NO: 8573362 - DNA, 22 bp, Homo sapiens
ttgattcacaattaccaagact

SEQ ID NO: 8573363 - DNA, 20 bp, Homo sapiens
ttgattcaagggctgatgga

SEQ ID NO: 8573364 - DNA, 22 bp, Homo sapiens
ttgattcagaaaaagatggaga

SEQ ID NO: 8573365 - DNA, 22 bp, Homo sapiens
ttgattcagagaagattggccc

SEQ ID NO: 8573366 - DNA, 22 bp, Homo sapiens
ttgattcagagaagattggccc

SEQ ID NO: 8573367 - DNA, 22 bp, Homo sapiens
ttgattcagtaaagctaaattt

SEQ ID NO: 8573368 - DNA, 22 bp, Homo sapiens
ttgattcagtaaagctaaattt

SEQ ID NO: 8573369 - DNA, 22 bp, Homo sapiens
ttgattcagtaaagctaaattt

SEQ ID NO: 8573370 - DNA, 22 bp, Homo sapiens
ttgattcatatagatatgcgtg

SEQ ID NO: 8573371 - DNA, 18 bp, Homo sapiens
ttgattcatattaaccat

SEQ ID NO: 8573372 - DNA, 22 bp, Homo sapiens
ttgattctacttaaaacatatg

SEQ ID NO: 8573373 - DNA, 22 bp, Homo sapiens
ttgattctaaaataggaggaaa

SEQ ID NO: 8573374 - DNA, 22 bp, Homo sapiens
ttgattctagaatcttccctct

SEQ ID NO: 8573375 - DNA, 22 bp, Homo sapiens
ttgattcatcttctaataccca

SEQ ID NO: 8573376 - DNA, 22 bp, Homo sapiens
ttgattcatcttctaataccca

SEQ ID NO: 8573377 - DNA, 18 bp, Homo sapiens
ttgattcatattaaccat

SEQ ID NO: 8573378 - DNA, 22 bp, Homo sapiens
ttgattcatggacaggccaggt

SEQ ID NO: 8573379 - DNA, 22 bp, Homo sapiens
ttgattcatttattgagtgcct

SEQ ID NO: 8573380 - DNA, 22 bp, Homo sapiens
ttgattctgatcctttgctagc

SEQ ID NO: 8573381 - DNA, 22 bp, Homo sapiens
ttgattctacttaaaacatatg

SEQ ID NO: 8573382 - DNA, 22 bp, Homo sapiens
ttgattctgatcctttgctagc

SEQ ID NO: 8573383 - DNA, 22 bp, Homo sapiens
ttgattctgatcctgtctggag

SEQ ID NO: 8573384 - DNA, 23 bp, Homo sapiens
ttgattctccagtatgggctgag

SEQ ID NO: 8573385 - DNA, 22 bp, Homo sapiens
ttgattctgatcctgtctggag

SEQ ID NO: 8573386 - DNA, 22 bp, Homo sapiens
ttgattctatgaggtaagctat

SEQ ID NO: 8573387 - DNA, 22 bp, Homo sapiens
ttgattctatggctccgggagt

SEQ ID NO: 8573388 - DNA, 22 bp, Homo sapiens
ttgattctatgttgttgtctca

SEQ ID NO: 8573389 - DNA, 22 bp, Homo sapiens
ttgattctatgttgttgtctca

SEQ ID NO: 8573390 - DNA, 22 bp, Homo sapiens
ttgattctgatcctgtctggag

SEQ ID NO: 8573391 - DNA, 23 bp, Homo sapiens
ttgattctccagtatgggctgag

SEQ ID NO: 8573392 - DNA, 22 bp, Homo sapiens
ttgattctgatgaaagtccatt

SEQ ID NO: 8573393 - DNA, 22 bp, Homo sapiens
ttgattctgggctcatttcttt

SEQ ID NO: 8573394 - DNA, 22 bp, Homo sapiens
ttgattctggtgactgatggaa

SEQ ID NO: 8573395 - DNA, 22 bp, Homo sapiens
ttgattcttagctggtgataat

SEQ ID NO: 8573396 - DNA, 22 bp, Homo sapiens
ttgattctggtgactgatggaa

SEQ ID NO: 8573397 - DNA, 22 bp, Homo sapiens
ttgattctgctgatctcggacg

SEQ ID NO: 8573398 - DNA, 22 bp, Homo sapiens
ttgattcttctgaatttgcaga

SEQ ID NO: 8573399 - DNA, 22 bp, Homo sapiens
ttgatgtacagaattgttcaca

SEQ ID NO: 8573400 - DNA, 22 bp, Homo sapiens
ttgatgtacagaattgttcaca

SEQ ID NO: 8573401 - DNA, 22 bp, Homo sapiens
ttgatgttgctcttaacagtat

SEQ ID NO: 8573402 - DNA, 22 bp, Homo sapiens
ttgattcaaaggggacaagtgg

SEQ ID NO: 8573403 - DNA, 22 bp, Homo sapiens
ttgattcaaaacaggaggtagg

SEQ ID NO: 8573404 - DNA, 20 bp, Homo sapiens
ttgattcaagggctgatgga

SEQ ID NO: 8573405 - DNA, 20 bp, Homo sapiens
ttgattcaagggctgatgga

SEQ ID NO: 8573406 - DNA, 20 bp, Homo sapiens
ttgattcaagggctgatgga

SEQ ID NO: 8573407 - DNA, 22 bp, Homo sapiens
ttgattcaaccacttaataatc

SEQ ID NO: 8573408 - DNA, 22 bp, Homo sapiens
ttgattcaaccacttaataatc

SEQ ID NO: 8573409 - DNA, 22 bp, Homo sapiens
ttgattactatgtgttgaaagc

SEQ ID NO: 8573410 - DNA, 22 bp, Homo sapiens
ttgattacaaagtagatacatt

SEQ ID NO: 8573411 - DNA, 22 bp, Homo sapiens
ttgattaaacaggcatattcaa

SEQ ID NO: 8573412 - DNA, 22 bp, Homo sapiens
ttgcaaatgtggttagggcttt

SEQ ID NO: 8573413 - DNA, 22 bp, Homo sapiens
ttgcaaatgtgagtttagactg

SEQ ID NO: 8573414 - DNA, 22 bp, Homo sapiens
ttgcaaatgttatactgccagt

SEQ ID NO: 8573415 - DNA, 22 bp, Homo sapiens
ttgcaaattatataagggatgc

SEQ ID NO: 8573416 - DNA, 22 bp, Homo sapiens
ttgcaaattaaagaggatagca

SEQ ID NO: 8573417 - DNA, 22 bp, Homo sapiens
ttgcaaatgaccattgccacat

SEQ ID NO: 8573418 - DNA, 22 bp, Homo sapiens
ttgcaaatgtgaataattacac

SEQ ID NO: 8573419 - DNA, 20 bp, Homo sapiens
ttgcaaatatctattgattg

SEQ ID NO: 8573420 - DNA, 22 bp, Homo sapiens
ttgcaaataatagcctgaaact

SEQ ID NO: 8573421 - DNA, 22 bp, Homo sapiens
ttgcaaataaacaagtatacat

SEQ ID NO: 8573422 - DNA, 22 bp, Homo sapiens
ttgcaaatcagaagtatagatt

SEQ ID NO: 8573423 - DNA, 22 bp, Homo sapiens
ttgcaaatctttgccagaaggc

SEQ ID NO: 8573424 - DNA, 22 bp, Homo sapiens
ttgcaaatctttgccagaaggc

SEQ ID NO: 8573425 - DNA, 22 bp, Homo sapiens
ttgcaaatattgtttacctttc

SEQ ID NO: 8573426 - DNA, 22 bp, Homo sapiens
ttgattttgcctgatctgagag

SEQ ID NO: 8573427 - DNA, 22 bp, Homo sapiens
ttgatttttccagcttctagag

SEQ ID NO: 8573428 - DNA, 22 bp, Homo sapiens
ttgattttcaattcattgacaa

SEQ ID NO: 8573429 - DNA, 22 bp, Homo sapiens
ttgattttcaattcattgacaa

SEQ ID NO: 8573430 - DNA, 22 bp, Homo sapiens
ttgattttaaaatagtgacact

SEQ ID NO: 8573431 - DNA, 22 bp, Homo sapiens
ttgattgaattttgaaaatcta

SEQ ID NO: 8573432 - DNA, 22 bp, Homo sapiens
ttgattctttgagaccgtgata

SEQ ID NO: 8573433 - DNA, 23 bp, Homo sapiens
ttgattctttcagggacctagat

SEQ ID NO: 8573434 - DNA, 23 bp, Homo sapiens
ttgatttagctgggattgcatgc

SEQ ID NO: 8573435 - DNA, 22 bp, Homo sapiens
ttgatttatagaatgttcaagc

SEQ ID NO: 8573436 - DNA, 22 bp, Homo sapiens
ttgatttatagaatgttcaagc

SEQ ID NO: 8573437 - DNA, 22 bp, Homo sapiens
ttgatttgattgatgaactaag

SEQ ID NO: 8573438 - DNA, 22 bp, Homo sapiens
ttgatttctattcagatgtaga

SEQ ID NO: 8573439 - DNA, 22 bp, Homo sapiens
ttgatttgcagaaggtgtagag

SEQ ID NO: 8573440 - DNA, 22 bp, Homo sapiens
ttgatttgattgtaatggctct

SEQ ID NO: 8573441 - DNA, 22 bp, Homo sapiens
ttgatttgcagaaggtgtagag

SEQ ID NO: 8573442 - DNA, 22 bp, Homo sapiens
ttgatttgggaatggtctggca

SEQ ID NO: 8573443 - DNA, 22 bp, Homo sapiens
ttgatttgtaggaatggagacc

SEQ ID NO: 8573444 - DNA, 22 bp, Homo sapiens
ttgatttgggaatggtctggca

SEQ ID NO: 8573445 - DNA, 22 bp, Homo sapiens
ttgatttgtaggaatggagacc

SEQ ID NO: 8573446 - DNA, 22 bp, Homo sapiens
ttgattttaaaatagtgacact

SEQ ID NO: 8573447 - DNA, 22 bp, Homo sapiens
ttctagttgagggagacaaata

SEQ ID NO: 8573448 - DNA, 22 bp, Homo sapiens
ttctagttttcagtccaccagg

SEQ ID NO: 8573449 - DNA, 22 bp, Homo sapiens
ttctagtgtccttggacttgct

SEQ ID NO: 8573450 - DNA, 22 bp, Homo sapiens
ttctagtgtccttggacttgct

SEQ ID NO: 8573451 - DNA, 22 bp, Homo sapiens
ttctagttaatgtagcatcttg

SEQ ID NO: 8573452 - DNA, 22 bp, Homo sapiens
ttctataagactcatatttctt

SEQ ID NO: 8573453 - DNA, 22 bp, Homo sapiens
ttctataaatgaatgtgtatat

SEQ ID NO: 8573454 - DNA, 22 bp, Homo sapiens
ttctcttttagaggctccatga

SEQ ID NO: 8573455 - DNA, 22 bp, Homo sapiens
ttctgaatcctcgaaacatagc

SEQ ID NO: 8573456 - DNA, 22 bp, Homo sapiens
ttctgaagggctaagtgtctat

SEQ ID NO: 8573457 - DNA, 22 bp, Homo sapiens
ttctcttttcaccagttgctaa

SEQ ID NO: 8573458 - DNA, 22 bp, Homo sapiens
ttctcttttcaccagttgctaa

SEQ ID NO: 8573459 - DNA, 22 bp, Homo sapiens
ttctcttttagaggctccatga

SEQ ID NO: 8573460 - DNA, 22 bp, Homo sapiens
ttctatatgacttctaggcagg

SEQ ID NO: 8573461 - DNA, 22 bp, Homo sapiens
ttctcttttagaggctccatga

SEQ ID NO: 8573462 - DNA, 22 bp, Homo sapiens
ttctgacagtaatcagtttgct

SEQ ID NO: 8573463 - DNA, 22 bp, Homo sapiens
ttctgacatatccagtctcagt

SEQ ID NO: 8573464 - DNA, 22 bp, Homo sapiens
ttctgagaaggctgtggacaca

SEQ ID NO: 8573465 - DNA, 22 bp, Homo sapiens
ttctgagaaatgggttcacata

SEQ ID NO: 8573466 - DNA, 22 bp, Homo sapiens
ttctgacaattcagtaacagca

SEQ ID NO: 8573467 - DNA, 22 bp, Homo sapiens
ttctgaatttctgtgtatctta

SEQ ID NO: 8573468 - DNA, 22 bp, Homo sapiens
ttctgacacattactacatgga

SEQ ID NO: 8573469 - DNA, 22 bp, Homo sapiens
ttctgacacattactacatgga

SEQ ID NO: 8573470 - DNA, 22 bp, Homo sapiens
ttctgaatgatagtcttgaact

SEQ ID NO: 8573471 - DNA, 22 bp, Homo sapiens
ttctgagagagcctctcatgtt

SEQ ID NO: 8573472 - DNA, 21 bp, Homo sapiens
ttctgagactcatttgaactc

SEQ ID NO: 8573473 - DNA, 22 bp, Homo sapiens
ttctgagacaattgagagtcta

SEQ ID NO: 8573474 - DNA, 20 bp, Homo sapiens
ttctgagagttcacagcccc

SEQ ID NO: 8573475 - DNA, 20 bp, Homo sapiens
ttctgagagttcacagcccc

SEQ ID NO: 8573476 - DNA, 22 bp, Homo sapiens
ttctgctcttggctttgctggt

SEQ ID NO: 8573477 - DNA, 22 bp, Homo sapiens
ttctgctgagtgggcaggtgca

SEQ ID NO: 8573478 - DNA, 22 bp, Homo sapiens
ttctgctgaagtcactgggagc

SEQ ID NO: 8573479 - DNA, 22 bp, Homo sapiens
ttctgctcagtagtaagagtgc

SEQ ID NO: 8573480 - DNA, 22 bp, Homo sapiens
ttctgctccaccacttccagca

SEQ ID NO: 8573481 - DNA, 22 bp, Homo sapiens
ttctgctccaccacttccagca

SEQ ID NO: 8573482 - DNA, 21 bp, Homo sapiens
ttctgctccagctcctctggg

SEQ ID NO: 8573483 - DNA, 22 bp, Homo sapiens
ttctgctctaatgtacaccagc

SEQ ID NO: 8573484 - DNA, 22 bp, Homo sapiens
ttctgctgcgacccaggagtta

SEQ ID NO: 8573485 - DNA, 22 bp, Homo sapiens
ttctgctggtaactatgtttca

SEQ ID NO: 8573486 - DNA, 22 bp, Homo sapiens
ttctgctgctgctgcacccaat

SEQ ID NO: 8573487 - DNA, 22 bp, Homo sapiens
ttctgctgtagttgcatctgtt

SEQ ID NO: 8573488 - DNA, 22 bp, Homo sapiens
ttctgctggtgttttgtgaggc

SEQ ID NO: 8573489 - DNA, 22 bp, Homo sapiens
ttctgctggtaactatgtttca

SEQ ID NO: 8573490 - DNA, 21 bp, Homo sapiens
ttctgctgtgccatgcctctg

SEQ ID NO: 8573491 - DNA, 21 bp, Homo sapiens
ttctgctgtgccatgcctctg

SEQ ID NO: 8573492 - DNA, 21 bp, Homo sapiens
ttctgctgttcaccaccaccc

SEQ ID NO: 8573493 - DNA, 22 bp, Homo sapiens
ttctgctatacttatgaataca

SEQ ID NO: 8573494 - DNA, 22 bp, Homo sapiens
ttctgctacctttctgtacctt

SEQ ID NO: 8573495 - DNA, 22 bp, Homo sapiens
ttctgccttcagtcctctgact

SEQ ID NO: 8573496 - DNA, 22 bp, Homo sapiens
ttctgagattgttaggcactaa

SEQ ID NO: 8573497 - DNA, 20 bp, Homo sapiens
ttctgagattaggttacaaa

SEQ ID NO: 8573498 - DNA, 22 bp, Homo sapiens
ttctgagccagagtcagttatg

SEQ ID NO: 8573499 - DNA, 21 bp, Homo sapiens
ttctgagcactcatcactgtc

SEQ ID NO: 8573500 - DNA, 22 bp, Homo sapiens
ttctgagctacatagtactggg

SEQ ID NO: 8573501 - DNA, 22 bp, Homo sapiens
ttctgagctacatagtactggg

SEQ ID NO: 8573502 - DNA, 22 bp, Homo sapiens
ttctgagcctcattcatgaggc

SEQ ID NO: 8573503 - DNA, 22 bp, Homo sapiens
ttctggaaagcatttgaggccc

SEQ ID NO: 8573504 - DNA, 22 bp, Homo sapiens
ttctggaaagatttgcgtgtaa

SEQ ID NO: 8573505 - DNA, 22 bp, Homo sapiens
ttctggaaatcagcagagggtg

SEQ ID NO: 8573506 - DNA, 22 bp, Homo sapiens
ttctggaaagaaggctaaggtc

SEQ ID NO: 8573507 - DNA, 22 bp, Homo sapiens
ttctggaaaccctcagccagtg

SEQ ID NO: 8573508 - DNA, 22 bp, Homo sapiens
ttctgcttttattgccagagtt

SEQ ID NO: 8573509 - DNA, 22 bp, Homo sapiens
ttctgcttttctctgtctgagt

SEQ ID NO: 8573510 - DNA, 22 bp, Homo sapiens
ttctgcttttattgccagagtt

SEQ ID NO: 8573511 - DNA, 22 bp, Homo sapiens
ttctgcttttagctaaactata

SEQ ID NO: 8573512 - DNA, 20 bp, Homo sapiens
ttctgcttgcaaatatcaag

SEQ ID NO: 8573513 - DNA, 22 bp, Homo sapiens
ttcttctttccaattacatggt

SEQ ID NO: 8573514 - DNA, 22 bp, Homo sapiens
ttcttctttcctataattaatt

SEQ ID NO: 8573515 - DNA, 22 bp, Homo sapiens
ttcttctttcctataattaatt

SEQ ID NO: 8573516 - DNA, 19 bp, Homo sapiens
ttcttgaacatgtttctca

SEQ ID NO: 8573517 - DNA, 19 bp, Homo sapiens
ttcttgaacatgtttctca

SEQ ID NO: 8573518 - DNA, 22 bp, Homo sapiens
ttcttgaaaatagccatgtaca

SEQ ID NO: 8573519 - DNA, 22 bp, Homo sapiens
ttcttgaatcactttagagata

SEQ ID NO: 8573520 - DNA, 22 bp, Homo sapiens
ttcttgaatcactttagagata

SEQ ID NO: 8573521 - DNA, 22 bp, Homo sapiens
ttcttgagtatctgcacagtgc

SEQ ID NO: 8573522 - DNA, 22 bp, Homo sapiens
ttcttgaatagggattgataaa

SEQ ID NO: 8573523 - DNA, 22 bp, Homo sapiens
ttcttgaaggggatataaatag

SEQ ID NO: 8573524 - DNA, 21 bp, Homo sapiens
ttcttcttggactgttttggc

SEQ ID NO: 8573525 - DNA, 22 bp, Homo sapiens
ttcttacatctataaagttggg

SEQ ID NO: 8573526 - DNA, 22 bp, Homo sapiens
ttcttacatcagtttattttgt

SEQ ID NO: 8573527 - DNA, 22 bp, Homo sapiens
ttcttctttatctcagtatcct

SEQ ID NO: 8573528 - DNA, 22 bp, Homo sapiens
ttcttacatattttcatatggt

SEQ ID NO: 8573529 - DNA, 22 bp, Homo sapiens
ttcttacatattttcatatggt

SEQ ID NO: 8573530 - DNA, 22 bp, Homo sapiens
ttcttacatattttcatatggt

SEQ ID NO: 8573531 - DNA, 22 bp, Homo sapiens
ttcttacatattttcatatggt

SEQ ID NO: 8573532 - DNA, 22 bp, Homo sapiens
ttcttacagccctattactaaa

SEQ ID NO: 8573533 - DNA, 22 bp, Homo sapiens
ttcttacagccctattactaaa

SEQ ID NO: 8573534 - DNA, 22 bp, Homo sapiens
ttcttacagatttggtgaatga

SEQ ID NO: 8573535 - DNA, 22 bp, Homo sapiens
ttcttacagagtttacagagcc

SEQ ID NO: 8573536 - DNA, 22 bp, Homo sapiens
ttcttacagagtttacagagcc

SEQ ID NO: 8573537 - DNA, 22 bp, Homo sapiens
ttctttaaaatagtgagaaaga

SEQ ID NO: 8573538 - DNA, 22 bp, Homo sapiens
ttcttgctcaatgtctgtttaa

SEQ ID NO: 8573539 - DNA, 22 bp, Homo sapiens
ttcttggaaactgattccttgt

SEQ ID NO: 8573540 - DNA, 22 bp, Homo sapiens
ttctttaaaatagtgagaaaga

SEQ ID NO: 8573541 - DNA, 22 bp, Homo sapiens
ttcttgatttcatgcagttaag

SEQ ID NO: 8573542 - DNA, 22 bp, Homo sapiens
ttcttgattagtctcatgccaa

SEQ ID NO: 8573543 - DNA, 22 bp, Homo sapiens
ttctttacagtgggttttgaat

SEQ ID NO: 8573544 - DNA, 22 bp, Homo sapiens
ttctttaccactactcttccaa

SEQ ID NO: 8573545 - DNA, 22 bp, Homo sapiens
ttctttaccactactcttccaa

SEQ ID NO: 8573546 - DNA, 20 bp, Homo sapiens
ttctttacgacctttctgca

SEQ ID NO: 8573547 - DNA, 20 bp, Homo sapiens
ttctttacgacctttctgca

SEQ ID NO: 8573548 - DNA, 22 bp, Homo sapiens
ttctttaccagtgaaatgttat

SEQ ID NO: 8573549 - DNA, 18 bp, Homo sapiens
ttctttaattcagtttga

SEQ ID NO: 8573550 - DNA, 18 bp, Homo sapiens
ttctttaattcagtttga

SEQ ID NO: 8573551 - DNA, 22 bp, Homo sapiens
ttctttatcagttactcatagg

SEQ ID NO: 8573552 - DNA, 22 bp, Homo sapiens
ttctttatcagttactcatagg

SEQ ID NO: 8573553 - DNA, 23 bp, Homo sapiens
ttctgggctgtggaagcctcggg

SEQ ID NO: 8573554 - DNA, 22 bp, Homo sapiens
ttctggggccaattgccactgc

SEQ ID NO: 8573555 - DNA, 22 bp, Homo sapiens
ttctgggcctcctaggacaggc

SEQ ID NO: 8573556 - DNA, 19 bp, Homo sapiens
ttctggtctggaatcaagg

SEQ ID NO: 8573557 - DNA, 22 bp, Homo sapiens
ttctggtggccagaagtctgaa

SEQ ID NO: 8573558 - DNA, 22 bp, Homo sapiens
ttctgggggaatacagctatga

SEQ ID NO: 8573559 - DNA, 22 bp, Homo sapiens
ttctgtttgccatatatagtag

SEQ ID NO: 8573560 - DNA, 22 bp, Homo sapiens
ttctgtttctggggtctctgac

SEQ ID NO: 8573561 - DNA, 22 bp, Homo sapiens
ttctgttttagaaataagtagt

SEQ ID NO: 8573562 - DNA, 22 bp, Homo sapiens
ttctgttttagaaataagtagt

SEQ ID NO: 8573563 - DNA, 21 bp, Homo sapiens
ttctgttttttgtaccagggc

SEQ ID NO: 8573564 - DNA, 22 bp, Homo sapiens
ttcttacaagtattccaggtcc

SEQ ID NO: 8573565 - DNA, 22 bp, Homo sapiens
ttcttaaaacttatggacaggt

SEQ ID NO: 8573566 - DNA, 22 bp, Homo sapiens
ttcttacaagtattccaggtcc

SEQ ID NO: 8573567 - DNA, 22 bp, Homo sapiens
ttctgtttataatttgcagttg

SEQ ID NO: 8573568 - DNA, 22 bp, Homo sapiens
ttctgtttattcctaggagctc

SEQ ID NO: 8573569 - DNA, 22 bp, Homo sapiens
ttctgttctttatttaccatat

SEQ ID NO: 8573570 - DNA, 22 bp, Homo sapiens
ttctgttctgatacttgtttct

SEQ ID NO: 8573571 - DNA, 22 bp, Homo sapiens
ttctgttactgttggtcataac

SEQ ID NO: 8573572 - DNA, 22 bp, Homo sapiens
ttctgttactgttggtcataac

SEQ ID NO: 8573573 - DNA, 22 bp, Homo sapiens
ttctgttacttgcaaccacagg

SEQ ID NO: 8573574 - DNA, 22 bp, Homo sapiens
ttctgttagaattttgaaaata

SEQ ID NO: 8573575 - DNA, 22 bp, Homo sapiens
ttctgttacttgcaaccacagg

SEQ ID NO: 8573576 - DNA, 22 bp, Homo sapiens
ttctgttagcattctgatctcc

SEQ ID NO: 8573577 - DNA, 22 bp, Homo sapiens
ttctgttatcattaagcattat

SEQ ID NO: 8573578 - DNA, 22 bp, Homo sapiens
ttctgttatcattaagcattat

SEQ ID NO: 8573579 - DNA, 22 bp, Homo sapiens
ttctggtgtgttctctctaggc

SEQ ID NO: 8573580 - DNA, 22 bp, Homo sapiens
ttctgttacatggggcacagtg

SEQ ID NO: 8573581 - DNA, 22 bp, Homo sapiens
ttctgttacaagtgaaaaaatg

SEQ ID NO: 8573582 - DNA, 21 bp, Homo sapiens
tttattaacaactgtggacgt

SEQ ID NO: 8573583 - DNA, 21 bp, Homo sapiens
tttattaacaactgtggacgt

SEQ ID NO: 8573584 - DNA, 22 bp, Homo sapiens
tttattaaaactgttggctctg

SEQ ID NO: 8573585 - DNA, 22 bp, Homo sapiens
tttatgtttgcattttcaaaga

SEQ ID NO: 8573586 - DNA, 22 bp, Homo sapiens
tttattaaaactgttggctctg

SEQ ID NO: 8573587 - DNA, 22 bp, Homo sapiens
tttattaatgtagcatccatgg

SEQ ID NO: 8573588 - DNA, 22 bp, Homo sapiens
tttattaagatgcgaatgctga

SEQ ID NO: 8573589 - DNA, 22 bp, Homo sapiens
tttattaatgtagcatccatgg

SEQ ID NO: 8573590 - DNA, 22 bp, Homo sapiens
tttattaagatgcgaatgctga

SEQ ID NO: 8573591 - DNA, 22 bp, Homo sapiens
tttattaagatgcgaatgctga

SEQ ID NO: 8573592 - DNA, 22 bp, Homo sapiens
tttatagttatatacagatgtt

SEQ ID NO: 8573593 - DNA, 22 bp, Homo sapiens
tttatagttatatacagatgtt

SEQ ID NO: 8573594 - DNA, 22 bp, Homo sapiens
tttatagtcgtctcagtaataa

SEQ ID NO: 8573595 - DNA, 20 bp, Homo sapiens
tttatagtgatcaatttata

SEQ ID NO: 8573596 - DNA, 22 bp, Homo sapiens
tttatgtttgcattttcaaaga

SEQ ID NO: 8573597 - DNA, 22 bp, Homo sapiens
tttatataacagagactgctat

SEQ ID NO: 8573598 - DNA, 22 bp, Homo sapiens
tttatataacagagactgctat

SEQ ID NO: 8573599 - DNA, 23 bp, Homo sapiens
tttatagcagcatgatttataat

SEQ ID NO: 8573600 - DNA, 22 bp, Homo sapiens
tttatagctgtgagaccttggg

SEQ ID NO: 8573601 - DNA, 23 bp, Homo sapiens
tttatagcagcatgatttatagt

SEQ ID NO: 8573602 - DNA, 22 bp, Homo sapiens
tttatagtagcatgatttataa

SEQ ID NO: 8573603 - DNA, 22 bp, Homo sapiens
tttatagctgtgagaccttggg

SEQ ID NO: 8573604 - DNA, 22 bp, Homo sapiens
tttatagtcgtctcagtaataa

SEQ ID NO: 8573605 - DNA, 22 bp, Homo sapiens
tttatagtagcatgatttatag

SEQ ID NO: 8573606 - DNA, 23 bp, Homo sapiens
tttatacaagaaaccgctggcct

SEQ ID NO: 8573607 - DNA, 22 bp, Homo sapiens
tttatacatggagaatttttgc

SEQ ID NO: 8573608 - DNA, 22 bp, Homo sapiens
tttatacatggagaatttttgc

SEQ ID NO: 8573609 - DNA, 22 bp, Homo sapiens
tttatacatggagaatttttgc

SEQ ID NO: 8573610 - DNA, 22 bp, Homo sapiens
tttatacatggagaatttttgc

SEQ ID NO: 8573611 - DNA, 22 bp, Homo sapiens
tttatacatggagaatttttgc

SEQ ID NO: 8573612 - DNA, 22 bp, Homo sapiens
tttataattatctctactctta

SEQ ID NO: 8573613 - DNA, 22 bp, Homo sapiens
tttataattatctctactctta

SEQ ID NO: 8573614 - DNA, 17 bp, Homo sapiens
tttataattggcctctt

SEQ ID NO: 8573615 - DNA, 22 bp, Homo sapiens
tttatacttcataatgtctatt

SEQ ID NO: 8573616 - DNA, 22 bp, Homo sapiens
tttatactccactctgcaagcg

SEQ ID NO: 8573617 - DNA, 22 bp, Homo sapiens
tttatagatgtctgtattataa

SEQ ID NO: 8573618 - DNA, 22 bp, Homo sapiens
tttatagatgtctgtattataa

SEQ ID NO: 8573619 - DNA, 22 bp, Homo sapiens
tttataaacagtaccacggtgc

SEQ ID NO: 8573620 - DNA, 22 bp, Homo sapiens
tttataaacagtaccacggtgc

SEQ ID NO: 8573621 - DNA, 22 bp, Homo sapiens
tttataaaatagactgggtcta

SEQ ID NO: 8573622 - DNA, 22 bp, Homo sapiens
tttataaaatagactgggtcta

SEQ ID NO: 8573623 - DNA, 22 bp, Homo sapiens
tttagttttaactgaaagctat

SEQ ID NO: 8573624 - DNA, 22 bp, Homo sapiens
tttagtttgatgttctactcct

SEQ ID NO: 8573625 - DNA, 22 bp, Homo sapiens
tttagtttgatgttctactcct

SEQ ID NO: 8573626 - DNA, 21 bp, Homo sapiens
tttagttcaagtacagaacca

SEQ ID NO: 8573627 - DNA, 22 bp, Homo sapiens
tttagttattgttacagtatga

SEQ ID NO: 8573628 - DNA, 22 bp, Homo sapiens
tttattattctgttctctctac

SEQ ID NO: 8573629 - DNA, 22 bp, Homo sapiens
tttattattctgttctctctac

SEQ ID NO: 8573630 - DNA, 22 bp, Homo sapiens
tttattattctgttctctctac

SEQ ID NO: 8573631 - DNA, 22 bp, Homo sapiens
tttattattctctggagaatgt

SEQ ID NO: 8573632 - DNA, 22 bp, Homo sapiens
tttattatgtacaggcactata

SEQ ID NO: 8573633 - DNA, 22 bp, Homo sapiens
tttattattctctggagaatgt

SEQ ID NO: 8573634 - DNA, 22 bp, Homo sapiens
tttattattctctggagaatgt

SEQ ID NO: 8573635 - DNA, 22 bp, Homo sapiens
tttattatgatggacaccttcg

SEQ ID NO: 8573636 - DNA, 22 bp, Homo sapiens
tttattatgatggacaccttcg

SEQ ID NO: 8573637 - DNA, 22 bp, Homo sapiens
tttattatccagtgttgtcatg

SEQ ID NO: 8573638 - DNA, 22 bp, Homo sapiens
tttattatgtacaggcactata

SEQ ID NO: 8573639 - DNA, 22 bp, Homo sapiens
tttattatgatggacaccttcg

SEQ ID NO: 8573640 - DNA, 22 bp, Homo sapiens
tttattacaccaggttaactca

SEQ ID NO: 8573641 - DNA, 22 bp, Homo sapiens
tttattagattatcaaagaggt

SEQ ID NO: 8573642 - DNA, 22 bp, Homo sapiens
tttattagattatcaaagaggt

SEQ ID NO: 8573643 - DNA, 22 bp, Homo sapiens
tttattaatgtagcatccatgg

SEQ ID NO: 8573644 - DNA, 22 bp, Homo sapiens
tttattaattagtgacccaatg

SEQ ID NO: 8573645 - DNA, 22 bp, Homo sapiens
tttattacaccaggttaactca

SEQ ID NO: 8573646 - DNA, 22 bp, Homo sapiens
tttattaattagtgacccaatg

SEQ ID NO: 8573647 - DNA, 22 bp, Homo sapiens
tttattatagtggtggggactg

SEQ ID NO: 8573648 - DNA, 22 bp, Homo sapiens
tttattagtgcttgtatcactg

SEQ ID NO: 8573649 - DNA, 22 bp, Homo sapiens
tttattatagtggtggggactg

SEQ ID NO: 8573650 - DNA, 22 bp, Homo sapiens
tttattatagtggtggggactg

SEQ ID NO: 8573651 - DNA, 22 bp, Homo sapiens
tttattatccagtgttgtcatg

SEQ ID NO: 8573652 - DNA, 22 bp, Homo sapiens
tttattatccagtgttgtcatg

SEQ ID NO: 8573653 - DNA, 22 bp, Homo sapiens
tttatttcactctccggatact

SEQ ID NO: 8573654 - DNA, 22 bp, Homo sapiens
tttatttcttagtttgccacag

SEQ ID NO: 8573655 - DNA, 19 bp, Homo sapiens
tttatttgagacatgcctt

SEQ ID NO: 8573656 - DNA, 19 bp, Homo sapiens
tttatttgagacatgcctt

SEQ ID NO: 8573657 - DNA, 22 bp, Homo sapiens
tttatttggcatccagggagaa

SEQ ID NO: 8573658 - DNA, 22 bp, Homo sapiens
tttatttgaatcaggggagaat

SEQ ID NO: 8573659 - DNA, 22 bp, Homo sapiens
tttatttgaatcaggggagaat

SEQ ID NO: 8573660 - DNA, 22 bp, Homo sapiens
tttatttgaatcaggggagaat

SEQ ID NO: 8573661 - DNA, 22 bp, Homo sapiens
tttatttggcatccagggagaa

SEQ ID NO: 8573662 - DNA, 22 bp, Homo sapiens
tttatttggcatccagggagaa

SEQ ID NO: 8573663 - DNA, 22 bp, Homo sapiens
tttatttggcatccagggagaa

SEQ ID NO: 8573664 - DNA, 22 bp, Homo sapiens
tttatttggcatccagggagaa

SEQ ID NO: 8573665 - DNA, 22 bp, Homo sapiens
tttatttggcatctctgccaag

SEQ ID NO: 8573666 - DNA, 22 bp, Homo sapiens
tttatttggcatctctgccaag

SEQ ID NO: 8573667 - DNA, 22 bp, Homo sapiens
tttatttggcatctctgccaag

SEQ ID NO: 8573668 - DNA, 22 bp, Homo sapiens
tttatttgtcttgccatttagt

SEQ ID NO: 8573669 - DNA, 22 bp, Homo sapiens
tttatttgtcttgccatttagt

SEQ ID NO: 8573670 - DNA, 22 bp, Homo sapiens
tttatttgtcttgccatttagt

SEQ ID NO: 8573671 - DNA, 22 bp, Homo sapiens
tttatttgtcttgccatttagt

SEQ ID NO: 8573672 - DNA, 22 bp, Homo sapiens
tttcaaacattcctgggagact

SEQ ID NO: 8573673 - DNA, 22 bp, Homo sapiens
tttcaaacattcctgggagact

SEQ ID NO: 8573674 - DNA, 22 bp, Homo sapiens
tttcaaaccactgaggttctga

SEQ ID NO: 8573675 - DNA, 22 bp, Homo sapiens
tttcaaactatgtgtcaggcag

SEQ ID NO: 8573676 - DNA, 22 bp, Homo sapiens
tttcaaacctacttgtatgttt

SEQ ID NO: 8573677 - DNA, 20 bp, Homo sapiens
tttcaaactgcacctttgct

SEQ ID NO: 8573678 - DNA, 22 bp, Homo sapiens
tttcaaacttaaatacctttcc

SEQ ID NO: 8573679 - DNA, 22 bp, Homo sapiens
tttcaaactgtactttccccta

SEQ ID NO: 8573680 - DNA, 22 bp, Homo sapiens
tttcaaactgcccagcacacct

SEQ ID NO: 8573681 - DNA, 22 bp, Homo sapiens
tttcaaactgggagtgagggga

SEQ ID NO: 8573682 - DNA, 22 bp, Homo sapiens
tttcaaactccagctcaccaat

SEQ ID NO: 8573683 - DNA, 22 bp, Homo sapiens
tttcaaaattttgcagtggtaa

SEQ ID NO: 8573684 - DNA, 22 bp, Homo sapiens
tttcaaacatagatctgaatat

SEQ ID NO: 8573685 - DNA, 22 bp, Homo sapiens
tttcaaacatagatctgaatat

SEQ ID NO: 8573686 - DNA, 22 bp, Homo sapiens
tttcaaacatatcttcattact

SEQ ID NO: 8573687 - DNA, 22 bp, Homo sapiens
tttaccatcctcttttagaatt

SEQ ID NO: 8573688 - DNA, 22 bp, Homo sapiens
tttaccatctgccacagatatg

SEQ ID NO: 8573689 - DNA, 22 bp, Homo sapiens
tttacccattcagactcacttg

SEQ ID NO: 8573690 - DNA, 22 bp, Homo sapiens
tttacccatattagcatcaagt

SEQ ID NO: 8573691 - DNA, 22 bp, Homo sapiens
tttacctttgtgggtctccctc

SEQ ID NO: 8573692 - DNA, 22 bp, Homo sapiens
tttacgagtgctaatgatattg

SEQ ID NO: 8573693 - DNA, 22 bp, Homo sapiens
tttacgaaaagtgactaatagg

SEQ ID NO: 8573694 - DNA, 19 bp, Homo sapiens
tttaccttcttgagagcag

SEQ ID NO: 8573695 - DNA, 22 bp, Homo sapiens
tttactaagcccagttatatgc

SEQ ID NO: 8573696 - DNA, 22 bp, Homo sapiens
tttactaacaccatacatgctg

SEQ ID NO: 8573697 - DNA, 22 bp, Homo sapiens
tttactcaagtatgcatttatg

SEQ ID NO: 8573698 - DNA, 22 bp, Homo sapiens
tttacaacgttcctggtgctaa

SEQ ID NO: 8573699 - DNA, 22 bp, Homo sapiens
tttacaacctcatattctgatg

SEQ ID NO: 8573700 - DNA, 22 bp, Homo sapiens
tttacaacctcatattctgatg

SEQ ID NO: 8573701 - DNA, 22 bp, Homo sapiens
tttacaaggcagaactgattaa

SEQ ID NO: 8573702 - DNA, 22 bp, Homo sapiens
tttacaaggcagaactgattaa

SEQ ID NO: 8573703 - DNA, 22 bp, Homo sapiens
tttacaaggcagttattttcct

SEQ ID NO: 8573704 - DNA, 22 bp, Homo sapiens
tttacaaggcagttattttcct

SEQ ID NO: 8573705 - DNA, 22 bp, Homo sapiens
tttacaaggcagttattttcct

SEQ ID NO: 8573706 - DNA, 22 bp, Homo sapiens
tttactgtgtccatctgtgact

SEQ ID NO: 8573707 - DNA, 22 bp, Homo sapiens
tttactgttttatattgtccag

SEQ ID NO: 8573708 - DNA, 22 bp, Homo sapiens
tttactgaatttggtatattcc

SEQ ID NO: 8573709 - DNA, 22 bp, Homo sapiens
tttactgaactgctagtacagg

SEQ ID NO: 8573710 - DNA, 18 bp, Homo sapiens
tttactcataggcctgac

SEQ ID NO: 8573711 - DNA, 21 bp, Homo sapiens
tttactgagcacttactatgt

SEQ ID NO: 8573712 - DNA, 22 bp, Homo sapiens
tttactgagtgacctagaataa

SEQ ID NO: 8573713 - DNA, 21 bp, Homo sapiens
tttactgagcacttactatgt

SEQ ID NO: 8573714 - DNA, 22 bp, Homo sapiens
tttactttgtgtcaagtcaaga

SEQ ID NO: 8573715 - DNA, 22 bp, Homo sapiens
tttactttgtgtcaagtcaaga

SEQ ID NO: 8573716 - DNA, 22 bp, Homo sapiens
tttactttctcaagtatatagg

SEQ ID NO: 8573717 - DNA, 22 bp, Homo sapiens
tttactttctcaagtatatagg

SEQ ID NO: 8573718 - DNA, 22 bp, Homo sapiens
tttactttctcaagtatatagg

SEQ ID NO: 8573719 - DNA, 22 bp, Homo sapiens
tttagaaattcatctatggcct

SEQ ID NO: 8573720 - DNA, 22 bp, Homo sapiens
tttacttttggtaaggtcattt

SEQ ID NO: 8573721 - DNA, 22 bp, Homo sapiens
tttacttttggtaaggtcattt

SEQ ID NO: 8573722 - DNA, 22 bp, Homo sapiens
tttacttttggtaaggtcattt

SEQ ID NO: 8573723 - DNA, 22 bp, Homo sapiens
tttagaaattgcagagtgggtg

SEQ ID NO: 8573724 - DNA, 22 bp, Homo sapiens
tttagttattgttacagtatga

SEQ ID NO: 8573725 - DNA, 22 bp, Homo sapiens
tttaaaaaactagtctgagtct

SEQ ID NO: 8573726 - DNA, 22 bp, Homo sapiens
tttaaaagttatcatctgtcca

SEQ ID NO: 8573727 - DNA, 23 bp, Homo sapiens
tttaaaagttgtaatgtaggctt

SEQ ID NO: 8573728 - DNA, 22 bp, Homo sapiens
tttaaaagttatcatctgtcca

SEQ ID NO: 8573729 - DNA, 22 bp, Homo sapiens
tttaaaatcagatgggagttgg

SEQ ID NO: 8573730 - DNA, 22 bp, Homo sapiens
ttgtttttagagaagccctgaa

SEQ ID NO: 8573731 - DNA, 22 bp, Homo sapiens
ttgtttttagagaagccctgaa

SEQ ID NO: 8573732 - DNA, 23 bp, Homo sapiens
ttgtttttagaggtggcatgaga

SEQ ID NO: 8573733 - DNA, 22 bp, Homo sapiens
ttgtttttatgaacatccagga

SEQ ID NO: 8573734 - DNA, 22 bp, Homo sapiens
ttgtttttatgaacatccagga

SEQ ID NO: 8573735 - DNA, 22 bp, Homo sapiens
ttgtttttatgaacatccagga

SEQ ID NO: 8573736 - DNA, 22 bp, Homo sapiens
tttaatgtgagtccctttcaag

SEQ ID NO: 8573737 - DNA, 22 bp, Homo sapiens
tttaaacatatctgttgaggga

SEQ ID NO: 8573738 - DNA, 22 bp, Homo sapiens
tttaaacatatctgttgaggga

SEQ ID NO: 8573739 - DNA, 22 bp, Homo sapiens
tttaaacaaataggattgccta

SEQ ID NO: 8573740 - DNA, 22 bp, Homo sapiens
tttaaacaaataggattgccta

SEQ ID NO: 8573741 - DNA, 22 bp, Homo sapiens
tttaatgttaaatttgtagatg

SEQ ID NO: 8573742 - DNA, 22 bp, Homo sapiens
tttaatgttaaatttgtagatg

SEQ ID NO: 8573743 - DNA, 22 bp, Homo sapiens
tttaaaatcagatgggagttgg

SEQ ID NO: 8573744 - DNA, 22 bp, Homo sapiens
tttaaaatttagacctctccac

SEQ ID NO: 8573745 - DNA, 22 bp, Homo sapiens
tttaaaatttagacctctccac

SEQ ID NO: 8573746 - DNA, 22 bp, Homo sapiens
tttaatgtttgagtcagtatat

SEQ ID NO: 8573747 - DNA, 22 bp, Homo sapiens
tttaatgtttgagtcagtatat

SEQ ID NO: 8573748 - DNA, 22 bp, Homo sapiens
tttaattagcaagccagagagc

SEQ ID NO: 8573749 - DNA, 22 bp, Homo sapiens
tttaattaggaaatgggcaggg

SEQ ID NO: 8573750 - DNA, 22 bp, Homo sapiens
tttaattatatctgggcagtta

SEQ ID NO: 8573751 - DNA, 22 bp, Homo sapiens
tttaattgattcacagtctgta

SEQ ID NO: 8573752 - DNA, 22 bp, Homo sapiens
tttaatttgaaatgagtaaccc

SEQ ID NO: 8573753 - DNA, 22 bp, Homo sapiens
tttaattgttgtgggtacatag

SEQ ID NO: 8573754 - DNA, 22 bp, Homo sapiens
tttaattgattcacagtctgta

SEQ ID NO: 8573755 - DNA, 22 bp, Homo sapiens
tttaattgcatttaaagatgga

SEQ ID NO: 8573756 - DNA, 22 bp, Homo sapiens
tttaattgttgtgggtacatag

SEQ ID NO: 8573757 - DNA, 22 bp, Homo sapiens
tttaattttcctcttcctggag

SEQ ID NO: 8573758 - DNA, 22 bp, Homo sapiens
tttacaacccaagtccagagag

SEQ ID NO: 8573759 - DNA, 22 bp, Homo sapiens
tttaattttctgggcccagcag

SEQ ID NO: 8573760 - DNA, 22 bp, Homo sapiens
tttaatttgtatttctagaggg

SEQ ID NO: 8573761 - DNA, 22 bp, Homo sapiens
tttaatttgtatttctagaggg

SEQ ID NO: 8573762 - DNA, 22 bp, Homo sapiens
tttaattttcctcttcctggag

SEQ ID NO: 8573763 - DNA, 22 bp, Homo sapiens
tttaattttcctcttcctggag

SEQ ID NO: 8573764 - DNA, 21 bp, Homo sapiens
tttaatttgcatgtatgacgc

SEQ ID NO: 8573765 - DNA, 22 bp, Homo sapiens
ttgttttcagggtgtcattcac

SEQ ID NO: 8573766 - DNA, 22 bp, Homo sapiens
ttgttttcacagctttgcccgg

SEQ ID NO: 8573767 - DNA, 22 bp, Homo sapiens
ttgttttctccactgcatctta

SEQ ID NO: 8573768 - DNA, 22 bp, Homo sapiens
ttgttttggagatgagctaaaa

SEQ ID NO: 8573769 - DNA, 22 bp, Homo sapiens
ttgttttctccactgcatctta

SEQ ID NO: 8573770 - DNA, 22 bp, Homo sapiens
ttgttttggaagaacttactct

SEQ ID NO: 8573771 - DNA, 22 bp, Homo sapiens
ttgttttgctaaagggtcatca

SEQ ID NO: 8573772 - DNA, 22 bp, Homo sapiens
ttgttttaacgactcagcttgt

SEQ ID NO: 8573773 - DNA, 18 bp, Homo sapiens
ttgttttaagactctgtc

SEQ ID NO: 8573774 - DNA, 17 bp, Homo sapiens
ttgtttcttctctgtgg

SEQ ID NO: 8573775 - DNA, 17 bp, Homo sapiens
ttgtttcttctctgtgg

SEQ ID NO: 8573776 - DNA, 23 bp, Homo sapiens
ttgtttctttgtattgtctctat

SEQ ID NO: 8573777 - DNA, 22 bp, Homo sapiens
ttgtttctttgaagtttctaga

SEQ ID NO: 8573778 - DNA, 17 bp, Homo sapiens
ttgtttcttctctgtgg

SEQ ID NO: 8573779 - DNA, 17 bp, Homo sapiens
ttgtttcttctctgtgg

SEQ ID NO: 8573780 - DNA, 22 bp, Homo sapiens
ttgtttcttcaggcttttagga

SEQ ID NO: 8573781 - DNA, 22 bp, Homo sapiens
ttgtttgaggtcactgatattt

SEQ ID NO: 8573782 - DNA, 22 bp, Homo sapiens
ttgtttggaacttggtgccacc

SEQ ID NO: 8573783 - DNA, 23 bp, Homo sapiens
ttgtttctttgtattgtctctat

SEQ ID NO: 8573784 - DNA, 23 bp, Homo sapiens
ttgtttctttgtattgtctctat

SEQ ID NO: 8573785 - DNA, 22 bp, Homo sapiens
ttgtttgtaaggctcttagaat

SEQ ID NO: 8573786 - DNA, 22 bp, Homo sapiens
ttgtttgtatgctgagaagaat

SEQ ID NO: 8573787 - DNA, 22 bp, Homo sapiens
ttgtttgtatgctgagaagaat

SEQ ID NO: 8573788 - DNA, 22 bp, Homo sapiens
ttgtttcctttctatacaggat

SEQ ID NO: 8573789 - DNA, 22 bp, Homo sapiens
ttgtttctccagtctaggaaaa

SEQ ID NO: 8573790 - DNA, 22 bp, Homo sapiens
ttgtttctcctggtgcctgata

SEQ ID NO: 8573791 - DNA, 22 bp, Homo sapiens
ttgtttctcctggtgcctgata

SEQ ID NO: 8573792 - DNA, 21 bp, Homo sapiens
ttgtttcccagagctcgctcc

SEQ ID NO: 8573793 - DNA, 22 bp, Homo sapiens
ttgtttccctggatctagagct

SEQ ID NO: 8573794 - DNA, 21 bp, Homo sapiens
ttgtttcctcccaaaatgcca

SEQ ID NO: 8573795 - DNA, 22 bp, Homo sapiens
ttgtttcctttctatacaggat

SEQ ID NO: 8573796 - DNA, 22 bp, Homo sapiens
ttgtttcctttctatacaggat

SEQ ID NO: 8573797 - DNA, 21 bp, Homo sapiens
ttgtttcctcccaaaatgcca

SEQ ID NO: 8573798 - DNA, 22 bp, Homo sapiens
ttgtttctgagttttcatgtat

SEQ ID NO: 8573799 - DNA, 22 bp, Homo sapiens
ttgtttctgagttttcatgtat

SEQ ID NO: 8573800 - DNA, 20 bp, Homo sapiens
ttgtttctgctattttctaa

SEQ ID NO: 8573801 - DNA, 22 bp, Homo sapiens
ttgtttctctggtcttgagtga

SEQ ID NO: 8573802 - DNA, 20 bp, Homo sapiens
ttgtttctgctattttctaa

SEQ ID NO: 8573803 - DNA, 20 bp, Homo sapiens
ttgtttctgctattttctaa

SEQ ID NO: 8573804 - DNA, 21 bp, Homo sapiens
ttgtgtttccccagtcacttt

SEQ ID NO: 8573805 - DNA, 22 bp, Homo sapiens
ttgtgtttcccttgcatattcc

SEQ ID NO: 8573806 - DNA, 22 bp, Homo sapiens
ttgtgtttctggccaagatgga

SEQ ID NO: 8573807 - DNA, 22 bp, Homo sapiens
ttgtgttttcttatggcataaa

SEQ ID NO: 8573808 - DNA, 22 bp, Homo sapiens
ttgtgtgtttgtagaaaatcca

SEQ ID NO: 8573809 - DNA, 22 bp, Homo sapiens
ttgtgtgtttgtagaaaatcca

SEQ ID NO: 8573810 - DNA, 22 bp, Homo sapiens
ttgtgtgtgtaactttatgaga

SEQ ID NO: 8573811 - DNA, 22 bp, Homo sapiens
ttgtgtgtgtaactttatgaga

SEQ ID NO: 8573812 - DNA, 22 bp, Homo sapiens
ttgtgtgtgtaactttatgaga

SEQ ID NO: 8573813 - DNA, 22 bp, Homo sapiens
ttgtgtgtgtaactttatgaga

SEQ ID NO: 8573814 - DNA, 22 bp, Homo sapiens
ttgtgtgtttgtagaaaatcca

SEQ ID NO: 8573815 - DNA, 22 bp, Homo sapiens
ttgtgtgtgtaactttatgaga

SEQ ID NO: 8573816 - DNA, 22 bp, Homo sapiens
ttgtgaatggtgccgcaataaa

SEQ ID NO: 8573817 - DNA, 22 bp, Homo sapiens
ttgtgaatggtgccgcaataaa

SEQ ID NO: 8573818 - DNA, 19 bp, Homo sapiens
ttgtgtgtcagtcagagtt

SEQ ID NO: 8573819 - DNA, 19 bp, Homo sapiens
ttgtgtgtcagtcagagtt

SEQ ID NO: 8573820 - DNA, 22 bp, Homo sapiens
ttgtgtgtcttcttcactgccc

SEQ ID NO: 8573821 - DNA, 22 bp, Homo sapiens
ttgtgtgtgagccttcaccaca

SEQ ID NO: 8573822 - DNA, 22 bp, Homo sapiens
ttgtgtgtgagccttcaccaca

SEQ ID NO: 8573823 - DNA, 22 bp, Homo sapiens
ttgtgtgtgagccttcaccaca

SEQ ID NO: 8573824 - DNA, 22 bp, Homo sapiens
ttgtgtgtgagccttcaccaca

SEQ ID NO: 8573825 - DNA, 22 bp, Homo sapiens
ttgtgtgtcttcttcactgccc

SEQ ID NO: 8573826 - DNA, 19 bp, Homo sapiens
ttgtgtgtcagtcagagtt

SEQ ID NO: 8573827 - DNA, 19 bp, Homo sapiens
ttgtgtgtcagtcagagtt

SEQ ID NO: 8573828 - DNA, 22 bp, Homo sapiens
ttgtgtgtcttcttcactgccc

SEQ ID NO: 8573829 - DNA, 22 bp, Homo sapiens
ttgttacatcttatgtaagtgg

SEQ ID NO: 8573830 - DNA, 22 bp, Homo sapiens
ttgttacatggacaactgtatg

SEQ ID NO: 8573831 - DNA, 21 bp, Homo sapiens
ttgttacattcttatggcata

SEQ ID NO: 8573832 - DNA, 20 bp, Homo sapiens
ttgttagaggaatgccatag

SEQ ID NO: 8573833 - DNA, 20 bp, Homo sapiens
ttgttagaggaatgccatag

SEQ ID NO: 8573834 - DNA, 22 bp, Homo sapiens
ttgtgtttgatgctgacacgca

SEQ ID NO: 8573835 - DNA, 22 bp, Homo sapiens
ttgttacagcagcaatagaaaa

SEQ ID NO: 8573836 - DNA, 22 bp, Homo sapiens
ttgttaaaaatagatttccagg

SEQ ID NO: 8573837 - DNA, 22 bp, Homo sapiens
ttgttaaaaatagatttccagg

SEQ ID NO: 8573838 - DNA, 22 bp, Homo sapiens
ttgttacatcttatgtaagtgg

SEQ ID NO: 8573839 - DNA, 22 bp, Homo sapiens
ttgttacagcagtgatttcaga

SEQ ID NO: 8573840 - DNA, 22 bp, Homo sapiens
ttgttacagcagtgatttcaga

SEQ ID NO: 8573841 - DNA, 22 bp, Homo sapiens
ttgttacagcagcaatagaaaa

SEQ ID NO: 8573842 - DNA, 22 bp, Homo sapiens
ttgtttccattgcagactgtgt

SEQ ID NO: 8573843 - DNA, 22 bp, Homo sapiens
ttgtttccattgcagactgtgt

SEQ ID NO: 8573844 - DNA, 22 bp, Homo sapiens
ttgtttccattgcagactgtgt

SEQ ID NO: 8573845 - DNA, 22 bp, Homo sapiens
ttgtttccataattaagtgtga

SEQ ID NO: 8573846 - DNA, 22 bp, Homo sapiens
ttgtttccagcaaatagtccat

SEQ ID NO: 8573847 - DNA, 20 bp, Homo sapiens
ttgtttaaaggtgaagaggc

SEQ ID NO: 8573848 - DNA, 22 bp, Homo sapiens
ttgttataaagactaaatatgt

SEQ ID NO: 8573849 - DNA, 22 bp, Homo sapiens
ttgttattattactaagtcttc

SEQ ID NO: 8573850 - DNA, 22 bp, Homo sapiens
ttgttattattactaagtcttc

SEQ ID NO: 8573851 - DNA, 22 bp, Homo sapiens
ttgttattattactaagtcttc

SEQ ID NO: 8573852 - DNA, 22 bp, Homo sapiens
ttgttattattactaagtcttc

SEQ ID NO: 8573853 - DNA, 22 bp, Homo sapiens
ttgtttaaagaacttctgactt

SEQ ID NO: 8573854 - DNA, 22 bp, Homo sapiens
ttgtcctttaatgtttagtatt

SEQ ID NO: 8573855 - DNA, 22 bp, Homo sapiens
ttgtctaatgagctccacttca

SEQ ID NO: 8573856 - DNA, 22 bp, Homo sapiens
ttgtcgggcttacgcagggcca

SEQ ID NO: 8573857 - DNA, 22 bp, Homo sapiens
ttggttttgggatgtacaaagg

SEQ ID NO: 8573858 - DNA, 23 bp, Homo sapiens
ttgtccttctgaaatatatctgg

SEQ ID NO: 8573859 - DNA, 22 bp, Homo sapiens
ttggtttactaggattcaaatt

SEQ ID NO: 8573860 - DNA, 22 bp, Homo sapiens
ttggtttaggaactggcttgga

SEQ ID NO: 8573861 - DNA, 22 bp, Homo sapiens
ttggtttagagagtgtggttac

SEQ ID NO: 8573862 - DNA, 22 bp, Homo sapiens
ttggttttcaggggcaggataa

SEQ ID NO: 8573863 - DNA, 22 bp, Homo sapiens
ttggtttgttcaccatcaagca

SEQ ID NO: 8573864 - DNA, 22 bp, Homo sapiens
ttgtgaatagtgccgcaataaa

SEQ ID NO: 8573865 - DNA, 22 bp, Homo sapiens
ttgtgaatagtgccgcaataaa

SEQ ID NO: 8573866 - DNA, 22 bp, Homo sapiens
ttgtgaatagtgccgctataaa

SEQ ID NO: 8573867 - DNA, 22 bp, Homo sapiens
ttgtgaatagtgccgctataaa

SEQ ID NO: 8573868 - DNA, 22 bp, Homo sapiens
ttgtgaaatgtttcaaaatagt

SEQ ID NO: 8573869 - DNA, 22 bp, Homo sapiens
ttgtgaaatgtttcaaaatagt

SEQ ID NO: 8573870 - DNA, 22 bp, Homo sapiens
ttgtgaaatgtttcaaaatagt

SEQ ID NO: 8573871 - DNA, 22 bp, Homo sapiens
ttgtgaaatgtttcaaaatagt

SEQ ID NO: 8573872 - DNA, 22 bp, Homo sapiens
ttgtctggtcaaatcacttgta

SEQ ID NO: 8573873 - DNA, 22 bp, Homo sapiens
ttgtgaaatgtttcaaaatagt

SEQ ID NO: 8573874 - DNA, 22 bp, Homo sapiens
ttgtctgtaaagacggccacca

SEQ ID NO: 8573875 - DNA, 22 bp, Homo sapiens
ttgtctgaattcttctaggcag

SEQ ID NO: 8573876 - DNA, 22 bp, Homo sapiens
ttgtctgaatatgtatgtatcc

SEQ ID NO: 8573877 - DNA, 22 bp, Homo sapiens
ttgtctctacagagagtagtag

SEQ ID NO: 8573878 - DNA, 22 bp, Homo sapiens
ttgtctctaagtgtgatcttca

SEQ ID NO: 8573879 - DNA, 22 bp, Homo sapiens
ttgtctctgggacatggtatta

SEQ ID NO: 8573880 - DNA, 22 bp, Homo sapiens
ttgcaagatgttaccattgtta

SEQ ID NO: 8573881 - DNA, 22 bp, Homo sapiens
ttgcaacttctcccatcactct

SEQ ID NO: 8573882 - DNA, 22 bp, Homo sapiens
ttgcaagacacttggaagcaca

SEQ ID NO: 8573883 - DNA, 18 bp, Homo sapiens
ttggggtgaggccaggaa

SEQ ID NO: 8573884 - DNA, 22 bp, Homo sapiens
ttgcaatagccttatttccaaa

SEQ ID NO: 8573885 - DNA, 22 bp, Homo sapiens
ttgcaaattattttagtccctt

SEQ ID NO: 8573886 - DNA, 22 bp, Homo sapiens
ttgcaaattcatggatctgaat

SEQ ID NO: 8573887 - DNA, 22 bp, Homo sapiens
ttgcaaattccaatccaatatt

SEQ ID NO: 8573888 - DNA, 22 bp, Homo sapiens
ttgcaaattgcaagagttggat

SEQ ID NO: 8573889 - DNA, 23 bp, Homo sapiens
ttgcaaatttcagttagttcatg

SEQ ID NO: 8573890 - DNA, 22 bp, Homo sapiens
ttgcaacattgtaagtttatat

SEQ ID NO: 8573891 - DNA, 22 bp, Homo sapiens
ttgcaacacaaagtttgattcc

SEQ ID NO: 8573892 - DNA, 22 bp, Homo sapiens
ttggtgtcttttttatacatgt

SEQ ID NO: 8573893 - DNA, 22 bp, Homo sapiens
ttggtgtgactaaggcagtgtg

SEQ ID NO: 8573894 - DNA, 22 bp, Homo sapiens
ttggtgagtgctatgtaccaca

SEQ ID NO: 8573895 - DNA, 22 bp, Homo sapiens
ttggtgagtatggacacagaga

SEQ ID NO: 8573896 - DNA, 22 bp, Homo sapiens
ttggtgactccccaccatgatg

SEQ ID NO: 8573897 - DNA, 22 bp, Homo sapiens
ttggtggagtcattggcatatg

SEQ ID NO: 8573898 - DNA, 22 bp, Homo sapiens
ttggggtgttggatggagcaag

SEQ ID NO: 8573899 - DNA, 22 bp, Homo sapiens
ttggtccctcatggacacatga

SEQ ID NO: 8573900 - DNA, 22 bp, Homo sapiens
tttcattgtctacatatgacat

SEQ ID NO: 8573901 - DNA, 22 bp, Homo sapiens
tttcattgtctacatatgacat

SEQ ID NO: 8573902 - DNA, 22 bp, Homo sapiens
tttcattgtcaataaactgtat

SEQ ID NO: 8573903 - DNA, 22 bp, Homo sapiens
tttcattggctccctgatgaat

SEQ ID NO: 8573904 - DNA, 22 bp, Homo sapiens
tttcattgtcaataaactgtat

SEQ ID NO: 8573905 - DNA, 22 bp, Homo sapiens
tttcattgcctttggaaggtct

SEQ ID NO: 8573906 - DNA, 22 bp, Homo sapiens
tttcattgcagagtctgtgtgc

SEQ ID NO: 8573907 - DNA, 22 bp, Homo sapiens
tttcattttggttatgccataa

SEQ ID NO: 8573908 - DNA, 22 bp, Homo sapiens
tttcatttcatagaattgtgtt

SEQ ID NO: 8573909 - DNA, 22 bp, Homo sapiens
tttcattttggttatgccataa

SEQ ID NO: 8573910 - DNA, 22 bp, Homo sapiens
tttcattttggttatgccataa

SEQ ID NO: 8573911 - DNA, 22 bp, Homo sapiens
tttcattttggttatgccataa

SEQ ID NO: 8573912 - DNA, 22 bp, Homo sapiens
tttcattttggttatgccataa

SEQ ID NO: 8573913 - DNA, 22 bp, Homo sapiens
tttcctctgctgccattgcccc

SEQ ID NO: 8573914 - DNA, 22 bp, Homo sapiens
tttcctctgctgccattgcccc

SEQ ID NO: 8573915 - DNA, 22 bp, Homo sapiens
tttcctctgggccctgccaccc

SEQ ID NO: 8573916 - DNA, 22 bp, Homo sapiens
tttcctcttatacagtgtttat

SEQ ID NO: 8573917 - DNA, 22 bp, Homo sapiens
tttcctctgtcatgacagctga

SEQ ID NO: 8573918 - DNA, 22 bp, Homo sapiens
tttcctctgtcatgacagctga

SEQ ID NO: 8573919 - DNA, 22 bp, Homo sapiens
tttcctcttcgattaagtttgg

SEQ ID NO: 8573920 - DNA, 22 bp, Homo sapiens
tttcctcttcttcccatgtcat

SEQ ID NO: 8573921 - DNA, 22 bp, Homo sapiens
tttcctcttcttcccatgtcat

SEQ ID NO: 8573922 - DNA, 22 bp, Homo sapiens
tttcctcttctggcaggcaggg

SEQ ID NO: 8573923 - DNA, 22 bp, Homo sapiens
tttccaaaggctaaactcagtt

SEQ ID NO: 8573924 - DNA, 22 bp, Homo sapiens
tttccaaaggaggaaccagttt

SEQ ID NO: 8573925 - DNA, 22 bp, Homo sapiens
tttccaaaggtggcaggaacaa

SEQ ID NO: 8573926 - DNA, 22 bp, Homo sapiens
tttccaaagttgccataagctt

SEQ ID NO: 8573927 - DNA, 20 bp, Homo sapiens
tttcagagtgtctttccatt

SEQ ID NO: 8573928 - DNA, 22 bp, Homo sapiens
tttcagagtctggctgcagcct

SEQ ID NO: 8573929 - DNA, 22 bp, Homo sapiens
tttcagagttagtagagcatgt

SEQ ID NO: 8573930 - DNA, 22 bp, Homo sapiens
tttcagagttagtagagcatgt

SEQ ID NO: 8573931 - DNA, 22 bp, Homo sapiens
tttcagagttatgtaagaaaat

SEQ ID NO: 8573932 - DNA, 22 bp, Homo sapiens
tttcagagttatgtaagaaaat

SEQ ID NO: 8573933 - DNA, 22 bp, Homo sapiens
tttcagaggtgcttggaatgct

SEQ ID NO: 8573934 - DNA, 22 bp, Homo sapiens
tttcagagtcagctcctctcta

SEQ ID NO: 8573935 - DNA, 22 bp, Homo sapiens
tttcagagtcagctcctctcta

SEQ ID NO: 8573936 - DNA, 20 bp, Homo sapiens
tttcaaaggcacctatgaag

SEQ ID NO: 8573937 - DNA, 20 bp, Homo sapiens
tttcaaaggcacctatgaag

SEQ ID NO: 8573938 - DNA, 20 bp, Homo sapiens
tttcaaaggcacctatgaag

SEQ ID NO: 8573939 - DNA, 22 bp, Homo sapiens
tttcagaggaaatctcattgag

SEQ ID NO: 8573940 - DNA, 22 bp, Homo sapiens
tttcagaggaaatctcattgag

SEQ ID NO: 8573941 - DNA, 22 bp, Homo sapiens
tttcagaggaggaaggcagtta

SEQ ID NO: 8573942 - DNA, 22 bp, Homo sapiens
tttcagaggaggaaggcagtta

SEQ ID NO: 8573943 - DNA, 22 bp, Homo sapiens
tttcagagggcagatctggggc

SEQ ID NO: 8573944 - DNA, 22 bp, Homo sapiens
tttcagaggtatgctgcttatc

SEQ ID NO: 8573945 - DNA, 22 bp, Homo sapiens
tttcagaggtatgctgcttatc

SEQ ID NO: 8573946 - DNA, 22 bp, Homo sapiens
tttcagaggtatgctgcttatc

SEQ ID NO: 8573947 - DNA, 22 bp, Homo sapiens
tttcaaagcaactgaaaaggaa

SEQ ID NO: 8573948 - DNA, 22 bp, Homo sapiens
tttcaaagcaactgaaaaggaa

SEQ ID NO: 8573949 - DNA, 22 bp, Homo sapiens
tttcaaaggaggctgagaggat

SEQ ID NO: 8573950 - DNA, 22 bp, Homo sapiens
tttcaaagcaactgaaaaggaa

SEQ ID NO: 8573951 - DNA, 22 bp, Homo sapiens
tttcaaagacagccatatttgt

SEQ ID NO: 8573952 - DNA, 22 bp, Homo sapiens
tttcaaactttactcttgaatc

SEQ ID NO: 8573953 - DNA, 22 bp, Homo sapiens
tttcaaagaccattaactatca

SEQ ID NO: 8573954 - DNA, 22 bp, Homo sapiens
tttcaaagacagccatatttgt

SEQ ID NO: 8573955 - DNA, 22 bp, Homo sapiens
tttcaaagaccattaactatca

SEQ ID NO: 8573956 - DNA, 23 bp, Homo sapiens
tttcaaagactttcccttagagt

SEQ ID NO: 8573957 - DNA, 22 bp, Homo sapiens
tttcaggacacctttaaaaacg

SEQ ID NO: 8573958 - DNA, 22 bp, Homo sapiens
tttcaggaaggtgaggcacatg

SEQ ID NO: 8573959 - DNA, 22 bp, Homo sapiens
tttcaggaaacatttaatggca

SEQ ID NO: 8573960 - DNA, 22 bp, Homo sapiens
tttcagctggtaaaggagtagc

SEQ ID NO: 8573961 - DNA, 22 bp, Homo sapiens
tttcagccagtgatgctgaaga

SEQ ID NO: 8573962 - DNA, 22 bp, Homo sapiens
tttcaggattagtttaagcagg

SEQ ID NO: 8573963 - DNA, 22 bp, Homo sapiens
tttcaggattttatgagatagt

SEQ ID NO: 8573964 - DNA, 19 bp, Homo sapiens
tttcaggagctatgcaggg

SEQ ID NO: 8573965 - DNA, 22 bp, Homo sapiens
tttcagtgcacgtagtttattt

SEQ ID NO: 8573966 - DNA, 22 bp, Homo sapiens
tttcagtcatggattcactgag

SEQ ID NO: 8573967 - DNA, 22 bp, Homo sapiens
tttcagtcatgagttgttttca

SEQ ID NO: 8573968 - DNA, 22 bp, Homo sapiens
tttcagtctgtaaaggtgagga

SEQ ID NO: 8573969 - DNA, 22 bp, Homo sapiens
tttcagtcttattttgttgata

SEQ ID NO: 8573970 - DNA, 22 bp, Homo sapiens
tttcagggaagtgttgaaaagg

SEQ ID NO: 8573971 - DNA, 22 bp, Homo sapiens
tttcaggtaagaaaactaagaa

SEQ ID NO: 8573972 - DNA, 22 bp, Homo sapiens
tttcagatggaggtttaggaca

SEQ ID NO: 8573973 - DNA, 22 bp, Homo sapiens
tttcagccagtgatgctgaaga

SEQ ID NO: 8573974 - DNA, 23 bp, Homo sapiens
tttcagcattctagttcaggttc

SEQ ID NO: 8573975 - DNA, 22 bp, Homo sapiens
tttcagcactttaggcagcagg

SEQ ID NO: 8573976 - DNA, 23 bp, Homo sapiens
tttcagcattctagttcaggttc

SEQ ID NO: 8573977 - DNA, 22 bp, Homo sapiens
tttcagagttgtcttcttgacc

SEQ ID NO: 8573978 - DNA, 22 bp, Homo sapiens
tttcagatcattttttaagtac

SEQ ID NO: 8573979 - DNA, 22 bp, Homo sapiens
tttcagatcattttttaagtac

SEQ ID NO: 8573980 - DNA, 22 bp, Homo sapiens
tttcagatgcaattaattttca

SEQ ID NO: 8573981 - DNA, 22 bp, Homo sapiens
tttcagatgcaattaattttca

SEQ ID NO: 8573982 - DNA, 22 bp, Homo sapiens
tttctacatttgtaaccagatt

SEQ ID NO: 8573983 - DNA, 22 bp, Homo sapiens
tttctacatttgtaaccagatt

SEQ ID NO: 8573984 - DNA, 22 bp, Homo sapiens
tttctactaagaaagttgatta

SEQ ID NO: 8573985 - DNA, 22 bp, Homo sapiens
tttctacattcaaaaactacca

SEQ ID NO: 8573986 - DNA, 22 bp, Homo sapiens
tttctacattcaaaaactacca

SEQ ID NO: 8573987 - DNA, 22 bp, Homo sapiens
tttctacattcaaaaactacca

SEQ ID NO: 8573988 - DNA, 22 bp, Homo sapiens
tttctacattcaaaaactacca

SEQ ID NO: 8573989 - DNA, 22 bp, Homo sapiens
tttctacattcaaaaactacca

SEQ ID NO: 8573990 - DNA, 22 bp, Homo sapiens
tttctaatctttagttacaaaa

SEQ ID NO: 8573991 - DNA, 22 bp, Homo sapiens
tttctaatctgattctcctacc

SEQ ID NO: 8573992 - DNA, 22 bp, Homo sapiens
tttctaatctttagttacaaaa

SEQ ID NO: 8573993 - DNA, 22 bp, Homo sapiens
tttctaattctaactggcagag

SEQ ID NO: 8573994 - DNA, 22 bp, Homo sapiens
tttctaagtctgagggagtata

SEQ ID NO: 8573995 - DNA, 22 bp, Homo sapiens
tttctaagtatcttgcagtttt

SEQ ID NO: 8573996 - DNA, 22 bp, Homo sapiens
tttctaagtatcttgcagtttt

SEQ ID NO: 8573997 - DNA, 22 bp, Homo sapiens
tttctaagtaagattaacttct

SEQ ID NO: 8573998 - DNA, 22 bp, Homo sapiens
tttctaagtgtgattttagatt

SEQ ID NO: 8573999 - DNA, 22 bp, Homo sapiens
tttccttaaatctgtttctagt

SEQ ID NO: 8574000 - DNA, 22 bp, Homo sapiens
tttccttccctggatgagaagt

SEQ ID NO: 8574001 - DNA, 22 bp, Homo sapiens
tttccttctcagggagcttcaa

SEQ ID NO: 8574002 - DNA, 22 bp, Homo sapiens
tttccttctcagggagcttcaa

SEQ ID NO: 8574003 - DNA, 22 bp, Homo sapiens
tttcctggttggggacgtggtt

SEQ ID NO: 8574004 - DNA, 22 bp, Homo sapiens
tttcctggctctgtggccttgt

SEQ ID NO: 8574005 - DNA, 22 bp, Homo sapiens
tttcctggagggtccccagcag

SEQ ID NO: 8574006 - DNA, 22 bp, Homo sapiens
tttcctggagggtccccagcag

SEQ ID NO: 8574007 - DNA, 22 bp, Homo sapiens
tttcctgtgactaatctggaca

SEQ ID NO: 8574008 - DNA, 22 bp, Homo sapiens
tttcctgtgactaatctggaca

SEQ ID NO: 8574009 - DNA, 22 bp, Homo sapiens
tttcctgtcttttgtgaaggat

SEQ ID NO: 8574010 - DNA, 22 bp, Homo sapiens
tttcctgttgccatcaagaatg

SEQ ID NO: 8574011 - DNA, 22 bp, Homo sapiens
tttcctgttgccatcaagaatg

SEQ ID NO: 8574012 - DNA, 22 bp, Homo sapiens
tttcctgttctagttgttgcca

SEQ ID NO: 8574013 - DNA, 22 bp, Homo sapiens
tttcctctttgtgacacagctg

SEQ ID NO: 8574014 - DNA, 22 bp, Homo sapiens
tttcctctttgtaccttgacta

SEQ ID NO: 8574015 - DNA, 22 bp, Homo sapiens
tttcctctttgtaccttgacta

SEQ ID NO: 8574016 - DNA, 22 bp, Homo sapiens
tttctccaatgtatcagcacac

SEQ ID NO: 8574017 - DNA, 22 bp, Homo sapiens
tttctcatggacccttcatgat

SEQ ID NO: 8574018 - DNA, 22 bp, Homo sapiens
tttctcatttagagtggcaggg

SEQ ID NO: 8574019 - DNA, 22 bp, Homo sapiens
tttctcatggcccttggctttt

SEQ ID NO: 8574020 - DNA, 22 bp, Homo sapiens
tttctcatggaacatagctcct

SEQ ID NO: 8574021 - DNA, 22 bp, Homo sapiens
tttctcatggacccttcatgat

SEQ ID NO: 8574022 - DNA, 22 bp, Homo sapiens
tttctcatggaacatcgtttag

SEQ ID NO: 8574023 - DNA, 22 bp, Homo sapiens
tttctcatagtcatgcctctta

SEQ ID NO: 8574024 - DNA, 23 bp, Homo sapiens
tttctcatccagagagtcagtcc

SEQ ID NO: 8574025 - DNA, 23 bp, Homo sapiens
tttctcatccagagagtcagtcc

SEQ ID NO: 8574026 - DNA, 23 bp, Homo sapiens
tttctcatccagagagtcagtcc

SEQ ID NO: 8574027 - DNA, 22 bp, Homo sapiens
tttctcatctggaaacagtgct

SEQ ID NO: 8574028 - DNA, 22 bp, Homo sapiens
tttctcctccagagagacacag

SEQ ID NO: 8574029 - DNA, 22 bp, Homo sapiens
tttctcctcatgactggttgtg

SEQ ID NO: 8574030 - DNA, 22 bp, Homo sapiens
tttctcctcatgactggttgtg

SEQ ID NO: 8574031 - DNA, 22 bp, Homo sapiens
tttctcctaactcaaatttaag

SEQ ID NO: 8574032 - DNA, 22 bp, Homo sapiens
tttctccctccactacaggctc

SEQ ID NO: 8574033 - DNA, 22 bp, Homo sapiens
tttctatttacagtgctaggta

SEQ ID NO: 8574034 - DNA, 22 bp, Homo sapiens
tttctattgtaagtctcctata

SEQ ID NO: 8574035 - DNA, 22 bp, Homo sapiens
tttctattgtaagtctcctata

SEQ ID NO: 8574036 - DNA, 22 bp, Homo sapiens
tttctacttctcctgaatgtct

SEQ ID NO: 8574037 - DNA, 22 bp, Homo sapiens
tttctactcatcctttggagaa

SEQ ID NO: 8574038 - DNA, 22 bp, Homo sapiens
tttctcagtaatgtcctggaat

SEQ ID NO: 8574039 - DNA, 22 bp, Homo sapiens
tttctcagtaatgtcctggaat

SEQ ID NO: 8574040 - DNA, 22 bp, Homo sapiens
tttctcagtcacatgaaccaat

SEQ ID NO: 8574041 - DNA, 22 bp, Homo sapiens
tttctcagtcacatgaaccaat

SEQ ID NO: 8574042 - DNA, 22 bp, Homo sapiens
tttctcagctcagcatctgggt

SEQ ID NO: 8574043 - DNA, 22 bp, Homo sapiens
tttctcagttactagctgtggt

SEQ ID NO: 8574044 - DNA, 22 bp, Homo sapiens
tttctcagttactagctgtggt

SEQ ID NO: 8574045 - DNA, 22 bp, Homo sapiens
tttcttcctaaatatgatttcc

SEQ ID NO: 8574046 - DNA, 22 bp, Homo sapiens
tttcttcctatgtatcttgctg

SEQ ID NO: 8574047 - DNA, 22 bp, Homo sapiens
tttcttccttaccttactagag

SEQ ID NO: 8574048 - DNA, 22 bp, Homo sapiens
tttcttcctggattcctacttc

SEQ ID NO: 8574049 - DNA, 22 bp, Homo sapiens
tttcttccttaccttactagag

SEQ ID NO: 8574050 - DNA, 22 bp, Homo sapiens
tttcttccttaccttactagag

SEQ ID NO: 8574051 - DNA, 22 bp, Homo sapiens
tttcttctaagatttcaaacta

SEQ ID NO: 8574052 - DNA, 22 bp, Homo sapiens
tttcttctaagatttcaaacta

SEQ ID NO: 8574053 - DNA, 22 bp, Homo sapiens
tttcttctaagatttcaaacta

SEQ ID NO: 8574054 - DNA, 22 bp, Homo sapiens
tttcttctaggactaataagag

SEQ ID NO: 8574055 - DNA, 22 bp, Homo sapiens
tttcttctaggactaataagag

SEQ ID NO: 8574056 - DNA, 22 bp, Homo sapiens
tttcttctccatggcaggtcct

SEQ ID NO: 8574057 - DNA, 22 bp, Homo sapiens
tttcttctcatccctgaaatca

SEQ ID NO: 8574058 - DNA, 22 bp, Homo sapiens
tttcttctcatccctgaaatca

SEQ ID NO: 8574059 - DNA, 22 bp, Homo sapiens
tttcttctcgacaccttatccc

SEQ ID NO: 8574060 - DNA, 22 bp, Homo sapiens
tttcttctcgacaccttatccc

SEQ ID NO: 8574061 - DNA, 22 bp, Homo sapiens
tttcttctcgacaccttatccc

SEQ ID NO: 8574062 - DNA, 22 bp, Homo sapiens
tttcttctcacccaggacagag

SEQ ID NO: 8574063 - DNA, 22 bp, Homo sapiens
tttcttctcatccctgaaatca

SEQ ID NO: 8574064 - DNA, 22 bp, Homo sapiens
tttcttctcacccaggacagag

SEQ ID NO: 8574065 - DNA, 22 bp, Homo sapiens
tttcttctatgtgtgatatttt

SEQ ID NO: 8574066 - DNA, 22 bp, Homo sapiens
tttcttctatgtgtgatatttt

SEQ ID NO: 8574067 - DNA, 22 bp, Homo sapiens
tttcttgtaagatgtttattaa

SEQ ID NO: 8574068 - DNA, 22 bp, Homo sapiens
tttcttgtaagatgtttattaa

SEQ ID NO: 8574069 - DNA, 20 bp, Homo sapiens
tttcttgtacttggagaagg

SEQ ID NO: 8574070 - DNA, 20 bp, Homo sapiens
tttcttgtacttggagaagg

SEQ ID NO: 8574071 - DNA, 20 bp, Homo sapiens
tttcttgtcggctgttgctg

SEQ ID NO: 8574072 - DNA, 20 bp, Homo sapiens
tttcttgtcggctgttgctg

SEQ ID NO: 8574073 - DNA, 20 bp, Homo sapiens
tttcttgtcggctgttgctg

SEQ ID NO: 8574074 - DNA, 22 bp, Homo sapiens
tttcttctctgattaaggctca

SEQ ID NO: 8574075 - DNA, 22 bp, Homo sapiens
tttcttctctgattaaggctca

SEQ ID NO: 8574076 - DNA, 22 bp, Homo sapiens
tttcttctgagatcagggagaa

SEQ ID NO: 8574077 - DNA, 22 bp, Homo sapiens
tttcttctctaatctcaatgat

SEQ ID NO: 8574078 - DNA, 22 bp, Homo sapiens
tttcttctctaatctcaatgat

SEQ ID NO: 8574079 - DNA, 22 bp, Homo sapiens
tttcttctctaatctcaatgat

SEQ ID NO: 8574080 - DNA, 22 bp, Homo sapiens
tttcttctctgattaaggctca

SEQ ID NO: 8574081 - DNA, 22 bp, Homo sapiens
tttctttatcatagcatctttg

SEQ ID NO: 8574082 - DNA, 22 bp, Homo sapiens
tttctttaattctcacagcaat

SEQ ID NO: 8574083 - DNA, 22 bp, Homo sapiens
tttctttatcatagcatctttg

SEQ ID NO: 8574084 - DNA, 22 bp, Homo sapiens
tttctttatcatagcatctttg

SEQ ID NO: 8574085 - DNA, 22 bp, Homo sapiens
tttctttatcatagcatctttg

SEQ ID NO: 8574086 - DNA, 22 bp, Homo sapiens
tttctttatcatagcatctttg

SEQ ID NO: 8574087 - DNA, 22 bp, Homo sapiens
tttctttatcatagcatctttg

SEQ ID NO: 8574088 - DNA, 22 bp, Homo sapiens
tttctttaattctcacagcaat

SEQ ID NO: 8574089 - DNA, 22 bp, Homo sapiens
tttctttaattctcacagcaat

SEQ ID NO: 8574090 - DNA, 22 bp, Homo sapiens
tttcttgtctttagtatctggc

SEQ ID NO: 8574091 - DNA, 22 bp, Homo sapiens
tttcttgtttcatggtgtctca

SEQ ID NO: 8574092 - DNA, 22 bp, Homo sapiens
tttcttgtttcatggtgtctca

SEQ ID NO: 8574093 - DNA, 22 bp, Homo sapiens
tttctgttaggcatcattttaa

SEQ ID NO: 8574094 - DNA, 22 bp, Homo sapiens
tttctgttaggcatcattttaa

SEQ ID NO: 8574095 - DNA, 22 bp, Homo sapiens
tttctgttaggcatcattttaa

SEQ ID NO: 8574096 - DNA, 22 bp, Homo sapiens
tttctgtggtgggtagttcaga

SEQ ID NO: 8574097 - DNA, 19 bp, Homo sapiens
tttctgttagaaggataca

SEQ ID NO: 8574098 - DNA, 23 bp, Homo sapiens
tttctgttgggtatatatccaag

SEQ ID NO: 8574099 - DNA, 23 bp, Homo sapiens
tttctgttgggtatatatccaag

SEQ ID NO: 8574100 - DNA, 23 bp, Homo sapiens
tttctgttgggtatatatccaag

SEQ ID NO: 8574101 - DNA, 22 bp, Homo sapiens
tttctgttgtacttaaactagg

SEQ ID NO: 8574102 - DNA, 20 bp, Homo sapiens
tttctgtgagaaacactgtt

SEQ ID NO: 8574103 - DNA, 20 bp, Homo sapiens
tttctgtgaggactgtactg

SEQ ID NO: 8574104 - DNA, 20 bp, Homo sapiens
tttctgtgagaaacactgtt

SEQ ID NO: 8574105 - DNA, 20 bp, Homo sapiens
tttctgtgcccaggtctgtt

SEQ ID NO: 8574106 - DNA, 19 bp, Homo sapiens
tttctgtctgtgttttgcc

SEQ ID NO: 8574107 - DNA, 21 bp, Homo sapiens
tttctgtctctgccactagtt

SEQ ID NO: 8574108 - DNA, 22 bp, Homo sapiens
tttctgtagtgtggtatgtagg

SEQ ID NO: 8574109 - DNA, 22 bp, Homo sapiens
tttctgtatttaaaagatctgg

SEQ ID NO: 8574110 - DNA, 22 bp, Homo sapiens
tttctgtcatagttatctttgt

SEQ ID NO: 8574111 - DNA, 22 bp, Homo sapiens
tttcttatggggtagtccttta

SEQ ID NO: 8574112 - DNA, 22 bp, Homo sapiens
tttcttatgtgcagagtgagta

SEQ ID NO: 8574113 - DNA, 22 bp, Homo sapiens
tttcttcacagggtattgggtg

SEQ ID NO: 8574114 - DNA, 22 bp, Homo sapiens
tttcttcagccttcacaacctg

SEQ ID NO: 8574115 - DNA, 22 bp, Homo sapiens
tttcttcatagaccttgtcttg

SEQ ID NO: 8574116 - DNA, 22 bp, Homo sapiens
tttcttccaaaggcacgttctc

SEQ ID NO: 8574117 - DNA, 19 bp, Homo sapiens
tttcttccaaagactatgg

SEQ ID NO: 8574118 - DNA, 21 bp, Homo sapiens
tttcttcccttggcttctgag

SEQ ID NO: 8574119 - DNA, 22 bp, Homo sapiens
tttctggcagcgggacaggggt

SEQ ID NO: 8574120 - DNA, 22 bp, Homo sapiens
tttctgggtttatgtcacagct

SEQ ID NO: 8574121 - DNA, 21 bp, Homo sapiens
tttctgggtggctgcatagtg

SEQ ID NO: 8574122 - DNA, 21 bp, Homo sapiens
tttctgggtggctgcatagtg

SEQ ID NO: 8574123 - DNA, 21 bp, Homo sapiens
tttctgggtggctgcatagtg

SEQ ID NO: 8574124 - DNA, 22 bp, Homo sapiens
tttctgtaagtggcaaataatg

SEQ ID NO: 8574125 - DNA, 22 bp, Homo sapiens
tttctgtaattaaaagggcagg

SEQ ID NO: 8574126 - DNA, 22 bp, Homo sapiens
tttctgctgtgctttcttgcgt

SEQ ID NO: 8574127 - DNA, 22 bp, Homo sapiens
tttctgctcgctctcaatcagg

SEQ ID NO: 8574128 - DNA, 22 bp, Homo sapiens
tttctgcttaggactctgtgga

SEQ ID NO: 8574129 - DNA, 22 bp, Homo sapiens
tttctgcttaggactctgtgga

SEQ ID NO: 8574130 - DNA, 17 bp, Homo sapiens
tttctggaatgggcaaa

SEQ ID NO: 8574131 - DNA, 22 bp, Homo sapiens
tttctggaacagtaattgaaga

SEQ ID NO: 8574132 - DNA, 22 bp, Homo sapiens
tttctggaaactgtaaagagga

SEQ ID NO: 8574133 - DNA, 22 bp, Homo sapiens
tttctgaagtcttctaacagat

SEQ ID NO: 8574134 - DNA, 22 bp, Homo sapiens
tttctgaaggttaaggaattag

SEQ ID NO: 8574135 - DNA, 22 bp, Homo sapiens
tttctgaagtcttctaacagat

SEQ ID NO: 8574136 - DNA, 23 bp, Homo sapiens
tttctgaagttgagatggacttt

SEQ ID NO: 8574137 - DNA, 22 bp, Homo sapiens
tttctgaataactctatgatat

SEQ ID NO: 8574138 - DNA, 22 bp, Homo sapiens
tttctgataattttgtgaaatc

SEQ ID NO: 8574139 - DNA, 22 bp, Homo sapiens
tttctgcatctctacagttgtt

SEQ ID NO: 8574140 - DNA, 17 bp, Homo sapiens
tttctgcatgattggac

SEQ ID NO: 8574141 - DNA, 22 bp, Homo sapiens
tttctgaggaattaatacagaa

SEQ ID NO: 8574142 - DNA, 22 bp, Homo sapiens
tttctgagaaattaaacacttt

SEQ ID NO: 8574143 - DNA, 22 bp, Homo sapiens
tttctgaggaattaatacagaa

SEQ ID NO: 8574144 - DNA, 22 bp, Homo sapiens
tttctgagaaattaaacacttt

SEQ ID NO: 8574145 - DNA, 22 bp, Homo sapiens
tttctgacacatcagttgtaaa

SEQ ID NO: 8574146 - DNA, 22 bp, Homo sapiens
tttctgccaaccatttaaactc

SEQ ID NO: 8574147 - DNA, 22 bp, Homo sapiens
tttctgctcatcctagtggagc

SEQ ID NO: 8574148 - DNA, 22 bp, Homo sapiens
tttctgctaatcttttactgag

SEQ ID NO: 8574149 - DNA, 22 bp, Homo sapiens
tttctctgttctctaactgtaa

SEQ ID NO: 8574150 - DNA, 22 bp, Homo sapiens
tttctctgttctctaactgtaa

SEQ ID NO: 8574151 - DNA, 22 bp, Homo sapiens
tttctctgtgccatttccataa

SEQ ID NO: 8574152 - DNA, 22 bp, Homo sapiens
tttctctgtgggctttatgcat

SEQ ID NO: 8574153 - DNA, 22 bp, Homo sapiens
tttctcttaatgtctctgtgct

SEQ ID NO: 8574154 - DNA, 22 bp, Homo sapiens
tttctcttaatgtctctgtgct

SEQ ID NO: 8574155 - DNA, 22 bp, Homo sapiens
tttctcttaatgtctctgtgct

SEQ ID NO: 8574156 - DNA, 22 bp, Homo sapiens
tttctcttaatgtctctgtgct

SEQ ID NO: 8574157 - DNA, 22 bp, Homo sapiens
tttctcggcagagatgatgggc

SEQ ID NO: 8574158 - DNA, 22 bp, Homo sapiens
tttctcggcagagatgatgggc

SEQ ID NO: 8574159 - DNA, 22 bp, Homo sapiens
tttctctaaatagggaggctta

SEQ ID NO: 8574160 - DNA, 19 bp, Homo sapiens
tttctctgtgcaccttttc

SEQ ID NO: 8574161 - DNA, 22 bp, Homo sapiens
tttctctgtgccatttccataa

SEQ ID NO: 8574162 - DNA, 22 bp, Homo sapiens
tttctctgggctgttggcagcc

SEQ ID NO: 8574163 - DNA, 22 bp, Homo sapiens
tttctctgggcactctccaaac

SEQ ID NO: 8574164 - DNA, 22 bp, Homo sapiens
tttctcctctccagagtgcagt

SEQ ID NO: 8574165 - DNA, 17 bp, Homo sapiens
tttctccttccatctca

SEQ ID NO: 8574166 - DNA, 22 bp, Homo sapiens
tttctccttgtgtctcctttga

SEQ ID NO: 8574167 - DNA, 22 bp, Homo sapiens
tttctctttgacaggaatcaga

SEQ ID NO: 8574168 - DNA, 22 bp, Homo sapiens
tttctctttgacaggaatcaga

SEQ ID NO: 8574169 - DNA, 22 bp, Homo sapiens
tttctctttcaatctgcagtac

SEQ ID NO: 8574170 - DNA, 22 bp, Homo sapiens
tttctctttcaatctgcagtac

SEQ ID NO: 8574171 - DNA, 22 bp, Homo sapiens
tttctctttcaatctgcagtac

SEQ ID NO: 8574172 - DNA, 22 bp, Homo sapiens
tttctcttcactgtgtgcctca

SEQ ID NO: 8574173 - DNA, 22 bp, Homo sapiens
tttctgaacttggtactggagc

SEQ ID NO: 8574174 - DNA, 22 bp, Homo sapiens
tttctgaaatctcttttgagga

SEQ ID NO: 8574175 - DNA, 22 bp, Homo sapiens
tttctgaacttggtactggagc

SEQ ID NO: 8574176 - DNA, 22 bp, Homo sapiens
ttttgatatcatgatgaacaga

SEQ ID NO: 8574177 - DNA, 22 bp, Homo sapiens
ttttgatatcatgatgaacaga

SEQ ID NO: 8574178 - DNA, 22 bp, Homo sapiens
ttttgcagaatgggaaggtagt

SEQ ID NO: 8574179 - DNA, 22 bp, Homo sapiens
ttttgcatctggtgaagaccag

SEQ ID NO: 8574180 - DNA, 22 bp, Homo sapiens
ttttgcagccacatctgacctg

SEQ ID NO: 8574181 - DNA, 22 bp, Homo sapiens
ttttggaatttatacagtaatg

SEQ ID NO: 8574182 - DNA, 19 bp, Homo sapiens
ttttgaagtatgagacagg

SEQ ID NO: 8574183 - DNA, 22 bp, Homo sapiens
ttttgaagaagatgggaattta

SEQ ID NO: 8574184 - DNA, 23 bp, Homo sapiens
ttttgacaggaggaaggtgttga

SEQ ID NO: 8574185 - DNA, 22 bp, Homo sapiens
ttttgaataattcagaaacagc

SEQ ID NO: 8574186 - DNA, 22 bp, Homo sapiens
ttttgaaagagtcctgctacag

SEQ ID NO: 8574187 - DNA, 22 bp, Homo sapiens
ttttgaaagccaggtttgtatg

SEQ ID NO: 8574188 - DNA, 22 bp, Homo sapiens
ttttgaaagccaggtttgtatg

SEQ ID NO: 8574189 - DNA, 22 bp, Homo sapiens
ttttgaaagccaggtttgtatg

SEQ ID NO: 8574190 - DNA, 22 bp, Homo sapiens
ttttgaaagggtgatttggctt

SEQ ID NO: 8574191 - DNA, 22 bp, Homo sapiens
ttttgaaagccaggtttgtatg

SEQ ID NO: 8574192 - DNA, 22 bp, Homo sapiens
ttttgaaagggtgatttggctt

SEQ ID NO: 8574193 - DNA, 22 bp, Homo sapiens
ttttgaaagggtgatttggctt

SEQ ID NO: 8574194 - DNA, 22 bp, Homo sapiens
tttttcctagtgctttctggta

SEQ ID NO: 8574195 - DNA, 20 bp, Homo sapiens
tttttccttctctacaggca

SEQ ID NO: 8574196 - DNA, 22 bp, Homo sapiens
tttttcctagcgatttgtcagc

SEQ ID NO: 8574197 - DNA, 22 bp, Homo sapiens
tttttcctagcgatttgtcagc

SEQ ID NO: 8574198 - DNA, 22 bp, Homo sapiens
tttttccagggttagatgttta

SEQ ID NO: 8574199 - DNA, 22 bp, Homo sapiens
tttttcattgcagcctctctcc

SEQ ID NO: 8574200 - DNA, 22 bp, Homo sapiens
ttttggcactgcgtctacatgg

SEQ ID NO: 8574201 - DNA, 22 bp, Homo sapiens
ttttggccacatccttttgagt

SEQ ID NO: 8574202 - DNA, 22 bp, Homo sapiens
tttttcatgagactagaagtca

SEQ ID NO: 8574203 - DNA, 22 bp, Homo sapiens
tttttcatgagactagaagtca

SEQ ID NO: 8574204 - DNA, 22 bp, Homo sapiens
tttttcatgagactagaagtca

SEQ ID NO: 8574205 - DNA, 22 bp, Homo sapiens
tttttcatgagactagaagtca

SEQ ID NO: 8574206 - DNA, 22 bp, Homo sapiens
tttttcattgcagcctctctcc

SEQ ID NO: 8574207 - DNA, 22 bp, Homo sapiens
ttttctaacatctagtaatttg

SEQ ID NO: 8574208 - DNA, 22 bp, Homo sapiens
ttttctaacatctagtaatttg

SEQ ID NO: 8574209 - DNA, 22 bp, Homo sapiens
ttttctaacatctagtaatttg

SEQ ID NO: 8574210 - DNA, 23 bp, Homo sapiens
ttttcctttggacaggctgtatt

SEQ ID NO: 8574211 - DNA, 23 bp, Homo sapiens
ttttcctttggacaggctgtatt

SEQ ID NO: 8574212 - DNA, 22 bp, Homo sapiens
ttttcctttggaagatgcatat

SEQ ID NO: 8574213 - DNA, 22 bp, Homo sapiens
ttttcttctacctgctgtccaa

SEQ ID NO: 8574214 - DNA, 22 bp, Homo sapiens
ttttcttggagtggctgtcctt

SEQ ID NO: 8574215 - DNA, 22 bp, Homo sapiens
ttttctattaactcattttgca

SEQ ID NO: 8574216 - DNA, 22 bp, Homo sapiens
ttttcttggagtggctgtcctt

SEQ ID NO: 8574217 - DNA, 22 bp, Homo sapiens
ttttctttaatctggtggggtg

SEQ ID NO: 8574218 - DNA, 22 bp, Homo sapiens
ttttctttaatctggtggggtg

SEQ ID NO: 8574219 - DNA, 22 bp, Homo sapiens
ttttctttaatctggtggggtg

SEQ ID NO: 8574220 - DNA, 22 bp, Homo sapiens
ttttctattaactcattttgca

SEQ ID NO: 8574221 - DNA, 22 bp, Homo sapiens
ttttctattaactcattttgca

SEQ ID NO: 8574222 - DNA, 22 bp, Homo sapiens
ttttctatctcctagaactgcc

SEQ ID NO: 8574223 - DNA, 22 bp, Homo sapiens
ttttctaatttagttaccctcc

SEQ ID NO: 8574224 - DNA, 22 bp, Homo sapiens
ttttctaagggaaacgtcctcc

SEQ ID NO: 8574225 - DNA, 22 bp, Homo sapiens
ttttatctacctatgctcattt

SEQ ID NO: 8574226 - DNA, 22 bp, Homo sapiens
ttttatctacctatgctcattt

SEQ ID NO: 8574227 - DNA, 22 bp, Homo sapiens
ttttatctacctatgctcattt

SEQ ID NO: 8574228 - DNA, 22 bp, Homo sapiens
ttttatctacctatgctcattt

SEQ ID NO: 8574229 - DNA, 22 bp, Homo sapiens
ttttatctacctatgctcattt

SEQ ID NO: 8574230 - DNA, 22 bp, Homo sapiens
ttttatctgcttcattagttga

SEQ ID NO: 8574231 - DNA, 22 bp, Homo sapiens
ttttatctgcttcattagttga

SEQ ID NO: 8574232 - DNA, 22 bp, Homo sapiens
ttttatctgtgacatctggcag

SEQ ID NO: 8574233 - DNA, 19 bp, Homo sapiens
ttttccttctcctcttaat

SEQ ID NO: 8574234 - DNA, 22 bp, Homo sapiens
ttttatcttcattcctatctac

SEQ ID NO: 8574235 - DNA, 22 bp, Homo sapiens
ttttatcttcattcctatctac

SEQ ID NO: 8574236 - DNA, 22 bp, Homo sapiens
ttttatcttcattcctatctac

SEQ ID NO: 8574237 - DNA, 22 bp, Homo sapiens
ttttatgaagataattttctga

SEQ ID NO: 8574238 - DNA, 22 bp, Homo sapiens
ttttcctttcatcaggacaaag

SEQ ID NO: 8574239 - DNA, 22 bp, Homo sapiens
ttttcctttcatcaggacaaag

SEQ ID NO: 8574240 - DNA, 22 bp, Homo sapiens
ttttcctttgaaaggtgagggc

SEQ ID NO: 8574241 - DNA, 22 bp, Homo sapiens
ttttcctttcatcaggacaaag

SEQ ID NO: 8574242 - DNA, 22 bp, Homo sapiens
ttttcctttgaaaggtgagggc

SEQ ID NO: 8574243 - DNA, 22 bp, Homo sapiens
ttttcctttgattcccagatgt

SEQ ID NO: 8574244 - DNA, 22 bp, Homo sapiens
ttttccttctgatactccattt

SEQ ID NO: 8574245 - DNA, 22 bp, Homo sapiens
ttttccttctgatactccattt

SEQ ID NO: 8574246 - DNA, 20 bp, Homo sapiens
ttttccttctgagtatgttg

SEQ ID NO: 8574247 - DNA, 22 bp, Homo sapiens
ttttttgtcttgaagaaatggt

SEQ ID NO: 8574248 - DNA, 22 bp, Homo sapiens
ttttttgtcttgaagaaatggt

SEQ ID NO: 8574249 - DNA, 22 bp, Homo sapiens
ttttttgtcttgaagaaatggt

SEQ ID NO: 8574250 - DNA, 22 bp, Homo sapiens
tttttgtagtcattagaagagg

SEQ ID NO: 8574251 - DNA, 22 bp, Homo sapiens
ttttttgtcccagagagcctgg

SEQ ID NO: 8574252 - DNA, 22 bp, Homo sapiens
tttttgcaccaacctaatagaa

SEQ ID NO: 8574253 - DNA, 22 bp, Homo sapiens
tttttgggtccaggctgtatct

SEQ ID NO: 8574254 - DNA, 22 bp, Homo sapiens
tttttgggtccaggctgtatct

SEQ ID NO: 8574255 - DNA, 22 bp, Homo sapiens
tttttgaaggctgatgtgatta

SEQ ID NO: 8574256 - DNA, 22 bp, Homo sapiens
tttttgaaggctgatgtgatta

SEQ ID NO: 8574257 - DNA, 22 bp, Homo sapiens
tttttgaaggctgatgtgatta

SEQ ID NO: 8574258 - DNA, 22 bp, Homo sapiens
tttttgatactcaagaggggta

SEQ ID NO: 8574259 - DNA, 22 bp, Homo sapiens
tttttgaaggctgatgtgatta

SEQ ID NO: 8574260 - DNA, 23 bp, Homo sapiens
ttttttgtcttgctaggctgccc

SEQ ID NO: 8574261 - DNA, 22 bp, Homo sapiens
ttttatcagcagggataacaag

SEQ ID NO: 8574262 - DNA, 22 bp, Homo sapiens
ttttatcaatcattaagacatt

SEQ ID NO: 8574263 - DNA, 22 bp, Homo sapiens
ttttatcagcagggataacaag

SEQ ID NO: 8574264 - DNA, 22 bp, Homo sapiens
ttttatcagcagggataacaag

SEQ ID NO: 8574265 - DNA, 22 bp, Homo sapiens
ttttatcaatcattaagacatt

SEQ ID NO: 8574266 - DNA, 22 bp, Homo sapiens
ttttatcaatcattaagacatt

SEQ ID NO: 8574267 - DNA, 22 bp, Homo sapiens
ttttatcaatcattaagacatt

SEQ ID NO: 8574268 - DNA, 22 bp, Homo sapiens
ttttatcaatcattaagacatt

SEQ ID NO: 8574269 - DNA, 22 bp, Homo sapiens
ttttatcaatcattaagacatt

SEQ ID NO: 8574270 - DNA, 20 bp, Homo sapiens
ttttatatgtagggtatatg

SEQ ID NO: 8574271 - DNA, 22 bp, Homo sapiens
ttttatatggcacattggttgg

SEQ ID NO: 8574272 - DNA, 22 bp, Homo sapiens
ttttatatggcacattggttgg

SEQ ID NO: 8574273 - DNA, 22 bp, Homo sapiens
ttttatatggcacattggttgg

SEQ ID NO: 8574274 - DNA, 22 bp, Homo sapiens
ttttatattgagtgagagttcc

SEQ ID NO: 8574275 - DNA, 22 bp, Homo sapiens
ttttatattgagtgagagttcc

SEQ ID NO: 8574276 - DNA, 22 bp, Homo sapiens
ttttataaagagagtcagttgg

SEQ ID NO: 8574277 - DNA, 22 bp, Homo sapiens
ttttagtttggatttctaaagc

SEQ ID NO: 8574278 - DNA, 22 bp, Homo sapiens
ttttataaagagagtcagttgg

SEQ ID NO: 8574279 - DNA, 22 bp, Homo sapiens
ttttataaagagagtcagttgg

SEQ ID NO: 8574280 - DNA, 22 bp, Homo sapiens
ttttagtttggatttctaaagc

SEQ ID NO: 8574281 - DNA, 22 bp, Homo sapiens
ttttagtttggatttctaaagc

SEQ ID NO: 8574282 - DNA, 22 bp, Homo sapiens
ttttagaagttcatgtgggatt

SEQ ID NO: 8574283 - DNA, 22 bp, Homo sapiens
ttttataagcaagaaagggaaa

SEQ ID NO: 8574284 - DNA, 22 bp, Homo sapiens
tttgtttagatggtaaatcagt

SEQ ID NO: 8574285 - DNA, 22 bp, Homo sapiens
tttgtttagaaagagattggtg

SEQ ID NO: 8574286 - DNA, 22 bp, Homo sapiens
tttgtttgccacacaaaacagt

SEQ ID NO: 8574287 - DNA, 22 bp, Homo sapiens
tttgttttcaatgtgtcattca

SEQ ID NO: 8574288 - DNA, 22 bp, Homo sapiens
tttgttttcaatgtgtcattca

SEQ ID NO: 8574289 - DNA, 22 bp, Homo sapiens
tttgttttcaatgtgtcattca

SEQ ID NO: 8574290 - DNA, 22 bp, Homo sapiens
ttttagaagtgcctatcctatg

SEQ ID NO: 8574291 - DNA, 22 bp, Homo sapiens
ttttaaactatagctggatgct

SEQ ID NO: 8574292 - DNA, 22 bp, Homo sapiens
ttttagaagttcacttgggttt

SEQ ID NO: 8574293 - DNA, 22 bp, Homo sapiens
ttttagaagtgcctatcctatg

SEQ ID NO: 8574294 - DNA, 22 bp, Homo sapiens
tttgttttgaactagctcagaa

SEQ ID NO: 8574295 - DNA, 22 bp, Homo sapiens
tttgttttgaactagctcagaa

SEQ ID NO: 8574296 - DNA, 22 bp, Homo sapiens
tttgttttgaactagctcagaa

SEQ ID NO: 8574297 - DNA, 22 bp, Homo sapiens
tttgttttctgtaggcctttcc

SEQ ID NO: 8574298 - DNA, 22 bp, Homo sapiens
tttgttttgaactagctcagaa

SEQ ID NO: 8574299 - DNA, 22 bp, Homo sapiens
tttgttttcaatgtgtcattca

SEQ ID NO: 8574300 - DNA, 22 bp, Homo sapiens
tttgttttcaatgtgtcattca

SEQ ID NO: 8574301 - DNA, 22 bp, Homo sapiens
tttgttttcaatgtgtcattca

SEQ ID NO: 8574302 - DNA, 22 bp, Homo sapiens
tttgttcactgagcaatgatta

SEQ ID NO: 8574303 - DNA, 23 bp, Homo sapiens
tttgttcactcctgggaaagaca

SEQ ID NO: 8574304 - DNA, 22 bp, Homo sapiens
tttgtcagtcatgtctgctttt

SEQ ID NO: 8574305 - DNA, 22 bp, Homo sapiens
tttgttcacctagcaaactttt

SEQ ID NO: 8574306 - DNA, 22 bp, Homo sapiens
tttgttcacctagcaaactttt

SEQ ID NO: 8574307 - DNA, 22 bp, Homo sapiens
tttgtattccatatcatgccat

SEQ ID NO: 8574308 - DNA, 22 bp, Homo sapiens
tttgtatttttcccagctagct

SEQ ID NO: 8574309 - DNA, 20 bp, Homo sapiens
tttgtcaactgcatccagca

SEQ ID NO: 8574310 - DNA, 22 bp, Homo sapiens
tttgtcaagtttgcaaatacgt

SEQ ID NO: 8574311 - DNA, 22 bp, Homo sapiens
tttgtcaatcccttgaaaacct

SEQ ID NO: 8574312 - DNA, 22 bp, Homo sapiens
tttgtcaccagtggctttggta

SEQ ID NO: 8574313 - DNA, 22 bp, Homo sapiens
tttgttgtgaacagaataatat

SEQ ID NO: 8574314 - DNA, 22 bp, Homo sapiens
tttgtttactcattcattgatg

SEQ ID NO: 8574315 - DNA, 22 bp, Homo sapiens
tttgtttactcattcattgatg

SEQ ID NO: 8574316 - DNA, 22 bp, Homo sapiens
tttgtttactcattcattgatg

SEQ ID NO: 8574317 - DNA, 22 bp, Homo sapiens
tttgtttacaaaaataagcagt

SEQ ID NO: 8574318 - DNA, 18 bp, Homo sapiens
tttgttgggttgccttta

SEQ ID NO: 8574319 - DNA, 22 bp, Homo sapiens
tttgttgagttacagagatgaa

SEQ ID NO: 8574320 - DNA, 22 bp, Homo sapiens
tttgttgacatccctgtacttt

SEQ ID NO: 8574321 - DNA, 22 bp, Homo sapiens
tttgttgagttacagagatgaa

SEQ ID NO: 8574322 - DNA, 22 bp, Homo sapiens
tttgttctgcatcacagaaaaa

SEQ ID NO: 8574323 - DNA, 22 bp, Homo sapiens
tttgttcttagtatctgtgtgc

SEQ ID NO: 8574324 - DNA, 22 bp, Homo sapiens
tttgtataagaacattctagca

SEQ ID NO: 8574325 - DNA, 22 bp, Homo sapiens
tttgtagcagcatgatttataa

SEQ ID NO: 8574326 - DNA, 22 bp, Homo sapiens
tttgtagcagcatgatttataa

SEQ ID NO: 8574327 - DNA, 22 bp, Homo sapiens
tttgtatgaactggtatgtagg

SEQ ID NO: 8574328 - DNA, 22 bp, Homo sapiens
tttgtatgggcagaaattagat

SEQ ID NO: 8574329 - DNA, 22 bp, Homo sapiens
tttgtatgaactggtatgtagg

SEQ ID NO: 8574330 - DNA, 22 bp, Homo sapiens
tttgtatgtgataagactattc

SEQ ID NO: 8574331 - DNA, 22 bp, Homo sapiens
tttgtatgtgataagactattc

SEQ ID NO: 8574332 - DNA, 22 bp, Homo sapiens
tttgtatgtgataagactattc

SEQ ID NO: 8574333 - DNA, 22 bp, Homo sapiens
tttgtattacaaagtcacagta

SEQ ID NO: 8574334 - DNA, 22 bp, Homo sapiens
tttgtattacaaagtcacagta

SEQ ID NO: 8574335 - DNA, 22 bp, Homo sapiens
tttgtacatttcactccattgt

SEQ ID NO: 8574336 - DNA, 22 bp, Homo sapiens
tttgtacatttcactccattgt

SEQ ID NO: 8574337 - DNA, 22 bp, Homo sapiens
tttgtagacgtcagaagttact

SEQ ID NO: 8574338 - DNA, 22 bp, Homo sapiens
tttgtagaactgtagaacaatg

SEQ ID NO: 8574339 - DNA, 22 bp, Homo sapiens
tttgtagaactatacttacatt

SEQ ID NO: 8574340 - DNA, 22 bp, Homo sapiens
tttgtagaactgtagaacaatg

SEQ ID NO: 8574341 - DNA, 22 bp, Homo sapiens
tttgtagactaccagtaattgt

SEQ ID NO: 8574342 - DNA, 22 bp, Homo sapiens
tttgtagagaataaaacaaatt

SEQ ID NO: 8574343 - DNA, 22 bp, Homo sapiens
tttgtagagggtaattgacaga

SEQ ID NO: 8574344 - DNA, 22 bp, Homo sapiens
tttgtagagggtaattgacaga

SEQ ID NO: 8574345 - DNA, 22 bp, Homo sapiens
tttgtagatagaaaaatgatta

SEQ ID NO: 8574346 - DNA, 22 bp, Homo sapiens
tttgcagaagaaaacatgaaca

SEQ ID NO: 8574347 - DNA, 22 bp, Homo sapiens
tttgcacacattcttagaaatg

SEQ ID NO: 8574348 - DNA, 22 bp, Homo sapiens
tttgcacacacaataacaaatg

SEQ ID NO: 8574349 - DNA, 22 bp, Homo sapiens
tttgcagagtgcagaagcatct

SEQ ID NO: 8574350 - DNA, 22 bp, Homo sapiens
tttgcagcaaggagagagcatt

SEQ ID NO: 8574351 - DNA, 22 bp, Homo sapiens
tttgcagcaaggagagagcatt

SEQ ID NO: 8574352 - DNA, 20 bp, Homo sapiens
tttgcaggaaggaaataggt

SEQ ID NO: 8574353 - DNA, 22 bp, Homo sapiens
tttgcagtcaaatttgctaaat

SEQ ID NO: 8574354 - DNA, 22 bp, Homo sapiens
tttgcagtagacatcttatttt

SEQ ID NO: 8574355 - DNA, 22 bp, Homo sapiens
tttgcagtagacatcttatttt

SEQ ID NO: 8574356 - DNA, 22 bp, Homo sapiens
tttgcaatttgtgctgcaaatg

SEQ ID NO: 8574357 - DNA, 22 bp, Homo sapiens
tttgcaatttgtgctgcaaatg

SEQ ID NO: 8574358 - DNA, 22 bp, Homo sapiens
tttgcaaatttcgtctcctcag

SEQ ID NO: 8574359 - DNA, 23 bp, Homo sapiens
tttgcaaattggacacaaccaca

SEQ ID NO: 8574360 - DNA, 22 bp, Homo sapiens
tttgcaaatgctctgcagagct

SEQ ID NO: 8574361 - DNA, 22 bp, Homo sapiens
tttgcaaattagccaccctgtt

SEQ ID NO: 8574362 - DNA, 22 bp, Homo sapiens
tttgcaaatgaagctctgagga

SEQ ID NO: 8574363 - DNA, 22 bp, Homo sapiens
tttgattttcagcaatagtggc

SEQ ID NO: 8574364 - DNA, 22 bp, Homo sapiens
tttgatttactggatattctca

SEQ ID NO: 8574365 - DNA, 22 bp, Homo sapiens
tttgcaaataaataagtgctcg

SEQ ID NO: 8574366 - DNA, 22 bp, Homo sapiens
tttgcaaatacagaggtcttgc

SEQ ID NO: 8574367 - DNA, 22 bp, Homo sapiens
tttgcaaataccatgaaacttg

SEQ ID NO: 8574368 - DNA, 22 bp, Homo sapiens
tttgcaaataccatgaaacttg

SEQ ID NO: 8574369 - DNA, 22 bp, Homo sapiens
tttgcaaataccatgaaacttg

SEQ ID NO: 8574370 - DNA, 22 bp, Homo sapiens
tttgcaaatatgtgtttctatt

SEQ ID NO: 8574371 - DNA, 22 bp, Homo sapiens
tttctttctcgtaaacttagtt

SEQ ID NO: 8574372 - DNA, 22 bp, Homo sapiens
tttctttctcgtaaacttagtt

SEQ ID NO: 8574373 - DNA, 22 bp, Homo sapiens
tttctttccatacatattgcta

SEQ ID NO: 8574374 - DNA, 22 bp, Homo sapiens
tttctttccatacatattgcta

SEQ ID NO: 8574375 - DNA, 22 bp, Homo sapiens
tttctttccatgagcctatgta

SEQ ID NO: 8574376 - DNA, 22 bp, Homo sapiens
tttctttatcctcctttgcaca

SEQ ID NO: 8574377 - DNA, 22 bp, Homo sapiens
tttctttatcctcctttgcaca

SEQ ID NO: 8574378 - DNA, 22 bp, Homo sapiens
tttggagtttaacaacttgaag

SEQ ID NO: 8574379 - DNA, 22 bp, Homo sapiens
tttggatcactgttcctctggg

SEQ ID NO: 8574380 - DNA, 22 bp, Homo sapiens
tttggagagcagctaggccctt

SEQ ID NO: 8574381 - DNA, 22 bp, Homo sapiens
tttggagatggagagagggcat

SEQ ID NO: 8574382 - DNA, 22 bp, Homo sapiens
tttggagagagttaaatatgtt

SEQ ID NO: 8574383 - DNA, 22 bp, Homo sapiens
tttggagagagttaaatatgtt

SEQ ID NO: 8574384 - DNA, 20 bp, Homo sapiens
tttggagagaaagaagtagt

SEQ ID NO: 8574385 - DNA, 20 bp, Homo sapiens
tttggagagaaagaagtagt

SEQ ID NO: 8574386 - DNA, 22 bp, Homo sapiens
tttggagaagttgctaaagtgt

SEQ ID NO: 8574387 - DNA, 22 bp, Homo sapiens
tttggagaaaagttgagaccat

SEQ ID NO: 8574388 - DNA, 22 bp, Homo sapiens
tttggagaagttgctaaagtgt

SEQ ID NO: 8574389 - DNA, 22 bp, Homo sapiens
tttgcagtctggcctgctttgg

SEQ ID NO: 8574390 - DNA, 22 bp, Homo sapiens
tttgcagtctggcctgctttgg

SEQ ID NO: 8574391 - DNA, 22 bp, Homo sapiens
tttggaagggaaagaaagtact

SEQ ID NO: 8574392 - DNA, 22 bp, Homo sapiens
tttggcaagtgggaaattagta

SEQ ID NO: 8574393 - DNA, 22 bp, Homo sapiens
tttggcaacggagaacttactc

SEQ ID NO: 8574394 - DNA, 22 bp, Homo sapiens
tttggcacattctgtcacattc

SEQ ID NO: 8574395 - DNA, 22 bp, Homo sapiens
tttggcagagtcatttcagaaa

SEQ ID NO: 8574396 - DNA, 22 bp, Homo sapiens
tttggcactgttctaggtgcaa

SEQ ID NO: 8574397 - DNA, 22 bp, Homo sapiens
tttggcactcacttatcattgg

SEQ ID NO: 8574398 - DNA, 22 bp, Homo sapiens
tttgtacacaggatgttataat

SEQ ID NO: 8574399 - DNA, 22 bp, Homo sapiens
tttgtacaattagcagaggcta

SEQ ID NO: 8574400 - DNA, 22 bp, Homo sapiens
tttgtacaattagcagaggcta

SEQ ID NO: 8574401 - DNA, 22 bp, Homo sapiens
tttgtacacaacctgtggtagt

SEQ ID NO: 8574402 - DNA, 23 bp, Homo sapiens
tttgtacattgaggaggcagaat

SEQ ID NO: 8574403 - DNA, 23 bp, Homo sapiens
tttgtacattgaggaggcagaat

SEQ ID NO: 8574404 - DNA, 22 bp, Homo sapiens
tttgtacatgaatgtgcaccca

SEQ ID NO: 8574405 - DNA, 17 bp, Homo sapiens
tttgtacaacattttaa

SEQ ID NO: 8574406 - DNA, 22 bp, Homo sapiens
gcagtgttacttggagtactaa

SEQ ID NO: 8574407 - DNA, 22 bp, Homo sapiens
gcagtgttaccttgggctggtt

SEQ ID NO: 8574408 - DNA, 22 bp, Homo sapiens
gcagtgttaaacaactgctgct

SEQ ID NO: 8574409 - DNA, 22 bp, Homo sapiens
gcagtgttacctcttcagtggg

SEQ ID NO: 8574410 - DNA, 22 bp, Homo sapiens
gcagtgttaatgcgagtgttca

SEQ ID NO: 8574411 - DNA, 22 bp, Homo sapiens
gcagtgttacttggtttgcaga

SEQ ID NO: 8574412 - DNA, 22 bp, Homo sapiens
gcatatgatcacgtgtgtcggt

SEQ ID NO: 8574413 - DNA, 22 bp, Homo sapiens
attccttgggctgccttattat

SEQ ID NO: 8574414 - DNA, 22 bp, Homo sapiens
attccttgggaattattgaatg

SEQ ID NO: 8574415 - DNA, 22 bp, Homo sapiens
attccttggcattctggacttg

SEQ ID NO: 8574416 - DNA, 22 bp, Homo sapiens
attccttgtatatctacatgca

SEQ ID NO: 8574417 - DNA, 22 bp, Homo sapiens
attccttgtttcactgaaaagg

SEQ ID NO: 8574418 - DNA, 22 bp, Homo sapiens
attccttgcacatcagatagtt

SEQ ID NO: 8574419 - DNA, 22 bp, Homo sapiens
attccttgctctcatcaacctt

SEQ ID NO: 8574420 - DNA, 22 bp, Homo sapiens
attccttggaacagatgcgaag

SEQ ID NO: 8574421 - DNA, 22 bp, Homo sapiens
gcagcgagtgcggctgccacag

SEQ ID NO: 8574422 - DNA, 22 bp, Homo sapiens
attagtgtacatctcacacgca

SEQ ID NO: 8574423 - DNA, 22 bp, Homo sapiens
attagtgttcttatcttctagg

SEQ ID NO: 8574424 - DNA, 22 bp, Homo sapiens
attagtgtctgtgaataattct

SEQ ID NO: 8574425 - DNA, 22 bp, Homo sapiens
attactttcagatgtgctgtaa

SEQ ID NO: 8574426 - DNA, 22 bp, Homo sapiens
attcatctatgactctaatgtg

SEQ ID NO: 8574427 - DNA, 22 bp, Homo sapiens
attcataacggcaaatgtcacc

SEQ ID NO: 8574428 - DNA, 22 bp, Homo sapiens
gcacggctaatttttgtatttt

SEQ ID NO: 8574429 - DNA, 22 bp, Homo sapiens
attcaagaggaacaatgaagat

SEQ ID NO: 8574430 - DNA, 22 bp, Homo sapiens
gcacctttctatattcagtggc

SEQ ID NO: 8574431 - DNA, 22 bp, Homo sapiens
attcagaaagatatgcctggtt

SEQ ID NO: 8574432 - DNA, 22 bp, Homo sapiens
attcagaaagggttgcctggtt

SEQ ID NO: 8574433 - DNA, 21 bp, Homo sapiens
caaatacttagaaacttaaga

SEQ ID NO: 8574434 - DNA, 22 bp, Homo sapiens
gctctttggattcctttacaaa

SEQ ID NO: 8574435 - DNA, 22 bp, Homo sapiens
gctctttgcacagctctgccct

SEQ ID NO: 8574436 - DNA, 22 bp, Homo sapiens
caaatagactctagaatttatt

SEQ ID NO: 8574437 - DNA, 22 bp, Homo sapiens
gctctttgtattttggaatcaa

SEQ ID NO: 8574438 - DNA, 20 bp, Homo sapiens
gctctttgtaagggaatttg

SEQ ID NO: 8574439 - DNA, 22 bp, Homo sapiens
caaatggatacaggcaaacatt

SEQ ID NO: 8574440 - DNA, 22 bp, Homo sapiens
caaatgcatgagaaataagagg

SEQ ID NO: 8574441 - DNA, 22 bp, Homo sapiens
caaatgcatgagaaataagagg

SEQ ID NO: 8574442 - DNA, 22 bp, Homo sapiens
caaatgcatagtttataagaag

SEQ ID NO: 8574443 - DNA, 22 bp, Homo sapiens
atttttcctgctggatctgctc

SEQ ID NO: 8574444 - DNA, 22 bp, Homo sapiens
atttttctctttccactgagat

SEQ ID NO: 8574445 - DNA, 22 bp, Homo sapiens
atttttgccctgcagtacataa

SEQ ID NO: 8574446 - DNA, 22 bp, Homo sapiens
attttacttcatttgaaatgcc

SEQ ID NO: 8574447 - DNA, 22 bp, Homo sapiens
caaacatagtgaagcaatgaca

SEQ ID NO: 8574448 - DNA, 22 bp, Homo sapiens
caaacatctgcaccttgaccgg

SEQ ID NO: 8574449 - DNA, 22 bp, Homo sapiens
gcctctgcaactccgccttggt

SEQ ID NO: 8574450 - DNA, 22 bp, Homo sapiens
gccaggctggtgcaaggatatt

SEQ ID NO: 8574451 - DNA, 22 bp, Homo sapiens
gccaggctgctggctgctgtcc

SEQ ID NO: 8574452 - DNA, 22 bp, Homo sapiens
gccacagggcgagcggaggcca

SEQ ID NO: 8574453 - DNA, 22 bp, Homo sapiens
atttccatgtccaaaaattagt

SEQ ID NO: 8574454 - DNA, 22 bp, Homo sapiens
atttccatgaaggcagatttta

SEQ ID NO: 8574455 - DNA, 22 bp, Homo sapiens
atttctgtaacttatgaaagtt

SEQ ID NO: 8574456 - DNA, 22 bp, Homo sapiens
atttctgtggcttcattctcct

SEQ ID NO: 8574457 - DNA, 22 bp, Homo sapiens
gaggaaggctaaggggcttaga

SEQ ID NO: 8574458 - DNA, 18 bp, Homo sapiens
atggtctcatactgggag

SEQ ID NO: 8574459 - DNA, 22 bp, Homo sapiens
atggtgtttataggcaaagatc

SEQ ID NO: 8574460 - DNA, 17 bp, Homo sapiens
gagatgggtggatcacc

SEQ ID NO: 8574461 - DNA, 22 bp, Homo sapiens
atggccacatttagtaactggt

SEQ ID NO: 8574462 - DNA, 21 bp, Homo sapiens
atggccactatggtgcagcag

SEQ ID NO: 8574463 - DNA, 22 bp, Homo sapiens
atggccaccatttaatgaagct

SEQ ID NO: 8574464 - DNA, 22 bp, Homo sapiens
atggccaccatctctaaaacac

SEQ ID NO: 8574465 - DNA, 18 bp, Homo sapiens
atgtgagagaatcttctt

SEQ ID NO: 8574466 - DNA, 20 bp, Homo sapiens
atgttgtttactcatagcat

SEQ ID NO: 8574467 - DNA, 22 bp, Homo sapiens
atgttgagagctgagatcagcc

SEQ ID NO: 8574468 - DNA, 22 bp, Homo sapiens
gaaaggttgtaacaagactctt

SEQ ID NO: 8574469 - DNA, 22 bp, Homo sapiens
atgatctcattctttcaaaggg

SEQ ID NO: 8574470 - DNA, 22 bp, Homo sapiens
atgatgctgtttatcatatact

SEQ ID NO: 8574471 - DNA, 22 bp, Homo sapiens
atgatggaatattattcaggca

SEQ ID NO: 8574472 - DNA, 22 bp, Homo sapiens
atgacagatgctgtggggaggt

SEQ ID NO: 8574473 - DNA, 22 bp, Homo sapiens
cttcttgtcaatttgccattgt

SEQ ID NO: 8574474 - DNA, 22 bp, Homo sapiens
atctggaggcctgtcttatccc

SEQ ID NO: 8574475 - DNA, 22 bp, Homo sapiens
atctggagatgggtctgtcacc

SEQ ID NO: 8574476 - DNA, 22 bp, Homo sapiens
atctggaggattctgggacttg

SEQ ID NO: 8574477 - DNA, 22 bp, Homo sapiens
ctttcccttagccccattctat

SEQ ID NO: 8574478 - DNA, 22 bp, Homo sapiens
gacacaaagtttgtcagaaatt

SEQ ID NO: 8574479 - DNA, 21 bp, Homo sapiens
gacacaaagggtagtaatggt

SEQ ID NO: 8574480 - DNA, 22 bp, Homo sapiens
gacggcagaaactcatgaggtc

SEQ ID NO: 8574481 - DNA, 22 bp, Homo sapiens
gaccttgtgatctgcccacctt

SEQ ID NO: 8574482 - DNA, 22 bp, Homo sapiens
gaccttgtgatccacccgcttt

SEQ ID NO: 8574483 - DNA, 22 bp, Homo sapiens
gaatattttcagtacagatggt

SEQ ID NO: 8574484 - DNA, 22 bp, Homo sapiens
gaatatttttaaagggactaat

SEQ ID NO: 8574485 - DNA, 22 bp, Homo sapiens
gaagtcttcatctgatgctctg

SEQ ID NO: 8574486 - DNA, 22 bp, Homo sapiens
ggtgagaaagggattcctgttc

SEQ ID NO: 8574487 - DNA, 19 bp, Homo sapiens
cagaggcaccaggtataga

SEQ ID NO: 8574488 - DNA, 22 bp, Homo sapiens
cagaggcacagtgcgggccact

SEQ ID NO: 8574489 - DNA, 19 bp, Homo sapiens
cagagtccttgaccagtcc

SEQ ID NO: 8574490 - DNA, 22 bp, Homo sapiens
cagagtcctggacacagagaca

SEQ ID NO: 8574491 - DNA, 22 bp, Homo sapiens
ggtccagaagctggtagggtag

SEQ ID NO: 8574492 - DNA, 22 bp, Homo sapiens
ggtcattgaaatcagaagggtt

SEQ ID NO: 8574493 - DNA, 22 bp, Homo sapiens
gggcaggtaggtgaaataatga

SEQ ID NO: 8574494 - DNA, 22 bp, Homo sapiens
gggcaggtatttatcttctatt

SEQ ID NO: 8574495 - DNA, 21 bp, Homo sapiens
gggccactctagagaaagaaa

SEQ ID NO: 8574496 - DNA, 22 bp, Homo sapiens
gggccagagcttggcagctggg

SEQ ID NO: 8574497 - DNA, 22 bp, Homo sapiens
cagagcctctcagaggtcagac

SEQ ID NO: 8574498 - DNA, 20 bp, Homo sapiens
cagaggcaaggagacttgga

SEQ ID NO: 8574499 - DNA, 22 bp, Homo sapiens
cagctacagaggccacatggct

SEQ ID NO: 8574500 - DNA, 22 bp, Homo sapiens
cagctattattttctctaaatt

SEQ ID NO: 8574501 - DNA, 22 bp, Homo sapiens
gtgcccagtcctgccttgacag

SEQ ID NO: 8574502 - DNA, 22 bp, Homo sapiens
cagccttcaaggcttagctcag

SEQ ID NO: 8574503 - DNA, 22 bp, Homo sapiens
gtctgtggcaggggagaagttt

SEQ ID NO: 8574504 - DNA, 19 bp, Homo sapiens
gtccctgggcagaggcacc

SEQ ID NO: 8574505 - DNA, 22 bp, Homo sapiens
gtccctgggaaaggagagggca

SEQ ID NO: 8574506 - DNA, 22 bp, Homo sapiens
gtccctggggaatcagctggag

SEQ ID NO: 8574507 - DNA, 22 bp, Homo sapiens
gtccctgggtctaaggcagtaa

SEQ ID NO: 8574508 - DNA, 22 bp, Homo sapiens
gtccctgggtagctcagtggct

SEQ ID NO: 8574509 - DNA, 22 bp, Homo sapiens
gtccctgggggtttaggactca

SEQ ID NO: 8574510 - DNA, 22 bp, Homo sapiens
gtccctggtttgcccaggacca

SEQ ID NO: 8574511 - DNA, 22 bp, Homo sapiens
cagcaggaagtactagctttga

SEQ ID NO: 8574512 - DNA, 22 bp, Homo sapiens
cagcaggaaagacatctgagca

SEQ ID NO: 8574513 - DNA, 22 bp, Homo sapiens
gtcatgcctggcttcttagaca

SEQ ID NO: 8574514 - DNA, 22 bp, Homo sapiens
gtcatgccagcggagctcggga

SEQ ID NO: 8574515 - DNA, 22 bp, Homo sapiens
gtccagccagctggtccttgcc

SEQ ID NO: 8574516 - DNA, 22 bp, Homo sapiens
cagaaagcgggatgcagcatgt

SEQ ID NO: 8574517 - DNA, 22 bp, Homo sapiens
cagaaataaacttctcacatcg

SEQ ID NO: 8574518 - DNA, 22 bp, Homo sapiens
ggctgagcttatatatgtgctg

SEQ ID NO: 8574519 - DNA, 18 bp, Homo sapiens
ggcctgaggatttcagca

SEQ ID NO: 8574520 - DNA, 22 bp, Homo sapiens
ggcctgagcttgggcagcgtat

SEQ ID NO: 8574521 - DNA, 22 bp, Homo sapiens
ggcctgtccagcctgcctggct

SEQ ID NO: 8574522 - DNA, 19 bp, Homo sapiens
cacatacagaaaagagtaa

SEQ ID NO: 8574523 - DNA, 22 bp, Homo sapiens
cacatacatgcacacctaaata

SEQ ID NO: 8574524 - DNA, 22 bp, Homo sapiens
cacagtgttccagagcagtggt

SEQ ID NO: 8574525 - DNA, 22 bp, Homo sapiens
ggccactgcctccgccatggct

SEQ ID NO: 8574526 - DNA, 23 bp, Homo sapiens
ggccactgaattttctgcatctt

SEQ ID NO: 8574527 - DNA, 22 bp, Homo sapiens
ggccactgacctacatctgggg

SEQ ID NO: 8574528 - DNA, 22 bp, Homo sapiens
ggccactgctctccagcctggg

SEQ ID NO: 8574529 - DNA, 22 bp, Homo sapiens
ggccactgtcctctagcccaga

SEQ ID NO: 8574530 - DNA, 22 bp, Homo sapiens
ggccctgtccccttcagttttg

SEQ ID NO: 8574531 - DNA, 22 bp, Homo sapiens
ggcccttggagcctccacagtg

SEQ ID NO: 8574532 - DNA, 20 bp, Homo sapiens
ggccggggagctctccaggg

SEQ ID NO: 8574533 - DNA, 22 bp, Homo sapiens
ggccggggcctccccgcgtcgc

SEQ ID NO: 8574534 - DNA, 22 bp, Homo sapiens
cacctgttagctctaattttct

SEQ ID NO: 8574535 - DNA, 22 bp, Homo sapiens
ggccggggcctgctcgcctgtg

SEQ ID NO: 8574536 - DNA, 22 bp, Homo sapiens
ggcagggcaggaaagtcaggaa

SEQ ID NO: 8574537 - DNA, 22 bp, Homo sapiens
ggcaggtgatctagagtcaata

SEQ ID NO: 8574538 - DNA, 22 bp, Homo sapiens
ggcaggtgcccagagagcacga

SEQ ID NO: 8574539 - DNA, 22 bp, Homo sapiens
cacagatagaccttatgagatt

SEQ ID NO: 8574540 - DNA, 20 bp, Homo sapiens
cacagagtcttgcagcgttc

SEQ ID NO: 8574541 - DNA, 22 bp, Homo sapiens
ggaggcaggaaagacaggttca

SEQ ID NO: 8574542 - DNA, 22 bp, Homo sapiens
ggaggccaaagtgtgggcggct

SEQ ID NO: 8574543 - DNA, 22 bp, Homo sapiens
cacaggaataagtcaaacttca

SEQ ID NO: 8574544 - DNA, 22 bp, Homo sapiens
ggactgggccaggggttggact

SEQ ID NO: 8574545 - DNA, 22 bp, Homo sapiens
ggaagggcctcgggcgtgggac

SEQ ID NO: 8574546 - DNA, 22 bp, Homo sapiens
caagccagcagtttaatgactc

SEQ ID NO: 8574547 - DNA, 22 bp, Homo sapiens
caagccagctcctgccacagag

SEQ ID NO: 8574548 - DNA, 22 bp, Homo sapiens
caaggcctgactgcttgtctaa

SEQ ID NO: 8574549 - DNA, 20 bp, Homo sapiens
caaggcctggatctagttgc

SEQ ID NO: 8574550 - DNA, 22 bp, Homo sapiens
gctggctgggtccctgagaggc

SEQ ID NO: 8574551 - DNA, 22 bp, Homo sapiens
gctggctgtatcacctggccag

SEQ ID NO: 8574552 - DNA, 21 bp, Homo sapiens
gctggctgtcccagggaagca

SEQ ID NO: 8574553 - DNA, 22 bp, Homo sapiens
caagggggcaggatcacacttg

SEQ ID NO: 8574554 - DNA, 22 bp, Homo sapiens
caagttttagaaatatctggat

SEQ ID NO: 8574555 - DNA, 22 bp, Homo sapiens
gctttctggttctcaaagcact

SEQ ID NO: 8574556 - DNA, 22 bp, Homo sapiens
caatgtatcaagaagcatcagt

SEQ ID NO: 8574557 - DNA, 22 bp, Homo sapiens
caatgtcaaggagaccaaaacg

SEQ ID NO: 8574558 - DNA, 22 bp, Homo sapiens
caaggtgaacttgctgtacagc

SEQ ID NO: 8574559 - DNA, 22 bp, Homo sapiens
caaggtagttctggtcattgac

SEQ ID NO: 8574560 - DNA, 22 bp, Homo sapiens
caagtagaaggatgtgattgta

SEQ ID NO: 8574561 - DNA, 22 bp, Homo sapiens
caagtagagattacagtgtgca

SEQ ID NO: 8574562 - DNA, 22 bp, Homo sapiens
caagtagaacagagctaccttg

SEQ ID NO: 8574563 - DNA, 22 bp, Homo sapiens
caagtatatttgaacatgtaaa

SEQ ID NO: 8574564 - DNA, 22 bp, Homo sapiens
caagtatgagaaagctattacc

SEQ ID NO: 8574565 - DNA, 22 bp, Homo sapiens
caagtagagttcacttgtcttt

SEQ ID NO: 8574566 - DNA, 22 bp, Homo sapiens
gctgttctttgcatctctggtg

SEQ ID NO: 8574567 - DNA, 22 bp, Homo sapiens
gctgttcagatgcgattcagga

SEQ ID NO: 8574568 - DNA, 22 bp, Homo sapiens
aggtcctgagggttcgtctgca

SEQ ID NO: 8574569 - DNA, 22 bp, Homo sapiens
aggtcctgaagattttactaga

SEQ ID NO: 8574570 - DNA, 22 bp, Homo sapiens
aggtcccaggcatagctggtct

SEQ ID NO: 8574571 - DNA, 22 bp, Homo sapiens
aggtccatcgtggatgaactgc

SEQ ID NO: 8574572 - DNA, 22 bp, Homo sapiens
cctggcacacggtggcattcaa

SEQ ID NO: 8574573 - DNA, 22 bp, Homo sapiens
aggtccagttttctgacaaggg

SEQ ID NO: 8574574 - DNA, 22 bp, Homo sapiens
aggtacagggtgaaagtttatg

SEQ ID NO: 8574575 - DNA, 20 bp, Homo sapiens
cctgtctcctcttacctggc

SEQ ID NO: 8574576 - DNA, 22 bp, Homo sapiens
cctgtccagggactgagggaga

SEQ ID NO: 8574577 - DNA, 22 bp, Homo sapiens
cctgggcttctgtctagatgtt

SEQ ID NO: 8574578 - DNA, 22 bp, Homo sapiens
cctgggctcaagtgatggtccc

SEQ ID NO: 8574579 - DNA, 22 bp, Homo sapiens
cctgggctcaccatgccttgga

SEQ ID NO: 8574580 - DNA, 22 bp, Homo sapiens
cctgggctccactccaagagca

SEQ ID NO: 8574581 - DNA, 18 bp, Homo sapiens
cgggcgggcgcctggccc

SEQ ID NO: 8574582 - DNA, 17 bp, Homo sapiens
cctgtgtttgctccttc

SEQ ID NO: 8574583 - DNA, 20 bp, Homo sapiens
cctgttccattccctcaacc

SEQ ID NO: 8574584 - DNA, 22 bp, Homo sapiens
cctgttgtctcttcctgttgac

SEQ ID NO: 8574585 - DNA, 22 bp, Homo sapiens
cgaggcggcggaagtgcccgta

SEQ ID NO: 8574586 - DNA, 22 bp, Homo sapiens
cgcagggatttcaaggggcctt

SEQ ID NO: 8574587 - DNA, 22 bp, Homo sapiens
cgcaggctcggttcacagagca

SEQ ID NO: 8574588 - DNA, 22 bp, Homo sapiens
agtccagggcttagtcagcggg

SEQ ID NO: 8574589 - DNA, 22 bp, Homo sapiens
agtccagggcttagtcagcggg

SEQ ID NO: 8574590 - DNA, 22 bp, Homo sapiens
ctagtagacagaaatgtccagt

SEQ ID NO: 8574591 - DNA, 17 bp, Homo sapiens
ctctgcagtgcatggct

SEQ ID NO: 8574592 - DNA, 21 bp, Homo sapiens
ctctgcagtgcccaccttgcc

SEQ ID NO: 8574593 - DNA, 22 bp, Homo sapiens
ctctgcgccaccctcgcctgct

SEQ ID NO: 8574594 - DNA, 22 bp, Homo sapiens
ctctggctttgctcatgcatcc

SEQ ID NO: 8574595 - DNA, 22 bp, Homo sapiens
ctctggcttgttaatgcatatt

SEQ ID NO: 8574596 - DNA, 22 bp, Homo sapiens
agttagagacacatgcacatgc

SEQ ID NO: 8574597 - DNA, 22 bp, Homo sapiens
ctcctggctcgcccccagctga

SEQ ID NO: 8574598 - DNA, 18 bp, Homo sapiens
ctccagggaactcagtca

SEQ ID NO: 8574599 - DNA, 22 bp, Homo sapiens
ctcctgggaaaggctggacaca

SEQ ID NO: 8574600 - DNA, 22 bp, Homo sapiens
ctcctgggaatttagttgtgag

SEQ ID NO: 8574601 - DNA, 20 bp, Homo sapiens
ctcctgggactgctggttat

SEQ ID NO: 8574602 - DNA, 22 bp, Homo sapiens
ctcctgggaaatgaaggggcag

SEQ ID NO: 8574603 - DNA, 22 bp, Homo sapiens
ctcctggggccatggaaggaac

SEQ ID NO: 8574604 - DNA, 22 bp, Homo sapiens
ctcctggggcacttagaagcaa

SEQ ID NO: 8574605 - DNA, 22 bp, Homo sapiens
ctcctgggggacagcggcaggg

SEQ ID NO: 8574606 - DNA, 22 bp, Homo sapiens
ctcctgggtcattgccagcaaa

SEQ ID NO: 8574607 - DNA, 22 bp, Homo sapiens
agtggcagagtcagggtttgga

SEQ ID NO: 8574608 - DNA, 22 bp, Homo sapiens
ctcatggagggagtgctcttcc

SEQ ID NO: 8574609 - DNA, 22 bp, Homo sapiens
agtcctgggtccagcaggtcct

SEQ ID NO: 8574610 - DNA, 22 bp, Homo sapiens
agtcctgggtccagcaggtcct

SEQ ID NO: 8574611 - DNA, 22 bp, Homo sapiens
agtcctggacttggagtcaggg

SEQ ID NO: 8574612 - DNA, 18 bp, Homo sapiens
agtcctggagatcaccaa

SEQ ID NO: 8574613 - DNA, 22 bp, Homo sapiens
agtcctggcatataggtcctca

SEQ ID NO: 8574614 - DNA, 22 bp, Homo sapiens
agtccgtggccagactcaagag

SEQ ID NO: 8574615 - DNA, 22 bp, Homo sapiens
agtcttctcatttcacatgctt

SEQ ID NO: 8574616 - DNA, 22 bp, Homo sapiens
ctgtggcttttccggggagcct

SEQ ID NO: 8574617 - DNA, 22 bp, Homo sapiens
ctgtggctttgtgtctattgta

SEQ ID NO: 8574618 - DNA, 22 bp, Homo sapiens
ctgtggctcagcacggggtcag

SEQ ID NO: 8574619 - DNA, 22 bp, Homo sapiens
ctgtggctcaggcctgtaagcc

SEQ ID NO: 8574620 - DNA, 22 bp, Homo sapiens
ctgtggctttggggcggaggac

SEQ ID NO: 8574621 - DNA, 22 bp, Homo sapiens
ctgtggctatggtgtacatact

SEQ ID NO: 8574622 - DNA, 22 bp, Homo sapiens
ctgtggctaggattattcctga

SEQ ID NO: 8574623 - DNA, 22 bp, Homo sapiens
ctgtggctcaattgcctactga

SEQ ID NO: 8574624 - DNA, 22 bp, Homo sapiens
ctgtggctcaaaatcccatgat

SEQ ID NO: 8574625 - DNA, 22 bp, Homo sapiens
ctgtggctcaaaatcccatgat

SEQ ID NO: 8574626 - DNA, 22 bp, Homo sapiens
ctgtggctaataattagtattt

SEQ ID NO: 8574627 - DNA, 22 bp, Homo sapiens
ctgtggctaggaagctgtggga

SEQ ID NO: 8574628 - DNA, 15 bp, Homo sapiens
ctgtggctaacctaa

SEQ ID NO: 8574629 - DNA, 22 bp, Homo sapiens
ctgtgtgctcggatggactcgt

SEQ ID NO: 8574630 - DNA, 19 bp, Homo sapiens
atcctgggtcctccagctg

SEQ ID NO: 8574631 - DNA, 22 bp, Homo sapiens
atcctgggtttgtgagtttatg

SEQ ID NO: 8574632 - DNA, 22 bp, Homo sapiens
atcctgggtaagttccttttaa

SEQ ID NO: 8574633 - DNA, 22 bp, Homo sapiens
atcctgggggcagctggaaaca

SEQ ID NO: 8574634 - DNA, 22 bp, Homo sapiens
atcctgggcctcagaggtgtgt

SEQ ID NO: 8574635 - DNA, 22 bp, Homo sapiens
atcctgggctgcaccctcagcc

SEQ ID NO: 8574636 - DNA, 22 bp, Homo sapiens
atcctgggcagttttgagtgct

SEQ ID NO: 8574637 - DNA, 18 bp, Homo sapiens
atcctgggccagtctttc

SEQ ID NO: 8574638 - DNA, 22 bp, Homo sapiens
atcctgggcagtgtgtcactct

SEQ ID NO: 8574639 - DNA, 22 bp, Homo sapiens
atcctgggcaaagtatgctgtc

SEQ ID NO: 8574640 - DNA, 22 bp, Homo sapiens
atcctgggcaagtcaatgtccc

SEQ ID NO: 8574641 - DNA, 22 bp, Homo sapiens
ctgtgtgcatagttgtgctcaa

SEQ ID NO: 8574642 - DNA, 22 bp, Homo sapiens
atccagggtgtggagagagctc

SEQ ID NO: 8574643 - DNA, 22 bp, Homo sapiens
atccaccctgtggtggctttct

SEQ ID NO: 8574644 - DNA, 22 bp, Homo sapiens
cttcttattaatccttctctgt

SEQ ID NO: 8574645 - DNA, 21 bp, Homo sapiens
atcagaatctctagatttgga

SEQ ID NO: 8574646 - DNA, 22 bp, Homo sapiens
atatttaactggtcccaatata

SEQ ID NO: 8574647 - DNA, 22 bp, Homo sapiens
atatttaaacagggtaccaata

SEQ ID NO: 8574648 - DNA, 22 bp, Homo sapiens
atattgtactagggttacatgt

SEQ ID NO: 8574649 - DNA, 22 bp, Homo sapiens
atattcttgtgattataaagta

SEQ ID NO: 8574650 - DNA, 22 bp, Homo sapiens
ctgggctcacctgtggctggca

SEQ ID NO: 8574651 - DNA, 19 bp, Homo sapiens
ctgggctgaggtctgcctt

SEQ ID NO: 8574652 - DNA, 22 bp, Homo sapiens
atattcatcgtgtagaaatact

SEQ ID NO: 8574653 - DNA, 22 bp, Homo sapiens
atattacataaacatgagtgaa

SEQ ID NO: 8574654 - DNA, 22 bp, Homo sapiens
atagcaaagcctggcacaatga

SEQ ID NO: 8574655 - DNA, 22 bp, Homo sapiens
ctggctcccatgagctctcacg

SEQ ID NO: 8574656 - DNA, 22 bp, Homo sapiens
ctggctccattactcagcatct

SEQ ID NO: 8574657 - DNA, 22 bp, Homo sapiens
ctggctccatccttgagctctg

SEQ ID NO: 8574658 - DNA, 22 bp, Homo sapiens
atagcagaaaccaagcttcttc

SEQ ID NO: 8574659 - DNA, 22 bp, Homo sapiens
ctggagaagtactgagacattt

SEQ ID NO: 8574660 - DNA, 22 bp, Homo sapiens
ctggagaagcattcaaataatt

SEQ ID NO: 8574661 - DNA, 22 bp, Homo sapiens
atacagtagacaatctcatgaa

SEQ ID NO: 8574662 - DNA, 22 bp, Homo sapiens
atacagtgaatacttacagtgt

SEQ ID NO: 8574663 - DNA, 22 bp, Homo sapiens
atacagtgccccttttcacatg

SEQ ID NO: 8574664 - DNA, 22 bp, Homo sapiens
atacagtgtactatttagcagt

SEQ ID NO: 8574665 - DNA, 22 bp, Homo sapiens
atacagtataactaataaaccc

SEQ ID NO: 8574666 - DNA, 22 bp, Homo sapiens
atacagtatgtaggcttttcag

SEQ ID NO: 8574667 - DNA, 22 bp, Homo sapiens
atacctgtgtatccacaagcgt

SEQ ID NO: 8574668 - DNA, 22 bp, Homo sapiens
ctgcatcctggaaatagctaag

SEQ ID NO: 8574669 - DNA, 22 bp, Homo sapiens
ctgcatcctaacctccatgcag

SEQ ID NO: 8574670 - DNA, 22 bp, Homo sapiens
ctgcagagatgaagaaggtggc

SEQ ID NO: 8574671 - DNA, 22 bp, Homo sapiens
ataagcagggtcaaatgcctac

SEQ ID NO: 8574672 - DNA, 23 bp, Homo sapiens
ataaattactatctccctagagc

SEQ ID NO: 8574673 - DNA, 22 bp, Homo sapiens
ataaattatgaatggccctttt

SEQ ID NO: 8574674 - DNA, 22 bp, Homo sapiens
ataaattaggatctggggttcc

SEQ ID NO: 8574675 - DNA, 22 bp, Homo sapiens
aggctagaggcttctggcttca

SEQ ID NO: 8574676 - DNA, 22 bp, Homo sapiens
aggcaggtcccctggaaggcac

SEQ ID NO: 8574677 - DNA, 22 bp, Homo sapiens
aggcaggtcacatgcttggcga

SEQ ID NO: 8574678 - DNA, 22 bp, Homo sapiens
aggcaggtctgtatctagtctc

SEQ ID NO: 8574679 - DNA, 22 bp, Homo sapiens
aggcaggtagaaggatctttat

SEQ ID NO: 8574680 - DNA, 19 bp, Homo sapiens
aggcaggtgcagaggtccc

SEQ ID NO: 8574681 - DNA, 22 bp, Homo sapiens
aggcaggtgagtcaaaacagac

SEQ ID NO: 8574682 - DNA, 22 bp, Homo sapiens
ccagaggatgctggtcagcctc

SEQ ID NO: 8574683 - DNA, 21 bp, Homo sapiens
ccagaggcctctcttggccac

SEQ ID NO: 8574684 - DNA, 22 bp, Homo sapiens
ccagaggctggcaagggctcct

SEQ ID NO: 8574685 - DNA, 22 bp, Homo sapiens
ccaggcctcacctgcccaccta

SEQ ID NO: 8574686 - DNA, 22 bp, Homo sapiens
ccagggcagcagaattggggca

SEQ ID NO: 8574687 - DNA, 22 bp, Homo sapiens
ccagggcagcagaattggggca

SEQ ID NO: 8574688 - DNA, 22 bp, Homo sapiens
ccaggtggtgaaagtgggccct

SEQ ID NO: 8574689 - DNA, 22 bp, Homo sapiens
ccagtgtgaacctcaccaccct

SEQ ID NO: 8574690 - DNA, 22 bp, Homo sapiens
cccacacatttttcacttaccg

SEQ ID NO: 8574691 - DNA, 22 bp, Homo sapiens
ccagtgggagggagctaggcca

SEQ ID NO: 8574692 - DNA, 22 bp, Homo sapiens
agggaaataatctattctgagg

SEQ ID NO: 8574693 - DNA, 22 bp, Homo sapiens
cctcctggtgggcgcttctggc

SEQ ID NO: 8574694 - DNA, 22 bp, Homo sapiens
agggggtgctacttccagagtt

SEQ ID NO: 8574695 - DNA, 22 bp, Homo sapiens
agggggctggagacacctcctc

SEQ ID NO: 8574696 - DNA, 22 bp, Homo sapiens
agggggtgaatgtctgtctaca

SEQ ID NO: 8574697 - DNA, 22 bp, Homo sapiens
cctactctgagcgcctccgcat

SEQ ID NO: 8574698 - DNA, 22 bp, Homo sapiens
agggctttgatgtccatgagga

SEQ ID NO: 8574699 - DNA, 22 bp, Homo sapiens
agggctttggccccctgctgca

SEQ ID NO: 8574700 - DNA, 22 bp, Homo sapiens
agggctttgcaatgcacagtgg

SEQ ID NO: 8574701 - DNA, 19 bp, Homo sapiens
agggctttgtgtgctgctc

SEQ ID NO: 8574702 - DNA, 22 bp, Homo sapiens
agggctttgtggcagtcactat

SEQ ID NO: 8574703 - DNA, 22 bp, Homo sapiens
agggctttgtttaggtgaccac

SEQ ID NO: 8574704 - DNA, 22 bp, Homo sapiens
agggcttttgcaatccaagtct

SEQ ID NO: 8574705 - DNA, 22 bp, Homo sapiens
agggcttttgagcgcacgtctg

SEQ ID NO: 8574706 - DNA, 22 bp, Homo sapiens
ccctggcataaaacttctccag

SEQ ID NO: 8574707 - DNA, 17 bp, Homo sapiens
ccctggcaaagaatggc

SEQ ID NO: 8574708 - DNA, 22 bp, Homo sapiens
agggcctgtgaattctccctgc

SEQ ID NO: 8574709 - DNA, 22 bp, Homo sapiens
aggaaaggcctcagcagaaacc

SEQ ID NO: 8574710 - DNA, 18 bp, Homo sapiens
cagggctgtggggtcact

SEQ ID NO: 8574711 - DNA, 22 bp, Homo sapiens
cagtaaattttatttgtgggtg

SEQ ID NO: 8574712 - DNA, 22 bp, Homo sapiens
cagtaaatataggaacgtggaa

SEQ ID NO: 8574713 - DNA, 22 bp, Homo sapiens
cagtaaatagtggagatgtggg

SEQ ID NO: 8574714 - DNA, 22 bp, Homo sapiens
cagtaaatacatatcagagaag

SEQ ID NO: 8574715 - DNA, 22 bp, Homo sapiens
cagggcttgaatcaaggaagtc

SEQ ID NO: 8574716 - DNA, 22 bp, Homo sapiens
cagctgttcacatttccaaaac

SEQ ID NO: 8574717 - DNA, 22 bp, Homo sapiens
cagctgttcggggctggcatgt

SEQ ID NO: 8574718 - DNA, 22 bp, Homo sapiens
cagctgttactctgagtaaatg

SEQ ID NO: 8574719 - DNA, 22 bp, Homo sapiens
cagctgttcttgggacagacag

SEQ ID NO: 8574720 - DNA, 22 bp, Homo sapiens
caggatggagagtgaggggtca

SEQ ID NO: 8574721 - DNA, 18 bp, Homo sapiens
caggagcaggagttgaac

SEQ ID NO: 8574722 - DNA, 22 bp, Homo sapiens
caggcccataatgcaaatattt

SEQ ID NO: 8574723 - DNA, 22 bp, Homo sapiens
caggcccatttgtagccacttt

SEQ ID NO: 8574724 - DNA, 22 bp, Homo sapiens
agcttcctgatgcaagagggct

SEQ ID NO: 8574725 - DNA, 22 bp, Homo sapiens
agcttcctgttgagagagggag

SEQ ID NO: 8574726 - DNA, 23 bp, Homo sapiens
agcttcctagtgacctggagtct

SEQ ID NO: 8574727 - DNA, 22 bp, Homo sapiens
caggcagggagctggaaaggat

SEQ ID NO: 8574728 - DNA, 22 bp, Homo sapiens
caggcaggtcagtgaagaagga

SEQ ID NO: 8574729 - DNA, 22 bp, Homo sapiens
caggcaggtgcagattcctctt

SEQ ID NO: 8574730 - DNA, 22 bp, Homo sapiens
catacagaaaatatattttgat

SEQ ID NO: 8574731 - DNA, 22 bp, Homo sapiens
catctcttcattagcattattg

SEQ ID NO: 8574732 - DNA, 22 bp, Homo sapiens
catctctggttcagtctctgtg

SEQ ID NO: 8574733 - DNA, 23 bp, Homo sapiens
aggatgtaggatgtatggcagag

SEQ ID NO: 8574734 - DNA, 22 bp, Homo sapiens
catcttgcttcatctgctgtgt

SEQ ID NO: 8574735 - DNA, 22 bp, Homo sapiens
catcttgcttgtctttagtaag

SEQ ID NO: 8574736 - DNA, 22 bp, Homo sapiens
cagtgtgtctcttgtcctggct

SEQ ID NO: 8574737 - DNA, 22 bp, Homo sapiens
cagtgtggtgtgcacagcttag

SEQ ID NO: 8574738 - DNA, 22 bp, Homo sapiens
cagtccagagcccaccagagga

SEQ ID NO: 8574739 - DNA, 22 bp, Homo sapiens
aggcaatcccctgaggatactt

SEQ ID NO: 8574740 - DNA, 22 bp, Homo sapiens
aggcaagtgcattagaagagca

SEQ ID NO: 8574741 - DNA, 22 bp, Homo sapiens
aggcagtgtattgctagcggct

SEQ ID NO: 8574742 - DNA, 20 bp, Homo sapiens
aggcagtgtagagatgagta

SEQ ID NO: 8574743 - DNA, 22 bp, Homo sapiens
aggcagaaccagctgggacttt

SEQ ID NO: 8574744 - DNA, 22 bp, Homo sapiens
aggcagaagccagccagggtcc

SEQ ID NO: 8574745 - DNA, 22 bp, Homo sapiens
aggcaggtgggagtgattcctt

SEQ ID NO: 8574746 - DNA, 22 bp, Homo sapiens
aggcaggtgcttatgacttgct

SEQ ID NO: 8574747 - DNA, 18 bp, Homo sapiens
aggcaggtgctggaagtc

SEQ ID NO: 8574748 - DNA, 22 bp, Homo sapiens
aggcaggtgggtcacttgagtc

SEQ ID NO: 8574749 - DNA, 22 bp, Homo sapiens
aggcaggtgttaaccctctgag

SEQ ID NO: 8574750 - DNA, 22 bp, Homo sapiens
aggcaggttacaaaaactttat

SEQ ID NO: 8574751 - DNA, 22 bp, Homo sapiens
aggcaggttacaaaaactttat

SEQ ID NO: 8574752 - DNA, 22 bp, Homo sapiens
aggcaggttggggaaaagcact

SEQ ID NO: 8574753 - DNA, 22 bp, Homo sapiens
aggcaggtgttgggagacacca

SEQ ID NO: 8574754 - DNA, 22 bp, Homo sapiens
aggcaggtgttacctctggttt

SEQ ID NO: 8574755 - DNA, 22 bp, Homo sapiens
acagtgttatttctgagtaatg

SEQ ID NO: 8574756 - DNA, 20 bp, Homo sapiens
acagtgttagttatcatctc

SEQ ID NO: 8574757 - DNA, 22 bp, Homo sapiens
acagtgttcaaaccactaggct

SEQ ID NO: 8574758 - DNA, 22 bp, Homo sapiens
acagtgttcactaaggttagct

SEQ ID NO: 8574759 - DNA, 22 bp, Homo sapiens
acagtgttcacttaacaatgga

SEQ ID NO: 8574760 - DNA, 22 bp, Homo sapiens
acagtgttcctttgttgtgact

SEQ ID NO: 8574761 - DNA, 22 bp, Homo sapiens
acagtgttctgaaagttgaggg

SEQ ID NO: 8574762 - DNA, 22 bp, Homo sapiens
acagtgttctcttcctgtatag

SEQ ID NO: 8574763 - DNA, 20 bp, Homo sapiens
acagtgttaggtttttcctt

SEQ ID NO: 8574764 - DNA, 22 bp, Homo sapiens
aggaggcaggaagtctatggga

SEQ ID NO: 8574765 - DNA, 22 bp, Homo sapiens
acagccagaggagccaggctgg

SEQ ID NO: 8574766 - DNA, 22 bp, Homo sapiens
acagccagaggagccaggctgg

SEQ ID NO: 8574767 - DNA, 22 bp, Homo sapiens
acagcagtggtgcactgagcca

SEQ ID NO: 8574768 - DNA, 22 bp, Homo sapiens
aggactgggtgcagagggcatc

SEQ ID NO: 8574769 - DNA, 22 bp, Homo sapiens
aggactggtgccagacaaggta

SEQ ID NO: 8574770 - DNA, 22 bp, Homo sapiens
aggactggccctgaggggaggc

SEQ ID NO: 8574771 - DNA, 22 bp, Homo sapiens
aggactggcagtgtgaggggtc

SEQ ID NO: 8574772 - DNA, 22 bp, Homo sapiens
aggaaaggtagcgtgccagcag

SEQ ID NO: 8574773 - DNA, 22 bp, Homo sapiens
agggaggatctgctccttgtct

SEQ ID NO: 8574774 - DNA, 22 bp, Homo sapiens
accagagaaaacacagcaggct

SEQ ID NO: 8574775 - DNA, 22 bp, Homo sapiens
agggccagttcagaggacatgg

SEQ ID NO: 8574776 - DNA, 22 bp, Homo sapiens
agggctcaatggtgggcatgta

SEQ ID NO: 8574777 - DNA, 22 bp, Homo sapiens
agggccagtaccaggtgggtgg

SEQ ID NO: 8574778 - DNA, 21 bp, Homo sapiens
agggccagatcaccaaggagc

SEQ ID NO: 8574779 - DNA, 22 bp, Homo sapiens
agggccagcccataatgccaaa

SEQ ID NO: 8574780 - DNA, 22 bp, Homo sapiens
agggccagcactcctggcagga

SEQ ID NO: 8574781 - DNA, 20 bp, Homo sapiens
agggtcagtagcacagagct

SEQ ID NO: 8574782 - DNA, 22 bp, Homo sapiens
aggggcaggtgctgcacttaga

SEQ ID NO: 8574783 - DNA, 22 bp, Homo sapiens
agggctttgatggcattctcat

SEQ ID NO: 8574784 - DNA, 22 bp, Homo sapiens
agggctttctttgtaaaagaag

SEQ ID NO: 8574785 - DNA, 22 bp, Homo sapiens
agggctttgagaatagtggaac

SEQ ID NO: 8574786 - DNA, 22 bp, Homo sapiens
agggctcagaacaatgagtgta

SEQ ID NO: 8574787 - DNA, 22 bp, Homo sapiens
acattaacactggtgctggtgt

SEQ ID NO: 8574788 - DNA, 22 bp, Homo sapiens
acattaacaccataagtgtgtt

SEQ ID NO: 8574789 - DNA, 22 bp, Homo sapiens
acattaacaccgtgagtttggt

SEQ ID NO: 8574790 - DNA, 22 bp, Homo sapiens
acatttctccttgcaggagtca

SEQ ID NO: 8574791 - DNA, 18 bp, Homo sapiens
acatttctccttctgacc

SEQ ID NO: 8574792 - DNA, 22 bp, Homo sapiens
acatttctccctgcatgcctgc

SEQ ID NO: 8574793 - DNA, 22 bp, Homo sapiens
acatttctcaggtaagtcattt

SEQ ID NO: 8574794 - DNA, 22 bp, Homo sapiens
agtccaggcattccagccattc

SEQ ID NO: 8574795 - DNA, 22 bp, Homo sapiens
agtcctggttctgattctgaca

SEQ ID NO: 8574796 - DNA, 22 bp, Homo sapiens
actcagcttcctacagctagaa

SEQ ID NO: 8574797 - DNA, 22 bp, Homo sapiens
actcagagttttacccagagac

SEQ ID NO: 8574798 - DNA, 22 bp, Homo sapiens
actcagctgatgaagcacaagt

SEQ ID NO: 8574799 - DNA, 22 bp, Homo sapiens
actcagctcaggagctggctgg

SEQ ID NO: 8574800 - DNA, 21 bp, Homo sapiens
aggttccagcagccagagaat

SEQ ID NO: 8574801 - DNA, 22 bp, Homo sapiens
aggtggagacccagagaaggcg

SEQ ID NO: 8574802 - DNA, 22 bp, Homo sapiens
aggtggagaagagatgggcagt

SEQ ID NO: 8574803 - DNA, 22 bp, Homo sapiens
aggtgcagtgaaggaaaaggaa

SEQ ID NO: 8574804 - DNA, 22 bp, Homo sapiens
aggtgcagtggctcatgcctgt

SEQ ID NO: 8574805 - DNA, 22 bp, Homo sapiens
aggtgcagtgtttaaaagtagc

SEQ ID NO: 8574806 - DNA, 23 bp, Homo sapiens
aggtgccaactgagagctgagag

SEQ ID NO: 8574807 - DNA, 21 bp, Homo sapiens
aggtgccaaggagaagcaggc

SEQ ID NO: 8574808 - DNA, 18 bp, Homo sapiens
agggtcagtgtcactggc

SEQ ID NO: 8574809 - DNA, 22 bp, Homo sapiens
agggtccatcaaggactgcaca

SEQ ID NO: 8574810 - DNA, 22 bp, Homo sapiens
agggtccatgtttccagttaat

SEQ ID NO: 8574811 - DNA, 22 bp, Homo sapiens
agttcaaagtcaaggaaactgt

SEQ ID NO: 8574812 - DNA, 22 bp, Homo sapiens
agttcaaagctgcagtaatgga

SEQ ID NO: 8574813 - DNA, 23 bp, Homo sapiens
agttcaaaatcaaccaggacact

SEQ ID NO: 8574814 - DNA, 22 bp, Homo sapiens
agtgtctttcatatcctccatc

SEQ ID NO: 8574815 - DNA, 22 bp, Homo sapiens
agtgtggggtcaccggcccagg

SEQ ID NO: 8574816 - DNA, 22 bp, Homo sapiens
agtgtgtactcatatacttcca

SEQ ID NO: 8574817 - DNA, 22 bp, Homo sapiens
agtggcagagcaggtgctggaa

SEQ ID NO: 8574818 - DNA, 20 bp, Homo sapiens
agtgggagagggcagactgc

SEQ ID NO: 8574819 - DNA, 22 bp, Homo sapiens
agtgggagcggcagtcggggac

SEQ ID NO: 8574820 - DNA, 22 bp, Homo sapiens
agtgggagccagcagcttgggg

SEQ ID NO: 8574821 - DNA, 22 bp, Homo sapiens
agtggcagaagtcactgggtag

SEQ ID NO: 8574822 - DNA, 22 bp, Homo sapiens
agtgcaaaattcagaagcaatt

SEQ ID NO: 8574823 - DNA, 22 bp, Homo sapiens
agtgcaaagcagcctgtacacc

SEQ ID NO: 8574824 - DNA, 20 bp, Homo sapiens
agtgcaagaaagcacagctg

SEQ ID NO: 8574825 - DNA, 22 bp, Homo sapiens
agtgcaaattatttacctgatt

SEQ ID NO: 8574826 - DNA, 22 bp, Homo sapiens
agtgcaaagggatcagattggg

SEQ ID NO: 8574827 - DNA, 18 bp, Homo sapiens
agaagcaggtaaaattct

SEQ ID NO: 8574828 - DNA, 18 bp, Homo sapiens
agaagcaggttctcccag

SEQ ID NO: 8574829 - DNA, 22 bp, Homo sapiens
agaagcagttattttttgcaca

SEQ ID NO: 8574830 - DNA, 22 bp, Homo sapiens
agaagcagggcagggaaaagca

SEQ ID NO: 8574831 - DNA, 22 bp, Homo sapiens
agaagcaggcctcacagatctg

SEQ ID NO: 8574832 - DNA, 21 bp, Homo sapiens
agaagccatgccagtaaaatt

SEQ ID NO: 8574833 - DNA, 22 bp, Homo sapiens
agaagccatggggtcaccagag

SEQ ID NO: 8574834 - DNA, 22 bp, Homo sapiens
atcctgggaatgggagggtcat

SEQ ID NO: 8574835 - DNA, 22 bp, Homo sapiens
atcctgggaagtggcctcctcc

SEQ ID NO: 8574836 - DNA, 22 bp, Homo sapiens
atcctgggaagctgacattgaa

SEQ ID NO: 8574837 - DNA, 22 bp, Homo sapiens
agaagccatgtttagtaggatg

SEQ ID NO: 8574838 - DNA, 21 bp, Homo sapiens
agaagccatttgttaggactt

SEQ ID NO: 8574839 - DNA, 22 bp, Homo sapiens
agaaagacgtgatgaagaagta

SEQ ID NO: 8574840 - DNA, 22 bp, Homo sapiens
agaaagaacgttggttatctta

SEQ ID NO: 8574841 - DNA, 17 bp, Homo sapiens
agaaagaggatccacag

SEQ ID NO: 8574842 - DNA, 22 bp, Homo sapiens
agaaagaggatgcagatctcat

SEQ ID NO: 8574843 - DNA, 22 bp, Homo sapiens
agaaagaacgcacttgtgctgc

SEQ ID NO: 8574844 - DNA, 22 bp, Homo sapiens
agaaatgcctacgagataggga

SEQ ID NO: 8574845 - DNA, 22 bp, Homo sapiens
atagtgtcagaaaatcataaga

SEQ ID NO: 8574846 - DNA, 20 bp, Homo sapiens
actttacagagaagactgac

SEQ ID NO: 8574847 - DNA, 22 bp, Homo sapiens
atacaatgggtgcaaagatgtg

SEQ ID NO: 8574848 - DNA, 22 bp, Homo sapiens
atacaaagacaaatctcaatct

SEQ ID NO: 8574849 - DNA, 22 bp, Homo sapiens
ataaggaaatgaaactctaata

SEQ ID NO: 8574850 - DNA, 22 bp, Homo sapiens
ataaatttataattgtttcctg

SEQ ID NO: 8574851 - DNA, 22 bp, Homo sapiens
ataaattttcttgctgtactta

SEQ ID NO: 8574852 - DNA, 22 bp, Homo sapiens
atgcttctgtaatgtgggaatg

SEQ ID NO: 8574853 - DNA, 22 bp, Homo sapiens
agagaacagacagatgcaatga

SEQ ID NO: 8574854 - DNA, 22 bp, Homo sapiens
agagaacagcattgcagctttg

SEQ ID NO: 8574855 - DNA, 22 bp, Homo sapiens
agagaacagacagatgcaatga

SEQ ID NO: 8574856 - DNA, 22 bp, Homo sapiens
atgattttctgataaagaactg

SEQ ID NO: 8574857 - DNA, 22 bp, Homo sapiens
atgacttcacctctgtgaagca

SEQ ID NO: 8574858 - DNA, 22 bp, Homo sapiens
atgacttctgcaaggtcatttg

SEQ ID NO: 8574859 - DNA, 22 bp, Homo sapiens
atgaggcaaggatcaggtaagg

SEQ ID NO: 8574860 - DNA, 22 bp, Homo sapiens
atctgttgtttgtttgctaaag

SEQ ID NO: 8574861 - DNA, 22 bp, Homo sapiens
atgaccagccgagataaacaga

SEQ ID NO: 8574862 - DNA, 21 bp, Homo sapiens
agagactgtcactgcagtacc

SEQ ID NO: 8574863 - DNA, 22 bp, Homo sapiens
agagccagcaagtgaatagtga

SEQ ID NO: 8574864 - DNA, 22 bp, Homo sapiens
atgtgcagaggcttccttgact

SEQ ID NO: 8574865 - DNA, 22 bp, Homo sapiens
atgtgcagcttttctagagaag

SEQ ID NO: 8574866 - DNA, 22 bp, Homo sapiens
atgtgcaggatccaggctccta

SEQ ID NO: 8574867 - DNA, 22 bp, Homo sapiens
agagatgtagcaaagaaccaca

SEQ ID NO: 8574868 - DNA, 22 bp, Homo sapiens
attaaatactgcaggctaagca

SEQ ID NO: 8574869 - DNA, 22 bp, Homo sapiens
agagctaagaaacagaattgct

SEQ ID NO: 8574870 - DNA, 22 bp, Homo sapiens
agagcggggatagttaatattc

SEQ ID NO: 8574871 - DNA, 22 bp, Homo sapiens
agagctaagaaacagaattgct

SEQ ID NO: 8574872 - DNA, 22 bp, Homo sapiens
agagctaggaatgaccactctc

SEQ ID NO: 8574873 - DNA, 22 bp, Homo sapiens
atgttctacagatggaaagggg

SEQ ID NO: 8574874 - DNA, 22 bp, Homo sapiens
atgttctacagatggaaagggg

SEQ ID NO: 8574875 - DNA, 23 bp, Homo sapiens
atttacagctgtgtgagcaagtt

SEQ ID NO: 8574876 - DNA, 22 bp, Homo sapiens
agattgtcattgacgatgagca

SEQ ID NO: 8574877 - DNA, 22 bp, Homo sapiens
attttctgtaactatttctata

SEQ ID NO: 8574878 - DNA, 22 bp, Homo sapiens
attttgttatagaactctgtga

SEQ ID NO: 8574879 - DNA, 22 bp, Homo sapiens
agcaagtagtaccaagtagctc

SEQ ID NO: 8574880 - DNA, 22 bp, Homo sapiens
agaggccggccgagcccatggg

SEQ ID NO: 8574881 - DNA, 22 bp, Homo sapiens
attgaaagagaatgtagctctt

SEQ ID NO: 8574882 - DNA, 22 bp, Homo sapiens
attgtatcttgtcattatgcat

SEQ ID NO: 8574883 - DNA, 22 bp, Homo sapiens
agatacaagttaagagaaagga

SEQ ID NO: 8574884 - DNA, 22 bp, Homo sapiens
agataattatttacttcaaagt

SEQ ID NO: 8574885 - DNA, 22 bp, Homo sapiens
agcccttcaagagctctgtcct

SEQ ID NO: 8574886 - DNA, 22 bp, Homo sapiens
agcccttcaacctgcctactcc

SEQ ID NO: 8574887 - DNA, 22 bp, Homo sapiens
agccctttccaatttgatttat

SEQ ID NO: 8574888 - DNA, 22 bp, Homo sapiens
cagatccacccttgtagtgaca

SEQ ID NO: 8574889 - DNA, 18 bp, Homo sapiens
cagatccaggcagctatt

SEQ ID NO: 8574890 - DNA, 22 bp, Homo sapiens
agccagggaaggataacaagaa

SEQ ID NO: 8574891 - DNA, 22 bp, Homo sapiens
agccagggaagaggcctacctc

SEQ ID NO: 8574892 - DNA, 22 bp, Homo sapiens
agccagggacgctgcaggctac

SEQ ID NO: 8574893 - DNA, 22 bp, Homo sapiens
agccagggctctccttcgcgtg

SEQ ID NO: 8574894 - DNA, 22 bp, Homo sapiens
agccagggatgcagcacagtga

SEQ ID NO: 8574895 - DNA, 22 bp, Homo sapiens
agccagggatggcagtgcccag

SEQ ID NO: 8574896 - DNA, 22 bp, Homo sapiens
agccagggctgcgagcagacag

SEQ ID NO: 8574897 - DNA, 22 bp, Homo sapiens
agccagggctgcaggttccttg

SEQ ID NO: 8574898 - DNA, 22 bp, Homo sapiens
agccaggggagtcagctgctgg

SEQ ID NO: 8574899 - DNA, 22 bp, Homo sapiens
cagctggcagccctggccctgc

SEQ ID NO: 8574900 - DNA, 22 bp, Homo sapiens
cagctgggtggctcttctgctc

SEQ ID NO: 8574901 - DNA, 22 bp, Homo sapiens
cagcctctaagcacagcctctc

SEQ ID NO: 8574902 - DNA, 22 bp, Homo sapiens
agcgcaggaacacgtctgcctt

SEQ ID NO: 8574903 - DNA, 22 bp, Homo sapiens
caattagacatttattggccag

SEQ ID NO: 8574904 - DNA, 22 bp, Homo sapiens
caattagaggaggaagctcata

SEQ ID NO: 8574905 - DNA, 22 bp, Homo sapiens
caagtctgacctctgggtgaag

SEQ ID NO: 8574906 - DNA, 22 bp, Homo sapiens
caagtccaggtgggcaaataaa

SEQ ID NO: 8574907 - DNA, 22 bp, Homo sapiens
caagtccaagatcaagaagcca

SEQ ID NO: 8574908 - DNA, 22 bp, Homo sapiens
agcagagacatgaaatatgctt

SEQ ID NO: 8574909 - DNA, 22 bp, Homo sapiens
cacaggaaatgattctgcagca

SEQ ID NO: 8574910 - DNA, 22 bp, Homo sapiens
agcattcaagtaattcacttgg

SEQ ID NO: 8574911 - DNA, 22 bp, Homo sapiens
agccaaagtccaaatgcagtgt

SEQ ID NO: 8574912 - DNA, 20 bp, Homo sapiens
cagaaagaaggtagattttt

SEQ ID NO: 8574913 - DNA, 20 bp, Homo sapiens
acagaaagctgccttgtccc

SEQ ID NO: 8574914 - DNA, 22 bp, Homo sapiens
acacataagcctaatcatctcc

SEQ ID NO: 8574915 - DNA, 22 bp, Homo sapiens
aagatacagacagagccaaaat

SEQ ID NO: 8574916 - DNA, 23 bp, Homo sapiens
aagatacaggtgtggaatggttt

SEQ ID NO: 8574917 - DNA, 22 bp, Homo sapiens
acagcaggaagctggagggaaa

SEQ ID NO: 8574918 - DNA, 22 bp, Homo sapiens
acagcagggggagctgttggac

SEQ ID NO: 8574919 - DNA, 22 bp, Homo sapiens
aagcaggacgtatttctatcct

SEQ ID NO: 8574920 - DNA, 18 bp, Homo sapiens
aagcagggtccattgtgc

SEQ ID NO: 8574921 - DNA, 22 bp, Homo sapiens
acagcaggttacagtggcacag

SEQ ID NO: 8574922 - DNA, 22 bp, Homo sapiens
aagccagtaagtttttgtcatt

SEQ ID NO: 8574923 - DNA, 22 bp, Homo sapiens
acaacaaaatcactagtcttcc

SEQ ID NO: 8574924 - DNA, 23 bp, Homo sapiens
acaatgtctgttcataaaatacc

SEQ ID NO: 8574925 - DNA, 22 bp, Homo sapiens
acaaatgaatcatacataatgt

SEQ ID NO: 8574926 - DNA, 22 bp, Homo sapiens
acaaaatagagttctcccctgg

SEQ ID NO: 8574927 - DNA, 22 bp, Homo sapiens
aagaacaggttctagaaccatt

SEQ ID NO: 8574928 - DNA, 22 bp, Homo sapiens
aagaacaggttctagaaccatt

SEQ ID NO: 8574929 - DNA, 22 bp, Homo sapiens
aagtaacttatttgcaaacagg

SEQ ID NO: 8574930 - DNA, 22 bp, Homo sapiens
aagtaactaaagatatccattt

SEQ ID NO: 8574931 - DNA, 22 bp, Homo sapiens
aagtccagtgaaatagaatgca

SEQ ID NO: 8574932 - DNA, 22 bp, Homo sapiens
aacagtaagagatgttttatct

SEQ ID NO: 8574933 - DNA, 22 bp, Homo sapiens
aacagtgtcaggattacagata

SEQ ID NO: 8574934 - DNA, 22 bp, Homo sapiens
aacagtgtttttcttcagcact

SEQ ID NO: 8574935 - DNA, 22 bp, Homo sapiens
aagtctgtagaaaaacagttta

SEQ ID NO: 8574936 - DNA, 19 bp, Homo sapiens
aaatggagctaatcttgtc

SEQ ID NO: 8574937 - DNA, 22 bp, Homo sapiens
aaatggaggcaaaattggtttc

SEQ ID NO: 8574938 - DNA, 22 bp, Homo sapiens
aaatggagttctaagtatagta

SEQ ID NO: 8574939 - DNA, 22 bp, Homo sapiens
aaatggaggcacgcagtggtta

SEQ ID NO: 8574940 - DNA, 22 bp, Homo sapiens
aaggagtctgggccattcagag

SEQ ID NO: 8574941 - DNA, 22 bp, Homo sapiens
aaggatcaagtggattttctta

SEQ ID NO: 8574942 - DNA, 22 bp, Homo sapiens
aatgaaagaatgaaacagccca

SEQ ID NO: 8574943 - DNA, 22 bp, Homo sapiens
aatctcttcccagtaaaaatgg

SEQ ID NO: 8574944 - DNA, 22 bp, Homo sapiens
aatgcagattcttattctgtag

SEQ ID NO: 8574945 - DNA, 22 bp, Homo sapiens
aatgcacctaccttgattctgc

SEQ ID NO: 8574946 - DNA, 22 bp, Homo sapiens
aatgctttaattgcatgtagtg

SEQ ID NO: 8574947 - DNA, 22 bp, Homo sapiens
aacttcattcctttttatgact

SEQ ID NO: 8574948 - DNA, 22 bp, Homo sapiens
aacttgtttagaagaggttact

SEQ ID NO: 8574949 - DNA, 22 bp, Homo sapiens
aacttgttagaaatgcagaatc

SEQ ID NO: 8574950 - DNA, 22 bp, Homo sapiens
aactttaaggctataaattatg

SEQ ID NO: 8574951 - DNA, 22 bp, Homo sapiens
aatattgagaaccagcatgttt

SEQ ID NO: 8574952 - DNA, 22 bp, Homo sapiens
aatatttatgacaggaagtagc

SEQ ID NO: 8574953 - DNA, 22 bp, Homo sapiens
aagttacagttacagaatggag

SEQ ID NO: 8574954 - DNA, 22 bp, Homo sapiens
aataatgagacagcttatttaa

SEQ ID NO: 8574955 - DNA, 22 bp, Homo sapiens
aataatgagcttgtctaattgt

SEQ ID NO: 8574956 - DNA, 22 bp, Homo sapiens
aaagacagtggattcaaaatcc

SEQ ID NO: 8574957 - DNA, 22 bp, Homo sapiens
aaagacacacagccagcaagtg

SEQ ID NO: 8574958 - DNA, 22 bp, Homo sapiens
aaatacacgtacatgtgtaaaa

SEQ ID NO: 8574959 - DNA, 19 bp, Homo sapiens
aaagttttattctcatttg

SEQ ID NO: 8574960 - DNA, 22 bp, Homo sapiens
aaagttttctgccttcattaga

SEQ ID NO: 8574961 - DNA, 22 bp, Homo sapiens
aaagtttttaagcaagaccctt

SEQ ID NO: 8574962 - DNA, 22 bp, Homo sapiens
aaagttttgttgattgtggaat

SEQ ID NO: 8574963 - DNA, 22 bp, Homo sapiens
aaagtcacttccttctgtcagc

SEQ ID NO: 8574964 - DNA, 22 bp, Homo sapiens
aaagtacatgcaattcttctga

SEQ ID NO: 8574965 - DNA, 22 bp, Homo sapiens
aaaacactgcaaagctgattgg

SEQ ID NO: 8574966 - DNA, 22 bp, Homo sapiens
aaaacattttactgccatctca

SEQ ID NO: 8574967 - DNA, 22 bp, Homo sapiens
aaaatgatatcctgacttttat

SEQ ID NO: 8574968 - DNA, 22 bp, Homo sapiens
aaaatgctatttcatggaggag

SEQ ID NO: 8574969 - DNA, 22 bp, Homo sapiens
aaaatggcttaataggcaataa

SEQ ID NO: 8574970 - DNA, 22 bp, Homo sapiens
aaaatgctgggaaagttggaat

SEQ ID NO: 8574971 - DNA, 22 bp, Homo sapiens
aaaatgctcatcagcgatggct

SEQ ID NO: 8574972 - DNA, 21 bp, Homo sapiens
aaagcagcccatggcacagtc

SEQ ID NO: 8574973 - DNA, 22 bp, Homo sapiens
aaaatactgtggagtgttgaaa

SEQ ID NO: 8574974 - DNA, 22 bp, Homo sapiens
aaaagtttgtgcaaacactcag

SEQ ID NO: 8574975 - DNA, 21 bp, Homo sapiens
aaaagtttgacaggaaaggga

SEQ ID NO: 8574976 - DNA, 22 bp, Homo sapiens
aaaatacacatactaggggaaa

SEQ ID NO: 8574977 - DNA, 22 bp, Homo sapiens
aaaagtttaagactcattctag

SEQ ID NO: 8574978 - DNA, 22 bp, Homo sapiens
aaagcagtataagtaacggaag

SEQ ID NO: 8574979 - DNA, 22 bp, Homo sapiens
aaagcagtatagtggaagggct

SEQ ID NO: 8574980 - DNA, 22 bp, Homo sapiens
aaagcaggttgcaattacagtg

SEQ ID NO: 8574981 - DNA, 22 bp, Homo sapiens
aaagcagtctcagacttaagca

SEQ ID NO: 8574982 - DNA, 20 bp, Homo sapiens
aaagcagtatgcaagtagag

SEQ ID NO: 8574983 - DNA, 22 bp, Homo sapiens
aaagcagtccttcccttaaggt

SEQ ID NO: 8574984 - DNA, 22 bp, Homo sapiens
aaattagatcagtggattttct

SEQ ID NO: 8574985 - DNA, 22 bp, Homo sapiens
aaattagatatgtgtgagactc

SEQ ID NO: 8574986 - DNA, 22 bp, Homo sapiens
aaattagaccagttcaggtcca

SEQ ID NO: 8574987 - DNA, 22 bp, Homo sapiens
aaattgctgtgaggtggtagta

SEQ ID NO: 8574988 - DNA, 22 bp, Homo sapiens
aaattgctctttaaaagtactg

SEQ ID NO: 8574989 - DNA, 22 bp, Homo sapiens
aaattgctatatgtgaatgtga

SEQ ID NO: 8574990 - DNA, 22 bp, Homo sapiens
aaagcatgctactttatatagg

SEQ ID NO: 8574991 - DNA, 22 bp, Homo sapiens
aaagtccagggaaagagcgtct

SEQ ID NO: 8574992 - DNA, 22 bp, Homo sapiens
aaatatagtaaatgcatagttc

SEQ ID NO: 8574993 - DNA, 22 bp, Homo sapiens
aaatatgagatgttctctttcg

SEQ ID NO: 8574994 - DNA, 22 bp, Homo sapiens
aaatgattgtcaaagttctgtt

SEQ ID NO: 8574995 - DNA, 22 bp, Homo sapiens
aaatgcaaggcacattcctttt

SEQ ID NO: 8574996 - DNA, 22 bp, Homo sapiens
aaatgagtagcgatgcacatta

SEQ ID NO: 8574997 - DNA, 22 bp, Homo sapiens
aaatatttgtctgaggcggttg

SEQ ID NO: 8574998 - DNA, 22 bp, Homo sapiens
aaatattggtaggatgcttgtt

SEQ ID NO: 8574999 - DNA, 22 bp, Homo sapiens
aattacagtcggagcagcactg

SEQ ID NO: 8575000 - DNA, 22 bp, Homo sapiens
aattacaaatgtagactctcat

SEQ ID NO: 8575001 - DNA, 23 bp, Homo sapiens
aattacaaccaagaactggaagg

SEQ ID NO: 8575002 - DNA, 22 bp, Homo sapiens
aattccagctaggaaaagcttc

SEQ ID NO: 8575003 - DNA, 22 bp, Homo sapiens
agacattatggctttcactggg

SEQ ID NO: 8575004 - DNA, 21 bp, Homo sapiens
aatgtgtgctatttatctttt

SEQ ID NO: 8575005 - DNA, 22 bp, Homo sapiens
agagatttgtcaatgatttcca

SEQ ID NO: 8575006 - DNA, 20 bp, Homo sapiens
agagattttagtagccacag

SEQ ID NO: 8575007 - DNA, 22 bp, Homo sapiens
agcaaatacttgaataaaaaga

SEQ ID NO: 8575008 - DNA, 23 bp, Homo sapiens
agcacaaagtgttttccttgtag

SEQ ID NO: 8575009 - DNA, 22 bp, Homo sapiens
agcacagaatgaggtggaagtg

SEQ ID NO: 8575010 - DNA, 22 bp, Homo sapiens
acaaatagagattcaaataaag

SEQ ID NO: 8575011 - DNA, 22 bp, Homo sapiens
acaaagtgctgacattacaggc

SEQ ID NO: 8575012 - DNA, 22 bp, Homo sapiens
acacacaaatctattagtgaat

SEQ ID NO: 8575013 - DNA, 22 bp, Homo sapiens
acacacaactcattgtgtaata

SEQ ID NO: 8575014 - DNA, 22 bp, Homo sapiens
acacacaactcattgtgtaata

SEQ ID NO: 8575015 - DNA, 22 bp, Homo sapiens
acacacaattagttttatgctt

SEQ ID NO: 8575016 - DNA, 22 bp, Homo sapiens
acacaagattgtgtattgaatt

SEQ ID NO: 8575017 - DNA, 22 bp, Homo sapiens
acacaatacagggctcaaaata

SEQ ID NO: 8575018 - DNA, 22 bp, Homo sapiens
agcagggactacgtgaaagtga

SEQ ID NO: 8575019 - DNA, 22 bp, Homo sapiens
agccaggaagaaggtcacacca

SEQ ID NO: 8575020 - DNA, 22 bp, Homo sapiens
agcaggtggtaggcagtcagca

SEQ ID NO: 8575021 - DNA, 22 bp, Homo sapiens
acagaatattgtaagtgccact

SEQ ID NO: 8575022 - DNA, 22 bp, Homo sapiens
acagaatagttggccctgctat

SEQ ID NO: 8575023 - DNA, 22 bp, Homo sapiens
acagaagctcaagagagcagtg

SEQ ID NO: 8575024 - DNA, 22 bp, Homo sapiens
agccttcactgggaccttggat

SEQ ID NO: 8575025 - DNA, 22 bp, Homo sapiens
agccttcaacctagctagagca

SEQ ID NO: 8575026 - DNA, 22 bp, Homo sapiens
agcgtgaattagttggtacaca

SEQ ID NO: 8575027 - DNA, 22 bp, Homo sapiens
agctgagaggtggcaagctgta

SEQ ID NO: 8575028 - DNA, 17 bp, Homo sapiens
acagcaggcccggaggg

SEQ ID NO: 8575029 - DNA, 22 bp, Homo sapiens
acagcagcataaactgactaag

SEQ ID NO: 8575030 - DNA, 22 bp, Homo sapiens
aagtagacttttgcatcaagga

SEQ ID NO: 8575031 - DNA, 22 bp, Homo sapiens
aagtagacagtcatctactttg

SEQ ID NO: 8575032 - DNA, 18 bp, Homo sapiens
aagtagatcatgagccac

SEQ ID NO: 8575033 - DNA, 22 bp, Homo sapiens
aagtagcaatctcattagttgg

SEQ ID NO: 8575034 - DNA, 22 bp, Homo sapiens
aagtccagtgctttagattcca

SEQ ID NO: 8575035 - DNA, 22 bp, Homo sapiens
aagtcctgttcctcatacttcc

SEQ ID NO: 8575036 - DNA, 20 bp, Homo sapiens
aagtcctgacctagtctaaa

SEQ ID NO: 8575037 - DNA, 22 bp, Homo sapiens
aagtcctgggcatttgaacagg

SEQ ID NO: 8575038 - DNA, 22 bp, Homo sapiens
aagtcctgggtgagaactgtcc

SEQ ID NO: 8575039 - DNA, 22 bp, Homo sapiens
aagtcctgtgctagagacacct

SEQ ID NO: 8575040 - DNA, 22 bp, Homo sapiens
aagggctggatctctctgagca

SEQ ID NO: 8575041 - DNA, 22 bp, Homo sapiens
aagggggccacacctggtgtga

SEQ ID NO: 8575042 - DNA, 22 bp, Homo sapiens
acatgcatgtcatcagcccttt

SEQ ID NO: 8575043 - DNA, 22 bp, Homo sapiens
aagctgttgttcatcctgaatt

SEQ ID NO: 8575044 - DNA, 22 bp, Homo sapiens
aataatacatgagattaatgtt

SEQ ID NO: 8575045 - DNA, 22 bp, Homo sapiens
aagtttttggtagagaaaagta

SEQ ID NO: 8575046 - DNA, 22 bp, Homo sapiens
aagttttgaaatactgaagtgt

SEQ ID NO: 8575047 - DNA, 22 bp, Homo sapiens
aagtttttcacattgctgttgt

SEQ ID NO: 8575048 - DNA, 22 bp, Homo sapiens
aagtttttgattctaagagaga

SEQ ID NO: 8575049 - DNA, 22 bp, Homo sapiens
aatagcatagagttaaaatgca

SEQ ID NO: 8575050 - DNA, 22 bp, Homo sapiens
aatagaatgtaatctaatacat

SEQ ID NO: 8575051 - DNA, 22 bp, Homo sapiens
actgtctcctcatcatgcctgg

SEQ ID NO: 8575052 - DNA, 22 bp, Homo sapiens
actgcatgataataatagcaga

SEQ ID NO: 8575053 - DNA, 18 bp, Homo sapiens
actctttctgcccacagg

SEQ ID NO: 8575054 - DNA, 22 bp, Homo sapiens
aagtgtgggaagtaggtggcga

SEQ ID NO: 8575055 - DNA, 22 bp, Homo sapiens
aagtgtgatttgtagaatgcct

SEQ ID NO: 8575056 - DNA, 22 bp, Homo sapiens
aagtgtttggggatcattttaa

SEQ ID NO: 8575057 - DNA, 22 bp, Homo sapiens
agaaaggaggaagaatgacctc

SEQ ID NO: 8575058 - DNA, 22 bp, Homo sapiens
aatcctggctgcgttggccagc

SEQ ID NO: 8575059 - DNA, 22 bp, Homo sapiens
aatagctgggacctgaattagc

SEQ ID NO: 8575060 - DNA, 22 bp, Homo sapiens
acttttcaaatgggaaactcag

SEQ ID NO: 8575061 - DNA, 22 bp, Homo sapiens
agaaggaaggataactgcatta

SEQ ID NO: 8575062 - DNA, 22 bp, Homo sapiens
agaagccagattgtagtgggac

SEQ ID NO: 8575063 - DNA, 22 bp, Homo sapiens
agaagccagaggcagtgggtac

SEQ ID NO: 8575064 - DNA, 22 bp, Homo sapiens
aatgaactggagaacaatgacc

SEQ ID NO: 8575065 - DNA, 22 bp, Homo sapiens
agaacgtctttactcttacgaa

SEQ ID NO: 8575066 - DNA, 21 bp, Homo sapiens
tagaggcaggagggactgcag

SEQ ID NO: 8575067 - DNA, 22 bp, Homo sapiens
tagaggcataagagggaagcag

SEQ ID NO: 8575068 - DNA, 22 bp, Homo sapiens
tagaattgggcctaacttccat

SEQ ID NO: 8575069 - DNA, 22 bp, Homo sapiens
tagaaagaacttcatgtaaaac

SEQ ID NO: 8575070 - DNA, 22 bp, Homo sapiens
tagaaagctgagtaatacattt

SEQ ID NO: 8575071 - DNA, 22 bp, Homo sapiens
tactttttatgataagaactga

SEQ ID NO: 8575072 - DNA, 22 bp, Homo sapiens
taccaaaagcttgtttcataca

SEQ ID NO: 8575073 - DNA, 22 bp, Homo sapiens
tagaaacattcagttgcagtcc

SEQ ID NO: 8575074 - DNA, 22 bp, Homo sapiens
tagcagaggctactgctccttg

SEQ ID NO: 8575075 - DNA, 22 bp, Homo sapiens
tagcagaggtaagtgtggcaat

SEQ ID NO: 8575076 - DNA, 22 bp, Homo sapiens
taggcacaagaccatgcaaagg

SEQ ID NO: 8575077 - DNA, 22 bp, Homo sapiens
taggcacaaaatgaaaatggca

SEQ ID NO: 8575078 - DNA, 22 bp, Homo sapiens
taggataggatggagacagaat

SEQ ID NO: 8575079 - DNA, 22 bp, Homo sapiens
tatgtacaccggggaaggtggg

SEQ ID NO: 8575080 - DNA, 22 bp, Homo sapiens
tatgtcctgctactctctcatg

SEQ ID NO: 8575081 - DNA, 22 bp, Homo sapiens
tatgtacataacatgaaatgca

SEQ ID NO: 8575082 - DNA, 22 bp, Homo sapiens
tatttatcaaggtaggagaata

SEQ ID NO: 8575083 - DNA, 22 bp, Homo sapiens
tatttctaagctgtaagtctga

SEQ ID NO: 8575084 - DNA, 22 bp, Homo sapiens
tattattaaatggcagaatttt

SEQ ID NO: 8575085 - DNA, 22 bp, Homo sapiens
tattattatagttattgggaag

SEQ ID NO: 8575086 - DNA, 22 bp, Homo sapiens
tattattatgcatagcatgaaa

SEQ ID NO: 8575087 - DNA, 22 bp, Homo sapiens
tattcatgagataggcagtttt

SEQ ID NO: 8575088 - DNA, 22 bp, Homo sapiens
tattgaattagaccctaaaatg

SEQ ID NO: 8575089 - DNA, 22 bp, Homo sapiens
tatacaagaggtgagatgagca

SEQ ID NO: 8575090 - DNA, 22 bp, Homo sapiens
tatacaagtgagaagaagagtt

SEQ ID NO: 8575091 - DNA, 20 bp, Homo sapiens
tataaattcagagctttggt

SEQ ID NO: 8575092 - DNA, 22 bp, Homo sapiens
tataaattaatgtgcccatgag

SEQ ID NO: 8575093 - DNA, 22 bp, Homo sapiens
tataaattattaggctgctaaa

SEQ ID NO: 8575094 - DNA, 20 bp, Homo sapiens
taggtccaatgctcgtcttc

SEQ ID NO: 8575095 - DNA, 22 bp, Homo sapiens
taggtccagcacggtgtagctt

SEQ ID NO: 8575096 - DNA, 22 bp, Homo sapiens
taggtccacagatttggtttct

SEQ ID NO: 8575097 - DNA, 22 bp, Homo sapiens
taggtccacaagatcaatgcag

SEQ ID NO: 8575098 - DNA, 22 bp, Homo sapiens
tatatatgggggaagctggatg

SEQ ID NO: 8575099 - DNA, 22 bp, Homo sapiens
tatatatgagcatgtgaggaca

SEQ ID NO: 8575100 - DNA, 22 bp, Homo sapiens
tacatacattacctcatttagt

SEQ ID NO: 8575101 - DNA, 22 bp, Homo sapiens
tacaggcccatagtccctgctt

SEQ ID NO: 8575102 - DNA, 22 bp, Homo sapiens
tacatttgctttgattttcagc

SEQ ID NO: 8575103 - DNA, 22 bp, Homo sapiens
tacattctcttcccattgtctc

SEQ ID NO: 8575104 - DNA, 22 bp, Homo sapiens
tacaacagttcatgaaatgaaa

SEQ ID NO: 8575105 - DNA, 22 bp, Homo sapiens
tacaacaggaatttcaactttg

SEQ ID NO: 8575106 - DNA, 22 bp, Homo sapiens
tacagaaagggatgattgatct

SEQ ID NO: 8575107 - DNA, 20 bp, Homo sapiens
tacagaaacaggacttttgg

SEQ ID NO: 8575108 - DNA, 22 bp, Homo sapiens
tacaaagtcaccagcttcttgc

SEQ ID NO: 8575109 - DNA, 22 bp, Homo sapiens
tacaaagtgagcaacctctttt

SEQ ID NO: 8575110 - DNA, 22 bp, Homo sapiens
tacaaagtgaaataattctgag

SEQ ID NO: 8575111 - DNA, 22 bp, Homo sapiens
tacaaagtttggggtcctcaaa

SEQ ID NO: 8575112 - DNA, 22 bp, Homo sapiens
tacaacagacctagatgaatga

SEQ ID NO: 8575113 - DNA, 22 bp, Homo sapiens
tacagaagctgagacactgaga

SEQ ID NO: 8575114 - DNA, 22 bp, Homo sapiens
taagtagatgcaaaatggagtt

SEQ ID NO: 8575115 - DNA, 22 bp, Homo sapiens
taagtagactgttgaacttggt

SEQ ID NO: 8575116 - DNA, 23 bp, Homo sapiens
taattagatgttgattcctgaga

SEQ ID NO: 8575117 - DNA, 22 bp, Homo sapiens
taattacaaagcaagcacaggg

SEQ ID NO: 8575118 - DNA, 22 bp, Homo sapiens
gttgtaagtttaatgtcaattg

SEQ ID NO: 8575119 - DNA, 22 bp, Homo sapiens
gttgagtgggttaggatgctga

SEQ ID NO: 8575120 - DNA, 21 bp, Homo sapiens
gttcaatagctctttgaatgc

SEQ ID NO: 8575121 - DNA, 22 bp, Homo sapiens
gttgaggtgatgccagccctgc

SEQ ID NO: 8575122 - DNA, 22 bp, Homo sapiens
gtgtgcatgtggaagcatgtat

SEQ ID NO: 8575123 - DNA, 22 bp, Homo sapiens
gtgctccctccttcctcaagga

SEQ ID NO: 8575124 - DNA, 22 bp, Homo sapiens
gtgctcctcacagtgtggccct

SEQ ID NO: 8575125 - DNA, 22 bp, Homo sapiens
gtgtggctagaagtgtcttgtt

SEQ ID NO: 8575126 - DNA, 22 bp, Homo sapiens
taaagtgtatgccatctctcat

SEQ ID NO: 8575127 - DNA, 22 bp, Homo sapiens
taaagtgtctgcctcagctcag

SEQ ID NO: 8575128 - DNA, 22 bp, Homo sapiens
taaattactcaatgcacataaa

SEQ ID NO: 8575129 - DNA, 22 bp, Homo sapiens
taaattagagccaggtaagttt

SEQ ID NO: 8575130 - DNA, 23 bp, Homo sapiens
taaattacctttccagtgcaggg

SEQ ID NO: 8575131 - DNA, 22 bp, Homo sapiens
taaattaccctttagggaattg

SEQ ID NO: 8575132 - DNA, 20 bp, Homo sapiens
taaattagccttgaagatta

SEQ ID NO: 8575133 - DNA, 22 bp, Homo sapiens
taaattagggactttagttaat

SEQ ID NO: 8575134 - DNA, 22 bp, Homo sapiens
taactctgcttgttctctgagt

SEQ ID NO: 8575135 - DNA, 23 bp, Homo sapiens
taactctgtgaagggtgactggg

SEQ ID NO: 8575136 - DNA, 22 bp, Homo sapiens
taactctgaatcctcacagcag

SEQ ID NO: 8575137 - DNA, 22 bp, Homo sapiens
taaatttttgttaacagcctct

SEQ ID NO: 8575138 - DNA, 22 bp, Homo sapiens
taaattgttttctagaagttgt

SEQ ID NO: 8575139 - DNA, 22 bp, Homo sapiens
taaattctgatcaagttccttc

SEQ ID NO: 8575140 - DNA, 22 bp, Homo sapiens
gtttcccaaattgttcacaggg

SEQ ID NO: 8575141 - DNA, 22 bp, Homo sapiens
gttttctttgaatgcttctaga

SEQ ID NO: 8575142 - DNA, 22 bp, Homo sapiens
gttttggctctggcatgtggaa

SEQ ID NO: 8575143 - DNA, 22 bp, Homo sapiens
gttttggcagccgtgttcacat

SEQ ID NO: 8575144 - DNA, 22 bp, Homo sapiens
taaaagttttagttgtacataa

SEQ ID NO: 8575145 - DNA, 22 bp, Homo sapiens
tcccagtgaggtcctggctgtc

SEQ ID NO: 8575146 - DNA, 21 bp, Homo sapiens
tcccattgttcccctccagtg

SEQ ID NO: 8575147 - DNA, 22 bp, Homo sapiens
tcccatgttgtgcctggctgca

SEQ ID NO: 8575148 - DNA, 20 bp, Homo sapiens
tcccatgtccatatcagccc

SEQ ID NO: 8575149 - DNA, 22 bp, Homo sapiens
tcccatgtgactcagctgcctg

SEQ ID NO: 8575150 - DNA, 22 bp, Homo sapiens
tcccatgtaagaaggagacagg

SEQ ID NO: 8575151 - DNA, 22 bp, Homo sapiens
tcccagggattaggacatggat

SEQ ID NO: 8575152 - DNA, 22 bp, Homo sapiens
tcccagggttacagccagggca

SEQ ID NO: 8575153 - DNA, 22 bp, Homo sapiens
tccccacctaagatacccatct

SEQ ID NO: 8575154 - DNA, 22 bp, Homo sapiens
tccaggcattccagccattcca

SEQ ID NO: 8575155 - DNA, 22 bp, Homo sapiens
tccaggaggtatgagtggcccc

SEQ ID NO: 8575156 - DNA, 22 bp, Homo sapiens
tccaggcagggcagccatcaag

SEQ ID NO: 8575157 - DNA, 21 bp, Homo sapiens
tccaggagttctaataggtgt

SEQ ID NO: 8575158 - DNA, 22 bp, Homo sapiens
tccaggagtggggcagaggtct

SEQ ID NO: 8575159 - DNA, 22 bp, Homo sapiens
tccaggagtgctggttagagta

SEQ ID NO: 8575160 - DNA, 19 bp, Homo sapiens
tccagggcaggaacatgta

SEQ ID NO: 8575161 - DNA, 22 bp, Homo sapiens
tccagggccacagaggatgcta

SEQ ID NO: 8575162 - DNA, 22 bp, Homo sapiens
tccagggccatgaagttgcaca

SEQ ID NO: 8575163 - DNA, 22 bp, Homo sapiens
tccagggccccccagttgcacg

SEQ ID NO: 8575164 - DNA, 22 bp, Homo sapiens
tccagggcctgaggttgaagtg

SEQ ID NO: 8575165 - DNA, 22 bp, Homo sapiens
tccagggctacaaggcaccaga

SEQ ID NO: 8575166 - DNA, 20 bp, Homo sapiens
tccagggctagggagctcat

SEQ ID NO: 8575167 - DNA, 22 bp, Homo sapiens
tccagaggtatgtagagagtat

SEQ ID NO: 8575168 - DNA, 22 bp, Homo sapiens
tccagagggcgatggctggggg

SEQ ID NO: 8575169 - DNA, 22 bp, Homo sapiens
tccagaggctccaaagggagat

SEQ ID NO: 8575170 - DNA, 22 bp, Homo sapiens
tccagaggctctgagggagagt

SEQ ID NO: 8575171 - DNA, 21 bp, Homo sapiens
tccagaggaggacagactcag

SEQ ID NO: 8575172 - DNA, 22 bp, Homo sapiens
tccagaggcaaaaaggtatgga

SEQ ID NO: 8575173 - DNA, 22 bp, Homo sapiens
tccagagctgagggtcagtaga

SEQ ID NO: 8575174 - DNA, 22 bp, Homo sapiens
tcattgcagtagggagagaccc

SEQ ID NO: 8575175 - DNA, 22 bp, Homo sapiens
tccagagccccagtctagtggg

SEQ ID NO: 8575176 - DNA, 22 bp, Homo sapiens
tccagagcaggtggtcagaagg

SEQ ID NO: 8575177 - DNA, 17 bp, Homo sapiens
tccagagcacagagctc

SEQ ID NO: 8575178 - DNA, 18 bp, Homo sapiens
tccagagctactgtggtg

SEQ ID NO: 8575179 - DNA, 22 bp, Homo sapiens
tccagagcctgcgcactggctg

SEQ ID NO: 8575180 - DNA, 22 bp, Homo sapiens
tatttctgattgctcatgaggc

SEQ ID NO: 8575181 - DNA, 22 bp, Homo sapiens
tatttctgtttatttgtacatc

SEQ ID NO: 8575182 - DNA, 22 bp, Homo sapiens
tcaagtttaattgagatgttta

SEQ ID NO: 8575183 - DNA, 22 bp, Homo sapiens
tcaagtagtacccaatgcgtgg

SEQ ID NO: 8575184 - DNA, 22 bp, Homo sapiens
tcaagtagaactataatgatgt

SEQ ID NO: 8575185 - DNA, 22 bp, Homo sapiens
tcacaaagctttgataagcaga

SEQ ID NO: 8575186 - DNA, 20 bp, Homo sapiens
tcaggatgtgctgagtgaag

SEQ ID NO: 8575187 - DNA, 22 bp, Homo sapiens
tcaggctgataggaggaactga

SEQ ID NO: 8575188 - DNA, 22 bp, Homo sapiens
tcagcaggcacggacaggctgc

SEQ ID NO: 8575189 - DNA, 22 bp, Homo sapiens
tcagcaggcacggacaggctgc

SEQ ID NO: 8575190 - DNA, 22 bp, Homo sapiens
tcagcaggcaccggaagtgttt

SEQ ID NO: 8575191 - DNA, 22 bp, Homo sapiens
tcagcaggcacaccaaaaactg

SEQ ID NO: 8575192 - DNA, 21 bp, Homo sapiens
tcagcaggcaccagaaggctg

SEQ ID NO: 8575193 - DNA, 22 bp, Homo sapiens
tcagccttgcttctggactggt

SEQ ID NO: 8575194 - DNA, 20 bp, Homo sapiens
tcagccttgaatgcttgaaa

SEQ ID NO: 8575195 - DNA, 20 bp, Homo sapiens
tcagccttctcatcctgggg

SEQ ID NO: 8575196 - DNA, 22 bp, Homo sapiens
tcagcctttgaagggctgcagg

SEQ ID NO: 8575197 - DNA, 22 bp, Homo sapiens
tcagctctcacagatctcaacc

SEQ ID NO: 8575198 - DNA, 22 bp, Homo sapiens
tcagctctctgggctcgaacct

SEQ ID NO: 8575199 - DNA, 22 bp, Homo sapiens
tcagctctacctgggagctgtc

SEQ ID NO: 8575200 - DNA, 22 bp, Homo sapiens
tcattcactgcccagcagtgta

SEQ ID NO: 8575201 - DNA, 23 bp, Homo sapiens
tcatggaactgggcaatcttgaa

SEQ ID NO: 8575202 - DNA, 22 bp, Homo sapiens
tcagtgttattagatgaggttt

SEQ ID NO: 8575203 - DNA, 22 bp, Homo sapiens
tcagtgttcagcggtgtgtgca

SEQ ID NO: 8575204 - DNA, 16 bp, Homo sapiens
tcagtgttccagaata

SEQ ID NO: 8575205 - DNA, 22 bp, Homo sapiens
tcagtgttcagggaccaggtcc

SEQ ID NO: 8575206 - DNA, 22 bp, Homo sapiens
tcagtgttcgctcagggactcc

SEQ ID NO: 8575207 - DNA, 22 bp, Homo sapiens
tcatgccaaaatccagtggctt

SEQ ID NO: 8575208 - DNA, 22 bp, Homo sapiens
tcatgccaaaatccagtggctt

SEQ ID NO: 8575209 - DNA, 22 bp, Homo sapiens
tcatgccaaactgaacacagtt

SEQ ID NO: 8575210 - DNA, 22 bp, Homo sapiens
tcatgccaatttctgcatggct

SEQ ID NO: 8575211 - DNA, 22 bp, Homo sapiens
tcatgccaatttctgcatggct

SEQ ID NO: 8575212 - DNA, 22 bp, Homo sapiens
tcagtgttaatcagtggtacct

SEQ ID NO: 8575213 - DNA, 22 bp, Homo sapiens
tcagtgttagacaagtttggaa

SEQ ID NO: 8575214 - DNA, 22 bp, Homo sapiens
tcagtgttacattatatagaac

SEQ ID NO: 8575215 - DNA, 22 bp, Homo sapiens
gcaaatacatgttgagcaccta

SEQ ID NO: 8575216 - DNA, 22 bp, Homo sapiens
gcaaagcagaaccctctctatc

SEQ ID NO: 8575217 - DNA, 22 bp, Homo sapiens
gcaaagaaatgtcagtgagagg

SEQ ID NO: 8575218 - DNA, 22 bp, Homo sapiens
gcaaagaaatgtcagtgagagg

SEQ ID NO: 8575219 - DNA, 22 bp, Homo sapiens
gcagaggatagcatatgaacct

SEQ ID NO: 8575220 - DNA, 22 bp, Homo sapiens
gcagggctttttgaaacatggt

SEQ ID NO: 8575221 - DNA, 21 bp, Homo sapiens
gcagggaccgcgacttctggg

SEQ ID NO: 8575222 - DNA, 22 bp, Homo sapiens
gcagggacaactgtgcacctga

SEQ ID NO: 8575223 - DNA, 21 bp, Homo sapiens
gcagggacaaagcttcaggag

SEQ ID NO: 8575224 - DNA, 22 bp, Homo sapiens
gcagctttcttgccctaatctt

SEQ ID NO: 8575225 - DNA, 22 bp, Homo sapiens
gcagccctggcctggcctactt

SEQ ID NO: 8575226 - DNA, 22 bp, Homo sapiens
gcagccctgcaggcagctccag

SEQ ID NO: 8575227 - DNA, 22 bp, Homo sapiens
gcagccctttctgggcagggga

SEQ ID NO: 8575228 - DNA, 22 bp, Homo sapiens
gcagcccttcaggtgaggggca

SEQ ID NO: 8575229 - DNA, 22 bp, Homo sapiens
gcagccctcgctagctctcccc

SEQ ID NO: 8575230 - DNA, 22 bp, Homo sapiens
gcagccctcgggtactcacgtg

SEQ ID NO: 8575231 - DNA, 22 bp, Homo sapiens
gcagccctgcagctccacaccg

SEQ ID NO: 8575232 - DNA, 22 bp, Homo sapiens
gcagccctcttggtcactaggc

SEQ ID NO: 8575233 - DNA, 22 bp, Homo sapiens
gcagccctaacctgtcatagtg

SEQ ID NO: 8575234 - DNA, 22 bp, Homo sapiens
gcagccctagcgacaaattgat

SEQ ID NO: 8575235 - DNA, 22 bp, Homo sapiens
gcagccctccctgggtgtgtct

SEQ ID NO: 8575236 - DNA, 22 bp, Homo sapiens
gccctggccttcatctcagaca

SEQ ID NO: 8575237 - DNA, 22 bp, Homo sapiens
gcctctggagttgcttgtaaat

SEQ ID NO: 8575238 - DNA, 22 bp, Homo sapiens
gcccagctgagaagcgcggggc

SEQ ID NO: 8575239 - DNA, 22 bp, Homo sapiens
gcccagctgtctggcagggatg

SEQ ID NO: 8575240 - DNA, 18 bp, Homo sapiens
gcccatggtaaatgctgt

SEQ ID NO: 8575241 - DNA, 22 bp, Homo sapiens
gcagtggctaagctcgcatgca

SEQ ID NO: 8575242 - DNA, 22 bp, Homo sapiens
gcagtggctaggagtctggcgt

SEQ ID NO: 8575243 - DNA, 22 bp, Homo sapiens
gcatggccttgctgtagtggta

SEQ ID NO: 8575244 - DNA, 22 bp, Homo sapiens
gcatggccttgctgtagtggta

SEQ ID NO: 8575245 - DNA, 22 bp, Homo sapiens
gcatggccttgtgctccttctc

SEQ ID NO: 8575246 - DNA, 22 bp, Homo sapiens
gcatggccaggaaaggtagaaa

SEQ ID NO: 8575247 - DNA, 22 bp, Homo sapiens
gcatggccaggaaaggtagaaa

SEQ ID NO: 8575248 - DNA, 22 bp, Homo sapiens
gcatggccatggcactatggac

SEQ ID NO: 8575249 - DNA, 22 bp, Homo sapiens
gcatggcctctgtgcttgttgc

SEQ ID NO: 8575250 - DNA, 22 bp, Homo sapiens
gcatggcctccagccaacagca

SEQ ID NO: 8575251 - DNA, 22 bp, Homo sapiens
gcatggccttcagggacagctg

SEQ ID NO: 8575252 - DNA, 22 bp, Homo sapiens
gccagggaacccaagggcctca

SEQ ID NO: 8575253 - DNA, 22 bp, Homo sapiens
gccagctcagtttcaaagtagg

SEQ ID NO: 8575254 - DNA, 22 bp, Homo sapiens
gccagctcagtgccaggcccct

SEQ ID NO: 8575255 - DNA, 22 bp, Homo sapiens
gccagctgaaatttcagttctg

SEQ ID NO: 8575256 - DNA, 22 bp, Homo sapiens
gccagccttctgtggcctgcaa

SEQ ID NO: 8575257 - DNA, 21 bp, Homo sapiens
gccagcctgtttacctgtggt

SEQ ID NO: 8575258 - DNA, 23 bp, Homo sapiens
gccagccttgctctcctgcagcc

SEQ ID NO: 8575259 - DNA, 22 bp, Homo sapiens
gccagcctgtgggggctctgtg

SEQ ID NO: 8575260 - DNA, 22 bp, Homo sapiens
gccagcctgtgcttggccaggc

SEQ ID NO: 8575261 - DNA, 22 bp, Homo sapiens
ggacaggtgactgcccagagtg

SEQ ID NO: 8575262 - DNA, 22 bp, Homo sapiens
ggacaggtgcaaagggcacatg

SEQ ID NO: 8575263 - DNA, 22 bp, Homo sapiens
ggagagaattccatggacatgt

SEQ ID NO: 8575264 - DNA, 22 bp, Homo sapiens
ggagacagtggtagggcctaag

SEQ ID NO: 8575265 - DNA, 22 bp, Homo sapiens
ggagcagggaattacagcgcag

SEQ ID NO: 8575266 - DNA, 22 bp, Homo sapiens
gctttattttgtgagggattac

SEQ ID NO: 8575267 - DNA, 22 bp, Homo sapiens
gctttctaggcagagatgactg

SEQ ID NO: 8575268 - DNA, 20 bp, Homo sapiens
gctttctatgagatggactg

SEQ ID NO: 8575269 - DNA, 22 bp, Homo sapiens
gctttctgaagcagtgtttctc

SEQ ID NO: 8575270 - DNA, 17 bp, Homo sapiens
ggacacagctcatggct

SEQ ID NO: 8575271 - DNA, 22 bp, Homo sapiens
ggacaaagcctggtggcaggtg

SEQ ID NO: 8575272 - DNA, 20 bp, Homo sapiens
ggaatctttgcaggaaaata

SEQ ID NO: 8575273 - DNA, 22 bp, Homo sapiens
ggaatcttaatggcatggagtt

SEQ ID NO: 8575274 - DNA, 20 bp, Homo sapiens
ggaagcagagaactgttttc

SEQ ID NO: 8575275 - DNA, 18 bp, Homo sapiens
gctttatttcttggggaa

SEQ ID NO: 8575276 - DNA, 23 bp, Homo sapiens
gcttgctcattctatcacacagc

SEQ ID NO: 8575277 - DNA, 22 bp, Homo sapiens
gctgtgtatcagatgccacggg

SEQ ID NO: 8575278 - DNA, 22 bp, Homo sapiens
gctgtggctttctgtttctgtt

SEQ ID NO: 8575279 - DNA, 22 bp, Homo sapiens
gctgtgctgattcattccctgc

SEQ ID NO: 8575280 - DNA, 22 bp, Homo sapiens
gctggcttgacagaggcctggg

SEQ ID NO: 8575281 - DNA, 22 bp, Homo sapiens
gctggcttccttctgcagctag

SEQ ID NO: 8575282 - DNA, 22 bp, Homo sapiens
gctggcttccttctgcagctag

SEQ ID NO: 8575283 - DNA, 22 bp, Homo sapiens
gctggcttgatagtttctgctt

SEQ ID NO: 8575284 - DNA, 22 bp, Homo sapiens
gctggctgttggaggtacctgc

SEQ ID NO: 8575285 - DNA, 22 bp, Homo sapiens
gctggctgtgtttcatctctga

SEQ ID NO: 8575286 - DNA, 22 bp, Homo sapiens
gctggctgtgttccttctgcca

SEQ ID NO: 8575287 - DNA, 22 bp, Homo sapiens
gctgggcttcacctccagagtt

SEQ ID NO: 8575288 - DNA, 22 bp, Homo sapiens
gctggcttttgaagtctagcta

SEQ ID NO: 8575289 - DNA, 22 bp, Homo sapiens
gctggagaaactgcagctgagg

SEQ ID NO: 8575290 - DNA, 22 bp, Homo sapiens
gctggctgcgtcatcacagggc

SEQ ID NO: 8575291 - DNA, 22 bp, Homo sapiens
gctggctggcgggtgcgtcctc

SEQ ID NO: 8575292 - DNA, 22 bp, Homo sapiens
gctggctggagtaaggagggag

SEQ ID NO: 8575293 - DNA, 19 bp, Homo sapiens
gctggctggaggagggaca

SEQ ID NO: 8575294 - DNA, 22 bp, Homo sapiens
gctgccttccaaagagttttat

SEQ ID NO: 8575295 - DNA, 22 bp, Homo sapiens
gctgcccacaaccccgtgtcta

SEQ ID NO: 8575296 - DNA, 22 bp, Homo sapiens
gctgccctgtggtccagcaggt

SEQ ID NO: 8575297 - DNA, 18 bp, Homo sapiens
gctctggctcacctccag

SEQ ID NO: 8575298 - DNA, 22 bp, Homo sapiens
gctgaggctcaagtcatgggtc

SEQ ID NO: 8575299 - DNA, 22 bp, Homo sapiens
gctgaggcggaaggattgctag

SEQ ID NO: 8575300 - DNA, 22 bp, Homo sapiens
gctgaggcctcagaaggctgag

SEQ ID NO: 8575301 - DNA, 22 bp, Homo sapiens
gctgaggccccagggtgatggg

SEQ ID NO: 8575302 - DNA, 22 bp, Homo sapiens
gctgaggccaggccccaccgga

SEQ ID NO: 8575303 - DNA, 22 bp, Homo sapiens
gctgaggccagtttaatgagga

SEQ ID NO: 8575304 - DNA, 22 bp, Homo sapiens
gctgaggctcctcgggaggaca

SEQ ID NO: 8575305 - DNA, 22 bp, Homo sapiens
gctgaggctgggagcagcctgt

SEQ ID NO: 8575306 - DNA, 22 bp, Homo sapiens
gctgaggctcaatccccttctg

SEQ ID NO: 8575307 - DNA, 22 bp, Homo sapiens
gctgaggcttagctaaaaattt

SEQ ID NO: 8575308 - DNA, 22 bp, Homo sapiens
gctacctgagcaagagcttcaa

SEQ ID NO: 8575309 - DNA, 22 bp, Homo sapiens
gctcagctgagcgaaggacatg

SEQ ID NO: 8575310 - DNA, 22 bp, Homo sapiens
gctcccagaaccaaggctgggg

SEQ ID NO: 8575311 - DNA, 22 bp, Homo sapiens
gcctctgtcatagctcatgtga

SEQ ID NO: 8575312 - DNA, 22 bp, Homo sapiens
gcctctgtggctcagccttgct

SEQ ID NO: 8575313 - DNA, 22 bp, Homo sapiens
gcctctggggcagctgagtcat

SEQ ID NO: 8575314 - DNA, 22 bp, Homo sapiens
gcggggggcaggcagtacgttg

SEQ ID NO: 8575315 - DNA, 22 bp, Homo sapiens
gcggtccaggagcgcaggtcct

SEQ ID NO: 8575316 - DNA, 17 bp, Homo sapiens
gggctttaggtggtgta

SEQ ID NO: 8575317 - DNA, 22 bp, Homo sapiens
gggctttatgagattgagatct

SEQ ID NO: 8575318 - DNA, 22 bp, Homo sapiens
gggctttagattgcagaggatt

SEQ ID NO: 8575319 - DNA, 22 bp, Homo sapiens
gggctttaggggccagtgacca

SEQ ID NO: 8575320 - DNA, 22 bp, Homo sapiens
gggctttaacacccagtcaggg

SEQ ID NO: 8575321 - DNA, 22 bp, Homo sapiens
gggctttaatcttgttaactag

SEQ ID NO: 8575322 - DNA, 18 bp, Homo sapiens
gggctttacagagtggag

SEQ ID NO: 8575323 - DNA, 19 bp, Homo sapiens
gggctttactccaagtggg

SEQ ID NO: 8575324 - DNA, 22 bp, Homo sapiens
ggggttaacagtattgctcatg

SEQ ID NO: 8575325 - DNA, 22 bp, Homo sapiens
gggctgatcgcttgagctcagg

SEQ ID NO: 8575326 - DNA, 22 bp, Homo sapiens
gggctgatgatgagcagaggtg

SEQ ID NO: 8575327 - DNA, 22 bp, Homo sapiens
gggcatgtacataatctagaaa

SEQ ID NO: 8575328 - DNA, 22 bp, Homo sapiens
ggtggcggccacttcagccctg

SEQ ID NO: 8575329 - DNA, 22 bp, Homo sapiens
ggtgttcaaatgaacacatgca

SEQ ID NO: 8575330 - DNA, 22 bp, Homo sapiens
ggtctcagactggcaggcagtg

SEQ ID NO: 8575331 - DNA, 22 bp, Homo sapiens
ggtctcaaggaatataatgagt

SEQ ID NO: 8575332 - DNA, 22 bp, Homo sapiens
ggtctcagccctcgccagcagc

SEQ ID NO: 8575333 - DNA, 22 bp, Homo sapiens
gtgcagtgagcagtgcagcacc

SEQ ID NO: 8575334 - DNA, 22 bp, Homo sapiens
gtgcaggtttaggaagcagctc

SEQ ID NO: 8575335 - DNA, 21 bp, Homo sapiens
gtgcagaggaatgtagggggc

SEQ ID NO: 8575336 - DNA, 22 bp, Homo sapiens
gtgcatatgtgtgtatacaaac

SEQ ID NO: 8575337 - DNA, 22 bp, Homo sapiens
gtgagaagataagtattgcaaa

SEQ ID NO: 8575338 - DNA, 22 bp, Homo sapiens
gtgcagagaggtggagggactt

SEQ ID NO: 8575339 - DNA, 22 bp, Homo sapiens
gtgaaatatttaacgtccaggt

SEQ ID NO: 8575340 - DNA, 22 bp, Homo sapiens
gtcctgggcctgctgaggctga

SEQ ID NO: 8575341 - DNA, 22 bp, Homo sapiens
gtcctgggcggagggctgctgt

SEQ ID NO: 8575342 - DNA, 22 bp, Homo sapiens
gtcctggggaatacagaagccg

SEQ ID NO: 8575343 - DNA, 22 bp, Homo sapiens
gtcctggggattatagagtgtt

SEQ ID NO: 8575344 - DNA, 22 bp, Homo sapiens
gtcctggggatacagaagtgaa

SEQ ID NO: 8575345 - DNA, 22 bp, Homo sapiens
gtcctgggggcagctgtgtcca

SEQ ID NO: 8575346 - DNA, 22 bp, Homo sapiens
gtctgctcatgctaccgcgggc

SEQ ID NO: 8575347 - DNA, 22 bp, Homo sapiens
gtcctgggaaggaagccaggga

SEQ ID NO: 8575348 - DNA, 22 bp, Homo sapiens
gtcctgggagatgggaccctga

SEQ ID NO: 8575349 - DNA, 22 bp, Homo sapiens
gtcctgggaggggctggtcctg

SEQ ID NO: 8575350 - DNA, 22 bp, Homo sapiens
gtcctgggcatgcagggctttc

SEQ ID NO: 8575351 - DNA, 22 bp, Homo sapiens
gtcctgggcccaggggctgcct

SEQ ID NO: 8575352 - DNA, 17 bp, Homo sapiens
gtcctgggaggagagag

SEQ ID NO: 8575353 - DNA, 20 bp, Homo sapiens
gtcctgggagccacagcaca

SEQ ID NO: 8575354 - DNA, 22 bp, Homo sapiens
gtccccgacgtttggcttgatg

SEQ ID NO: 8575355 - DNA, 22 bp, Homo sapiens
gtccacagagggctgggcaggc

SEQ ID NO: 8575356 - DNA, 22 bp, Homo sapiens
gtccacagctggccagggcctc

SEQ ID NO: 8575357 - DNA, 22 bp, Homo sapiens
gtccaagagtcaagaagggggc

SEQ ID NO: 8575358 - DNA, 22 bp, Homo sapiens
gtagaatatatggttagtattg

SEQ ID NO: 8575359 - DNA, 22 bp, Homo sapiens
gtaccagtctctgtgggcacct

SEQ ID NO: 8575360 - DNA, 23 bp, Homo sapiens
gtaaaatacgcagtgcagtgtga

SEQ ID NO: 8575361 - DNA, 22 bp, Homo sapiens
ggcctgaggcgtcccagctgtg

SEQ ID NO: 8575362 - DNA, 22 bp, Homo sapiens
ggcctgagaatgtaccagatct

SEQ ID NO: 8575363 - DNA, 22 bp, Homo sapiens
ggcgaggccgggacaggctgga

SEQ ID NO: 8575364 - DNA, 22 bp, Homo sapiens
ggcctttgcgtccacgccgctt

SEQ ID NO: 8575365 - DNA, 22 bp, Homo sapiens
ggccttggttccaaagcaggca

SEQ ID NO: 8575366 - DNA, 22 bp, Homo sapiens
ggcagtcccaggctgcatgttg

SEQ ID NO: 8575367 - DNA, 22 bp, Homo sapiens
ggcagtcccagcccagaggcgc

SEQ ID NO: 8575368 - DNA, 22 bp, Homo sapiens
ggcaggtggaagttggcagagc

SEQ ID NO: 8575369 - DNA, 22 bp, Homo sapiens
ggcaggtggacgtgctaaagct

SEQ ID NO: 8575370 - DNA, 22 bp, Homo sapiens
ggcatggcctgtaagacggaga

SEQ ID NO: 8575371 - DNA, 22 bp, Homo sapiens
ggcatgtctgatggcccaagtc

SEQ ID NO: 8575372 - DNA, 19 bp, Homo sapiens
ggcatggtcggaagagctc

SEQ ID NO: 8575373 - DNA, 22 bp, Homo sapiens
ggccaggttgggtggaagtggc

SEQ ID NO: 8575374 - DNA, 22 bp, Homo sapiens
ggccatctgcctcaatgtgtgc

SEQ ID NO: 8575375 - DNA, 19 bp, Homo sapiens
ggccaggctgactgtggtc

SEQ ID NO: 8575376 - DNA, 22 bp, Homo sapiens
ggccagggggcttcagactcca

SEQ ID NO: 8575377 - DNA, 21 bp, Homo sapiens
ggcaagaaacacaatcaagta

SEQ ID NO: 8575378 - DNA, 22 bp, Homo sapiens
ggcaaacaggagagtaaagaga

SEQ ID NO: 8575379 - DNA, 22 bp, Homo sapiens
ggcaaacaccaggcgagggagc

SEQ ID NO: 8575380 - DNA, 22 bp, Homo sapiens
ggcaaacagacttgaccatctt

SEQ ID NO: 8575381 - DNA, 22 bp, Homo sapiens
ggcaaacacacctcggtgagaa

SEQ ID NO: 8575382 - DNA, 23 bp, Homo sapiens
ggagtgcaatggcgccatctcgg

SEQ ID NO: 8575383 - DNA, 22 bp, Homo sapiens
ggagccagaggctgctgctgtg

SEQ ID NO: 8575384 - DNA, 22 bp, Homo sapiens
ggagtcatctcagctgagaggc

SEQ ID NO: 8575385 - DNA, 22 bp, Homo sapiens
ggcaggcaacggaccactagtc

SEQ ID NO: 8575386 - DNA, 22 bp, Homo sapiens
ggctttaaggtttaggaagcaa

SEQ ID NO: 8575387 - DNA, 22 bp, Homo sapiens
gggacatctttctagtcagggt

SEQ ID NO: 8575388 - DNA, 22 bp, Homo sapiens
gggagaggttacccgagcaact

SEQ ID NO: 8575389 - DNA, 22 bp, Homo sapiens
gggaggagctgagtgtgtgtgc

SEQ ID NO: 8575390 - DNA, 22 bp, Homo sapiens
gggcaggagagaacagtcatgg

SEQ ID NO: 8575391 - DNA, 22 bp, Homo sapiens
gggcaggagagggccacctgga

SEQ ID NO: 8575392 - DNA, 22 bp, Homo sapiens
ggcgggggtccaggagcctgca

SEQ ID NO: 8575393 - DNA, 22 bp, Homo sapiens
ggcggggcctcgcgaacggcct

SEQ ID NO: 8575394 - DNA, 22 bp, Homo sapiens
ggcgggagatggggccgttcag

SEQ ID NO: 8575395 - DNA, 22 bp, Homo sapiens
ggctcttctgtttcacaggcca

SEQ ID NO: 8575396 - DNA, 22 bp, Homo sapiens
ggctcttctggttgtcacattt

SEQ ID NO: 8575397 - DNA, 22 bp, Homo sapiens
gagcctggatagccttgttcca

SEQ ID NO: 8575398 - DNA, 22 bp, Homo sapiens
gagcttttcccgtctttctcgt

SEQ ID NO: 8575399 - DNA, 22 bp, Homo sapiens
gaggcaccagacatggcctcat

SEQ ID NO: 8575400 - DNA, 22 bp, Homo sapiens
gaggcactctcgacaagggtgg

SEQ ID NO: 8575401 - DNA, 22 bp, Homo sapiens
gaggcactgcagtacagtgact

SEQ ID NO: 8575402 - DNA, 22 bp, Homo sapiens
gaggcactgctgggcccctgta

SEQ ID NO: 8575403 - DNA, 22 bp, Homo sapiens
gaggcactggaggaaaggagaa

SEQ ID NO: 8575404 - DNA, 22 bp, Homo sapiens
gaggaaaatgcaacaggaatgc

SEQ ID NO: 8575405 - DNA, 22 bp, Homo sapiens
gaggaaaagagacaggttattg

SEQ ID NO: 8575406 - DNA, 22 bp, Homo sapiens
gagaatgggaatgaaagtagca

SEQ ID NO: 8575407 - DNA, 22 bp, Homo sapiens
gagaagggggctcgagtgtcct

SEQ ID NO: 8575408 - DNA, 22 bp, Homo sapiens
gagaagggcttgggagtcaaca

SEQ ID NO: 8575409 - DNA, 22 bp, Homo sapiens
gagaagggatatggcttcttga

SEQ ID NO: 8575410 - DNA, 22 bp, Homo sapiens
gagaagggatatgccactctcg

SEQ ID NO: 8575411 - DNA, 22 bp, Homo sapiens
gagaggccatggctgtgcagtg

SEQ ID NO: 8575412 - DNA, 22 bp, Homo sapiens
gagaggccctgtggtcccagct

SEQ ID NO: 8575413 - DNA, 22 bp, Homo sapiens
gagccaggggtcagctccgagg

SEQ ID NO: 8575414 - DNA, 22 bp, Homo sapiens
gagccaggtcgggccgcggcga

SEQ ID NO: 8575415 - DNA, 22 bp, Homo sapiens
gagccaggttggaggctgcagt

SEQ ID NO: 8575416 - DNA, 22 bp, Homo sapiens
gagccaggttggaggctgcagt

SEQ ID NO: 8575417 - DNA, 22 bp, Homo sapiens
gagcatttttgtctgcatttta

SEQ ID NO: 8575418 - DNA, 22 bp, Homo sapiens
gagcagagtctatttccacact

SEQ ID NO: 8575419 - DNA, 21 bp, Homo sapiens
gacaggggaagaagcaaggag

SEQ ID NO: 8575420 - DNA, 22 bp, Homo sapiens
gaaggaagattctgttggaatc

SEQ ID NO: 8575421 - DNA, 22 bp, Homo sapiens
gaagaccaccccctacagcaca

SEQ ID NO: 8575422 - DNA, 22 bp, Homo sapiens
gaagagctggaatccagtctgg

SEQ ID NO: 8575423 - DNA, 22 bp, Homo sapiens
gaagagaaaggcaaggagtttt

SEQ ID NO: 8575424 - DNA, 22 bp, Homo sapiens
gaagagaagcatcaataggtaa

SEQ ID NO: 8575425 - DNA, 22 bp, Homo sapiens
gaagagaaggtgtaggccatcc

SEQ ID NO: 8575426 - DNA, 22 bp, Homo sapiens
gaagccagattatcacaagcca

SEQ ID NO: 8575427 - DNA, 22 bp, Homo sapiens
gaagataattcctacttataac

SEQ ID NO: 8575428 - DNA, 22 bp, Homo sapiens
gaagatcagagtaagcttttta

SEQ ID NO: 8575429 - DNA, 22 bp, Homo sapiens
ctttcacagtcctgactgagcg

SEQ ID NO: 8575430 - DNA, 22 bp, Homo sapiens
gaaatatttctcttgagcccct

SEQ ID NO: 8575431 - DNA, 22 bp, Homo sapiens
cttgtccagatgtttgttaggt

SEQ ID NO: 8575432 - DNA, 22 bp, Homo sapiens
cttcctggccattgccatggca

SEQ ID NO: 8575433 - DNA, 22 bp, Homo sapiens
cttcctggctcggtgcctcacc

SEQ ID NO: 8575434 - DNA, 22 bp, Homo sapiens
cttcctgggtcagcctggaggt

SEQ ID NO: 8575435 - DNA, 22 bp, Homo sapiens
cttgatgatagcaggcagggaa

SEQ ID NO: 8575436 - DNA, 22 bp, Homo sapiens
cttgatgatgacgtcggtgatg

SEQ ID NO: 8575437 - DNA, 22 bp, Homo sapiens
cttgatgatttgcagagggagt

SEQ ID NO: 8575438 - DNA, 22 bp, Homo sapiens
cttgatgagtcagaactgaagg

SEQ ID NO: 8575439 - DNA, 22 bp, Homo sapiens
cttgatgatagaatgtgaggag

SEQ ID NO: 8575440 - DNA, 22 bp, Homo sapiens
cttgatgaggtatgaacctctc

SEQ ID NO: 8575441 - DNA, 22 bp, Homo sapiens
cttgatgagcctagtgcttaga

SEQ ID NO: 8575442 - DNA, 20 bp, Homo sapiens
cttgatgagataaacagcag

SEQ ID NO: 8575443 - DNA, 22 bp, Homo sapiens
cttgatgaaatttttcaattgt

SEQ ID NO: 8575444 - DNA, 22 bp, Homo sapiens
cttgatgaatgacctgggtggt

SEQ ID NO: 8575445 - DNA, 22 bp, Homo sapiens
cttgatgactcaggaggaggag

SEQ ID NO: 8575446 - DNA, 20 bp, Homo sapiens
cttgattctttgatgaggta

SEQ ID NO: 8575447 - DNA, 22 bp, Homo sapiens
cttatcagattatctgggctgt

SEQ ID NO: 8575448 - DNA, 22 bp, Homo sapiens
cttcaaaagccagaagcctgcg

SEQ ID NO: 8575449 - DNA, 22 bp, Homo sapiens
ctgtggccccaccctcttggcc

SEQ ID NO: 8575450 - DNA, 22 bp, Homo sapiens
ctgtggctcatatctgtaatct

SEQ ID NO: 8575451 - DNA, 22 bp, Homo sapiens
ctgttcacagaatcctcccctg

SEQ ID NO: 8575452 - DNA, 22 bp, Homo sapiens
ctgttcagaaaaaatcttcatg

SEQ ID NO: 8575453 - DNA, 18 bp, Homo sapiens
ctgttcagctgaactaca

SEQ ID NO: 8575454 - DNA, 22 bp, Homo sapiens
ctgttcagtaacctataaaaca

SEQ ID NO: 8575455 - DNA, 22 bp, Homo sapiens
ctgtgtcttcacatttgtgtgc

SEQ ID NO: 8575456 - DNA, 23 bp, Homo sapiens
ctgttaaattccttaagagcagg

SEQ ID NO: 8575457 - DNA, 23 bp, Homo sapiens
ctgtggctgagtcctgttggagt

SEQ ID NO: 8575458 - DNA, 22 bp, Homo sapiens
ctgtggctgagttccttatgtt

SEQ ID NO: 8575459 - DNA, 22 bp, Homo sapiens
ctgtggctgaactctgaagagg

SEQ ID NO: 8575460 - DNA, 19 bp, Homo sapiens
ctgtggctgacctctggcc

SEQ ID NO: 8575461 - DNA, 22 bp, Homo sapiens
ctgtggctctgcagtcccaaca

SEQ ID NO: 8575462 - DNA, 22 bp, Homo sapiens
ctgtggctctttagttgagcac

SEQ ID NO: 8575463 - DNA, 22 bp, Homo sapiens
ctgtggctgcgccatcgaaaac

SEQ ID NO: 8575464 - DNA, 22 bp, Homo sapiens
ctgtggctgcgccctgggggag

SEQ ID NO: 8575465 - DNA, 22 bp, Homo sapiens
ctgtggctgcgtaggtctggca

SEQ ID NO: 8575466 - DNA, 22 bp, Homo sapiens
ctgtggctgcagaccttaaaca

SEQ ID NO: 8575467 - DNA, 22 bp, Homo sapiens
ctgtggctgcagccttggtcct

SEQ ID NO: 8575468 - DNA, 22 bp, Homo sapiens
ctgtggctgcctcacctacagg

SEQ ID NO: 8575469 - DNA, 16 bp, Homo sapiens
ctgtggctcccaggtt

SEQ ID NO: 8575470 - DNA, 22 bp, Homo sapiens
ctgtggctccatagaagttgca

SEQ ID NO: 8575471 - DNA, 22 bp, Homo sapiens
ctgtggctcattcttggtggca

SEQ ID NO: 8575472 - DNA, 22 bp, Homo sapiens
ctgtggctccagtgaaccaatg

SEQ ID NO: 8575473 - DNA, 20 bp, Homo sapiens
ctgtggctcatgcatctgcc

SEQ ID NO: 8575474 - DNA, 22 bp, Homo sapiens
ctgtggctctccaatggaggga

SEQ ID NO: 8575475 - DNA, 22 bp, Homo sapiens
ctgtggctctctgcagggtccc

SEQ ID NO: 8575476 - DNA, 22 bp, Homo sapiens
ctgtggctctcagaggctgctg

SEQ ID NO: 8575477 - DNA, 22 bp, Homo sapiens
ctgtggctctcagaggctgctg

SEQ ID NO: 8575478 - DNA, 22 bp, Homo sapiens
ctgtggctctcagaggctgctg

SEQ ID NO: 8575479 - DNA, 22 bp, Homo sapiens
ctgtggctgtatttggccagag

SEQ ID NO: 8575480 - DNA, 22 bp, Homo sapiens
ctgtggctggctcatcataggt

SEQ ID NO: 8575481 - DNA, 22 bp, Homo sapiens
ctgtggctggcctgtctgacat

SEQ ID NO: 8575482 - DNA, 22 bp, Homo sapiens
ctgtggctggaataataaatgt

SEQ ID NO: 8575483 - DNA, 22 bp, Homo sapiens
ctgtggctggcctgtctgacat

SEQ ID NO: 8575484 - DNA, 22 bp, Homo sapiens
ctgtggctggccttattgctgc

SEQ ID NO: 8575485 - DNA, 22 bp, Homo sapiens
ctgtggcttcagcattcagagc

SEQ ID NO: 8575486 - DNA, 22 bp, Homo sapiens
ctgtggctgtgaaacttctcag

SEQ ID NO: 8575487 - DNA, 22 bp, Homo sapiens
ctgtggctgtctctttcccatg

SEQ ID NO: 8575488 - DNA, 22 bp, Homo sapiens
ctgccactctgggtgggcctgg

SEQ ID NO: 8575489 - DNA, 22 bp, Homo sapiens
ctgccactagctttcacatctt

SEQ ID NO: 8575490 - DNA, 22 bp, Homo sapiens
ctgccacttactaggcatggtg

SEQ ID NO: 8575491 - DNA, 18 bp, Homo sapiens
ctgccacttaatgtggtg

SEQ ID NO: 8575492 - DNA, 22 bp, Homo sapiens
ctgccactttggagtgctcaga

SEQ ID NO: 8575493 - DNA, 22 bp, Homo sapiens
ctggcagcccaacctagagtct

SEQ ID NO: 8575494 - DNA, 22 bp, Homo sapiens
ctggcagcttcaggacactcgg

SEQ ID NO: 8575495 - DNA, 22 bp, Homo sapiens
ctgccagctcgccacaatgaca

SEQ ID NO: 8575496 - DNA, 22 bp, Homo sapiens
ctgccagcaatgtgaccatgct

SEQ ID NO: 8575497 - DNA, 22 bp, Homo sapiens
ctggccactgattcctcccctg

SEQ ID NO: 8575498 - DNA, 22 bp, Homo sapiens
ctggccctggagggctgtgcga

SEQ ID NO: 8575499 - DNA, 22 bp, Homo sapiens
ctggccctcgtcagtttcactg

SEQ ID NO: 8575500 - DNA, 22 bp, Homo sapiens
ctggccctattccaggccttcc

SEQ ID NO: 8575501 - DNA, 22 bp, Homo sapiens
ctggccctggctggagcccagg

SEQ ID NO: 8575502 - DNA, 22 bp, Homo sapiens
ctggcctggtctggcctctcca

SEQ ID NO: 8575503 - DNA, 22 bp, Homo sapiens
ctggccctgtaggatgtgagtt

SEQ ID NO: 8575504 - DNA, 22 bp, Homo sapiens
ctggctcatagagcagctccaa

SEQ ID NO: 8575505 - DNA, 22 bp, Homo sapiens
ctggctcttcagtgcttggttc

SEQ ID NO: 8575506 - DNA, 22 bp, Homo sapiens
ctggctccaaattctgatgttc

SEQ ID NO: 8575507 - DNA, 22 bp, Homo sapiens
ctgggctgcagttcctggtcct

SEQ ID NO: 8575508 - DNA, 22 bp, Homo sapiens
ctgggctggacacacttaacct

SEQ ID NO: 8575509 - DNA, 23 bp, Homo sapiens
ctgggctgcttgagtccctggct

SEQ ID NO: 8575510 - DNA, 22 bp, Homo sapiens
ctgggtctggctactgcttcct

SEQ ID NO: 8575511 - DNA, 22 bp, Homo sapiens
ctgggtctgggcctcctggagt

SEQ ID NO: 8575512 - DNA, 22 bp, Homo sapiens
ctgggccaagaagttgtgtatg

SEQ ID NO: 8575513 - DNA, 22 bp, Homo sapiens
ctgggccacatcagatgaagac

SEQ ID NO: 8575514 - DNA, 22 bp, Homo sapiens
ctgggccacaagcctgtgtgat

SEQ ID NO: 8575515 - DNA, 22 bp, Homo sapiens
ctggcttgttttaagaatacaa

SEQ ID NO: 8575516 - DNA, 22 bp, Homo sapiens
ctggctgtgctgactgagaggg

SEQ ID NO: 8575517 - DNA, 22 bp, Homo sapiens
ctggctttgttctgattgcttc

SEQ ID NO: 8575518 - DNA, 22 bp, Homo sapiens
cctggtgttgccaatctgtgcc

SEQ ID NO: 8575519 - DNA, 22 bp, Homo sapiens
cctgggcttacgacctctgact

SEQ ID NO: 8575520 - DNA, 22 bp, Homo sapiens
tgtgttctgaaggagaagagtg

SEQ ID NO: 8575521 - DNA, 22 bp, Homo sapiens
cctgggagtggcactcacagca

SEQ ID NO: 8575522 - DNA, 22 bp, Homo sapiens
cctgggagtgtcagacttgctt

SEQ ID NO: 8575523 - DNA, 23 bp, Homo sapiens
tgtgtctgaggatatatgtgcat

SEQ ID NO: 8575524 - DNA, 22 bp, Homo sapiens
cctgggcaacatagtgagaccc

SEQ ID NO: 8575525 - DNA, 22 bp, Homo sapiens
cctgggcaacatagtgagacct

SEQ ID NO: 8575526 - DNA, 22 bp, Homo sapiens
cctgggcaacatagggagaccc

SEQ ID NO: 8575527 - DNA, 22 bp, Homo sapiens
ttagaaaaatgttcagtagttt

SEQ ID NO: 8575528 - DNA, 21 bp, Homo sapiens
ccttctccacagggtctccgg

SEQ ID NO: 8575529 - DNA, 22 bp, Homo sapiens
ccttcctttcagggctatgcct

SEQ ID NO: 8575530 - DNA, 22 bp, Homo sapiens
ccttccttgagaagcaattcct

SEQ ID NO: 8575531 - DNA, 20 bp, Homo sapiens
cctgtgtggccagctgaggc

SEQ ID NO: 8575532 - DNA, 22 bp, Homo sapiens
cctgtgtggtagccagcggtgc

SEQ ID NO: 8575533 - DNA, 22 bp, Homo sapiens
cctgtgtgaaggttaggcaggt

SEQ ID NO: 8575534 - DNA, 22 bp, Homo sapiens
cctgtgtgattggaagctgaga

SEQ ID NO: 8575535 - DNA, 22 bp, Homo sapiens
ttaaagctgagccctcagaagc

SEQ ID NO: 8575536 - DNA, 22 bp, Homo sapiens
ttaaagtatagaggacaaaaac

SEQ ID NO: 8575537 - DNA, 22 bp, Homo sapiens
cctgtgtcatcagctgtggcta

SEQ ID NO: 8575538 - DNA, 22 bp, Homo sapiens
cctgtctgaggaggtgctcttt

SEQ ID NO: 8575539 - DNA, 22 bp, Homo sapiens
tgtttactttccttctcacagg

SEQ ID NO: 8575540 - DNA, 22 bp, Homo sapiens
cctgtctgtattggtttgctat

SEQ ID NO: 8575541 - DNA, 19 bp, Homo sapiens
cgcaggtggaaggagccgc

SEQ ID NO: 8575542 - DNA, 22 bp, Homo sapiens
cgccggcttgaggcaggcggca

SEQ ID NO: 8575543 - DNA, 22 bp, Homo sapiens
ttcaatagaaatgacattcttt

SEQ ID NO: 8575544 - DNA, 22 bp, Homo sapiens
ttcagaaagtgaatcttgttat

SEQ ID NO: 8575545 - DNA, 22 bp, Homo sapiens
ttcatgaatgttccatgtgagt

SEQ ID NO: 8575546 - DNA, 22 bp, Homo sapiens
cggtccagagctagttcattgc

SEQ ID NO: 8575547 - DNA, 22 bp, Homo sapiens
cggtccaggatggctggcaagc

SEQ ID NO: 8575548 - DNA, 22 bp, Homo sapiens
cggtccagggaacgcccccgcc

SEQ ID NO: 8575549 - DNA, 22 bp, Homo sapiens
ctcaaaagacttaaacataaga

SEQ ID NO: 8575550 - DNA, 22 bp, Homo sapiens
ctatatacttttcacagatgtt

SEQ ID NO: 8575551 - DNA, 22 bp, Homo sapiens
ctatatacttttcacagatgtt

SEQ ID NO: 8575552 - DNA, 21 bp, Homo sapiens
ttcctggggaaggagctgcct

SEQ ID NO: 8575553 - DNA, 22 bp, Homo sapiens
ttcctgggctttcccctctggt

SEQ ID NO: 8575554 - DNA, 22 bp, Homo sapiens
ttcctgggctgcagagagcacc

SEQ ID NO: 8575555 - DNA, 22 bp, Homo sapiens
ttcctgggactggagcagccca

SEQ ID NO: 8575556 - DNA, 22 bp, Homo sapiens
ttcctgggctctggctggccta

SEQ ID NO: 8575557 - DNA, 22 bp, Homo sapiens
ttcctgggccttaaatcttttg

SEQ ID NO: 8575558 - DNA, 22 bp, Homo sapiens
ttcctgggcaggacgagagtct

SEQ ID NO: 8575559 - DNA, 22 bp, Homo sapiens
ttcctgggaggctgtgtacttg

SEQ ID NO: 8575560 - DNA, 22 bp, Homo sapiens
ttcctgggattattgtcaagca

SEQ ID NO: 8575561 - DNA, 22 bp, Homo sapiens
ttcctgggagctagccacatct

SEQ ID NO: 8575562 - DNA, 22 bp, Homo sapiens
ctacaggtatgtgcatgacatc

SEQ ID NO: 8575563 - DNA, 22 bp, Homo sapiens
ctacaggtcaagcagtagctct

SEQ ID NO: 8575564 - DNA, 22 bp, Homo sapiens
ctgaccctagcatctctgtgca

SEQ ID NO: 8575565 - DNA, 22 bp, Homo sapiens
ctgacccttgctcgggccctgt

SEQ ID NO: 8575566 - DNA, 22 bp, Homo sapiens
ctgactctgacaggacttgtgg

SEQ ID NO: 8575567 - DNA, 20 bp, Homo sapiens
ctgagccaactctcttcttg

SEQ ID NO: 8575568 - DNA, 19 bp, Homo sapiens
ctgcagggatgtgcagagt

SEQ ID NO: 8575569 - DNA, 22 bp, Homo sapiens
ctgcaggggaccaaagtctgac

SEQ ID NO: 8575570 - DNA, 22 bp, Homo sapiens
ctgaggcccctctcttgagctt

SEQ ID NO: 8575571 - DNA, 22 bp, Homo sapiens
tttccttgttcatttgccctat

SEQ ID NO: 8575572 - DNA, 20 bp, Homo sapiens
ctctgcagcaaggcctgggt

SEQ ID NO: 8575573 - DNA, 22 bp, Homo sapiens
tttgcaaataaataagtgctcg

SEQ ID NO: 8575574 - DNA, 22 bp, Homo sapiens
tttgggcaattcagtgggacct

SEQ ID NO: 8575575 - DNA, 22 bp, Homo sapiens
tttgggcaagctcactgattca

SEQ ID NO: 8575576 - DNA, 22 bp, Homo sapiens
tttgggcaaggtccagattcct

SEQ ID NO: 8575577 - DNA, 21 bp, Homo sapiens
tttgggcaaaattaaatgaga

SEQ ID NO: 8575578 - DNA, 22 bp, Homo sapiens
tttgggcaaaggtagaaggaga

SEQ ID NO: 8575579 - DNA, 22 bp, Homo sapiens
ctctgctttttagggagcctag

SEQ ID NO: 8575580 - DNA, 20 bp, Homo sapiens
tttgctatgcatatctgacc

SEQ ID NO: 8575581 - DNA, 22 bp, Homo sapiens
tttgctataaaagggtcacacg

SEQ ID NO: 8575582 - DNA, 22 bp, Homo sapiens
ctcttatacatatttttaggcg

SEQ ID NO: 8575583 - DNA, 22 bp, Homo sapiens
ttttcagttactgtttatgtga

SEQ ID NO: 8575584 - DNA, 22 bp, Homo sapiens
ttttcaggtgcagtaatcatat

SEQ ID NO: 8575585 - DNA, 22 bp, Homo sapiens
ttttcagtaatgtctacataat

SEQ ID NO: 8575586 - DNA, 22 bp, Homo sapiens
tttgggcagaagctgaatgtct

SEQ ID NO: 8575587 - DNA, 22 bp, Homo sapiens
tttgggcacacaaatattttat

SEQ ID NO: 8575588 - DNA, 22 bp, Homo sapiens
tttgggcacagatattaagtat

SEQ ID NO: 8575589 - DNA, 20 bp, Homo sapiens
tttgggcacggctagatttt

SEQ ID NO: 8575590 - DNA, 22 bp, Homo sapiens
tttgggcagaaacatgcgcccc

SEQ ID NO: 8575591 - DNA, 22 bp, Homo sapiens
ttttaatactgctattgtagga

SEQ ID NO: 8575592 - DNA, 19 bp, Homo sapiens
ctccaagttaagagggagg

SEQ ID NO: 8575593 - DNA, 22 bp, Homo sapiens
ctcccagaggtgtcattcgagc

SEQ ID NO: 8575594 - DNA, 22 bp, Homo sapiens
ctcccagattcctgctgtggga

SEQ ID NO: 8575595 - DNA, 22 bp, Homo sapiens
ctcccagagaccaagctgagaa

SEQ ID NO: 8575596 - DNA, 22 bp, Homo sapiens
ctcccagagagcaggtgggccg

SEQ ID NO: 8575597 - DNA, 22 bp, Homo sapiens
ctcccagaaaattctcagacaa

SEQ ID NO: 8575598 - DNA, 22 bp, Homo sapiens
ctcccagacatgtgcctccttg

SEQ ID NO: 8575599 - DNA, 16 bp, Homo sapiens
tttatttactagtgtt

SEQ ID NO: 8575600 - DNA, 22 bp, Homo sapiens
tttatttaccttatgtcctcca

SEQ ID NO: 8575601 - DNA, 22 bp, Homo sapiens
tttatttaaagtcgtgtgttaa

SEQ ID NO: 8575602 - DNA, 22 bp, Homo sapiens
ctcctggcagttccccttgtca

SEQ ID NO: 8575603 - DNA, 17 bp, Homo sapiens
ctcctggcagcctcagg

SEQ ID NO: 8575604 - DNA, 22 bp, Homo sapiens
tttcctcacacagaagatcttg

SEQ ID NO: 8575605 - DNA, 22 bp, Homo sapiens
tttccttgttattatttgtcct

SEQ ID NO: 8575606 - DNA, 18 bp, Homo sapiens
tttccttgtatgaacata

SEQ ID NO: 8575607 - DNA, 22 bp, Homo sapiens
tttccttgggtctcttagtggc

SEQ ID NO: 8575608 - DNA, 22 bp, Homo sapiens
tttcacaaagcatagcacttta

SEQ ID NO: 8575609 - DNA, 19 bp, Homo sapiens
tttcacaaagagagcgtga

SEQ ID NO: 8575610 - DNA, 22 bp, Homo sapiens
ctcctggccctgagctcccagg

SEQ ID NO: 8575611 - DNA, 22 bp, Homo sapiens
caggcgggcaggtgcggcccct

SEQ ID NO: 8575612 - DNA, 22 bp, Homo sapiens
caggcctctatggtcagctgag

SEQ ID NO: 8575613 - DNA, 19 bp, Homo sapiens
caggcctctggtctgctgt

SEQ ID NO: 8575614 - DNA, 22 bp, Homo sapiens
caggcccagcccttagccaggt

SEQ ID NO: 8575615 - DNA, 22 bp, Homo sapiens
caggctggagttcagtggtgtg

SEQ ID NO: 8575616 - DNA, 22 bp, Homo sapiens
caggctggcaatgcgtcaagca

SEQ ID NO: 8575617 - DNA, 22 bp, Homo sapiens
caggctgggaacgccacccgct

SEQ ID NO: 8575618 - DNA, 22 bp, Homo sapiens
caggctgggaacgccacccgct

SEQ ID NO: 8575619 - DNA, 22 bp, Homo sapiens
caggctgggactgacccctgct

SEQ ID NO: 8575620 - DNA, 22 bp, Homo sapiens
tagattcaagtattcagtttgg

SEQ ID NO: 8575621 - DNA, 22 bp, Homo sapiens
tagattcagatatttaggacaa

SEQ ID NO: 8575622 - DNA, 22 bp, Homo sapiens
tagattcatgcagtatgctagt

SEQ ID NO: 8575623 - DNA, 22 bp, Homo sapiens
cagctattttgcctatcatggt

SEQ ID NO: 8575624 - DNA, 22 bp, Homo sapiens
cagctcagacgcaggtcgagca

SEQ ID NO: 8575625 - DNA, 22 bp, Homo sapiens
gtgcttcctctgccaacactct

SEQ ID NO: 8575626 - DNA, 22 bp, Homo sapiens
taatacagaagtgtattaaaat

SEQ ID NO: 8575627 - DNA, 20 bp, Homo sapiens
tacaaacctccacactggtg

SEQ ID NO: 8575628 - DNA, 22 bp, Homo sapiens
caggccagagcgcgtggttggg

SEQ ID NO: 8575629 - DNA, 22 bp, Homo sapiens
tacaaaaggaagagggatctta

SEQ ID NO: 8575630 - DNA, 22 bp, Homo sapiens
caggccaggtggcaggcaaaac

SEQ ID NO: 8575631 - DNA, 22 bp, Homo sapiens
caggccagtgggaaatagggat

SEQ ID NO: 8575632 - DNA, 22 bp, Homo sapiens
caggccagggttgagaagagaa

SEQ ID NO: 8575633 - DNA, 22 bp, Homo sapiens
caggccagggttgagaagagaa

SEQ ID NO: 8575634 - DNA, 22 bp, Homo sapiens
caggccaggtgctctagaatca

SEQ ID NO: 8575635 - DNA, 22 bp, Homo sapiens
caggccaggtgctctagaatca

SEQ ID NO: 8575636 - DNA, 22 bp, Homo sapiens
taatatgtgttactgacttttt

SEQ ID NO: 8575637 - DNA, 22 bp, Homo sapiens
taatatttctaccctgctgcct

SEQ ID NO: 8575638 - DNA, 22 bp, Homo sapiens
cagggtcaccagagatctgcat

SEQ ID NO: 8575639 - DNA, 22 bp, Homo sapiens
taggcagggattagggttgatt

SEQ ID NO: 8575640 - DNA, 22 bp, Homo sapiens
taggcaggtgtgcactgcccac

SEQ ID NO: 8575641 - DNA, 22 bp, Homo sapiens
caggtggccttgccatctcctg

SEQ ID NO: 8575642 - DNA, 18 bp, Homo sapiens
caggtgggtctcctgccc

SEQ ID NO: 8575643 - DNA, 22 bp, Homo sapiens
caggtagaggctgccatcagct

SEQ ID NO: 8575644 - DNA, 22 bp, Homo sapiens
caggtacacaggacaaagtact

SEQ ID NO: 8575645 - DNA, 22 bp, Homo sapiens
caggtcaaaggttagttatgtt

SEQ ID NO: 8575646 - DNA, 22 bp, Homo sapiens
caggtcagaggtagatgagatg

SEQ ID NO: 8575647 - DNA, 22 bp, Homo sapiens
caggtccacagcccatcactgc

SEQ ID NO: 8575648 - DNA, 22 bp, Homo sapiens
caggtccaattgcgctaaaatc

SEQ ID NO: 8575649 - DNA, 22 bp, Homo sapiens
caggtccaaggttcctgaatag

SEQ ID NO: 8575650 - DNA, 22 bp, Homo sapiens
caggtccaagagatcctcctac

SEQ ID NO: 8575651 - DNA, 22 bp, Homo sapiens
caggtccaactatttatctgtg

SEQ ID NO: 8575652 - DNA, 22 bp, Homo sapiens
caggtgcctcaggatgagacaa

SEQ ID NO: 8575653 - DNA, 22 bp, Homo sapiens
tcaaaaatgttttatattggta

SEQ ID NO: 8575654 - DNA, 22 bp, Homo sapiens
tattttactttaaagcgagaga

SEQ ID NO: 8575655 - DNA, 22 bp, Homo sapiens
tattttactatttggcaaagtc

SEQ ID NO: 8575656 - DNA, 22 bp, Homo sapiens
tattttacatgatccagagttg

SEQ ID NO: 8575657 - DNA, 22 bp, Homo sapiens
tcaaaacaacactcaggtgtaa

SEQ ID NO: 8575658 - DNA, 22 bp, Homo sapiens
tcaaaacactattacctttaat

SEQ ID NO: 8575659 - DNA, 22 bp, Homo sapiens
tattttacagactactttagat

SEQ ID NO: 8575660 - DNA, 22 bp, Homo sapiens
cagtcagtcaatactctttgag

SEQ ID NO: 8575661 - DNA, 22 bp, Homo sapiens
cagtattttcaggatttggaag

SEQ ID NO: 8575662 - DNA, 22 bp, Homo sapiens
tccctgggtcctgcttgctctc

SEQ ID NO: 8575663 - DNA, 22 bp, Homo sapiens
tcccactcccaggcaggcctct

SEQ ID NO: 8575664 - DNA, 22 bp, Homo sapiens
cattgtgcagggataatgcagc

SEQ ID NO: 8575665 - DNA, 22 bp, Homo sapiens
catttacacttctaaccacaag

SEQ ID NO: 8575666 - DNA, 22 bp, Homo sapiens
tccaggagaccagatgtaggcc

SEQ ID NO: 8575667 - DNA, 22 bp, Homo sapiens
tccaggagacacaaggtacata

SEQ ID NO: 8575668 - DNA, 19 bp, Homo sapiens
tccaggagcaaagccagtt

SEQ ID NO: 8575669 - DNA, 22 bp, Homo sapiens
tcctggaggacagaggcatctc

SEQ ID NO: 8575670 - DNA, 22 bp, Homo sapiens
tcctgggactttcaaggctagg

SEQ ID NO: 8575671 - DNA, 22 bp, Homo sapiens
tcctgggagcacatggtcctgc

SEQ ID NO: 8575672 - DNA, 22 bp, Homo sapiens
tcctgggagagtttgattcatt

SEQ ID NO: 8575673 - DNA, 22 bp, Homo sapiens
tcctgggagcccttgctccacc

SEQ ID NO: 8575674 - DNA, 22 bp, Homo sapiens
tcctgggagcccttgctccacc

SEQ ID NO: 8575675 - DNA, 22 bp, Homo sapiens
tcctgggcttaagtgatcctcc

SEQ ID NO: 8575676 - DNA, 22 bp, Homo sapiens
tccttggggacgctgacatcgt

SEQ ID NO: 8575677 - DNA, 22 bp, Homo sapiens
tcctgggcttgctcctccagct

SEQ ID NO: 8575678 - DNA, 22 bp, Homo sapiens
tcctgtttttgtaatcgactct

SEQ ID NO: 8575679 - DNA, 22 bp, Homo sapiens
tctaagaggcatcaagacaagc

SEQ ID NO: 8575680 - DNA, 22 bp, Homo sapiens
ccactgggggctgctcccaggt

SEQ ID NO: 8575681 - DNA, 22 bp, Homo sapiens
ccagagaatccggagagtccat

SEQ ID NO: 8575682 - DNA, 22 bp, Homo sapiens
ccagagaattttagacaaaaat

SEQ ID NO: 8575683 - DNA, 22 bp, Homo sapiens
ccagagaattttagacaaaaat

SEQ ID NO: 8575684 - DNA, 22 bp, Homo sapiens
ccagagaagtcttgcctggatt

SEQ ID NO: 8575685 - DNA, 22 bp, Homo sapiens
ccagagaaccatctgcttgagg

SEQ ID NO: 8575686 - DNA, 22 bp, Homo sapiens
ccagagaaataaggggaaaatg

SEQ ID NO: 8575687 - DNA, 22 bp, Homo sapiens
ccagagaaccttgagctgtgag

SEQ ID NO: 8575688 - DNA, 22 bp, Homo sapiens
ccagagaagaaaagcacctttt

SEQ ID NO: 8575689 - DNA, 22 bp, Homo sapiens
ccagagaaggtggagcttgtgt

SEQ ID NO: 8575690 - DNA, 22 bp, Homo sapiens
cagttttggtcctttctaggta

SEQ ID NO: 8575691 - DNA, 22 bp, Homo sapiens
cataatatctccgattacttgc

SEQ ID NO: 8575692 - DNA, 22 bp, Homo sapiens
tcagcaggtgaacatcatgcca

SEQ ID NO: 8575693 - DNA, 22 bp, Homo sapiens
tcagcagggtttgacttctaat

SEQ ID NO: 8575694 - DNA, 22 bp, Homo sapiens
catgcagtgactcagacacagg

SEQ ID NO: 8575695 - DNA, 22 bp, Homo sapiens
catgcagtcaataaacatgtgt

SEQ ID NO: 8575696 - DNA, 23 bp, Homo sapiens
tccaggagaattccagggcccgg

SEQ ID NO: 8575697 - DNA, 22 bp, Homo sapiens
catggccaaggatgctcaacca

SEQ ID NO: 8575698 - DNA, 22 bp, Homo sapiens
catggccaaagaattatatttt

SEQ ID NO: 8575699 - DNA, 22 bp, Homo sapiens
catggccacatctagctgcaag

SEQ ID NO: 8575700 - DNA, 22 bp, Homo sapiens
catggccagcccccagttcctc

SEQ ID NO: 8575701 - DNA, 22 bp, Homo sapiens
catggccagattctttcttctc

SEQ ID NO: 8575702 - DNA, 22 bp, Homo sapiens
catggccacattggaccgaagc

SEQ ID NO: 8575703 - DNA, 22 bp, Homo sapiens
catggccacatgataatcaagt

SEQ ID NO: 8575704 - DNA, 22 bp, Homo sapiens
catctcagtgtacagggagtct

SEQ ID NO: 8575705 - DNA, 22 bp, Homo sapiens
catctgctgttccttggactca

SEQ ID NO: 8575706 - DNA, 20 bp, Homo sapiens
tggaatgggtccttgaaaaa

SEQ ID NO: 8575707 - DNA, 22 bp, Homo sapiens
cccattccctttactgttgcat

SEQ ID NO: 8575708 - DNA, 22 bp, Homo sapiens
cccaggtccccacctgtctgct

SEQ ID NO: 8575709 - DNA, 22 bp, Homo sapiens
cccattcttcatggtttcctgt

SEQ ID NO: 8575710 - DNA, 22 bp, Homo sapiens
cccgagtgtctactcactccca

SEQ ID NO: 8575711 - DNA, 22 bp, Homo sapiens
cccgactagctgggattacagg

SEQ ID NO: 8575712 - DNA, 22 bp, Homo sapiens
tgccctggtagacacagactgt

SEQ ID NO: 8575713 - DNA, 22 bp, Homo sapiens
tgccctggtgaagtgctctcct

SEQ ID NO: 8575714 - DNA, 22 bp, Homo sapiens
tgccctggttacactggagtcc

SEQ ID NO: 8575715 - DNA, 22 bp, Homo sapiens
cccaggtagtgagaaatggagg

SEQ ID NO: 8575716 - DNA, 22 bp, Homo sapiens
tgccttcactgagcttatggga

SEQ ID NO: 8575717 - DNA, 22 bp, Homo sapiens
tgccttcatccatgttatagtg

SEQ ID NO: 8575718 - DNA, 22 bp, Homo sapiens
tgccttcaccaggccttcagcc

SEQ ID NO: 8575719 - DNA, 22 bp, Homo sapiens
tgccttcaagacccatcctcca

SEQ ID NO: 8575720 - DNA, 22 bp, Homo sapiens
tgccttcaatcaggatggtctc

SEQ ID NO: 8575721 - DNA, 22 bp, Homo sapiens
tgccatattgcaaagtgtctgc

SEQ ID NO: 8575722 - DNA, 22 bp, Homo sapiens
tgccagttgggaaaacagacat

SEQ ID NO: 8575723 - DNA, 22 bp, Homo sapiens
tgccagcttttgactatcttag

SEQ ID NO: 8575724 - DNA, 22 bp, Homo sapiens
tgggctctagactttagtgtgg

SEQ ID NO: 8575725 - DNA, 22 bp, Homo sapiens
tgggctgcggataggcctcgga

SEQ ID NO: 8575726 - DNA, 22 bp, Homo sapiens
cctgagctcaaagggtgcctgg

SEQ ID NO: 8575727 - DNA, 22 bp, Homo sapiens
cctcttctaggacgtccttgtg

SEQ ID NO: 8575728 - DNA, 22 bp, Homo sapiens
cctgagatggggattattccaa

SEQ ID NO: 8575729 - DNA, 19 bp, Homo sapiens
tggctctgtcgaaggcaca

SEQ ID NO: 8575730 - DNA, 22 bp, Homo sapiens
cctctgcctttagtgaaagttg

SEQ ID NO: 8575731 - DNA, 22 bp, Homo sapiens
cctctgcctgcacatcatcctg

SEQ ID NO: 8575732 - DNA, 18 bp, Homo sapiens
cctctgccatagccagca

SEQ ID NO: 8575733 - DNA, 22 bp, Homo sapiens
tggcaggtagagttctgagatg

SEQ ID NO: 8575734 - DNA, 18 bp, Homo sapiens
tggcaggtagactcaggt

SEQ ID NO: 8575735 - DNA, 22 bp, Homo sapiens
tggcaggtacccattggctgta

SEQ ID NO: 8575736 - DNA, 22 bp, Homo sapiens
ccctgcagggaggattctgaag

SEQ ID NO: 8575737 - DNA, 22 bp, Homo sapiens
ccctgcaggggacctgcagcct

SEQ ID NO: 8575738 - DNA, 21 bp, Homo sapiens
ccctgcaggccagggctgagc

SEQ ID NO: 8575739 - DNA, 21 bp, Homo sapiens
cccttcttgggtcaaagtata

SEQ ID NO: 8575740 - DNA, 21 bp, Homo sapiens
cccttcttactcaagctcatt

SEQ ID NO: 8575741 - DNA, 22 bp, Homo sapiens
cccttctttgtaataaagatta

SEQ ID NO: 8575742 - DNA, 21 bp, Homo sapiens
cccttcttgggtcaaagtata

SEQ ID NO: 8575743 - DNA, 17 bp, Homo sapiens
cctcagcttctttcctc

SEQ ID NO: 8575744 - DNA, 22 bp, Homo sapiens
ccaggctgaatatgttccaggg

SEQ ID NO: 8575745 - DNA, 22 bp, Homo sapiens
tcttcacattcacgtaacatag

SEQ ID NO: 8575746 - DNA, 22 bp, Homo sapiens
ccaggagtttgaggctgcagtg

SEQ ID NO: 8575747 - DNA, 22 bp, Homo sapiens
ccaggatggggagcagatagaa

SEQ ID NO: 8575748 - DNA, 22 bp, Homo sapiens
ccaggagttggaagctgccatg

SEQ ID NO: 8575749 - DNA, 22 bp, Homo sapiens
ccaggagttggaggctgcagtg

SEQ ID NO: 8575750 - DNA, 22 bp, Homo sapiens
ccaggccagcgctggctggagg

SEQ ID NO: 8575751 - DNA, 22 bp, Homo sapiens
tctgggagcagctcagcagatt

SEQ ID NO: 8575752 - DNA, 22 bp, Homo sapiens
tctgggagcagctcagcagatt

SEQ ID NO: 8575753 - DNA, 22 bp, Homo sapiens
tctgggagcacacgcagtgatc

SEQ ID NO: 8575754 - DNA, 22 bp, Homo sapiens
tctgggagatccaagcagaact

SEQ ID NO: 8575755 - DNA, 22 bp, Homo sapiens
tctgggagatccaagcagaact

SEQ ID NO: 8575756 - DNA, 22 bp, Homo sapiens
tctgggagagtctaacttgttt

SEQ ID NO: 8575757 - DNA, 22 bp, Homo sapiens
tctggtgtcagtattctttgaa

SEQ ID NO: 8575758 - DNA, 22 bp, Homo sapiens
tctggcctgaaagtccatgctt

SEQ ID NO: 8575759 - DNA, 22 bp, Homo sapiens
tctggcctcttgggatgctccc

SEQ ID NO: 8575760 - DNA, 22 bp, Homo sapiens
tctggccctgctgctgtgagca

SEQ ID NO: 8575761 - DNA, 22 bp, Homo sapiens
ccagctctctgcagaaaggact

SEQ ID NO: 8575762 - DNA, 22 bp, Homo sapiens
ccagctctgcatgtttcccttg

SEQ ID NO: 8575763 - DNA, 22 bp, Homo sapiens
ccagctctctttgaagcataaa

SEQ ID NO: 8575764 - DNA, 21 bp, Homo sapiens
tgaatgcttcgtcatcctggc

SEQ ID NO: 8575765 - DNA, 22 bp, Homo sapiens
ccaggctggagtgcaatggtgc

SEQ ID NO: 8575766 - DNA, 22 bp, Homo sapiens
ccaggggaaacagggagcactc

SEQ ID NO: 8575767 - DNA, 22 bp, Homo sapiens
tgagaatgagggggtagaaggt

SEQ ID NO: 8575768 - DNA, 22 bp, Homo sapiens
tgagaatgccataagagctatt

SEQ ID NO: 8575769 - DNA, 22 bp, Homo sapiens
tgagaatgaatcttttgctttc

SEQ ID NO: 8575770 - DNA, 22 bp, Homo sapiens
ccagggggcttggtgaggccat

SEQ ID NO: 8575771 - DNA, 22 bp, Homo sapiens
tgaggcagatatttattgggtt

SEQ ID NO: 8575772 - DNA, 22 bp, Homo sapiens
tgaggcagatatttattgggtt

SEQ ID NO: 8575773 - DNA, 22 bp, Homo sapiens
tgaggcagcaattgattattca

SEQ ID NO: 8575774 - DNA, 22 bp, Homo sapiens
tgaggcagaaattcctgttttc

SEQ ID NO: 8575775 - DNA, 22 bp, Homo sapiens
tgaggcagagtaagatacatga

SEQ ID NO: 8575776 - DNA, 22 bp, Homo sapiens
tgaggcagaaaatagcagttca

SEQ ID NO: 8575777 - DNA, 23 bp, Homo sapiens
tgaggacctctcaggggccaggc

SEQ ID NO: 8575778 - DNA, 22 bp, Homo sapiens
tgatttctcatattgttcaaaa

SEQ ID NO: 8575779 - DNA, 22 bp, Homo sapiens
ccattgtaaattctgtggaagt

SEQ ID NO: 8575780 - DNA, 22 bp, Homo sapiens
ccatgcagtgctggagctgatt

SEQ ID NO: 8575781 - DNA, 22 bp, Homo sapiens
ccagtgttttcatcctcccttg

SEQ ID NO: 8575782 - DNA, 22 bp, Homo sapiens
ccagtgtttgatgggattttca

SEQ ID NO: 8575783 - DNA, 22 bp, Homo sapiens
ccagtgtttccccagaagagag

SEQ ID NO: 8575784 - DNA, 22 bp, Homo sapiens
ccagtgtttccgtcagtacacg

SEQ ID NO: 8575785 - DNA, 22 bp, Homo sapiens
ccatgcctggactccactctca

SEQ ID NO: 8575786 - DNA, 22 bp, Homo sapiens
ccatgcctttcactgaaccagt

SEQ ID NO: 8575787 - DNA, 22 bp, Homo sapiens
ccagtgttgcataggatgggga

SEQ ID NO: 8575788 - DNA, 22 bp, Homo sapiens
ccagtgtttacagttgaacaaa

SEQ ID NO: 8575789 - DNA, 22 bp, Homo sapiens
ccagtgttggaggatggcttgc

SEQ ID NO: 8575790 - DNA, 22 bp, Homo sapiens
ccagtgtttaggaataaaatgt

SEQ ID NO: 8575791 - DNA, 22 bp, Homo sapiens
ccagtgttccctcgggttcatg

SEQ ID NO: 8575792 - DNA, 22 bp, Homo sapiens
ccagtgttccatggagtgatta

SEQ ID NO: 8575793 - DNA, 22 bp, Homo sapiens
ccagtgttccagagagctgatg

SEQ ID NO: 8575794 - DNA, 22 bp, Homo sapiens
ccagtgttctggtgttcatttc

SEQ ID NO: 8575795 - DNA, 22 bp, Homo sapiens
ccagtgttgaacagtatttgga

SEQ ID NO: 8575796 - DNA, 22 bp, Homo sapiens
ccagtcctgccaccctgtctat

SEQ ID NO: 8575797 - DNA, 22 bp, Homo sapiens
ccagtcctgctccctgaccacc

SEQ ID NO: 8575798 - DNA, 22 bp, Homo sapiens
tgaggcagcaattgtattgtat

SEQ ID NO: 8575799 - DNA, 22 bp, Homo sapiens
tgaggcagcattcttcaagaca

SEQ ID NO: 8575800 - DNA, 22 bp, Homo sapiens
tgaggcagcccactttccttag

SEQ ID NO: 8575801 - DNA, 22 bp, Homo sapiens
tgaggcagcctgcattaaagag

SEQ ID NO: 8575802 - DNA, 22 bp, Homo sapiens
tttgcaaataccatgaaacttg

SEQ ID NO: 8575803 - DNA, 22 bp, Homo sapiens
tttgcaaaatgaggtgaagagt

SEQ ID NO: 8575804 - DNA, 22 bp, Homo sapiens
tttgcaaatgctctgcagagct

SEQ ID NO: 8575805 - DNA, 22 bp, Homo sapiens
tttgtataagaacattctagca

SEQ ID NO: 8575806 - DNA, 22 bp, Homo sapiens
tttgttgacatccctgtacttt

SEQ ID NO: 8575807 - DNA, 22 bp, Homo sapiens
tttgttgagttacagagatgaa

SEQ ID NO: 8575808 - DNA, 22 bp, Homo sapiens
tttgtatttttcccagctagct

SEQ ID NO: 8575809 - DNA, 22 bp, Homo sapiens
ttttataagcaagaaagggaaa

SEQ ID NO: 8575810 - DNA, 22 bp, Homo sapiens
ttttataaagagagtcagttgg

SEQ ID NO: 8575811 - DNA, 23 bp, Homo sapiens
ttttcctttggacaggctgtatt

SEQ ID NO: 8575812 - DNA, 22 bp, Homo sapiens
tttttccaccgtacttcctgag

SEQ ID NO: 8575813 - DNA, 22 bp, Homo sapiens
ttttgaaagggtgatttggctt

SEQ ID NO: 8575814 - DNA, 22 bp, Homo sapiens
tttctgtagggatttcacagtt

SEQ ID NO: 8575815 - DNA, 22 bp, Homo sapiens
tttcttatgtgcagagtgagta

SEQ ID NO: 8575816 - DNA, 22 bp, Homo sapiens
tttcttatggggtagtccttta

SEQ ID NO: 8575817 - DNA, 22 bp, Homo sapiens
tttcttatgagcaagactctat

SEQ ID NO: 8575818 - DNA, 21 bp, Homo sapiens
tttcttatctgtaaagtggga

SEQ ID NO: 8575819 - DNA, 22 bp, Homo sapiens
tttctgtggtgggtagttcaga

SEQ ID NO: 8575820 - DNA, 22 bp, Homo sapiens
tttctgttaggcatcattttaa

SEQ ID NO: 8575821 - DNA, 22 bp, Homo sapiens
tttcttgtgcctaattttgggc

SEQ ID NO: 8575822 - DNA, 22 bp, Homo sapiens
tttctagaaacattatctctat

SEQ ID NO: 8575823 - DNA, 22 bp, Homo sapiens
tttctagaaatagagatagagt

SEQ ID NO: 8575824 - DNA, 22 bp, Homo sapiens
tttctattgtaagtctcctata

SEQ ID NO: 8575825 - DNA, 22 bp, Homo sapiens
tttctccctccactacaggctc

SEQ ID NO: 8575826 - DNA, 22 bp, Homo sapiens
tttctccctttataagactgta

SEQ ID NO: 8575827 - DNA, 22 bp, Homo sapiens
tttctcccccatgataatttct

SEQ ID NO: 8575828 - DNA, 22 bp, Homo sapiens
tttctccccagtctaatctgga

SEQ ID NO: 8575829 - DNA, 22 bp, Homo sapiens
tttctcccagtctcctgagaca

SEQ ID NO: 8575830 - DNA, 20 bp, Homo sapiens
tttctcccaagtgcaagggt

SEQ ID NO: 8575831 - DNA, 22 bp, Homo sapiens
tttctcccaactctggaagcca

SEQ ID NO: 8575832 - DNA, 22 bp, Homo sapiens
tttctcccaaagtgcaaccaca

SEQ ID NO: 8575833 - DNA, 22 bp, Homo sapiens
tttcctctttgtaccttgacta

SEQ ID NO: 8575834 - DNA, 17 bp, Homo sapiens
tttcagattcactttct

SEQ ID NO: 8575835 - DNA, 22 bp, Homo sapiens
tttcagtgcacgtagtttattt

SEQ ID NO: 8575836 - DNA, 19 bp, Homo sapiens
tttcaggagctatgcaggg

SEQ ID NO: 8575837 - DNA, 22 bp, Homo sapiens
tttcaggattagtttaagcagg

SEQ ID NO: 8575838 - DNA, 22 bp, Homo sapiens
tttcaaagaccattaactatca

SEQ ID NO: 8575839 - DNA, 22 bp, Homo sapiens
tttcaaagagaggcagaaggaa

SEQ ID NO: 8575840 - DNA, 22 bp, Homo sapiens
tttcaaagcaactgaaaaggaa

SEQ ID NO: 8575841 - DNA, 22 bp, Homo sapiens
tttcagaggtatgctgcttatc

SEQ ID NO: 8575842 - DNA, 22 bp, Homo sapiens
tttcagaggaggaaggcagtta

SEQ ID NO: 8575843 - DNA, 22 bp, Homo sapiens
tttcagaggaaatctcattgag

SEQ ID NO: 8575844 - DNA, 22 bp, Homo sapiens
tttcagagtcagctcctctcta

SEQ ID NO: 8575845 - DNA, 22 bp, Homo sapiens
tttcagagttagtagagcatgt

SEQ ID NO: 8575846 - DNA, 22 bp, Homo sapiens
tttcagagtctggctgcagcct

SEQ ID NO: 8575847 - DNA, 20 bp, Homo sapiens
tttcagagtgtctttccatt

SEQ ID NO: 8575848 - DNA, 22 bp, Homo sapiens
tttcattttggttatgccataa

SEQ ID NO: 8575849 - DNA, 22 bp, Homo sapiens
tttcatttcatagaattgtgtt

SEQ ID NO: 8575850 - DNA, 22 bp, Homo sapiens
ttgcaagatgttaccattgtta

SEQ ID NO: 8575851 - DNA, 22 bp, Homo sapiens
ttgtctgaaaaggtaaatattt

SEQ ID NO: 8575852 - DNA, 22 bp, Homo sapiens
ttgtctggtcaaatcacttgta

SEQ ID NO: 8575853 - DNA, 22 bp, Homo sapiens
ttgtgaatagtgccgcaataaa

SEQ ID NO: 8575854 - DNA, 22 bp, Homo sapiens
ttgtttccattgcagactgtgt

SEQ ID NO: 8575855 - DNA, 22 bp, Homo sapiens
ttgtgaatggtgccgcaataaa

SEQ ID NO: 8575856 - DNA, 22 bp, Homo sapiens
ttgtgtttcccttgcatattcc

SEQ ID NO: 8575857 - DNA, 22 bp, Homo sapiens
ttgtttctgagttttcatgtat

SEQ ID NO: 8575858 - DNA, 21 bp, Homo sapiens
ttgtttcctcccaaaatgcca

SEQ ID NO: 8575859 - DNA, 22 bp, Homo sapiens
ttgtttcctttctatacaggat

SEQ ID NO: 8575860 - DNA, 22 bp, Homo sapiens
ttgtttgtaaggctcttagaat

SEQ ID NO: 8575861 - DNA, 22 bp, Homo sapiens
ttgtttgaataacagacaaatt

SEQ ID NO: 8575862 - DNA, 22 bp, Homo sapiens
tttaattagcaagccagagagc

SEQ ID NO: 8575863 - DNA, 22 bp, Homo sapiens
tttaaaaaactagtctgagtct

SEQ ID NO: 8575864 - DNA, 22 bp, Homo sapiens
tttacaaggcagttattttcct

SEQ ID NO: 8575865 - DNA, 22 bp, Homo sapiens
tttacaaggcagaactgattaa

SEQ ID NO: 8575866 - DNA, 22 bp, Homo sapiens
tttacaagtacacctaacagct

SEQ ID NO: 8575867 - DNA, 22 bp, Homo sapiens
tttacaaggatcaagggatctc

SEQ ID NO: 8575868 - DNA, 22 bp, Homo sapiens
tttacaagaaatcatgatgcta

SEQ ID NO: 8575869 - DNA, 22 bp, Homo sapiens
tttaccatctgccacagatatg

SEQ ID NO: 8575870 - DNA, 22 bp, Homo sapiens
tttattatagtggtggggactg

SEQ ID NO: 8575871 - DNA, 22 bp, Homo sapiens
tttattaatgtagcatccatgg

SEQ ID NO: 8575872 - DNA, 22 bp, Homo sapiens
tttattatgatggacaccttcg

SEQ ID NO: 8575873 - DNA, 22 bp, Homo sapiens
tttattatgatggacaccttcg

SEQ ID NO: 8575874 - DNA, 22 bp, Homo sapiens
tttattatccagtgttgtcatg

SEQ ID NO: 8575875 - DNA, 22 bp, Homo sapiens
tttattatgtacaggcactata

SEQ ID NO: 8575876 - DNA, 22 bp, Homo sapiens
tttataaaatagactgggtcta

SEQ ID NO: 8575877 - DNA, 22 bp, Homo sapiens
tttataaacagtaccacggtgc

SEQ ID NO: 8575878 - DNA, 22 bp, Homo sapiens
tttattaagatgcgaatgctga

SEQ ID NO: 8575879 - DNA, 22 bp, Homo sapiens
ttctggttctcaggaatgctaa

SEQ ID NO: 8575880 - DNA, 22 bp, Homo sapiens
ttcttgattcttccttgaagga

SEQ ID NO: 8575881 - DNA, 22 bp, Homo sapiens
ttcttgatgtaccaacttggga

SEQ ID NO: 8575882 - DNA, 22 bp, Homo sapiens
ttcttgattagtctcatgccaa

SEQ ID NO: 8575883 - DNA, 22 bp, Homo sapiens
ttcttgatgcttgtttaaaggt

SEQ ID NO: 8575884 - DNA, 22 bp, Homo sapiens
ttcttgatttcatgcagttaag

SEQ ID NO: 8575885 - DNA, 20 bp, Homo sapiens
ttcttgatttgatcctggtt

SEQ ID NO: 8575886 - DNA, 22 bp, Homo sapiens
ttcttgatgaatgctaagaact

SEQ ID NO: 8575887 - DNA, 22 bp, Homo sapiens
ttcttctttcctataattaatt

SEQ ID NO: 8575888 - DNA, 21 bp, Homo sapiens
ttctgccttcgaggtctcagg

SEQ ID NO: 8575889 - DNA, 22 bp, Homo sapiens
ttgattgaattttgaaaatcta

SEQ ID NO: 8575890 - DNA, 20 bp, Homo sapiens
ttgcaaagtgaatagcaatt

SEQ ID NO: 8575891 - DNA, 22 bp, Homo sapiens
ttgattcagagaagattggccc

SEQ ID NO: 8575892 - DNA, 22 bp, Homo sapiens
ttgattcagaaaaagatggaga

SEQ ID NO: 8575893 - DNA, 20 bp, Homo sapiens
ttgattcaagggctgatgga

SEQ ID NO: 8575894 - DNA, 22 bp, Homo sapiens
ttgatcatcttgtgctgacggc

SEQ ID NO: 8575895 - DNA, 22 bp, Homo sapiens
ttgagtgtaaggaatgtggggc

SEQ ID NO: 8575896 - DNA, 23 bp, Homo sapiens
ttgagtcttataggattgaggtg

SEQ ID NO: 8575897 - DNA, 22 bp, Homo sapiens
ttgagtctctgccaaaacacaa

SEQ ID NO: 8575898 - DNA, 22 bp, Homo sapiens
ttgatgatcttacggcagagga

SEQ ID NO: 8575899 - DNA, 22 bp, Homo sapiens
ttgatgatgtttctgccttgcc

SEQ ID NO: 8575900 - DNA, 22 bp, Homo sapiens
ttgatgatgcacatttataatt

SEQ ID NO: 8575901 - DNA, 22 bp, Homo sapiens
ttgaagataggccaggatgagc

SEQ ID NO: 8575902 - DNA, 22 bp, Homo sapiens
ttgaagatctttgcattgcagg

SEQ ID NO: 8575903 - DNA, 22 bp, Homo sapiens
ttgaagatggtagcaatttcct

SEQ ID NO: 8575904 - DNA, 22 bp, Homo sapiens
ttgaagattctttttgttagta

SEQ ID NO: 8575905 - DNA, 22 bp, Homo sapiens
ttgaagattattctattaaaag

SEQ ID NO: 8575906 - DNA, 18 bp, Homo sapiens
ttgaggagttcactgtct

SEQ ID NO: 8575907 - DNA, 23 bp, Homo sapiens
ttgagctcagtagctctgctggt

SEQ ID NO: 8575908 - DNA, 22 bp, Homo sapiens
ttgagcccaggaggcctgggtg

SEQ ID NO: 8575909 - DNA, 22 bp, Homo sapiens
ttgagcccaggaggcctgggtg

SEQ ID NO: 8575910 - DNA, 22 bp, Homo sapiens
ttcacagtgagctatgtcttgt

SEQ ID NO: 8575911 - DNA, 22 bp, Homo sapiens
ttagaggtgtcaggagcacagg

SEQ ID NO: 8575912 - DNA, 22 bp, Homo sapiens
ttcatggatcatgccttttgtg

SEQ ID NO: 8575913 - DNA, 22 bp, Homo sapiens
ttcatgtgtatggaacattttt

SEQ ID NO: 8575914 - DNA, 22 bp, Homo sapiens
ttcacagtggctgtgccatttg

SEQ ID NO: 8575915 - DNA, 22 bp, Homo sapiens
ttcacagtggccctctctgagt

SEQ ID NO: 8575916 - DNA, 22 bp, Homo sapiens
ttcaggtgtcaaggataggctg

SEQ ID NO: 8575917 - DNA, 22 bp, Homo sapiens
ttcctccacgtgacaggagcca

SEQ ID NO: 8575918 - DNA, 22 bp, Homo sapiens
ttcctccagcctggagcacttc

SEQ ID NO: 8575919 - DNA, 22 bp, Homo sapiens
ttcctacagccctgaatctcta

SEQ ID NO: 8575920 - DNA, 22 bp, Homo sapiens
ttccacattccttacattcata

SEQ ID NO: 8575921 - DNA, 22 bp, Homo sapiens
ttccacaggactaaatgtcatc

SEQ ID NO: 8575922 - DNA, 22 bp, Homo sapiens
ttccacagcccaagctggtggc

SEQ ID NO: 8575923 - DNA, 22 bp, Homo sapiens
ttcctgtgatattagccactgt

SEQ ID NO: 8575924 - DNA, 22 bp, Homo sapiens
ttcctgtggccttacatctgtg

SEQ ID NO: 8575925 - DNA, 22 bp, Homo sapiens
ttcctctttagggctggccagg

SEQ ID NO: 8575926 - DNA, 21 bp, Homo sapiens
ttcctcttgcttccgccttgc

SEQ ID NO: 8575927 - DNA, 22 bp, Homo sapiens
tgttcctgtactgctgtggctt

SEQ ID NO: 8575928 - DNA, 22 bp, Homo sapiens
tgtttactagccaacatggaga

SEQ ID NO: 8575929 - DNA, 22 bp, Homo sapiens
tgtgtttatagtgtatcttcca

SEQ ID NO: 8575930 - DNA, 22 bp, Homo sapiens
tgtgtttacttctatgcagttt

SEQ ID NO: 8575931 - DNA, 22 bp, Homo sapiens
tgtgttgtgacattcttggatg

SEQ ID NO: 8575932 - DNA, 22 bp, Homo sapiens
tgtgttcaatcaccaaaggtat

SEQ ID NO: 8575933 - DNA, 21 bp, Homo sapiens
tgtgttcttctaggtcagcta

SEQ ID NO: 8575934 - DNA, 22 bp, Homo sapiens
tgttcctggggacctgccttcc

SEQ ID NO: 8575935 - DNA, 18 bp, Homo sapiens
tgttcctgcctttctctg

SEQ ID NO: 8575936 - DNA, 22 bp, Homo sapiens
tgttatcctcagctcacctcta

SEQ ID NO: 8575937 - DNA, 22 bp, Homo sapiens
tgtgtgattgcaggagatgtgg

SEQ ID NO: 8575938 - DNA, 22 bp, Homo sapiens
tgtgtgaggactcagtgaaaca

SEQ ID NO: 8575939 - DNA, 22 bp, Homo sapiens
tgtgtgaatggattattctatt

SEQ ID NO: 8575940 - DNA, 22 bp, Homo sapiens
tgtgtgaatctattgaatatat

SEQ ID NO: 8575941 - DNA, 22 bp, Homo sapiens
tgtgtgaagtgattttaagtct

SEQ ID NO: 8575942 - DNA, 22 bp, Homo sapiens
tgtgtgaactctctgatgtaca

SEQ ID NO: 8575943 - DNA, 22 bp, Homo sapiens
tgtgtgaacatgttttcatttc

SEQ ID NO: 8575944 - DNA, 22 bp, Homo sapiens
tgtgtgaagcacatgttcaagg

SEQ ID NO: 8575945 - DNA, 22 bp, Homo sapiens
tgtggtctcctgtcttggcctt

SEQ ID NO: 8575946 - DNA, 22 bp, Homo sapiens
tccccctccaattgccatgtta

SEQ ID NO: 8575947 - DNA, 22 bp, Homo sapiens
tcccctccaactccaactatgg

SEQ ID NO: 8575948 - DNA, 22 bp, Homo sapiens
tccccagtcccggcggtgggtg

SEQ ID NO: 8575949 - DNA, 22 bp, Homo sapiens
tccccagtaagcctgcactgtg

SEQ ID NO: 8575950 - DNA, 22 bp, Homo sapiens
tgtggagctcagaagtagcagt

SEQ ID NO: 8575951 - DNA, 22 bp, Homo sapiens
tgtggagaagaaggccactgca

SEQ ID NO: 8575952 - DNA, 22 bp, Homo sapiens
tgtggagatgtgagcaagggga

SEQ ID NO: 8575953 - DNA, 22 bp, Homo sapiens
ttacacagttggtaggggcaga

SEQ ID NO: 8575954 - DNA, 22 bp, Homo sapiens
ttactttatctcctagattcca

SEQ ID NO: 8575955 - DNA, 22 bp, Homo sapiens
ttagagaattccaaatgactac

SEQ ID NO: 8575956 - DNA, 22 bp, Homo sapiens
ttactaggccagttttcacttt

SEQ ID NO: 8575957 - DNA, 22 bp, Homo sapiens
ttactttagatcatactgtgtg

SEQ ID NO: 8575958 - DNA, 22 bp, Homo sapiens
ttaacaaagtaacgggaaaaga

SEQ ID NO: 8575959 - DNA, 22 bp, Homo sapiens
ttaaattaggactctagttctg

SEQ ID NO: 8575960 - DNA, 22 bp, Homo sapiens
ttaaatgacgggactgggtttt

SEQ ID NO: 8575961 - DNA, 22 bp, Homo sapiens
ttaaatgagatgttcagatatt

SEQ ID NO: 8575962 - DNA, 22 bp, Homo sapiens
ttaaatgagatgttcagatatt

SEQ ID NO: 8575963 - DNA, 23 bp, Homo sapiens
tgtttttcattcacatgggctgt

SEQ ID NO: 8575964 - DNA, 22 bp, Homo sapiens
tgttttgtctaatagggcaggt

SEQ ID NO: 8575965 - DNA, 22 bp, Homo sapiens
tgttttgtctaatctaaattct

SEQ ID NO: 8575966 - DNA, 22 bp, Homo sapiens
tgttttgtgcatttacaacatg

SEQ ID NO: 8575967 - DNA, 22 bp, Homo sapiens
tgttttctgtgtagagatcaca

SEQ ID NO: 8575968 - DNA, 20 bp, Homo sapiens
ttaagaaaagcacatcctgc

SEQ ID NO: 8575969 - DNA, 22 bp, Homo sapiens
ttaagaatgtgccttttggttg

SEQ ID NO: 8575970 - DNA, 17 bp, Homo sapiens
ttaaggtggatcagcac

SEQ ID NO: 8575971 - DNA, 22 bp, Homo sapiens
ttaattacaaaacacataggtt

SEQ ID NO: 8575972 - DNA, 22 bp, Homo sapiens
gtaggcagtggttggaagagaa

SEQ ID NO: 8575973 - DNA, 22 bp, Homo sapiens
gtaggcagataggagtgcagcc

SEQ ID NO: 8575974 - DNA, 22 bp, Homo sapiens
gtagggacttgttttactagta

SEQ ID NO: 8575975 - DNA, 22 bp, Homo sapiens
gtcagcagggtccccttgagtg

SEQ ID NO: 8575976 - DNA, 21 bp, Homo sapiens
gtcagcagatccagcacttgt

SEQ ID NO: 8575977 - DNA, 22 bp, Homo sapiens
gtccagagatggacgagcagat

SEQ ID NO: 8575978 - DNA, 22 bp, Homo sapiens
gtccagagatggacgagcagat

SEQ ID NO: 8575979 - DNA, 22 bp, Homo sapiens
gtccagagccggaagagtgaca

SEQ ID NO: 8575980 - DNA, 22 bp, Homo sapiens
gtccagagaggcaggaggctac

SEQ ID NO: 8575981 - DNA, 22 bp, Homo sapiens
gtccagagagtaaagggggtaa

SEQ ID NO: 8575982 - DNA, 22 bp, Homo sapiens
gtccagagaggcaggaggctac

SEQ ID NO: 8575983 - DNA, 22 bp, Homo sapiens
gtccagagtattcaagtaactt

SEQ ID NO: 8575984 - DNA, 17 bp, Homo sapiens
gtcctggtgtgtgagga

SEQ ID NO: 8575985 - DNA, 22 bp, Homo sapiens
gtcctggtggagtctctgggga

SEQ ID NO: 8575986 - DNA, 22 bp, Homo sapiens
gtcctggtgccacctgcgggat

SEQ ID NO: 8575987 - DNA, 22 bp, Homo sapiens
gtcctggtcctgcctccccatg

SEQ ID NO: 8575988 - DNA, 22 bp, Homo sapiens
gtcctggttttcacagaccttt

SEQ ID NO: 8575989 - DNA, 22 bp, Homo sapiens
cagccctgaaacaacctcctct

SEQ ID NO: 8575990 - DNA, 22 bp, Homo sapiens
ggggccttggatctgtgccccg

SEQ ID NO: 8575991 - DNA, 22 bp, Homo sapiens
gggctggaggagatccagaggc

SEQ ID NO: 8575992 - DNA, 22 bp, Homo sapiens
ggtcctgaggggagctgaaggt

SEQ ID NO: 8575993 - DNA, 22 bp, Homo sapiens
gggttcaggttggcctgagcac

SEQ ID NO: 8575994 - DNA, 22 bp, Homo sapiens
gggttcagagtcaggtgtgata

SEQ ID NO: 8575995 - DNA, 22 bp, Homo sapiens
gggttcagactaaagctatgca

SEQ ID NO: 8575996 - DNA, 22 bp, Homo sapiens
gggtccaggtttagtcatttgt

SEQ ID NO: 8575997 - DNA, 22 bp, Homo sapiens
gggtccaggtcttcaggcagag

SEQ ID NO: 8575998 - DNA, 22 bp, Homo sapiens
gggtccagtttcatctgaggtt

SEQ ID NO: 8575999 - DNA, 22 bp, Homo sapiens
gggtccagtagttggtggccgt

SEQ ID NO: 8576000 - DNA, 20 bp, Homo sapiens
gggaggcattggtccctcac

SEQ ID NO: 8576001 - DNA, 22 bp, Homo sapiens
cagagaacttagctagttttcc

SEQ ID NO: 8576002 - DNA, 22 bp, Homo sapiens
gggatctttctgatgctgtggc

SEQ ID NO: 8576003 - DNA, 22 bp, Homo sapiens
gggatcttgaaacagctggatt

SEQ ID NO: 8576004 - DNA, 22 bp, Homo sapiens
gggatgagagctgggacagaag

SEQ ID NO: 8576005 - DNA, 22 bp, Homo sapiens
cagagcataattgacatgaggt

SEQ ID NO: 8576006 - DNA, 22 bp, Homo sapiens
gggcaggtactgggtggtgagc

SEQ ID NO: 8576007 - DNA, 22 bp, Homo sapiens
gggcaggtacaagatgcttctt

SEQ ID NO: 8576008 - DNA, 22 bp, Homo sapiens
cagaaaatagagtttctctgag

SEQ ID NO: 8576009 - DNA, 22 bp, Homo sapiens
ggcaaggtactctagagcacat

SEQ ID NO: 8576010 - DNA, 22 bp, Homo sapiens
ggcaagtatttgtgcatctaca

SEQ ID NO: 8576011 - DNA, 22 bp, Homo sapiens
ggcaaggtgctacagacagtga

SEQ ID NO: 8576012 - DNA, 22 bp, Homo sapiens
ggcaagtaatacaggattattt

SEQ ID NO: 8576013 - DNA, 22 bp, Homo sapiens
ggcaagtcaggaagttgacatt

SEQ ID NO: 8576014 - DNA, 22 bp, Homo sapiens
ggcagagttggtggagtcagtt

SEQ ID NO: 8576015 - DNA, 22 bp, Homo sapiens
ggcagagtgctctgggcagggg

SEQ ID NO: 8576016 - DNA, 22 bp, Homo sapiens
cactgcaacctccacctcctgg

SEQ ID NO: 8576017 - DNA, 22 bp, Homo sapiens
cactccctctagttgcattctg

SEQ ID NO: 8576018 - DNA, 21 bp, Homo sapiens
cactccacttagaacagggtt

SEQ ID NO: 8576019 - DNA, 22 bp, Homo sapiens
ggccagggaggagaggcccctg

SEQ ID NO: 8576020 - DNA, 22 bp, Homo sapiens
ggccaggctggtctcagacttc

SEQ ID NO: 8576021 - DNA, 22 bp, Homo sapiens
caccaggcacatagtaggcact

SEQ ID NO: 8576022 - DNA, 22 bp, Homo sapiens
caccaggctgaaccagagggga

SEQ ID NO: 8576023 - DNA, 22 bp, Homo sapiens
cacttcagctacaatcacatga

SEQ ID NO: 8576024 - DNA, 22 bp, Homo sapiens
caacaccttgatcttggacttc

SEQ ID NO: 8576025 - DNA, 22 bp, Homo sapiens
gctgccctgtctgcagcaggac

SEQ ID NO: 8576026 - DNA, 22 bp, Homo sapiens
caagaagtcatttagcctctca

SEQ ID NO: 8576027 - DNA, 22 bp, Homo sapiens
gctggactcaggggactcaggg

SEQ ID NO: 8576028 - DNA, 22 bp, Homo sapiens
caagaatataaatactttcaaa

SEQ ID NO: 8576029 - DNA, 22 bp, Homo sapiens
gctggaaggctaggctcagttg

SEQ ID NO: 8576030 - DNA, 22 bp, Homo sapiens
caagccttggaaatccattctg

SEQ ID NO: 8576031 - DNA, 22 bp, Homo sapiens
gctggggagcaagagtagtgag

SEQ ID NO: 8576032 - DNA, 22 bp, Homo sapiens
gctggggactccccaccatagc

SEQ ID NO: 8576033 - DNA, 22 bp, Homo sapiens
gctggggagaattgggttatct

SEQ ID NO: 8576034 - DNA, 22 bp, Homo sapiens
gctggctgagttctgtcgtctg

SEQ ID NO: 8576035 - DNA, 22 bp, Homo sapiens
gctggctgaggtctagctcttt

SEQ ID NO: 8576036 - DNA, 22 bp, Homo sapiens
cacaaataccagtttcctaaca

SEQ ID NO: 8576037 - DNA, 22 bp, Homo sapiens
ggagaaggtgctggtcactgtg

SEQ ID NO: 8576038 - DNA, 22 bp, Homo sapiens
ggagaaggtgctggtcactgtg

SEQ ID NO: 8576039 - DNA, 22 bp, Homo sapiens
ggagaagggtatgtgtggcgga

SEQ ID NO: 8576040 - DNA, 22 bp, Homo sapiens
ggagaagggacagactcagctt

SEQ ID NO: 8576041 - DNA, 22 bp, Homo sapiens
ggagaagggccaattccatgta

SEQ ID NO: 8576042 - DNA, 22 bp, Homo sapiens
ggagaagggcatggtagtttta

SEQ ID NO: 8576043 - DNA, 22 bp, Homo sapiens
ggagaaggcgaagtcattcttt

SEQ ID NO: 8576044 - DNA, 22 bp, Homo sapiens
ggagaagggaactgagtttttg

SEQ ID NO: 8576045 - DNA, 22 bp, Homo sapiens
caatatataatgagtactttcc

SEQ ID NO: 8576046 - DNA, 22 bp, Homo sapiens
gaggttcagtcctgctctgtca

SEQ ID NO: 8576047 - DNA, 22 bp, Homo sapiens
gaggttcattcagctctgtcac

SEQ ID NO: 8576048 - DNA, 22 bp, Homo sapiens
atgtggctgccacctgcctgaa

SEQ ID NO: 8576049 - DNA, 22 bp, Homo sapiens
atgtggctgccacctgcctgaa

SEQ ID NO: 8576050 - DNA, 22 bp, Homo sapiens
atgtggctcagcaggctcccgt

SEQ ID NO: 8576051 - DNA, 22 bp, Homo sapiens
atgtggctagtcctctgcggca

SEQ ID NO: 8576052 - DNA, 22 bp, Homo sapiens
atgtcaccttcggtggcacggt

SEQ ID NO: 8576053 - DNA, 22 bp, Homo sapiens
atggcagacctgggctggagaa

SEQ ID NO: 8576054 - DNA, 22 bp, Homo sapiens
gagcccgagcgcgtacccggcg

SEQ ID NO: 8576055 - DNA, 22 bp, Homo sapiens
atgggcaaggggtaaggacact

SEQ ID NO: 8576056 - DNA, 22 bp, Homo sapiens
gagaaggggtgatgtgggtaat

SEQ ID NO: 8576057 - DNA, 22 bp, Homo sapiens
atggcaaaaattaacagatcaa

SEQ ID NO: 8576058 - DNA, 22 bp, Homo sapiens
gaagtagaaaactcagtttcaa

SEQ ID NO: 8576059 - DNA, 22 bp, Homo sapiens
gaagtagaaagcctcgtaaata

SEQ ID NO: 8576060 - DNA, 22 bp, Homo sapiens
gaagtagattcgttgcatcttg

SEQ ID NO: 8576061 - DNA, 22 bp, Homo sapiens
gaagtcctcctatcttgctctt

SEQ ID NO: 8576062 - DNA, 22 bp, Homo sapiens
gaagtcatgctcccatcttgct

SEQ ID NO: 8576063 - DNA, 22 bp, Homo sapiens
gaagtcatccactatgggggag

SEQ ID NO: 8576064 - DNA, 20 bp, Homo sapiens
gaagtcctgttatatccttt

SEQ ID NO: 8576065 - DNA, 20 bp, Homo sapiens
gaagtcctttcactcttccc

SEQ ID NO: 8576066 - DNA, 22 bp, Homo sapiens
atgccactgcactccagcctag

SEQ ID NO: 8576067 - DNA, 22 bp, Homo sapiens
atgccactgcactccagcctag

SEQ ID NO: 8576068 - DNA, 22 bp, Homo sapiens
atgccactgcactccagcctgg

SEQ ID NO: 8576069 - DNA, 22 bp, Homo sapiens
atgccactgcactccagcctgg

SEQ ID NO: 8576070 - DNA, 22 bp, Homo sapiens
atgccactgcacttcagcctgg

SEQ ID NO: 8576071 - DNA, 22 bp, Homo sapiens
gaatttgtcccttgatataaaa

SEQ ID NO: 8576072 - DNA, 22 bp, Homo sapiens
gaatttcctctaaacccctgag

SEQ ID NO: 8576073 - DNA, 22 bp, Homo sapiens
atgctaaattcagacagggtta

SEQ ID NO: 8576074 - DNA, 22 bp, Homo sapiens
atgctatgtaactggcagatag

SEQ ID NO: 8576075 - DNA, 22 bp, Homo sapiens
atgagctagaaaaccatgtgga

SEQ ID NO: 8576076 - DNA, 22 bp, Homo sapiens
atgagccctggaggcatttttt

SEQ ID NO: 8576077 - DNA, 22 bp, Homo sapiens
gaagaaagggaattaacttgag

SEQ ID NO: 8576078 - DNA, 22 bp, Homo sapiens
gaagctccgtactatgactttt

SEQ ID NO: 8576079 - DNA, 22 bp, Homo sapiens
gaagccttgaactgcaaacccc

SEQ ID NO: 8576080 - DNA, 22 bp, Homo sapiens
gaagccttatcagtcacttata

SEQ ID NO: 8576081 - DNA, 22 bp, Homo sapiens
gaagccttgaactgcaaacccc

SEQ ID NO: 8576082 - DNA, 22 bp, Homo sapiens
gaagctaatgagataaatgcca

SEQ ID NO: 8576083 - DNA, 22 bp, Homo sapiens
gaagctaaaccacagctaagaa

SEQ ID NO: 8576084 - DNA, 22 bp, Homo sapiens
atgagaggtttcgtcagaggaa

SEQ ID NO: 8576085 - DNA, 22 bp, Homo sapiens
ctttttcattggctttaggaca

SEQ ID NO: 8576086 - DNA, 22 bp, Homo sapiens
atgacagaaggcctccctgaca

SEQ ID NO: 8576087 - DNA, 22 bp, Homo sapiens
atgacagacagaagggattttt

SEQ ID NO: 8576088 - DNA, 22 bp, Homo sapiens
ctttgggcaaagggccaattcg

SEQ ID NO: 8576089 - DNA, 19 bp, Homo sapiens
ctttgcttgtttctgtgtc

SEQ ID NO: 8576090 - DNA, 22 bp, Homo sapiens
ctttacagataggaactactca

SEQ ID NO: 8576091 - DNA, 22 bp, Homo sapiens
ctttacagaaagagaactctgg

SEQ ID NO: 8576092 - DNA, 22 bp, Homo sapiens
cttctcctctgagtcctgggag

SEQ ID NO: 8576093 - DNA, 22 bp, Homo sapiens
cttctccctgggggctctttat

SEQ ID NO: 8576094 - DNA, 22 bp, Homo sapiens
attcttttcccaactgctttaa

SEQ ID NO: 8576095 - DNA, 22 bp, Homo sapiens
gcagggcatccctgagcgggtg

SEQ ID NO: 8576096 - DNA, 22 bp, Homo sapiens
gcagggcatagaggcacggagg

SEQ ID NO: 8576097 - DNA, 22 bp, Homo sapiens
gcagtaaataattttgtgtata

SEQ ID NO: 8576098 - DNA, 22 bp, Homo sapiens
attgcactccggcctgggtgac

SEQ ID NO: 8576099 - DNA, 22 bp, Homo sapiens
attgcactccagcctgggtgac

SEQ ID NO: 8576100 - DNA, 22 bp, Homo sapiens
attgcactccagcctgggggac

SEQ ID NO: 8576101 - DNA, 22 bp, Homo sapiens
attcacaacaaaaggatatgag

SEQ ID NO: 8576102 - DNA, 22 bp, Homo sapiens
attcacaaatgctgccccattc

SEQ ID NO: 8576103 - DNA, 22 bp, Homo sapiens
attcaataagtcactgtggaat

SEQ ID NO: 8576104 - DNA, 20 bp, Homo sapiens
attcacaaagccagtgttgc

SEQ ID NO: 8576105 - DNA, 22 bp, Homo sapiens
gatggagtctgaagctgggaac

SEQ ID NO: 8576106 - DNA, 22 bp, Homo sapiens
gatggcagtcaaccaggtgagg

SEQ ID NO: 8576107 - DNA, 22 bp, Homo sapiens
gatggcagcagcagccagggat

SEQ ID NO: 8576108 - DNA, 22 bp, Homo sapiens
attcaataaatatgctacatgg

SEQ ID NO: 8576109 - DNA, 22 bp, Homo sapiens
gcaccatgatggagcctcatta

SEQ ID NO: 8576110 - DNA, 22 bp, Homo sapiens
attataggcttgagccaccgtg

SEQ ID NO: 8576111 - DNA, 22 bp, Homo sapiens
gcccagtgctgagggtgctgct

SEQ ID NO: 8576112 - DNA, 22 bp, Homo sapiens
atttcttcaggttcttctagga

SEQ ID NO: 8576113 - DNA, 19 bp, Homo sapiens
gcccaggggcccgatgctg

SEQ ID NO: 8576114 - DNA, 22 bp, Homo sapiens
atttataacgtgcagccagggt

SEQ ID NO: 8576115 - DNA, 22 bp, Homo sapiens
atttattaagcatctgctatgt

SEQ ID NO: 8576116 - DNA, 22 bp, Homo sapiens
atttattacctcggagtttctg

SEQ ID NO: 8576117 - DNA, 22 bp, Homo sapiens
gccatcatatcccctgtgacct

SEQ ID NO: 8576118 - DNA, 22 bp, Homo sapiens
atttattatgggatttggcaca

SEQ ID NO: 8576119 - DNA, 20 bp, Homo sapiens
gccagctgcccttccaccct

SEQ ID NO: 8576120 - DNA, 21 bp, Homo sapiens
gccagctgcagggcttccttg

SEQ ID NO: 8576121 - DNA, 22 bp, Homo sapiens
caaagaagagatttacagagct

SEQ ID NO: 8576122 - DNA, 22 bp, Homo sapiens
caaagaaggaactataatccca

SEQ ID NO: 8576123 - DNA, 22 bp, Homo sapiens
caaagacacgggaaacaacgtt

SEQ ID NO: 8576124 - DNA, 22 bp, Homo sapiens
attttgcacactatgcagcttt

SEQ ID NO: 8576125 - DNA, 22 bp, Homo sapiens
attttgcacactatgcagcttt

SEQ ID NO: 8576126 - DNA, 21 bp, Homo sapiens
caaaagagactgattcttgga

SEQ ID NO: 8576127 - DNA, 19 bp, Homo sapiens
gctcagagacacctgttgc

SEQ ID NO: 8576128 - DNA, 22 bp, Homo sapiens
attttcagttgaaaaagttggt

SEQ ID NO: 8576129 - DNA, 22 bp, Homo sapiens
atttgtagtgaagtgaaaataa

SEQ ID NO: 8576130 - DNA, 22 bp, Homo sapiens
atttgtcaataagatgaacata

SEQ ID NO: 8576131 - DNA, 22 bp, Homo sapiens
ccaggagcgggaaaaggaagaa

SEQ ID NO: 8576132 - DNA, 22 bp, Homo sapiens
aggctccaaattaccaagctct

SEQ ID NO: 8576133 - DNA, 22 bp, Homo sapiens
aggctccaccctacagagctcc

SEQ ID NO: 8576134 - DNA, 22 bp, Homo sapiens
ccagggaagtagttgtgagagc

SEQ ID NO: 8576135 - DNA, 22 bp, Homo sapiens
ccagggagcctggtgtgtcagc

SEQ ID NO: 8576136 - DNA, 22 bp, Homo sapiens
ccagggaggagcatttcatggt

SEQ ID NO: 8576137 - DNA, 18 bp, Homo sapiens
ccagggagcttattagga

SEQ ID NO: 8576138 - DNA, 22 bp, Homo sapiens
ccatgggaattgggaggtccca

SEQ ID NO: 8576139 - DNA, 22 bp, Homo sapiens
ccagagaaagtgaagcaaatgt

SEQ ID NO: 8576140 - DNA, 22 bp, Homo sapiens
ccagagaaaggtttgattcatt

SEQ ID NO: 8576141 - DNA, 22 bp, Homo sapiens
aggcaggggagctggaagggta

SEQ ID NO: 8576142 - DNA, 17 bp, Homo sapiens
aggcaggtaagagttat

SEQ ID NO: 8576143 - DNA, 17 bp, Homo sapiens
aggcaggtaagagttat

SEQ ID NO: 8576144 - DNA, 19 bp, Homo sapiens
ccagcagacacagctgccc

SEQ ID NO: 8576145 - DNA, 22 bp, Homo sapiens
ccagagcagaaccggaacacca

SEQ ID NO: 8576146 - DNA, 22 bp, Homo sapiens
aggcatggacatttcggcagct

SEQ ID NO: 8576147 - DNA, 22 bp, Homo sapiens
aggcatggatgtagcagtgacc

SEQ ID NO: 8576148 - DNA, 22 bp, Homo sapiens
aggcatggatggatccagggct

SEQ ID NO: 8576149 - DNA, 19 bp, Homo sapiens
ccagcctctcttccacccc

SEQ ID NO: 8576150 - DNA, 22 bp, Homo sapiens
ccagcctgaaatgcctcatcct

SEQ ID NO: 8576151 - DNA, 22 bp, Homo sapiens
aggcccagagagccagttagtg

SEQ ID NO: 8576152 - DNA, 22 bp, Homo sapiens
ccaggagcgcgtgaacaggctg

SEQ ID NO: 8576153 - DNA, 22 bp, Homo sapiens
ccagcttttcttatcattataa

SEQ ID NO: 8576154 - DNA, 22 bp, Homo sapiens
agggctcttcctttgcctctca

SEQ ID NO: 8576155 - DNA, 22 bp, Homo sapiens
ccctttctccagaactgtctga

SEQ ID NO: 8576156 - DNA, 22 bp, Homo sapiens
ccctggaggcaaaggttgcagt

SEQ ID NO: 8576157 - DNA, 22 bp, Homo sapiens
ccctggaggcggatgttgcagt

SEQ ID NO: 8576158 - DNA, 22 bp, Homo sapiens
agggccagagtctgtgtagata

SEQ ID NO: 8576159 - DNA, 22 bp, Homo sapiens
agggccagagtctgtgtagata

SEQ ID NO: 8576160 - DNA, 22 bp, Homo sapiens
agggccagaatccctcagtcta

SEQ ID NO: 8576161 - DNA, 22 bp, Homo sapiens
cctgaggacacacgctgcagga

SEQ ID NO: 8576162 - DNA, 22 bp, Homo sapiens
cctgaggacagtgtgaccatgg

SEQ ID NO: 8576163 - DNA, 22 bp, Homo sapiens
cctgagctttaaaagccatgta

SEQ ID NO: 8576164 - DNA, 22 bp, Homo sapiens
cctgaggcaaggacttggtggc

SEQ ID NO: 8576165 - DNA, 19 bp, Homo sapiens
cctctgccagcccgcctct

SEQ ID NO: 8576166 - DNA, 22 bp, Homo sapiens
agggctgagtggtgcagtcaaa

SEQ ID NO: 8576167 - DNA, 22 bp, Homo sapiens
cctcctgcacttgctttccttc

SEQ ID NO: 8576168 - DNA, 22 bp, Homo sapiens
agggatcacggtggacttggat

SEQ ID NO: 8576169 - DNA, 22 bp, Homo sapiens
agggatgactcttggctgattc

SEQ ID NO: 8576170 - DNA, 22 bp, Homo sapiens
agggatcagcagagggtgtggt

SEQ ID NO: 8576171 - DNA, 22 bp, Homo sapiens
ccctggaggagcttagagcttg

SEQ ID NO: 8576172 - DNA, 22 bp, Homo sapiens
agggaaatggagagtgtagttt

SEQ ID NO: 8576173 - DNA, 22 bp, Homo sapiens
cattaaaatatctcatggtgtt

SEQ ID NO: 8576174 - DNA, 22 bp, Homo sapiens
catttgttctgatttcaaaagg

SEQ ID NO: 8576175 - DNA, 22 bp, Homo sapiens
ccaagtagttgagactacaggt

SEQ ID NO: 8576176 - DNA, 22 bp, Homo sapiens
ccaaggtcttggacagctaatg

SEQ ID NO: 8576177 - DNA, 22 bp, Homo sapiens
aggagggcaggctggctgccta

SEQ ID NO: 8576178 - DNA, 22 bp, Homo sapiens
aggagggctaggaaaaccagga

SEQ ID NO: 8576179 - DNA, 21 bp, Homo sapiens
aggagggcacaaggccaggaa

SEQ ID NO: 8576180 - DNA, 22 bp, Homo sapiens
catgtccatttatgcacagaaa

SEQ ID NO: 8576181 - DNA, 17 bp, Homo sapiens
cagtggtctgaggtatg

SEQ ID NO: 8576182 - DNA, 22 bp, Homo sapiens
cagtggtccctgaggttgctgg

SEQ ID NO: 8576183 - DNA, 23 bp, Homo sapiens
cagtggtcagaacgtgggagggt

SEQ ID NO: 8576184 - DNA, 22 bp, Homo sapiens
cagtggcgtgatctctgctcac

SEQ ID NO: 8576185 - DNA, 22 bp, Homo sapiens
cagtgggtgccatcgtgccctt

SEQ ID NO: 8576186 - DNA, 22 bp, Homo sapiens
catattctgttggtcacataga

SEQ ID NO: 8576187 - DNA, 22 bp, Homo sapiens
aggagaagtaaggctagatgat

SEQ ID NO: 8576188 - DNA, 20 bp, Homo sapiens
cagtgcccgtggaaaagatg

SEQ ID NO: 8576189 - DNA, 22 bp, Homo sapiens
aggaccagaggccagagtcagc

SEQ ID NO: 8576190 - DNA, 22 bp, Homo sapiens
aggaccaggtctaatgaagaca

SEQ ID NO: 8576191 - DNA, 22 bp, Homo sapiens
caggctccactgtaggcagctc

SEQ ID NO: 8576192 - DNA, 22 bp, Homo sapiens
caggctcactgtaaggtcagct

SEQ ID NO: 8576193 - DNA, 22 bp, Homo sapiens
caggctcactttctcagtcaca

SEQ ID NO: 8576194 - DNA, 22 bp, Homo sapiens
cagggatggcgctggctgcccg

SEQ ID NO: 8576195 - DNA, 22 bp, Homo sapiens
cagggatgggatggagtcagtt

SEQ ID NO: 8576196 - DNA, 22 bp, Homo sapiens
caggctggagtgcagtggtgcc

SEQ ID NO: 8576197 - DNA, 22 bp, Homo sapiens
caggctggagtgcagtgtcgcc

SEQ ID NO: 8576198 - DNA, 22 bp, Homo sapiens
caggctggacattagatacata

SEQ ID NO: 8576199 - DNA, 22 bp, Homo sapiens
caggctggagtgcagttgtgca

SEQ ID NO: 8576200 - DNA, 22 bp, Homo sapiens
caggctggagttacctttaggg

SEQ ID NO: 8576201 - DNA, 22 bp, Homo sapiens
caggggcggtggctcacgcctg

SEQ ID NO: 8576202 - DNA, 22 bp, Homo sapiens
cagggatgtctctggaagggag

SEQ ID NO: 8576203 - DNA, 22 bp, Homo sapiens
cagggtgacaagtggcaaggag

SEQ ID NO: 8576204 - DNA, 22 bp, Homo sapiens
cagggtgactgccctggccact

SEQ ID NO: 8576205 - DNA, 22 bp, Homo sapiens
cagggtgcctctgctcccacca

SEQ ID NO: 8576206 - DNA, 22 bp, Homo sapiens
cagggtgcctcccgctcgccgg

SEQ ID NO: 8576207 - DNA, 22 bp, Homo sapiens
caggtcctttagtgtccagaac

SEQ ID NO: 8576208 - DNA, 22 bp, Homo sapiens
caggtcgccagcaggaacgtca

SEQ ID NO: 8576209 - DNA, 18 bp, Homo sapiens
agctggccctggctgccg

SEQ ID NO: 8576210 - DNA, 22 bp, Homo sapiens
agctggccattgtgagtggcct

SEQ ID NO: 8576211 - DNA, 22 bp, Homo sapiens
caggccagcgtccagaacaagc

SEQ ID NO: 8576212 - DNA, 22 bp, Homo sapiens
caggccagcagggcctccgtgg

SEQ ID NO: 8576213 - DNA, 22 bp, Homo sapiens
caggcactgcactaccactttt

SEQ ID NO: 8576214 - DNA, 22 bp, Homo sapiens
agctgctgagccatgtcctgct

SEQ ID NO: 8576215 - DNA, 22 bp, Homo sapiens
cagctctgtaaattccttcatc

SEQ ID NO: 8576216 - DNA, 22 bp, Homo sapiens
agctgattccactttttcccca

SEQ ID NO: 8576217 - DNA, 22 bp, Homo sapiens
aggtattattagcatctctatt

SEQ ID NO: 8576218 - DNA, 22 bp, Homo sapiens
aggtcctgtccttggtctctga

SEQ ID NO: 8576219 - DNA, 22 bp, Homo sapiens
aggtcctgtctatcaccctcgc

SEQ ID NO: 8576220 - DNA, 22 bp, Homo sapiens
cctgggcagggagaccaggctc

SEQ ID NO: 8576221 - DNA, 22 bp, Homo sapiens
aggtggagtgtgcagggagagc

SEQ ID NO: 8576222 - DNA, 23 bp, Homo sapiens
aggtggagctgtgcagccggggc

SEQ ID NO: 8576223 - DNA, 22 bp, Homo sapiens
cctgggttattttggtctagtg

SEQ ID NO: 8576224 - DNA, 22 bp, Homo sapiens
cctgggttagtatctgtttcca

SEQ ID NO: 8576225 - DNA, 23 bp, Homo sapiens
cctgggtttcagagctgcttttc

SEQ ID NO: 8576226 - DNA, 22 bp, Homo sapiens
cctgggttggagagcaatggtg

SEQ ID NO: 8576227 - DNA, 22 bp, Homo sapiens
cctggccttaagggcagggagc

SEQ ID NO: 8576228 - DNA, 22 bp, Homo sapiens
cctggccttaagggcagggagc

SEQ ID NO: 8576229 - DNA, 22 bp, Homo sapiens
agtaatcaatttttcggtggat

SEQ ID NO: 8576230 - DNA, 22 bp, Homo sapiens
aggttcaggctgcacacctgag

SEQ ID NO: 8576231 - DNA, 22 bp, Homo sapiens
aggttcaggcacttgcccaaca

SEQ ID NO: 8576232 - DNA, 23 bp, Homo sapiens
aggttcaggagatggaggaacaa

SEQ ID NO: 8576233 - DNA, 23 bp, Homo sapiens
aggttcaggagatggaggaacaa

SEQ ID NO: 8576234 - DNA, 22 bp, Homo sapiens
aggttcagtctttggacccctc

SEQ ID NO: 8576235 - DNA, 22 bp, Homo sapiens
aggttcagtgcctggaacaggg

SEQ ID NO: 8576236 - DNA, 17 bp, Homo sapiens
aggttcaggttacattc

SEQ ID NO: 8576237 - DNA, 22 bp, Homo sapiens
aggttcagtaaatgttagttga

SEQ ID NO: 8576238 - DNA, 22 bp, Homo sapiens
aggttcagagttgttgatgttt

SEQ ID NO: 8576239 - DNA, 22 bp, Homo sapiens
aggttcagacgcataataggca

SEQ ID NO: 8576240 - DNA, 22 bp, Homo sapiens
aggttcagacgcataataggca

SEQ ID NO: 8576241 - DNA, 23 bp, Homo sapiens
aggttcagctttcttactctggg

SEQ ID NO: 8576242 - DNA, 22 bp, Homo sapiens
aggttcagatgacttttatgct

SEQ ID NO: 8576243 - DNA, 19 bp, Homo sapiens
cgcctggcaggccctgcgc

SEQ ID NO: 8576244 - DNA, 22 bp, Homo sapiens
cggtcaggtgcagcgttggcac

SEQ ID NO: 8576245 - DNA, 22 bp, Homo sapiens
agtgggagagaagcaagtagta

SEQ ID NO: 8576246 - DNA, 22 bp, Homo sapiens
agtggggaagagcatgggccct

SEQ ID NO: 8576247 - DNA, 22 bp, Homo sapiens
agtgcaggccccaggccaggcc

SEQ ID NO: 8576248 - DNA, 22 bp, Homo sapiens
agtgcaggccccaggccaggcc

SEQ ID NO: 8576249 - DNA, 18 bp, Homo sapiens
ctctctgggtgaggacaa

SEQ ID NO: 8576250 - DNA, 22 bp, Homo sapiens
ctctctggtacatagagtttgg

SEQ ID NO: 8576251 - DNA, 22 bp, Homo sapiens
ctctgtttggcgctgctccttc

SEQ ID NO: 8576252 - DNA, 22 bp, Homo sapiens
ctcttaaaaacttgatatattt

SEQ ID NO: 8576253 - DNA, 20 bp, Homo sapiens
ctcttaaatgtaaagtaggc

SEQ ID NO: 8576254 - DNA, 20 bp, Homo sapiens
ctcttaaatgtaaagtaggc

SEQ ID NO: 8576255 - DNA, 22 bp, Homo sapiens
agtgtctgaacctgcagtggga

SEQ ID NO: 8576256 - DNA, 21 bp, Homo sapiens
agtgtgttcttggcattacct

SEQ ID NO: 8576257 - DNA, 19 bp, Homo sapiens
agtgttaacccagtgttgg

SEQ ID NO: 8576258 - DNA, 22 bp, Homo sapiens
ctccagttggccccagttggtt

SEQ ID NO: 8576259 - DNA, 20 bp, Homo sapiens
ctccagtgttcaggggagtg

SEQ ID NO: 8576260 - DNA, 22 bp, Homo sapiens
ctccagtgggggtgagcctaga

SEQ ID NO: 8576261 - DNA, 22 bp, Homo sapiens
agtgcaggagcctggccagagc

SEQ ID NO: 8576262 - DNA, 22 bp, Homo sapiens
agtcatccaagagcctgggcag

SEQ ID NO: 8576263 - DNA, 22 bp, Homo sapiens
agtcattacggactagtactac

SEQ ID NO: 8576264 - DNA, 22 bp, Homo sapiens
agtcattacagcaggcagaagg

SEQ ID NO: 8576265 - DNA, 22 bp, Homo sapiens
agtcattaattagtaggaaggt

SEQ ID NO: 8576266 - DNA, 22 bp, Homo sapiens
agtcattaagacaactggagta

SEQ ID NO: 8576267 - DNA, 23 bp, Homo sapiens
agtcattaagaagttcaggaact

SEQ ID NO: 8576268 - DNA, 22 bp, Homo sapiens
agtctgtggatggactggcaga

SEQ ID NO: 8576269 - DNA, 19 bp, Homo sapiens
agtctgtggatttgtgggt

SEQ ID NO: 8576270 - DNA, 22 bp, Homo sapiens
cttcagagaacttgatcgctgc

SEQ ID NO: 8576271 - DNA, 22 bp, Homo sapiens
cttcacaattctaacagggcaa

SEQ ID NO: 8576272 - DNA, 22 bp, Homo sapiens
cttcatgttctgcctgtggaag

SEQ ID NO: 8576273 - DNA, 22 bp, Homo sapiens
ctgtgccttggcgctgtgccac

SEQ ID NO: 8576274 - DNA, 22 bp, Homo sapiens
ctgtgcctgccttgttcactga

SEQ ID NO: 8576275 - DNA, 22 bp, Homo sapiens
ctgtgcctccagtctcgcttct

SEQ ID NO: 8576276 - DNA, 22 bp, Homo sapiens
atagtatttccagaaatagtct

SEQ ID NO: 8576277 - DNA, 22 bp, Homo sapiens
ctgggccatctctctgcaagtg

SEQ ID NO: 8576278 - DNA, 22 bp, Homo sapiens
ctgggccatgggccagcgaggc

SEQ ID NO: 8576279 - DNA, 20 bp, Homo sapiens
ctgggccatccttttacaat

SEQ ID NO: 8576280 - DNA, 22 bp, Homo sapiens
ctgggccagtctcggccgctct

SEQ ID NO: 8576281 - DNA, 22 bp, Homo sapiens
ctgggctgtcaatggccctctg

SEQ ID NO: 8576282 - DNA, 23 bp, Homo sapiens
ctgggctgtcctgaggtcacctc

SEQ ID NO: 8576283 - DNA, 22 bp, Homo sapiens
ctggggatcctttttgcatcta

SEQ ID NO: 8576284 - DNA, 22 bp, Homo sapiens
atatttgttagagtctatgtgt

SEQ ID NO: 8576285 - DNA, 22 bp, Homo sapiens
ctgtatctgtgttggatgagtt

SEQ ID NO: 8576286 - DNA, 22 bp, Homo sapiens
ataagcctgattcacttgtcat

SEQ ID NO: 8576287 - DNA, 23 bp, Homo sapiens
ataagccttttctttctgcccca

SEQ ID NO: 8576288 - DNA, 22 bp, Homo sapiens
ctgccctgtttggacagcccgg

SEQ ID NO: 8576289 - DNA, 22 bp, Homo sapiens
ctgccctgtggttgtgggttct

SEQ ID NO: 8576290 - DNA, 22 bp, Homo sapiens
ctgccctgtctgcagcctggct

SEQ ID NO: 8576291 - DNA, 22 bp, Homo sapiens
ctgccctgtatcttctcccaat

SEQ ID NO: 8576292 - DNA, 22 bp, Homo sapiens
ctgccctgtccttcccgccggc

SEQ ID NO: 8576293 - DNA, 22 bp, Homo sapiens
ctgccctgtgcacaggaaactg

SEQ ID NO: 8576294 - DNA, 22 bp, Homo sapiens
ctgccctgtggctctgagtcat

SEQ ID NO: 8576295 - DNA, 22 bp, Homo sapiens
ctgccctgtgagggtccttggg

SEQ ID NO: 8576296 - DNA, 22 bp, Homo sapiens
ctgccctgtctttttctgatga

SEQ ID NO: 8576297 - DNA, 22 bp, Homo sapiens
agttttctgttctacaatttga

SEQ ID NO: 8576298 - DNA, 21 bp, Homo sapiens
agttttctgagttataaaata

SEQ ID NO: 8576299 - DNA, 22 bp, Homo sapiens
agttttctcacatcaaaaatga

SEQ ID NO: 8576300 - DNA, 22 bp, Homo sapiens
ctgccctgtagctgttctagca

SEQ ID NO: 8576301 - DNA, 22 bp, Homo sapiens
ctgccctggtcccatggctgat

SEQ ID NO: 8576302 - DNA, 22 bp, Homo sapiens
ctgccctgacctgcctcagagt

SEQ ID NO: 8576303 - DNA, 22 bp, Homo sapiens
ctgccctgactgaccttttgaa

SEQ ID NO: 8576304 - DNA, 18 bp, Homo sapiens
ctgccccttctctgagat

SEQ ID NO: 8576305 - DNA, 22 bp, Homo sapiens
ctgccctcccagttggtccgtg

SEQ ID NO: 8576306 - DNA, 22 bp, Homo sapiens
agtttcaattcttttcacaaag

SEQ ID NO: 8576307 - DNA, 22 bp, Homo sapiens
agtgttcatttattcattcact

SEQ ID NO: 8576308 - DNA, 22 bp, Homo sapiens
agtgttcagtgattgtcaaccg

SEQ ID NO: 8576309 - DNA, 22 bp, Homo sapiens
agtgttcactctgtggagccca

SEQ ID NO: 8576310 - DNA, 22 bp, Homo sapiens
agtttcatattaccatgtcacc

SEQ ID NO: 8576311 - DNA, 22 bp, Homo sapiens
agtttcagttctgtcatttata

SEQ ID NO: 8576312 - DNA, 22 bp, Homo sapiens
agtttctctcagtatagaatag

SEQ ID NO: 8576313 - DNA, 22 bp, Homo sapiens
agtttctttagatagaaagttc

SEQ ID NO: 8576314 - DNA, 22 bp, Homo sapiens
agtttcttgaagactgatgttt

SEQ ID NO: 8576315 - DNA, 22 bp, Homo sapiens
atagaaaacagatgtccttaaa

SEQ ID NO: 8576316 - DNA, 22 bp, Homo sapiens
ataggtccaaggagaggtcttt

SEQ ID NO: 8576317 - DNA, 22 bp, Homo sapiens
ataggccaatactgtagagttt

SEQ ID NO: 8576318 - DNA, 22 bp, Homo sapiens
atagggcctaaaaagtattgct

SEQ ID NO: 8576319 - DNA, 22 bp, Homo sapiens
ataatgtttcagtactgtctgt

SEQ ID NO: 8576320 - DNA, 22 bp, Homo sapiens
atacagaactctcagttgtata

SEQ ID NO: 8576321 - DNA, 22 bp, Homo sapiens
aggctttaagtggcctacagct

SEQ ID NO: 8576322 - DNA, 22 bp, Homo sapiens
aggctttaattatctacaggag

SEQ ID NO: 8576323 - DNA, 22 bp, Homo sapiens
agggagaggagggtcttgttga

SEQ ID NO: 8576324 - DNA, 18 bp, Homo sapiens
agggagagaccgcgggtc

SEQ ID NO: 8576325 - DNA, 22 bp, Homo sapiens
agggagagacatttccttcttg

SEQ ID NO: 8576326 - DNA, 22 bp, Homo sapiens
acatttcttttcatctctatat

SEQ ID NO: 8576327 - DNA, 22 bp, Homo sapiens
acatttctttgctagacagcag

SEQ ID NO: 8576328 - DNA, 22 bp, Homo sapiens
acatttctcttgatgtctctat

SEQ ID NO: 8576329 - DNA, 22 bp, Homo sapiens
acatttctaatttaatgtaaca

SEQ ID NO: 8576330 - DNA, 22 bp, Homo sapiens
acatgtttgataaatatttggg

SEQ ID NO: 8576331 - DNA, 22 bp, Homo sapiens
aggcctctgggtctcctctgac

SEQ ID NO: 8576332 - DNA, 18 bp, Homo sapiens
aggcctctgtgtgcccag

SEQ ID NO: 8576333 - DNA, 22 bp, Homo sapiens
aggccaggcctttctccattcc

SEQ ID NO: 8576334 - DNA, 22 bp, Homo sapiens
aggccagggcactgctctttag

SEQ ID NO: 8576335 - DNA, 22 bp, Homo sapiens
acatgctacacagagctcctcg

SEQ ID NO: 8576336 - DNA, 22 bp, Homo sapiens
acatcatgagagacttaaattg

SEQ ID NO: 8576337 - DNA, 23 bp, Homo sapiens
acatcatgatagccaacttggga

SEQ ID NO: 8576338 - DNA, 19 bp, Homo sapiens
acaggggctagcggaagca

SEQ ID NO: 8576339 - DNA, 22 bp, Homo sapiens
agctgaagctcagcccagtagt

SEQ ID NO: 8576340 - DNA, 22 bp, Homo sapiens
acatagagttcaattttcagtc

SEQ ID NO: 8576341 - DNA, 22 bp, Homo sapiens
acagtgttacttgatagtgtat

SEQ ID NO: 8576342 - DNA, 22 bp, Homo sapiens
aggatgagccgcgcaagctgac

SEQ ID NO: 8576343 - DNA, 21 bp, Homo sapiens
acagttcatgataactccatc

SEQ ID NO: 8576344 - DNA, 19 bp, Homo sapiens
acagtcagggaataaagac

SEQ ID NO: 8576345 - DNA, 22 bp, Homo sapiens
aggagattgtactgtcatcact

SEQ ID NO: 8576346 - DNA, 22 bp, Homo sapiens
agaaagggtcactgaaagagga

SEQ ID NO: 8576347 - DNA, 22 bp, Homo sapiens
agaacagaggccttatgtttca

SEQ ID NO: 8576348 - DNA, 18 bp, Homo sapiens
atcctgggagcagacagc

SEQ ID NO: 8576349 - DNA, 22 bp, Homo sapiens
agaaaataaattgatggtggaa

SEQ ID NO: 8576350 - DNA, 22 bp, Homo sapiens
ataatgcagcttttcaatggcc

SEQ ID NO: 8576351 - DNA, 22 bp, Homo sapiens
ataatgagcttttgaatactga

SEQ ID NO: 8576352 - DNA, 22 bp, Homo sapiens
ataatgagaatacagtaactat

SEQ ID NO: 8576353 - DNA, 22 bp, Homo sapiens
atacagcagtttgtgatcctag

SEQ ID NO: 8576354 - DNA, 22 bp, Homo sapiens
atacagggacatccagtttttc

SEQ ID NO: 8576355 - DNA, 22 bp, Homo sapiens
ataatgcatttagaataattca

SEQ ID NO: 8576356 - DNA, 22 bp, Homo sapiens
acttcttcttcagctgggggat

SEQ ID NO: 8576357 - DNA, 22 bp, Homo sapiens
atacatgttgagaaaatatctg

SEQ ID NO: 8576358 - DNA, 22 bp, Homo sapiens
agtcttggtccaggctcatttc

SEQ ID NO: 8576359 - DNA, 22 bp, Homo sapiens
agtcttgaaagcacattagagt

SEQ ID NO: 8576360 - DNA, 22 bp, Homo sapiens
agtctgtctaatattattcagg

SEQ ID NO: 8576361 - DNA, 22 bp, Homo sapiens
actcctggtttgtgtcctggct

SEQ ID NO: 8576362 - DNA, 22 bp, Homo sapiens
actcctgggttgcagtcctcaa

SEQ ID NO: 8576363 - DNA, 18 bp, Homo sapiens
agtcccatcttcagctct

SEQ ID NO: 8576364 - DNA, 22 bp, Homo sapiens
agtcccaggcagccgagccggt

SEQ ID NO: 8576365 - DNA, 22 bp, Homo sapiens
agtcccagtgagatgagccacg

SEQ ID NO: 8576366 - DNA, 22 bp, Homo sapiens
actgaggacagtgaggagggct

SEQ ID NO: 8576367 - DNA, 22 bp, Homo sapiens
actgaggatggataggtcatat

SEQ ID NO: 8576368 - DNA, 22 bp, Homo sapiens
actctgtgaagatgcaggcttg

SEQ ID NO: 8576369 - DNA, 22 bp, Homo sapiens
actctgtgttttggtggcagca

SEQ ID NO: 8576370 - DNA, 22 bp, Homo sapiens
agtgtttaatgccttttccagc

SEQ ID NO: 8576371 - DNA, 22 bp, Homo sapiens
agtgttcttcttcaaagctctg

SEQ ID NO: 8576372 - DNA, 22 bp, Homo sapiens
agtggcagtagatgagctggtt

SEQ ID NO: 8576373 - DNA, 22 bp, Homo sapiens
agtggcagagccagggttggga

SEQ ID NO: 8576374 - DNA, 22 bp, Homo sapiens
aggtctcaagagaaaagtggtg

SEQ ID NO: 8576375 - DNA, 22 bp, Homo sapiens
aggtctcaagttgagaaggcag

SEQ ID NO: 8576376 - DNA, 22 bp, Homo sapiens
aggtctaggagtctgaaagtat

SEQ ID NO: 8576377 - DNA, 22 bp, Homo sapiens
aggtctagatttatagacagca

SEQ ID NO: 8576378 - DNA, 22 bp, Homo sapiens
aggtccagttttcagttctcat

SEQ ID NO: 8576379 - DNA, 20 bp, Homo sapiens
aggtcctgttccttgtctcc

SEQ ID NO: 8576380 - DNA, 20 bp, Homo sapiens
aggtctcagagcaagagccc

SEQ ID NO: 8576381 - DNA, 22 bp, Homo sapiens
aggtctcactttgtggaagtga

SEQ ID NO: 8576382 - DNA, 22 bp, Homo sapiens
acctgcaggggtgctctctggg

SEQ ID NO: 8576383 - DNA, 22 bp, Homo sapiens
acctgcaggtgtttccacactt

SEQ ID NO: 8576384 - DNA, 19 bp, Homo sapiens
acctgcagtaataattcct

SEQ ID NO: 8576385 - DNA, 22 bp, Homo sapiens
acctgcagtggccactcctaat

SEQ ID NO: 8576386 - DNA, 22 bp, Homo sapiens
acctgcagctaaagatgtaggg

SEQ ID NO: 8576387 - DNA, 22 bp, Homo sapiens
acctgcagccacttctctcctt

SEQ ID NO: 8576388 - DNA, 22 bp, Homo sapiens
acctgcagctgagaaaatgact

SEQ ID NO: 8576389 - DNA, 22 bp, Homo sapiens
acctgcaggcacaggtgtgcgc

SEQ ID NO: 8576390 - DNA, 20 bp, Homo sapiens
acctgccacagagaaaggta

SEQ ID NO: 8576391 - DNA, 22 bp, Homo sapiens
acctgccaagcatcagtggcag

SEQ ID NO: 8576392 - DNA, 22 bp, Homo sapiens
acctgccagaatccaagccaca

SEQ ID NO: 8576393 - DNA, 21 bp, Homo sapiens
acctgccacattgcagacttg

SEQ ID NO: 8576394 - DNA, 22 bp, Homo sapiens
aggtccagttgccagaatggcc

SEQ ID NO: 8576395 - DNA, 22 bp, Homo sapiens
acctgccagaatgctagtcctg

SEQ ID NO: 8576396 - DNA, 19 bp, Homo sapiens
acctgccatgacagcctga

SEQ ID NO: 8576397 - DNA, 22 bp, Homo sapiens
acctgccagtgaatactatctt

SEQ ID NO: 8576398 - DNA, 22 bp, Homo sapiens
acctgccagctgagaagggtgt

SEQ ID NO: 8576399 - DNA, 22 bp, Homo sapiens
acctgagggcccaaacttggta

SEQ ID NO: 8576400 - DNA, 20 bp, Homo sapiens
acctgaggtccctatggtct

SEQ ID NO: 8576401 - DNA, 22 bp, Homo sapiens
acctgaggcctccccagcagac

SEQ ID NO: 8576402 - DNA, 22 bp, Homo sapiens
acctgaggctgttagtctaggt

SEQ ID NO: 8576403 - DNA, 22 bp, Homo sapiens
acctgagggagattaggcctga

SEQ ID NO: 8576404 - DNA, 22 bp, Homo sapiens
acctgaggactggatggtagaa

SEQ ID NO: 8576405 - DNA, 22 bp, Homo sapiens
acctgaggaagggcgagaagct

SEQ ID NO: 8576406 - DNA, 22 bp, Homo sapiens
actaggaattcaagtagacaga

SEQ ID NO: 8576407 - DNA, 22 bp, Homo sapiens
actaggaattcaagtagacaga

SEQ ID NO: 8576408 - DNA, 22 bp, Homo sapiens
actaggaaggcatatgggcaga

SEQ ID NO: 8576409 - DNA, 22 bp, Homo sapiens
actcaggaaatgaagactggtt

SEQ ID NO: 8576410 - DNA, 22 bp, Homo sapiens
actcaggaaatgagaggctctc

SEQ ID NO: 8576411 - DNA, 22 bp, Homo sapiens
actcaggaatggggctgggact

SEQ ID NO: 8576412 - DNA, 22 bp, Homo sapiens
agcctctgctggccctggcact

SEQ ID NO: 8576413 - DNA, 20 bp, Homo sapiens
agcctctgcccttcccactg

SEQ ID NO: 8576414 - DNA, 22 bp, Homo sapiens
agcctctgtcaagcttttcaaa

SEQ ID NO: 8576415 - DNA, 22 bp, Homo sapiens
agcctctgtcaagcttttcaaa

SEQ ID NO: 8576416 - DNA, 22 bp, Homo sapiens
cagaggtccctgttcttaagga

SEQ ID NO: 8576417 - DNA, 22 bp, Homo sapiens
cagctcaggaaggaaggccggc

SEQ ID NO: 8576418 - DNA, 22 bp, Homo sapiens
agctcagccctcctgtgcagct

SEQ ID NO: 8576419 - DNA, 18 bp, Homo sapiens
agctcctgaactctgtgg

SEQ ID NO: 8576420 - DNA, 22 bp, Homo sapiens
cagctcagtctggagagatgca

SEQ ID NO: 8576421 - DNA, 19 bp, Homo sapiens
cagctcagtttgattctct

SEQ ID NO: 8576422 - DNA, 22 bp, Homo sapiens
agctcctgagtagctttactca

SEQ ID NO: 8576423 - DNA, 22 bp, Homo sapiens
cagccctgcacgctgcctccgc

SEQ ID NO: 8576424 - DNA, 19 bp, Homo sapiens
agccagaactagtgtttct

SEQ ID NO: 8576425 - DNA, 22 bp, Homo sapiens
agccagaaaggggcattatctg

SEQ ID NO: 8576426 - DNA, 22 bp, Homo sapiens
cagaatatgacaagattttcct

SEQ ID NO: 8576427 - DNA, 21 bp, Homo sapiens
cagaatccagtctcttattac

SEQ ID NO: 8576428 - DNA, 22 bp, Homo sapiens
cagaaatatcagttgaaagtgc

SEQ ID NO: 8576429 - DNA, 19 bp, Homo sapiens
cagaaatagcgaagtgtaa

SEQ ID NO: 8576430 - DNA, 19 bp, Homo sapiens
cagaaatagcgaagtgtaa

SEQ ID NO: 8576431 - DNA, 22 bp, Homo sapiens
cagaaatattccaagtactgca

SEQ ID NO: 8576432 - DNA, 22 bp, Homo sapiens
cagaaatatttattgagtgaca

SEQ ID NO: 8576433 - DNA, 22 bp, Homo sapiens
cagagaaagggtgaattccttc

SEQ ID NO: 8576434 - DNA, 22 bp, Homo sapiens
cagagaaagaagcccattcatt

SEQ ID NO: 8576435 - DNA, 22 bp, Homo sapiens
cagagaaaaaatcctgctctca

SEQ ID NO: 8576436 - DNA, 22 bp, Homo sapiens
cagagaaactcagatagctgat

SEQ ID NO: 8576437 - DNA, 21 bp, Homo sapiens
cagaggcaggtcctgggacgg

SEQ ID NO: 8576438 - DNA, 20 bp, Homo sapiens
cagaggcattttcagactct

SEQ ID NO: 8576439 - DNA, 22 bp, Homo sapiens
cagaggcattactgaaaaggtg

SEQ ID NO: 8576440 - DNA, 22 bp, Homo sapiens
caacttgttcttggtagatcta

SEQ ID NO: 8576441 - DNA, 22 bp, Homo sapiens
caaatattccaggtacatccct

SEQ ID NO: 8576442 - DNA, 22 bp, Homo sapiens
caaattaccctcaacatctaga

SEQ ID NO: 8576443 - DNA, 22 bp, Homo sapiens
caaatagattgttcaatcctga

SEQ ID NO: 8576444 - DNA, 22 bp, Homo sapiens
caaatagattgttcaatcctga

SEQ ID NO: 8576445 - DNA, 22 bp, Homo sapiens
caaatagacttcaatctcttga

SEQ ID NO: 8576446 - DNA, 22 bp, Homo sapiens
agcacatgcacagtgctacact

SEQ ID NO: 8576447 - DNA, 22 bp, Homo sapiens
caagcagacagtaggcctagaa

SEQ ID NO: 8576448 - DNA, 22 bp, Homo sapiens
agcagccaaccttacattcatc

SEQ ID NO: 8576449 - DNA, 22 bp, Homo sapiens
cacacaaatattctggaggcaa

SEQ ID NO: 8576450 - DNA, 17 bp, Homo sapiens
agcaggcacgtcagcac

SEQ ID NO: 8576451 - DNA, 22 bp, Homo sapiens
agcaggagtttgatgcttttat

SEQ ID NO: 8576452 - DNA, 22 bp, Homo sapiens
cacagtgttccagagcagtggt

SEQ ID NO: 8576453 - DNA, 22 bp, Homo sapiens
cacagtgtttgatttaggggcc

SEQ ID NO: 8576454 - DNA, 22 bp, Homo sapiens
agcaggcaggaaggcagcactg

SEQ ID NO: 8576455 - DNA, 22 bp, Homo sapiens
agcagggggcatccttgccctt

SEQ ID NO: 8576456 - DNA, 22 bp, Homo sapiens
caaaaggcaggggaaagagtgc

SEQ ID NO: 8576457 - DNA, 22 bp, Homo sapiens
atttgttgctagcagcactgat

SEQ ID NO: 8576458 - DNA, 22 bp, Homo sapiens
atttgttgttgctcccctaaga

SEQ ID NO: 8576459 - DNA, 22 bp, Homo sapiens
atttgttgaataaattagtatt

SEQ ID NO: 8576460 - DNA, 22 bp, Homo sapiens
atttctcatgtacaaaaacact

SEQ ID NO: 8576461 - DNA, 22 bp, Homo sapiens
atttgctttcccttccctgaca

SEQ ID NO: 8576462 - DNA, 22 bp, Homo sapiens
atttcacaaagaacagatgcag

SEQ ID NO: 8576463 - DNA, 22 bp, Homo sapiens
agaggtcttttggtctgcagaa

SEQ ID NO: 8576464 - DNA, 22 bp, Homo sapiens
attcatttgctattgtgtatgg

SEQ ID NO: 8576465 - DNA, 22 bp, Homo sapiens
agaggcagccgtatttcaaagg

SEQ ID NO: 8576466 - DNA, 22 bp, Homo sapiens
agaggcaggaagagctgatttt

SEQ ID NO: 8576467 - DNA, 22 bp, Homo sapiens
agaggcaggaggttgacttgag

SEQ ID NO: 8576468 - DNA, 22 bp, Homo sapiens
agaggcagcagtcatactacag

SEQ ID NO: 8576469 - DNA, 17 bp, Homo sapiens
agaggcagatacttgga

SEQ ID NO: 8576470 - DNA, 22 bp, Homo sapiens
attattatatagggaaagtccc

SEQ ID NO: 8576471 - DNA, 22 bp, Homo sapiens
attataggcttgagccaccgtg

SEQ ID NO: 8576472 - DNA, 22 bp, Homo sapiens
agaggcagaagtgttcaaaccc

SEQ ID NO: 8576473 - DNA, 22 bp, Homo sapiens
atgtgtatatttattgtagttt

SEQ ID NO: 8576474 - DNA, 22 bp, Homo sapiens
agagctgttaattttgcactgg

SEQ ID NO: 8576475 - DNA, 22 bp, Homo sapiens
agagctgtttggacatctgagt

SEQ ID NO: 8576476 - DNA, 22 bp, Homo sapiens
agacagcatgagcctgctgatg

SEQ ID NO: 8576477 - DNA, 22 bp, Homo sapiens
agaagtccccccagcatcgtag

SEQ ID NO: 8576478 - DNA, 21 bp, Homo sapiens
agaagtccccactctgtcgca

SEQ ID NO: 8576479 - DNA, 18 bp, Homo sapiens
agaattgctgcttcttct

SEQ ID NO: 8576480 - DNA, 22 bp, Homo sapiens
agacaaagaaaccgtagaagca

SEQ ID NO: 8576481 - DNA, 22 bp, Homo sapiens
agacaaaggattaatgatgatg

SEQ ID NO: 8576482 - DNA, 22 bp, Homo sapiens
atgaaagatgatttaaagtact

SEQ ID NO: 8576483 - DNA, 22 bp, Homo sapiens
agagcctgtgattgtcatcacc

SEQ ID NO: 8576484 - DNA, 22 bp, Homo sapiens
agagcctgtgattgtcatcacc

SEQ ID NO: 8576485 - DNA, 22 bp, Homo sapiens
agagcctgtacttttctgtgaa

SEQ ID NO: 8576486 - DNA, 22 bp, Homo sapiens
agagcctgtaacatctttctta

SEQ ID NO: 8576487 - DNA, 22 bp, Homo sapiens
atgtgggccgtgcgggtgtcct

SEQ ID NO: 8576488 - DNA, 22 bp, Homo sapiens
agagcctgggcagctcctctgg

SEQ ID NO: 8576489 - DNA, 22 bp, Homo sapiens
agagcctgggaatttgcatgtt

SEQ ID NO: 8576490 - DNA, 19 bp, Homo sapiens
agagccagacagcatagga

SEQ ID NO: 8576491 - DNA, 22 bp, Homo sapiens
atggccagggtggcactgtggt

SEQ ID NO: 8576492 - DNA, 22 bp, Homo sapiens
atggccagtcaagcctctggct

SEQ ID NO: 8576493 - DNA, 22 bp, Homo sapiens
atggccagccactcctgatggc

SEQ ID NO: 8576494 - DNA, 22 bp, Homo sapiens
agagatgaagggcattccccag

SEQ ID NO: 8576495 - DNA, 22 bp, Homo sapiens
agaaaacataggagacaggaaa

SEQ ID NO: 8576496 - DNA, 22 bp, Homo sapiens
agaaaacataggagacaggaaa

SEQ ID NO: 8576497 - DNA, 22 bp, Homo sapiens
agaaaacattacataggtgtgt

SEQ ID NO: 8576498 - DNA, 22 bp, Homo sapiens
aatacagagaatgttatttgga

SEQ ID NO: 8576499 - DNA, 22 bp, Homo sapiens
aatcaagaaaatgaggattctt

SEQ ID NO: 8576500 - DNA, 22 bp, Homo sapiens
acttgttgccctcctgaaaatt

SEQ ID NO: 8576501 - DNA, 22 bp, Homo sapiens
aatcataattgtatacattcat

SEQ ID NO: 8576502 - DNA, 22 bp, Homo sapiens
aagtttcattgttcatgtaaca

SEQ ID NO: 8576503 - DNA, 22 bp, Homo sapiens
aataattttagctcagagttgt

SEQ ID NO: 8576504 - DNA, 22 bp, Homo sapiens
aagtgctttacaaatgtctgtt

SEQ ID NO: 8576505 - DNA, 22 bp, Homo sapiens
aagtcagataggtgagtccaaa

SEQ ID NO: 8576506 - DNA, 22 bp, Homo sapiens
aagttagagattccatcatgct

SEQ ID NO: 8576507 - DNA, 22 bp, Homo sapiens
aagttagaaataagggctctcc

SEQ ID NO: 8576508 - DNA, 22 bp, Homo sapiens
acagtagagtaaatggttagat

SEQ ID NO: 8576509 - DNA, 22 bp, Homo sapiens
aaggcaggtattgatgccacag

SEQ ID NO: 8576510 - DNA, 22 bp, Homo sapiens
aaggcaggatgggaaaagattt

SEQ ID NO: 8576511 - DNA, 22 bp, Homo sapiens
aaggcagggaaagtggattagg

SEQ ID NO: 8576512 - DNA, 22 bp, Homo sapiens
aaggcaggatgcggacccatct

SEQ ID NO: 8576513 - DNA, 22 bp, Homo sapiens
aaggcaggagctgtatcttatt

SEQ ID NO: 8576514 - DNA, 22 bp, Homo sapiens
acagtacagtgcagaggaagat

SEQ ID NO: 8576515 - DNA, 22 bp, Homo sapiens
aaggaaagattctctctctaga

SEQ ID NO: 8576516 - DNA, 22 bp, Homo sapiens
aaggaaatacaacatgtattca

SEQ ID NO: 8576517 - DNA, 22 bp, Homo sapiens
aaggaaagacatataaatgact

SEQ ID NO: 8576518 - DNA, 22 bp, Homo sapiens
aagggaaatcatatggtgcagt

SEQ ID NO: 8576519 - DNA, 22 bp, Homo sapiens
aagggaaactttcacaatgtcc

SEQ ID NO: 8576520 - DNA, 22 bp, Homo sapiens
aagggctctgtgcttgtcccat

SEQ ID NO: 8576521 - DNA, 22 bp, Homo sapiens
aaggctgtttattagaaaaagt

SEQ ID NO: 8576522 - DNA, 22 bp, Homo sapiens
aaggctgtgtcagaagctccct

SEQ ID NO: 8576523 - DNA, 22 bp, Homo sapiens
aaggctgggaaacatgcaggcc

SEQ ID NO: 8576524 - DNA, 22 bp, Homo sapiens
aaggctgtccaggagaaaatag

SEQ ID NO: 8576525 - DNA, 22 bp, Homo sapiens
acatgtgtctaagaatgaaaga

SEQ ID NO: 8576526 - DNA, 22 bp, Homo sapiens
acatgtgtggacatgaatctac

SEQ ID NO: 8576527 - DNA, 22 bp, Homo sapiens
aagtagaaaaccgcactggact

SEQ ID NO: 8576528 - DNA, 22 bp, Homo sapiens
aagtagaatctcaggtaggcta

SEQ ID NO: 8576529 - DNA, 22 bp, Homo sapiens
aagggctgagaagtggggctgg

SEQ ID NO: 8576530 - DNA, 22 bp, Homo sapiens
aaggtgactcacaaagccagtt

SEQ ID NO: 8576531 - DNA, 22 bp, Homo sapiens
agccatgggctcccagtccttt

SEQ ID NO: 8576532 - DNA, 22 bp, Homo sapiens
agccatgctccttcccctctgg

SEQ ID NO: 8576533 - DNA, 22 bp, Homo sapiens
acagcaaaggacgaacactctg

SEQ ID NO: 8576534 - DNA, 22 bp, Homo sapiens
agcaggaaagaaaaatctgtgt

SEQ ID NO: 8576535 - DNA, 22 bp, Homo sapiens
aatgttgatgttttcagtgagc

SEQ ID NO: 8576536 - DNA, 22 bp, Homo sapiens
agaagggtagggacttatccaa

SEQ ID NO: 8576537 - DNA, 22 bp, Homo sapiens
agaagggtagttgtaagagtga

SEQ ID NO: 8576538 - DNA, 23 bp, Homo sapiens
agaagggtccttggcagcgacag

SEQ ID NO: 8576539 - DNA, 22 bp, Homo sapiens
agaagggtgtatacatttcctg

SEQ ID NO: 8576540 - DNA, 22 bp, Homo sapiens
agaagggttcaggaatatgtta

SEQ ID NO: 8576541 - DNA, 22 bp, Homo sapiens
aatgtgttcagttaaatgaact

SEQ ID NO: 8576542 - DNA, 22 bp, Homo sapiens
aatgtgttatttcagaatccag

SEQ ID NO: 8576543 - DNA, 22 bp, Homo sapiens
aatgtgttcacaggaaatacag

SEQ ID NO: 8576544 - DNA, 22 bp, Homo sapiens
agacagggagggagcgcggctg

SEQ ID NO: 8576545 - DNA, 22 bp, Homo sapiens
acaagtaggtgcacttcaatag

SEQ ID NO: 8576546 - DNA, 22 bp, Homo sapiens
acaagtagtaaattattaggtg

SEQ ID NO: 8576547 - DNA, 22 bp, Homo sapiens
acaatgtttttgttcaaagagt

SEQ ID NO: 8576548 - DNA, 22 bp, Homo sapiens
agatggggctgaaagttccaat

SEQ ID NO: 8576549 - DNA, 22 bp, Homo sapiens
agatggggtttcatcatgttgg

SEQ ID NO: 8576550 - DNA, 20 bp, Homo sapiens
acaaaataggtactgggtag

SEQ ID NO: 8576551 - DNA, 22 bp, Homo sapiens
aattttcacagtgctgtgagat

SEQ ID NO: 8576552 - DNA, 22 bp, Homo sapiens
acaaacagagttgaaaaatagg

SEQ ID NO: 8576553 - DNA, 22 bp, Homo sapiens
acaaatatggtactcggagaaa

SEQ ID NO: 8576554 - DNA, 22 bp, Homo sapiens
aaaagagagctgaggagctcca

SEQ ID NO: 8576555 - DNA, 22 bp, Homo sapiens
aaaaaattccattctgtgcctt

SEQ ID NO: 8576556 - DNA, 22 bp, Homo sapiens
aaaaaattatcatagttcctga

SEQ ID NO: 8576557 - DNA, 22 bp, Homo sapiens
aaaatgaagcaaaggcattcag

SEQ ID NO: 8576558 - DNA, 22 bp, Homo sapiens
aaaatgacattccagtgatatt

SEQ ID NO: 8576559 - DNA, 22 bp, Homo sapiens
aaaaatcacttttataggcagc

SEQ ID NO: 8576560 - DNA, 22 bp, Homo sapiens
aaacacttcttaggtcttaagt

SEQ ID NO: 8576561 - DNA, 22 bp, Homo sapiens
aaacagaaatttcctcatgctc

SEQ ID NO: 8576562 - DNA, 22 bp, Homo sapiens
aaagggctgatgtgacatagct

SEQ ID NO: 8576563 - DNA, 22 bp, Homo sapiens
aaaggtctacatcactgaaaga

SEQ ID NO: 8576564 - DNA, 22 bp, Homo sapiens
aaacctttaccagactagcaag

SEQ ID NO: 8576565 - DNA, 22 bp, Homo sapiens
aaaggtcttgtcttgacagagt

SEQ ID NO: 8576566 - DNA, 19 bp, Homo sapiens
aaactctgaaggccactgg

SEQ ID NO: 8576567 - DNA, 22 bp, Homo sapiens
aaactctataggcagaagcaat

SEQ ID NO: 8576568 - DNA, 22 bp, Homo sapiens
aaagaatttgtacaccctacta

SEQ ID NO: 8576569 - DNA, 22 bp, Homo sapiens
aaactctggagatgtttatgca

SEQ ID NO: 8576570 - DNA, 22 bp, Homo sapiens
aaactctgccatttttggcctg

SEQ ID NO: 8576571 - DNA, 22 bp, Homo sapiens
aaactctgcactgcggtaaggt

SEQ ID NO: 8576572 - DNA, 22 bp, Homo sapiens
aaactctgatgcttattgggaa

SEQ ID NO: 8576573 - DNA, 22 bp, Homo sapiens
aaactctggattggagtccagc

SEQ ID NO: 8576574 - DNA, 22 bp, Homo sapiens
aaactctgggggtggagcccag

SEQ ID NO: 8576575 - DNA, 22 bp, Homo sapiens
aaactctgtagctaaacataat

SEQ ID NO: 8576576 - DNA, 22 bp, Homo sapiens
aaactctgtatttgctgtgggt

SEQ ID NO: 8576577 - DNA, 22 bp, Homo sapiens
aaactctgttgagataatattt

SEQ ID NO: 8576578 - DNA, 22 bp, Homo sapiens
aaattagaccagggctcctgga

SEQ ID NO: 8576579 - DNA, 22 bp, Homo sapiens
aaattagaagtgctcaggaata

SEQ ID NO: 8576580 - DNA, 22 bp, Homo sapiens
aaattagaaatactttcaaagc

SEQ ID NO: 8576581 - DNA, 22 bp, Homo sapiens
aaattacagccttgggtagctt

SEQ ID NO: 8576582 - DNA, 22 bp, Homo sapiens
aaattacagatcaccaatgcat

SEQ ID NO: 8576583 - DNA, 22 bp, Homo sapiens
aaagataatgtttccttattct

SEQ ID NO: 8576584 - DNA, 22 bp, Homo sapiens
aaattttgtattctagttctag

SEQ ID NO: 8576585 - DNA, 22 bp, Homo sapiens
aaagtagaacattttcttatct

SEQ ID NO: 8576586 - DNA, 22 bp, Homo sapiens
aaagtagaggcattgatcaggt

SEQ ID NO: 8576587 - DNA, 22 bp, Homo sapiens
aaaggaaaataagtagttccat

SEQ ID NO: 8576588 - DNA, 22 bp, Homo sapiens
aaaggaagatgccaggactctg

SEQ ID NO: 8576589 - DNA, 22 bp, Homo sapiens
aaagtgggaacaatggagagtg

SEQ ID NO: 8576590 - DNA, 22 bp, Homo sapiens
aaagtagagttgtggaattact

SEQ ID NO: 8576591 - DNA, 22 bp, Homo sapiens
aaagtagagttgtggaattact

SEQ ID NO: 8576592 - DNA, 22 bp, Homo sapiens
aaagtagatttctcatggcgaa

SEQ ID NO: 8576593 - DNA, 22 bp, Homo sapiens
aagcatgggaatcccacagggt

SEQ ID NO: 8576594 - DNA, 22 bp, Homo sapiens
aagcatgggaggcctggaggag

SEQ ID NO: 8576595 - DNA, 22 bp, Homo sapiens
aaatcggttggttcaaggtaat

SEQ ID NO: 8576596 - DNA, 23 bp, Homo sapiens
aagcacagaatggtttaggagtt

SEQ ID NO: 8576597 - DNA, 22 bp, Homo sapiens
aaagttttattcaagcattagt

SEQ ID NO: 8576598 - DNA, 22 bp, Homo sapiens
aaataagaaattcttctttgca

SEQ ID NO: 8576599 - DNA, 23 bp, Homo sapiens
aaataggagtatctggatcatga

SEQ ID NO: 8576600 - DNA, 22 bp, Homo sapiens
aaatagacaggcttaaatagga

SEQ ID NO: 8576601 - DNA, 22 bp, Homo sapiens
aagtccaggctggcgtagagtc

SEQ ID NO: 8576602 - DNA, 22 bp, Homo sapiens
aagtccagggatcaaagtaggc

SEQ ID NO: 8576603 - DNA, 22 bp, Homo sapiens
aagtccagcatttgggtagatt

SEQ ID NO: 8576604 - DNA, 17 bp, Homo sapiens
aagtccagagttgagca

SEQ ID NO: 8576605 - DNA, 23 bp, Homo sapiens
aagtccagaaggagaactgggag

SEQ ID NO: 8576606 - DNA, 22 bp, Homo sapiens
aagtccaccagtcagactagga

SEQ ID NO: 8576607 - DNA, 22 bp, Homo sapiens
aaggtccatgactcggcatagt

SEQ ID NO: 8576608 - DNA, 22 bp, Homo sapiens
aaggtccagtttgaattactgt

SEQ ID NO: 8576609 - DNA, 22 bp, Homo sapiens
aaggtccacaactggtaaatgg

SEQ ID NO: 8576610 - DNA, 22 bp, Homo sapiens
aaggtccagtggaaactagagt

SEQ ID NO: 8576611 - DNA, 20 bp, Homo sapiens
aaggtccaaactctgtgttc

SEQ ID NO: 8576612 - DNA, 22 bp, Homo sapiens
aaggtccagaggtcccgtcacc

SEQ ID NO: 8576613 - DNA, 22 bp, Homo sapiens
aacaaacagttaagtgtggatg

SEQ ID NO: 8576614 - DNA, 22 bp, Homo sapiens
aacaaacattacctggtgctgg

SEQ ID NO: 8576615 - DNA, 22 bp, Homo sapiens
aacaaagcaccactgagtcagt

SEQ ID NO: 8576616 - DNA, 22 bp, Homo sapiens
aacaaagatgggtgggaaagag

SEQ ID NO: 8576617 - DNA, 22 bp, Homo sapiens
aacaaagtagctgctgttctta

SEQ ID NO: 8576618 - DNA, 22 bp, Homo sapiens
aacaaagccctgcccaagagct

SEQ ID NO: 8576619 - DNA, 22 bp, Homo sapiens
aacaaaggccgttaataaccac

SEQ ID NO: 8576620 - DNA, 22 bp, Homo sapiens
aaccagagagtcttcttcattg

SEQ ID NO: 8576621 - DNA, 22 bp, Homo sapiens
aaccagagaaatggagtgataa

SEQ ID NO: 8576622 - DNA, 22 bp, Homo sapiens
aaccagaggcagcagtacctga

SEQ ID NO: 8576623 - DNA, 22 bp, Homo sapiens
aaccaccattctctcctcttcc

SEQ ID NO: 8576624 - DNA, 23 bp, Homo sapiens
aacgtcctcaacaggattgcacc

SEQ ID NO: 8576625 - DNA, 22 bp, Homo sapiens
aacgtcctcacctgtaacttgg

SEQ ID NO: 8576626 - DNA, 22 bp, Homo sapiens
aacttaaacccactcatgtaga

SEQ ID NO: 8576627 - DNA, 22 bp, Homo sapiens
aagcagcctggcatgatgcttt

SEQ ID NO: 8576628 - DNA, 22 bp, Homo sapiens
aagcagagtccccttcccatgg

SEQ ID NO: 8576629 - DNA, 22 bp, Homo sapiens
aagcacaggatcttgaggagcg

SEQ ID NO: 8576630 - DNA, 22 bp, Homo sapiens
aagcacagggactcaggaccgg

SEQ ID NO: 8576631 - DNA, 22 bp, Homo sapiens
aattgttgtacagaataaatga

SEQ ID NO: 8576632 - DNA, 22 bp, Homo sapiens
aacttcatgggttcaaagctgg

SEQ ID NO: 8576633 - DNA, 22 bp, Homo sapiens
acaaagatgtttaaagcattta

SEQ ID NO: 8576634 - DNA, 22 bp, Homo sapiens
ggctctgcccaggtggacagca

SEQ ID NO: 8576635 - DNA, 18 bp, Homo sapiens
ggcctctggactggcagc

SEQ ID NO: 8576636 - DNA, 22 bp, Homo sapiens
ggcccagctgtgcttccagccc

SEQ ID NO: 8576637 - DNA, 22 bp, Homo sapiens
ggccacctaggagccacagtga

SEQ ID NO: 8576638 - DNA, 22 bp, Homo sapiens
ggccacctctgccctaccgagt

SEQ ID NO: 8576639 - DNA, 19 bp, Homo sapiens
ggccacctctcttcccagg

SEQ ID NO: 8576640 - DNA, 22 bp, Homo sapiens
ggccacctccgtgaaggaatga

SEQ ID NO: 8576641 - DNA, 21 bp, Homo sapiens
ggcagcccgccctctcctggc

SEQ ID NO: 8576642 - DNA, 22 bp, Homo sapiens
ggaggcagaacttcccgtcagt

SEQ ID NO: 8576643 - DNA, 22 bp, Homo sapiens
ggcacctggatgtagcagtgaa

SEQ ID NO: 8576644 - DNA, 22 bp, Homo sapiens
ggcacctggtaagtgctcagta

SEQ ID NO: 8576645 - DNA, 22 bp, Homo sapiens
gggctatagcactatgtatggg

SEQ ID NO: 8576646 - DNA, 22 bp, Homo sapiens
gggcaggtggcagggtctctgg

SEQ ID NO: 8576647 - DNA, 22 bp, Homo sapiens
gggcaggtggagggcccagcca

SEQ ID NO: 8576648 - DNA, 22 bp, Homo sapiens
gggcaggtggcaaagccagagg

SEQ ID NO: 8576649 - DNA, 22 bp, Homo sapiens
gggcaggtgtttccaaggtgag

SEQ ID NO: 8576650 - DNA, 22 bp, Homo sapiens
gggcaggtgttgtcaatctaat

SEQ ID NO: 8576651 - DNA, 22 bp, Homo sapiens
gggcaggtggcctcttgtacta

SEQ ID NO: 8576652 - DNA, 22 bp, Homo sapiens
gggcaggtgtgcagagctgttg

SEQ ID NO: 8576653 - DNA, 22 bp, Homo sapiens
gggcaggtgcccagggccagag

SEQ ID NO: 8576654 - DNA, 22 bp, Homo sapiens
gggcaggtgccagctccctgtc

SEQ ID NO: 8576655 - DNA, 22 bp, Homo sapiens
gggcaggtgacctcttgtcctg

SEQ ID NO: 8576656 - DNA, 22 bp, Homo sapiens
gggcaggtgattttggctccat

SEQ ID NO: 8576657 - DNA, 21 bp, Homo sapiens
gggcaggtctctgatgtcaac

SEQ ID NO: 8576658 - DNA, 22 bp, Homo sapiens
gggcaggtctgggtcagcctga

SEQ ID NO: 8576659 - DNA, 15 bp, Homo sapiens
gggcaggtctggggc

SEQ ID NO: 8576660 - DNA, 21 bp, Homo sapiens
gggcagaggggcctcctgggt

SEQ ID NO: 8576661 - DNA, 20 bp, Homo sapiens
gggcagagccagccagtccc

SEQ ID NO: 8576662 - DNA, 22 bp, Homo sapiens
gggagtccaaattggtacaata

SEQ ID NO: 8576663 - DNA, 22 bp, Homo sapiens
ggctggagtgggctccagagtt

SEQ ID NO: 8576664 - DNA, 23 bp, Homo sapiens
gggagatgggaaatgaaggctct

SEQ ID NO: 8576665 - DNA, 22 bp, Homo sapiens
gggagatggctcagaggccgcg

SEQ ID NO: 8576666 - DNA, 22 bp, Homo sapiens
ggctgtggtctgggtgctcccc

SEQ ID NO: 8576667 - DNA, 22 bp, Homo sapiens
gtgcccagctccacctcacaga

SEQ ID NO: 8576668 - DNA, 22 bp, Homo sapiens
gtgcagggcagccgaatgggct

SEQ ID NO: 8576669 - DNA, 17 bp, Homo sapiens
gtgcagggatgaaggat

SEQ ID NO: 8576670 - DNA, 22 bp, Homo sapiens
gtgccacttacctgggaggagt

SEQ ID NO: 8576671 - DNA, 22 bp, Homo sapiens
gtcttttttacaccttacatca

SEQ ID NO: 8576672 - DNA, 22 bp, Homo sapiens
gtgagctttgtggtaatgaagt

SEQ ID NO: 8576673 - DNA, 22 bp, Homo sapiens
gtcctgggaactggacagctaa

SEQ ID NO: 8576674 - DNA, 22 bp, Homo sapiens
gtccaggctgcccagggtcctg

SEQ ID NO: 8576675 - DNA, 22 bp, Homo sapiens
gtcctctggcctttcccaggac

SEQ ID NO: 8576676 - DNA, 22 bp, Homo sapiens
gtccaggaatcaaaagatggaa

SEQ ID NO: 8576677 - DNA, 22 bp, Homo sapiens
gtccaggaagcaataaatagaa

SEQ ID NO: 8576678 - DNA, 20 bp, Homo sapiens
gtccaggacccagcaggagg

SEQ ID NO: 8576679 - DNA, 22 bp, Homo sapiens
gtccaggagtttccaattaagc

SEQ ID NO: 8576680 - DNA, 22 bp, Homo sapiens
gtcaccctgctggctgttcagc

SEQ ID NO: 8576681 - DNA, 22 bp, Homo sapiens
gtcaccctgctgtttgtccatt

SEQ ID NO: 8576682 - DNA, 22 bp, Homo sapiens
gtcactttattaattttggtga

SEQ ID NO: 8576683 - DNA, 22 bp, Homo sapiens
gtccagagaagggaggggactc

SEQ ID NO: 8576684 - DNA, 22 bp, Homo sapiens
gtcagaggaatggatgagtgat

SEQ ID NO: 8576685 - DNA, 22 bp, Homo sapiens
gtccagcccctgactcccaggc

SEQ ID NO: 8576686 - DNA, 22 bp, Homo sapiens
gtccagcccgggctccgccagc

SEQ ID NO: 8576687 - DNA, 22 bp, Homo sapiens
gtattttatggcatgcagtggc

SEQ ID NO: 8576688 - DNA, 22 bp, Homo sapiens
gtcaaaacaaagttaagaattc

SEQ ID NO: 8576689 - DNA, 22 bp, Homo sapiens
gtatttttaggtaaggaaagta

SEQ ID NO: 8576690 - DNA, 22 bp, Homo sapiens
gtatttttcagttaggagctta

SEQ ID NO: 8576691 - DNA, 22 bp, Homo sapiens
gtatttttagtagagtcggggt

SEQ ID NO: 8576692 - DNA, 22 bp, Homo sapiens
gtatttttcattccaagtgaga

SEQ ID NO: 8576693 - DNA, 22 bp, Homo sapiens
gtcaaaaagtagtcatttctgt

SEQ ID NO: 8576694 - DNA, 22 bp, Homo sapiens
gtacaatagcagttttcccttt

SEQ ID NO: 8576695 - DNA, 22 bp, Homo sapiens
gtagtcccagctaccccggagg

SEQ ID NO: 8576696 - DNA, 22 bp, Homo sapiens
ggggaggccagtggaccgtccc

SEQ ID NO: 8576697 - DNA, 22 bp, Homo sapiens
ggggatctaggatatttcatga

SEQ ID NO: 8576698 - DNA, 22 bp, Homo sapiens
gggctgtgtgcccacttcccat

SEQ ID NO: 8576699 - DNA, 22 bp, Homo sapiens
gggtgcaggcagcccaggcagg

SEQ ID NO: 8576700 - DNA, 22 bp, Homo sapiens
ggggcccagcacccctcctcgc

SEQ ID NO: 8576701 - DNA, 22 bp, Homo sapiens
ggtcccagctgctcaagaggct

SEQ ID NO: 8576702 - DNA, 22 bp, Homo sapiens
ggtcccagttgcccaggtcagg

SEQ ID NO: 8576703 - DNA, 22 bp, Homo sapiens
ggtcccaggttgacagggagac

SEQ ID NO: 8576704 - DNA, 22 bp, Homo sapiens
ggtccccgtggaggctggagcg

SEQ ID NO: 8576705 - DNA, 22 bp, Homo sapiens
ggtggataggtacatggacttt

SEQ ID NO: 8576706 - DNA, 22 bp, Homo sapiens
ggtggggcctgctccagcggcc

SEQ ID NO: 8576707 - DNA, 22 bp, Homo sapiens
ggtggggccagggctccaacct

SEQ ID NO: 8576708 - DNA, 22 bp, Homo sapiens
ggttggtaactccctgtgcagt

SEQ ID NO: 8576709 - DNA, 22 bp, Homo sapiens
ggttggtaactccctgtgcagt

SEQ ID NO: 8576710 - DNA, 22 bp, Homo sapiens
gcaaggagactgtagggccaag

SEQ ID NO: 8576711 - DNA, 23 bp, Homo sapiens
gcagagtcaagtagtcatgagtg

SEQ ID NO: 8576712 - DNA, 22 bp, Homo sapiens
gcagagtcaggtccaaggactg

SEQ ID NO: 8576713 - DNA, 22 bp, Homo sapiens
gcaggccctcctctagcaaggc

SEQ ID NO: 8576714 - DNA, 22 bp, Homo sapiens
gcagggcagcttagtccctgtc

SEQ ID NO: 8576715 - DNA, 22 bp, Homo sapiens
gcagggcagctgaagctaggtg

SEQ ID NO: 8576716 - DNA, 22 bp, Homo sapiens
gcagggcagccacaggccccct

SEQ ID NO: 8576717 - DNA, 22 bp, Homo sapiens
gcaggccagctgtgcagatggg

SEQ ID NO: 8576718 - DNA, 22 bp, Homo sapiens
gcagggccaggtacaagaagca

SEQ ID NO: 8576719 - DNA, 22 bp, Homo sapiens
gcaggtctcaatctgagcaggc

SEQ ID NO: 8576720 - DNA, 22 bp, Homo sapiens
gcaggtctggcatagagcctgc

SEQ ID NO: 8576721 - DNA, 19 bp, Homo sapiens
gcagggtgttgactgtccc

SEQ ID NO: 8576722 - DNA, 22 bp, Homo sapiens
gcaggtcccagaaagttaattc

SEQ ID NO: 8576723 - DNA, 22 bp, Homo sapiens
gcaggtccagtcaccagagaga

SEQ ID NO: 8576724 - DNA, 20 bp, Homo sapiens
gcaggtccctggcatgcaga

SEQ ID NO: 8576725 - DNA, 19 bp, Homo sapiens
gcaggtcattaggctaggt

SEQ ID NO: 8576726 - DNA, 21 bp, Homo sapiens
gcagccagccgagaccatgcc

SEQ ID NO: 8576727 - DNA, 22 bp, Homo sapiens
gcagccaggaaagctggaccct

SEQ ID NO: 8576728 - DNA, 22 bp, Homo sapiens
gcagccagcccctctgacctct

SEQ ID NO: 8576729 - DNA, 22 bp, Homo sapiens
gcagccagaagactcagaacaa

SEQ ID NO: 8576730 - DNA, 23 bp, Homo sapiens
gcagccatgttcccgtctcagct

SEQ ID NO: 8576731 - DNA, 22 bp, Homo sapiens
gccccttgtctccaggccccaa

SEQ ID NO: 8576732 - DNA, 22 bp, Homo sapiens
gcccgcgccagcctctccatct

SEQ ID NO: 8576733 - DNA, 22 bp, Homo sapiens
gccctatcattcattgagtgct

SEQ ID NO: 8576734 - DNA, 22 bp, Homo sapiens
gcccctctccttgtgcacctgc

SEQ ID NO: 8576735 - DNA, 22 bp, Homo sapiens
gcctgcagtgagtgcagaaggt

SEQ ID NO: 8576736 - DNA, 21 bp, Homo sapiens
gcctgcagttttgaagccctt

SEQ ID NO: 8576737 - DNA, 22 bp, Homo sapiens
gcctggagcagacgtgtcccgg

SEQ ID NO: 8576738 - DNA, 22 bp, Homo sapiens
gcctggagacctgctcctctac

SEQ ID NO: 8576739 - DNA, 22 bp, Homo sapiens
gcctgagggctcctagcaggct

SEQ ID NO: 8576740 - DNA, 22 bp, Homo sapiens
gcctgaggaatgctcctgactt

SEQ ID NO: 8576741 - DNA, 22 bp, Homo sapiens
gcctccctccaccactgcaggt

SEQ ID NO: 8576742 - DNA, 22 bp, Homo sapiens
gcctccctgagtcacccaagca

SEQ ID NO: 8576743 - DNA, 22 bp, Homo sapiens
gcctccctggcccacagcagcg

SEQ ID NO: 8576744 - DNA, 22 bp, Homo sapiens
gcagtgttggcaggatggggct

SEQ ID NO: 8576745 - DNA, 22 bp, Homo sapiens
gcagtgttggtttgctctgcag

SEQ ID NO: 8576746 - DNA, 22 bp, Homo sapiens
gcagtgtttggatccatagcga

SEQ ID NO: 8576747 - DNA, 23 bp, Homo sapiens
gcagtgtttgcttcatcttatcc

SEQ ID NO: 8576748 - DNA, 22 bp, Homo sapiens
gcagtgtttcagtgctttttct

SEQ ID NO: 8576749 - DNA, 22 bp, Homo sapiens
gcagtgtttcccagagatggaa

SEQ ID NO: 8576750 - DNA, 22 bp, Homo sapiens
gcagtgtttcaaatcaaaggca

SEQ ID NO: 8576751 - DNA, 22 bp, Homo sapiens
gcagtgtttacatattagaaac

SEQ ID NO: 8576752 - DNA, 22 bp, Homo sapiens
gcagtgttgtgatccaggtctt

SEQ ID NO: 8576753 - DNA, 22 bp, Homo sapiens
gcagtgttgttaaaagattaga

SEQ ID NO: 8576754 - DNA, 22 bp, Homo sapiens
gcagttcctacagtggaaagcg

SEQ ID NO: 8576755 - DNA, 22 bp, Homo sapiens
gcagtgtttgtgttctcacatg

SEQ ID NO: 8576756 - DNA, 22 bp, Homo sapiens
gcagtgtttttcaatgcttcca

SEQ ID NO: 8576757 - DNA, 22 bp, Homo sapiens
gcagtgttttacagaccagcat

SEQ ID NO: 8576758 - DNA, 22 bp, Homo sapiens
gccacctgtttcagatgtggtt

SEQ ID NO: 8576759 - DNA, 22 bp, Homo sapiens
gccacctgtttcgcttgcccag

SEQ ID NO: 8576760 - DNA, 22 bp, Homo sapiens
gccacctggtggcatcttctgg

SEQ ID NO: 8576761 - DNA, 22 bp, Homo sapiens
gccacctgtaagccattaggcc

SEQ ID NO: 8576762 - DNA, 22 bp, Homo sapiens
gccacctgtgtgggcctttgtg

SEQ ID NO: 8576763 - DNA, 22 bp, Homo sapiens
gccacctggactcagagccagg

SEQ ID NO: 8576764 - DNA, 22 bp, Homo sapiens
gccacctggacagctgtgccct

SEQ ID NO: 8576765 - DNA, 22 bp, Homo sapiens
gccacctgcgggccgtggtgga

SEQ ID NO: 8576766 - DNA, 22 bp, Homo sapiens
gccacctgccaacttgctggaa

SEQ ID NO: 8576767 - DNA, 22 bp, Homo sapiens
gccacctctttgtctctgccgc

SEQ ID NO: 8576768 - DNA, 22 bp, Homo sapiens
gccaggctaagaaaggtgtgat

SEQ ID NO: 8576769 - DNA, 23 bp, Homo sapiens
gccaggctccggtctgtggccac

SEQ ID NO: 8576770 - DNA, 22 bp, Homo sapiens
gccagctgttcagacattcttt

SEQ ID NO: 8576771 - DNA, 22 bp, Homo sapiens
gccagctggctgcaggtcccag

SEQ ID NO: 8576772 - DNA, 22 bp, Homo sapiens
gctctctggaaggtatcattat

SEQ ID NO: 8576773 - DNA, 22 bp, Homo sapiens
gctctgtggcaggaggtcttgt

SEQ ID NO: 8576774 - DNA, 22 bp, Homo sapiens
gctagctttataatgctgggcg

SEQ ID NO: 8576775 - DNA, 23 bp, Homo sapiens
gctcatcaggcttagagtcaagg

SEQ ID NO: 8576776 - DNA, 22 bp, Homo sapiens
gctgcagggagctggaaggctc

SEQ ID NO: 8576777 - DNA, 22 bp, Homo sapiens
gctggagtctggaggtgtgcca

SEQ ID NO: 8576778 - DNA, 22 bp, Homo sapiens
gctggcaggtaaagccccgggg

SEQ ID NO: 8576779 - DNA, 22 bp, Homo sapiens
gctgtgtgctaggatatgtttt

SEQ ID NO: 8576780 - DNA, 22 bp, Homo sapiens
gctgtctggaggctctgaggga

SEQ ID NO: 8576781 - DNA, 22 bp, Homo sapiens
gctggccacagatccccaggga

SEQ ID NO: 8576782 - DNA, 22 bp, Homo sapiens
gcttttgtggtgatggagaggc

SEQ ID NO: 8576783 - DNA, 22 bp, Homo sapiens
gctgttggcgaggagctcagct

SEQ ID NO: 8576784 - DNA, 22 bp, Homo sapiens
ggactttagctgtaatgtgtgt

SEQ ID NO: 8576785 - DNA, 19 bp, Homo sapiens
ggaaggcagaggggctgtg

SEQ ID NO: 8576786 - DNA, 22 bp, Homo sapiens
ggaaggctctgttccttgactt

SEQ ID NO: 8576787 - DNA, 22 bp, Homo sapiens
ggaaggcttgagttcccaggtc

SEQ ID NO: 8576788 - DNA, 22 bp, Homo sapiens
ggaaggcagtgaaggggctgat

SEQ ID NO: 8576789 - DNA, 22 bp, Homo sapiens
ggagaagaggagctggaagcct

SEQ ID NO: 8576790 - DNA, 22 bp, Homo sapiens
ggagctgtgttatccattccca

SEQ ID NO: 8576791 - DNA, 22 bp, Homo sapiens
gttgacagaaaaataacatagc

SEQ ID NO: 8576792 - DNA, 22 bp, Homo sapiens
gtttattagagttttctgtctg

SEQ ID NO: 8576793 - DNA, 22 bp, Homo sapiens
gtttattaactgtcaagtgatt

SEQ ID NO: 8576794 - DNA, 22 bp, Homo sapiens
gtttgttgatatgcccctttgt

SEQ ID NO: 8576795 - DNA, 22 bp, Homo sapiens
gtttcaatttgacccaaatctt

SEQ ID NO: 8576796 - DNA, 22 bp, Homo sapiens
gttaaataacctcatgtccgtt

SEQ ID NO: 8576797 - DNA, 22 bp, Homo sapiens
gtgttcattgctagtgaggtgt

SEQ ID NO: 8576798 - DNA, 22 bp, Homo sapiens
gttataaatgactgcaaaagtt

SEQ ID NO: 8576799 - DNA, 22 bp, Homo sapiens
taaagcagccagggtctaagcc

SEQ ID NO: 8576800 - DNA, 22 bp, Homo sapiens
taaagacatggtgtaggtgaac

SEQ ID NO: 8576801 - DNA, 23 bp, Homo sapiens
taaagacagccttcaggattctg

SEQ ID NO: 8576802 - DNA, 22 bp, Homo sapiens
taaagacatgcaaagtctaatt

SEQ ID NO: 8576803 - DNA, 20 bp, Homo sapiens
taaagacataagctactatc

SEQ ID NO: 8576804 - DNA, 22 bp, Homo sapiens
taaaaggaggttgaagctgtca

SEQ ID NO: 8576805 - DNA, 22 bp, Homo sapiens
gttttacaaatgacggcattca

SEQ ID NO: 8576806 - DNA, 22 bp, Homo sapiens
taagagctaggattttaaatca

SEQ ID NO: 8576807 - DNA, 22 bp, Homo sapiens
tacttaaaactgatagaatctc

SEQ ID NO: 8576808 - DNA, 22 bp, Homo sapiens
tactgtgtgattccatttacgt

SEQ ID NO: 8576809 - DNA, 22 bp, Homo sapiens
tactgtgtggtgagctgtctcc

SEQ ID NO: 8576810 - DNA, 22 bp, Homo sapiens
tactgtgtgcccagccgagctg

SEQ ID NO: 8576811 - DNA, 19 bp, Homo sapiens
taccatgttgactttcctg

SEQ ID NO: 8576812 - DNA, 22 bp, Homo sapiens
taccatgtcttcaataagtcta

SEQ ID NO: 8576813 - DNA, 22 bp, Homo sapiens
taccaagtgtattatgctttgt

SEQ ID NO: 8576814 - DNA, 22 bp, Homo sapiens
tacatgctccttatgagaatct

SEQ ID NO: 8576815 - DNA, 22 bp, Homo sapiens
tacagtgtctggatatcaaagg

SEQ ID NO: 8576816 - DNA, 22 bp, Homo sapiens
tacagtgtctggatatcaaagg

SEQ ID NO: 8576817 - DNA, 22 bp, Homo sapiens
tacagtgtgacatttctacaaa

SEQ ID NO: 8576818 - DNA, 22 bp, Homo sapiens
tacagtatggaaaatgtatagt

SEQ ID NO: 8576819 - DNA, 22 bp, Homo sapiens
tacagtagtcgtcttattttga

SEQ ID NO: 8576820 - DNA, 22 bp, Homo sapiens
tacagtgtccctttttcagaca

SEQ ID NO: 8576821 - DNA, 22 bp, Homo sapiens
tacagtcaatactaggaccata

SEQ ID NO: 8576822 - DNA, 22 bp, Homo sapiens
tacagtcacattctgaggtctt

SEQ ID NO: 8576823 - DNA, 22 bp, Homo sapiens
tacagtcaacattgatgatgat

SEQ ID NO: 8576824 - DNA, 22 bp, Homo sapiens
tacaagaaactacatgaatgca

SEQ ID NO: 8576825 - DNA, 22 bp, Homo sapiens
tacaagaaagtccagtgggttt

SEQ ID NO: 8576826 - DNA, 22 bp, Homo sapiens
tacaagagacaccagggaggct

SEQ ID NO: 8576827 - DNA, 22 bp, Homo sapiens
taagcctgcatgaaccatgaga

SEQ ID NO: 8576828 - DNA, 22 bp, Homo sapiens
tagcaaaatgtggatgtagttg

SEQ ID NO: 8576829 - DNA, 22 bp, Homo sapiens
tagcaaaagctcaacaggaagg

SEQ ID NO: 8576830 - DNA, 22 bp, Homo sapiens
tagaagaacatgtcaaactata

SEQ ID NO: 8576831 - DNA, 22 bp, Homo sapiens
tagagaaacagaaccaacaggg

SEQ ID NO: 8576832 - DNA, 22 bp, Homo sapiens
tagatatgatgagtcacttgag

SEQ ID NO: 8576833 - DNA, 22 bp, Homo sapiens
tagtgcaacagggaaagagtgt

SEQ ID NO: 8576834 - DNA, 22 bp, Homo sapiens
tagtgcaaaggtcttgcaccag

SEQ ID NO: 8576835 - DNA, 22 bp, Homo sapiens
tagtgcaaggattgctgcagag

SEQ ID NO: 8576836 - DNA, 22 bp, Homo sapiens
tagtgcaaggttttgccaactt

SEQ ID NO: 8576837 - DNA, 22 bp, Homo sapiens
tagtgcaaaggccctgagatgg

SEQ ID NO: 8576838 - DNA, 22 bp, Homo sapiens
tagtgcaattccccatactaac

SEQ ID NO: 8576839 - DNA, 22 bp, Homo sapiens
tagtgcaatctcttcctcagca

SEQ ID NO: 8576840 - DNA, 22 bp, Homo sapiens
tagtgcaatgtgaggcagtacc

SEQ ID NO: 8576841 - DNA, 21 bp, Homo sapiens
tagggggcagtgggatgctta

SEQ ID NO: 8576842 - DNA, 22 bp, Homo sapiens
tagtttttaagtgtacaatttc

SEQ ID NO: 8576843 - DNA, 22 bp, Homo sapiens
tagtttcatctccaccctgccc

SEQ ID NO: 8576844 - DNA, 22 bp, Homo sapiens
taggcaggctgaatgtagattt

SEQ ID NO: 8576845 - DNA, 23 bp, Homo sapiens
taggcaggactcagatatgacag

SEQ ID NO: 8576846 - DNA, 22 bp, Homo sapiens
taggccatgcagcaaagaggct

SEQ ID NO: 8576847 - DNA, 22 bp, Homo sapiens
taggccattgatttttataagt

SEQ ID NO: 8576848 - DNA, 22 bp, Homo sapiens
tatttttgcctctcagataaaa

SEQ ID NO: 8576849 - DNA, 22 bp, Homo sapiens
tcaaaaagttgaagagttgggg

SEQ ID NO: 8576850 - DNA, 22 bp, Homo sapiens
tattttggctgattcatcatgt

SEQ ID NO: 8576851 - DNA, 22 bp, Homo sapiens
tcaaagagctctatcttcaaaa

SEQ ID NO: 8576852 - DNA, 22 bp, Homo sapiens
tcaaagagctattcagttgtgg

SEQ ID NO: 8576853 - DNA, 22 bp, Homo sapiens
tcaaataggtatgagtagaaat

SEQ ID NO: 8576854 - DNA, 22 bp, Homo sapiens
tcaaatattggctatttcacat

SEQ ID NO: 8576855 - DNA, 22 bp, Homo sapiens
tattacaagaaagggcatgaat

SEQ ID NO: 8576856 - DNA, 22 bp, Homo sapiens
tattacaaattataatgggaga

SEQ ID NO: 8576857 - DNA, 22 bp, Homo sapiens
tattttctggggagagtgaacc

SEQ ID NO: 8576858 - DNA, 22 bp, Homo sapiens
tataaaattctcagtttggggt

SEQ ID NO: 8576859 - DNA, 22 bp, Homo sapiens
tataaaatggcatcagctccaa

SEQ ID NO: 8576860 - DNA, 22 bp, Homo sapiens
tataaaatggcatcagctccaa

SEQ ID NO: 8576861 - DNA, 22 bp, Homo sapiens
tatgcttttaacctgtaactga

SEQ ID NO: 8576862 - DNA, 20 bp, Homo sapiens
tatgctttttataagattga

SEQ ID NO: 8576863 - DNA, 22 bp, Homo sapiens
tatgctttggtagagagttgtg

SEQ ID NO: 8576864 - DNA, 22 bp, Homo sapiens
tatgctttcattcatatgtgag

SEQ ID NO: 8576865 - DNA, 22 bp, Homo sapiens
tatgctttacttttcattgtga

SEQ ID NO: 8576866 - DNA, 22 bp, Homo sapiens
tcagtaaatctctaattggcat

SEQ ID NO: 8576867 - DNA, 21 bp, Homo sapiens
tcagtaaacctaaagattgta

SEQ ID NO: 8576868 - DNA, 22 bp, Homo sapiens
tcatagaaatatcacgtctttt

SEQ ID NO: 8576869 - DNA, 22 bp, Homo sapiens
tcatagaagcactcagctccct

SEQ ID NO: 8576870 - DNA, 22 bp, Homo sapiens
tcatacattcagcagatatttg

SEQ ID NO: 8576871 - DNA, 22 bp, Homo sapiens
tcatgcagatttggaggtattt

SEQ ID NO: 8576872 - DNA, 22 bp, Homo sapiens
tcatgcagataagaataagtaa

SEQ ID NO: 8576873 - DNA, 22 bp, Homo sapiens
tcatgcagagtagaaagggcaa

SEQ ID NO: 8576874 - DNA, 22 bp, Homo sapiens
tcatgcagaggaaggctagttt

SEQ ID NO: 8576875 - DNA, 22 bp, Homo sapiens
tcatgcagagccagtcaggata

SEQ ID NO: 8576876 - DNA, 23 bp, Homo sapiens
tcatgcagagaaggactgcttac

SEQ ID NO: 8576877 - DNA, 22 bp, Homo sapiens
tcataaagcttgcctgcagtgt

SEQ ID NO: 8576878 - DNA, 22 bp, Homo sapiens
tcagtgtttttaaagcaatata

SEQ ID NO: 8576879 - DNA, 22 bp, Homo sapiens
tcagtgttttccagggtctact

SEQ ID NO: 8576880 - DNA, 22 bp, Homo sapiens
tcagtgtttgtggcaaatgtta

SEQ ID NO: 8576881 - DNA, 22 bp, Homo sapiens
tcagtgttttaactgtctttta

SEQ ID NO: 8576882 - DNA, 22 bp, Homo sapiens
tcagtgtttggtttcagaattg

SEQ ID NO: 8576883 - DNA, 22 bp, Homo sapiens
tcagtgtttgaacccagggtta

SEQ ID NO: 8576884 - DNA, 22 bp, Homo sapiens
tcagtgtttcctgtggtacagc

SEQ ID NO: 8576885 - DNA, 22 bp, Homo sapiens
tcagtgtttcctagagcatata

SEQ ID NO: 8576886 - DNA, 22 bp, Homo sapiens
tcagtcctctctgggtttctta

SEQ ID NO: 8576887 - DNA, 18 bp, Homo sapiens
tcagtctattgtataaga

SEQ ID NO: 8576888 - DNA, 22 bp, Homo sapiens
tcagtcctcacttggttctaag

SEQ ID NO: 8576889 - DNA, 22 bp, Homo sapiens
tcagtgtttacatgcatccttg

SEQ ID NO: 8576890 - DNA, 22 bp, Homo sapiens
tcagtgttgtgcacatacaaaa

SEQ ID NO: 8576891 - DNA, 22 bp, Homo sapiens
tcagtgttggctacatctgcct

SEQ ID NO: 8576892 - DNA, 22 bp, Homo sapiens
tcagtgttggtcaagaatcagt

SEQ ID NO: 8576893 - DNA, 22 bp, Homo sapiens
tcagtgtttattcaatgttatt

SEQ ID NO: 8576894 - DNA, 22 bp, Homo sapiens
tcagtgtttaccgtatgttgtt

SEQ ID NO: 8576895 - DNA, 22 bp, Homo sapiens
tcagtgtttcagtttggaaatg

SEQ ID NO: 8576896 - DNA, 22 bp, Homo sapiens
tcagtgtttattgcggtgtgta

SEQ ID NO: 8576897 - DNA, 22 bp, Homo sapiens
tcagtgttggcattcagaaatg

SEQ ID NO: 8576898 - DNA, 22 bp, Homo sapiens
tcagtgttggagataattgcac

SEQ ID NO: 8576899 - DNA, 22 bp, Homo sapiens
tcagtgttgaattttttgcaaa

SEQ ID NO: 8576900 - DNA, 22 bp, Homo sapiens
tcagtgttcttatttaattagg

SEQ ID NO: 8576901 - DNA, 22 bp, Homo sapiens
tcagtgttctggatttggggca

SEQ ID NO: 8576902 - DNA, 22 bp, Homo sapiens
tcatgcaggaccaccccagcat

SEQ ID NO: 8576903 - DNA, 22 bp, Homo sapiens
tcatgcaggacttacaagagat

SEQ ID NO: 8576904 - DNA, 22 bp, Homo sapiens
tcatgcagcaatatgcattagg

SEQ ID NO: 8576905 - DNA, 23 bp, Homo sapiens
tcatgcagcctggaacctcccag

SEQ ID NO: 8576906 - DNA, 22 bp, Homo sapiens
tcatgcagcttttccattcagc

SEQ ID NO: 8576907 - DNA, 22 bp, Homo sapiens
tcatgcaggtttccagccagat

SEQ ID NO: 8576908 - DNA, 20 bp, Homo sapiens
tcatgcaggtgttctaggtt

SEQ ID NO: 8576909 - DNA, 22 bp, Homo sapiens
tcatgcaggcagcctttagtaa

SEQ ID NO: 8576910 - DNA, 21 bp, Homo sapiens
tcatgcaggcagagtttggta

SEQ ID NO: 8576911 - DNA, 22 bp, Homo sapiens
tcatgcaggacttacgagagat

SEQ ID NO: 8576912 - DNA, 22 bp, Homo sapiens
tcatgcagtgaatctttcttgc

SEQ ID NO: 8576913 - DNA, 19 bp, Homo sapiens
tcatgcagtggggggtgtg

SEQ ID NO: 8576914 - DNA, 22 bp, Homo sapiens
tcatgcagttactgttatgcaa

SEQ ID NO: 8576915 - DNA, 19 bp, Homo sapiens
tcatgcagtggggggtgtg

SEQ ID NO: 8576916 - DNA, 22 bp, Homo sapiens
tcatgcagttttgccacctaag

SEQ ID NO: 8576917 - DNA, 22 bp, Homo sapiens
tcatgcagtttgaagttcaggg

SEQ ID NO: 8576918 - DNA, 22 bp, Homo sapiens
tcatgcagtttcttatctgcca

SEQ ID NO: 8576919 - DNA, 22 bp, Homo sapiens
tcattgccatggcatttgcaga

SEQ ID NO: 8576920 - DNA, 22 bp, Homo sapiens
tcattgtcagctcttgacttct

SEQ ID NO: 8576921 - DNA, 22 bp, Homo sapiens
tcattgtcttgatatgattgtc

SEQ ID NO: 8576922 - DNA, 22 bp, Homo sapiens
tcattgttgcgttaatgtcttc

SEQ ID NO: 8576923 - DNA, 22 bp, Homo sapiens
tcattgttgacataccaagagc

SEQ ID NO: 8576924 - DNA, 22 bp, Homo sapiens
tcatttcagtggcacagaagat

SEQ ID NO: 8576925 - DNA, 22 bp, Homo sapiens
tcatttctcctaagtgaaatat

SEQ ID NO: 8576926 - DNA, 21 bp, Homo sapiens
tcatttctctatgtatttcac

SEQ ID NO: 8576927 - DNA, 22 bp, Homo sapiens
tcatttctgagccttccatgat

SEQ ID NO: 8576928 - DNA, 22 bp, Homo sapiens
tccaaaggccctaataagcttg

SEQ ID NO: 8576929 - DNA, 22 bp, Homo sapiens
tccaaaggggcagtgtccagcc

SEQ ID NO: 8576930 - DNA, 22 bp, Homo sapiens
tccaaaggaagaggctgtcagt

SEQ ID NO: 8576931 - DNA, 22 bp, Homo sapiens
tccaaagacttgctgtatgtaa

SEQ ID NO: 8576932 - DNA, 22 bp, Homo sapiens
tccaaagaacctggctactgtc

SEQ ID NO: 8576933 - DNA, 22 bp, Homo sapiens
tcatttttagcgcgcaaaagtt

SEQ ID NO: 8576934 - DNA, 22 bp, Homo sapiens
tccaaatattatgattatagga

SEQ ID NO: 8576935 - DNA, 22 bp, Homo sapiens
tcagctctgcctgtggaggcac

SEQ ID NO: 8576936 - DNA, 22 bp, Homo sapiens
tcagcaggcggttccttgtggg

SEQ ID NO: 8576937 - DNA, 22 bp, Homo sapiens
tcagcaggctctggttgaccat

SEQ ID NO: 8576938 - DNA, 22 bp, Homo sapiens
tcagcaggcccatcctccaggc

SEQ ID NO: 8576939 - DNA, 22 bp, Homo sapiens
tcagcaggcagtgggtcacaat

SEQ ID NO: 8576940 - DNA, 22 bp, Homo sapiens
tcagcaggcaggaggcatgcca

SEQ ID NO: 8576941 - DNA, 22 bp, Homo sapiens
tcagcagggaggctctgtgccc

SEQ ID NO: 8576942 - DNA, 22 bp, Homo sapiens
tcagcagggaggctctgtgccc

SEQ ID NO: 8576943 - DNA, 22 bp, Homo sapiens
tcagcagggagaggagaatgca

SEQ ID NO: 8576944 - DNA, 22 bp, Homo sapiens
tcagcaggctgtcagcaggggc

SEQ ID NO: 8576945 - DNA, 22 bp, Homo sapiens
tcagcagggccatgctctctct

SEQ ID NO: 8576946 - DNA, 22 bp, Homo sapiens
tcagcagggcatactgagccta

SEQ ID NO: 8576947 - DNA, 17 bp, Homo sapiens
tcagcaggggccaagct

SEQ ID NO: 8576948 - DNA, 22 bp, Homo sapiens
tcagcaggggccgttgggtgga

SEQ ID NO: 8576949 - DNA, 22 bp, Homo sapiens
tcagcagggctgggagctgtga

SEQ ID NO: 8576950 - DNA, 22 bp, Homo sapiens
tcagcagggcctccttgtgcag

SEQ ID NO: 8576951 - DNA, 22 bp, Homo sapiens
tcagacagagaagtacaatgag

SEQ ID NO: 8576952 - DNA, 22 bp, Homo sapiens
tcactgcaacctccacctcctg

SEQ ID NO: 8576953 - DNA, 22 bp, Homo sapiens
tcactgcaacctccacctcccg

SEQ ID NO: 8576954 - DNA, 22 bp, Homo sapiens
tcagaaaccagctctctcaatt

SEQ ID NO: 8576955 - DNA, 22 bp, Homo sapiens
tcagaaacactcttcttctgtc

SEQ ID NO: 8576956 - DNA, 22 bp, Homo sapiens
tcctgaggaaagttcatgaatg

SEQ ID NO: 8576957 - DNA, 22 bp, Homo sapiens
tcctgaggaccctgtcaggggc

SEQ ID NO: 8576958 - DNA, 22 bp, Homo sapiens
tcctgaggactaacaggaagga

SEQ ID NO: 8576959 - DNA, 22 bp, Homo sapiens
tcctgaggctaaagtgcagtgg

SEQ ID NO: 8576960 - DNA, 20 bp, Homo sapiens
tcctgagtgcagttggcttg

SEQ ID NO: 8576961 - DNA, 22 bp, Homo sapiens
tcctgaggcacaatcctagaat

SEQ ID NO: 8576962 - DNA, 22 bp, Homo sapiens
tcctgaggatggttgaagtgca

SEQ ID NO: 8576963 - DNA, 22 bp, Homo sapiens
tcctgaggcctctgtgatgtga

SEQ ID NO: 8576964 - DNA, 22 bp, Homo sapiens
tcctgaggccctgttagggtct

SEQ ID NO: 8576965 - DNA, 22 bp, Homo sapiens
tcctctggttatacttgcaccc

SEQ ID NO: 8576966 - DNA, 19 bp, Homo sapiens
tcctctggtaccacccttg

SEQ ID NO: 8576967 - DNA, 22 bp, Homo sapiens
tcctgcaggtggatgattctct

SEQ ID NO: 8576968 - DNA, 20 bp, Homo sapiens
tcctgcagtcgctagcgccc

SEQ ID NO: 8576969 - DNA, 18 bp, Homo sapiens
tcctgcagcttctatgta

SEQ ID NO: 8576970 - DNA, 22 bp, Homo sapiens
tcctgcaggcttgagtcctcag

SEQ ID NO: 8576971 - DNA, 22 bp, Homo sapiens
tcctgcaggcctgttcccagta

SEQ ID NO: 8576972 - DNA, 22 bp, Homo sapiens
tcctgcagctctgagaagcatc

SEQ ID NO: 8576973 - DNA, 22 bp, Homo sapiens
tcctgcagctgaagctcatgtg

SEQ ID NO: 8576974 - DNA, 22 bp, Homo sapiens
tcctgcagctgcagacctgggg

SEQ ID NO: 8576975 - DNA, 22 bp, Homo sapiens
tcctgcagacctcagtcaggtc

SEQ ID NO: 8576976 - DNA, 22 bp, Homo sapiens
tcctgcagagacagaggcctca

SEQ ID NO: 8576977 - DNA, 19 bp, Homo sapiens
tcctgcagaccagacctgt

SEQ ID NO: 8576978 - DNA, 22 bp, Homo sapiens
tcctgcagagtcccactgattt

SEQ ID NO: 8576979 - DNA, 23 bp, Homo sapiens
tcctgcagataagctggttgaca

SEQ ID NO: 8576980 - DNA, 22 bp, Homo sapiens
tcctgcagagccgccctcaggt

SEQ ID NO: 8576981 - DNA, 22 bp, Homo sapiens
tcctgcagccattagaggtcaa

SEQ ID NO: 8576982 - DNA, 22 bp, Homo sapiens
tcctgcagatcaaagcctttga

SEQ ID NO: 8576983 - DNA, 22 bp, Homo sapiens
tccctctggtcctcggtggaga

SEQ ID NO: 8576984 - DNA, 19 bp, Homo sapiens
tccctcagtctgccaggcc

SEQ ID NO: 8576985 - DNA, 22 bp, Homo sapiens
tccctcagtccctggacaggca

SEQ ID NO: 8576986 - DNA, 22 bp, Homo sapiens
tcctcacactatagatgaggat

SEQ ID NO: 8576987 - DNA, 22 bp, Homo sapiens
tcctcacagagtggcaggcaat

SEQ ID NO: 8576988 - DNA, 22 bp, Homo sapiens
tcctcacatggtgagccacaca

SEQ ID NO: 8576989 - DNA, 22 bp, Homo sapiens
tcctcagcaaacacttcactct

SEQ ID NO: 8576990 - DNA, 22 bp, Homo sapiens
tcctagggtaatcagcatacat

SEQ ID NO: 8576991 - DNA, 22 bp, Homo sapiens
tcctaggaagtggaggcacctg

SEQ ID NO: 8576992 - DNA, 22 bp, Homo sapiens
tccctggaggtgtttgctcagg

SEQ ID NO: 8576993 - DNA, 22 bp, Homo sapiens
tccctggcagctgtcctttcag

SEQ ID NO: 8576994 - DNA, 22 bp, Homo sapiens
tccctgggaccggcagctcaca

SEQ ID NO: 8576995 - DNA, 22 bp, Homo sapiens
tccaggtgtgctctgtgccctg

SEQ ID NO: 8576996 - DNA, 22 bp, Homo sapiens
tccagggcttgacagggtgcct

SEQ ID NO: 8576997 - DNA, 22 bp, Homo sapiens
tccagggcttggctgggacggt

SEQ ID NO: 8576998 - DNA, 22 bp, Homo sapiens
tccagggaagagcagaggctac

SEQ ID NO: 8576999 - DNA, 21 bp, Homo sapiens
tccagggaatttcaactttta

SEQ ID NO: 8577000 - DNA, 22 bp, Homo sapiens
tccagggaaggtgtgaggctgg

SEQ ID NO: 8577001 - DNA, 22 bp, Homo sapiens
tccagggctgacttgggagagg

SEQ ID NO: 8577002 - DNA, 22 bp, Homo sapiens
tccagggctgggttggctcagc

SEQ ID NO: 8577003 - DNA, 22 bp, Homo sapiens
tccagggctgttactttacata

SEQ ID NO: 8577004 - DNA, 22 bp, Homo sapiens
tcccaaagctactcttctgact

SEQ ID NO: 8577005 - DNA, 22 bp, Homo sapiens
tccatgggaagattttgagtgg

SEQ ID NO: 8577006 - DNA, 22 bp, Homo sapiens
tcccagagaagagctggatgga

SEQ ID NO: 8577007 - DNA, 22 bp, Homo sapiens
tcccagagacagagcctcctcc

SEQ ID NO: 8577008 - DNA, 22 bp, Homo sapiens
tcccagagcagtactccaggag

SEQ ID NO: 8577009 - DNA, 22 bp, Homo sapiens
tcccagagcagatgtgctaaag

SEQ ID NO: 8577010 - DNA, 22 bp, Homo sapiens
tcccagagccaagctatggatg

SEQ ID NO: 8577011 - DNA, 22 bp, Homo sapiens
tcccagagatttcctctccttc

SEQ ID NO: 8577012 - DNA, 22 bp, Homo sapiens
tcccagagacatcatttctccg

SEQ ID NO: 8577013 - DNA, 22 bp, Homo sapiens
tcccagcctggaccctgccagt

SEQ ID NO: 8577014 - DNA, 23 bp, Homo sapiens
tcccagcctcttctcttgcatac

SEQ ID NO: 8577015 - DNA, 22 bp, Homo sapiens
tcccagaggttgagtcacttat

SEQ ID NO: 8577016 - DNA, 22 bp, Homo sapiens
tcccagaggtctctgctggttc

SEQ ID NO: 8577017 - DNA, 22 bp, Homo sapiens
tcccagagtattagcaattgct

SEQ ID NO: 8577018 - DNA, 22 bp, Homo sapiens
tcccagaggctccagtctctat

SEQ ID NO: 8577019 - DNA, 22 bp, Homo sapiens
tcccagaggcagttggtaactt

SEQ ID NO: 8577020 - DNA, 22 bp, Homo sapiens
gagtaaatcgtcattgcagcat

SEQ ID NO: 8577021 - DNA, 22 bp, Homo sapiens
gaggtggatgttgcagtgagct

SEQ ID NO: 8577022 - DNA, 22 bp, Homo sapiens
gagggccagatcccaggaggaa

SEQ ID NO: 8577023 - DNA, 22 bp, Homo sapiens
gagggccagagtcctggggtca

SEQ ID NO: 8577024 - DNA, 22 bp, Homo sapiens
gaggctagatgtttgctgggag

SEQ ID NO: 8577025 - DNA, 22 bp, Homo sapiens
gaggctagagcaggggctcaat

SEQ ID NO: 8577026 - DNA, 19 bp, Homo sapiens
gaggcgaggcgtgcaggag

SEQ ID NO: 8577027 - DNA, 22 bp, Homo sapiens
gaggcctggaattccagcctgg

SEQ ID NO: 8577028 - DNA, 22 bp, Homo sapiens
gaggcctggaccagccacagag

SEQ ID NO: 8577029 - DNA, 22 bp, Homo sapiens
gaggcatggcctgaggctagga

SEQ ID NO: 8577030 - DNA, 22 bp, Homo sapiens
gaggcatggcctgaggctagga

SEQ ID NO: 8577031 - DNA, 22 bp, Homo sapiens
gaggcatgcagagctggagcag

SEQ ID NO: 8577032 - DNA, 22 bp, Homo sapiens
gaggcatgcagagctggagcag

SEQ ID NO: 8577033 - DNA, 22 bp, Homo sapiens
gaggagagaagctaacggtgct

SEQ ID NO: 8577034 - DNA, 22 bp, Homo sapiens
gagctcatccccatggtccgtc

SEQ ID NO: 8577035 - DNA, 22 bp, Homo sapiens
gagctcattcattcattgcctg

SEQ ID NO: 8577036 - DNA, 22 bp, Homo sapiens
gagctcattgtggatggatggg

SEQ ID NO: 8577037 - DNA, 22 bp, Homo sapiens
gagctccaccaccttcaggcag

SEQ ID NO: 8577038 - DNA, 22 bp, Homo sapiens
gagagcaggctctcgggggcca

SEQ ID NO: 8577039 - DNA, 22 bp, Homo sapiens
gagagcatgtggtctagtttta

SEQ ID NO: 8577040 - DNA, 22 bp, Homo sapiens
gagagcaggaggcagcgggacg

SEQ ID NO: 8577041 - DNA, 22 bp, Homo sapiens
gagagctgtaatagtcatgtct

SEQ ID NO: 8577042 - DNA, 22 bp, Homo sapiens
gagaaagggaacttacagagtg

SEQ ID NO: 8577043 - DNA, 19 bp, Homo sapiens
gactccaactttaagcatg

SEQ ID NO: 8577044 - DNA, 22 bp, Homo sapiens
gagaagccgagtcagctgagcc

SEQ ID NO: 8577045 - DNA, 23 bp, Homo sapiens
gagcagagcgggcgggggtcctg

SEQ ID NO: 8577046 - DNA, 22 bp, Homo sapiens
gagcagcttgcgctgtcttcac

SEQ ID NO: 8577047 - DNA, 22 bp, Homo sapiens
gacatcaattcagcattttaag

SEQ ID NO: 8577048 - DNA, 22 bp, Homo sapiens
gacatcatatcaggaggcatgt

SEQ ID NO: 8577049 - DNA, 22 bp, Homo sapiens
gacagcatctgtgtggcaggag

SEQ ID NO: 8577050 - DNA, 22 bp, Homo sapiens
gacagcatgagagatgccagtg

SEQ ID NO: 8577051 - DNA, 22 bp, Homo sapiens
gacagcattccatctgcaggtt

SEQ ID NO: 8577052 - DNA, 22 bp, Homo sapiens
gacagcatggtgtctgttcagg

SEQ ID NO: 8577053 - DNA, 22 bp, Homo sapiens
gacagctccttttggtgcatat

SEQ ID NO: 8577054 - DNA, 22 bp, Homo sapiens
gacaaagtcaacagtactctca

SEQ ID NO: 8577055 - DNA, 21 bp, Homo sapiens
gacaaagtgaagcaggcagga

SEQ ID NO: 8577056 - DNA, 22 bp, Homo sapiens
gacagcagccacagggagaggg

SEQ ID NO: 8577057 - DNA, 22 bp, Homo sapiens
gaatttacaagttgaataacaa

SEQ ID NO: 8577058 - DNA, 21 bp, Homo sapiens
gaagacaaatgggaatagctg

SEQ ID NO: 8577059 - DNA, 22 bp, Homo sapiens
gaatgctacttgactcagctca

SEQ ID NO: 8577060 - DNA, 22 bp, Homo sapiens
gaatgctattatttctgtgtgt

SEQ ID NO: 8577061 - DNA, 22 bp, Homo sapiens
gaattacagccagaagaatgaa

SEQ ID NO: 8577062 - DNA, 22 bp, Homo sapiens
ctgtggtgagcaactgactgaa

SEQ ID NO: 8577063 - DNA, 20 bp, Homo sapiens
ctgtggtgagcaggagagta

SEQ ID NO: 8577064 - DNA, 22 bp, Homo sapiens
ctgtgtttttggtctgatctat

SEQ ID NO: 8577065 - DNA, 22 bp, Homo sapiens
ctgtgttttgagatattattaa

SEQ ID NO: 8577066 - DNA, 22 bp, Homo sapiens
ctgtgtttgacaggcggtctcc

SEQ ID NO: 8577067 - DNA, 22 bp, Homo sapiens
ctgtgtttggacaacttttcag

SEQ ID NO: 8577068 - DNA, 22 bp, Homo sapiens
ctgtgtttctgagaagtgggga

SEQ ID NO: 8577069 - DNA, 22 bp, Homo sapiens
ctgtggctttctctgcctcctt

SEQ ID NO: 8577070 - DNA, 22 bp, Homo sapiens
ctgtggcttctaggtccccgat

SEQ ID NO: 8577071 - DNA, 22 bp, Homo sapiens
ctgtggcttctgggtcagttca

SEQ ID NO: 8577072 - DNA, 22 bp, Homo sapiens
ctgtggcttctgcttgggcctc

SEQ ID NO: 8577073 - DNA, 22 bp, Homo sapiens
ctgtggctttgcagggcttgtt

SEQ ID NO: 8577074 - DNA, 22 bp, Homo sapiens
ctgtgggctcctgcagctcagg

SEQ ID NO: 8577075 - DNA, 22 bp, Homo sapiens
ctgtggatttaggcagagctga

SEQ ID NO: 8577076 - DNA, 22 bp, Homo sapiens
ctgtccctctcacacctcacca

SEQ ID NO: 8577077 - DNA, 22 bp, Homo sapiens
ctggttttaatgttatgtttat

SEQ ID NO: 8577078 - DNA, 22 bp, Homo sapiens
ctggttttgtcagaagctttat

SEQ ID NO: 8577079 - DNA, 22 bp, Homo sapiens
ctggttaaatgaaaaagtatta

SEQ ID NO: 8577080 - DNA, 22 bp, Homo sapiens
ctgggttttattacagtgagct

SEQ ID NO: 8577081 - DNA, 22 bp, Homo sapiens
ctgggtttagggtctccccttg

SEQ ID NO: 8577082 - DNA, 22 bp, Homo sapiens
ctgggtgttgggtactgaccgt

SEQ ID NO: 8577083 - DNA, 22 bp, Homo sapiens
ctgggttctatttttggcttca

SEQ ID NO: 8577084 - DNA, 22 bp, Homo sapiens
ctgggttccatgtagccaagag

SEQ ID NO: 8577085 - DNA, 22 bp, Homo sapiens
ctgggtgtagatggaagtttgg

SEQ ID NO: 8577086 - DNA, 22 bp, Homo sapiens
ctgggtgtcaggagacatgatg

SEQ ID NO: 8577087 - DNA, 22 bp, Homo sapiens
ctgggtgtagcccagtatgagg

SEQ ID NO: 8577088 - DNA, 22 bp, Homo sapiens
ctgggtgttgggtactgaccgt

SEQ ID NO: 8577089 - DNA, 22 bp, Homo sapiens
ctgggctctagaaaggaaagaa

SEQ ID NO: 8577090 - DNA, 22 bp, Homo sapiens
ctgggatgatagtgctagtatt

SEQ ID NO: 8577091 - DNA, 22 bp, Homo sapiens
ctgggccagcaactgcaatgga

SEQ ID NO: 8577092 - DNA, 22 bp, Homo sapiens
ctgggcccacgagggctctggg

SEQ ID NO: 8577093 - DNA, 22 bp, Homo sapiens
ctgggctcagcaggccaaggcc

SEQ ID NO: 8577094 - DNA, 22 bp, Homo sapiens
ctgggctcaaatcctggccctg

SEQ ID NO: 8577095 - DNA, 22 bp, Homo sapiens
ctgggctcagtggctcatggct

SEQ ID NO: 8577096 - DNA, 22 bp, Homo sapiens
cttggactttagtctctctcca

SEQ ID NO: 8577097 - DNA, 22 bp, Homo sapiens
cttcaaatgtgattttaataac

SEQ ID NO: 8577098 - DNA, 22 bp, Homo sapiens
cttcaaatacaagtagattatg

SEQ ID NO: 8577099 - DNA, 22 bp, Homo sapiens
ctgttaaatgagaaagcagact

SEQ ID NO: 8577100 - DNA, 22 bp, Homo sapiens
cttcagaaactagtaacagcta

SEQ ID NO: 8577101 - DNA, 22 bp, Homo sapiens
ctttttctaatcataattgtct

SEQ ID NO: 8577102 - DNA, 22 bp, Homo sapiens
gaaacctttgccgatggggtcc

SEQ ID NO: 8577103 - DNA, 22 bp, Homo sapiens
gaaagaatgagcatcatgactt

SEQ ID NO: 8577104 - DNA, 22 bp, Homo sapiens
gaaagaatgctatagtgacttc

SEQ ID NO: 8577105 - DNA, 22 bp, Homo sapiens
gaagaagcctctgtggatctga

SEQ ID NO: 8577106 - DNA, 22 bp, Homo sapiens
gaaatattgggactcagagctt

SEQ ID NO: 8577107 - DNA, 22 bp, Homo sapiens
gaaatattgggactcagagctt

SEQ ID NO: 8577108 - DNA, 22 bp, Homo sapiens
gaaatattgtactggagatgtt

SEQ ID NO: 8577109 - DNA, 22 bp, Homo sapiens
gaaatatttctcttgagcccct

SEQ ID NO: 8577110 - DNA, 22 bp, Homo sapiens
gaaatattgtactggagatgtt

SEQ ID NO: 8577111 - DNA, 22 bp, Homo sapiens
gaaatattacagtggaggggat

SEQ ID NO: 8577112 - DNA, 22 bp, Homo sapiens
gaaatattacagtggaggggat

SEQ ID NO: 8577113 - DNA, 22 bp, Homo sapiens
gaaatattcttgtcttgttttc

SEQ ID NO: 8577114 - DNA, 22 bp, Homo sapiens
gaaatattcttgtcttgttttc

SEQ ID NO: 8577115 - DNA, 22 bp, Homo sapiens
gaaatacaggaatgccacacag

SEQ ID NO: 8577116 - DNA, 21 bp, Homo sapiens
ttctttctgaatctgaagtat

SEQ ID NO: 8577117 - DNA, 22 bp, Homo sapiens
ttctttctctactagcagagct

SEQ ID NO: 8577118 - DNA, 22 bp, Homo sapiens
ttctttctctgtaaaaggaaaa

SEQ ID NO: 8577119 - DNA, 22 bp, Homo sapiens
ttctttctgaatacagttgagt

SEQ ID NO: 8577120 - DNA, 22 bp, Homo sapiens
ttctggcttgacccctacttcc

SEQ ID NO: 8577121 - DNA, 22 bp, Homo sapiens
ttctggcttatcctaactctaa

SEQ ID NO: 8577122 - DNA, 18 bp, Homo sapiens
ttctggctcactcatgct

SEQ ID NO: 8577123 - DNA, 22 bp, Homo sapiens
ttctggctgcagtccctgtaat

SEQ ID NO: 8577124 - DNA, 22 bp, Homo sapiens
ttctggctgtatgatatttaat

SEQ ID NO: 8577125 - DNA, 22 bp, Homo sapiens
ttctggctctcccctgctgggt

SEQ ID NO: 8577126 - DNA, 22 bp, Homo sapiens
ttctggctgaaagtttatttga

SEQ ID NO: 8577127 - DNA, 22 bp, Homo sapiens
ttctggctccagatgcttctgt

SEQ ID NO: 8577128 - DNA, 22 bp, Homo sapiens
ctatacatcccaatttcagaga

SEQ ID NO: 8577129 - DNA, 22 bp, Homo sapiens
ctagaaagatacttaaatcaag

SEQ ID NO: 8577130 - DNA, 22 bp, Homo sapiens
ctaaaaatccacactaggtgaa

SEQ ID NO: 8577131 - DNA, 22 bp, Homo sapiens
ttggaaggaattaaggtcatga

SEQ ID NO: 8577132 - DNA, 22 bp, Homo sapiens
ttggaaggaccaggccttgatt

SEQ ID NO: 8577133 - DNA, 22 bp, Homo sapiens
ttggaaggaagaaccgcggtag

SEQ ID NO: 8577134 - DNA, 22 bp, Homo sapiens
ttggaaggagtcaaccagctga

SEQ ID NO: 8577135 - DNA, 19 bp, Homo sapiens
ttggaaggagccagagtgg

SEQ ID NO: 8577136 - DNA, 22 bp, Homo sapiens
ttggaaggcagcatttgtccat

SEQ ID NO: 8577137 - DNA, 22 bp, Homo sapiens
ttggaaggccctgcctagcagg

SEQ ID NO: 8577138 - DNA, 22 bp, Homo sapiens
ttggaaggccagcaccttgagt

SEQ ID NO: 8577139 - DNA, 22 bp, Homo sapiens
ttggaaggagtctttggggatg

SEQ ID NO: 8577140 - DNA, 22 bp, Homo sapiens
ttggaaggatttagagatgtct

SEQ ID NO: 8577141 - DNA, 22 bp, Homo sapiens
ctcagtccgtcccgctaggtgc

SEQ ID NO: 8577142 - DNA, 22 bp, Homo sapiens
ctcagtccttatttgcctctac

SEQ ID NO: 8577143 - DNA, 22 bp, Homo sapiens
ctcagtctcttgggctgtgaag

SEQ ID NO: 8577144 - DNA, 22 bp, Homo sapiens
ttggaaggttctggtcatggtt

SEQ ID NO: 8577145 - DNA, 22 bp, Homo sapiens
ttggaagggaaccgagtttgct

SEQ ID NO: 8577146 - DNA, 23 bp, Homo sapiens
ttggaagggaagagcatttgaga

SEQ ID NO: 8577147 - DNA, 22 bp, Homo sapiens
ttggaagggaacaccatttgac

SEQ ID NO: 8577148 - DNA, 22 bp, Homo sapiens
ttggaaggctgaatggcctctc

SEQ ID NO: 8577149 - DNA, 22 bp, Homo sapiens
ttggaagggatattggcatatg

SEQ ID NO: 8577150 - DNA, 22 bp, Homo sapiens
ttggaaggggcagagtggctgc

SEQ ID NO: 8577151 - DNA, 22 bp, Homo sapiens
ttggaagggtttcagttagtct

SEQ ID NO: 8577152 - DNA, 22 bp, Homo sapiens
ttggaaggtgagtccctgggtt

SEQ ID NO: 8577153 - DNA, 20 bp, Homo sapiens
ttggaaggtggagaagagga

SEQ ID NO: 8577154 - DNA, 20 bp, Homo sapiens
ttggagtctaaagactgggg

SEQ ID NO: 8577155 - DNA, 22 bp, Homo sapiens
ttgccctgcctccctgaggtga

SEQ ID NO: 8577156 - DNA, 22 bp, Homo sapiens
ttgccctgcagcggtgagtggt

SEQ ID NO: 8577157 - DNA, 22 bp, Homo sapiens
ttgccctgaagaacgtcccaga

SEQ ID NO: 8577158 - DNA, 16 bp, Homo sapiens
ttgccctgaggggagg

SEQ ID NO: 8577159 - DNA, 17 bp, Homo sapiens
ttgccctgatttttaac

SEQ ID NO: 8577160 - DNA, 22 bp, Homo sapiens
ttgccctggggctggcctggca

SEQ ID NO: 8577161 - DNA, 22 bp, Homo sapiens
ttgccctgcgggtcctgcgcaa

SEQ ID NO: 8577162 - DNA, 22 bp, Homo sapiens
ttgccctgcgttaccatctctt

SEQ ID NO: 8577163 - DNA, 22 bp, Homo sapiens
ttgccctgtcttaagctggcaa

SEQ ID NO: 8577164 - DNA, 22 bp, Homo sapiens
ttgccctgtctcactatgttaa

SEQ ID NO: 8577165 - DNA, 22 bp, Homo sapiens
ttgccctgtcagtagaagtgca

SEQ ID NO: 8577166 - DNA, 22 bp, Homo sapiens
ttgccctgtggggcctccagcc

SEQ ID NO: 8577167 - DNA, 22 bp, Homo sapiens
ttagcaaatatcttgaaacagg

SEQ ID NO: 8577168 - DNA, 22 bp, Homo sapiens
ttagttttcccatctttatggt

SEQ ID NO: 8577169 - DNA, 22 bp, Homo sapiens
ccttgcagacatcagtagtggc

SEQ ID NO: 8577170 - DNA, 22 bp, Homo sapiens
ttatcagttgtgtgtatacacg

SEQ ID NO: 8577171 - DNA, 23 bp, Homo sapiens
ttataaatattttcaggtgtgtt

SEQ ID NO: 8577172 - DNA, 22 bp, Homo sapiens
ttaaatagtaggtctattttgg

SEQ ID NO: 8577173 - DNA, 22 bp, Homo sapiens
ttaaattagtcaagcttctctg

SEQ ID NO: 8577174 - DNA, 22 bp, Homo sapiens
ttaaattagtcaagcttctctg

SEQ ID NO: 8577175 - DNA, 22 bp, Homo sapiens
ttaaattattgagggattgtca

SEQ ID NO: 8577176 - DNA, 22 bp, Homo sapiens
ttaaattattgagggattgtca

SEQ ID NO: 8577177 - DNA, 22 bp, Homo sapiens
ttaaattccagcctcataatag

SEQ ID NO: 8577178 - DNA, 22 bp, Homo sapiens
ttaaattatttctagtgaggtg

SEQ ID NO: 8577179 - DNA, 22 bp, Homo sapiens
ttaaattccagcctcataatag

SEQ ID NO: 8577180 - DNA, 21 bp, Homo sapiens
cctgtgtgtgtccctttaaga

SEQ ID NO: 8577181 - DNA, 18 bp, Homo sapiens
cctgtgtgtgttgcaggc

SEQ ID NO: 8577182 - DNA, 22 bp, Homo sapiens
cggagaggacctgcaactcgct

SEQ ID NO: 8577183 - DNA, 22 bp, Homo sapiens
cggagtcttgctatgttgccca

SEQ ID NO: 8577184 - DNA, 22 bp, Homo sapiens
cggagaggtgggggcagcatct

SEQ ID NO: 8577185 - DNA, 22 bp, Homo sapiens
cgtggctggtggacctgagggc

SEQ ID NO: 8577186 - DNA, 22 bp, Homo sapiens
ccttttttctatgccaactctg

SEQ ID NO: 8577187 - DNA, 22 bp, Homo sapiens
ccttttgctctcccatccagaa

SEQ ID NO: 8577188 - DNA, 22 bp, Homo sapiens
ctggaagggggacagccacaca

SEQ ID NO: 8577189 - DNA, 22 bp, Homo sapiens
ctggaaggggcagtctttgggc

SEQ ID NO: 8577190 - DNA, 22 bp, Homo sapiens
ctggaagggtacataggaaact

SEQ ID NO: 8577191 - DNA, 22 bp, Homo sapiens
ctggaaggctctgctgcctgtc

SEQ ID NO: 8577192 - DNA, 22 bp, Homo sapiens
ctggaagggaaatctcttggca

SEQ ID NO: 8577193 - DNA, 22 bp, Homo sapiens
ctggaagggagcactgtagaga

SEQ ID NO: 8577194 - DNA, 22 bp, Homo sapiens
ctggaaggcagaggttgcagtg

SEQ ID NO: 8577195 - DNA, 22 bp, Homo sapiens
ctggaaggcggaggttgtagtg

SEQ ID NO: 8577196 - DNA, 22 bp, Homo sapiens
ctggaaggagcccgggcggatc

SEQ ID NO: 8577197 - DNA, 19 bp, Homo sapiens
ctggaaggagggactgttc

SEQ ID NO: 8577198 - DNA, 22 bp, Homo sapiens
ctggaaggttcctcccagctcc

SEQ ID NO: 8577199 - DNA, 22 bp, Homo sapiens
ctggaaggtaacaaggccatta

SEQ ID NO: 8577200 - DNA, 22 bp, Homo sapiens
ctggaagggtctacttagcaga

SEQ ID NO: 8577201 - DNA, 22 bp, Homo sapiens
ctggaagggtcagagtgatgag

SEQ ID NO: 8577202 - DNA, 22 bp, Homo sapiens
ctggaaggtgactgtcttgaat

SEQ ID NO: 8577203 - DNA, 22 bp, Homo sapiens
ctggaaggtggatggcgaggcc

SEQ ID NO: 8577204 - DNA, 22 bp, Homo sapiens
ctggaaggtctgtccccactgc

SEQ ID NO: 8577205 - DNA, 22 bp, Homo sapiens
ctggaaagtcaggtcagaaact

SEQ ID NO: 8577206 - DNA, 22 bp, Homo sapiens
ctggaaggagaaggaggctgtg

SEQ ID NO: 8577207 - DNA, 22 bp, Homo sapiens
ctgcctttgcccttgacactgt

SEQ ID NO: 8577208 - DNA, 22 bp, Homo sapiens
ctcttcttatggccgtggctga

SEQ ID NO: 8577209 - DNA, 22 bp, Homo sapiens
ctcttcctagtgtgcagcgtgg

SEQ ID NO: 8577210 - DNA, 22 bp, Homo sapiens
ctcttcctacagtctgctatgc

SEQ ID NO: 8577211 - DNA, 22 bp, Homo sapiens
ctgaggctgaagagggcctacg

SEQ ID NO: 8577212 - DNA, 22 bp, Homo sapiens
ctgaggctgcccagggccaggt

SEQ ID NO: 8577213 - DNA, 22 bp, Homo sapiens
ctgcccctgccaggcagctgtc

SEQ ID NO: 8577214 - DNA, 22 bp, Homo sapiens
ctgcccaggaaggagaggatgg

SEQ ID NO: 8577215 - DNA, 21 bp, Homo sapiens
ctgcaggatgctgaagccagg

SEQ ID NO: 8577216 - DNA, 22 bp, Homo sapiens
ctgcaggagcaaagcctctgct

SEQ ID NO: 8577217 - DNA, 20 bp, Homo sapiens
ctgcccagccactgagggat

SEQ ID NO: 8577218 - DNA, 22 bp, Homo sapiens
tttgaaagaatttatgtacttt

SEQ ID NO: 8577219 - DNA, 22 bp, Homo sapiens
ctctgcaacttctagcagtgtc

SEQ ID NO: 8577220 - DNA, 22 bp, Homo sapiens
tttgcaaacacttaagaagaga

SEQ ID NO: 8577221 - DNA, 22 bp, Homo sapiens
tttgcaaagtgcttgcagagta

SEQ ID NO: 8577222 - DNA, 18 bp, Homo sapiens
tttgcaaaggaagtatgg

SEQ ID NO: 8577223 - DNA, 22 bp, Homo sapiens
ttttgcctaagaatctctctga

SEQ ID NO: 8577224 - DNA, 22 bp, Homo sapiens
ctctggttgcagctgaagttcc

SEQ ID NO: 8577225 - DNA, 19 bp, Homo sapiens
ctctgggctgcatcttggt

SEQ ID NO: 8577226 - DNA, 22 bp, Homo sapiens
ctctggctccatttccctatgt

SEQ ID NO: 8577227 - DNA, 22 bp, Homo sapiens
ctctggctcccgcagcccccat

SEQ ID NO: 8577228 - DNA, 22 bp, Homo sapiens
tttctcaaaagacagaagtgaa

SEQ ID NO: 8577229 - DNA, 22 bp, Homo sapiens
tttattcacttcagtgccaaag

SEQ ID NO: 8577230 - DNA, 22 bp, Homo sapiens
tgaggcagtgatgtttaagcac

SEQ ID NO: 8577231 - DNA, 18 bp, Homo sapiens
tgaggcagtcagtgatgg

SEQ ID NO: 8577232 - DNA, 22 bp, Homo sapiens
tgaggcagtgatgtttaagcac

SEQ ID NO: 8577233 - DNA, 22 bp, Homo sapiens
tgatacataaaccatcattttg

SEQ ID NO: 8577234 - DNA, 22 bp, Homo sapiens
ccagtgttacggcttgaactat

SEQ ID NO: 8577235 - DNA, 22 bp, Homo sapiens
ccagtgttattttagagtgtga

SEQ ID NO: 8577236 - DNA, 22 bp, Homo sapiens
ccagtgttagagactgatacag

SEQ ID NO: 8577237 - DNA, 22 bp, Homo sapiens
ccagtgttcaatacatatttgt

SEQ ID NO: 8577238 - DNA, 22 bp, Homo sapiens
ccagtgttcagtatgcattaag

SEQ ID NO: 8577239 - DNA, 22 bp, Homo sapiens
ccagtgttcatcaagaaaatgt

SEQ ID NO: 8577240 - DNA, 22 bp, Homo sapiens
ccagtgttcataattttacact

SEQ ID NO: 8577241 - DNA, 22 bp, Homo sapiens
ccagtgtgggcccggcctcctc

SEQ ID NO: 8577242 - DNA, 22 bp, Homo sapiens
ccagtgtgttccctgcctcact

SEQ ID NO: 8577243 - DNA, 23 bp, Homo sapiens
ccagtgtggtaggtccacaggtg

SEQ ID NO: 8577244 - DNA, 22 bp, Homo sapiens
ccagtgtggtaggtccacaggt

SEQ ID NO: 8577245 - DNA, 22 bp, Homo sapiens
tgaggcagtcaccccctcctgc

SEQ ID NO: 8577246 - DNA, 22 bp, Homo sapiens
tgaggcagtattttagtgactt

SEQ ID NO: 8577247 - DNA, 22 bp, Homo sapiens
tgaggcaggtaagcaagttttg

SEQ ID NO: 8577248 - DNA, 22 bp, Homo sapiens
tgaggcaggtggattacaaggt

SEQ ID NO: 8577249 - DNA, 22 bp, Homo sapiens
tgaggcagtattctccattcca

SEQ ID NO: 8577250 - DNA, 19 bp, Homo sapiens
cccaacttgactattttct

SEQ ID NO: 8577251 - DNA, 22 bp, Homo sapiens
cccagagactttgtccgacgac

SEQ ID NO: 8577252 - DNA, 22 bp, Homo sapiens
cccagagagcacaggtggtggg

SEQ ID NO: 8577253 - DNA, 19 bp, Homo sapiens
cccagagagatctcttgcc

SEQ ID NO: 8577254 - DNA, 22 bp, Homo sapiens
cccagagagcatttggacaaag

SEQ ID NO: 8577255 - DNA, 22 bp, Homo sapiens
cccagagaggtaaaacagcctt

SEQ ID NO: 8577256 - DNA, 22 bp, Homo sapiens
cccagagagctttctttgtgct

SEQ ID NO: 8577257 - DNA, 22 bp, Homo sapiens
cccagagatctactgagcccag

SEQ ID NO: 8577258 - DNA, 22 bp, Homo sapiens
cccagaggtgaaggaggtggga

SEQ ID NO: 8577259 - DNA, 17 bp, Homo sapiens
cccagagatgctgcctt

SEQ ID NO: 8577260 - DNA, 22 bp, Homo sapiens
cccagagatcttgtcctttcca

SEQ ID NO: 8577261 - DNA, 22 bp, Homo sapiens
cccagagaaccttctgtgccac

SEQ ID NO: 8577262 - DNA, 22 bp, Homo sapiens
cccagagaagtgaagtgacttg

SEQ ID NO: 8577263 - DNA, 22 bp, Homo sapiens
cccagagaatctttcagaaagg

SEQ ID NO: 8577264 - DNA, 22 bp, Homo sapiens
cccagagaattccacatagagg

SEQ ID NO: 8577265 - DNA, 22 bp, Homo sapiens
tgattcaactttcttgaatgca

SEQ ID NO: 8577266 - DNA, 22 bp, Homo sapiens
tgcatatcttcaatgctgttgc

SEQ ID NO: 8577267 - DNA, 22 bp, Homo sapiens
tgcatatccacaccttatctct

SEQ ID NO: 8577268 - DNA, 21 bp, Homo sapiens
tgcatatataagtgcatacac

SEQ ID NO: 8577269 - DNA, 22 bp, Homo sapiens
tgcagcagtttaatgcagggtt

SEQ ID NO: 8577270 - DNA, 19 bp, Homo sapiens
ccaggcctggcgtctccgc

SEQ ID NO: 8577271 - DNA, 17 bp, Homo sapiens
ccaggctataccaggct

SEQ ID NO: 8577272 - DNA, 22 bp, Homo sapiens
ccagcctcactggcatcaccta

SEQ ID NO: 8577273 - DNA, 22 bp, Homo sapiens
ccagcccttgaggtctgtccat

SEQ ID NO: 8577274 - DNA, 22 bp, Homo sapiens
tgaacagatgccttctcccatg

SEQ ID NO: 8577275 - DNA, 22 bp, Homo sapiens
tgaagatctgtcaaccccatat

SEQ ID NO: 8577276 - DNA, 22 bp, Homo sapiens
tgaagatcctatctgcaaatat

SEQ ID NO: 8577277 - DNA, 22 bp, Homo sapiens
tgaagatattttaaaatactga

SEQ ID NO: 8577278 - DNA, 22 bp, Homo sapiens
tgaagatttccaccaaatcaca

SEQ ID NO: 8577279 - DNA, 22 bp, Homo sapiens
tgaagctttaggatgggttcat

SEQ ID NO: 8577280 - DNA, 22 bp, Homo sapiens
tgaccactgaatatgactgcct

SEQ ID NO: 8577281 - DNA, 22 bp, Homo sapiens
tgaccacagacccaatgactac

SEQ ID NO: 8577282 - DNA, 22 bp, Homo sapiens
ccaggctttcccagcctctcca

SEQ ID NO: 8577283 - DNA, 22 bp, Homo sapiens
ccagggaaaggaggttgacttg

SEQ ID NO: 8577284 - DNA, 21 bp, Homo sapiens
ccagggaagaaatgagggcag

SEQ ID NO: 8577285 - DNA, 22 bp, Homo sapiens
ccagggcatgggaagaactgaa

SEQ ID NO: 8577286 - DNA, 22 bp, Homo sapiens
ccagggcatgggaagaactgaa

SEQ ID NO: 8577287 - DNA, 22 bp, Homo sapiens
ccagggcatgtaactaatggtg

SEQ ID NO: 8577288 - DNA, 22 bp, Homo sapiens
ccaggtccctggaatttatgag

SEQ ID NO: 8577289 - DNA, 22 bp, Homo sapiens
ccaggtcctgttttcaccacag

SEQ ID NO: 8577290 - DNA, 22 bp, Homo sapiens
ccagtgtggccaggtgctggta

SEQ ID NO: 8577291 - DNA, 23 bp, Homo sapiens
ccctgcagtcagggtgagatggt

SEQ ID NO: 8577292 - DNA, 22 bp, Homo sapiens
ccctgcagagagtgcttttgtg

SEQ ID NO: 8577293 - DNA, 22 bp, Homo sapiens
ccctgcagagaccactgacctt

SEQ ID NO: 8577294 - DNA, 22 bp, Homo sapiens
ccctgcagcattctctaactgg

SEQ ID NO: 8577295 - DNA, 22 bp, Homo sapiens
ccctgcagatctagggtccttc

SEQ ID NO: 8577296 - DNA, 22 bp, Homo sapiens
ccctgcagatcagtgagaactt

SEQ ID NO: 8577297 - DNA, 22 bp, Homo sapiens
ccctgcagagccagccctgacc

SEQ ID NO: 8577298 - DNA, 22 bp, Homo sapiens
tggaggtctgcaaggcgctgga

SEQ ID NO: 8577299 - DNA, 19 bp, Homo sapiens
tggaggtccaggagtaggg

SEQ ID NO: 8577300 - DNA, 22 bp, Homo sapiens
tggaggtcgctagcgagcgggc

SEQ ID NO: 8577301 - DNA, 22 bp, Homo sapiens
tggaaggctttgctgtccttgc

SEQ ID NO: 8577302 - DNA, 22 bp, Homo sapiens
tggaaggcttggaatacttcca

SEQ ID NO: 8577303 - DNA, 22 bp, Homo sapiens
tggaagggaacaggtgggtgtt

SEQ ID NO: 8577304 - DNA, 22 bp, Homo sapiens
tggaaggcctgttgtgtcctag

SEQ ID NO: 8577305 - DNA, 22 bp, Homo sapiens
tggaaggctgtgattactgtgc

SEQ ID NO: 8577306 - DNA, 22 bp, Homo sapiens
tggaaggcaggacctgccttgg

SEQ ID NO: 8577307 - DNA, 22 bp, Homo sapiens
tggaaggcagtgatattgttga

SEQ ID NO: 8577308 - DNA, 20 bp, Homo sapiens
tggaaggcatctgcattatt

SEQ ID NO: 8577309 - DNA, 21 bp, Homo sapiens
ccctggttccactgtcaccgc

SEQ ID NO: 8577310 - DNA, 22 bp, Homo sapiens
ccctggttcaggtttctctgaa

SEQ ID NO: 8577311 - DNA, 22 bp, Homo sapiens
ccggcgggcagcggcagtgagc

SEQ ID NO: 8577312 - DNA, 22 bp, Homo sapiens
ccggcgggcgcggtgacgtcag

SEQ ID NO: 8577313 - DNA, 22 bp, Homo sapiens
ccgggttgaggttcccatagat

SEQ ID NO: 8577314 - DNA, 23 bp, Homo sapiens
ccgtgaagacagacagacagcag

SEQ ID NO: 8577315 - DNA, 22 bp, Homo sapiens
cctctttgtgcctgcaggctgc

SEQ ID NO: 8577316 - DNA, 22 bp, Homo sapiens
cctctttgactctcaggtcttt

SEQ ID NO: 8577317 - DNA, 22 bp, Homo sapiens
cctctttgacaagtacctgccc

SEQ ID NO: 8577318 - DNA, 22 bp, Homo sapiens
cctctggcaacttcacagccca

SEQ ID NO: 8577319 - DNA, 23 bp, Homo sapiens
tggctctctcagtgctgcagagg

SEQ ID NO: 8577320 - DNA, 22 bp, Homo sapiens
cctccctgcgctcctgcggcgg

SEQ ID NO: 8577321 - DNA, 21 bp, Homo sapiens
tgggagagcgttgctgtcctc

SEQ ID NO: 8577322 - DNA, 22 bp, Homo sapiens
cctgacaggagaagcgcagcat

SEQ ID NO: 8577323 - DNA, 22 bp, Homo sapiens
cctgaccacccttggacaaggt

SEQ ID NO: 8577324 - DNA, 22 bp, Homo sapiens
cctgaccatttgccacatgggt

SEQ ID NO: 8577325 - DNA, 22 bp, Homo sapiens
cctgaggccctggctgtgctga

SEQ ID NO: 8577326 - DNA, 22 bp, Homo sapiens
cctgagctggcagtgacctgga

SEQ ID NO: 8577327 - DNA, 22 bp, Homo sapiens
cctgagctggcagtgacctgga

SEQ ID NO: 8577328 - DNA, 22 bp, Homo sapiens
cctgaggcttgggagttccgcc

SEQ ID NO: 8577329 - DNA, 22 bp, Homo sapiens
cctgcaagagcggagaagccag

SEQ ID NO: 8577330 - DNA, 22 bp, Homo sapiens
cctgattattgtaaatatattt

SEQ ID NO: 8577331 - DNA, 22 bp, Homo sapiens
tggggtacttgtatcaaagcac

SEQ ID NO: 8577332 - DNA, 22 bp, Homo sapiens
taggacataagtattctaactt

SEQ ID NO: 8577333 - DNA, 22 bp, Homo sapiens
taggaacatatgcagtgctttt

SEQ ID NO: 8577334 - DNA, 22 bp, Homo sapiens
taggaacaagtttccttgctgt

SEQ ID NO: 8577335 - DNA, 22 bp, Homo sapiens
taggactgataaggggccagag

SEQ ID NO: 8577336 - DNA, 22 bp, Homo sapiens
cagggcggggtctgccggccct

SEQ ID NO: 8577337 - DNA, 22 bp, Homo sapiens
tagggacaaagagctgaggcct

SEQ ID NO: 8577338 - DNA, 22 bp, Homo sapiens
cagggctttcctgagaagtgat

SEQ ID NO: 8577339 - DNA, 22 bp, Homo sapiens
tagcaatgtgtgtgtataaatt

SEQ ID NO: 8577340 - DNA, 21 bp, Homo sapiens
cagggcaaccaagtccagaga

SEQ ID NO: 8577341 - DNA, 22 bp, Homo sapiens
cagggcaaagagagcacatgct

SEQ ID NO: 8577342 - DNA, 22 bp, Homo sapiens
cagggcaaagtcttctagaacc

SEQ ID NO: 8577343 - DNA, 22 bp, Homo sapiens
cagggcaagtttgagattattt

SEQ ID NO: 8577344 - DNA, 22 bp, Homo sapiens
caggctgggcagcctccccggc

SEQ ID NO: 8577345 - DNA, 22 bp, Homo sapiens
caggctgggcagcctccccggc

SEQ ID NO: 8577346 - DNA, 22 bp, Homo sapiens
caggctgggctccggagataaa

SEQ ID NO: 8577347 - DNA, 22 bp, Homo sapiens
caggctgggctggtgttagagt

SEQ ID NO: 8577348 - DNA, 22 bp, Homo sapiens
caggctggtcccagagcattgc

SEQ ID NO: 8577349 - DNA, 22 bp, Homo sapiens
caggctggtcccagagcattgc

SEQ ID NO: 8577350 - DNA, 22 bp, Homo sapiens
caggctggagtacaattgtgtg

SEQ ID NO: 8577351 - DNA, 22 bp, Homo sapiens
caggctggagtgcaatggtgct

SEQ ID NO: 8577352 - DNA, 22 bp, Homo sapiens
caggctggagtgcaatggcaca

SEQ ID NO: 8577353 - DNA, 22 bp, Homo sapiens
caggctggagtgagtgtagtgg

SEQ ID NO: 8577354 - DNA, 22 bp, Homo sapiens
caggctggagtgcaatgacgcc

SEQ ID NO: 8577355 - DNA, 22 bp, Homo sapiens
tagaatagtgttttcattatgg

SEQ ID NO: 8577356 - DNA, 22 bp, Homo sapiens
caggctggagtgcagtggcgct

SEQ ID NO: 8577357 - DNA, 22 bp, Homo sapiens
caggctggagtgcagtggcgcc

SEQ ID NO: 8577358 - DNA, 22 bp, Homo sapiens
caggctggagtgcagtggggcg

SEQ ID NO: 8577359 - DNA, 22 bp, Homo sapiens
tactcaaaaagttatgaatcat

SEQ ID NO: 8577360 - DNA, 22 bp, Homo sapiens
tactcaaactcactaagacaga

SEQ ID NO: 8577361 - DNA, 22 bp, Homo sapiens
tactcaaactcactaagacaga

SEQ ID NO: 8577362 - DNA, 22 bp, Homo sapiens
cagtgtgacttctgagctgcca

SEQ ID NO: 8577363 - DNA, 22 bp, Homo sapiens
cagtgtttgtggaattcaggtg

SEQ ID NO: 8577364 - DNA, 22 bp, Homo sapiens
tcagagaaaggccaaaatatca

SEQ ID NO: 8577365 - DNA, 21 bp, Homo sapiens
cagtgggctgctgcgctccag

SEQ ID NO: 8577366 - DNA, 22 bp, Homo sapiens
cagtggggtttctgtgggtgct

SEQ ID NO: 8577367 - DNA, 23 bp, Homo sapiens
cagtgggcttctaactgctcctg

SEQ ID NO: 8577368 - DNA, 22 bp, Homo sapiens
cataaattgtacccattccaac

SEQ ID NO: 8577369 - DNA, 22 bp, Homo sapiens
cataaattcagttctgcctctt

SEQ ID NO: 8577370 - DNA, 22 bp, Homo sapiens
tcagcttttgtcagaaattgta

SEQ ID NO: 8577371 - DNA, 22 bp, Homo sapiens
cagtgaagttctactgaatggt

SEQ ID NO: 8577372 - DNA, 22 bp, Homo sapiens
cagtgagataccacagagcaaa

SEQ ID NO: 8577373 - DNA, 22 bp, Homo sapiens
caggttcccttgcagctaagtg

SEQ ID NO: 8577374 - DNA, 22 bp, Homo sapiens
caggttccctagcagcaaagcc

SEQ ID NO: 8577375 - DNA, 22 bp, Homo sapiens
caggttcagcaggaggcatccc

SEQ ID NO: 8577376 - DNA, 22 bp, Homo sapiens
catgtgttttgtcatttcaata

SEQ ID NO: 8577377 - DNA, 22 bp, Homo sapiens
catgtgtttcgagactgttgag

SEQ ID NO: 8577378 - DNA, 22 bp, Homo sapiens
catgtgttaatctttctgcaaa

SEQ ID NO: 8577379 - DNA, 22 bp, Homo sapiens
catgtgttaatctttctgcaaa

SEQ ID NO: 8577380 - DNA, 22 bp, Homo sapiens
tccacagtggttgaactagttt

SEQ ID NO: 8577381 - DNA, 22 bp, Homo sapiens
tccacagtggttgaactagtaa

SEQ ID NO: 8577382 - DNA, 20 bp, Homo sapiens
tccaagccctccttccattc

SEQ ID NO: 8577383 - DNA, 22 bp, Homo sapiens
tccacagggcctttctggtgtg

SEQ ID NO: 8577384 - DNA, 18 bp, Homo sapiens
tcatgaggtagaggctgg

SEQ ID NO: 8577385 - DNA, 22 bp, Homo sapiens
tcccagagctctgacaccagct

SEQ ID NO: 8577386 - DNA, 22 bp, Homo sapiens
tcccagagctctggaggttgga

SEQ ID NO: 8577387 - DNA, 22 bp, Homo sapiens
tcccagagctgataagccttta

SEQ ID NO: 8577388 - DNA, 22 bp, Homo sapiens
tcccagaggaaatggcagctga

SEQ ID NO: 8577389 - DNA, 22 bp, Homo sapiens
tcccagaggactgttggtgcta

SEQ ID NO: 8577390 - DNA, 22 bp, Homo sapiens
tcccagagcctctgccactctg

SEQ ID NO: 8577391 - DNA, 22 bp, Homo sapiens
tcccagagcccaagttggagag

SEQ ID NO: 8577392 - DNA, 22 bp, Homo sapiens
cattgcaacttcaaactcctgg

SEQ ID NO: 8577393 - DNA, 22 bp, Homo sapiens
cattgaaatatggaaactgatg

SEQ ID NO: 8577394 - DNA, 22 bp, Homo sapiens
tcctcagctttggtttactcat

SEQ ID NO: 8577395 - DNA, 22 bp, Homo sapiens
tcctcagcttttatttcacttg

SEQ ID NO: 8577396 - DNA, 19 bp, Homo sapiens
ccagccctgtcacttcttg

SEQ ID NO: 8577397 - DNA, 19 bp, Homo sapiens
ccagcaggttcatttcagg

SEQ ID NO: 8577398 - DNA, 22 bp, Homo sapiens
ccagcagggttggtttcttctg

SEQ ID NO: 8577399 - DNA, 22 bp, Homo sapiens
ccagcaggtgtagggctcatgg

SEQ ID NO: 8577400 - DNA, 22 bp, Homo sapiens
ccagcagggcagtgccctggac

SEQ ID NO: 8577401 - DNA, 22 bp, Homo sapiens
tctcctggctcaccaggctgga

SEQ ID NO: 8577402 - DNA, 22 bp, Homo sapiens
tctctgatctttaattcagata

SEQ ID NO: 8577403 - DNA, 21 bp, Homo sapiens
tctctgggaggacttgtgaga

SEQ ID NO: 8577404 - DNA, 22 bp, Homo sapiens
ccacatctggtggccagtgcta

SEQ ID NO: 8577405 - DNA, 19 bp, Homo sapiens
ccactttgcttctctgggt

SEQ ID NO: 8577406 - DNA, 22 bp, Homo sapiens
tctccctctttgtctgctttgg

SEQ ID NO: 8577407 - DNA, 22 bp, Homo sapiens
tttttacacttagcattgagcg

SEQ ID NO: 8577408 - DNA, 22 bp, Homo sapiens
tttttacagtcatggtcactca

SEQ ID NO: 8577409 - DNA, 22 bp, Homo sapiens
tttttatctacagattctcagc

SEQ ID NO: 8577410 - DNA, 22 bp, Homo sapiens
tttcttttacagtgtggctatt

SEQ ID NO: 8577411 - DNA, 22 bp, Homo sapiens
tttcttttgaatagtgtgtggt

SEQ ID NO: 8577412 - DNA, 22 bp, Homo sapiens
tttcttttgccctgtgggttag

SEQ ID NO: 8577413 - DNA, 22 bp, Homo sapiens
tttcctcctagcctccagccgc

SEQ ID NO: 8577414 - DNA, 22 bp, Homo sapiens
tttcctcctagcctccagccgc

SEQ ID NO: 8577415 - DNA, 22 bp, Homo sapiens
tttcctctgactgctcccctgc

SEQ ID NO: 8577416 - DNA, 17 bp, Homo sapiens
tttgaaaggatgtcagt

SEQ ID NO: 8577417 - DNA, 22 bp, Homo sapiens
tttgaagagccacagtgaaatt

SEQ ID NO: 8577418 - DNA, 22 bp, Homo sapiens
tttgcttttgtgctctagtggt

SEQ ID NO: 8577419 - DNA, 22 bp, Homo sapiens
tttgcttttgtgctctagtggt

SEQ ID NO: 8577420 - DNA, 22 bp, Homo sapiens
tttgaggttagctagcagatca

SEQ ID NO: 8577421 - DNA, 22 bp, Homo sapiens
tttgagttgcttatttaatagg

SEQ ID NO: 8577422 - DNA, 22 bp, Homo sapiens
tttgataattaaaaattgtagt

SEQ ID NO: 8577423 - DNA, 22 bp, Homo sapiens
ttttaacttaaaatacatagat

SEQ ID NO: 8577424 - DNA, 22 bp, Homo sapiens
ttttattatctttgaatgggac

SEQ ID NO: 8577425 - DNA, 22 bp, Homo sapiens
ttttcattgttactatgagcta

SEQ ID NO: 8577426 - DNA, 22 bp, Homo sapiens
ttttcattagaatgactgagaa

SEQ ID NO: 8577427 - DNA, 22 bp, Homo sapiens
ttttcatgtcatgtccttgagg

SEQ ID NO: 8577428 - DNA, 22 bp, Homo sapiens
ttttcttatgtgcagctatatg

SEQ ID NO: 8577429 - DNA, 22 bp, Homo sapiens
ttttcttatggtgaagcacaaa

SEQ ID NO: 8577430 - DNA, 22 bp, Homo sapiens
ttttcttatagagcttaaagtt

SEQ ID NO: 8577431 - DNA, 22 bp, Homo sapiens
ttttcttaggtgctccaagtag

SEQ ID NO: 8577432 - DNA, 22 bp, Homo sapiens
ttttcttactgtctgtgatcct

SEQ ID NO: 8577433 - DNA, 20 bp, Homo sapiens
ttttctgtgccaagaaaact

SEQ ID NO: 8577434 - DNA, 22 bp, Homo sapiens
ttttctgtgattctgaggttgg

SEQ ID NO: 8577435 - DNA, 22 bp, Homo sapiens
ttttctgcctgcgtgtttagga

SEQ ID NO: 8577436 - DNA, 21 bp, Homo sapiens
ttttctggagtatgtctcctc

SEQ ID NO: 8577437 - DNA, 22 bp, Homo sapiens
ttttctggtcacatgttattaa

SEQ ID NO: 8577438 - DNA, 22 bp, Homo sapiens
ttttcatttttgtagatgcaag

SEQ ID NO: 8577439 - DNA, 23 bp, Homo sapiens
ttgtatttttagtagagacaggg

SEQ ID NO: 8577440 - DNA, 22 bp, Homo sapiens
ttgtatttcgatgcacgtgtag

SEQ ID NO: 8577441 - DNA, 22 bp, Homo sapiens
ttgtggctgtgcaccgctgcct

SEQ ID NO: 8577442 - DNA, 22 bp, Homo sapiens
ttgtggctcatcttcagctccc

SEQ ID NO: 8577443 - DNA, 22 bp, Homo sapiens
ttgcagcttctaacagcttcag

SEQ ID NO: 8577444 - DNA, 22 bp, Homo sapiens
ttgcagcttcttgcatcagaaa

SEQ ID NO: 8577445 - DNA, 22 bp, Homo sapiens
ttggaaatgatttctattatta

SEQ ID NO: 8577446 - DNA, 22 bp, Homo sapiens
ttggaaatacgagtagtatcat

SEQ ID NO: 8577447 - DNA, 22 bp, Homo sapiens
ttggaaatgcaaatatattgaa

SEQ ID NO: 8577448 - DNA, 22 bp, Homo sapiens
ttggaaatggctgtagttatga

SEQ ID NO: 8577449 - DNA, 22 bp, Homo sapiens
ttggaaatgtagaaaagcagat

SEQ ID NO: 8577450 - DNA, 22 bp, Homo sapiens
ttgctttcccaaggcagaacat

SEQ ID NO: 8577451 - DNA, 22 bp, Homo sapiens
ttgcttcagaagttctgcttgt

SEQ ID NO: 8577452 - DNA, 22 bp, Homo sapiens
tttattctagctcagaatagtt

SEQ ID NO: 8577453 - DNA, 22 bp, Homo sapiens
tttcaaaggttttgtcatgtct

SEQ ID NO: 8577454 - DNA, 22 bp, Homo sapiens
tttcaaaggtggaagagtgaat

SEQ ID NO: 8577455 - DNA, 19 bp, Homo sapiens
tttcaaagggcataagcct

SEQ ID NO: 8577456 - DNA, 23 bp, Homo sapiens
tttcacaatgagcattacagaat

SEQ ID NO: 8577457 - DNA, 20 bp, Homo sapiens
tttcacaatgaacatgtctc

SEQ ID NO: 8577458 - DNA, 20 bp, Homo sapiens
tttcacaatgaacatgtctc

SEQ ID NO: 8577459 - DNA, 22 bp, Homo sapiens
tttcatgcacaaatgagcaagg

SEQ ID NO: 8577460 - DNA, 22 bp, Homo sapiens
tttcatcttccttggcataggt

SEQ ID NO: 8577461 - DNA, 22 bp, Homo sapiens
tttcagagctctaggctctcag

SEQ ID NO: 8577462 - DNA, 22 bp, Homo sapiens
tttcagagaggcttcaaatctt

SEQ ID NO: 8577463 - DNA, 22 bp, Homo sapiens
tttcagagaattagaagctgat

SEQ ID NO: 8577464 - DNA, 22 bp, Homo sapiens
tttcagagcctttatctctcta

SEQ ID NO: 8577465 - DNA, 22 bp, Homo sapiens
tttcagagatgcagaattcagg

SEQ ID NO: 8577466 - DNA, 22 bp, Homo sapiens
tttcagagaactgagtccttgc

SEQ ID NO: 8577467 - DNA, 22 bp, Homo sapiens
tttcacagcgtctttctcttgc

SEQ ID NO: 8577468 - DNA, 18 bp, Homo sapiens
tttcacagattcatgact

SEQ ID NO: 8577469 - DNA, 22 bp, Homo sapiens
tttaatgtagcgtgaaatgatt

SEQ ID NO: 8577470 - DNA, 22 bp, Homo sapiens
tttaagtaataaagtagcagct

SEQ ID NO: 8577471 - DNA, 22 bp, Homo sapiens
tttaaataggactcctgggggt

SEQ ID NO: 8577472 - DNA, 22 bp, Homo sapiens
tttagattgtgacctcccccca

SEQ ID NO: 8577473 - DNA, 22 bp, Homo sapiens
tttatattgtaaaaatggttct

SEQ ID NO: 8577474 - DNA, 22 bp, Homo sapiens
tttagcaattattaagggttga

SEQ ID NO: 8577475 - DNA, 22 bp, Homo sapiens
ttcacagagcttgttcatggcc

SEQ ID NO: 8577476 - DNA, 18 bp, Homo sapiens
ttcagcagcagacacact

SEQ ID NO: 8577477 - DNA, 22 bp, Homo sapiens
ttcatttgtggtgaatgaagtg

SEQ ID NO: 8577478 - DNA, 22 bp, Homo sapiens
ttcagttttgcttttaatcatg

SEQ ID NO: 8577479 - DNA, 22 bp, Homo sapiens
ttcagttccatttcaggtgggt

SEQ ID NO: 8577480 - DNA, 22 bp, Homo sapiens
ttcattgtgaacacattctgcc

SEQ ID NO: 8577481 - DNA, 22 bp, Homo sapiens
ttcattgtactttaagagatgc

SEQ ID NO: 8577482 - DNA, 22 bp, Homo sapiens
ttaggaaagggttttctaacag

SEQ ID NO: 8577483 - DNA, 22 bp, Homo sapiens
ttagctgctgattaaatatgtt

SEQ ID NO: 8577484 - DNA, 22 bp, Homo sapiens
ttattgtgtcttggtttatctt

SEQ ID NO: 8577485 - DNA, 22 bp, Homo sapiens
ttcaaacacagacagcagcatg

SEQ ID NO: 8577486 - DNA, 18 bp, Homo sapiens
ttctccagaaaacatagc

SEQ ID NO: 8577487 - DNA, 22 bp, Homo sapiens
ttcctgataatgagattttccc

SEQ ID NO: 8577488 - DNA, 22 bp, Homo sapiens
ttcctgcctacatgccttatgc

SEQ ID NO: 8577489 - DNA, 22 bp, Homo sapiens
ttcctggggcgactgtatctga

SEQ ID NO: 8577490 - DNA, 21 bp, Homo sapiens
ttcctggggacttccgtggga

SEQ ID NO: 8577491 - DNA, 22 bp, Homo sapiens
ttcctgggtggtcctggtagag

SEQ ID NO: 8577492 - DNA, 22 bp, Homo sapiens
ttcctggggtgaagatattttt

SEQ ID NO: 8577493 - DNA, 19 bp, Homo sapiens
ttcctggggttccattgtg

SEQ ID NO: 8577494 - DNA, 22 bp, Homo sapiens
ttcctgggttccctctcattct

SEQ ID NO: 8577495 - DNA, 22 bp, Homo sapiens
ttcctgggttgtgcattgtaca

SEQ ID NO: 8577496 - DNA, 22 bp, Homo sapiens
ttcctgggtttacgtattgggt

SEQ ID NO: 8577497 - DNA, 22 bp, Homo sapiens
ttcctggggctccagctaccag

SEQ ID NO: 8577498 - DNA, 22 bp, Homo sapiens
ttcctgggggcagcagtcttga

SEQ ID NO: 8577499 - DNA, 22 bp, Homo sapiens
ttcctggggcttagcaatggag

SEQ ID NO: 8577500 - DNA, 22 bp, Homo sapiens
ttcctggggtactggagaaaat

SEQ ID NO: 8577501 - DNA, 22 bp, Homo sapiens
ttcctggggggatagatttcac

SEQ ID NO: 8577502 - DNA, 22 bp, Homo sapiens
ttcctggtagtaagacatctgg

SEQ ID NO: 8577503 - DNA, 22 bp, Homo sapiens
ttccttgaaagtttgaactgac

SEQ ID NO: 8577504 - DNA, 22 bp, Homo sapiens
ttccttgaatgagtcatggaaa

SEQ ID NO: 8577505 - DNA, 22 bp, Homo sapiens
ttccttgaccactgcataatga

SEQ ID NO: 8577506 - DNA, 22 bp, Homo sapiens
ttctttttaaagtgtgtatgca

SEQ ID NO: 8577507 - DNA, 22 bp, Homo sapiens
ttctttttaaagtgtgtatgca

SEQ ID NO: 8577508 - DNA, 22 bp, Homo sapiens
ttcttttaatgttctgaagttt

SEQ ID NO: 8577509 - DNA, 22 bp, Homo sapiens
ttctttgtgctgaagaagccct

SEQ ID NO: 8577510 - DNA, 22 bp, Homo sapiens
ttctttgtggcagtgagctggg

SEQ ID NO: 8577511 - DNA, 23 bp, Homo sapiens
ttctttgtggataatctccagtg

SEQ ID NO: 8577512 - DNA, 22 bp, Homo sapiens
ttctttgttgagcaagtaggac

SEQ ID NO: 8577513 - DNA, 22 bp, Homo sapiens
ttctttgtttgataagtatgct

SEQ ID NO: 8577514 - DNA, 22 bp, Homo sapiens
ttcttatgttcacataattcca

SEQ ID NO: 8577515 - DNA, 22 bp, Homo sapiens
ttcttatagaagcaaccattgt

SEQ ID NO: 8577516 - DNA, 22 bp, Homo sapiens
ttcttatattgggtcatggata

SEQ ID NO: 8577517 - DNA, 22 bp, Homo sapiens
ttcttataagataggcctcagg

SEQ ID NO: 8577518 - DNA, 22 bp, Homo sapiens
ttcttataagttaatatttcca

SEQ ID NO: 8577519 - DNA, 22 bp, Homo sapiens
ttctgtgtgccagagttgtgct

SEQ ID NO: 8577520 - DNA, 22 bp, Homo sapiens
ttctgtgtgcttactggtgttc

SEQ ID NO: 8577521 - DNA, 22 bp, Homo sapiens
ttctgtgtcttcttgttctgtg

SEQ ID NO: 8577522 - DNA, 22 bp, Homo sapiens
cagataaatagatagataaact

SEQ ID NO: 8577523 - DNA, 22 bp, Homo sapiens
cagataacacaaagaaatgggc

SEQ ID NO: 8577524 - DNA, 22 bp, Homo sapiens
cagataataatatgacttcact

SEQ ID NO: 8577525 - DNA, 22 bp, Homo sapiens
ggtgcaaagatggcagttgcaa

SEQ ID NO: 8577526 - DNA, 22 bp, Homo sapiens
cagaggctgctctgggtggcat

SEQ ID NO: 8577527 - DNA, 22 bp, Homo sapiens
cagaggcaggataagaactgcg

SEQ ID NO: 8577528 - DNA, 22 bp, Homo sapiens
gtaagcctctgctctatctggt

SEQ ID NO: 8577529 - DNA, 22 bp, Homo sapiens
gtaagcctgagaaacaccacct

SEQ ID NO: 8577530 - DNA, 22 bp, Homo sapiens
gtaagcctggaatttttgactt

SEQ ID NO: 8577531 - DNA, 22 bp, Homo sapiens
cagaagcacatgtttacatgta

SEQ ID NO: 8577532 - DNA, 22 bp, Homo sapiens
cagaagcagattctaaagcaag

SEQ ID NO: 8577533 - DNA, 22 bp, Homo sapiens
cagaggcagccgggggagaacg

SEQ ID NO: 8577534 - DNA, 22 bp, Homo sapiens
cagaggcaggaagatgggcagt

SEQ ID NO: 8577535 - DNA, 22 bp, Homo sapiens
gggctcagtctgcggcgcgcgg

SEQ ID NO: 8577536 - DNA, 22 bp, Homo sapiens
gtgccctgacacacctggtgtg

SEQ ID NO: 8577537 - DNA, 22 bp, Homo sapiens
gtgccctgaaagagttaattca

SEQ ID NO: 8577538 - DNA, 22 bp, Homo sapiens
cagcccttaagagtcatccctc

SEQ ID NO: 8577539 - DNA, 22 bp, Homo sapiens
cagcccttaaatagatatacag

SEQ ID NO: 8577540 - DNA, 22 bp, Homo sapiens
cagcccttcagggggctgcagg

SEQ ID NO: 8577541 - DNA, 22 bp, Homo sapiens
cagcccttccaggcagaattct

SEQ ID NO: 8577542 - DNA, 22 bp, Homo sapiens
cagcccttcttccaaccagctt

SEQ ID NO: 8577543 - DNA, 22 bp, Homo sapiens
cagcccttgatgataatttatc

SEQ ID NO: 8577544 - DNA, 22 bp, Homo sapiens
cagcccttgcgacaccctggct

SEQ ID NO: 8577545 - DNA, 20 bp, Homo sapiens
cagcccttgatttacaatcc

SEQ ID NO: 8577546 - DNA, 23 bp, Homo sapiens
cagcccttcctgcatgtttttgt

SEQ ID NO: 8577547 - DNA, 22 bp, Homo sapiens
cagcccttccttctgtttatac

SEQ ID NO: 8577548 - DNA, 22 bp, Homo sapiens
cagccctttccttctcagcttt

SEQ ID NO: 8577549 - DNA, 22 bp, Homo sapiens
cagcccttttttggtacaaccg

SEQ ID NO: 8577550 - DNA, 22 bp, Homo sapiens
cagcccttggcccagggcacag

SEQ ID NO: 8577551 - DNA, 22 bp, Homo sapiens
cagcccttggctggctccttgc

SEQ ID NO: 8577552 - DNA, 22 bp, Homo sapiens
cagcccttgggccatcctagaa

SEQ ID NO: 8577553 - DNA, 20 bp, Homo sapiens
cagccctttatcctcctatg

SEQ ID NO: 8577554 - DNA, 22 bp, Homo sapiens
cagcccttgtttctaaagctgc

SEQ ID NO: 8577555 - DNA, 22 bp, Homo sapiens
cagcccttgtttgggaaggatg

SEQ ID NO: 8577556 - DNA, 21 bp, Homo sapiens
cagctccactaaagcagctgt

SEQ ID NO: 8577557 - DNA, 23 bp, Homo sapiens
cagctccagtgcactcaggtagc

SEQ ID NO: 8577558 - DNA, 23 bp, Homo sapiens
gtcctagtgcttggtgcccaggc

SEQ ID NO: 8577559 - DNA, 22 bp, Homo sapiens
gtcctagtgcctggaagctggg

SEQ ID NO: 8577560 - DNA, 22 bp, Homo sapiens
cagcagtaactcccgtgcagca

SEQ ID NO: 8577561 - DNA, 22 bp, Homo sapiens
cagcagtacttctcagaggtat

SEQ ID NO: 8577562 - DNA, 22 bp, Homo sapiens
cagcaggtggacacactcacct

SEQ ID NO: 8577563 - DNA, 22 bp, Homo sapiens
gtctttggagaggtgccatttc

SEQ ID NO: 8577564 - DNA, 22 bp, Homo sapiens
ggctgggagccccacagagtca

SEQ ID NO: 8577565 - DNA, 22 bp, Homo sapiens
cagaaatgtttgttaatattgt

SEQ ID NO: 8577566 - DNA, 22 bp, Homo sapiens
ggctgaggctcatgccatcttg

SEQ ID NO: 8577567 - DNA, 22 bp, Homo sapiens
ggcgctcagtgttgccccagag

SEQ ID NO: 8577568 - DNA, 22 bp, Homo sapiens
ggctcctgggggtgctcctgcc

SEQ ID NO: 8577569 - DNA, 22 bp, Homo sapiens
ggctcctgtcccctcagctgct

SEQ ID NO: 8577570 - DNA, 22 bp, Homo sapiens
caccaaagtcgcttctgtcgtc

SEQ ID NO: 8577571 - DNA, 22 bp, Homo sapiens
ggccagggccaaggctttccca

SEQ ID NO: 8577572 - DNA, 22 bp, Homo sapiens
ggcgcacaatgtgcaggtttgt

SEQ ID NO: 8577573 - DNA, 22 bp, Homo sapiens
ggcgccagcccaggccgtcgtg

SEQ ID NO: 8577574 - DNA, 22 bp, Homo sapiens
ggcgccagcactgcagcgcctc

SEQ ID NO: 8577575 - DNA, 22 bp, Homo sapiens
ggcccagcccgagtcagccttc

SEQ ID NO: 8577576 - DNA, 22 bp, Homo sapiens
ggcagtatgagttcaaataatt

SEQ ID NO: 8577577 - DNA, 22 bp, Homo sapiens
ggcaggactgatcagtgggatg

SEQ ID NO: 8577578 - DNA, 20 bp, Homo sapiens
ggcaggaccccagtggcatc

SEQ ID NO: 8577579 - DNA, 22 bp, Homo sapiens
ggcaggacattgactacagtga

SEQ ID NO: 8577580 - DNA, 22 bp, Homo sapiens
ggcaggacagtcccagttcaaa

SEQ ID NO: 8577581 - DNA, 20 bp, Homo sapiens
ggcaggacccggtagggagc

SEQ ID NO: 8577582 - DNA, 22 bp, Homo sapiens
ggcaggactctcaggaccaagc

SEQ ID NO: 8577583 - DNA, 22 bp, Homo sapiens
ggatccagaggtgaagatggga

SEQ ID NO: 8577584 - DNA, 22 bp, Homo sapiens
ggatacagcggcttctgcgcga

SEQ ID NO: 8577585 - DNA, 22 bp, Homo sapiens
ggagtcttaaaaatcaaatgga

SEQ ID NO: 8577586 - DNA, 22 bp, Homo sapiens
ggagtcttcagatagagtattt

SEQ ID NO: 8577587 - DNA, 22 bp, Homo sapiens
ggagtcttggcctgctgagaaa

SEQ ID NO: 8577588 - DNA, 22 bp, Homo sapiens
gctggcagcattagaccctggg

SEQ ID NO: 8577589 - DNA, 19 bp, Homo sapiens
gctgggagcagaccctccc

SEQ ID NO: 8577590 - DNA, 19 bp, Homo sapiens
gctgggagcagaccctccc

SEQ ID NO: 8577591 - DNA, 22 bp, Homo sapiens
gctgggagccccgagccagcgc

SEQ ID NO: 8577592 - DNA, 22 bp, Homo sapiens
gctgggagcaaagccatgcata

SEQ ID NO: 8577593 - DNA, 22 bp, Homo sapiens
gctgggagccgtacctgtcacg

SEQ ID NO: 8577594 - DNA, 22 bp, Homo sapiens
gctgggagccctggtctgctcc

SEQ ID NO: 8577595 - DNA, 22 bp, Homo sapiens
gcttccacctactaaatgccac

SEQ ID NO: 8577596 - DNA, 20 bp, Homo sapiens
gcttccacctgaagcgcacc

SEQ ID NO: 8577597 - DNA, 22 bp, Homo sapiens
caatgctgtgctcctcatgagg

SEQ ID NO: 8577598 - DNA, 22 bp, Homo sapiens
gctgtaaagaacattaggaatc

SEQ ID NO: 8577599 - DNA, 22 bp, Homo sapiens
caatcccatcaccatctgctct

SEQ ID NO: 8577600 - DNA, 22 bp, Homo sapiens
gctggtcctcaagggcacagcc

SEQ ID NO: 8577601 - DNA, 22 bp, Homo sapiens
ggagaggttatccgtgttatgt

SEQ ID NO: 8577602 - DNA, 22 bp, Homo sapiens
ggagagctgacatcatgatgtt

SEQ ID NO: 8577603 - DNA, 22 bp, Homo sapiens
ggagagttgtttttgcctagat

SEQ ID NO: 8577604 - DNA, 22 bp, Homo sapiens
ggacaaagggtggagcctctga

SEQ ID NO: 8577605 - DNA, 22 bp, Homo sapiens
ggacaaagctctgctgcctccc

SEQ ID NO: 8577606 - DNA, 22 bp, Homo sapiens
ggacaaaggtctggggaacctg

SEQ ID NO: 8577607 - DNA, 22 bp, Homo sapiens
ggagggcaacttttcagtaggt

SEQ ID NO: 8577608 - DNA, 22 bp, Homo sapiens
atgcacaagaggctagaaaaga

SEQ ID NO: 8577609 - DNA, 22 bp, Homo sapiens
gaagaaagatcaaatagtttcc

SEQ ID NO: 8577610 - DNA, 22 bp, Homo sapiens
gaagaaagattggcatgcttca

SEQ ID NO: 8577611 - DNA, 22 bp, Homo sapiens
atgaggcatgtgaggagaaggg

SEQ ID NO: 8577612 - DNA, 22 bp, Homo sapiens
atgaggcatatcctcctatggt

SEQ ID NO: 8577613 - DNA, 22 bp, Homo sapiens
gaaaatgcctctggcattaaac

SEQ ID NO: 8577614 - DNA, 22 bp, Homo sapiens
gaaatcttccaatggtcacatc

SEQ ID NO: 8577615 - DNA, 22 bp, Homo sapiens
atcttcaattgaaaactagcct

SEQ ID NO: 8577616 - DNA, 22 bp, Homo sapiens
cttgagcttaggttcaggattg

SEQ ID NO: 8577617 - DNA, 22 bp, Homo sapiens
cttgagctaggaaggctgaggc

SEQ ID NO: 8577618 - DNA, 22 bp, Homo sapiens
atgaattgaaagaagaatatct

SEQ ID NO: 8577619 - DNA, 22 bp, Homo sapiens
gaaaataggctgcatctccttc

SEQ ID NO: 8577620 - DNA, 22 bp, Homo sapiens
atgccacttcattccagcctcg

SEQ ID NO: 8577621 - DNA, 22 bp, Homo sapiens
atgccacttcattccagcctcg

SEQ ID NO: 8577622 - DNA, 22 bp, Homo sapiens
atgccctgagcaggccttcaag

SEQ ID NO: 8577623 - DNA, 22 bp, Homo sapiens
atgccctgaaagattcaaaggc

SEQ ID NO: 8577624 - DNA, 22 bp, Homo sapiens
atgccctgctgccatctggccg

SEQ ID NO: 8577625 - DNA, 22 bp, Homo sapiens
atgccctgctgctggggcagtg

SEQ ID NO: 8577626 - DNA, 22 bp, Homo sapiens
atgccctggactagctatactt

SEQ ID NO: 8577627 - DNA, 22 bp, Homo sapiens
atgccctgctctcgggaaggga

SEQ ID NO: 8577628 - DNA, 22 bp, Homo sapiens
atgccctgccaagcaggctaaa

SEQ ID NO: 8577629 - DNA, 22 bp, Homo sapiens
atgccctgcatcaagtgacact

SEQ ID NO: 8577630 - DNA, 22 bp, Homo sapiens
atgccctgaggaatgtcacgct

SEQ ID NO: 8577631 - DNA, 18 bp, Homo sapiens
atgccctgttgacttcag

SEQ ID NO: 8577632 - DNA, 22 bp, Homo sapiens
atgccctgtggttcatgtgaga

SEQ ID NO: 8577633 - DNA, 22 bp, Homo sapiens
atgccctggacttctagtattc

SEQ ID NO: 8577634 - DNA, 22 bp, Homo sapiens
atgccctgggagtgctgtacca

SEQ ID NO: 8577635 - DNA, 22 bp, Homo sapiens
atgccctggggctacctctgag

SEQ ID NO: 8577636 - DNA, 23 bp, Homo sapiens
atgccctgtagaggctgctgacc

SEQ ID NO: 8577637 - DNA, 20 bp, Homo sapiens
atgccctgtcctcttctgtt

SEQ ID NO: 8577638 - DNA, 22 bp, Homo sapiens
atgccctgtgactctcctggac

SEQ ID NO: 8577639 - DNA, 23 bp, Homo sapiens
atgccctgtgcagaaatgtggaa

SEQ ID NO: 8577640 - DNA, 22 bp, Homo sapiens
atgccctgtggcagtacatatt

SEQ ID NO: 8577641 - DNA, 22 bp, Homo sapiens
gaagcagaagtacgatttacta

SEQ ID NO: 8577642 - DNA, 22 bp, Homo sapiens
gaccctgataggagtagaagaa

SEQ ID NO: 8577643 - DNA, 22 bp, Homo sapiens
gaccctgaggattccctgctga

SEQ ID NO: 8577644 - DNA, 22 bp, Homo sapiens
gaccctgactctaatgcttggc

SEQ ID NO: 8577645 - DNA, 22 bp, Homo sapiens
gaccctgaggatgcaccagcag

SEQ ID NO: 8577646 - DNA, 22 bp, Homo sapiens
gaccctgagcaaaagcagttct

SEQ ID NO: 8577647 - DNA, 22 bp, Homo sapiens
atgcttttccaggagaaatata

SEQ ID NO: 8577648 - DNA, 22 bp, Homo sapiens
atgctttagtgtcaagtttggg

SEQ ID NO: 8577649 - DNA, 22 bp, Homo sapiens
atgcttgggactccctgtagca

SEQ ID NO: 8577650 - DNA, 22 bp, Homo sapiens
atgcttggcgtttcacttcctg

SEQ ID NO: 8577651 - DNA, 22 bp, Homo sapiens
gacataaaccttgagatattaa

SEQ ID NO: 8577652 - DNA, 20 bp, Homo sapiens
gagtccaggggcctgtagca

SEQ ID NO: 8577653 - DNA, 22 bp, Homo sapiens
gagtccagtagttaggacagag

SEQ ID NO: 8577654 - DNA, 22 bp, Homo sapiens
gagtccagtagttaggacagag

SEQ ID NO: 8577655 - DNA, 22 bp, Homo sapiens
gagtccagttagtgaggctggg

SEQ ID NO: 8577656 - DNA, 22 bp, Homo sapiens
gagtccagttctttccagcagt

SEQ ID NO: 8577657 - DNA, 23 bp, Homo sapiens
gagtgcagaatagacatgcagtg

SEQ ID NO: 8577658 - DNA, 22 bp, Homo sapiens
atgtttcaaatatatagagttg

SEQ ID NO: 8577659 - DNA, 21 bp, Homo sapiens
gagtgcaggtctgatgccatc

SEQ ID NO: 8577660 - DNA, 22 bp, Homo sapiens
gatctctgtggactcttagcac

SEQ ID NO: 8577661 - DNA, 22 bp, Homo sapiens
gatctctgggtcctgttggcct

SEQ ID NO: 8577662 - DNA, 22 bp, Homo sapiens
gatctctgaatctgaagccttc

SEQ ID NO: 8577663 - DNA, 22 bp, Homo sapiens
gagtccagcagaatgagccaag

SEQ ID NO: 8577664 - DNA, 22 bp, Homo sapiens
gagtccaggctggtcaaatagc

SEQ ID NO: 8577665 - DNA, 22 bp, Homo sapiens
gagaggctgactggctgtcctg

SEQ ID NO: 8577666 - DNA, 21 bp, Homo sapiens
gagccttccctctgccctttc

SEQ ID NO: 8577667 - DNA, 21 bp, Homo sapiens
gagccttccctctgccctttc

SEQ ID NO: 8577668 - DNA, 22 bp, Homo sapiens
gagccttcatcgcagccttgtt

SEQ ID NO: 8577669 - DNA, 19 bp, Homo sapiens
gagcgcagagggcagggga

SEQ ID NO: 8577670 - DNA, 19 bp, Homo sapiens
gagcgcagagggcagggga

SEQ ID NO: 8577671 - DNA, 22 bp, Homo sapiens
gagcctggcctcctgcctcagc

SEQ ID NO: 8577672 - DNA, 22 bp, Homo sapiens
gagcagggagacaactctggtg

SEQ ID NO: 8577673 - DNA, 17 bp, Homo sapiens
gagcagggatgcggttc

SEQ ID NO: 8577674 - DNA, 22 bp, Homo sapiens
gagcaggtctttcatggtgcat

SEQ ID NO: 8577675 - DNA, 22 bp, Homo sapiens
gagcaggtgcctgtagctctct

SEQ ID NO: 8577676 - DNA, 22 bp, Homo sapiens
atgtacaatctatcacaagaag

SEQ ID NO: 8577677 - DNA, 17 bp, Homo sapiens
atgtaagaagaaagcag

SEQ ID NO: 8577678 - DNA, 22 bp, Homo sapiens
atgtaatttatgttatccataa

SEQ ID NO: 8577679 - DNA, 22 bp, Homo sapiens
atgtaaattgtactgacacacg

SEQ ID NO: 8577680 - DNA, 22 bp, Homo sapiens
atgtaaagtatctgaaatgctg

SEQ ID NO: 8577681 - DNA, 20 bp, Homo sapiens
gcaactcacccacagcagct

SEQ ID NO: 8577682 - DNA, 21 bp, Homo sapiens
gcagccaggactttgggctgg

SEQ ID NO: 8577683 - DNA, 22 bp, Homo sapiens
gcagccaggggctgtgacctgt

SEQ ID NO: 8577684 - DNA, 22 bp, Homo sapiens
gcagccagggttaattatattt

SEQ ID NO: 8577685 - DNA, 22 bp, Homo sapiens
gcagcaggtccgcatcatcatc

SEQ ID NO: 8577686 - DNA, 22 bp, Homo sapiens
gcagaagtaggctctgtgtagg

SEQ ID NO: 8577687 - DNA, 22 bp, Homo sapiens
gcagaagtcagaccatctgaat

SEQ ID NO: 8577688 - DNA, 21 bp, Homo sapiens
gcagaagtggctacatctcca

SEQ ID NO: 8577689 - DNA, 22 bp, Homo sapiens
gcagaattccttcttccttggg

SEQ ID NO: 8577690 - DNA, 19 bp, Homo sapiens
gcagatccaaaagtcacat

SEQ ID NO: 8577691 - DNA, 22 bp, Homo sapiens
gcagggtccatggaggcagccc

SEQ ID NO: 8577692 - DNA, 22 bp, Homo sapiens
gcagggtcttgagaggcagcca

SEQ ID NO: 8577693 - DNA, 22 bp, Homo sapiens
gcagggtcgctctaggagatca

SEQ ID NO: 8577694 - DNA, 22 bp, Homo sapiens
gcaggtggatcacctgaggtca

SEQ ID NO: 8577695 - DNA, 22 bp, Homo sapiens
gcaggcgtgtttcacgtgccag

SEQ ID NO: 8577696 - DNA, 22 bp, Homo sapiens
attgttgataatcgtgttgtca

SEQ ID NO: 8577697 - DNA, 22 bp, Homo sapiens
attgttgatcttctggtaagcc

SEQ ID NO: 8577698 - DNA, 22 bp, Homo sapiens
attgttgaggagactcttcaat

SEQ ID NO: 8577699 - DNA, 22 bp, Homo sapiens
attgttgacttgattactcaac

SEQ ID NO: 8577700 - DNA, 22 bp, Homo sapiens
attgttgaggcagttcatcttg

SEQ ID NO: 8577701 - DNA, 22 bp, Homo sapiens
attgttgagtgcttcagctgta

SEQ ID NO: 8577702 - DNA, 22 bp, Homo sapiens
gccactgattccaagtcaattt

SEQ ID NO: 8577703 - DNA, 22 bp, Homo sapiens
caaatgaatttccctgcaaatg

SEQ ID NO: 8577704 - DNA, 22 bp, Homo sapiens
caaatattccaggtacatccct

SEQ ID NO: 8577705 - DNA, 22 bp, Homo sapiens
gcgcaggtgctgctggagcagc

SEQ ID NO: 8577706 - DNA, 22 bp, Homo sapiens
gctacaaactgtcatggtgctt

SEQ ID NO: 8577707 - DNA, 22 bp, Homo sapiens
gccagaggggctcgaaggcgcg

SEQ ID NO: 8577708 - DNA, 22 bp, Homo sapiens
gccctcctggcaggcagtgatg

SEQ ID NO: 8577709 - DNA, 23 bp, Homo sapiens
attttaaccttgactaacatgca

SEQ ID NO: 8577710 - DNA, 22 bp, Homo sapiens
gcctgccatgagctaatgacac

SEQ ID NO: 8577711 - DNA, 23 bp, Homo sapiens
attttacaggtcagttccttgaa

SEQ ID NO: 8577712 - DNA, 22 bp, Homo sapiens
attttacataaggaaggtttaa

SEQ ID NO: 8577713 - DNA, 22 bp, Homo sapiens
aggccatcaaatcatgtagtgc

SEQ ID NO: 8577714 - DNA, 22 bp, Homo sapiens
ccagagaaaagaggccaaggat

SEQ ID NO: 8577715 - DNA, 22 bp, Homo sapiens
ccagagaaagctcacaggcagt

SEQ ID NO: 8577716 - DNA, 22 bp, Homo sapiens
ccagagaaaaatgtgtccctgt

SEQ ID NO: 8577717 - DNA, 22 bp, Homo sapiens
ccagctctggcttcttgctggg

SEQ ID NO: 8577718 - DNA, 22 bp, Homo sapiens
ccagctctgcttgcccagtcag

SEQ ID NO: 8577719 - DNA, 22 bp, Homo sapiens
ccagctctgtaagctgtgaaat

SEQ ID NO: 8577720 - DNA, 22 bp, Homo sapiens
ccagcaggagatgcctgtgtct

SEQ ID NO: 8577721 - DNA, 22 bp, Homo sapiens
ccagctggcccagctgtgctcc

SEQ ID NO: 8577722 - DNA, 22 bp, Homo sapiens
ccaggctgctgttggtgtccgc

SEQ ID NO: 8577723 - DNA, 22 bp, Homo sapiens
ccaggctgctgttggtgtccgc

SEQ ID NO: 8577724 - DNA, 22 bp, Homo sapiens
ccaggctgctttattactctgt

SEQ ID NO: 8577725 - DNA, 22 bp, Homo sapiens
agggcctggaactggagaccac

SEQ ID NO: 8577726 - DNA, 22 bp, Homo sapiens
agggcctggaactgtgggcagg

SEQ ID NO: 8577727 - DNA, 22 bp, Homo sapiens
agggcctgctctatcactctca

SEQ ID NO: 8577728 - DNA, 20 bp, Homo sapiens
agggcctggagtacagcagg

SEQ ID NO: 8577729 - DNA, 22 bp, Homo sapiens
agggcgggctcatcacatgctc

SEQ ID NO: 8577730 - DNA, 22 bp, Homo sapiens
agggctggagggtactagttta

SEQ ID NO: 8577731 - DNA, 22 bp, Homo sapiens
aggctggtgcctgcagtgaatc

SEQ ID NO: 8577732 - DNA, 22 bp, Homo sapiens
aggctggtagtatttagtcaca

SEQ ID NO: 8577733 - DNA, 23 bp, Homo sapiens
cccatgctgggcgcagtgaatgg

SEQ ID NO: 8577734 - DNA, 22 bp, Homo sapiens
ccctcaccaggctccaggcatg

SEQ ID NO: 8577735 - DNA, 18 bp, Homo sapiens
ccctgccagctcccagca

SEQ ID NO: 8577736 - DNA, 22 bp, Homo sapiens
ccctgccaatcccgtctctctg

SEQ ID NO: 8577737 - DNA, 22 bp, Homo sapiens
aggatcaaatgaaatattttga

SEQ ID NO: 8577738 - DNA, 22 bp, Homo sapiens
ccaaaccatccatctccaggct

SEQ ID NO: 8577739 - DNA, 19 bp, Homo sapiens
ccaaaggaagtttccctcc

SEQ ID NO: 8577740 - DNA, 22 bp, Homo sapiens
ccaaaggatgtccctgtgtttt

SEQ ID NO: 8577741 - DNA, 22 bp, Homo sapiens
aggcaggcctacacaatgggag

SEQ ID NO: 8577742 - DNA, 22 bp, Homo sapiens
aggcaggccctctggaaaggta

SEQ ID NO: 8577743 - DNA, 22 bp, Homo sapiens
aggcagcgtagcaaggctagta

SEQ ID NO: 8577744 - DNA, 22 bp, Homo sapiens
aggacaaaggaccagatctgga

SEQ ID NO: 8577745 - DNA, 22 bp, Homo sapiens
catcatgtctgcaggaatgtgt

SEQ ID NO: 8577746 - DNA, 22 bp, Homo sapiens
catcatgccccgctacagtgca

SEQ ID NO: 8577747 - DNA, 21 bp, Homo sapiens
catcatgcttgtgttggagaa

SEQ ID NO: 8577748 - DNA, 22 bp, Homo sapiens
aggagggtggggtctgcctgtc

SEQ ID NO: 8577749 - DNA, 23 bp, Homo sapiens
catcatgcaatcttgggatttct

SEQ ID NO: 8577750 - DNA, 21 bp, Homo sapiens
agctggaatctggctgtgctt

SEQ ID NO: 8577751 - DNA, 22 bp, Homo sapiens
agctggaacccgggtgggcagc

SEQ ID NO: 8577752 - DNA, 22 bp, Homo sapiens
agctgcctggagtcatttcctg

SEQ ID NO: 8577753 - DNA, 22 bp, Homo sapiens
agctgcctctgctggtttagaa

SEQ ID NO: 8577754 - DNA, 21 bp, Homo sapiens
agctgcctgctctggacctgg

SEQ ID NO: 8577755 - DNA, 22 bp, Homo sapiens
agctgcctccctgtgcttgtcc

SEQ ID NO: 8577756 - DNA, 21 bp, Homo sapiens
agctgcctccacttctgaggc

SEQ ID NO: 8577757 - DNA, 22 bp, Homo sapiens
agctgcctagtagattgattgg

SEQ ID NO: 8577758 - DNA, 22 bp, Homo sapiens
caggaaatgctatcatagctga

SEQ ID NO: 8577759 - DNA, 17 bp, Homo sapiens
caggaaaatatgagtga

SEQ ID NO: 8577760 - DNA, 17 bp, Homo sapiens
caggaaaatatgagtga

SEQ ID NO: 8577761 - DNA, 22 bp, Homo sapiens
agctggtaaaggggaaagcaga

SEQ ID NO: 8577762 - DNA, 22 bp, Homo sapiens
aggaaaattatcatgagagcca

SEQ ID NO: 8577763 - DNA, 22 bp, Homo sapiens
agctttcacgatttggaacagg

SEQ ID NO: 8577764 - DNA, 22 bp, Homo sapiens
agcttctgttcatcttccaggc

SEQ ID NO: 8577765 - DNA, 22 bp, Homo sapiens
caggctggagttacctttaggg

SEQ ID NO: 8577766 - DNA, 22 bp, Homo sapiens
caggtccagtcactggtctgca

SEQ ID NO: 8577767 - DNA, 22 bp, Homo sapiens
caggtccagtaaaaagagtcct

SEQ ID NO: 8577768 - DNA, 22 bp, Homo sapiens
caggtcccgttccccagagatt

SEQ ID NO: 8577769 - DNA, 22 bp, Homo sapiens
caggtcctgcagggagagtaaa

SEQ ID NO: 8577770 - DNA, 22 bp, Homo sapiens
caggtcctggcatcaggcaggt

SEQ ID NO: 8577771 - DNA, 22 bp, Homo sapiens
cagggtgctgcaccatccctca

SEQ ID NO: 8577772 - DNA, 22 bp, Homo sapiens
agtgctgggtactgttcccatt

SEQ ID NO: 8577773 - DNA, 22 bp, Homo sapiens
agtgcgtggtttacagctagtt

SEQ ID NO: 8577774 - DNA, 22 bp, Homo sapiens
agtgccaaacagtacataacat

SEQ ID NO: 8577775 - DNA, 22 bp, Homo sapiens
agtggcaattgacaacaaagga

SEQ ID NO: 8577776 - DNA, 22 bp, Homo sapiens
agtggcaatgtagagagtgatc

SEQ ID NO: 8577777 - DNA, 20 bp, Homo sapiens
ctcacagtcaatgcagaggt

SEQ ID NO: 8577778 - DNA, 23 bp, Homo sapiens
ctcaccaagcgccgccgctgtgt

SEQ ID NO: 8577779 - DNA, 22 bp, Homo sapiens
agtgatggggccctgcactgat

SEQ ID NO: 8577780 - DNA, 22 bp, Homo sapiens
agtgtcaactcggaataaggat

SEQ ID NO: 8577781 - DNA, 22 bp, Homo sapiens
agtgtcaaatgtgtgccaagct

SEQ ID NO: 8577782 - DNA, 22 bp, Homo sapiens
agtgtctttgtctctcaagcac

SEQ ID NO: 8577783 - DNA, 22 bp, Homo sapiens
agtgtctttgacacattcaaag

SEQ ID NO: 8577784 - DNA, 22 bp, Homo sapiens
agtgtctggtctctgaactaaa

SEQ ID NO: 8577785 - DNA, 22 bp, Homo sapiens
agtgtcccctccaagggcctgg

SEQ ID NO: 8577786 - DNA, 22 bp, Homo sapiens
agtgggtgggtgtctgacagtt

SEQ ID NO: 8577787 - DNA, 22 bp, Homo sapiens
agtgggtgtagtcttcctcctg

SEQ ID NO: 8577788 - DNA, 22 bp, Homo sapiens
agtgtttggggtgattgtaacc

SEQ ID NO: 8577789 - DNA, 22 bp, Homo sapiens
agtgtttcaagtgatgctttgg

SEQ ID NO: 8577790 - DNA, 23 bp, Homo sapiens
agttccagaaaaatgctcaagca

SEQ ID NO: 8577791 - DNA, 22 bp, Homo sapiens
agttccagaactggaaaaggac

SEQ ID NO: 8577792 - DNA, 22 bp, Homo sapiens
ctgagctgctcccgctgcagcg

SEQ ID NO: 8577793 - DNA, 22 bp, Homo sapiens
aggtacagatgaaagtctagtt

SEQ ID NO: 8577794 - DNA, 22 bp, Homo sapiens
aggtcacacttggatcatagaa

SEQ ID NO: 8577795 - DNA, 22 bp, Homo sapiens
aggtcacacaactgtcagaggc

SEQ ID NO: 8577796 - DNA, 22 bp, Homo sapiens
cctgagtagctggaattaaagg

SEQ ID NO: 8577797 - DNA, 22 bp, Homo sapiens
aggtcacagggttgaagtactt

SEQ ID NO: 8577798 - DNA, 22 bp, Homo sapiens
aggtcaccatggcatgctccac

SEQ ID NO: 8577799 - DNA, 22 bp, Homo sapiens
aggtcaggtatcagcaggtatt

SEQ ID NO: 8577800 - DNA, 22 bp, Homo sapiens
cctgggaggctgtttccagcct

SEQ ID NO: 8577801 - DNA, 22 bp, Homo sapiens
aggtgcagctggtggagtctgg

SEQ ID NO: 8577802 - DNA, 17 bp, Homo sapiens
aggtgcagaggcagagc

SEQ ID NO: 8577803 - DNA, 22 bp, Homo sapiens
aggtcctggtgaccatggagtt

SEQ ID NO: 8577804 - DNA, 23 bp, Homo sapiens
aggtcctggacatatgtgcatca

SEQ ID NO: 8577805 - DNA, 19 bp, Homo sapiens
aggtcctgatcagcaagga

SEQ ID NO: 8577806 - DNA, 22 bp, Homo sapiens
cctggggctctgcacagagcag

SEQ ID NO: 8577807 - DNA, 22 bp, Homo sapiens
agtagaataattggattacagt

SEQ ID NO: 8577808 - DNA, 22 bp, Homo sapiens
agtagaatcccttgcaatgtcc

SEQ ID NO: 8577809 - DNA, 22 bp, Homo sapiens
agtagaatgttctatgtcaatg

SEQ ID NO: 8577810 - DNA, 22 bp, Homo sapiens
agtagattttagattacatagt

SEQ ID NO: 8577811 - DNA, 22 bp, Homo sapiens
agtaacaaagtgggagaatgat

SEQ ID NO: 8577812 - DNA, 22 bp, Homo sapiens
agtaaataacagagaaaatggg

SEQ ID NO: 8577813 - DNA, 22 bp, Homo sapiens
agtaaaaattgaggtgcaaaat

SEQ ID NO: 8577814 - DNA, 22 bp, Homo sapiens
ctatgaccccagcatgaataag

SEQ ID NO: 8577815 - DNA, 22 bp, Homo sapiens
ctatgaccccagcatgaataag

SEQ ID NO: 8577816 - DNA, 22 bp, Homo sapiens
atcatacagcctttgttagtgt

SEQ ID NO: 8577817 - DNA, 22 bp, Homo sapiens
cttaagattgtcagcttcagcc

SEQ ID NO: 8577818 - DNA, 22 bp, Homo sapiens
cttcacaaatggcctagagttc

SEQ ID NO: 8577819 - DNA, 22 bp, Homo sapiens
cttcaatacctgcgttgctagt

SEQ ID NO: 8577820 - DNA, 22 bp, Homo sapiens
cttcaataggaactgcatggca

SEQ ID NO: 8577821 - DNA, 22 bp, Homo sapiens
cttccttgctgtctgctccagg

SEQ ID NO: 8577822 - DNA, 19 bp, Homo sapiens
cttccttgctccccatgtg

SEQ ID NO: 8577823 - DNA, 22 bp, Homo sapiens
cttccttgcggcccctgcctag

SEQ ID NO: 8577824 - DNA, 22 bp, Homo sapiens
cttccttctgaagcatagaagc

SEQ ID NO: 8577825 - DNA, 22 bp, Homo sapiens
atctgtctatgtggctatgtat

SEQ ID NO: 8577826 - DNA, 22 bp, Homo sapiens
atctgtgtccttataagagaca

SEQ ID NO: 8577827 - DNA, 22 bp, Homo sapiens
atctgtggcgcaaacaaaggct

SEQ ID NO: 8577828 - DNA, 22 bp, Homo sapiens
atctgtggctggtgagaggcag

SEQ ID NO: 8577829 - DNA, 22 bp, Homo sapiens
cttccttgtggtccttctcatt

SEQ ID NO: 8577830 - DNA, 22 bp, Homo sapiens
cttccttggcttctggggtgtg

SEQ ID NO: 8577831 - DNA, 21 bp, Homo sapiens
atctcgggcttctcgcccagc

SEQ ID NO: 8577832 - DNA, 22 bp, Homo sapiens
cttctccttatatgtcccgttc

SEQ ID NO: 8577833 - DNA, 18 bp, Homo sapiens
atattcaagaagacagag

SEQ ID NO: 8577834 - DNA, 18 bp, Homo sapiens
ctgggtctccaggctgcc

SEQ ID NO: 8577835 - DNA, 22 bp, Homo sapiens
ctggtccagaatttatgattct

SEQ ID NO: 8577836 - DNA, 22 bp, Homo sapiens
atattattctagctcttgtgtg

SEQ ID NO: 8577837 - DNA, 22 bp, Homo sapiens
ctgtaaatatgaagaatatatg

SEQ ID NO: 8577838 - DNA, 22 bp, Homo sapiens
ctggcctcagagggtcatggtg

SEQ ID NO: 8577839 - DNA, 22 bp, Homo sapiens
ctggcaggttatagagctgccc

SEQ ID NO: 8577840 - DNA, 22 bp, Homo sapiens
ctggccactggaggtggcaccc

SEQ ID NO: 8577841 - DNA, 22 bp, Homo sapiens
atatacagttttacagggtttc

SEQ ID NO: 8577842 - DNA, 22 bp, Homo sapiens
ctggctgaggcagagcctgggg

SEQ ID NO: 8577843 - DNA, 22 bp, Homo sapiens
atatacaggtggtatgtgtaaa

SEQ ID NO: 8577844 - DNA, 22 bp, Homo sapiens
atatacagtatgtactgtggtt

SEQ ID NO: 8577845 - DNA, 22 bp, Homo sapiens
atatacagggagaaacagctta

SEQ ID NO: 8577846 - DNA, 22 bp, Homo sapiens
ctggctctttcagccgctggag

SEQ ID NO: 8577847 - DNA, 19 bp, Homo sapiens
ctggcctgtgtcctgtgct

SEQ ID NO: 8577848 - DNA, 22 bp, Homo sapiens
ctggcctgtgggctgtctccgg

SEQ ID NO: 8577849 - DNA, 22 bp, Homo sapiens
ctgcctgggttcaagtcctgtt

SEQ ID NO: 8577850 - DNA, 22 bp, Homo sapiens
ctgcaggctgagcgcctgccgg

SEQ ID NO: 8577851 - DNA, 22 bp, Homo sapiens
ctgcagggaccacaagcaggtt

SEQ ID NO: 8577852 - DNA, 22 bp, Homo sapiens
agttttgtaattctcaaaaata

SEQ ID NO: 8577853 - DNA, 22 bp, Homo sapiens
ataaaaatgagggcggtagcta

SEQ ID NO: 8577854 - DNA, 22 bp, Homo sapiens
ataaaaaggacagatgtggtct

SEQ ID NO: 8577855 - DNA, 22 bp, Homo sapiens
ataaaagatcccttctgagctc

SEQ ID NO: 8577856 - DNA, 22 bp, Homo sapiens
atctctggccttccttttccaa

SEQ ID NO: 8577857 - DNA, 22 bp, Homo sapiens
atctctggttgttttgctccca

SEQ ID NO: 8577858 - DNA, 22 bp, Homo sapiens
agaagccaacagggcaggagag

SEQ ID NO: 8577859 - DNA, 20 bp, Homo sapiens
agaagccaagtgacatgttt

SEQ ID NO: 8577860 - DNA, 22 bp, Homo sapiens
agaaatcctgatggagtctgaa

SEQ ID NO: 8577861 - DNA, 20 bp, Homo sapiens
atcaaaatcctattgaggtt

SEQ ID NO: 8577862 - DNA, 22 bp, Homo sapiens
atcaaaatgctccagtgatggt

SEQ ID NO: 8577863 - DNA, 22 bp, Homo sapiens
atatttctccaaatgttttcaa

SEQ ID NO: 8577864 - DNA, 22 bp, Homo sapiens
agaaaaagtcaaggaattggac

SEQ ID NO: 8577865 - DNA, 22 bp, Homo sapiens
agtttttccgtggctacgataa

SEQ ID NO: 8577866 - DNA, 22 bp, Homo sapiens
agtttttcctgattttacagaa

SEQ ID NO: 8577867 - DNA, 18 bp, Homo sapiens
agtttttaggaagaaatg

SEQ ID NO: 8577868 - DNA, 22 bp, Homo sapiens
agtttttctcccctggcttcat

SEQ ID NO: 8577869 - DNA, 22 bp, Homo sapiens
agtttttctgggaggcactgct

SEQ ID NO: 8577870 - DNA, 23 bp, Homo sapiens
agtttttctgcatggttctgtat

SEQ ID NO: 8577871 - DNA, 22 bp, Homo sapiens
agtttttctgctggtctcacta

SEQ ID NO: 8577872 - DNA, 22 bp, Homo sapiens
actgggccttgccatggcagcc

SEQ ID NO: 8577873 - DNA, 22 bp, Homo sapiens
acttccttttgggaaactgttt

SEQ ID NO: 8577874 - DNA, 22 bp, Homo sapiens
actgttttcttagctccctgct

SEQ ID NO: 8577875 - DNA, 22 bp, Homo sapiens
actgttttctgtaaagggccag

SEQ ID NO: 8577876 - DNA, 22 bp, Homo sapiens
atacatcacctatatattcaca

SEQ ID NO: 8577877 - DNA, 22 bp, Homo sapiens
atacatatccacaggagataaa

SEQ ID NO: 8577878 - DNA, 22 bp, Homo sapiens
actgccaatggtagtttgatgg

SEQ ID NO: 8577879 - DNA, 23 bp, Homo sapiens
actgccagttttaccacagacgg

SEQ ID NO: 8577880 - DNA, 21 bp, Homo sapiens
actggctgccatgatccaggg

SEQ ID NO: 8577881 - DNA, 22 bp, Homo sapiens
actggctgcggggtggaagaag

SEQ ID NO: 8577882 - DNA, 22 bp, Homo sapiens
actggctgtgcccatagagctc

SEQ ID NO: 8577883 - DNA, 22 bp, Homo sapiens
actgggcccatatactcagtct

SEQ ID NO: 8577884 - DNA, 22 bp, Homo sapiens
agtactgtcagcagggtgttga

SEQ ID NO: 8577885 - DNA, 22 bp, Homo sapiens
aggtgggcgctgctcccgctgg

SEQ ID NO: 8577886 - DNA, 22 bp, Homo sapiens
aggtgggcccagtgggctccag

SEQ ID NO: 8577887 - DNA, 21 bp, Homo sapiens
aggtgggcaggtggagtggcc

SEQ ID NO: 8577888 - DNA, 22 bp, Homo sapiens
actcctgggtgcatttctgatt

SEQ ID NO: 8577889 - DNA, 22 bp, Homo sapiens
actcctgggtgctgaccagcgt

SEQ ID NO: 8577890 - DNA, 22 bp, Homo sapiens
aggtgactggtttatctggcag

SEQ ID NO: 8577891 - DNA, 22 bp, Homo sapiens
aggtgacatcccggcagcagag

SEQ ID NO: 8577892 - DNA, 19 bp, Homo sapiens
aggtgacatgtgacagcct

SEQ ID NO: 8577893 - DNA, 22 bp, Homo sapiens
aggtcaaagaacctagctatag

SEQ ID NO: 8577894 - DNA, 22 bp, Homo sapiens
aggtcaagagtaaatttgggta

SEQ ID NO: 8577895 - DNA, 22 bp, Homo sapiens
aggtccaaatgttgagactgat

SEQ ID NO: 8577896 - DNA, 22 bp, Homo sapiens
aggtcaagtttagatagagtta

SEQ ID NO: 8577897 - DNA, 22 bp, Homo sapiens
aggtcaagggcaagagtgaggt

SEQ ID NO: 8577898 - DNA, 22 bp, Homo sapiens
aggtcaaggctgcagtgagctg

SEQ ID NO: 8577899 - DNA, 22 bp, Homo sapiens
aggtccagaggttgaacggtgg

SEQ ID NO: 8577900 - DNA, 22 bp, Homo sapiens
aggtccagcctgccctctctcc

SEQ ID NO: 8577901 - DNA, 22 bp, Homo sapiens
aggtccagctctattgaaaaga

SEQ ID NO: 8577902 - DNA, 22 bp, Homo sapiens
aggtccagagttgagatacaga

SEQ ID NO: 8577903 - DNA, 22 bp, Homo sapiens
aggtccagaggctccttattac

SEQ ID NO: 8577904 - DNA, 22 bp, Homo sapiens
aggtccagactgtgtaccctag

SEQ ID NO: 8577905 - DNA, 22 bp, Homo sapiens
aggtccagaacgtgcctactct

SEQ ID NO: 8577906 - DNA, 22 bp, Homo sapiens
aggtccaggatttgtggggtct

SEQ ID NO: 8577907 - DNA, 22 bp, Homo sapiens
aggtccaggagatttggcaatt

SEQ ID NO: 8577908 - DNA, 22 bp, Homo sapiens
aggtccagctgttgcagcctcc

SEQ ID NO: 8577909 - DNA, 22 bp, Homo sapiens
aggtccaggcatttgggttggg

SEQ ID NO: 8577910 - DNA, 22 bp, Homo sapiens
aggtccaggttccgtttctgcg

SEQ ID NO: 8577911 - DNA, 22 bp, Homo sapiens
aggtccaggcctcatgatggcc

SEQ ID NO: 8577912 - DNA, 22 bp, Homo sapiens
aggtccagtgctcttggtggtt

SEQ ID NO: 8577913 - DNA, 22 bp, Homo sapiens
aggtccagtgaaactttatttg

SEQ ID NO: 8577914 - DNA, 21 bp, Homo sapiens
aggtccagttctgtcttggac

SEQ ID NO: 8577915 - DNA, 21 bp, Homo sapiens
accttctgaattacctaccaa

SEQ ID NO: 8577916 - DNA, 22 bp, Homo sapiens
aggagacataactatgatgaga

SEQ ID NO: 8577917 - DNA, 23 bp, Homo sapiens
aggaagctaagtgtggctgcgga

SEQ ID NO: 8577918 - DNA, 22 bp, Homo sapiens
aggaagctaaccagggagtgag

SEQ ID NO: 8577919 - DNA, 22 bp, Homo sapiens
acagggtcttagagatcacctg

SEQ ID NO: 8577920 - DNA, 22 bp, Homo sapiens
acaggggctccgaaggtgaggg

SEQ ID NO: 8577921 - DNA, 22 bp, Homo sapiens
aggaggggttctcgggtgctga

SEQ ID NO: 8577922 - DNA, 23 bp, Homo sapiens
agctccaggtgattgtaatgtgt

SEQ ID NO: 8577923 - DNA, 22 bp, Homo sapiens
agctccaggtgcaagtcatggt

SEQ ID NO: 8577924 - DNA, 22 bp, Homo sapiens
acagccagtgactgcagaccct

SEQ ID NO: 8577925 - DNA, 22 bp, Homo sapiens
agctggctatgccctgtgaacc

SEQ ID NO: 8577926 - DNA, 21 bp, Homo sapiens
agctggctctctctggagaga

SEQ ID NO: 8577927 - DNA, 22 bp, Homo sapiens
agctgtggtgttttcaagccct

SEQ ID NO: 8577928 - DNA, 22 bp, Homo sapiens
aggaagcatgttggatccactt

SEQ ID NO: 8577929 - DNA, 22 bp, Homo sapiens
aggaagcagtttataatgcatt

SEQ ID NO: 8577930 - DNA, 22 bp, Homo sapiens
agcttcataattccttgactca

SEQ ID NO: 8577931 - DNA, 22 bp, Homo sapiens
aggaaaaagagttgctgccttc

SEQ ID NO: 8577932 - DNA, 22 bp, Homo sapiens
acatacatggattcatggattc

SEQ ID NO: 8577933 - DNA, 22 bp, Homo sapiens
aggcatggggctgcagtcaggt

SEQ ID NO: 8577934 - DNA, 22 bp, Homo sapiens
aggcatggctttaggcaggcgt

SEQ ID NO: 8577935 - DNA, 19 bp, Homo sapiens
aggcatgggaagagaagtc

SEQ ID NO: 8577936 - DNA, 17 bp, Homo sapiens
aggcatggtctggggtg

SEQ ID NO: 8577937 - DNA, 22 bp, Homo sapiens
aggcatgggtagaagagaagcc

SEQ ID NO: 8577938 - DNA, 22 bp, Homo sapiens
acatgaaaagactatctgatta

SEQ ID NO: 8577939 - DNA, 22 bp, Homo sapiens
aggcccagcttgaagtgggaag

SEQ ID NO: 8577940 - DNA, 22 bp, Homo sapiens
aggctccagcagccagaggaag

SEQ ID NO: 8577941 - DNA, 22 bp, Homo sapiens
acccagagcacagatgcaacgt

SEQ ID NO: 8577942 - DNA, 22 bp, Homo sapiens
accaaggagacaaaggtgtatt

SEQ ID NO: 8577943 - DNA, 22 bp, Homo sapiens
accaggaggcctggagcacaaa

SEQ ID NO: 8577944 - DNA, 22 bp, Homo sapiens
accaggagccatagagtcaggc

SEQ ID NO: 8577945 - DNA, 20 bp, Homo sapiens
accaggagatggaggcaggg

SEQ ID NO: 8577946 - DNA, 19 bp, Homo sapiens
accaggagacagtgagctt

SEQ ID NO: 8577947 - DNA, 19 bp, Homo sapiens
accaggagtatcagagctg

SEQ ID NO: 8577948 - DNA, 22 bp, Homo sapiens
accagggcttacagcagtagct

SEQ ID NO: 8577949 - DNA, 22 bp, Homo sapiens
accagggcagccgaggtgtgtc

SEQ ID NO: 8577950 - DNA, 22 bp, Homo sapiens
accagggcggcttgaggaggca

SEQ ID NO: 8577951 - DNA, 23 bp, Homo sapiens
agaggcaggagtggcttgcccgg

SEQ ID NO: 8577952 - DNA, 19 bp, Homo sapiens
agaggcaagggtggaagta

SEQ ID NO: 8577953 - DNA, 22 bp, Homo sapiens
agaggcaagattatcagggcat

SEQ ID NO: 8577954 - DNA, 22 bp, Homo sapiens
agaggctggattgagcatagac

SEQ ID NO: 8577955 - DNA, 22 bp, Homo sapiens
agagtccaaatgtgcagttatg

SEQ ID NO: 8577956 - DNA, 22 bp, Homo sapiens
agagtattgtgaccatttgtca

SEQ ID NO: 8577957 - DNA, 22 bp, Homo sapiens
agagtctgatatttgtaccaga

SEQ ID NO: 8577958 - DNA, 22 bp, Homo sapiens
agatcacagtggcaactccctt

SEQ ID NO: 8577959 - DNA, 22 bp, Homo sapiens
agatcaaaaacttaatggcttt

SEQ ID NO: 8577960 - DNA, 22 bp, Homo sapiens
agatatttgtatcttgctattg

SEQ ID NO: 8577961 - DNA, 22 bp, Homo sapiens
attggccatttgcatgtattat

SEQ ID NO: 8577962 - DNA, 22 bp, Homo sapiens
attggtagttttgtatttctct

SEQ ID NO: 8577963 - DNA, 22 bp, Homo sapiens
attggtcacctccctcagctct

SEQ ID NO: 8577964 - DNA, 22 bp, Homo sapiens
agcaagaagggcaaggaagttt

SEQ ID NO: 8577965 - DNA, 22 bp, Homo sapiens
caaagatatgacatggaaaatg

SEQ ID NO: 8577966 - DNA, 22 bp, Homo sapiens
attttcagaacattcattcact

SEQ ID NO: 8577967 - DNA, 22 bp, Homo sapiens
agaatattcatctgtattctta

SEQ ID NO: 8577968 - DNA, 22 bp, Homo sapiens
agaatatgatcggaatacagat

SEQ ID NO: 8577969 - DNA, 22 bp, Homo sapiens
agaatattgaaagttcttgaca

SEQ ID NO: 8577970 - DNA, 22 bp, Homo sapiens
agaatcaaagagaaatactttg

SEQ ID NO: 8577971 - DNA, 22 bp, Homo sapiens
atgcatttttgagtatgaatga

SEQ ID NO: 8577972 - DNA, 22 bp, Homo sapiens
agagattgtgctactcacccaa

SEQ ID NO: 8577973 - DNA, 22 bp, Homo sapiens
agagatttacacatgccttttc

SEQ ID NO: 8577974 - DNA, 21 bp, Homo sapiens
agagcctgagatcttccagca

SEQ ID NO: 8577975 - DNA, 22 bp, Homo sapiens
agagccctctcattggcttatt

SEQ ID NO: 8577976 - DNA, 22 bp, Homo sapiens
agagaatgcagggcttcggaca

SEQ ID NO: 8577977 - DNA, 22 bp, Homo sapiens
agagaggcattcggtgatccca

SEQ ID NO: 8577978 - DNA, 22 bp, Homo sapiens
agagagcccgggccagggcaca

SEQ ID NO: 8577979 - DNA, 22 bp, Homo sapiens
agagagcctgagtggcagctat

SEQ ID NO: 8577980 - DNA, 22 bp, Homo sapiens
agagaagggtgtagcctgggcc

SEQ ID NO: 8577981 - DNA, 22 bp, Homo sapiens
agcagggagaccatctcttcct

SEQ ID NO: 8577982 - DNA, 22 bp, Homo sapiens
agcagggaggtctagcacgtgg

SEQ ID NO: 8577983 - DNA, 22 bp, Homo sapiens
agcagggaggcggtgtgctggc

SEQ ID NO: 8577984 - DNA, 22 bp, Homo sapiens
caccagctacagactactgtgt

SEQ ID NO: 8577985 - DNA, 22 bp, Homo sapiens
cactgtgggcctgtcgtgggtg

SEQ ID NO: 8577986 - DNA, 19 bp, Homo sapiens
cactgtggtccttcactgc

SEQ ID NO: 8577987 - DNA, 22 bp, Homo sapiens
agcagtaagcaactgagcttgc

SEQ ID NO: 8577988 - DNA, 22 bp, Homo sapiens
agcagcagatccaaaaaatgtg

SEQ ID NO: 8577989 - DNA, 23 bp, Homo sapiens
agcagcccagatgccttccatcc

SEQ ID NO: 8577990 - DNA, 22 bp, Homo sapiens
agcacctggagggctgggacct

SEQ ID NO: 8577991 - DNA, 22 bp, Homo sapiens
agcacctggtctcctggcgctg

SEQ ID NO: 8577992 - DNA, 22 bp, Homo sapiens
caaaggcatgtgagtatatgtg

SEQ ID NO: 8577993 - DNA, 22 bp, Homo sapiens
agcacctgtgtggtagggaggt

SEQ ID NO: 8577994 - DNA, 22 bp, Homo sapiens
agcacctgtgccctgatggaga

SEQ ID NO: 8577995 - DNA, 22 bp, Homo sapiens
agccagcatcccttcagtctcc

SEQ ID NO: 8577996 - DNA, 22 bp, Homo sapiens
cagagaactccagtggctggcg

SEQ ID NO: 8577997 - DNA, 22 bp, Homo sapiens
cagagaacattcagagctgtag

SEQ ID NO: 8577998 - DNA, 22 bp, Homo sapiens
cagagaacaaagctgagggttt

SEQ ID NO: 8577999 - DNA, 22 bp, Homo sapiens
cagagcggccactagagggcgc

SEQ ID NO: 8578000 - DNA, 22 bp, Homo sapiens
cagagcctggcgatgtcatgga

SEQ ID NO: 8578001 - DNA, 22 bp, Homo sapiens
agccaggccagctgtcttgagt

SEQ ID NO: 8578002 - DNA, 22 bp, Homo sapiens
cagatgaagatcatagaatagt

SEQ ID NO: 8578003 - DNA, 22 bp, Homo sapiens
agcccagtgggccgaggcgggg

SEQ ID NO: 8578004 - DNA, 22 bp, Homo sapiens
agctccaggataagacaggtgc

SEQ ID NO: 8578005 - DNA, 22 bp, Homo sapiens
agctccaggatctgaaagttcg

SEQ ID NO: 8578006 - DNA, 23 bp, Homo sapiens
agctccagctgacgtgggcagcc

SEQ ID NO: 8578007 - DNA, 22 bp, Homo sapiens
agctccagggaaagagtggatc

SEQ ID NO: 8578008 - DNA, 23 bp, Homo sapiens
agctccagaacatagcacaggaa

SEQ ID NO: 8578009 - DNA, 20 bp, Homo sapiens
agctaggagaaagcatggag

SEQ ID NO: 8578010 - DNA, 22 bp, Homo sapiens
agctaggacaggtagagatggg

SEQ ID NO: 8578011 - DNA, 22 bp, Homo sapiens
agctaggaaattgaggctgaga

SEQ ID NO: 8578012 - DNA, 22 bp, Homo sapiens
agctccagaggcagtgatgaag

SEQ ID NO: 8578013 - DNA, 22 bp, Homo sapiens
agctccagaagcctgcaaggta

SEQ ID NO: 8578014 - DNA, 22 bp, Homo sapiens
agctccagaagcctgcaaggta

SEQ ID NO: 8578015 - DNA, 22 bp, Homo sapiens
agctcctgggccaagcccatgc

SEQ ID NO: 8578016 - DNA, 22 bp, Homo sapiens
agctcctggcaaggtcatggtg

SEQ ID NO: 8578017 - DNA, 17 bp, Homo sapiens
agctcctggggtcttta

SEQ ID NO: 8578018 - DNA, 19 bp, Homo sapiens
agctctttgctgcattcca

SEQ ID NO: 8578019 - DNA, 22 bp, Homo sapiens
aagcactgagcacagtggctga

SEQ ID NO: 8578020 - DNA, 22 bp, Homo sapiens
aagcactgggaggaggctgaga

SEQ ID NO: 8578021 - DNA, 22 bp, Homo sapiens
aagcagagttagcttgtcacct

SEQ ID NO: 8578022 - DNA, 22 bp, Homo sapiens
aaatatgactagaatgccaggt

SEQ ID NO: 8578023 - DNA, 22 bp, Homo sapiens
aagaaagccaaagttcatacct

SEQ ID NO: 8578024 - DNA, 22 bp, Homo sapiens
aagaatgattacaaagcaacga

SEQ ID NO: 8578025 - DNA, 22 bp, Homo sapiens
aagaatggtggtggggccagca

SEQ ID NO: 8578026 - DNA, 22 bp, Homo sapiens
aagaaagtgctttgtaaattat

SEQ ID NO: 8578027 - DNA, 22 bp, Homo sapiens
aacatgcaatgtctgaaaatcc

SEQ ID NO: 8578028 - DNA, 22 bp, Homo sapiens
aacacatggcaagagcaggaaa

SEQ ID NO: 8578029 - DNA, 22 bp, Homo sapiens
aacacaaagaagctgcaggatc

SEQ ID NO: 8578030 - DNA, 23 bp, Homo sapiens
aacacaaagctgattccagtggc

SEQ ID NO: 8578031 - DNA, 22 bp, Homo sapiens
aacacaaagaagctgcaggatc

SEQ ID NO: 8578032 - DNA, 22 bp, Homo sapiens
aacacaaaaattctcaggggca

SEQ ID NO: 8578033 - DNA, 22 bp, Homo sapiens
aaagcaagtctctacaaagtac

SEQ ID NO: 8578034 - DNA, 22 bp, Homo sapiens
aaatggctacaagatgtgctct

SEQ ID NO: 8578035 - DNA, 22 bp, Homo sapiens
aaatggctgactaaattaaatt

SEQ ID NO: 8578036 - DNA, 22 bp, Homo sapiens
aaatggctttgagggtaggaca

SEQ ID NO: 8578037 - DNA, 22 bp, Homo sapiens
aaagcacatagtagaaggattt

SEQ ID NO: 8578038 - DNA, 22 bp, Homo sapiens
aaagcacatgagtagtgtagta

SEQ ID NO: 8578039 - DNA, 22 bp, Homo sapiens
aaaataggtacggattagaatg

SEQ ID NO: 8578040 - DNA, 22 bp, Homo sapiens
aaacaaagccagggaagttatg

SEQ ID NO: 8578041 - DNA, 19 bp, Homo sapiens
aaaaagaggctataatatt

SEQ ID NO: 8578042 - DNA, 22 bp, Homo sapiens
aaagatgtcacaagatgtgatg

SEQ ID NO: 8578043 - DNA, 19 bp, Homo sapiens
aaagatctgggattgagac

SEQ ID NO: 8578044 - DNA, 22 bp, Homo sapiens
aaacttgttctcttgtgcctat

SEQ ID NO: 8578045 - DNA, 22 bp, Homo sapiens
aaacttgttctcatgttgcaga

SEQ ID NO: 8578046 - DNA, 22 bp, Homo sapiens
aaacatcataggcatgcatgat

SEQ ID NO: 8578047 - DNA, 22 bp, Homo sapiens
aaacatcaattgcatctcccaa

SEQ ID NO: 8578048 - DNA, 22 bp, Homo sapiens
aaacatcaccattttacctaat

SEQ ID NO: 8578049 - DNA, 22 bp, Homo sapiens
aaagcaatgcccgttcattatc

SEQ ID NO: 8578050 - DNA, 22 bp, Homo sapiens
aaagcaatcagattcagatgtc

SEQ ID NO: 8578051 - DNA, 23 bp, Homo sapiens
aaagatgtgagtattcatatggc

SEQ ID NO: 8578052 - DNA, 22 bp, Homo sapiens
aaagatgtcagtttgaaataac

SEQ ID NO: 8578053 - DNA, 22 bp, Homo sapiens
aaatgctacatacacatcaggg

SEQ ID NO: 8578054 - DNA, 22 bp, Homo sapiens
aaatgctaacaaggaatgctgc

SEQ ID NO: 8578055 - DNA, 22 bp, Homo sapiens
aaatgctagggagaaactctcc

SEQ ID NO: 8578056 - DNA, 22 bp, Homo sapiens
aaatagaattggaagcagagtt

SEQ ID NO: 8578057 - DNA, 22 bp, Homo sapiens
aaatagaattaactagctactg

SEQ ID NO: 8578058 - DNA, 22 bp, Homo sapiens
aaatagaaaccaacaaggtcag

SEQ ID NO: 8578059 - DNA, 22 bp, Homo sapiens
aaatataatttctgcctcaata

SEQ ID NO: 8578060 - DNA, 22 bp, Homo sapiens
aaatatgtgatcagtgaataaa

SEQ ID NO: 8578061 - DNA, 22 bp, Homo sapiens
aaatatgagggtgatgcccaga

SEQ ID NO: 8578062 - DNA, 22 bp, Homo sapiens
aataaaatggtcagttttctca

SEQ ID NO: 8578063 - DNA, 22 bp, Homo sapiens
aataaacaaaggacaaggaggt

SEQ ID NO: 8578064 - DNA, 22 bp, Homo sapiens
aagtcaaagctttcagaggaaa

SEQ ID NO: 8578065 - DNA, 22 bp, Homo sapiens
aaccatgctagcatcaaaatgt

SEQ ID NO: 8578066 - DNA, 22 bp, Homo sapiens
aaccagagtgacactctacaga

SEQ ID NO: 8578067 - DNA, 22 bp, Homo sapiens
aacatttatggtagtcattgca

SEQ ID NO: 8578068 - DNA, 18 bp, Homo sapiens
aaattagatggacctgtg

SEQ ID NO: 8578069 - DNA, 22 bp, Homo sapiens
aaattgctaaattgtaagaggg

SEQ ID NO: 8578070 - DNA, 20 bp, Homo sapiens
aaatttaggaaattttacgc

SEQ ID NO: 8578071 - DNA, 21 bp, Homo sapiens
aaggaaaagcttggtctctga

SEQ ID NO: 8578072 - DNA, 22 bp, Homo sapiens
aagtatgtcaatcatacttcaa

SEQ ID NO: 8578073 - DNA, 22 bp, Homo sapiens
aagggggcacagtcactgtaat

SEQ ID NO: 8578074 - DNA, 23 bp, Homo sapiens
aaggcattggcttctctcatttc

SEQ ID NO: 8578075 - DNA, 21 bp, Homo sapiens
aagaggaagcattatggcata

SEQ ID NO: 8578076 - DNA, 23 bp, Homo sapiens
aagaggaggccctgctcccgtcc

SEQ ID NO: 8578077 - DNA, 22 bp, Homo sapiens
acacctttgccccaagtcatag

SEQ ID NO: 8578078 - DNA, 22 bp, Homo sapiens
aagatacatcattcaggagtga

SEQ ID NO: 8578079 - DNA, 22 bp, Homo sapiens
acagaagcaaagactcaggcaa

SEQ ID NO: 8578080 - DNA, 20 bp, Homo sapiens
aattagatgtttaatcaata

SEQ ID NO: 8578081 - DNA, 22 bp, Homo sapiens
aattcaatctgtagattgtgat

SEQ ID NO: 8578082 - DNA, 22 bp, Homo sapiens
aattcaatggtttttaggatat

SEQ ID NO: 8578083 - DNA, 22 bp, Homo sapiens
aattcaatctaagaaatgatca

SEQ ID NO: 8578084 - DNA, 22 bp, Homo sapiens
aagaattggtttcctctgtcat

SEQ ID NO: 8578085 - DNA, 22 bp, Homo sapiens
aagacaatattgctgtgaacgt

SEQ ID NO: 8578086 - DNA, 22 bp, Homo sapiens
aagacaatgtttctgatagata

SEQ ID NO: 8578087 - DNA, 22 bp, Homo sapiens
aagacaattttgagtatgcaca

SEQ ID NO: 8578088 - DNA, 22 bp, Homo sapiens
aagacaatttgatactagttgc

SEQ ID NO: 8578089 - DNA, 20 bp, Homo sapiens
aactcctagcctcaagtgat

SEQ ID NO: 8578090 - DNA, 23 bp, Homo sapiens
aactcctgaatcgtgagccatct

SEQ ID NO: 8578091 - DNA, 22 bp, Homo sapiens
aactcctgaggaaatggtctca

SEQ ID NO: 8578092 - DNA, 22 bp, Homo sapiens
aatgtattctgggaaaatgtta

SEQ ID NO: 8578093 - DNA, 22 bp, Homo sapiens
aatgtgttttcactgaagattc

SEQ ID NO: 8578094 - DNA, 22 bp, Homo sapiens
aatgtgttttatgagagaatat

SEQ ID NO: 8578095 - DNA, 21 bp, Homo sapiens
agaggcaggcattaagtacac

SEQ ID NO: 8578096 - DNA, 19 bp, Homo sapiens
agaggcagtctccaacagg

SEQ ID NO: 8578097 - DNA, 22 bp, Homo sapiens
agaggcagtatacaatccgagc

SEQ ID NO: 8578098 - DNA, 22 bp, Homo sapiens
agagtctgtgctttcatcagga

SEQ ID NO: 8578099 - DNA, 22 bp, Homo sapiens
agagtctgcctttttctcctgc

SEQ ID NO: 8578100 - DNA, 19 bp, Homo sapiens
agagtctgtgctcttccta

SEQ ID NO: 8578101 - DNA, 22 bp, Homo sapiens
agaggtggccatgggcgctgga

SEQ ID NO: 8578102 - DNA, 22 bp, Homo sapiens
acaaaaagctccattactgtcc

SEQ ID NO: 8578103 - DNA, 22 bp, Homo sapiens
agatatatttcctgcccaaggc

SEQ ID NO: 8578104 - DNA, 21 bp, Homo sapiens
agattacaggtgtgatccacc

SEQ ID NO: 8578105 - DNA, 22 bp, Homo sapiens
agatctggttggagtcctgaca

SEQ ID NO: 8578106 - DNA, 22 bp, Homo sapiens
agagaaagtcctgatctctcta

SEQ ID NO: 8578107 - DNA, 22 bp, Homo sapiens
agagaaagtcctgatctctcta

SEQ ID NO: 8578108 - DNA, 22 bp, Homo sapiens
agactgggattctccctgatca

SEQ ID NO: 8578109 - DNA, 23 bp, Homo sapiens
agactggggcataagaagatggc

SEQ ID NO: 8578110 - DNA, 23 bp, Homo sapiens
agactggggcataagaagatggc

SEQ ID NO: 8578111 - DNA, 22 bp, Homo sapiens
agacactgccacttctgttccc

SEQ ID NO: 8578112 - DNA, 22 bp, Homo sapiens
agacactgatgttcagctcaat

SEQ ID NO: 8578113 - DNA, 22 bp, Homo sapiens
agaataaactgctttagggcag

SEQ ID NO: 8578114 - DNA, 22 bp, Homo sapiens
aatgtagaatgatccttaggat

SEQ ID NO: 8578115 - DNA, 22 bp, Homo sapiens
agcaggagggttttgtagagtc

SEQ ID NO: 8578116 - DNA, 22 bp, Homo sapiens
agcaggtcttgctctcaacagg

SEQ ID NO: 8578117 - DNA, 22 bp, Homo sapiens
agcactttcctggcaaatgtgg

SEQ ID NO: 8578118 - DNA, 22 bp, Homo sapiens
agcactttgggagataaagctg

SEQ ID NO: 8578119 - DNA, 22 bp, Homo sapiens
agatttgtatgtctaaatgtaa

SEQ ID NO: 8578120 - DNA, 22 bp, Homo sapiens
agatttgtatagatgtggttga

SEQ ID NO: 8578121 - DNA, 22 bp, Homo sapiens
agatttgtcctgctttctacct

SEQ ID NO: 8578122 - DNA, 23 bp, Homo sapiens
agctccagggaacaggcagtagg

SEQ ID NO: 8578123 - DNA, 22 bp, Homo sapiens
agcctgtgttttttctattgca

SEQ ID NO: 8578124 - DNA, 22 bp, Homo sapiens
agcctgtggatccctgcactgg

SEQ ID NO: 8578125 - DNA, 22 bp, Homo sapiens
agcatctgcatattgggagacc

SEQ ID NO: 8578126 - DNA, 22 bp, Homo sapiens
agccaggacagggcagctcgct

SEQ ID NO: 8578127 - DNA, 22 bp, Homo sapiens
agccaggacagggcagctcgct

SEQ ID NO: 8578128 - DNA, 22 bp, Homo sapiens
acagacagtaaatagtgtggct

SEQ ID NO: 8578129 - DNA, 22 bp, Homo sapiens
acagaacaggctgagaaaaaca

SEQ ID NO: 8578130 - DNA, 22 bp, Homo sapiens
accaggagttttgaccaggggc

SEQ ID NO: 8578131 - DNA, 22 bp, Homo sapiens
acaggaaagagctaggcatagg

SEQ ID NO: 8578132 - DNA, 22 bp, Homo sapiens
acaggaaatgaaatggtatcta

SEQ ID NO: 8578133 - DNA, 18 bp, Homo sapiens
acagtggtttgatgtgct

SEQ ID NO: 8578134 - DNA, 22 bp, Homo sapiens
acaggtgtcctcacagggggtg

SEQ ID NO: 8578135 - DNA, 22 bp, Homo sapiens
acaggtcctcaagtcagctggg

SEQ ID NO: 8578136 - DNA, 22 bp, Homo sapiens
acaggtccttataagagcactc

SEQ ID NO: 8578137 - DNA, 22 bp, Homo sapiens
aagtttgtagctggatgtctgt

SEQ ID NO: 8578138 - DNA, 22 bp, Homo sapiens
aagtgggaatagaaatgaaggt

SEQ ID NO: 8578139 - DNA, 22 bp, Homo sapiens
aagtttgttcattcattcatcc

SEQ ID NO: 8578140 - DNA, 22 bp, Homo sapiens
actcatcagattagattagggc

SEQ ID NO: 8578141 - DNA, 22 bp, Homo sapiens
aagtgcaaatctgtggctgaaa

SEQ ID NO: 8578142 - DNA, 22 bp, Homo sapiens
aagtgcaatgaatagctgcaat

SEQ ID NO: 8578143 - DNA, 23 bp, Homo sapiens
aagtgcaagtgaaaggcacagtt

SEQ ID NO: 8578144 - DNA, 22 bp, Homo sapiens
aagtgcaaatttaagaaggcat

SEQ ID NO: 8578145 - DNA, 22 bp, Homo sapiens
accttctgaccagttatcttga

SEQ ID NO: 8578146 - DNA, 22 bp, Homo sapiens
accttctggtctgcctgacagc

SEQ ID NO: 8578147 - DNA, 22 bp, Homo sapiens
acctgggatggggccaggttta

SEQ ID NO: 8578148 - DNA, 22 bp, Homo sapiens
acctgggagtatgcagtggtga

SEQ ID NO: 8578149 - DNA, 22 bp, Homo sapiens
acctgggaggcggaggttgcag

SEQ ID NO: 8578150 - DNA, 22 bp, Homo sapiens
acctgggaggcagaggttgcag

SEQ ID NO: 8578151 - DNA, 20 bp, Homo sapiens
acctgggaaaaccttttcct

SEQ ID NO: 8578152 - DNA, 22 bp, Homo sapiens
aatctgttaagaacagaaatgt

SEQ ID NO: 8578153 - DNA, 22 bp, Homo sapiens
agaaaataatttcttggctggt

SEQ ID NO: 8578154 - DNA, 22 bp, Homo sapiens
agaaaatgtgaacttgtgaatt

SEQ ID NO: 8578155 - DNA, 20 bp, Homo sapiens
agaaaatgttttcagctgga

SEQ ID NO: 8578156 - DNA, 22 bp, Homo sapiens
aatatgcattaactgtgtacat

SEQ ID NO: 8578157 - DNA, 22 bp, Homo sapiens
aatatgcatgtatacatgtgta

SEQ ID NO: 8578158 - DNA, 22 bp, Homo sapiens
aatatgcaaagcgtgttatctg

SEQ ID NO: 8578159 - DNA, 22 bp, Homo sapiens
aatatgcaaataggtgtaatga

SEQ ID NO: 8578160 - DNA, 22 bp, Homo sapiens
aatatgcagcatgatgaagtaa

SEQ ID NO: 8578161 - DNA, 22 bp, Homo sapiens
aatatcagctctgtcacttact

SEQ ID NO: 8578162 - DNA, 22 bp, Homo sapiens
actgtggcactaggcaccttac

SEQ ID NO: 8578163 - DNA, 22 bp, Homo sapiens
actgtggccaaagcctctggga

SEQ ID NO: 8578164 - DNA, 22 bp, Homo sapiens
actgtggctaattcatttggtc

SEQ ID NO: 8578165 - DNA, 22 bp, Homo sapiens
actgtggccttgtgggttcagg

SEQ ID NO: 8578166 - DNA, 22 bp, Homo sapiens
actgtggcctgctgtatgggct

SEQ ID NO: 8578167 - DNA, 22 bp, Homo sapiens
actgtggccggaacagtgggac

SEQ ID NO: 8578168 - DNA, 22 bp, Homo sapiens
tcaaaaatggtctttgagctgc

SEQ ID NO: 8578169 - DNA, 22 bp, Homo sapiens
tcaaaattttatttctcaagga

SEQ ID NO: 8578170 - DNA, 20 bp, Homo sapiens
tcacatcctctcccaacatg

SEQ ID NO: 8578171 - DNA, 22 bp, Homo sapiens
tcactgggcatcggagctgaaa

SEQ ID NO: 8578172 - DNA, 22 bp, Homo sapiens
tcactacaacctccgcctcctg

SEQ ID NO: 8578173 - DNA, 22 bp, Homo sapiens
tcactggggcccacatcaacat

SEQ ID NO: 8578174 - DNA, 22 bp, Homo sapiens
tcagaacagttcttaatattgc

SEQ ID NO: 8578175 - DNA, 22 bp, Homo sapiens
tcaccgaggctggagtgcagtg

SEQ ID NO: 8578176 - DNA, 22 bp, Homo sapiens
tcagctttcctgcagctaaggg

SEQ ID NO: 8578177 - DNA, 22 bp, Homo sapiens
tcagaggcttgaagcccaagcc

SEQ ID NO: 8578178 - DNA, 22 bp, Homo sapiens
tcaggcactggctgagtgatgg

SEQ ID NO: 8578179 - DNA, 22 bp, Homo sapiens
tcataaagcatttcagcttttg

SEQ ID NO: 8578180 - DNA, 22 bp, Homo sapiens
tcatccagcctcatcaggagct

SEQ ID NO: 8578181 - DNA, 22 bp, Homo sapiens
tcatccagcctcatcaggagct

SEQ ID NO: 8578182 - DNA, 22 bp, Homo sapiens
tcatccaggaaaagatttggaa

SEQ ID NO: 8578183 - DNA, 22 bp, Homo sapiens
tcatccagtaccatggaaggca

SEQ ID NO: 8578184 - DNA, 20 bp, Homo sapiens
tcatccaggacaggagtggc

SEQ ID NO: 8578185 - DNA, 22 bp, Homo sapiens
tcatccagttgtggagagggaa

SEQ ID NO: 8578186 - DNA, 22 bp, Homo sapiens
tcatccagttcacatggtgagt

SEQ ID NO: 8578187 - DNA, 22 bp, Homo sapiens
tcatccagtatgactggtgtct

SEQ ID NO: 8578188 - DNA, 22 bp, Homo sapiens
tcaggtcctctgggtcccagcc

SEQ ID NO: 8578189 - DNA, 22 bp, Homo sapiens
tcaggtccccaactcttctcac

SEQ ID NO: 8578190 - DNA, 22 bp, Homo sapiens
tcaggtcccactgctagtaagt

SEQ ID NO: 8578191 - DNA, 22 bp, Homo sapiens
tcaggtccttttggtgtatatt

SEQ ID NO: 8578192 - DNA, 22 bp, Homo sapiens
tcaggtccttactgtgctccct

SEQ ID NO: 8578193 - DNA, 22 bp, Homo sapiens
tcaggtccaagatggccatcca

SEQ ID NO: 8578194 - DNA, 22 bp, Homo sapiens
tcaggtccagctcctgtgcctc

SEQ ID NO: 8578195 - DNA, 22 bp, Homo sapiens
tccctgggccacagctgtgagc

SEQ ID NO: 8578196 - DNA, 22 bp, Homo sapiens
tccctgggcacaatctgctggc

SEQ ID NO: 8578197 - DNA, 22 bp, Homo sapiens
tccctgggcctcctgctatgca

SEQ ID NO: 8578198 - DNA, 22 bp, Homo sapiens
tccctgggcctatcttagctcc

SEQ ID NO: 8578199 - DNA, 22 bp, Homo sapiens
tccctgtggatatctgcagctg

SEQ ID NO: 8578200 - DNA, 22 bp, Homo sapiens
tcccttgtcctcttcgtcactg

SEQ ID NO: 8578201 - DNA, 22 bp, Homo sapiens
tccctgtgtcttcctcttgccc

SEQ ID NO: 8578202 - DNA, 23 bp, Homo sapiens
tccctgtgtacagcctgcatgag

SEQ ID NO: 8578203 - DNA, 22 bp, Homo sapiens
tccgggagctgaacgtcttgcg

SEQ ID NO: 8578204 - DNA, 22 bp, Homo sapiens
tcctccctgcactcagtgaagt

SEQ ID NO: 8578205 - DNA, 22 bp, Homo sapiens
tcctcccttctcactgggaagg

SEQ ID NO: 8578206 - DNA, 21 bp, Homo sapiens
tcctccctgagctgtggggga

SEQ ID NO: 8578207 - DNA, 22 bp, Homo sapiens
tcctccctgagtggggacagct

SEQ ID NO: 8578208 - DNA, 22 bp, Homo sapiens
tccagggacagcgctggagcta

SEQ ID NO: 8578209 - DNA, 22 bp, Homo sapiens
tccagggacctccctgagagct

SEQ ID NO: 8578210 - DNA, 20 bp, Homo sapiens
tccaggcccactcagctgaa

SEQ ID NO: 8578211 - DNA, 20 bp, Homo sapiens
tccagggcaactagagtgtg

SEQ ID NO: 8578212 - DNA, 23 bp, Homo sapiens
tccagggattaatgaagtcagtc

SEQ ID NO: 8578213 - DNA, 22 bp, Homo sapiens
tccagggatgtcctgtagcact

SEQ ID NO: 8578214 - DNA, 22 bp, Homo sapiens
tccagggatgccagccatgttg

SEQ ID NO: 8578215 - DNA, 22 bp, Homo sapiens
tccagggatctttagagtcttt

SEQ ID NO: 8578216 - DNA, 22 bp, Homo sapiens
tccagtggaacagatgttgcct

SEQ ID NO: 8578217 - DNA, 21 bp, Homo sapiens
tcccactgccacagcttcagg

SEQ ID NO: 8578218 - DNA, 22 bp, Homo sapiens
tcccagagaaagtcaaggtctt

SEQ ID NO: 8578219 - DNA, 22 bp, Homo sapiens
tcccagagttcaatgggaaggt

SEQ ID NO: 8578220 - DNA, 22 bp, Homo sapiens
tcccagagtgtgggcatcaagg

SEQ ID NO: 8578221 - DNA, 21 bp, Homo sapiens
tcccagagtgcttgggactgc

SEQ ID NO: 8578222 - DNA, 19 bp, Homo sapiens
tcccagagtctagaggttg

SEQ ID NO: 8578223 - DNA, 22 bp, Homo sapiens
tcccagagtcagaggtggggcc

SEQ ID NO: 8578224 - DNA, 22 bp, Homo sapiens
tcccagagtgagccaggggcag

SEQ ID NO: 8578225 - DNA, 22 bp, Homo sapiens
tcccagagtcttctcctgtaat

SEQ ID NO: 8578226 - DNA, 22 bp, Homo sapiens
tcccagagtttcctgtgtccca

SEQ ID NO: 8578227 - DNA, 22 bp, Homo sapiens
tccagccttgccacttttctgt

SEQ ID NO: 8578228 - DNA, 23 bp, Homo sapiens
tccagcctcttgctctcacatgc

SEQ ID NO: 8578229 - DNA, 19 bp, Homo sapiens
tccagcctgctgtttctct

SEQ ID NO: 8578230 - DNA, 22 bp, Homo sapiens
tccagccacgtattatctcact

SEQ ID NO: 8578231 - DNA, 22 bp, Homo sapiens
tcatgtgtctgccagtgtttat

SEQ ID NO: 8578232 - DNA, 22 bp, Homo sapiens
tcatggcttgcagatggccacc

SEQ ID NO: 8578233 - DNA, 22 bp, Homo sapiens
tcatgtgtcctagttcatataa

SEQ ID NO: 8578234 - DNA, 22 bp, Homo sapiens
tcatgtttttgccatatgactc

SEQ ID NO: 8578235 - DNA, 22 bp, Homo sapiens
tccacagcacaaagccagtgtg

SEQ ID NO: 8578236 - DNA, 22 bp, Homo sapiens
tccacagattaaaaacatactt

SEQ ID NO: 8578237 - DNA, 22 bp, Homo sapiens
tccacagggatgttgagttctt

SEQ ID NO: 8578238 - DNA, 22 bp, Homo sapiens
tacacccaggtaccgtgatttc

SEQ ID NO: 8578239 - DNA, 21 bp, Homo sapiens
tacacaaagcgtggtccagag

SEQ ID NO: 8578240 - DNA, 22 bp, Homo sapiens
tacacaaaggcactctgttgtt

SEQ ID NO: 8578241 - DNA, 22 bp, Homo sapiens
taatttttccacgtacactggg

SEQ ID NO: 8578242 - DNA, 22 bp, Homo sapiens
taagttttaagcaatctgataa

SEQ ID NO: 8578243 - DNA, 22 bp, Homo sapiens
taagcagaaaaagtgggagtta

SEQ ID NO: 8578244 - DNA, 22 bp, Homo sapiens
tacctgcacagccagccatgtg

SEQ ID NO: 8578245 - DNA, 22 bp, Homo sapiens
tacctgcagcgggaatccatta

SEQ ID NO: 8578246 - DNA, 22 bp, Homo sapiens
tacctgttgtcacgataacact

SEQ ID NO: 8578247 - DNA, 22 bp, Homo sapiens
tacctgttttaaagctaaaagg

SEQ ID NO: 8578248 - DNA, 22 bp, Homo sapiens
tacctggggctgggctttgatt

SEQ ID NO: 8578249 - DNA, 22 bp, Homo sapiens
tacctggctggggaatagccag

SEQ ID NO: 8578250 - DNA, 22 bp, Homo sapiens
tacatacacaaatatactgttt

SEQ ID NO: 8578251 - DNA, 22 bp, Homo sapiens
tacatgtctacatgcatttttg

SEQ ID NO: 8578252 - DNA, 22 bp, Homo sapiens
taagaaatttagttatagaatg

SEQ ID NO: 8578253 - DNA, 22 bp, Homo sapiens
taacttctgcacagaaaatttg

SEQ ID NO: 8578254 - DNA, 22 bp, Homo sapiens
taacttctggaaatgcatctgc

SEQ ID NO: 8578255 - DNA, 22 bp, Homo sapiens
taaacatctgaatcctgcttcc

SEQ ID NO: 8578256 - DNA, 22 bp, Homo sapiens
gttttataggtgaaatattact

SEQ ID NO: 8578257 - DNA, 22 bp, Homo sapiens
taaagttataaattacctgtca

SEQ ID NO: 8578258 - DNA, 22 bp, Homo sapiens
taaagtttggcagacaataaca

SEQ ID NO: 8578259 - DNA, 17 bp, Homo sapiens
taaatacacaagggtat

SEQ ID NO: 8578260 - DNA, 22 bp, Homo sapiens
taaatacagtcatttgagccat

SEQ ID NO: 8578261 - DNA, 22 bp, Homo sapiens
gtttctcacttccagtagccaa

SEQ ID NO: 8578262 - DNA, 22 bp, Homo sapiens
gtttatatgaacttcataccca

SEQ ID NO: 8578263 - DNA, 22 bp, Homo sapiens
gtttataaggtaaaggagagag

SEQ ID NO: 8578264 - DNA, 22 bp, Homo sapiens
gtttataatgtctgtgccaaaa

SEQ ID NO: 8578265 - DNA, 22 bp, Homo sapiens
gtttataatccaactctgctcc

SEQ ID NO: 8578266 - DNA, 23 bp, Homo sapiens
gttttacaggtgagaaaatggag

SEQ ID NO: 8578267 - DNA, 22 bp, Homo sapiens
gttttacaaggttaatcagcag

SEQ ID NO: 8578268 - DNA, 22 bp, Homo sapiens
gttttacacacctatgaaagac

SEQ ID NO: 8578269 - DNA, 22 bp, Homo sapiens
gtttataaggcccaatatttct

SEQ ID NO: 8578270 - DNA, 22 bp, Homo sapiens
gtttataaattctgcttttgtt

SEQ ID NO: 8578271 - DNA, 22 bp, Homo sapiens
gttccttggaagaacttgaggt

SEQ ID NO: 8578272 - DNA, 22 bp, Homo sapiens
gttccttgggaacaacgctgaa

SEQ ID NO: 8578273 - DNA, 22 bp, Homo sapiens
gttccttgtaatttgttaagga

SEQ ID NO: 8578274 - DNA, 22 bp, Homo sapiens
gttccttgtatttcagacatga

SEQ ID NO: 8578275 - DNA, 22 bp, Homo sapiens
gttagaataaaaggtcagagag

SEQ ID NO: 8578276 - DNA, 23 bp, Homo sapiens
gttcattttattgtctgattgct

SEQ ID NO: 8578277 - DNA, 22 bp, Homo sapiens
gttcatttttccctaatgagta

SEQ ID NO: 8578278 - DNA, 22 bp, Homo sapiens
gttataaaatgcacagttgttt

SEQ ID NO: 8578279 - DNA, 22 bp, Homo sapiens
gttataaatacctaataggatt

SEQ ID NO: 8578280 - DNA, 22 bp, Homo sapiens
gttataaaggtgataatggtca

SEQ ID NO: 8578281 - DNA, 22 bp, Homo sapiens
gttcattttactgtaaatagca

SEQ ID NO: 8578282 - DNA, 22 bp, Homo sapiens
taggaagggctcagggctcggt

SEQ ID NO: 8578283 - DNA, 22 bp, Homo sapiens
tagtcccggaactccttcaggt

SEQ ID NO: 8578284 - DNA, 22 bp, Homo sapiens
taggttcatgaaattttcagga

SEQ ID NO: 8578285 - DNA, 22 bp, Homo sapiens
taggttcagagaactgaaaata

SEQ ID NO: 8578286 - DNA, 22 bp, Homo sapiens
taggttcagcttccactgccta

SEQ ID NO: 8578287 - DNA, 22 bp, Homo sapiens
taggttcacttagctgtgggaa

SEQ ID NO: 8578288 - DNA, 22 bp, Homo sapiens
taggttcagtgtcttgttctgc

SEQ ID NO: 8578289 - DNA, 22 bp, Homo sapiens
taggttcatattctagaatcat

SEQ ID NO: 8578290 - DNA, 22 bp, Homo sapiens
taggttcaggagatattgcaca

SEQ ID NO: 8578291 - DNA, 22 bp, Homo sapiens
taggttcagctttcatcctgaa

SEQ ID NO: 8578292 - DNA, 22 bp, Homo sapiens
taggttcactgtcttgaggagc

SEQ ID NO: 8578293 - DNA, 22 bp, Homo sapiens
taggttcaagttcaggctctat

SEQ ID NO: 8578294 - DNA, 22 bp, Homo sapiens
taggttcacacatcttccagat

SEQ ID NO: 8578295 - DNA, 22 bp, Homo sapiens
tagaggcaccctggaggagact

SEQ ID NO: 8578296 - DNA, 22 bp, Homo sapiens
tagcagaacaatagtcaatgat

SEQ ID NO: 8578297 - DNA, 22 bp, Homo sapiens
tatgttgatcataggtaaaaga

SEQ ID NO: 8578298 - DNA, 22 bp, Homo sapiens
tatgctaattgttagtcacatg

SEQ ID NO: 8578299 - DNA, 22 bp, Homo sapiens
tattgagttacagaaaatactt

SEQ ID NO: 8578300 - DNA, 22 bp, Homo sapiens
tatttcacataccacagagtgt

SEQ ID NO: 8578301 - DNA, 22 bp, Homo sapiens
tattttcatcttgtccttggat

SEQ ID NO: 8578302 - DNA, 22 bp, Homo sapiens
tattttcattctgtgtgactgt

SEQ ID NO: 8578303 - DNA, 22 bp, Homo sapiens
tattttcaccttctctggatat

SEQ ID NO: 8578304 - DNA, 22 bp, Homo sapiens
tatttgttgagttgttatgtct

SEQ ID NO: 8578305 - DNA, 22 bp, Homo sapiens
tatttctaagagatatctgtac

SEQ ID NO: 8578306 - DNA, 22 bp, Homo sapiens
tagtgtttagtacatatgcata

SEQ ID NO: 8578307 - DNA, 22 bp, Homo sapiens
tagtgtcagcatctcattgagc

SEQ ID NO: 8578308 - DNA, 22 bp, Homo sapiens
tagttaaagccctaaattgata

SEQ ID NO: 8578309 - DNA, 22 bp, Homo sapiens
tagttaaagccctaaattgata

SEQ ID NO: 8578310 - DNA, 22 bp, Homo sapiens
gcatttttcatccctcttgggt

SEQ ID NO: 8578311 - DNA, 22 bp, Homo sapiens
gcatttttctaatcattggcat

SEQ ID NO: 8578312 - DNA, 22 bp, Homo sapiens
gccagcagtcctgctgtgtgcc

SEQ ID NO: 8578313 - DNA, 22 bp, Homo sapiens
gccagaggcccaaggacagctg

SEQ ID NO: 8578314 - DNA, 22 bp, Homo sapiens
gcatctaaataaacgtgggagt

SEQ ID NO: 8578315 - DNA, 22 bp, Homo sapiens
gcatttctgtgcatacacatga

SEQ ID NO: 8578316 - DNA, 22 bp, Homo sapiens
gccaggtctcataaatgcagct

SEQ ID NO: 8578317 - DNA, 22 bp, Homo sapiens
gccaggtctaagcatcagccac

SEQ ID NO: 8578318 - DNA, 22 bp, Homo sapiens
gccaggtctgggtagcagagga

SEQ ID NO: 8578319 - DNA, 22 bp, Homo sapiens
gccaggagaatgctagcagagg

SEQ ID NO: 8578320 - DNA, 22 bp, Homo sapiens
gcccagtggtaaaagcaggcct

SEQ ID NO: 8578321 - DNA, 22 bp, Homo sapiens
gcccatggacacccaagtgcca

SEQ ID NO: 8578322 - DNA, 23 bp, Homo sapiens
gcaagagacagagcatcctgttc

SEQ ID NO: 8578323 - DNA, 18 bp, Homo sapiens
gcaagccctctccattaa

SEQ ID NO: 8578324 - DNA, 22 bp, Homo sapiens
gcacttctatttttttcagtgg

SEQ ID NO: 8578325 - DNA, 22 bp, Homo sapiens
gcagaggacacaggagggcaag

SEQ ID NO: 8578326 - DNA, 22 bp, Homo sapiens
gcaggctcaaaagctggtagga

SEQ ID NO: 8578327 - DNA, 22 bp, Homo sapiens
gcaggctcagagcagattagca

SEQ ID NO: 8578328 - DNA, 22 bp, Homo sapiens
gcaggctcccttgcagagcagg

SEQ ID NO: 8578329 - DNA, 22 bp, Homo sapiens
gcagcaggaatttaaatttata

SEQ ID NO: 8578330 - DNA, 22 bp, Homo sapiens
gcagcaggatggccaattgcca

SEQ ID NO: 8578331 - DNA, 22 bp, Homo sapiens
gctgggagaggccctgaagtga

SEQ ID NO: 8578332 - DNA, 22 bp, Homo sapiens
gctgggagaggcagctttcgga

SEQ ID NO: 8578333 - DNA, 18 bp, Homo sapiens
gctggctgcacttctgct

SEQ ID NO: 8578334 - DNA, 22 bp, Homo sapiens
gctggctgccttactttgtgga

SEQ ID NO: 8578335 - DNA, 22 bp, Homo sapiens
gctgggtttccagcaggcagga

SEQ ID NO: 8578336 - DNA, 22 bp, Homo sapiens
gctgggtttccagcaggcagga

SEQ ID NO: 8578337 - DNA, 22 bp, Homo sapiens
gctgggttttcttccgggccta

SEQ ID NO: 8578338 - DNA, 22 bp, Homo sapiens
gctgggaggcagcacctttagc

SEQ ID NO: 8578339 - DNA, 16 bp, Homo sapiens
gctgggagggagaggt

SEQ ID NO: 8578340 - DNA, 22 bp, Homo sapiens
gctgtcttgatgattggatgct

SEQ ID NO: 8578341 - DNA, 22 bp, Homo sapiens
ggaaagctttgtacttgaaaac

SEQ ID NO: 8578342 - DNA, 22 bp, Homo sapiens
ggaaagtggtggtggaaagagg

SEQ ID NO: 8578343 - DNA, 22 bp, Homo sapiens
gcttcctagcattagccattgc

SEQ ID NO: 8578344 - DNA, 22 bp, Homo sapiens
gcttcctgagaaacaatctgat

SEQ ID NO: 8578345 - DNA, 22 bp, Homo sapiens
gcttcctccctgctgctcacta

SEQ ID NO: 8578346 - DNA, 22 bp, Homo sapiens
ggaaggaaagcagcttggccct

SEQ ID NO: 8578347 - DNA, 22 bp, Homo sapiens
ggaaggaacaaaccctgtgtgg

SEQ ID NO: 8578348 - DNA, 22 bp, Homo sapiens
ggagaggcgatgagtcacagcc

SEQ ID NO: 8578349 - DNA, 22 bp, Homo sapiens
ggactctcaggctgtcggcttc

SEQ ID NO: 8578350 - DNA, 22 bp, Homo sapiens
gctctggctactccaccctgtt

SEQ ID NO: 8578351 - DNA, 22 bp, Homo sapiens
gctctggccagaccctcagtgg

SEQ ID NO: 8578352 - DNA, 22 bp, Homo sapiens
gctctggctactgtggctaccg

SEQ ID NO: 8578353 - DNA, 23 bp, Homo sapiens
gctctggcagcttgtgtcagcac

SEQ ID NO: 8578354 - DNA, 22 bp, Homo sapiens
gctcctggtctggagcttcaag

SEQ ID NO: 8578355 - DNA, 22 bp, Homo sapiens
gctgcaggagctggagctgtgg

SEQ ID NO: 8578356 - DNA, 22 bp, Homo sapiens
gctgaagtgcttttgaatttgg

SEQ ID NO: 8578357 - DNA, 22 bp, Homo sapiens
gctgaagtctgagaatttgcaa

SEQ ID NO: 8578358 - DNA, 22 bp, Homo sapiens
gcggggcccggacccagcctct

SEQ ID NO: 8578359 - DNA, 22 bp, Homo sapiens
gcggggcccccggccgagctct

SEQ ID NO: 8578360 - DNA, 22 bp, Homo sapiens
gcgggggcggcgcagacctcag

SEQ ID NO: 8578361 - DNA, 22 bp, Homo sapiens
gcggggggcagcagtcgctcag

SEQ ID NO: 8578362 - DNA, 22 bp, Homo sapiens
gctcaccactgctagagtctat

SEQ ID NO: 8578363 - DNA, 22 bp, Homo sapiens
gccttctgtgctcctggccttt

SEQ ID NO: 8578364 - DNA, 22 bp, Homo sapiens
gccttctgtccaaccccacgat

SEQ ID NO: 8578365 - DNA, 22 bp, Homo sapiens
gccttctgcgctcgtgtctccg

SEQ ID NO: 8578366 - DNA, 22 bp, Homo sapiens
gccttctgatcgctggactgac

SEQ ID NO: 8578367 - DNA, 22 bp, Homo sapiens
gccttctgattgctggactgac

SEQ ID NO: 8578368 - DNA, 22 bp, Homo sapiens
gccttctgatatctcttggcat

SEQ ID NO: 8578369 - DNA, 22 bp, Homo sapiens
gcggcaggagtaaaggaggaag

SEQ ID NO: 8578370 - DNA, 22 bp, Homo sapiens
gcggcgcctaagccccgacctc

SEQ ID NO: 8578371 - DNA, 22 bp, Homo sapiens
gcgggcgggggttcccaggtct

SEQ ID NO: 8578372 - DNA, 22 bp, Homo sapiens
gcggagggcgagcccgcggagc

SEQ ID NO: 8578373 - DNA, 22 bp, Homo sapiens
gcctggtggtgtgctcaagtgg

SEQ ID NO: 8578374 - DNA, 22 bp, Homo sapiens
gcctgggtgtcgatcactagtg

SEQ ID NO: 8578375 - DNA, 21 bp, Homo sapiens
ggctggacatcccaggagact

SEQ ID NO: 8578376 - DNA, 21 bp, Homo sapiens
ggctggtcgcgtgcatgtctc

SEQ ID NO: 8578377 - DNA, 22 bp, Homo sapiens
ggctccctgggtgctcctgctc

SEQ ID NO: 8578378 - DNA, 22 bp, Homo sapiens
ggcgtggggccttctgcccgct

SEQ ID NO: 8578379 - DNA, 22 bp, Homo sapiens
gggagggccaggctcacccagg

SEQ ID NO: 8578380 - DNA, 22 bp, Homo sapiens
gggcaggttattggagtaggga

SEQ ID NO: 8578381 - DNA, 22 bp, Homo sapiens
gggcaggttggcatcccgggca

SEQ ID NO: 8578382 - DNA, 23 bp, Homo sapiens
gggcaggtttttataggcttcag

SEQ ID NO: 8578383 - DNA, 22 bp, Homo sapiens
ggctttatagggtagaggatca

SEQ ID NO: 8578384 - DNA, 22 bp, Homo sapiens
ggctttatattgtttgagcaga

SEQ ID NO: 8578385 - DNA, 22 bp, Homo sapiens
ggctttatgcagggatagaaat

SEQ ID NO: 8578386 - DNA, 22 bp, Homo sapiens
ggctttatgcacagcagatggt

SEQ ID NO: 8578387 - DNA, 22 bp, Homo sapiens
ggctttatcaaatgagaccctg

SEQ ID NO: 8578388 - DNA, 22 bp, Homo sapiens
ggctttattatgtggccatgtg

SEQ ID NO: 8578389 - DNA, 22 bp, Homo sapiens
ggctttatttcactgtaccata

SEQ ID NO: 8578390 - DNA, 22 bp, Homo sapiens
ggctttatttgcagccattgtt

SEQ ID NO: 8578391 - DNA, 21 bp, Homo sapiens
ggctttatgctcacccagcct

SEQ ID NO: 8578392 - DNA, 22 bp, Homo sapiens
ggctttatgtttttcatgtggt

SEQ ID NO: 8578393 - DNA, 22 bp, Homo sapiens
ggctttattaactcatccgtaa

SEQ ID NO: 8578394 - DNA, 22 bp, Homo sapiens
ggctttattaagcagggtaagt

SEQ ID NO: 8578395 - DNA, 22 bp, Homo sapiens
ggctttattttgcatgaatgct

SEQ ID NO: 8578396 - DNA, 22 bp, Homo sapiens
ggagcaagtcccaggcactagt

SEQ ID NO: 8578397 - DNA, 22 bp, Homo sapiens
ggagcagagcatttcacagcct

SEQ ID NO: 8578398 - DNA, 22 bp, Homo sapiens
ggagcagatgtcttcatggcct

SEQ ID NO: 8578399 - DNA, 22 bp, Homo sapiens
ggatgggaacttggtagggcat

SEQ ID NO: 8578400 - DNA, 22 bp, Homo sapiens
ggcactttgcctttatgcactg

SEQ ID NO: 8578401 - DNA, 22 bp, Homo sapiens
ggcactttgattttgagatgca

SEQ ID NO: 8578402 - DNA, 22 bp, Homo sapiens
ggcacttttctccccggtcatg

SEQ ID NO: 8578403 - DNA, 22 bp, Homo sapiens
ggcggggtctgagcgccgcgcc

SEQ ID NO: 8578404 - DNA, 22 bp, Homo sapiens
ggcgggtgcacagacccttccc

SEQ ID NO: 8578405 - DNA, 22 bp, Homo sapiens
ggcgggtggcgaggcttctcgg

SEQ ID NO: 8578406 - DNA, 22 bp, Homo sapiens
ggcctggagtcagggaaagcaa

SEQ ID NO: 8578407 - DNA, 21 bp, Homo sapiens
ggccctggttacgcctcctct

SEQ ID NO: 8578408 - DNA, 22 bp, Homo sapiens
ggcctcacccatcggtgccttt

SEQ ID NO: 8578409 - DNA, 22 bp, Homo sapiens
ggccaggcactgtgtgagatat

SEQ ID NO: 8578410 - DNA, 22 bp, Homo sapiens
ggccaggccaagagggttggaa

SEQ ID NO: 8578411 - DNA, 22 bp, Homo sapiens
ggcatcttgttgctcaaatcta

SEQ ID NO: 8578412 - DNA, 22 bp, Homo sapiens
ggcaggtcaggtccatgaccaa

SEQ ID NO: 8578413 - DNA, 22 bp, Homo sapiens
ggcaggtagcctagaggaggtt

SEQ ID NO: 8578414 - DNA, 22 bp, Homo sapiens
ggcaggtcatcaactgtaattt

SEQ ID NO: 8578415 - DNA, 19 bp, Homo sapiens
ggcaggtagagggccagtc

SEQ ID NO: 8578416 - DNA, 22 bp, Homo sapiens
ggcaggtacagcaagaggacaa

SEQ ID NO: 8578417 - DNA, 22 bp, Homo sapiens
ggcagggtttacaatagcaata

SEQ ID NO: 8578418 - DNA, 22 bp, Homo sapiens
ggcagggtggccctccagtgag

SEQ ID NO: 8578419 - DNA, 22 bp, Homo sapiens
ggcagggtggcagaggctcaga

SEQ ID NO: 8578420 - DNA, 22 bp, Homo sapiens
ggcagggtaaaccgaggtaagt

SEQ ID NO: 8578421 - DNA, 22 bp, Homo sapiens
ggcaggggtgaggccactctga

SEQ ID NO: 8578422 - DNA, 21 bp, Homo sapiens
gggcctggctgcgcaggacgg

SEQ ID NO: 8578423 - DNA, 22 bp, Homo sapiens
gggggcggagcacgtgaccacg

SEQ ID NO: 8578424 - DNA, 23 bp, Homo sapiens
gggggcgtgtcatggagggccac

SEQ ID NO: 8578425 - DNA, 22 bp, Homo sapiens
gggctgggcatggtgttccctc

SEQ ID NO: 8578426 - DNA, 22 bp, Homo sapiens
ggggcaaagggagagtccctac

SEQ ID NO: 8578427 - DNA, 22 bp, Homo sapiens
ggtgccaggctgtagtcagggt

SEQ ID NO: 8578428 - DNA, 22 bp, Homo sapiens
ggtgcccagcaagctttcaatg

SEQ ID NO: 8578429 - DNA, 22 bp, Homo sapiens
ggtgcccagcgaagtggctgtg

SEQ ID NO: 8578430 - DNA, 22 bp, Homo sapiens
ggtgcccacctgtcttcctgga

SEQ ID NO: 8578431 - DNA, 22 bp, Homo sapiens
ggtgcccagagccaggaatgag

SEQ ID NO: 8578432 - DNA, 22 bp, Homo sapiens
ggtgggatcaaagagtcattcg

SEQ ID NO: 8578433 - DNA, 23 bp, Homo sapiens
ggtgggagattatccagaattat

SEQ ID NO: 8578434 - DNA, 22 bp, Homo sapiens
ggtgcagggagaggcaggcccc

SEQ ID NO: 8578435 - DNA, 22 bp, Homo sapiens
ggtcccagaattggttagcaca

SEQ ID NO: 8578436 - DNA, 22 bp, Homo sapiens
ggtctgtgctctggagcctctg

SEQ ID NO: 8578437 - DNA, 22 bp, Homo sapiens
gggtccagatggtgagagttaa

SEQ ID NO: 8578438 - DNA, 16 bp, Homo sapiens
gggtccagatctgctc

SEQ ID NO: 8578439 - DNA, 22 bp, Homo sapiens
gggtccagcgacagcaggctca

SEQ ID NO: 8578440 - DNA, 23 bp, Homo sapiens
gggtccagccaattccaaggaaa

SEQ ID NO: 8578441 - DNA, 23 bp, Homo sapiens
ggtaccagcacagagtggagagg

SEQ ID NO: 8578442 - DNA, 22 bp, Homo sapiens
gggtccagaatgagaatgggct

SEQ ID NO: 8578443 - DNA, 22 bp, Homo sapiens
gggtccagactatgaagaactt

SEQ ID NO: 8578444 - DNA, 22 bp, Homo sapiens
gggtccagacactccagaggaa

SEQ ID NO: 8578445 - DNA, 23 bp, Homo sapiens
gggtccagagaagccattagggc

SEQ ID NO: 8578446 - DNA, 23 bp, Homo sapiens
gggtccagagacaggcatgggtg

SEQ ID NO: 8578447 - DNA, 22 bp, Homo sapiens
gggtccagagcctcagcccaga

SEQ ID NO: 8578448 - DNA, 22 bp, Homo sapiens
gggtccagagttttcccgccct

SEQ ID NO: 8578449 - DNA, 22 bp, Homo sapiens
gggtccagagttgaagaggtta

SEQ ID NO: 8578450 - DNA, 22 bp, Homo sapiens
ggtcaggggctgctctacagag

SEQ ID NO: 8578451 - DNA, 18 bp, Homo sapiens
ggtcaggggcggagagaa

SEQ ID NO: 8578452 - DNA, 22 bp, Homo sapiens
ggtcagggggatctgtgaggta

SEQ ID NO: 8578453 - DNA, 23 bp, Homo sapiens
ggtccaggaaaggcagcagcacc

SEQ ID NO: 8578454 - DNA, 19 bp, Homo sapiens
ggtccagacttcagactag

SEQ ID NO: 8578455 - DNA, 22 bp, Homo sapiens
ggtccagagtccttgctagaga

SEQ ID NO: 8578456 - DNA, 22 bp, Homo sapiens
ggtccagggaactttgaaggat

SEQ ID NO: 8578457 - DNA, 22 bp, Homo sapiens
ggtccagggggtagatatgtga

SEQ ID NO: 8578458 - DNA, 22 bp, Homo sapiens
ggtccagggggtagatatgtga

SEQ ID NO: 8578459 - DNA, 22 bp, Homo sapiens
ggtccaggtatgtggtgtgaat

SEQ ID NO: 8578460 - DNA, 22 bp, Homo sapiens
gtctggtgggattccaagtggc

SEQ ID NO: 8578461 - DNA, 22 bp, Homo sapiens
gtgctggggagataggaagaga

SEQ ID NO: 8578462 - DNA, 22 bp, Homo sapiens
gtgccctgtctcttgtctccag

SEQ ID NO: 8578463 - DNA, 22 bp, Homo sapiens
gtgccctgtgaactgtaaggaa

SEQ ID NO: 8578464 - DNA, 20 bp, Homo sapiens
gtgccctgtgggctattttc

SEQ ID NO: 8578465 - DNA, 22 bp, Homo sapiens
gtgccctgttcatttctctccc

SEQ ID NO: 8578466 - DNA, 21 bp, Homo sapiens
gtgccctgttcccacatgccc

SEQ ID NO: 8578467 - DNA, 22 bp, Homo sapiens
gtgccctgttgcacacttgagg

SEQ ID NO: 8578468 - DNA, 22 bp, Homo sapiens
gtgccctgggccttcagggcca

SEQ ID NO: 8578469 - DNA, 22 bp, Homo sapiens
gtgccctggctcacagtgtctc

SEQ ID NO: 8578470 - DNA, 22 bp, Homo sapiens
gtgccctggtccccagcatata

SEQ ID NO: 8578471 - DNA, 22 bp, Homo sapiens
gtgccctggggtgaacccctgg

SEQ ID NO: 8578472 - DNA, 22 bp, Homo sapiens
gtgcaaaaatctatcaccagca

SEQ ID NO: 8578473 - DNA, 22 bp, Homo sapiens
gtgccctgaggtcttcactttg

SEQ ID NO: 8578474 - DNA, 22 bp, Homo sapiens
gtgccctgagcttatgcattct

SEQ ID NO: 8578475 - DNA, 22 bp, Homo sapiens
gtgccctggatgactttggtct

SEQ ID NO: 8578476 - DNA, 22 bp, Homo sapiens
gtgccctggaggggttgaaggg

SEQ ID NO: 8578477 - DNA, 22 bp, Homo sapiens
gtgccctgcatgccccgggtat

SEQ ID NO: 8578478 - DNA, 22 bp, Homo sapiens
gtgccctgatgcaattgtctca

SEQ ID NO: 8578479 - DNA, 22 bp, Homo sapiens
gtgccctgagtgggtaggagag

SEQ ID NO: 8578480 - DNA, 22 bp, Homo sapiens
gtgccctgatcgctaggctccc

SEQ ID NO: 8578481 - DNA, 22 bp, Homo sapiens
gtgcaagtccagaaagaactct

SEQ ID NO: 8578482 - DNA, 22 bp, Homo sapiens
gtcaatatattctgtctctttg

SEQ ID NO: 8578483 - DNA, 22 bp, Homo sapiens
gtcagtgtgagataatcttgga

SEQ ID NO: 8578484 - DNA, 22 bp, Homo sapiens
gtcaggtcttggaagataggct

SEQ ID NO: 8578485 - DNA, 22 bp, Homo sapiens
gtccctggatctgggacagctg

SEQ ID NO: 8578486 - DNA, 22 bp, Homo sapiens
gtccctggagctgagcagtgct

SEQ ID NO: 8578487 - DNA, 21 bp, Homo sapiens
gtagataaagcattttcatta

SEQ ID NO: 8578488 - DNA, 22 bp, Homo sapiens
gtagatgagctcacatgacctt

SEQ ID NO: 8578489 - DNA, 22 bp, Homo sapiens
gtagctctgtttaaagttcttt

SEQ ID NO: 8578490 - DNA, 22 bp, Homo sapiens
gtcaagatgagaattcttttta

SEQ ID NO: 8578491 - DNA, 22 bp, Homo sapiens
gtaaattatttcaagatcatct

SEQ ID NO: 8578492 - DNA, 20 bp, Homo sapiens
ctgccctgccctgggtcctg

SEQ ID NO: 8578493 - DNA, 22 bp, Homo sapiens
ctgccctgcctggccagtgtgg

SEQ ID NO: 8578494 - DNA, 22 bp, Homo sapiens
ctgccctgcccaggccttgggc

SEQ ID NO: 8578495 - DNA, 22 bp, Homo sapiens
ctgccctgctggagatcacagt

SEQ ID NO: 8578496 - DNA, 22 bp, Homo sapiens
ctgccctgcttctgagggaagc

SEQ ID NO: 8578497 - DNA, 22 bp, Homo sapiens
ctgccctgctctccgggatctt

SEQ ID NO: 8578498 - DNA, 22 bp, Homo sapiens
ctgccctgctaatgagttccaa

SEQ ID NO: 8578499 - DNA, 22 bp, Homo sapiens
ctgccctgagtcatgccagatg

SEQ ID NO: 8578500 - DNA, 22 bp, Homo sapiens
ctgccctgatatgatttagaac

SEQ ID NO: 8578501 - DNA, 23 bp, Homo sapiens
ctgccctgatcttgatctattgt

SEQ ID NO: 8578502 - DNA, 22 bp, Homo sapiens
ctgccctgcagctccacggact

SEQ ID NO: 8578503 - DNA, 22 bp, Homo sapiens
ctgccctgagggcctgtgtgtt

SEQ ID NO: 8578504 - DNA, 22 bp, Homo sapiens
ctgccctgggccaggaagcggc

SEQ ID NO: 8578505 - DNA, 22 bp, Homo sapiens
ctgccctgcttgatgacagcga

SEQ ID NO: 8578506 - DNA, 22 bp, Homo sapiens
ctgccctggcagcctaccatgg

SEQ ID NO: 8578507 - DNA, 22 bp, Homo sapiens
ctgccctggaaaacgtatctta

SEQ ID NO: 8578508 - DNA, 22 bp, Homo sapiens
ctgccctgcttgtttccagtgg

SEQ ID NO: 8578509 - DNA, 22 bp, Homo sapiens
ctgccctgggatggtctgtgcg

SEQ ID NO: 8578510 - DNA, 22 bp, Homo sapiens
ctgccctgggagtacctgtcct

SEQ ID NO: 8578511 - DNA, 22 bp, Homo sapiens
ctgccctggccactgtgcccag

SEQ ID NO: 8578512 - DNA, 22 bp, Homo sapiens
ctgagggctggagctgaggcct

SEQ ID NO: 8578513 - DNA, 21 bp, Homo sapiens
ctgagggccgcagctgggctc

SEQ ID NO: 8578514 - DNA, 22 bp, Homo sapiens
ttttcagtttgcactgcagtgc

SEQ ID NO: 8578515 - DNA, 22 bp, Homo sapiens
ttttctccaactcaaaggaaag

SEQ ID NO: 8578516 - DNA, 21 bp, Homo sapiens
ttttctccagctgtgatttta

SEQ ID NO: 8578517 - DNA, 22 bp, Homo sapiens
ttttctccagggaacaaggtga

SEQ ID NO: 8578518 - DNA, 22 bp, Homo sapiens
ttttctccccagagaccatcat

SEQ ID NO: 8578519 - DNA, 22 bp, Homo sapiens
ttttctcccgctggctgctctt

SEQ ID NO: 8578520 - DNA, 22 bp, Homo sapiens
ttttctcctaagacccttcacc

SEQ ID NO: 8578521 - DNA, 17 bp, Homo sapiens
ttttctcctgcccattc

SEQ ID NO: 8578522 - DNA, 22 bp, Homo sapiens
ttttctctatattgtctgtgaa

SEQ ID NO: 8578523 - DNA, 22 bp, Homo sapiens
ttttctctacaaaataaccagc

SEQ ID NO: 8578524 - DNA, 22 bp, Homo sapiens
ttttctcctttctaggtcacat

SEQ ID NO: 8578525 - DNA, 22 bp, Homo sapiens
ttttctcctttcaagatagcat

SEQ ID NO: 8578526 - DNA, 19 bp, Homo sapiens
tttttacaagtaggtgtga

SEQ ID NO: 8578527 - DNA, 22 bp, Homo sapiens
tttttctcttctgtaaagtggt

SEQ ID NO: 8578528 - DNA, 22 bp, Homo sapiens
ctgaagattataaacagacata

SEQ ID NO: 8578529 - DNA, 22 bp, Homo sapiens
tttttcttgtgctggatctaat

SEQ ID NO: 8578530 - DNA, 22 bp, Homo sapiens
tttttcttaaatgtgggttggc

SEQ ID NO: 8578531 - DNA, 22 bp, Homo sapiens
ctgagggagaagtcacgggcag

SEQ ID NO: 8578532 - DNA, 18 bp, Homo sapiens
ctgaggctggcaggagcc

SEQ ID NO: 8578533 - DNA, 22 bp, Homo sapiens
ctgaggctgggcatggggtcca

SEQ ID NO: 8578534 - DNA, 22 bp, Homo sapiens
ctgaggacattgatgaggcaat

SEQ ID NO: 8578535 - DNA, 22 bp, Homo sapiens
ctctagctgaggtcactgctat

SEQ ID NO: 8578536 - DNA, 22 bp, Homo sapiens
tttctctcagcctgtagaaact

SEQ ID NO: 8578537 - DNA, 22 bp, Homo sapiens
tttctgcaacgagtctttgact

SEQ ID NO: 8578538 - DNA, 22 bp, Homo sapiens
tttcttgactgcttaggaatgc

SEQ ID NO: 8578539 - DNA, 22 bp, Homo sapiens
tttcttatattctgtcattgtt

SEQ ID NO: 8578540 - DNA, 22 bp, Homo sapiens
tttcttatactatattgtcatc

SEQ ID NO: 8578541 - DNA, 22 bp, Homo sapiens
tttcttgaccactatgttgata

SEQ ID NO: 8578542 - DNA, 22 bp, Homo sapiens
tttcttcttgatttaaacaggg

SEQ ID NO: 8578543 - DNA, 22 bp, Homo sapiens
ctccctgtgtcttcacttggcc

SEQ ID NO: 8578544 - DNA, 22 bp, Homo sapiens
ctccctggtgactcccaaagct

SEQ ID NO: 8578545 - DNA, 23 bp, Homo sapiens
ctccctgaacatgacacaccaga

SEQ ID NO: 8578546 - DNA, 22 bp, Homo sapiens
ctccctgcttgtttcccttcag

SEQ ID NO: 8578547 - DNA, 22 bp, Homo sapiens
tttatattacctggaatagctt

SEQ ID NO: 8578548 - DNA, 22 bp, Homo sapiens
ctcctgggcttcgaaggctccc

SEQ ID NO: 8578549 - DNA, 22 bp, Homo sapiens
ctcctgctgaatggccaggagc

SEQ ID NO: 8578550 - DNA, 22 bp, Homo sapiens
tttacaagtttacagaatgatg

SEQ ID NO: 8578551 - DNA, 22 bp, Homo sapiens
ttacctaaaatagctcaattta

SEQ ID NO: 8578552 - DNA, 22 bp, Homo sapiens
ccttcttgaggtagcacattct

SEQ ID NO: 8578553 - DNA, 22 bp, Homo sapiens
ccttgtgcaggttcatgatggg

SEQ ID NO: 8578554 - DNA, 22 bp, Homo sapiens
cctttaaagactgcataacttc

SEQ ID NO: 8578555 - DNA, 22 bp, Homo sapiens
ttacctgtgtgtttgatacata

SEQ ID NO: 8578556 - DNA, 22 bp, Homo sapiens
ttacctgtgtcagtatatgaga

SEQ ID NO: 8578557 - DNA, 22 bp, Homo sapiens
ttacctgttttacatgcacaac

SEQ ID NO: 8578558 - DNA, 22 bp, Homo sapiens
cgcaccactgaattccagcctg

SEQ ID NO: 8578559 - DNA, 21 bp, Homo sapiens
cgcagagcgaacttgcggcgc

SEQ ID NO: 8578560 - DNA, 22 bp, Homo sapiens
ttcaaaacaatctgtttgcatt

SEQ ID NO: 8578561 - DNA, 22 bp, Homo sapiens
cctttgatttcccccgtctcag

SEQ ID NO: 8578562 - DNA, 22 bp, Homo sapiens
cctttctgatggcctcccagcc

SEQ ID NO: 8578563 - DNA, 22 bp, Homo sapiens
cctggggccccgagccagaagc

SEQ ID NO: 8578564 - DNA, 22 bp, Homo sapiens
cctggggagaagagcttccccc

SEQ ID NO: 8578565 - DNA, 22 bp, Homo sapiens
cctggggagccgcctgagcccc

SEQ ID NO: 8578566 - DNA, 22 bp, Homo sapiens
tgtttctgtatgatcaatattg

SEQ ID NO: 8578567 - DNA, 22 bp, Homo sapiens
tgtttcttctcacacaaactca

SEQ ID NO: 8578568 - DNA, 22 bp, Homo sapiens
tggttcctacgcacattgaatt

SEQ ID NO: 8578569 - DNA, 22 bp, Homo sapiens
cctgtggctgccacttgggtga

SEQ ID NO: 8578570 - DNA, 22 bp, Homo sapiens
tgttttctcttgaaaagcagtc

SEQ ID NO: 8578571 - DNA, 23 bp, Homo sapiens
ttgaatagggtggcaacaaactg

SEQ ID NO: 8578572 - DNA, 22 bp, Homo sapiens
ttgaagtcagttcatattttta

SEQ ID NO: 8578573 - DNA, 18 bp, Homo sapiens
ttgaagttatttacattc

SEQ ID NO: 8578574 - DNA, 22 bp, Homo sapiens
ttgaaatatcaagttattagtg

SEQ ID NO: 8578575 - DNA, 22 bp, Homo sapiens
ttgaaggtttaactgagaggca

SEQ ID NO: 8578576 - DNA, 22 bp, Homo sapiens
ttgaaggtgacatatctggagc

SEQ ID NO: 8578577 - DNA, 22 bp, Homo sapiens
ttgaaggtaaattatattgatc

SEQ ID NO: 8578578 - DNA, 22 bp, Homo sapiens
ttcttaatggcaaaggatttta

SEQ ID NO: 8578579 - DNA, 22 bp, Homo sapiens
ttcttaaagaggcaaaacacag

SEQ ID NO: 8578580 - DNA, 22 bp, Homo sapiens
ctataaatctacccagcattgg

SEQ ID NO: 8578581 - DNA, 22 bp, Homo sapiens
ttgcactccagcccgagcaaca

SEQ ID NO: 8578582 - DNA, 22 bp, Homo sapiens
ttgatttttccagcttctagag

SEQ ID NO: 8578583 - DNA, 22 bp, Homo sapiens
cgtctggcttctccacggtaaa

SEQ ID NO: 8578584 - DNA, 22 bp, Homo sapiens
cgtccgcaatgcaagcctttta

SEQ ID NO: 8578585 - DNA, 22 bp, Homo sapiens
cgtcatcacggcaagcatctcc

SEQ ID NO: 8578586 - DNA, 22 bp, Homo sapiens
ttctccttgaaaagctgcatct

SEQ ID NO: 8578587 - DNA, 22 bp, Homo sapiens
ctaaattatcatgagaattatg

SEQ ID NO: 8578588 - DNA, 22 bp, Homo sapiens
gaggaaaatggagtgtaattaa

SEQ ID NO: 8578589 - DNA, 22 bp, Homo sapiens
gaggcaggcactgttatcagca

SEQ ID NO: 8578590 - DNA, 22 bp, Homo sapiens
gaggcaggaggattgcttgagc

SEQ ID NO: 8578591 - DNA, 22 bp, Homo sapiens
gaggcaggcagattgcttgagg

SEQ ID NO: 8578592 - DNA, 22 bp, Homo sapiens
gaggcagtttgccatgccagga

SEQ ID NO: 8578593 - DNA, 22 bp, Homo sapiens
gaggcagggtgttgattacaga

SEQ ID NO: 8578594 - DNA, 22 bp, Homo sapiens
gaggcaggccctgaatgagtca

SEQ ID NO: 8578595 - DNA, 22 bp, Homo sapiens
gaggcagtccagtgggtaagaa

SEQ ID NO: 8578596 - DNA, 22 bp, Homo sapiens
gaggcagtaattgtgggcaata

SEQ ID NO: 8578597 - DNA, 22 bp, Homo sapiens
gaggcagtgtcggtggcaggat

SEQ ID NO: 8578598 - DNA, 22 bp, Homo sapiens
gaggcagtgcattgtctagggg

SEQ ID NO: 8578599 - DNA, 22 bp, Homo sapiens
gaggcagtggtctgatgcaagg

SEQ ID NO: 8578600 - DNA, 22 bp, Homo sapiens
gaatccagggttgtttgagcta

SEQ ID NO: 8578601 - DNA, 22 bp, Homo sapiens
gaatatttgtaattactgttga

SEQ ID NO: 8578602 - DNA, 22 bp, Homo sapiens
gaaggtccagcgtggccaagtc

SEQ ID NO: 8578603 - DNA, 22 bp, Homo sapiens
gaagggggagctcttcctaatt

SEQ ID NO: 8578604 - DNA, 22 bp, Homo sapiens
gaagggggttgcagtctagggt

SEQ ID NO: 8578605 - DNA, 22 bp, Homo sapiens
gacactgttatggtgaggtaag

SEQ ID NO: 8578606 - DNA, 22 bp, Homo sapiens
gaatgacccactatcaagagac

SEQ ID NO: 8578607 - DNA, 22 bp, Homo sapiens
gaagccaacattccaagtagaa

SEQ ID NO: 8578608 - DNA, 22 bp, Homo sapiens
gagaaagatgtaggctgggagg

SEQ ID NO: 8578609 - DNA, 22 bp, Homo sapiens
gagaaagaaagggaagtttgtt

SEQ ID NO: 8578610 - DNA, 22 bp, Homo sapiens
gagaaagacgtaggctgggagg

SEQ ID NO: 8578611 - DNA, 22 bp, Homo sapiens
gagagaaagcccctgcatccct

SEQ ID NO: 8578612 - DNA, 22 bp, Homo sapiens
gagagaaaaatgagcttcattg

SEQ ID NO: 8578613 - DNA, 22 bp, Homo sapiens
gactctgtgggaggaggctcag

SEQ ID NO: 8578614 - DNA, 22 bp, Homo sapiens
gacagcagacaaaccatgtttt

SEQ ID NO: 8578615 - DNA, 22 bp, Homo sapiens
gacagcagagcagactaatgga

SEQ ID NO: 8578616 - DNA, 22 bp, Homo sapiens
ctttacaaatagggagggagtg

SEQ ID NO: 8578617 - DNA, 22 bp, Homo sapiens
ctttgaaaacttaaataacagc

SEQ ID NO: 8578618 - DNA, 22 bp, Homo sapiens
ctttgatataagtatacatagt

SEQ ID NO: 8578619 - DNA, 22 bp, Homo sapiens
gaaacaatcatcatgtgatttg

SEQ ID NO: 8578620 - DNA, 22 bp, Homo sapiens
gaaacaatttttgttgtctaag

SEQ ID NO: 8578621 - DNA, 22 bp, Homo sapiens
cttttacatttgttgaagagta

SEQ ID NO: 8578622 - DNA, 21 bp, Homo sapiens
cttttacattcagtcatgatg

SEQ ID NO: 8578623 - DNA, 22 bp, Homo sapiens
cttttacagtggacctgccatt

SEQ ID NO: 8578624 - DNA, 22 bp, Homo sapiens
cttttcttatgtggacgtacct

SEQ ID NO: 8578625 - DNA, 22 bp, Homo sapiens
cttttctggaatcatctctaac

SEQ ID NO: 8578626 - DNA, 22 bp, Homo sapiens
cttttctgtatcaaaaggatta

SEQ ID NO: 8578627 - DNA, 22 bp, Homo sapiens
cttttctgtgatgctgacagtc

SEQ ID NO: 8578628 - DNA, 22 bp, Homo sapiens
cttccaagttgctctgctgacc

SEQ ID NO: 8578629 - DNA, 20 bp, Homo sapiens
cttccacacaagaagcacag

SEQ ID NO: 8578630 - DNA, 22 bp, Homo sapiens
cttagcatgcagtgttctgccc

SEQ ID NO: 8578631 - DNA, 22 bp, Homo sapiens
cttataaagtccatctgaacaa

SEQ ID NO: 8578632 - DNA, 22 bp, Homo sapiens
cttataaagtccatctgaacaa

SEQ ID NO: 8578633 - DNA, 22 bp, Homo sapiens
cttcagttagccaattcaggtc

SEQ ID NO: 8578634 - DNA, 22 bp, Homo sapiens
cttcatttggagaactgtgctt

SEQ ID NO: 8578635 - DNA, 18 bp, Homo sapiens
cttcatttgtagagttcc

SEQ ID NO: 8578636 - DNA, 22 bp, Homo sapiens
cttcatttcaggctgaagaata

SEQ ID NO: 8578637 - DNA, 22 bp, Homo sapiens
cttaatgtggacctggtttcta

SEQ ID NO: 8578638 - DNA, 22 bp, Homo sapiens
cttacaagaccaaagaaaggat

SEQ ID NO: 8578639 - DNA, 22 bp, Homo sapiens
cttaaactgggcattcagagaa

SEQ ID NO: 8578640 - DNA, 22 bp, Homo sapiens
ctgtgcttgtgttcattgttaa

SEQ ID NO: 8578641 - DNA, 22 bp, Homo sapiens
ctgtgcttgcgggtgtggagcc

SEQ ID NO: 8578642 - DNA, 21 bp, Homo sapiens
ctgtgctttttaagtgtgatg

SEQ ID NO: 8578643 - DNA, 22 bp, Homo sapiens
ctgtgctttcgagatgtgatct

SEQ ID NO: 8578644 - DNA, 22 bp, Homo sapiens
ctgggagatgactcagagcagg

SEQ ID NO: 8578645 - DNA, 22 bp, Homo sapiens
ctgggagatctcctgagggcag

SEQ ID NO: 8578646 - DNA, 22 bp, Homo sapiens
ctgggagaggctgctccgctct

SEQ ID NO: 8578647 - DNA, 22 bp, Homo sapiens
ctgggacatattgctagtgttg

SEQ ID NO: 8578648 - DNA, 22 bp, Homo sapiens
ctgggacacccagagctgcaga

SEQ ID NO: 8578649 - DNA, 22 bp, Homo sapiens
ctgggctgtttgttctggtctc

SEQ ID NO: 8578650 - DNA, 22 bp, Homo sapiens
ctgggctagaaggaccaggatg

SEQ ID NO: 8578651 - DNA, 22 bp, Homo sapiens
ctggtgaatggataaactgttg

SEQ ID NO: 8578652 - DNA, 22 bp, Homo sapiens
ctgtgcttcagagtcagtgctg

SEQ ID NO: 8578653 - DNA, 22 bp, Homo sapiens
ccagggaagattagaagccact

SEQ ID NO: 8578654 - DNA, 23 bp, Homo sapiens
ccagggaggttgattggttaccc

SEQ ID NO: 8578655 - DNA, 22 bp, Homo sapiens
ccagggagggtcctgtggcttc

SEQ ID NO: 8578656 - DNA, 22 bp, Homo sapiens
ccagggagtttccaatctgaga

SEQ ID NO: 8578657 - DNA, 22 bp, Homo sapiens
ccagggcacgttgggacagtac

SEQ ID NO: 8578658 - DNA, 22 bp, Homo sapiens
ccagggcaacgctgtctcagag

SEQ ID NO: 8578659 - DNA, 22 bp, Homo sapiens
ccagggcatcacatccagtgtt

SEQ ID NO: 8578660 - DNA, 22 bp, Homo sapiens
ccagggcagtgggagaaggtgc

SEQ ID NO: 8578661 - DNA, 22 bp, Homo sapiens
ccaggctgtgcttttcataaat

SEQ ID NO: 8578662 - DNA, 22 bp, Homo sapiens
ccaggctgtggtttagatagag

SEQ ID NO: 8578663 - DNA, 21 bp, Homo sapiens
tgaaacaatcagacagagtct

SEQ ID NO: 8578664 - DNA, 22 bp, Homo sapiens
tcttgcacttcatgaatatgtt

SEQ ID NO: 8578665 - DNA, 22 bp, Homo sapiens
ccaggagcagatatggacataa

SEQ ID NO: 8578666 - DNA, 22 bp, Homo sapiens
ccaggagccactcaggcccaca

SEQ ID NO: 8578667 - DNA, 22 bp, Homo sapiens
ccaggagccactcaggcccaca

SEQ ID NO: 8578668 - DNA, 22 bp, Homo sapiens
ccaggagagcaaaggtcactct

SEQ ID NO: 8578669 - DNA, 22 bp, Homo sapiens
tctgggctcacgagtctggaca

SEQ ID NO: 8578670 - DNA, 22 bp, Homo sapiens
tctgggctatatggtctctgct

SEQ ID NO: 8578671 - DNA, 22 bp, Homo sapiens
tctgggctatatggtctctgct

SEQ ID NO: 8578672 - DNA, 22 bp, Homo sapiens
ccaggcctcccttttccagcca

SEQ ID NO: 8578673 - DNA, 22 bp, Homo sapiens
tcttacaagaaataagccaatg

SEQ ID NO: 8578674 - DNA, 22 bp, Homo sapiens
tgcactttgcaggcatggaaac

SEQ ID NO: 8578675 - DNA, 22 bp, Homo sapiens
tgcactttatttcctctcacac

SEQ ID NO: 8578676 - DNA, 22 bp, Homo sapiens
tgcactttaaaaaatggtgatg

SEQ ID NO: 8578677 - DNA, 22 bp, Homo sapiens
cccagagatgggaggtgatcgg

SEQ ID NO: 8578678 - DNA, 22 bp, Homo sapiens
cccagagatgtcctgagtgata

SEQ ID NO: 8578679 - DNA, 22 bp, Homo sapiens
tgcaagtatgacagccccatgg

SEQ ID NO: 8578680 - DNA, 22 bp, Homo sapiens
tgcaagtagtccagcctttggg

SEQ ID NO: 8578681 - DNA, 22 bp, Homo sapiens
tgcaaatattgggacagtctag

SEQ ID NO: 8578682 - DNA, 22 bp, Homo sapiens
tgcactccaggctgggtgacag

SEQ ID NO: 8578683 - DNA, 22 bp, Homo sapiens
ccagtgttttccagtttgccca

SEQ ID NO: 8578684 - DNA, 22 bp, Homo sapiens
tgataaactggagaggtggagg

SEQ ID NO: 8578685 - DNA, 22 bp, Homo sapiens
tgagtcatgggcttgaggttac

SEQ ID NO: 8578686 - DNA, 22 bp, Homo sapiens
tgagtccaagagccagtgggaa

SEQ ID NO: 8578687 - DNA, 22 bp, Homo sapiens
tgagtccaataggggcctggaa

SEQ ID NO: 8578688 - DNA, 22 bp, Homo sapiens
tgagtccagatgggccagcagg

SEQ ID NO: 8578689 - DNA, 22 bp, Homo sapiens
ccaggtggcttctgcccgatgt

SEQ ID NO: 8578690 - DNA, 17 bp, Homo sapiens
ccaggtgggaggtgggg

SEQ ID NO: 8578691 - DNA, 22 bp, Homo sapiens
ccagtgcgagcctgtgctggcc

SEQ ID NO: 8578692 - DNA, 22 bp, Homo sapiens
tgaggcagtgtgagataataaa

SEQ ID NO: 8578693 - DNA, 22 bp, Homo sapiens
tgaggcagtgctgggaagcctg

SEQ ID NO: 8578694 - DNA, 22 bp, Homo sapiens
ccagtgcgcaggcgccacctgt

SEQ ID NO: 8578695 - DNA, 22 bp, Homo sapiens
cctgcctcaggactctgcatat

SEQ ID NO: 8578696 - DNA, 22 bp, Homo sapiens
cctgcaggggagagacttctag

SEQ ID NO: 8578697 - DNA, 19 bp, Homo sapiens
cctgcagggatgagaggtt

SEQ ID NO: 8578698 - DNA, 19 bp, Homo sapiens
cctgcagggatgagaggtt

SEQ ID NO: 8578699 - DNA, 22 bp, Homo sapiens
cctgcaggtaaggctaactgcc

SEQ ID NO: 8578700 - DNA, 22 bp, Homo sapiens
cctgcagggtgctgccacagat

SEQ ID NO: 8578701 - DNA, 22 bp, Homo sapiens
cctgcaggggagagacttctag

SEQ ID NO: 8578702 - DNA, 22 bp, Homo sapiens
cctgcaggtccccggatgcgca

SEQ ID NO: 8578703 - DNA, 22 bp, Homo sapiens
cctgcaggttgcagaggcggaa

SEQ ID NO: 8578704 - DNA, 22 bp, Homo sapiens
cctgcaggtttcccccggacgg

SEQ ID NO: 8578705 - DNA, 22 bp, Homo sapiens
tggggagaaatgtctttgttcc

SEQ ID NO: 8578706 - DNA, 22 bp, Homo sapiens
tggggagaagcaatagactcta

SEQ ID NO: 8578707 - DNA, 22 bp, Homo sapiens
cctgagtggagggattctgcag

SEQ ID NO: 8578708 - DNA, 22 bp, Homo sapiens
cctgcaggctgcaggccagttc

SEQ ID NO: 8578709 - DNA, 22 bp, Homo sapiens
cctgcagggaatcgaggcagaa

SEQ ID NO: 8578710 - DNA, 22 bp, Homo sapiens
tggggagaggtatcattgagat

SEQ ID NO: 8578711 - DNA, 22 bp, Homo sapiens
tgggctccagcacctgtgctct

SEQ ID NO: 8578712 - DNA, 22 bp, Homo sapiens
tgggcaggagagaagctaaaga

SEQ ID NO: 8578713 - DNA, 19 bp, Homo sapiens
tggcaggtagtgagcagtc

SEQ ID NO: 8578714 - DNA, 22 bp, Homo sapiens
tggcaggtagtcagaggcgaca

SEQ ID NO: 8578715 - DNA, 22 bp, Homo sapiens
tgggagagaattctggtgactg

SEQ ID NO: 8578716 - DNA, 22 bp, Homo sapiens
cctctcccacgtggcagaggct

SEQ ID NO: 8578717 - DNA, 22 bp, Homo sapiens
cctctcccgggtgccgctgggc

SEQ ID NO: 8578718 - DNA, 22 bp, Homo sapiens
tggcttggctaagatctaagct

SEQ ID NO: 8578719 - DNA, 22 bp, Homo sapiens
tggctttaagaagactgacagc

SEQ ID NO: 8578720 - DNA, 22 bp, Homo sapiens
tgctgcctggtttcttcttgct

SEQ ID NO: 8578721 - DNA, 22 bp, Homo sapiens
tgctgcctggagccttttgttt

SEQ ID NO: 8578722 - DNA, 22 bp, Homo sapiens
tgcttcctgaggccgtcttctc

SEQ ID NO: 8578723 - DNA, 22 bp, Homo sapiens
tgcttcctgaggccgtcttctc

SEQ ID NO: 8578724 - DNA, 22 bp, Homo sapiens
tgcttcctatccacacaatgcc

SEQ ID NO: 8578725 - DNA, 22 bp, Homo sapiens
tgcttcctatccacacaatgcc

SEQ ID NO: 8578726 - DNA, 22 bp, Homo sapiens
tgcttccttgagctctccaatc

SEQ ID NO: 8578727 - DNA, 22 bp, Homo sapiens
tgcttccttgatcattcccaaa

SEQ ID NO: 8578728 - DNA, 22 bp, Homo sapiens
tgcttccttgagctctccaatc

SEQ ID NO: 8578729 - DNA, 22 bp, Homo sapiens
tgcttccttcccgttcttctcc

SEQ ID NO: 8578730 - DNA, 22 bp, Homo sapiens
cccagtgttccttgaggggctg

SEQ ID NO: 8578731 - DNA, 22 bp, Homo sapiens
cccagtgttacgtgacagcctg

SEQ ID NO: 8578732 - DNA, 22 bp, Homo sapiens
cccagtgtctcttgtgcctttc

SEQ ID NO: 8578733 - DNA, 22 bp, Homo sapiens
cccagtgtctgggcctgcaggg

SEQ ID NO: 8578734 - DNA, 22 bp, Homo sapiens
cccagtggcttttgcccaggtt

SEQ ID NO: 8578735 - DNA, 22 bp, Homo sapiens
cccagtggggagctgaggttca

SEQ ID NO: 8578736 - DNA, 22 bp, Homo sapiens
tgctgggggtgtctcaccaggc

SEQ ID NO: 8578737 - DNA, 22 bp, Homo sapiens
tggcacttgcttcagatgatgt

SEQ ID NO: 8578738 - DNA, 22 bp, Homo sapiens
tggcagaatgaagactggggcc

SEQ ID NO: 8578739 - DNA, 22 bp, Homo sapiens
ccctggaggtggaggttgcagg

SEQ ID NO: 8578740 - DNA, 22 bp, Homo sapiens
ccctggaggttgaggctgcagt

SEQ ID NO: 8578741 - DNA, 22 bp, Homo sapiens
ccctggagtcctggcagttgat

SEQ ID NO: 8578742 - DNA, 23 bp, Homo sapiens
ccctggagtaaattcttggaagg

SEQ ID NO: 8578743 - DNA, 19 bp, Homo sapiens
tggcaggcccaggatggac

SEQ ID NO: 8578744 - DNA, 22 bp, Homo sapiens
ccctttaagtagaatatattat

SEQ ID NO: 8578745 - DNA, 22 bp, Homo sapiens
tggagaattaggccaaatctcc

SEQ ID NO: 8578746 - DNA, 22 bp, Homo sapiens
tggagaatgatattccatcatt

SEQ ID NO: 8578747 - DNA, 22 bp, Homo sapiens
tggagaatctggaaactgttga

SEQ ID NO: 8578748 - DNA, 23 bp, Homo sapiens
tggagaatgtgtttacttcgtgt

SEQ ID NO: 8578749 - DNA, 22 bp, Homo sapiens
tggagaatggaatgttgtgcag

SEQ ID NO: 8578750 - DNA, 23 bp, Homo sapiens
tggagaatttagagtctctagga

SEQ ID NO: 8578751 - DNA, 23 bp, Homo sapiens
tggagaattcttccttccactgt

SEQ ID NO: 8578752 - DNA, 22 bp, Homo sapiens
tggagaattttgtcaccagaca

SEQ ID NO: 8578753 - DNA, 22 bp, Homo sapiens
tggagaattctatgttgagggg

SEQ ID NO: 8578754 - DNA, 22 bp, Homo sapiens
tagaaagaacttcatgtaaaac

SEQ ID NO: 8578755 - DNA, 22 bp, Homo sapiens
tacctcaagttccaggaaagcg

SEQ ID NO: 8578756 - DNA, 22 bp, Homo sapiens
tagaaagagctttgcttccttt

SEQ ID NO: 8578757 - DNA, 22 bp, Homo sapiens
tagaaagactgtccagatttca

SEQ ID NO: 8578758 - DNA, 22 bp, Homo sapiens
tagaaagacatgggccagcagc

SEQ ID NO: 8578759 - DNA, 22 bp, Homo sapiens
cagggagaagtctggtcagtcc

SEQ ID NO: 8578760 - DNA, 22 bp, Homo sapiens
cagggatggcctggcgggccac

SEQ ID NO: 8578761 - DNA, 22 bp, Homo sapiens
cagggatgagcagatggagcaa

SEQ ID NO: 8578762 - DNA, 22 bp, Homo sapiens
cagggatgctgcttaggcagtt

SEQ ID NO: 8578763 - DNA, 22 bp, Homo sapiens
cagggcattacttcaggtcctt

SEQ ID NO: 8578764 - DNA, 22 bp, Homo sapiens
cagctctgcctctggggctgag

SEQ ID NO: 8578765 - DNA, 22 bp, Homo sapiens
gtggagcaggactagctgagaa

SEQ ID NO: 8578766 - DNA, 20 bp, Homo sapiens
gtggagaggctggcgggact

SEQ ID NO: 8578767 - DNA, 22 bp, Homo sapiens
tacacagggaaaggtctcagag

SEQ ID NO: 8578768 - DNA, 22 bp, Homo sapiens
tacagcatgatcacaatggaaa

SEQ ID NO: 8578769 - DNA, 22 bp, Homo sapiens
tacagcattgcattttcctttg

SEQ ID NO: 8578770 - DNA, 22 bp, Homo sapiens
tacagcattaacaggctgttta

SEQ ID NO: 8578771 - DNA, 22 bp, Homo sapiens
caggctccctgcaggccagtga

SEQ ID NO: 8578772 - DNA, 22 bp, Homo sapiens
caggctccttcccagggatggt

SEQ ID NO: 8578773 - DNA, 20 bp, Homo sapiens
tagtgcaaaggcagccatag

SEQ ID NO: 8578774 - DNA, 22 bp, Homo sapiens
tagtgtggtaaataaatgtttt

SEQ ID NO: 8578775 - DNA, 22 bp, Homo sapiens
tagtgttctaagaacatccatg

SEQ ID NO: 8578776 - DNA, 22 bp, Homo sapiens
tatatacaaggtaggtttaggt

SEQ ID NO: 8578777 - DNA, 22 bp, Homo sapiens
caggtggcttattagggtcagt

SEQ ID NO: 8578778 - DNA, 22 bp, Homo sapiens
caggtgggctgcctctccagct

SEQ ID NO: 8578779 - DNA, 22 bp, Homo sapiens
tatgtacatcgttgaattcaaa

SEQ ID NO: 8578780 - DNA, 22 bp, Homo sapiens
cagtaaaagatggaaatagaat

SEQ ID NO: 8578781 - DNA, 22 bp, Homo sapiens
tcaaaagaaacaccatgttcct

SEQ ID NO: 8578782 - DNA, 22 bp, Homo sapiens
tcaaaggaaacacaagcttctg

SEQ ID NO: 8578783 - DNA, 22 bp, Homo sapiens
tcaaaggaaacgtggtcctggc

SEQ ID NO: 8578784 - DNA, 22 bp, Homo sapiens
tcaaaggagacacaaggagaaa

SEQ ID NO: 8578785 - DNA, 22 bp, Homo sapiens
tcaaaggaatttgattttgatg

SEQ ID NO: 8578786 - DNA, 23 bp, Homo sapiens
tcaaaggaggcatcgttctgcag

SEQ ID NO: 8578787 - DNA, 22 bp, Homo sapiens
tcaaaggagtttaagttactgg

SEQ ID NO: 8578788 - DNA, 22 bp, Homo sapiens
tcaaaggataactgagggcagt

SEQ ID NO: 8578789 - DNA, 22 bp, Homo sapiens
tcactctctaagcatgacagac

SEQ ID NO: 8578790 - DNA, 22 bp, Homo sapiens
cagtgggtcctgcgtctgccag

SEQ ID NO: 8578791 - DNA, 22 bp, Homo sapiens
tcctgtttctcctgcaaaatcc

SEQ ID NO: 8578792 - DNA, 22 bp, Homo sapiens
tcctgtttccaatttgttgggt

SEQ ID NO: 8578793 - DNA, 22 bp, Homo sapiens
tcctgtttcaacccttacactg

SEQ ID NO: 8578794 - DNA, 22 bp, Homo sapiens
tcctgtttaggctgtggtctgg

SEQ ID NO: 8578795 - DNA, 22 bp, Homo sapiens
tcctgtttatctgtgtgactcg

SEQ ID NO: 8578796 - DNA, 17 bp, Homo sapiens
tcctgtttatcattgat

SEQ ID NO: 8578797 - DNA, 22 bp, Homo sapiens
tcctgtgttactgcctggagcg

SEQ ID NO: 8578798 - DNA, 22 bp, Homo sapiens
tcctgtgtgggcaggatgagaa

SEQ ID NO: 8578799 - DNA, 22 bp, Homo sapiens
tcctgtgtctcagcgtgaagca

SEQ ID NO: 8578800 - DNA, 22 bp, Homo sapiens
tcctgtgtaaatagatctggtt

SEQ ID NO: 8578801 - DNA, 22 bp, Homo sapiens
tcctgtggtctggaaggaatgg

SEQ ID NO: 8578802 - DNA, 22 bp, Homo sapiens
ccagaggtcctgctcactggtg

SEQ ID NO: 8578803 - DNA, 22 bp, Homo sapiens
ccagagggagccaccagggtgt

SEQ ID NO: 8578804 - DNA, 20 bp, Homo sapiens
ccagagcagccactgaagtt

SEQ ID NO: 8578805 - DNA, 22 bp, Homo sapiens
ccagaggctggggaaggataca

SEQ ID NO: 8578806 - DNA, 22 bp, Homo sapiens
tcctgaggtggattgagcagag

SEQ ID NO: 8578807 - DNA, 22 bp, Homo sapiens
tcctgaggtatatgctttgcag

SEQ ID NO: 8578808 - DNA, 23 bp, Homo sapiens
tcctgagggtttcccagccttgg

SEQ ID NO: 8578809 - DNA, 22 bp, Homo sapiens
tcctgagggctgcagtcatagg

SEQ ID NO: 8578810 - DNA, 22 bp, Homo sapiens
ccaacagtccagatgagatggt

SEQ ID NO: 8578811 - DNA, 22 bp, Homo sapiens
tcctgcggttcatgctcattct

SEQ ID NO: 8578812 - DNA, 22 bp, Homo sapiens
tcctggccttagcgaggcggtc

SEQ ID NO: 8578813 - DNA, 22 bp, Homo sapiens
tcctggcctgtctggagtagct

SEQ ID NO: 8578814 - DNA, 16 bp, Homo sapiens
tcctggcctttggaag

SEQ ID NO: 8578815 - DNA, 22 bp, Homo sapiens
tcctggccttgcgtcttgggag

SEQ ID NO: 8578816 - DNA, 20 bp, Homo sapiens
tcctggccttctcgggcagt

SEQ ID NO: 8578817 - DNA, 22 bp, Homo sapiens
tcctggagctggtgtctttccc

SEQ ID NO: 8578818 - DNA, 20 bp, Homo sapiens
tcctggagctgcttgaattc

SEQ ID NO: 8578819 - DNA, 22 bp, Homo sapiens
tcctgagggcattttggtgact

SEQ ID NO: 8578820 - DNA, 22 bp, Homo sapiens
tcctgagggactggttcctcgc

SEQ ID NO: 8578821 - DNA, 22 bp, Homo sapiens
tcctgagggctcggggctcatg

SEQ ID NO: 8578822 - DNA, 22 bp, Homo sapiens
tcctgagggcgattcagcaggt

SEQ ID NO: 8578823 - DNA, 22 bp, Homo sapiens
tcctgagggcgattcagcaggt

SEQ ID NO: 8578824 - DNA, 22 bp, Homo sapiens
tcctgaggctcactttgaatgt

SEQ ID NO: 8578825 - DNA, 22 bp, Homo sapiens
tcctgaggctcactttgaatgt

SEQ ID NO: 8578826 - DNA, 22 bp, Homo sapiens
catttgtctctaggaagtgagg

SEQ ID NO: 8578827 - DNA, 22 bp, Homo sapiens
catttcagtgtcttgtgatgaa

SEQ ID NO: 8578828 - DNA, 22 bp, Homo sapiens
tcagtttcctggttttaatatt

SEQ ID NO: 8578829 - DNA, 22 bp, Homo sapiens
catcagtcccacggagcagccc

SEQ ID NO: 8578830 - DNA, 22 bp, Homo sapiens
catcagtgagccccttgatgag

SEQ ID NO: 8578831 - DNA, 22 bp, Homo sapiens
tcacttagatggggatcatcac

SEQ ID NO: 8578832 - DNA, 23 bp, Homo sapiens
tccagggcagtggctgggtctgc

SEQ ID NO: 8578833 - DNA, 22 bp, Homo sapiens
tccagggcaggtgctgggctct

SEQ ID NO: 8578834 - DNA, 22 bp, Homo sapiens
tccaggcttgagaccaggctct

SEQ ID NO: 8578835 - DNA, 20 bp, Homo sapiens
catgctgcctccattgatgc

SEQ ID NO: 8578836 - DNA, 22 bp, Homo sapiens
tccagagttgtaagtgttgaca

SEQ ID NO: 8578837 - DNA, 22 bp, Homo sapiens
catgctttgggtcagaaatgcc

SEQ ID NO: 8578838 - DNA, 22 bp, Homo sapiens
tttgtcttatccaatctctcag

SEQ ID NO: 8578839 - DNA, 22 bp, Homo sapiens
tttgtcttaaatcttgttactg

SEQ ID NO: 8578840 - DNA, 22 bp, Homo sapiens
tttgtcttccccctttaatcag

SEQ ID NO: 8578841 - DNA, 22 bp, Homo sapiens
ttttggctctgtctgtatcttt

SEQ ID NO: 8578842 - DNA, 22 bp, Homo sapiens
ttttcctcacctaactcaaggt

SEQ ID NO: 8578843 - DNA, 22 bp, Homo sapiens
tttgggctggtttgccatgccc

SEQ ID NO: 8578844 - DNA, 22 bp, Homo sapiens
tttgggcaggcttttccctaga

SEQ ID NO: 8578845 - DNA, 22 bp, Homo sapiens
tttgggcaggcttttccctaga

SEQ ID NO: 8578846 - DNA, 22 bp, Homo sapiens
tttgggcagtagatgtatcact

SEQ ID NO: 8578847 - DNA, 22 bp, Homo sapiens
tttgggcagtcctggaatttgt

SEQ ID NO: 8578848 - DNA, 22 bp, Homo sapiens
tttgggcagtgggcttagcggc

SEQ ID NO: 8578849 - DNA, 22 bp, Homo sapiens
tttgggcattagtaagttaagc

SEQ ID NO: 8578850 - DNA, 22 bp, Homo sapiens
tttgggcatatagctgttccct

SEQ ID NO: 8578851 - DNA, 22 bp, Homo sapiens
tttgggcatgttgtggccagct

SEQ ID NO: 8578852 - DNA, 22 bp, Homo sapiens
tttgggcattagaatattcttt

SEQ ID NO: 8578853 - DNA, 22 bp, Homo sapiens
tttacaagtttacagaatgatg

SEQ ID NO: 8578854 - DNA, 19 bp, Homo sapiens
tttacaagttctttgtatg

SEQ ID NO: 8578855 - DNA, 22 bp, Homo sapiens
tttacaagtcagggactgttct

SEQ ID NO: 8578856 - DNA, 22 bp, Homo sapiens
tttacaagtctgttgatcccaa

SEQ ID NO: 8578857 - DNA, 22 bp, Homo sapiens
tttaacttagaagagatatcct

SEQ ID NO: 8578858 - DNA, 22 bp, Homo sapiens
tttaaattatagttaatgtctg

SEQ ID NO: 8578859 - DNA, 22 bp, Homo sapiens
ttgttgcaagggttaaatgaga

SEQ ID NO: 8578860 - DNA, 22 bp, Homo sapiens
ttgttgaatggataaataaatt

SEQ ID NO: 8578861 - DNA, 21 bp, Homo sapiens
ttgttgagagttagaacatgg

SEQ ID NO: 8578862 - DNA, 20 bp, Homo sapiens
ttgttgagctcttcaaagaa

SEQ ID NO: 8578863 - DNA, 22 bp, Homo sapiens
ttgttgacgacttgactttctc

SEQ ID NO: 8578864 - DNA, 22 bp, Homo sapiens
ttgttgaattagttgactgtgt

SEQ ID NO: 8578865 - DNA, 22 bp, Homo sapiens
ttgtttaaaagaaatcatagaa

SEQ ID NO: 8578866 - DNA, 22 bp, Homo sapiens
tttcaataacaaagctcatttt

SEQ ID NO: 8578867 - DNA, 18 bp, Homo sapiens
tttcacaacctccagagg

SEQ ID NO: 8578868 - DNA, 22 bp, Homo sapiens
tttcacaagtttcaggattctg

SEQ ID NO: 8578869 - DNA, 22 bp, Homo sapiens
tttatttataagccacttgctg

SEQ ID NO: 8578870 - DNA, 21 bp, Homo sapiens
tttatttatataggacacatg

SEQ ID NO: 8578871 - DNA, 23 bp, Homo sapiens
tttatttatttaggctgagggat

SEQ ID NO: 8578872 - DNA, 22 bp, Homo sapiens
tttatttatccttctggattgc

SEQ ID NO: 8578873 - DNA, 22 bp, Homo sapiens
tttcatctgtgctgccaagact

SEQ ID NO: 8578874 - DNA, 17 bp, Homo sapiens
tttcatctgggaccacc

SEQ ID NO: 8578875 - DNA, 22 bp, Homo sapiens
tttccagtctcagccctgtaac

SEQ ID NO: 8578876 - DNA, 22 bp, Homo sapiens
tttcatctctctaaaagacagt

SEQ ID NO: 8578877 - DNA, 22 bp, Homo sapiens
tttctaaagggtagatttggcc

SEQ ID NO: 8578878 - DNA, 19 bp, Homo sapiens
tttctaagctaaatgcttc

SEQ ID NO: 8578879 - DNA, 22 bp, Homo sapiens
tttccttgcctcctgtccttct

SEQ ID NO: 8578880 - DNA, 22 bp, Homo sapiens
tttccttgcacattggtttcca

SEQ ID NO: 8578881 - DNA, 22 bp, Homo sapiens
ttgtgagtagtgccgcaataaa

SEQ ID NO: 8578882 - DNA, 22 bp, Homo sapiens
ttgtatttcctataacctttct

SEQ ID NO: 8578883 - DNA, 22 bp, Homo sapiens
ttgtgagtagtgccgcaataaa

SEQ ID NO: 8578884 - DNA, 22 bp, Homo sapiens
ttgtagctgaaagtaaagaagt

SEQ ID NO: 8578885 - DNA, 22 bp, Homo sapiens
ttggggtacgcaggtctgggag

SEQ ID NO: 8578886 - DNA, 22 bp, Homo sapiens
ttgtattaattgaaatgaatgc

SEQ ID NO: 8578887 - DNA, 22 bp, Homo sapiens
ttgtatgatcaaaagaaatgta

SEQ ID NO: 8578888 - DNA, 22 bp, Homo sapiens
ttggctcaggacccctgtgact

SEQ ID NO: 8578889 - DNA, 22 bp, Homo sapiens
ttggaattcaagttgtagctta

SEQ ID NO: 8578890 - DNA, 22 bp, Homo sapiens
ttgcatttgagaaagttctcct

SEQ ID NO: 8578891 - DNA, 18 bp, Homo sapiens
ttgagtctagccatggaa

SEQ ID NO: 8578892 - DNA, 22 bp, Homo sapiens
ttgagtctcctcagcagggcta

SEQ ID NO: 8578893 - DNA, 22 bp, Homo sapiens
ttgcatttcactttcagtaggc

SEQ ID NO: 8578894 - DNA, 22 bp, Homo sapiens
ttgcatttttagatgcttctgt

SEQ ID NO: 8578895 - DNA, 22 bp, Homo sapiens
ttgccactaactagctgtgaga

SEQ ID NO: 8578896 - DNA, 22 bp, Homo sapiens
ttgcattttggttgtaaatatg

SEQ ID NO: 8578897 - DNA, 22 bp, Homo sapiens
ttgccactgaaccagtcttgca

SEQ ID NO: 8578898 - DNA, 22 bp, Homo sapiens
ttgctataaatggtttcatatt

SEQ ID NO: 8578899 - DNA, 22 bp, Homo sapiens
ttccatgtgagtacactgtgat

SEQ ID NO: 8578900 - DNA, 22 bp, Homo sapiens
ttcccatgcctggcccctatcc

SEQ ID NO: 8578901 - DNA, 22 bp, Homo sapiens
ttcaagtaatgctactcctatg

SEQ ID NO: 8578902 - DNA, 22 bp, Homo sapiens
ttcaagtagctaaattagctgc

SEQ ID NO: 8578903 - DNA, 22 bp, Homo sapiens
ttcagacaataagagtcatctc

SEQ ID NO: 8578904 - DNA, 22 bp, Homo sapiens
ttcatataaatggaatcagaat

SEQ ID NO: 8578905 - DNA, 22 bp, Homo sapiens
ttagttgatagccaaaatttat

SEQ ID NO: 8578906 - DNA, 20 bp, Homo sapiens
ttatgtgtacctgtgctccc

SEQ ID NO: 8578907 - DNA, 22 bp, Homo sapiens
ttatgtgtgtacatgcatatgt

SEQ ID NO: 8578908 - DNA, 22 bp, Homo sapiens
tcctctgctccaggctggactt

SEQ ID NO: 8578909 - DNA, 22 bp, Homo sapiens
tcctctgctccatctttactgt

SEQ ID NO: 8578910 - DNA, 22 bp, Homo sapiens
tcctctggaacctcacccttgc

SEQ ID NO: 8578911 - DNA, 22 bp, Homo sapiens
tcctctggctctttccctagga

SEQ ID NO: 8578912 - DNA, 20 bp, Homo sapiens
ttatttgtttactttggtcc

SEQ ID NO: 8578913 - DNA, 22 bp, Homo sapiens
ttatttacaactcttctcttcc

SEQ ID NO: 8578914 - DNA, 22 bp, Homo sapiens
ttatttactggatggccttggg

SEQ ID NO: 8578915 - DNA, 22 bp, Homo sapiens
ttatttaaaagtggtaagattc

SEQ ID NO: 8578916 - DNA, 22 bp, Homo sapiens
ttcaaaagactcagatgtagcg

SEQ ID NO: 8578917 - DNA, 22 bp, Homo sapiens
ttcaaaagtaatcagtattaga

SEQ ID NO: 8578918 - DNA, 22 bp, Homo sapiens
ttcaaaagtaatcagtattaga

SEQ ID NO: 8578919 - DNA, 22 bp, Homo sapiens
ttattttaccttcctctgagct

SEQ ID NO: 8578920 - DNA, 21 bp, Homo sapiens
ttcttcttggactgttttggc

SEQ ID NO: 8578921 - DNA, 22 bp, Homo sapiens
ttcttctgacactgatgctgta

SEQ ID NO: 8578922 - DNA, 22 bp, Homo sapiens
ttgagaaggtggtcatttgcaa

SEQ ID NO: 8578923 - DNA, 22 bp, Homo sapiens
ttgagggtctggatctgctgct

SEQ ID NO: 8578924 - DNA, 22 bp, Homo sapiens
ttgaaaagttttgaaacactct

SEQ ID NO: 8578925 - DNA, 22 bp, Homo sapiens
ttctttttggatagctgatgaa

SEQ ID NO: 8578926 - DNA, 22 bp, Homo sapiens
ttctttttatcttcccataaga

SEQ ID NO: 8578927 - DNA, 22 bp, Homo sapiens
ttctttttggatagctgatgaa

SEQ ID NO: 8578928 - DNA, 22 bp, Homo sapiens
ttctgcattggagtctattctt

SEQ ID NO: 8578929 - DNA, 22 bp, Homo sapiens
ttctcccactccgtgcttcagt

SEQ ID NO: 8578930 - DNA, 22 bp, Homo sapiens
ttctcccatctcagtcttacat

SEQ ID NO: 8578931 - DNA, 22 bp, Homo sapiens
ttctcccagaccaaaggcagca

SEQ ID NO: 8578932 - DNA, 22 bp, Homo sapiens
ttctcacaggctggaatgatga

SEQ ID NO: 8578933 - DNA, 22 bp, Homo sapiens
atttctcaaccaggtcaaaaag

SEQ ID NO: 8578934 - DNA, 18 bp, Homo sapiens
gcctgctctgctctcccc

SEQ ID NO: 8578935 - DNA, 22 bp, Homo sapiens
gcctgggagagggatagtgcag

SEQ ID NO: 8578936 - DNA, 22 bp, Homo sapiens
gcctgggagattaattaggaag

SEQ ID NO: 8578937 - DNA, 22 bp, Homo sapiens
gcctgggagcacatcggggtcc

SEQ ID NO: 8578938 - DNA, 22 bp, Homo sapiens
caaaccttgcagaactgggcag

SEQ ID NO: 8578939 - DNA, 22 bp, Homo sapiens
gcgcagagtagcagagtgctga

SEQ ID NO: 8578940 - DNA, 22 bp, Homo sapiens
caaaggcaacatatacttgttt

SEQ ID NO: 8578941 - DNA, 18 bp, Homo sapiens
gcctgggaggaggaaatg

SEQ ID NO: 8578942 - DNA, 23 bp, Homo sapiens
gcctgggagttgcgatctgcccg

SEQ ID NO: 8578943 - DNA, 22 bp, Homo sapiens
gcctgggagtgcacagtgaggt

SEQ ID NO: 8578944 - DNA, 22 bp, Homo sapiens
caaaaagcttaggtaacaagcc

SEQ ID NO: 8578945 - DNA, 22 bp, Homo sapiens
gccaggagtgtcccactcattt

SEQ ID NO: 8578946 - DNA, 22 bp, Homo sapiens
atttaaattttctgatggagag

SEQ ID NO: 8578947 - DNA, 21 bp, Homo sapiens
atttacaaaacagtcccttcc

SEQ ID NO: 8578948 - DNA, 22 bp, Homo sapiens
attggaaatacagtagaaaaat

SEQ ID NO: 8578949 - DNA, 22 bp, Homo sapiens
gcagcagggtgccagctttgca

SEQ ID NO: 8578950 - DNA, 22 bp, Homo sapiens
gcagcaggcttttcataccttg

SEQ ID NO: 8578951 - DNA, 22 bp, Homo sapiens
gcagcaggcacttaccgttgct

SEQ ID NO: 8578952 - DNA, 22 bp, Homo sapiens
attcctggtggcagaaacatga

SEQ ID NO: 8578953 - DNA, 22 bp, Homo sapiens
attcctcatttgttgagaacca

SEQ ID NO: 8578954 - DNA, 21 bp, Homo sapiens
attcagagtaattcatcttta

SEQ ID NO: 8578955 - DNA, 22 bp, Homo sapiens
attcttattatagtaaaacagt

SEQ ID NO: 8578956 - DNA, 22 bp, Homo sapiens
attgaaaaatgactattgctta

SEQ ID NO: 8578957 - DNA, 22 bp, Homo sapiens
attgaagaaacccaaataatgg

SEQ ID NO: 8578958 - DNA, 22 bp, Homo sapiens
attgaagattaaatgcttcctt

SEQ ID NO: 8578959 - DNA, 22 bp, Homo sapiens
attgcacttcagcctgggtgac

SEQ ID NO: 8578960 - DNA, 22 bp, Homo sapiens
attgacaaccctggtatgagca

SEQ ID NO: 8578961 - DNA, 22 bp, Homo sapiens
attacaagggtctgactggagg

SEQ ID NO: 8578962 - DNA, 20 bp, Homo sapiens
attattcatacatgtgtgac

SEQ ID NO: 8578963 - DNA, 20 bp, Homo sapiens
gcaagtgaaaactatgggtg

SEQ ID NO: 8578964 - DNA, 22 bp, Homo sapiens
gcaagtaggaagtgtcctcctt

SEQ ID NO: 8578965 - DNA, 22 bp, Homo sapiens
gcaagtagtgggaaagaagatg

SEQ ID NO: 8578966 - DNA, 22 bp, Homo sapiens
gcaagtacaaacgcatcggctg

SEQ ID NO: 8578967 - DNA, 22 bp, Homo sapiens
gcaaggtctttcagaaaggaaa

SEQ ID NO: 8578968 - DNA, 22 bp, Homo sapiens
gatgaggcaagccagaggactg

SEQ ID NO: 8578969 - DNA, 22 bp, Homo sapiens
gatgaggcagctcagggggaaa

SEQ ID NO: 8578970 - DNA, 22 bp, Homo sapiens
atgtgtttgtacctttaaatat

SEQ ID NO: 8578971 - DNA, 22 bp, Homo sapiens
atgtgtttataattactcaatc

SEQ ID NO: 8578972 - DNA, 22 bp, Homo sapiens
atgtgttttggtaatttctgct

SEQ ID NO: 8578973 - DNA, 22 bp, Homo sapiens
atgtgttttggtggatcattca

SEQ ID NO: 8578974 - DNA, 22 bp, Homo sapiens
atgtgtgtgtttaatcctcaaa

SEQ ID NO: 8578975 - DNA, 22 bp, Homo sapiens
atgttttattaccaacttgtac

SEQ ID NO: 8578976 - DNA, 22 bp, Homo sapiens
atgagtgtgaagttagctcagt

SEQ ID NO: 8578977 - DNA, 22 bp, Homo sapiens
atgatttttcagcagaggatct

SEQ ID NO: 8578978 - DNA, 22 bp, Homo sapiens
atgattttttctaacacagtcg

SEQ ID NO: 8578979 - DNA, 20 bp, Homo sapiens
atgattttgcactaacttca

SEQ ID NO: 8578980 - DNA, 22 bp, Homo sapiens
atgcaaaagtaattgcaatttt

SEQ ID NO: 8578981 - DNA, 22 bp, Homo sapiens
atgaggtaatactttcagtcct

SEQ ID NO: 8578982 - DNA, 22 bp, Homo sapiens
gaaagcagatgaaattgcaaca

SEQ ID NO: 8578983 - DNA, 22 bp, Homo sapiens
atgaggcaggagtgcagtggca

SEQ ID NO: 8578984 - DNA, 22 bp, Homo sapiens
atgaggcaggtggaggctgcca

SEQ ID NO: 8578985 - DNA, 22 bp, Homo sapiens
gaaagcaatttgtgtaatctgt

SEQ ID NO: 8578986 - DNA, 22 bp, Homo sapiens
atgaagatattcttgttttctg

SEQ ID NO: 8578987 - DNA, 22 bp, Homo sapiens
atgcagccccctggtgcccggg

SEQ ID NO: 8578988 - DNA, 20 bp, Homo sapiens
atgcaaactcacaaaatacc

SEQ ID NO: 8578989 - DNA, 22 bp, Homo sapiens
atgcaaaattaccattctgttc

SEQ ID NO: 8578990 - DNA, 22 bp, Homo sapiens
atgcagaaagagaatgtaatgt

SEQ ID NO: 8578991 - DNA, 22 bp, Homo sapiens
atgcagaacgtttgtgaaactt

SEQ ID NO: 8578992 - DNA, 22 bp, Homo sapiens
atgcagaaggagccatgcttgc

SEQ ID NO: 8578993 - DNA, 22 bp, Homo sapiens
atgcagaaggagccatgcttgc

SEQ ID NO: 8578994 - DNA, 22 bp, Homo sapiens
atgcagaattgctaagtatctg

SEQ ID NO: 8578995 - DNA, 20 bp, Homo sapiens
cttgttgattctaggaatga

SEQ ID NO: 8578996 - DNA, 17 bp, Homo sapiens
cttgttgagctcgttcc

SEQ ID NO: 8578997 - DNA, 22 bp, Homo sapiens
cttgttaaattatataagcaga

SEQ ID NO: 8578998 - DNA, 22 bp, Homo sapiens
cttggcagtttcggaaggatga

SEQ ID NO: 8578999 - DNA, 22 bp, Homo sapiens
cttggcctgacatgtggcaggg

SEQ ID NO: 8579000 - DNA, 22 bp, Homo sapiens
atggaaggctttatgactcaaa

SEQ ID NO: 8579001 - DNA, 22 bp, Homo sapiens
atggaagggacagaagggcaag

SEQ ID NO: 8579002 - DNA, 22 bp, Homo sapiens
atggaaggtcctacagagcgca

SEQ ID NO: 8579003 - DNA, 22 bp, Homo sapiens
atgccactgcacttcagcttgg

SEQ ID NO: 8579004 - DNA, 22 bp, Homo sapiens
atgccactgcgctccagcctgg

SEQ ID NO: 8579005 - DNA, 22 bp, Homo sapiens
atgccactgcgctccagcctgg

SEQ ID NO: 8579006 - DNA, 22 bp, Homo sapiens
atgccactgcgctctagcctgg

SEQ ID NO: 8579007 - DNA, 22 bp, Homo sapiens
atggccagtgtttccctcagtt

SEQ ID NO: 8579008 - DNA, 22 bp, Homo sapiens
atgggtttataggtggactttt

SEQ ID NO: 8579009 - DNA, 22 bp, Homo sapiens
atgggtttccctctgaaattat

SEQ ID NO: 8579010 - DNA, 22 bp, Homo sapiens
atgggttcaagtgattctcctg

SEQ ID NO: 8579011 - DNA, 23 bp, Homo sapiens
atggtccagccagctgcacagga

SEQ ID NO: 8579012 - DNA, 18 bp, Homo sapiens
atgtacatttgctaaagc

SEQ ID NO: 8579013 - DNA, 22 bp, Homo sapiens
atgtgtgtatatatagtcattt

SEQ ID NO: 8579014 - DNA, 22 bp, Homo sapiens
atgtgtgtgcatttctctccct

SEQ ID NO: 8579015 - DNA, 22 bp, Homo sapiens
atgtgtatgagtgtgcttcttt

SEQ ID NO: 8579016 - DNA, 22 bp, Homo sapiens
atgtctttgccatagttcatat

SEQ ID NO: 8579017 - DNA, 22 bp, Homo sapiens
gaggcctgggagaactgttttt

SEQ ID NO: 8579018 - DNA, 22 bp, Homo sapiens
gaggcctgggagcctgtcctcc

SEQ ID NO: 8579019 - DNA, 22 bp, Homo sapiens
atgtctttattaatatcatgcc

SEQ ID NO: 8579020 - DNA, 22 bp, Homo sapiens
ggatgggcccgggacggcgctg

SEQ ID NO: 8579021 - DNA, 22 bp, Homo sapiens
ggatgggcagacaggacggcac

SEQ ID NO: 8579022 - DNA, 22 bp, Homo sapiens
ggatgggctgaaaggtagcccc

SEQ ID NO: 8579023 - DNA, 22 bp, Homo sapiens
ggatgtcgaggatggggtagca

SEQ ID NO: 8579024 - DNA, 22 bp, Homo sapiens
ggatgggagcagaggacgacca

SEQ ID NO: 8579025 - DNA, 22 bp, Homo sapiens
ggcacacaaaggcagcatttga

SEQ ID NO: 8579026 - DNA, 22 bp, Homo sapiens
cacagtgtgactgaccttcagc

SEQ ID NO: 8579027 - DNA, 22 bp, Homo sapiens
cacagtgtctgtgcttcagtgt

SEQ ID NO: 8579028 - DNA, 22 bp, Homo sapiens
cacagtgtgggcatggtgcctg

SEQ ID NO: 8579029 - DNA, 22 bp, Homo sapiens
cacagtggaagtccaggatccc

SEQ ID NO: 8579030 - DNA, 22 bp, Homo sapiens
cacagtgtagactaataataga

SEQ ID NO: 8579031 - DNA, 22 bp, Homo sapiens
cacagtggctttgctggtctcg

SEQ ID NO: 8579032 - DNA, 22 bp, Homo sapiens
cacagtggcaaaggggcttggg

SEQ ID NO: 8579033 - DNA, 22 bp, Homo sapiens
ggctatatcctcacaagatgga

SEQ ID NO: 8579034 - DNA, 22 bp, Homo sapiens
ggcagtgtggcctgagtaagtc

SEQ ID NO: 8579035 - DNA, 22 bp, Homo sapiens
ggcagttctcagccaaggcaat

SEQ ID NO: 8579036 - DNA, 22 bp, Homo sapiens
ggcagttctggatgcattgtca

SEQ ID NO: 8579037 - DNA, 22 bp, Homo sapiens
caagaggagcaggcaggtgtgc

SEQ ID NO: 8579038 - DNA, 22 bp, Homo sapiens
gctgccttcccaggcctttgct

SEQ ID NO: 8579039 - DNA, 20 bp, Homo sapiens
gctgccttgtcctgcttggt

SEQ ID NO: 8579040 - DNA, 22 bp, Homo sapiens
gctgccttcccggaatgtcatc

SEQ ID NO: 8579041 - DNA, 18 bp, Homo sapiens
gctcctggagtctgactc

SEQ ID NO: 8579042 - DNA, 19 bp, Homo sapiens
gctcctggatgacctgtgg

SEQ ID NO: 8579043 - DNA, 20 bp, Homo sapiens
gctgtggcaaagctttgtgt

SEQ ID NO: 8579044 - DNA, 22 bp, Homo sapiens
cagccaagaaagcagtgctcca

SEQ ID NO: 8579045 - DNA, 22 bp, Homo sapiens
cagcaggattggatacatctca

SEQ ID NO: 8579046 - DNA, 22 bp, Homo sapiens
gtaaaattctagcatctgaaag

SEQ ID NO: 8579047 - DNA, 20 bp, Homo sapiens
gtaaaatatggtctttgggt

SEQ ID NO: 8579048 - DNA, 22 bp, Homo sapiens
ggttccaggcatggcaggatgt

SEQ ID NO: 8579049 - DNA, 22 bp, Homo sapiens
cagacaggctagccagactcac

SEQ ID NO: 8579050 - DNA, 22 bp, Homo sapiens
gggagggcttggacccagatgt

SEQ ID NO: 8579051 - DNA, 22 bp, Homo sapiens
gggagggccagtgctctctaga

SEQ ID NO: 8579052 - DNA, 22 bp, Homo sapiens
gggcaagtccggtgcccagagc

SEQ ID NO: 8579053 - DNA, 22 bp, Homo sapiens
gggcaagtgttttgtctgcctg

SEQ ID NO: 8579054 - DNA, 22 bp, Homo sapiens
gggcaagtgtcaagcatgtcat

SEQ ID NO: 8579055 - DNA, 22 bp, Homo sapiens
gggcaagttgagaagaatgcta

SEQ ID NO: 8579056 - DNA, 20 bp, Homo sapiens
gggatgagagtcctagctct

SEQ ID NO: 8579057 - DNA, 22 bp, Homo sapiens
cactggctgagcttctctaggg

SEQ ID NO: 8579058 - DNA, 22 bp, Homo sapiens
gggaaagaagatctagatactg

SEQ ID NO: 8579059 - DNA, 22 bp, Homo sapiens
gggacaatggaggcctctctcc

SEQ ID NO: 8579060 - DNA, 22 bp, Homo sapiens
gggcgcagccaatcctggccct

SEQ ID NO: 8579061 - DNA, 22 bp, Homo sapiens
gggcgcatcacctgaggtcagg

SEQ ID NO: 8579062 - DNA, 22 bp, Homo sapiens
gggtgccacagagcttccactt

SEQ ID NO: 8579063 - DNA, 22 bp, Homo sapiens
cagaggccatatttcttcactc

SEQ ID NO: 8579064 - DNA, 22 bp, Homo sapiens
cagaggccccagaactagctct

SEQ ID NO: 8579065 - DNA, 20 bp, Homo sapiens
atccctggccttaaggagtg

SEQ ID NO: 8579066 - DNA, 22 bp, Homo sapiens
atcctctgtggattacacctag

SEQ ID NO: 8579067 - DNA, 22 bp, Homo sapiens
atcctcgtctgcacatcaaagg

SEQ ID NO: 8579068 - DNA, 22 bp, Homo sapiens
atccccaggggcattcaagctt

SEQ ID NO: 8579069 - DNA, 22 bp, Homo sapiens
atccccctcttggatggcggca

SEQ ID NO: 8579070 - DNA, 22 bp, Homo sapiens
atccccctgtatctggaagaat

SEQ ID NO: 8579071 - DNA, 22 bp, Homo sapiens
ctgtggagatgcagaccaggcc

SEQ ID NO: 8579072 - DNA, 22 bp, Homo sapiens
ctgtggagatgcagaccaggcc

SEQ ID NO: 8579073 - DNA, 22 bp, Homo sapiens
ctgtggagcagggcagggtcac

SEQ ID NO: 8579074 - DNA, 22 bp, Homo sapiens
ctgtggagtgcttggctcagtg

SEQ ID NO: 8579075 - DNA, 22 bp, Homo sapiens
ctgtggagtggggagtactggt

SEQ ID NO: 8579076 - DNA, 22 bp, Homo sapiens
ctgtggagtgcttggctcagtg

SEQ ID NO: 8579077 - DNA, 22 bp, Homo sapiens
ctgtggagtcctggggaatgga

SEQ ID NO: 8579078 - DNA, 22 bp, Homo sapiens
ctgtggaggtaggagcaggaca

SEQ ID NO: 8579079 - DNA, 22 bp, Homo sapiens
ctgtggagcttgtggcagtggg

SEQ ID NO: 8579080 - DNA, 22 bp, Homo sapiens
ctgtggagcttgtggcagtggg

SEQ ID NO: 8579081 - DNA, 22 bp, Homo sapiens
ctgggtataggaaacagttaag

SEQ ID NO: 8579082 - DNA, 21 bp, Homo sapiens
ctgtcctcagatgtggacgag

SEQ ID NO: 8579083 - DNA, 22 bp, Homo sapiens
ctgtcctccagacgacagtccc

SEQ ID NO: 8579084 - DNA, 22 bp, Homo sapiens
atcatgcattgtattgagttga

SEQ ID NO: 8579085 - DNA, 22 bp, Homo sapiens
atcatgcatggtactcttgtgc

SEQ ID NO: 8579086 - DNA, 22 bp, Homo sapiens
atcatgcagctaatccaattca

SEQ ID NO: 8579087 - DNA, 22 bp, Homo sapiens
atcatgcaggtttctcctttct

SEQ ID NO: 8579088 - DNA, 22 bp, Homo sapiens
atcatgcagcaacaagcaaggc

SEQ ID NO: 8579089 - DNA, 22 bp, Homo sapiens
atcatgcaataaggtgaggcct

SEQ ID NO: 8579090 - DNA, 22 bp, Homo sapiens
atcatgcagagtctgggcttca

SEQ ID NO: 8579091 - DNA, 22 bp, Homo sapiens
ctgggagagaagcgaagctggg

SEQ ID NO: 8579092 - DNA, 22 bp, Homo sapiens
ctgggagaggaacctcgagggt

SEQ ID NO: 8579093 - DNA, 22 bp, Homo sapiens
ctgggagagcctttcctgagtc

SEQ ID NO: 8579094 - DNA, 20 bp, Homo sapiens
atatttcttaagaactttca

SEQ ID NO: 8579095 - DNA, 22 bp, Homo sapiens
atatttctgggggtgtgtttct

SEQ ID NO: 8579096 - DNA, 22 bp, Homo sapiens
atatttctgggggtgtgtttct

SEQ ID NO: 8579097 - DNA, 23 bp, Homo sapiens
atatgtcatgcaccagcacttta

SEQ ID NO: 8579098 - DNA, 22 bp, Homo sapiens
atatgtgtatggatttctatct

SEQ ID NO: 8579099 - DNA, 22 bp, Homo sapiens
atatgtgtgtatttcttactag

SEQ ID NO: 8579100 - DNA, 22 bp, Homo sapiens
atatgagtttcccacttctgga

SEQ ID NO: 8579101 - DNA, 22 bp, Homo sapiens
ctgggcaggagggctctatgga

SEQ ID NO: 8579102 - DNA, 22 bp, Homo sapiens
atatgcaagcacatagaatact

SEQ ID NO: 8579103 - DNA, 22 bp, Homo sapiens
atatgcaagcacatagaatact

SEQ ID NO: 8579104 - DNA, 20 bp, Homo sapiens
ataaaataactgccacaaga

SEQ ID NO: 8579105 - DNA, 20 bp, Homo sapiens
ataaaataactgccacaaga

SEQ ID NO: 8579106 - DNA, 22 bp, Homo sapiens
agtttggaagtcaggcttttct

SEQ ID NO: 8579107 - DNA, 22 bp, Homo sapiens
ctgcagagcaagttctctgttg

SEQ ID NO: 8579108 - DNA, 22 bp, Homo sapiens
agttgtcccggtctagccactt

SEQ ID NO: 8579109 - DNA, 22 bp, Homo sapiens
ctgaggctgggctgagggtata

SEQ ID NO: 8579110 - DNA, 22 bp, Homo sapiens
atactcaatttgttggaaagca

SEQ ID NO: 8579111 - DNA, 22 bp, Homo sapiens
ctggagtcttcagcttgctgcc

SEQ ID NO: 8579112 - DNA, 21 bp, Homo sapiens
ctggagtctgggggtggcagt

SEQ ID NO: 8579113 - DNA, 18 bp, Homo sapiens
atacaagatcaagtgttc

SEQ ID NO: 8579114 - DNA, 22 bp, Homo sapiens
ctgcccactatgttgtcatggg

SEQ ID NO: 8579115 - DNA, 22 bp, Homo sapiens
cctggccacagggctctgcatt

SEQ ID NO: 8579116 - DNA, 22 bp, Homo sapiens
cctggccacccagccttggcca

SEQ ID NO: 8579117 - DNA, 22 bp, Homo sapiens
cctggcagcgtgccgagctgcg

SEQ ID NO: 8579118 - DNA, 22 bp, Homo sapiens
agggtctgtggatgcatctggg

SEQ ID NO: 8579119 - DNA, 20 bp, Homo sapiens
agggtctgatgtggtggccc

SEQ ID NO: 8579120 - DNA, 22 bp, Homo sapiens
agggtctgaccaccagtaggga

SEQ ID NO: 8579121 - DNA, 22 bp, Homo sapiens
cctctgcacttcaccttagctc

SEQ ID NO: 8579122 - DNA, 22 bp, Homo sapiens
cgaggcagggaagctgcaaaag

SEQ ID NO: 8579123 - DNA, 18 bp, Homo sapiens
cgaggcaggcggatcacg

SEQ ID NO: 8579124 - DNA, 22 bp, Homo sapiens
cgaggcaggcaggcggaggata

SEQ ID NO: 8579125 - DNA, 22 bp, Homo sapiens
cgaggcagaggctgaaacggct

SEQ ID NO: 8579126 - DNA, 22 bp, Homo sapiens
cgaggcagacaaaagttggaag

SEQ ID NO: 8579127 - DNA, 22 bp, Homo sapiens
aggtgccattgcttgccagttt

SEQ ID NO: 8579128 - DNA, 22 bp, Homo sapiens
aggtgccagctctcaggcagga

SEQ ID NO: 8579129 - DNA, 22 bp, Homo sapiens
aggtgggacccgtggggtgcga

SEQ ID NO: 8579130 - DNA, 22 bp, Homo sapiens
ccttggctgaggagggagctga

SEQ ID NO: 8579131 - DNA, 22 bp, Homo sapiens
ccttgctcaagctagtgacggg

SEQ ID NO: 8579132 - DNA, 22 bp, Homo sapiens
ccttgctgttagcctacattat

SEQ ID NO: 8579133 - DNA, 22 bp, Homo sapiens
ctcctgaggaaaagcttggtca

SEQ ID NO: 8579134 - DNA, 22 bp, Homo sapiens
agtgctatcgagttctaatgct

SEQ ID NO: 8579135 - DNA, 22 bp, Homo sapiens
ctccttctgggcctggcagtgg

SEQ ID NO: 8579136 - DNA, 18 bp, Homo sapiens
ctcctttccctacacctc

SEQ ID NO: 8579137 - DNA, 22 bp, Homo sapiens
ctcggaatggaacaacagcggt

SEQ ID NO: 8579138 - DNA, 22 bp, Homo sapiens
agtgacaaggtggtaatgaagc

SEQ ID NO: 8579139 - DNA, 20 bp, Homo sapiens
ctcagctcttcagggcaagt

SEQ ID NO: 8579140 - DNA, 22 bp, Homo sapiens
cgggttcacgccattctcctgc

SEQ ID NO: 8579141 - DNA, 22 bp, Homo sapiens
ctcaaatagaactgatctataa

SEQ ID NO: 8579142 - DNA, 22 bp, Homo sapiens
ctcaaatatgtggtcagaaagc

SEQ ID NO: 8579143 - DNA, 20 bp, Homo sapiens
agtcccaacattcagctctg

SEQ ID NO: 8579144 - DNA, 22 bp, Homo sapiens
agtcccagcctaggctgtgctg

SEQ ID NO: 8579145 - DNA, 22 bp, Homo sapiens
aggcatggcatggggcagatgt

SEQ ID NO: 8579146 - DNA, 22 bp, Homo sapiens
aggcagtgagcagggtgtcatg

SEQ ID NO: 8579147 - DNA, 22 bp, Homo sapiens
aggcagtggctgagaccagggg

SEQ ID NO: 8579148 - DNA, 22 bp, Homo sapiens
aggcaggttggtgagaagactg

SEQ ID NO: 8579149 - DNA, 18 bp, Homo sapiens
aggcaggtgctaatattt

SEQ ID NO: 8579150 - DNA, 22 bp, Homo sapiens
aggcagtcagccctgctagggt

SEQ ID NO: 8579151 - DNA, 23 bp, Homo sapiens
aggcaggtttgggctcttcttgt

SEQ ID NO: 8579152 - DNA, 22 bp, Homo sapiens
aggcaggtttcccggctgtcaa

SEQ ID NO: 8579153 - DNA, 22 bp, Homo sapiens
aggcaggtttactcttatttgg

SEQ ID NO: 8579154 - DNA, 22 bp, Homo sapiens
aggctccattccaggagctaga

SEQ ID NO: 8579155 - DNA, 19 bp, Homo sapiens
ccagtgcaaggtaagatag

SEQ ID NO: 8579156 - DNA, 22 bp, Homo sapiens
ccagtctgtactttgctctgtt

SEQ ID NO: 8579157 - DNA, 22 bp, Homo sapiens
ccagtgcaccaagaggcctaga

SEQ ID NO: 8579158 - DNA, 22 bp, Homo sapiens
cctcagtctgtctgatctgcca

SEQ ID NO: 8579159 - DNA, 22 bp, Homo sapiens
cccttcaagctctctgggtttt

SEQ ID NO: 8579160 - DNA, 22 bp, Homo sapiens
ccctgtgtcttcttgcctttgt

SEQ ID NO: 8579161 - DNA, 22 bp, Homo sapiens
ccctgtgtagttaactttccac

SEQ ID NO: 8579162 - DNA, 22 bp, Homo sapiens
ccctgttttaagttgatattga

SEQ ID NO: 8579163 - DNA, 22 bp, Homo sapiens
ccctgtttaagaaacctgtaaa

SEQ ID NO: 8579164 - DNA, 22 bp, Homo sapiens
ccctgtttatttttggagagaa

SEQ ID NO: 8579165 - DNA, 22 bp, Homo sapiens
ccctgtttggatggggacccag

SEQ ID NO: 8579166 - DNA, 22 bp, Homo sapiens
agggcagctctcacctctggcc

SEQ ID NO: 8579167 - DNA, 22 bp, Homo sapiens
agggccaggctcccatgtcagg

SEQ ID NO: 8579168 - DNA, 22 bp, Homo sapiens
agggccagccgacttccagcct

SEQ ID NO: 8579169 - DNA, 22 bp, Homo sapiens
agggccagctgcagaattagca

SEQ ID NO: 8579170 - DNA, 18 bp, Homo sapiens
agggccagctgtgagtag

SEQ ID NO: 8579171 - DNA, 22 bp, Homo sapiens
cccagctctggaaggtggggga

SEQ ID NO: 8579172 - DNA, 18 bp, Homo sapiens
cccagcctctcctttcta

SEQ ID NO: 8579173 - DNA, 22 bp, Homo sapiens
cccagcctctgggctcacccaa

SEQ ID NO: 8579174 - DNA, 22 bp, Homo sapiens
cccagcctctggattctgccct

SEQ ID NO: 8579175 - DNA, 22 bp, Homo sapiens
cccagcctctgtttgctcctct

SEQ ID NO: 8579176 - DNA, 22 bp, Homo sapiens
cccagcctctgggttctgccgg

SEQ ID NO: 8579177 - DNA, 22 bp, Homo sapiens
cccagctctaggagtggtggca

SEQ ID NO: 8579178 - DNA, 22 bp, Homo sapiens
cccagcctgatctcggccagct

SEQ ID NO: 8579179 - DNA, 22 bp, Homo sapiens
cccagcctcagctttacttcca

SEQ ID NO: 8579180 - DNA, 22 bp, Homo sapiens
agggagagtttgatgtttcctc

SEQ ID NO: 8579181 - DNA, 19 bp, Homo sapiens
ccccagggtaggctagggg

SEQ ID NO: 8579182 - DNA, 22 bp, Homo sapiens
ccccatgctgggatctgacacc

SEQ ID NO: 8579183 - DNA, 22 bp, Homo sapiens
agggaaggaaaagctgtcgctt

SEQ ID NO: 8579184 - DNA, 19 bp, Homo sapiens
agggaatccggctgaggga

SEQ ID NO: 8579185 - DNA, 22 bp, Homo sapiens
agcttcttaagttcctgcagca

SEQ ID NO: 8579186 - DNA, 22 bp, Homo sapiens
agctgtgttctggttgattcac

SEQ ID NO: 8579187 - DNA, 22 bp, Homo sapiens
caggcctcatggtgtgtccttc

SEQ ID NO: 8579188 - DNA, 23 bp, Homo sapiens
agctgggaattttctgaagcttt

SEQ ID NO: 8579189 - DNA, 22 bp, Homo sapiens
agctttagagagccaagactca

SEQ ID NO: 8579190 - DNA, 22 bp, Homo sapiens
agctttaaagcatatttctaag

SEQ ID NO: 8579191 - DNA, 23 bp, Homo sapiens
agctttaaccctttcaggagcat

SEQ ID NO: 8579192 - DNA, 22 bp, Homo sapiens
agctttaaatcaatccagtgag

SEQ ID NO: 8579193 - DNA, 22 bp, Homo sapiens
agctttaaaaatccaatatcca

SEQ ID NO: 8579194 - DNA, 22 bp, Homo sapiens
aggaacaactgattcagtcaac

SEQ ID NO: 8579195 - DNA, 22 bp, Homo sapiens
aggaaatgcaggcaaatactct

SEQ ID NO: 8579196 - DNA, 22 bp, Homo sapiens
aggaaataggaccagacaaagc

SEQ ID NO: 8579197 - DNA, 22 bp, Homo sapiens
agctctctgataaattgataaa

SEQ ID NO: 8579198 - DNA, 22 bp, Homo sapiens
cagcttcttagtctttccttgt

SEQ ID NO: 8579199 - DNA, 22 bp, Homo sapiens
cagctctgaagaaaggtgtcta

SEQ ID NO: 8579200 - DNA, 21 bp, Homo sapiens
agctggcctggtttgagctcc

SEQ ID NO: 8579201 - DNA, 22 bp, Homo sapiens
agctggctttgagctgggaggt

SEQ ID NO: 8579202 - DNA, 22 bp, Homo sapiens
agctggcttctctgcagacatt

SEQ ID NO: 8579203 - DNA, 22 bp, Homo sapiens
caggaaaaggagactttagcac

SEQ ID NO: 8579204 - DNA, 22 bp, Homo sapiens
caggaaaaatgccaggagtcag

SEQ ID NO: 8579205 - DNA, 22 bp, Homo sapiens
aggagaggcatcaagaaaatcg

SEQ ID NO: 8579206 - DNA, 22 bp, Homo sapiens
aggagaggaatcattattacaa

SEQ ID NO: 8579207 - DNA, 22 bp, Homo sapiens
aggagaggggtaggattaattt

SEQ ID NO: 8579208 - DNA, 22 bp, Homo sapiens
aggagaggctctaactctgtgt

SEQ ID NO: 8579209 - DNA, 22 bp, Homo sapiens
aggagaattaggaactcaagat

SEQ ID NO: 8579210 - DNA, 22 bp, Homo sapiens
aggagagggtggcattaagttt

SEQ ID NO: 8579211 - DNA, 22 bp, Homo sapiens
aggagaggtctcccttccccag

SEQ ID NO: 8579212 - DNA, 19 bp, Homo sapiens
aggagaagactctctcccc

SEQ ID NO: 8579213 - DNA, 23 bp, Homo sapiens
aggagaagagatttccacatgca

SEQ ID NO: 8579214 - DNA, 22 bp, Homo sapiens
aggaagcttggggcagggctac

SEQ ID NO: 8579215 - DNA, 20 bp, Homo sapiens
cagtcctgccccttggggac

SEQ ID NO: 8579216 - DNA, 22 bp, Homo sapiens
cagtcctgagctcctgggctga

SEQ ID NO: 8579217 - DNA, 20 bp, Homo sapiens
cagtcctgcaggcgggagaa

SEQ ID NO: 8579218 - DNA, 22 bp, Homo sapiens
catgcagcggcgtttggtttaa

SEQ ID NO: 8579219 - DNA, 22 bp, Homo sapiens
catgcagcctgtgaacagtgtc

SEQ ID NO: 8579220 - DNA, 22 bp, Homo sapiens
catgcagcagaataatgactat

SEQ ID NO: 8579221 - DNA, 22 bp, Homo sapiens
catgcagcaggatctcattccc

SEQ ID NO: 8579222 - DNA, 20 bp, Homo sapiens
catgcctgctggtatctggc

SEQ ID NO: 8579223 - DNA, 22 bp, Homo sapiens
catggccaggcccagggcccag

SEQ ID NO: 8579224 - DNA, 22 bp, Homo sapiens
catggccaggccaagagagtac

SEQ ID NO: 8579225 - DNA, 22 bp, Homo sapiens
catggccagggcagatggcagg

SEQ ID NO: 8579226 - DNA, 22 bp, Homo sapiens
catggccaggcccagggcccag

SEQ ID NO: 8579227 - DNA, 22 bp, Homo sapiens
catggccagggagagagaatgt

SEQ ID NO: 8579228 - DNA, 22 bp, Homo sapiens
catgcctgtatttctgatctat

SEQ ID NO: 8579229 - DNA, 22 bp, Homo sapiens
catgaaagcaggaatggtttta

SEQ ID NO: 8579230 - DNA, 22 bp, Homo sapiens
aggaggcactcactctcagggt

SEQ ID NO: 8579231 - DNA, 21 bp, Homo sapiens
catttacatgacagattggtt

SEQ ID NO: 8579232 - DNA, 22 bp, Homo sapiens
cattcaaacattaatttattca

SEQ ID NO: 8579233 - DNA, 22 bp, Homo sapiens
atcttggggaatcctctgtgta

SEQ ID NO: 8579234 - DNA, 22 bp, Homo sapiens
agaagacagagtctacattcta

SEQ ID NO: 8579235 - DNA, 22 bp, Homo sapiens
agaagacagagtctacattcta

SEQ ID NO: 8579236 - DNA, 22 bp, Homo sapiens
agaatgtgtgattgaagctctt

SEQ ID NO: 8579237 - DNA, 22 bp, Homo sapiens
agaatgtgaagattttgaatta

SEQ ID NO: 8579238 - DNA, 22 bp, Homo sapiens
agaatgtgttttaacatgggaa

SEQ ID NO: 8579239 - DNA, 22 bp, Homo sapiens
agacaatatataattttagttg

SEQ ID NO: 8579240 - DNA, 22 bp, Homo sapiens
atgtccaggaagtcttaactca

SEQ ID NO: 8579241 - DNA, 22 bp, Homo sapiens
atgtccagggggcttgactggt

SEQ ID NO: 8579242 - DNA, 22 bp, Homo sapiens
atgtccagggcacacagcagtg

SEQ ID NO: 8579243 - DNA, 22 bp, Homo sapiens
atgtctgtttatccttcaagat

SEQ ID NO: 8579244 - DNA, 22 bp, Homo sapiens
atgtccagagtgtcctggaaag

SEQ ID NO: 8579245 - DNA, 22 bp, Homo sapiens
atgtccagaggtgagtcagagc

SEQ ID NO: 8579246 - DNA, 22 bp, Homo sapiens
atgtccagagtaaagcacattc

SEQ ID NO: 8579247 - DNA, 22 bp, Homo sapiens
atgcttggatgctgccatggga

SEQ ID NO: 8579248 - DNA, 21 bp, Homo sapiens
atggagtcaggggaatgggcc

SEQ ID NO: 8579249 - DNA, 22 bp, Homo sapiens
atggagttctgccagcgctgct

SEQ ID NO: 8579250 - DNA, 22 bp, Homo sapiens
atggataatcatgaactttgag

SEQ ID NO: 8579251 - DNA, 22 bp, Homo sapiens
attataaatattttctaggggt

SEQ ID NO: 8579252 - DNA, 22 bp, Homo sapiens
attataaagaacatgtgtgtgg

SEQ ID NO: 8579253 - DNA, 22 bp, Homo sapiens
attcacaattagaagtagataa

SEQ ID NO: 8579254 - DNA, 22 bp, Homo sapiens
agagggatcaccctgtttctgg

SEQ ID NO: 8579255 - DNA, 22 bp, Homo sapiens
atgtgtatccatctgtctattt

SEQ ID NO: 8579256 - DNA, 22 bp, Homo sapiens
atgtttctgaagtttacagata

SEQ ID NO: 8579257 - DNA, 22 bp, Homo sapiens
attataaacctttgagggtggg

SEQ ID NO: 8579258 - DNA, 22 bp, Homo sapiens
attagattgtaaatgttttcac

SEQ ID NO: 8579259 - DNA, 22 bp, Homo sapiens
attaaagaaacccagcatgtga

SEQ ID NO: 8579260 - DNA, 22 bp, Homo sapiens
attaaagacagcagatggatgg

SEQ ID NO: 8579261 - DNA, 22 bp, Homo sapiens
atttattatgggatttggctca

SEQ ID NO: 8579262 - DNA, 22 bp, Homo sapiens
atttattattgtggttacttct

SEQ ID NO: 8579263 - DNA, 22 bp, Homo sapiens
agatgaaagatttttatagaga

SEQ ID NO: 8579264 - DNA, 19 bp, Homo sapiens
atttgcttgtctgctctgc

SEQ ID NO: 8579265 - DNA, 22 bp, Homo sapiens
atttgcttgactatggcttgca

SEQ ID NO: 8579266 - DNA, 22 bp, Homo sapiens
atttgcttgtaaatgtatgcct

SEQ ID NO: 8579267 - DNA, 22 bp, Homo sapiens
atttgcttcctaatactcatat

SEQ ID NO: 8579268 - DNA, 22 bp, Homo sapiens
agatttcacatgctgctctatt

SEQ ID NO: 8579269 - DNA, 17 bp, Homo sapiens
agcaaaagtatcaaagc

SEQ ID NO: 8579270 - DNA, 22 bp, Homo sapiens
agcaaaataaggtaatttattg

SEQ ID NO: 8579271 - DNA, 22 bp, Homo sapiens
cagaggcgaggcagctgaacct

SEQ ID NO: 8579272 - DNA, 22 bp, Homo sapiens
agcctggtttaagcattttata

SEQ ID NO: 8579273 - DNA, 22 bp, Homo sapiens
agcctggtttaagcattttata

SEQ ID NO: 8579274 - DNA, 22 bp, Homo sapiens
agccttcagcagttcaggtgcc

SEQ ID NO: 8579275 - DNA, 22 bp, Homo sapiens
agccttcagtaaatccactgtg

SEQ ID NO: 8579276 - DNA, 23 bp, Homo sapiens
agccttcaggcaatgtcagtaga

SEQ ID NO: 8579277 - DNA, 22 bp, Homo sapiens
agccttcagtaagggcttagca

SEQ ID NO: 8579278 - DNA, 22 bp, Homo sapiens
agccttcataatcttgggcttt

SEQ ID NO: 8579279 - DNA, 22 bp, Homo sapiens
agccttgaatgcgctgcattgg

SEQ ID NO: 8579280 - DNA, 22 bp, Homo sapiens
agccttgcatgatttcattcat

SEQ ID NO: 8579281 - DNA, 22 bp, Homo sapiens
cagcaggaggtgagatgtgacc

SEQ ID NO: 8579282 - DNA, 22 bp, Homo sapiens
cagcaggaggtgagtagcaggt

SEQ ID NO: 8579283 - DNA, 22 bp, Homo sapiens
cagcaggataggtttctttgga

SEQ ID NO: 8579284 - DNA, 22 bp, Homo sapiens
agctaggagattttgtgaggct

SEQ ID NO: 8579285 - DNA, 22 bp, Homo sapiens
cagaagctgcagtgatctggga

SEQ ID NO: 8579286 - DNA, 22 bp, Homo sapiens
agccaggacgttgctcagctcc

SEQ ID NO: 8579287 - DNA, 22 bp, Homo sapiens
cagaagctttgtctagtcttga

SEQ ID NO: 8579288 - DNA, 22 bp, Homo sapiens
caactgaaaagattctacgcag

SEQ ID NO: 8579289 - DNA, 21 bp, Homo sapiens
agcagagtgctttgactttgt

SEQ ID NO: 8579290 - DNA, 22 bp, Homo sapiens
agcacagaggtggaagtgtata

SEQ ID NO: 8579291 - DNA, 22 bp, Homo sapiens
agcacagatggatgtattcatt

SEQ ID NO: 8579292 - DNA, 21 bp, Homo sapiens
attttctctggatgatggtca

SEQ ID NO: 8579293 - DNA, 22 bp, Homo sapiens
attttctctttgtatatgctag

SEQ ID NO: 8579294 - DNA, 22 bp, Homo sapiens
attttctcacaatgcagaagga

SEQ ID NO: 8579295 - DNA, 22 bp, Homo sapiens
attttctcacaatcctatgggg

SEQ ID NO: 8579296 - DNA, 22 bp, Homo sapiens
attttctctcaaaccttaaaat

SEQ ID NO: 8579297 - DNA, 22 bp, Homo sapiens
attttctgtaactatttctata

SEQ ID NO: 8579298 - DNA, 22 bp, Homo sapiens
agcagaagtgccttagcaatca

SEQ ID NO: 8579299 - DNA, 22 bp, Homo sapiens
agcagttttcctgagctcctca

SEQ ID NO: 8579300 - DNA, 23 bp, Homo sapiens
agcataaacctctgtggctttag

SEQ ID NO: 8579301 - DNA, 21 bp, Homo sapiens
agcaggtctacaggttcatag

SEQ ID NO: 8579302 - DNA, 22 bp, Homo sapiens
agcaggtcgccgaagatagctc

SEQ ID NO: 8579303 - DNA, 22 bp, Homo sapiens
cacagtccagactcctggagtt

SEQ ID NO: 8579304 - DNA, 22 bp, Homo sapiens
agggctggtatgtccatgaaag

SEQ ID NO: 8579305 - DNA, 22 bp, Homo sapiens
agggctttcggcactctgaggg

SEQ ID NO: 8579306 - DNA, 22 bp, Homo sapiens
agggctttaatgattattttct

SEQ ID NO: 8579307 - DNA, 22 bp, Homo sapiens
agggctttacttctcagttcta

SEQ ID NO: 8579308 - DNA, 22 bp, Homo sapiens
acctgtggatcagattcttgta

SEQ ID NO: 8579309 - DNA, 22 bp, Homo sapiens
acctgtttaccctgggctcccc

SEQ ID NO: 8579310 - DNA, 22 bp, Homo sapiens
aggtaccatatgcgggagcaac

SEQ ID NO: 8579311 - DNA, 22 bp, Homo sapiens
aggtacagtagacagacagtta

SEQ ID NO: 8579312 - DNA, 22 bp, Homo sapiens
acctgtttacctgcacctgttt

SEQ ID NO: 8579313 - DNA, 22 bp, Homo sapiens
acctgtttagaaagcttatgag

SEQ ID NO: 8579314 - DNA, 22 bp, Homo sapiens
acctgtttggaggaggtgttag

SEQ ID NO: 8579315 - DNA, 22 bp, Homo sapiens
acctgtttctctctgagttact

SEQ ID NO: 8579316 - DNA, 22 bp, Homo sapiens
acctgtttgtgtccattagtga

SEQ ID NO: 8579317 - DNA, 22 bp, Homo sapiens
acctgtttgtgtttggactgca

SEQ ID NO: 8579318 - DNA, 22 bp, Homo sapiens
acctgttttagtctttaatcat

SEQ ID NO: 8579319 - DNA, 22 bp, Homo sapiens
acctgtttgttaagaaagcttc

SEQ ID NO: 8579320 - DNA, 22 bp, Homo sapiens
acctgttttcagaaaatgcaga

SEQ ID NO: 8579321 - DNA, 22 bp, Homo sapiens
acctgttttcctatctagattg

SEQ ID NO: 8579322 - DNA, 22 bp, Homo sapiens
accttcaattatttttgttcca

SEQ ID NO: 8579323 - DNA, 22 bp, Homo sapiens
accttcaaactagatagaagtt

SEQ ID NO: 8579324 - DNA, 22 bp, Homo sapiens
accttcaactcaaagtgtccca

SEQ ID NO: 8579325 - DNA, 21 bp, Homo sapiens
accttcaagccagaggtggtc

SEQ ID NO: 8579326 - DNA, 22 bp, Homo sapiens
accttcaagaaacatttccttg

SEQ ID NO: 8579327 - DNA, 22 bp, Homo sapiens
accttcaagattgtgggtcaat

SEQ ID NO: 8579328 - DNA, 22 bp, Homo sapiens
accttcaatgaaaataatagtc

SEQ ID NO: 8579329 - DNA, 22 bp, Homo sapiens
accttcaagtatgtgggctgaa

SEQ ID NO: 8579330 - DNA, 19 bp, Homo sapiens
actaaaaatgatgtttgag

SEQ ID NO: 8579331 - DNA, 22 bp, Homo sapiens
actgcaacctccgcctgccagg

SEQ ID NO: 8579332 - DNA, 22 bp, Homo sapiens
agtctcttacccaagcagaatg

SEQ ID NO: 8579333 - DNA, 22 bp, Homo sapiens
agtctctgtcgtagatcagcgt

SEQ ID NO: 8579334 - DNA, 22 bp, Homo sapiens
agtctcttaatgggcagaaagt

SEQ ID NO: 8579335 - DNA, 20 bp, Homo sapiens
agaaacagcacaattctgtt

SEQ ID NO: 8579336 - DNA, 22 bp, Homo sapiens
atccagctttgtctggtcttcg

SEQ ID NO: 8579337 - DNA, 22 bp, Homo sapiens
atcattttatggctgagaggac

SEQ ID NO: 8579338 - DNA, 22 bp, Homo sapiens
actgtgtgggccgctcactggg

SEQ ID NO: 8579339 - DNA, 22 bp, Homo sapiens
actgtgtgactgttattactgt

SEQ ID NO: 8579340 - DNA, 22 bp, Homo sapiens
actgtgtgaaacatcaatgtgt

SEQ ID NO: 8579341 - DNA, 22 bp, Homo sapiens
agtttacataaaaaggcagagg

SEQ ID NO: 8579342 - DNA, 22 bp, Homo sapiens
agtttagaagaggaacttgtta

SEQ ID NO: 8579343 - DNA, 21 bp, Homo sapiens
agtttcctcaactgcagaagg

SEQ ID NO: 8579344 - DNA, 22 bp, Homo sapiens
agtttccttggattcaatttgg

SEQ ID NO: 8579345 - DNA, 22 bp, Homo sapiens
aggctagggtaacagatgtggc

SEQ ID NO: 8579346 - DNA, 22 bp, Homo sapiens
aggctagggccatggctggtga

SEQ ID NO: 8579347 - DNA, 22 bp, Homo sapiens
aggcgcagggtttggacccagg

SEQ ID NO: 8579348 - DNA, 22 bp, Homo sapiens
aggcgcagacatacagggtctg

SEQ ID NO: 8579349 - DNA, 22 bp, Homo sapiens
aggcgcagaaggccaggggcct

SEQ ID NO: 8579350 - DNA, 18 bp, Homo sapiens
aggctgcactgtcttaaa

SEQ ID NO: 8579351 - DNA, 22 bp, Homo sapiens
aggcccttaggacccctgcgtg

SEQ ID NO: 8579352 - DNA, 22 bp, Homo sapiens
acatgcaaaaatatatttatga

SEQ ID NO: 8579353 - DNA, 22 bp, Homo sapiens
acatgaaagttattctgagttg

SEQ ID NO: 8579354 - DNA, 22 bp, Homo sapiens
aggcagggctgggattagactc

SEQ ID NO: 8579355 - DNA, 22 bp, Homo sapiens
acatttttattcatcaaagcag

SEQ ID NO: 8579356 - DNA, 22 bp, Homo sapiens
acatttttactgggcatctgca

SEQ ID NO: 8579357 - DNA, 22 bp, Homo sapiens
accaaaacctgctactaaagga

SEQ ID NO: 8579358 - DNA, 22 bp, Homo sapiens
acatttttgggttgatgtctga

SEQ ID NO: 8579359 - DNA, 22 bp, Homo sapiens
accaaaaagatatgttgaagcc

SEQ ID NO: 8579360 - DNA, 22 bp, Homo sapiens
accaaaaattgtggggctgaat

SEQ ID NO: 8579361 - DNA, 22 bp, Homo sapiens
agggcctgggccagcacccttt

SEQ ID NO: 8579362 - DNA, 22 bp, Homo sapiens
agggcctggggtagcttactgc

SEQ ID NO: 8579363 - DNA, 22 bp, Homo sapiens
agggcctgggtctgtactcctc

SEQ ID NO: 8579364 - DNA, 22 bp, Homo sapiens
acccgggaggcaggagtcatag

SEQ ID NO: 8579365 - DNA, 22 bp, Homo sapiens
accctactaaatgtggtatgtc

SEQ ID NO: 8579366 - DNA, 23 bp, Homo sapiens
aggaggaaaagttatctgctgag

SEQ ID NO: 8579367 - DNA, 21 bp, Homo sapiens
aggaggaacccgtggctgggc

SEQ ID NO: 8579368 - DNA, 22 bp, Homo sapiens
acagtgttctgctttttaatcc

SEQ ID NO: 8579369 - DNA, 22 bp, Homo sapiens
acagtgttttagaaaagcttga

SEQ ID NO: 8579370 - DNA, 22 bp, Homo sapiens
acagtgttttatgagaattgtt

SEQ ID NO: 8579371 - DNA, 22 bp, Homo sapiens
acagtgttttcttaaggagaaa

SEQ ID NO: 8579372 - DNA, 22 bp, Homo sapiens
acagtgttttgtctggcagggc

SEQ ID NO: 8579373 - DNA, 20 bp, Homo sapiens
acagtgtttttgagtagagc

SEQ ID NO: 8579374 - DNA, 22 bp, Homo sapiens
acagttatctttgaaatagaga

SEQ ID NO: 8579375 - DNA, 22 bp, Homo sapiens
acagttaggtcctaaaattctg

SEQ ID NO: 8579376 - DNA, 22 bp, Homo sapiens
aggcaggcactccggaagtgtc

SEQ ID NO: 8579377 - DNA, 22 bp, Homo sapiens
agctgccttaaattactttgtg

SEQ ID NO: 8579378 - DNA, 20 bp, Homo sapiens
agctgccttcattttctaga

SEQ ID NO: 8579379 - DNA, 17 bp, Homo sapiens
agctgccttgcttgagc

SEQ ID NO: 8579380 - DNA, 22 bp, Homo sapiens
acagctcactcacagggctagt

SEQ ID NO: 8579381 - DNA, 22 bp, Homo sapiens
acagctctgagatattactatt

SEQ ID NO: 8579382 - DNA, 22 bp, Homo sapiens
acagctctccctcagagaaatg

SEQ ID NO: 8579383 - DNA, 22 bp, Homo sapiens
aggaatggtgctcagcagaaat

SEQ ID NO: 8579384 - DNA, 22 bp, Homo sapiens
agctttatgcttcctacaagct

SEQ ID NO: 8579385 - DNA, 22 bp, Homo sapiens
aacagaagggggtatttacatt

SEQ ID NO: 8579386 - DNA, 22 bp, Homo sapiens
aaatttgataagccattgttac

SEQ ID NO: 8579387 - DNA, 22 bp, Homo sapiens
aaggctggtcagatgtggtgaa

SEQ ID NO: 8579388 - DNA, 22 bp, Homo sapiens
aaggctggtggattatgaggtc

SEQ ID NO: 8579389 - DNA, 22 bp, Homo sapiens
aaggctgggtttgggatgtgat

SEQ ID NO: 8579390 - DNA, 22 bp, Homo sapiens
aatggctatacaacatgagtat

SEQ ID NO: 8579391 - DNA, 22 bp, Homo sapiens
aatggctctgatgttgttgtga

SEQ ID NO: 8579392 - DNA, 22 bp, Homo sapiens
aacatcatcctttgagtattta

SEQ ID NO: 8579393 - DNA, 22 bp, Homo sapiens
aacatcatcatgaacaactaat

SEQ ID NO: 8579394 - DNA, 22 bp, Homo sapiens
aacatcatcagatgggtgcttg

SEQ ID NO: 8579395 - DNA, 19 bp, Homo sapiens
aacatcatggctctttcca

SEQ ID NO: 8579396 - DNA, 22 bp, Homo sapiens
aacatcattatgtccattaatg

SEQ ID NO: 8579397 - DNA, 22 bp, Homo sapiens
aacagctagaattctactggct

SEQ ID NO: 8579398 - DNA, 22 bp, Homo sapiens
aacagctattcactactatggg

SEQ ID NO: 8579399 - DNA, 22 bp, Homo sapiens
aacatctgatcgaacagtgcca

SEQ ID NO: 8579400 - DNA, 22 bp, Homo sapiens
aagcaatagcaacaactttaca

SEQ ID NO: 8579401 - DNA, 22 bp, Homo sapiens
aagatgcagctttacaataagg

SEQ ID NO: 8579402 - DNA, 22 bp, Homo sapiens
aagatgaatcagtatgtgtcct

SEQ ID NO: 8579403 - DNA, 22 bp, Homo sapiens
aagatgaactgtcttcacccat

SEQ ID NO: 8579404 - DNA, 22 bp, Homo sapiens
aagcaatagggtaatctactca

SEQ ID NO: 8579405 - DNA, 22 bp, Homo sapiens
aagcagaactgggaagtagtgg

SEQ ID NO: 8579406 - DNA, 22 bp, Homo sapiens
aagcagagaaaagcttaggttc

SEQ ID NO: 8579407 - DNA, 22 bp, Homo sapiens
aagcagagaccggctaatggag

SEQ ID NO: 8579408 - DNA, 22 bp, Homo sapiens
aagcagctttctttcctgtgaa

SEQ ID NO: 8579409 - DNA, 22 bp, Homo sapiens
aagcagcttccctggctcctgg

SEQ ID NO: 8579410 - DNA, 22 bp, Homo sapiens
aagcagcttaaattagagcctg

SEQ ID NO: 8579411 - DNA, 21 bp, Homo sapiens
acacaaacctcctcagcctgg

SEQ ID NO: 8579412 - DNA, 22 bp, Homo sapiens
aagacttgaccaggttgaaggc

SEQ ID NO: 8579413 - DNA, 22 bp, Homo sapiens
aatttgttacacagcaatataa

SEQ ID NO: 8579414 - DNA, 22 bp, Homo sapiens
aagaaatgtgaatattgaatag

SEQ ID NO: 8579415 - DNA, 22 bp, Homo sapiens
aagaaagagatcactcctccat

SEQ ID NO: 8579416 - DNA, 22 bp, Homo sapiens
aatgggaaaagagtatgattta

SEQ ID NO: 8579417 - DNA, 22 bp, Homo sapiens
aatgggaaagagactagatgct

SEQ ID NO: 8579418 - DNA, 22 bp, Homo sapiens
aagaaaacaatgacttgccagc

SEQ ID NO: 8579419 - DNA, 20 bp, Homo sapiens
aaaatatgtataactcttct

SEQ ID NO: 8579420 - DNA, 22 bp, Homo sapiens
aaaatattttagggccaggaga

SEQ ID NO: 8579421 - DNA, 22 bp, Homo sapiens
aaaatattttagggccaggaga

SEQ ID NO: 8579422 - DNA, 22 bp, Homo sapiens
aaaagtaattgatgcaatcgta

SEQ ID NO: 8579423 - DNA, 22 bp, Homo sapiens
aaaaagtttcaactgccaactc

SEQ ID NO: 8579424 - DNA, 22 bp, Homo sapiens
aaaaggctcttcaaaatggaag

SEQ ID NO: 8579425 - DNA, 22 bp, Homo sapiens
aaagccagagtgtgttagagac

SEQ ID NO: 8579426 - DNA, 22 bp, Homo sapiens
aaacagcagctgtttaatttgc

SEQ ID NO: 8579427 - DNA, 22 bp, Homo sapiens
aaacagctcaagaagttactct

SEQ ID NO: 8579428 - DNA, 22 bp, Homo sapiens
aaacattctcagccctgcttgc

SEQ ID NO: 8579429 - DNA, 22 bp, Homo sapiens
aaacttttttaggttcataggc

SEQ ID NO: 8579430 - DNA, 22 bp, Homo sapiens
aaatagtttagctctcatttca

SEQ ID NO: 8579431 - DNA, 22 bp, Homo sapiens
aaacttttcctgctcttgtcct

SEQ ID NO: 8579432 - DNA, 22 bp, Homo sapiens
aaagagaaaaagatcccggctc

SEQ ID NO: 8579433 - DNA, 22 bp, Homo sapiens
aaagagaaaaagatcccggctc

SEQ ID NO: 8579434 - DNA, 22 bp, Homo sapiens
aaagagaaaatgatctgtacat

SEQ ID NO: 8579435 - DNA, 22 bp, Homo sapiens
aaagagaacttttacccaagaa

SEQ ID NO: 8579436 - DNA, 20 bp, Homo sapiens
aaagagaagcctcaccttgt

SEQ ID NO: 8579437 - DNA, 20 bp, Homo sapiens
aaagagaagcctcaccttgt

SEQ ID NO: 8579438 - DNA, 22 bp, Homo sapiens
aaagatcagtctgaagcaacat

SEQ ID NO: 8579439 - DNA, 22 bp, Homo sapiens
aaagatgttatgaaataactat

SEQ ID NO: 8579440 - DNA, 22 bp, Homo sapiens
aaagcacttcaggagcagtttg

SEQ ID NO: 8579441 - DNA, 22 bp, Homo sapiens
aaagcagaggttgcagtgagct

SEQ ID NO: 8579442 - DNA, 22 bp, Homo sapiens
aaagcagaggtgatatgactta

SEQ ID NO: 8579443 - DNA, 19 bp, Homo sapiens
aaagcagaggagcatctga

SEQ ID NO: 8579444 - DNA, 22 bp, Homo sapiens
aacacattttgcctaggcaata

SEQ ID NO: 8579445 - DNA, 23 bp, Homo sapiens
aaagcaaggaattggcaacagag

SEQ ID NO: 8579446 - DNA, 22 bp, Homo sapiens
aaagccttcttcggtctgtgat

SEQ ID NO: 8579447 - DNA, 22 bp, Homo sapiens
aaagccttgagatcctatagtt

SEQ ID NO: 8579448 - DNA, 22 bp, Homo sapiens
aaagccttctgtctagcagata

SEQ ID NO: 8579449 - DNA, 22 bp, Homo sapiens
aaagccttcaagtagatgtaag

SEQ ID NO: 8579450 - DNA, 22 bp, Homo sapiens
aaagccttttctgtttaacaca

SEQ ID NO: 8579451 - DNA, 22 bp, Homo sapiens
aaagccttttatgatcagttaa

SEQ ID NO: 8579452 - DNA, 22 bp, Homo sapiens
aaagcctttgtctcaggctctg

SEQ ID NO: 8579453 - DNA, 22 bp, Homo sapiens
aaagccttgggatttgtgatca

SEQ ID NO: 8579454 - DNA, 22 bp, Homo sapiens
aagcaggatggaggttgagtta

SEQ ID NO: 8579455 - DNA, 22 bp, Homo sapiens
aagcaggagatgggtgcttttc

SEQ ID NO: 8579456 - DNA, 22 bp, Homo sapiens
aagattcacagagtgaatgaaa

SEQ ID NO: 8579457 - DNA, 22 bp, Homo sapiens
aagatcaagatcagagaacagc

SEQ ID NO: 8579458 - DNA, 22 bp, Homo sapiens
aagatattcaaagatttattag

SEQ ID NO: 8579459 - DNA, 22 bp, Homo sapiens
aagatcaatgttcattaagatg

SEQ ID NO: 8579460 - DNA, 22 bp, Homo sapiens
aagccttcagagttggctggtc

SEQ ID NO: 8579461 - DNA, 22 bp, Homo sapiens
aagccttcagtccgttgcagag

SEQ ID NO: 8579462 - DNA, 22 bp, Homo sapiens
aagaggggtgtgtgtcaaccca

SEQ ID NO: 8579463 - DNA, 22 bp, Homo sapiens
aaagttttagctgtccagttcc

SEQ ID NO: 8579464 - DNA, 22 bp, Homo sapiens
aaagttttatatgctgcagcga

SEQ ID NO: 8579465 - DNA, 22 bp, Homo sapiens
aaagttttagaactaggaagca

SEQ ID NO: 8579466 - DNA, 22 bp, Homo sapiens
aagaccttgtctaaacatgtag

SEQ ID NO: 8579467 - DNA, 22 bp, Homo sapiens
acactagctaaatgctgattaa

SEQ ID NO: 8579468 - DNA, 22 bp, Homo sapiens
acacagagttattatgtgaact

SEQ ID NO: 8579469 - DNA, 22 bp, Homo sapiens
acaatgcaccagcatcttcacc

SEQ ID NO: 8579470 - DNA, 22 bp, Homo sapiens
agccctgttgtctgatgatggg

SEQ ID NO: 8579471 - DNA, 22 bp, Homo sapiens
agctcctgcacccagccttgag

SEQ ID NO: 8579472 - DNA, 22 bp, Homo sapiens
acagagaaagtgggctgaagat

SEQ ID NO: 8579473 - DNA, 22 bp, Homo sapiens
agccagggtctctcgctctgtt

SEQ ID NO: 8579474 - DNA, 19 bp, Homo sapiens
agccagggtccagacatgt

SEQ ID NO: 8579475 - DNA, 22 bp, Homo sapiens
agccaggggattcatcagggac

SEQ ID NO: 8579476 - DNA, 22 bp, Homo sapiens
agaagcagcaagcccttcaaag

SEQ ID NO: 8579477 - DNA, 22 bp, Homo sapiens
aatgtggcattgtcattattgg

SEQ ID NO: 8579478 - DNA, 22 bp, Homo sapiens
agagccaggctctacctgggtt

SEQ ID NO: 8579479 - DNA, 22 bp, Homo sapiens
agagccaggctcccatggggca

SEQ ID NO: 8579480 - DNA, 22 bp, Homo sapiens
agagccaggcggctgggcacct

SEQ ID NO: 8579481 - DNA, 22 bp, Homo sapiens
agagcctggaggttctgctgaa

SEQ ID NO: 8579482 - DNA, 22 bp, Homo sapiens
aattaaaaaaggagagcttgct

SEQ ID NO: 8579483 - DNA, 22 bp, Homo sapiens
aatgtttgtgcataaatatgtt

SEQ ID NO: 8579484 - DNA, 18 bp, Homo sapiens
acaaaggatcatgaggga

SEQ ID NO: 8579485 - DNA, 22 bp, Homo sapiens
acaaaggactgaaactggctgt

SEQ ID NO: 8579486 - DNA, 21 bp, Homo sapiens
acaaaggaagtctcttttaag

SEQ ID NO: 8579487 - DNA, 22 bp, Homo sapiens
agaggctgaatgatgtcatcat

SEQ ID NO: 8579488 - DNA, 22 bp, Homo sapiens
acaagctccttattcagctggg

SEQ ID NO: 8579489 - DNA, 22 bp, Homo sapiens
acaacagagctggactgagagg

SEQ ID NO: 8579490 - DNA, 22 bp, Homo sapiens
acaacaaagacacttgaaatga

SEQ ID NO: 8579491 - DNA, 22 bp, Homo sapiens
agaacaatgttaaattattaag

SEQ ID NO: 8579492 - DNA, 22 bp, Homo sapiens
agaacaatgcgtattttactcc

SEQ ID NO: 8579493 - DNA, 22 bp, Homo sapiens
aatgatttcccctacacagaag

SEQ ID NO: 8579494 - DNA, 22 bp, Homo sapiens
aatatagaatcactttccttca

SEQ ID NO: 8579495 - DNA, 22 bp, Homo sapiens
actggctgaaagtaaagaacac

SEQ ID NO: 8579496 - DNA, 22 bp, Homo sapiens
actggacagaggaaatatggag

SEQ ID NO: 8579497 - DNA, 22 bp, Homo sapiens
actcagagaaacagcagggtgt

SEQ ID NO: 8579498 - DNA, 22 bp, Homo sapiens
aagccttccctttttgagctca

SEQ ID NO: 8579499 - DNA, 22 bp, Homo sapiens
aagccttcctgagtgcaaggcc

SEQ ID NO: 8579500 - DNA, 22 bp, Homo sapiens
aagccaaataatgtaggtacat

SEQ ID NO: 8579501 - DNA, 22 bp, Homo sapiens
acagtgtttaaaataatatgct

SEQ ID NO: 8579502 - DNA, 22 bp, Homo sapiens
acagtgtttaaaaatcagatct

SEQ ID NO: 8579503 - DNA, 22 bp, Homo sapiens
acagtgttgaggtgcttgtttc

SEQ ID NO: 8579504 - DNA, 22 bp, Homo sapiens
acagtgttgtatttagtttgat

SEQ ID NO: 8579505 - DNA, 22 bp, Homo sapiens
acagtgttgtggctcttaatag

SEQ ID NO: 8579506 - DNA, 22 bp, Homo sapiens
acagtgttcttggcgctgagtg

SEQ ID NO: 8579507 - DNA, 22 bp, Homo sapiens
acagtgttcttgatattacagt

SEQ ID NO: 8579508 - DNA, 22 bp, Homo sapiens
aaggaggagtggggtcctggaa

SEQ ID NO: 8579509 - DNA, 22 bp, Homo sapiens
acagtgtttggcaatgcatgca

SEQ ID NO: 8579510 - DNA, 22 bp, Homo sapiens
acagtgtttcacttaaccgttt

SEQ ID NO: 8579511 - DNA, 22 bp, Homo sapiens
acagtgtttaagagatggcatt

SEQ ID NO: 8579512 - DNA, 22 bp, Homo sapiens
acagtgtttatgtacagattgt

SEQ ID NO: 8579513 - DNA, 19 bp, Homo sapiens
acatatgtggatatacatg

SEQ ID NO: 8579514 - DNA, 22 bp, Homo sapiens
accatgttggccaagctggtct

SEQ ID NO: 8579515 - DNA, 22 bp, Homo sapiens
acccagagcccttagcacagac

SEQ ID NO: 8579516 - DNA, 22 bp, Homo sapiens
aagggcttttaagatttatcct

SEQ ID NO: 8579517 - DNA, 22 bp, Homo sapiens
aaggcctgctcagctgtctgtg

SEQ ID NO: 8579518 - DNA, 22 bp, Homo sapiens
aaggcctgggaggcctctcttc

SEQ ID NO: 8579519 - DNA, 21 bp, Homo sapiens
aaggctggagatgcaggtctg

SEQ ID NO: 8579520 - DNA, 22 bp, Homo sapiens
acatttctgcatctcagagcta

SEQ ID NO: 8579521 - DNA, 22 bp, Homo sapiens
acatttctggagtttctcaaca

SEQ ID NO: 8579522 - DNA, 22 bp, Homo sapiens
acatttctgctagaataggtga

SEQ ID NO: 8579523 - DNA, 22 bp, Homo sapiens
gtgtcagatgtccagggcagca

SEQ ID NO: 8579524 - DNA, 22 bp, Homo sapiens
gtgtccagggctggaagtgagg

SEQ ID NO: 8579525 - DNA, 22 bp, Homo sapiens
gtgtccagagaactgtgggagc

SEQ ID NO: 8579526 - DNA, 22 bp, Homo sapiens
gtgtccagcgtggaatgagggt

SEQ ID NO: 8579527 - DNA, 22 bp, Homo sapiens
gtgtgagcatcaaagcctgtca

SEQ ID NO: 8579528 - DNA, 22 bp, Homo sapiens
gtgtcctgccaccctgggcttt

SEQ ID NO: 8579529 - DNA, 22 bp, Homo sapiens
gttctgagtcctcctttgaagg

SEQ ID NO: 8579530 - DNA, 22 bp, Homo sapiens
gttgttgatcacatgcatatct

SEQ ID NO: 8579531 - DNA, 22 bp, Homo sapiens
gttgttgatgaagatctgactg

SEQ ID NO: 8579532 - DNA, 22 bp, Homo sapiens
gttattttcattggctcagact

SEQ ID NO: 8579533 - DNA, 22 bp, Homo sapiens
gttcaaaattcaaatggtatac

SEQ ID NO: 8579534 - DNA, 21 bp, Homo sapiens
gttattttaagtgagctttgc

SEQ ID NO: 8579535 - DNA, 22 bp, Homo sapiens
gttcgcatcttgatcatggact

SEQ ID NO: 8579536 - DNA, 22 bp, Homo sapiens
gtggtgtaggtcacagttagga

SEQ ID NO: 8579537 - DNA, 22 bp, Homo sapiens
gtggtgtttgagctgccaggga

SEQ ID NO: 8579538 - DNA, 22 bp, Homo sapiens
gtgggctggaccctcctgctcc

SEQ ID NO: 8579539 - DNA, 22 bp, Homo sapiens
taaagcaggcatctctctcctc

SEQ ID NO: 8579540 - DNA, 22 bp, Homo sapiens
gtttttctagaaatctcctcct

SEQ ID NO: 8579541 - DNA, 22 bp, Homo sapiens
gtttttctaagtagcgatattt

SEQ ID NO: 8579542 - DNA, 22 bp, Homo sapiens
gtttttctttgtgtgaagacaa

SEQ ID NO: 8579543 - DNA, 22 bp, Homo sapiens
gttttttgggtgtatatcttct

SEQ ID NO: 8579544 - DNA, 20 bp, Homo sapiens
gtttttctctcttgccacta

SEQ ID NO: 8579545 - DNA, 22 bp, Homo sapiens
gtttttctaggaccatgtgatt

SEQ ID NO: 8579546 - DNA, 22 bp, Homo sapiens
gtttttctagactgggagtttg

SEQ ID NO: 8579547 - DNA, 22 bp, Homo sapiens
gtttttctctgaaatagttgac

SEQ ID NO: 8579548 - DNA, 20 bp, Homo sapiens
gtttttcttgggcgagctat

SEQ ID NO: 8579549 - DNA, 22 bp, Homo sapiens
gtttttctgtgagcggtaaagg

SEQ ID NO: 8579550 - DNA, 22 bp, Homo sapiens
taaatgagtaatatagctgttt

SEQ ID NO: 8579551 - DNA, 22 bp, Homo sapiens
gtatagaaacccagaaagatag

SEQ ID NO: 8579552 - DNA, 22 bp, Homo sapiens
gtacagtcttcttaatgctttt

SEQ ID NO: 8579553 - DNA, 22 bp, Homo sapiens
gtaaacattactgtgctgtata

SEQ ID NO: 8579554 - DNA, 22 bp, Homo sapiens
ggtgagggtaaatataggcaaa

SEQ ID NO: 8579555 - DNA, 22 bp, Homo sapiens
ggtgcaggacgaagtgggggtt

SEQ ID NO: 8579556 - DNA, 22 bp, Homo sapiens
ggtgcaggaatctgcaattgaa

SEQ ID NO: 8579557 - DNA, 22 bp, Homo sapiens
ggtgcaggcggtggggcaagta

SEQ ID NO: 8579558 - DNA, 22 bp, Homo sapiens
ggtgcaggcggtggggcaagta

SEQ ID NO: 8579559 - DNA, 22 bp, Homo sapiens
ggtgcaggagcggggtgctcgg

SEQ ID NO: 8579560 - DNA, 22 bp, Homo sapiens
ggtggccaggccagctctggcc

SEQ ID NO: 8579561 - DNA, 22 bp, Homo sapiens
ggtggccataggaccagcctgg

SEQ ID NO: 8579562 - DNA, 22 bp, Homo sapiens
ggtgtccgcgctgtagaaggtc

SEQ ID NO: 8579563 - DNA, 22 bp, Homo sapiens
ggtggccattctaccgccttct

SEQ ID NO: 8579564 - DNA, 20 bp, Homo sapiens
gtctgaggagcagtgggaaa

SEQ ID NO: 8579565 - DNA, 22 bp, Homo sapiens
gtctggctgtccagcttatcta

SEQ ID NO: 8579566 - DNA, 22 bp, Homo sapiens
gtctggctagagacaccctccc

SEQ ID NO: 8579567 - DNA, 22 bp, Homo sapiens
gtctggcttttgccctgtgttt

SEQ ID NO: 8579568 - DNA, 22 bp, Homo sapiens
gtctggctttatatttgctatt

SEQ ID NO: 8579569 - DNA, 22 bp, Homo sapiens
gtctggctttgctcagatgctg

SEQ ID NO: 8579570 - DNA, 18 bp, Homo sapiens
gtcagaggatggggaaat

SEQ ID NO: 8579571 - DNA, 22 bp, Homo sapiens
gtcctggtagggctctgtgtct

SEQ ID NO: 8579572 - DNA, 22 bp, Homo sapiens
gtcctgggtccccgcaggtcag

SEQ ID NO: 8579573 - DNA, 22 bp, Homo sapiens
gtcctgtgtgagtgcaccacct

SEQ ID NO: 8579574 - DNA, 22 bp, Homo sapiens
gtccagggggcttaagcaaact

SEQ ID NO: 8579575 - DNA, 22 bp, Homo sapiens
gtccagtgacaagtagctggcc

SEQ ID NO: 8579576 - DNA, 22 bp, Homo sapiens
gtccagtgctaacaggttgagg

SEQ ID NO: 8579577 - DNA, 22 bp, Homo sapiens
gtccagtgcttatagaatcagt

SEQ ID NO: 8579578 - DNA, 22 bp, Homo sapiens
gtggcaggatcacggctcactg

SEQ ID NO: 8579579 - DNA, 22 bp, Homo sapiens
gtggcagctgtgggacactggt

SEQ ID NO: 8579580 - DNA, 22 bp, Homo sapiens
gtggcagctggtatgcagacag

SEQ ID NO: 8579581 - DNA, 22 bp, Homo sapiens
gtggcaggagactggaagatgg

SEQ ID NO: 8579582 - DNA, 22 bp, Homo sapiens
gtggcaggggtattccagctga

SEQ ID NO: 8579583 - DNA, 22 bp, Homo sapiens
gtggcaggggtattccagctga

SEQ ID NO: 8579584 - DNA, 22 bp, Homo sapiens
gtggcattgacatgtaaacagt

SEQ ID NO: 8579585 - DNA, 22 bp, Homo sapiens
gtggctgctgtcctctctggtt

SEQ ID NO: 8579586 - DNA, 22 bp, Homo sapiens
gtgggagaagatttggtcatct

SEQ ID NO: 8579587 - DNA, 22 bp, Homo sapiens
gtgggagaagccctgttcgtag

SEQ ID NO: 8579588 - DNA, 22 bp, Homo sapiens
gtggctctcgccagcctgcggg

SEQ ID NO: 8579589 - DNA, 21 bp, Homo sapiens
gtggctctgccaggactgaaa

SEQ ID NO: 8579590 - DNA, 22 bp, Homo sapiens
gtggctctggctttccaggcgg

SEQ ID NO: 8579591 - DNA, 22 bp, Homo sapiens
gtggctctgtaaaatgcctgca

SEQ ID NO: 8579592 - DNA, 22 bp, Homo sapiens
gtggctcttgcatggggtctct

SEQ ID NO: 8579593 - DNA, 22 bp, Homo sapiens
gtggctctgtaaaatgcctgca

SEQ ID NO: 8579594 - DNA, 22 bp, Homo sapiens
gtggattacaagacagttgaga

SEQ ID NO: 8579595 - DNA, 22 bp, Homo sapiens
gtggagaggaacccagctctgt

SEQ ID NO: 8579596 - DNA, 22 bp, Homo sapiens
gtggaaggaattaacagactag

SEQ ID NO: 8579597 - DNA, 22 bp, Homo sapiens
gtggaaggaagagatggcccca

SEQ ID NO: 8579598 - DNA, 22 bp, Homo sapiens
gtggaagggactgcctagagga

SEQ ID NO: 8579599 - DNA, 22 bp, Homo sapiens
gtggaaggtaatgcagcttact

SEQ ID NO: 8579600 - DNA, 22 bp, Homo sapiens
gtggaagggtcacagcccctac

SEQ ID NO: 8579601 - DNA, 22 bp, Homo sapiens
gtggaaggtgaaggagcagcga

SEQ ID NO: 8579602 - DNA, 22 bp, Homo sapiens
gtggaaggtgaaggagcagcga

SEQ ID NO: 8579603 - DNA, 22 bp, Homo sapiens
gtggaaggtgctagaacaagga

SEQ ID NO: 8579604 - DNA, 22 bp, Homo sapiens
ggccctgagctgaagtactgtg

SEQ ID NO: 8579605 - DNA, 22 bp, Homo sapiens
ggctccaccctgcttccagaag

SEQ ID NO: 8579606 - DNA, 22 bp, Homo sapiens
ggctcctgccgtcttttctgag

SEQ ID NO: 8579607 - DNA, 22 bp, Homo sapiens
ggccccagattctgggctgggt

SEQ ID NO: 8579608 - DNA, 20 bp, Homo sapiens
ggccacctgcttcagacccc

SEQ ID NO: 8579609 - DNA, 22 bp, Homo sapiens
ggccacctggctgtgggggcag

SEQ ID NO: 8579610 - DNA, 22 bp, Homo sapiens
ggccacctgggatctcatcctg

SEQ ID NO: 8579611 - DNA, 22 bp, Homo sapiens
ggccaccttccagttgcctgca

SEQ ID NO: 8579612 - DNA, 22 bp, Homo sapiens
ggccaccttaagttaaggatat

SEQ ID NO: 8579613 - DNA, 22 bp, Homo sapiens
ggccacctgggttcgactgggc

SEQ ID NO: 8579614 - DNA, 22 bp, Homo sapiens
ggccaccttcctgtggtctctg

SEQ ID NO: 8579615 - DNA, 22 bp, Homo sapiens
ggccaccttcctgtggtctctg

SEQ ID NO: 8579616 - DNA, 22 bp, Homo sapiens
ggccacctctgccctactgagt

SEQ ID NO: 8579617 - DNA, 22 bp, Homo sapiens
ggcaggtgcttgtcgaaggcct

SEQ ID NO: 8579618 - DNA, 22 bp, Homo sapiens
ggcaggtgctgggagcatctca

SEQ ID NO: 8579619 - DNA, 22 bp, Homo sapiens
ggctcctggggaggtgagcttg

SEQ ID NO: 8579620 - DNA, 22 bp, Homo sapiens
ggctgcagagctgggtgggcct

SEQ ID NO: 8579621 - DNA, 22 bp, Homo sapiens
ggctgcaggaacgacggagggg

SEQ ID NO: 8579622 - DNA, 22 bp, Homo sapiens
gggaaatctcgtcctctattta

SEQ ID NO: 8579623 - DNA, 22 bp, Homo sapiens
ggcttcctggagaaggtctgag

SEQ ID NO: 8579624 - DNA, 22 bp, Homo sapiens
ggcttcctggggcctcctgcaa

SEQ ID NO: 8579625 - DNA, 22 bp, Homo sapiens
gggaacagggcctgagctgggg

SEQ ID NO: 8579626 - DNA, 22 bp, Homo sapiens
gggggctggaatatccatcaac

SEQ ID NO: 8579627 - DNA, 20 bp, Homo sapiens
gggtccaggactctgaattt

SEQ ID NO: 8579628 - DNA, 22 bp, Homo sapiens
gggtccagctacatcagggtgg

SEQ ID NO: 8579629 - DNA, 22 bp, Homo sapiens
gggtccaggcggcatagttgta

SEQ ID NO: 8579630 - DNA, 22 bp, Homo sapiens
gggtccaggcactatgctaagt

SEQ ID NO: 8579631 - DNA, 22 bp, Homo sapiens
gggtccaggcgtggcccagatg

SEQ ID NO: 8579632 - DNA, 22 bp, Homo sapiens
gggtccagggccagtggctgag

SEQ ID NO: 8579633 - DNA, 22 bp, Homo sapiens
gggtccagggacgtttctgcag

SEQ ID NO: 8579634 - DNA, 22 bp, Homo sapiens
gggtctggcatgctgagatgga

SEQ ID NO: 8579635 - DNA, 22 bp, Homo sapiens
gggctagcctcttccctgctcc

SEQ ID NO: 8579636 - DNA, 20 bp, Homo sapiens
gggaggccccagagtccagg

SEQ ID NO: 8579637 - DNA, 22 bp, Homo sapiens
gggcggcgtcggcgaggccatc

SEQ ID NO: 8579638 - DNA, 22 bp, Homo sapiens
gggcggggcttccgtcctccac

SEQ ID NO: 8579639 - DNA, 22 bp, Homo sapiens
gggcggggggagctggaatgaa

SEQ ID NO: 8579640 - DNA, 22 bp, Homo sapiens
gggcggtgcctgtctccgaagc

SEQ ID NO: 8579641 - DNA, 22 bp, Homo sapiens
gggcggggtggctcatgcctgt

SEQ ID NO: 8579642 - DNA, 22 bp, Homo sapiens
gggcccagcactggctgggatc

SEQ ID NO: 8579643 - DNA, 19 bp, Homo sapiens
gggcccagcatggagggtt

SEQ ID NO: 8579644 - DNA, 22 bp, Homo sapiens
gggcctggtgcttctgactcct

SEQ ID NO: 8579645 - DNA, 22 bp, Homo sapiens
gggcctgtatgggtctcagata

SEQ ID NO: 8579646 - DNA, 22 bp, Homo sapiens
gggccaggagtggagatatggg

SEQ ID NO: 8579647 - DNA, 22 bp, Homo sapiens
ggaggtccatgtgaatgtggcc

SEQ ID NO: 8579648 - DNA, 22 bp, Homo sapiens
ggaggtccatgtgaatgtggcc

SEQ ID NO: 8579649 - DNA, 22 bp, Homo sapiens
ggaggtggtggcagtgacaatt

SEQ ID NO: 8579650 - DNA, 22 bp, Homo sapiens
ggagggggaagaagctaaagac

SEQ ID NO: 8579651 - DNA, 22 bp, Homo sapiens
ggaggggtggaaggagtgcctg

SEQ ID NO: 8579652 - DNA, 22 bp, Homo sapiens
ggagggggactgacactgattt

SEQ ID NO: 8579653 - DNA, 22 bp, Homo sapiens
ggagggacccactgcggtgacc

SEQ ID NO: 8579654 - DNA, 20 bp, Homo sapiens
ggagggcagctgagagttgg

SEQ ID NO: 8579655 - DNA, 22 bp, Homo sapiens
ggagggccatcttgggtgtgat

SEQ ID NO: 8579656 - DNA, 22 bp, Homo sapiens
ggagggcccctccagtgggcag

SEQ ID NO: 8579657 - DNA, 22 bp, Homo sapiens
ggaggcggggaaggcatcccat

SEQ ID NO: 8579658 - DNA, 22 bp, Homo sapiens
ggcaggctcagcagccaaggag

SEQ ID NO: 8579659 - DNA, 22 bp, Homo sapiens
ggcaggcgtggtggcctcagaa

SEQ ID NO: 8579660 - DNA, 19 bp, Homo sapiens
ggcaggctggatagagagg

SEQ ID NO: 8579661 - DNA, 22 bp, Homo sapiens
ggcaggtgctaagagaggtaaa

SEQ ID NO: 8579662 - DNA, 17 bp, Homo sapiens
ggcaggtgcggggccgc

SEQ ID NO: 8579663 - DNA, 22 bp, Homo sapiens
ggagtggcctctcctgtgcagg

SEQ ID NO: 8579664 - DNA, 22 bp, Homo sapiens
ggagaatgattctttgctcact

SEQ ID NO: 8579665 - DNA, 22 bp, Homo sapiens
ggagaatggccatcttttcaga

SEQ ID NO: 8579666 - DNA, 22 bp, Homo sapiens
ggagaaggtggctcagcaaagg

SEQ ID NO: 8579667 - DNA, 22 bp, Homo sapiens
ggagaaggaagaaagctactat

SEQ ID NO: 8579668 - DNA, 22 bp, Homo sapiens
ggagaaggaatattggagtagg

SEQ ID NO: 8579669 - DNA, 22 bp, Homo sapiens
ggagaaggcacacccacctctg

SEQ ID NO: 8579670 - DNA, 21 bp, Homo sapiens
ggagaaggacaatgttgagta

SEQ ID NO: 8579671 - DNA, 22 bp, Homo sapiens
ggagaggtgtattcagtgggtc

SEQ ID NO: 8579672 - DNA, 22 bp, Homo sapiens
ggagatcttgcttgaaggcatg

SEQ ID NO: 8579673 - DNA, 22 bp, Homo sapiens
ggagaggtgcaggtcagtggca

SEQ ID NO: 8579674 - DNA, 22 bp, Homo sapiens
ggagaggtgagaggtacaagtt

SEQ ID NO: 8579675 - DNA, 22 bp, Homo sapiens
ggagagggtaggggtcctgccc

SEQ ID NO: 8579676 - DNA, 22 bp, Homo sapiens
ggagaggtgaatggctgctcta

SEQ ID NO: 8579677 - DNA, 22 bp, Homo sapiens
ggagatctttaggagttggact

SEQ ID NO: 8579678 - DNA, 22 bp, Homo sapiens
ggagccttagacatctgatcct

SEQ ID NO: 8579679 - DNA, 22 bp, Homo sapiens
ggaggccagtcctggccgggct

SEQ ID NO: 8579680 - DNA, 22 bp, Homo sapiens
ggaggcagaatagagtgtgggt

SEQ ID NO: 8579681 - DNA, 22 bp, Homo sapiens
ggagctgcacgctctgaagcct

SEQ ID NO: 8579682 - DNA, 22 bp, Homo sapiens
ggaggaaaggctccctccctct

SEQ ID NO: 8579683 - DNA, 22 bp, Homo sapiens
gctgggctccaggccagggtga

SEQ ID NO: 8579684 - DNA, 22 bp, Homo sapiens
gcttccttctaccacatcatgc

SEQ ID NO: 8579685 - DNA, 22 bp, Homo sapiens
gcttccttattgttgccatagt

SEQ ID NO: 8579686 - DNA, 22 bp, Homo sapiens
gcttcaaactgagcttcaagtg

SEQ ID NO: 8579687 - DNA, 20 bp, Homo sapiens
gcttcaaagccatcctttta

SEQ ID NO: 8579688 - DNA, 22 bp, Homo sapiens
ggaagaaatctggttaagagat

SEQ ID NO: 8579689 - DNA, 17 bp, Homo sapiens
ggaaggtcaaggggagg

SEQ ID NO: 8579690 - DNA, 22 bp, Homo sapiens
ggaaggggttaggggtccctga

SEQ ID NO: 8579691 - DNA, 22 bp, Homo sapiens
ggaactcctgctccaagcagct

SEQ ID NO: 8579692 - DNA, 22 bp, Homo sapiens
ggaactcctgctccaagcagct

SEQ ID NO: 8579693 - DNA, 22 bp, Homo sapiens
ggaaagatttgtcacatgaatg

SEQ ID NO: 8579694 - DNA, 22 bp, Homo sapiens
gaggcctgctttggcactctgg

SEQ ID NO: 8579695 - DNA, 22 bp, Homo sapiens
gaggggaaagtgtgaggctgcg

SEQ ID NO: 8579696 - DNA, 22 bp, Homo sapiens
gagggcagtagcctcgtaccct

SEQ ID NO: 8579697 - DNA, 22 bp, Homo sapiens
gaggggcagtgcacccgggccc

SEQ ID NO: 8579698 - DNA, 22 bp, Homo sapiens
gagtccagttgttcacagaggc

SEQ ID NO: 8579699 - DNA, 22 bp, Homo sapiens
gagtcattgcacactagctcag

SEQ ID NO: 8579700 - DNA, 22 bp, Homo sapiens
gagtcaggtccgtggacagtta

SEQ ID NO: 8579701 - DNA, 22 bp, Homo sapiens
gagtcaggcactgctgctgctc

SEQ ID NO: 8579702 - DNA, 22 bp, Homo sapiens
gaggtccatacagctattctac

SEQ ID NO: 8579703 - DNA, 22 bp, Homo sapiens
gaggtccattttcacatatgat

SEQ ID NO: 8579704 - DNA, 22 bp, Homo sapiens
gaggtccagccaagcggcaagg

SEQ ID NO: 8579705 - DNA, 22 bp, Homo sapiens
gaggtccagggtggggcctgag

SEQ ID NO: 8579706 - DNA, 22 bp, Homo sapiens
gaggtccagagcaggttcagtg

SEQ ID NO: 8579707 - DNA, 22 bp, Homo sapiens
gaggtccaacacaatgggtgtt

SEQ ID NO: 8579708 - DNA, 22 bp, Homo sapiens
gaggtccactgaggcaacaggg

SEQ ID NO: 8579709 - DNA, 22 bp, Homo sapiens
gagagtctagtgcacctagttt

SEQ ID NO: 8579710 - DNA, 22 bp, Homo sapiens
gagctggaggaccaggactggg

SEQ ID NO: 8579711 - DNA, 22 bp, Homo sapiens
gaggcctcagcctgccctgaac

SEQ ID NO: 8579712 - DNA, 22 bp, Homo sapiens
gaggaggcttccgggaggcacg

SEQ ID NO: 8579713 - DNA, 22 bp, Homo sapiens
gaggcagagtgcaccccaggag

SEQ ID NO: 8579714 - DNA, 22 bp, Homo sapiens
gatcatgctggctgccctgttg

SEQ ID NO: 8579715 - DNA, 22 bp, Homo sapiens
gatgagaatgtttatcaaatgc

SEQ ID NO: 8579716 - DNA, 22 bp, Homo sapiens
gatgcagggctggcaggagctt

SEQ ID NO: 8579717 - DNA, 22 bp, Homo sapiens
gatgcaggtgtgccacagagct

SEQ ID NO: 8579718 - DNA, 22 bp, Homo sapiens
gatgattttgttggtgattcaa

SEQ ID NO: 8579719 - DNA, 22 bp, Homo sapiens
gatgatttttgccagtgtgatg

SEQ ID NO: 8579720 - DNA, 22 bp, Homo sapiens
gatgatttctccattcccttct

SEQ ID NO: 8579721 - DNA, 22 bp, Homo sapiens
gatgatttaagtggccaaagta

SEQ ID NO: 8579722 - DNA, 22 bp, Homo sapiens
gatgatttgaggatttcatgag

SEQ ID NO: 8579723 - DNA, 22 bp, Homo sapiens
gatgattttagttgactaaact

SEQ ID NO: 8579724 - DNA, 22 bp, Homo sapiens
gatgattttatgtcttgtcatt

SEQ ID NO: 8579725 - DNA, 22 bp, Homo sapiens
gatgattttgatgcagtaaaga

SEQ ID NO: 8579726 - DNA, 22 bp, Homo sapiens
gatgattttctgtgttagaaga

SEQ ID NO: 8579727 - DNA, 22 bp, Homo sapiens
gatcttgaaatatcttttccta

SEQ ID NO: 8579728 - DNA, 22 bp, Homo sapiens
gatcttgagcaagttgcatccc

SEQ ID NO: 8579729 - DNA, 18 bp, Homo sapiens
gagtgtggcactgggccc

SEQ ID NO: 8579730 - DNA, 22 bp, Homo sapiens
gataaattatcaggggtttaaa

SEQ ID NO: 8579731 - DNA, 20 bp, Homo sapiens
gataaattgtctcttaagtg

SEQ ID NO: 8579732 - DNA, 22 bp, Homo sapiens
gataaattgcactttttcttac

SEQ ID NO: 8579733 - DNA, 22 bp, Homo sapiens
gagtgcaataaactgttttcta

SEQ ID NO: 8579734 - DNA, 22 bp, Homo sapiens
gagtgcaagttcttccttcttc

SEQ ID NO: 8579735 - DNA, 22 bp, Homo sapiens
gagtctgtggtattttatcata

SEQ ID NO: 8579736 - DNA, 17 bp, Homo sapiens
gagtctgtgttcatcag

SEQ ID NO: 8579737 - DNA, 22 bp, Homo sapiens
gagtgcagttggggtgagggga

SEQ ID NO: 8579738 - DNA, 22 bp, Homo sapiens
gagtgcagtatgagaggctgct

SEQ ID NO: 8579739 - DNA, 22 bp, Homo sapiens
gagtgcaatggcatgatctggg

SEQ ID NO: 8579740 - DNA, 22 bp, Homo sapiens
cttgggcaagcagcattcagaa

SEQ ID NO: 8579741 - DNA, 22 bp, Homo sapiens
cttgaatccaaatgggagatga

SEQ ID NO: 8579742 - DNA, 22 bp, Homo sapiens
ctttagtgttcaacccagataa

SEQ ID NO: 8579743 - DNA, 22 bp, Homo sapiens
cttgaaatccagatttcagagg

SEQ ID NO: 8579744 - DNA, 22 bp, Homo sapiens
cttcttgagcatgggtagtact

SEQ ID NO: 8579745 - DNA, 19 bp, Homo sapiens
cttcttgataaggttcttt

SEQ ID NO: 8579746 - DNA, 22 bp, Homo sapiens
cttcttgattgctttcaaacca

SEQ ID NO: 8579747 - DNA, 22 bp, Homo sapiens
cttcttgaagtcctccagaagt

SEQ ID NO: 8579748 - DNA, 22 bp, Homo sapiens
cttcttgacttctgggtgccct

SEQ ID NO: 8579749 - DNA, 22 bp, Homo sapiens
cttcttgaaacctgctccctca

SEQ ID NO: 8579750 - DNA, 22 bp, Homo sapiens
cttcttgaaagtggtgaccctc

SEQ ID NO: 8579751 - DNA, 22 bp, Homo sapiens
gaaaaggaaatttatagagatc

SEQ ID NO: 8579752 - DNA, 22 bp, Homo sapiens
cttttacactcatctgggaggg

SEQ ID NO: 8579753 - DNA, 22 bp, Homo sapiens
ctttgttgtgcctgagtgcacc

SEQ ID NO: 8579754 - DNA, 21 bp, Homo sapiens
gaaaatacaatgagcttgacc

SEQ ID NO: 8579755 - DNA, 22 bp, Homo sapiens
gaaagtttataggttatataat

SEQ ID NO: 8579756 - DNA, 21 bp, Homo sapiens
gaaaggtcttaacttacagag

SEQ ID NO: 8579757 - DNA, 17 bp, Homo sapiens
gaaaggtcctagaaatc

SEQ ID NO: 8579758 - DNA, 22 bp, Homo sapiens
gaaatacaaagccagccatttt

SEQ ID NO: 8579759 - DNA, 22 bp, Homo sapiens
gagagctgggggactgtggatg

SEQ ID NO: 8579760 - DNA, 22 bp, Homo sapiens
gagagctgggctttgggtgaag

SEQ ID NO: 8579761 - DNA, 22 bp, Homo sapiens
gagagctggattctggataggt

SEQ ID NO: 8579762 - DNA, 22 bp, Homo sapiens
gagagctgatagatgagctact

SEQ ID NO: 8579763 - DNA, 22 bp, Homo sapiens
gagaaaatgtcagacttggtcg

SEQ ID NO: 8579764 - DNA, 22 bp, Homo sapiens
gactgtggggaagcagatgcca

SEQ ID NO: 8579765 - DNA, 22 bp, Homo sapiens
gaattagacatgctttgctttt

SEQ ID NO: 8579766 - DNA, 22 bp, Homo sapiens
gaattccttaggctcttgactg

SEQ ID NO: 8579767 - DNA, 22 bp, Homo sapiens
gacacagggacgtgctctgcct

SEQ ID NO: 8579768 - DNA, 22 bp, Homo sapiens
gaaggcctgtggtagtgagacg

SEQ ID NO: 8579769 - DNA, 22 bp, Homo sapiens
gctgggagtgggcaagatgaga

SEQ ID NO: 8579770 - DNA, 22 bp, Homo sapiens
gctggcctgtctagagccttac

SEQ ID NO: 8579771 - DNA, 22 bp, Homo sapiens
gctggccttgtgtctgaggaag

SEQ ID NO: 8579772 - DNA, 22 bp, Homo sapiens
gctggcctcgcaggcaggatgt

SEQ ID NO: 8579773 - DNA, 22 bp, Homo sapiens
gctggagagtagtaagcagtta

SEQ ID NO: 8579774 - DNA, 22 bp, Homo sapiens
gctgaggcagtccacccttgtg

SEQ ID NO: 8579775 - DNA, 22 bp, Homo sapiens
gctgaggcaaaccaagaatgta

SEQ ID NO: 8579776 - DNA, 22 bp, Homo sapiens
gctgaggcaaatagttttaagt

SEQ ID NO: 8579777 - DNA, 22 bp, Homo sapiens
gctgaggcaagatttgaaccca

SEQ ID NO: 8579778 - DNA, 22 bp, Homo sapiens
gcctgtttactttgccgcagga

SEQ ID NO: 8579779 - DNA, 22 bp, Homo sapiens
gcctgtttactttgccgcagga

SEQ ID NO: 8579780 - DNA, 22 bp, Homo sapiens
gcctgtttccctgacgcttaca

SEQ ID NO: 8579781 - DNA, 22 bp, Homo sapiens
gcctgtttccatcaacacatgc

SEQ ID NO: 8579782 - DNA, 22 bp, Homo sapiens
gcctgtttatctatcatgaact

SEQ ID NO: 8579783 - DNA, 22 bp, Homo sapiens
gcctgtttctaatctcatttct

SEQ ID NO: 8579784 - DNA, 22 bp, Homo sapiens
gcctgtttctcctccttggccc

SEQ ID NO: 8579785 - DNA, 22 bp, Homo sapiens
gcctgtttgagaatagtcaggg

SEQ ID NO: 8579786 - DNA, 22 bp, Homo sapiens
gcctgtttgactggtctctgct

SEQ ID NO: 8579787 - DNA, 22 bp, Homo sapiens
gcctgttttcctgctgtggttg

SEQ ID NO: 8579788 - DNA, 22 bp, Homo sapiens
gcctgtttgtttgcaaaggagc

SEQ ID NO: 8579789 - DNA, 22 bp, Homo sapiens
gcctgttttagatgcattgatg

SEQ ID NO: 8579790 - DNA, 22 bp, Homo sapiens
gcctgtttttgcttcgtttaag

SEQ ID NO: 8579791 - DNA, 22 bp, Homo sapiens
gcctgtttggcatcattggttg

SEQ ID NO: 8579792 - DNA, 22 bp, Homo sapiens
gcctgtttggaatctgtttaat

SEQ ID NO: 8579793 - DNA, 22 bp, Homo sapiens
gcctgtttgttatgtcatggta

SEQ ID NO: 8579794 - DNA, 22 bp, Homo sapiens
gcctgtttggctgctgacattg

SEQ ID NO: 8579795 - DNA, 22 bp, Homo sapiens
gctcctggcaggcagtgtgtgt

SEQ ID NO: 8579796 - DNA, 19 bp, Homo sapiens
gctcctgggcctcactcat

SEQ ID NO: 8579797 - DNA, 22 bp, Homo sapiens
gctcctggcttcactgacatca

SEQ ID NO: 8579798 - DNA, 22 bp, Homo sapiens
gctcctgggctctaccttgcta

SEQ ID NO: 8579799 - DNA, 22 bp, Homo sapiens
gctgagagtgggtgcagtgctt

SEQ ID NO: 8579800 - DNA, 22 bp, Homo sapiens
gctcttatagtcccagcatgtt

SEQ ID NO: 8579801 - DNA, 22 bp, Homo sapiens
gctcttctcagattgtacactc

SEQ ID NO: 8579802 - DNA, 22 bp, Homo sapiens
gcctgtttaagtattctgacat

SEQ ID NO: 8579803 - DNA, 22 bp, Homo sapiens
gcctgggattgtgtaagtgaat

SEQ ID NO: 8579804 - DNA, 22 bp, Homo sapiens
gcctgtggccactgcgtctgca

SEQ ID NO: 8579805 - DNA, 22 bp, Homo sapiens
gcctgtggccgactgagagcct

SEQ ID NO: 8579806 - DNA, 22 bp, Homo sapiens
gcctgggattctcaaaggggtg

SEQ ID NO: 8579807 - DNA, 22 bp, Homo sapiens
gcctgggattcccagaggggca

SEQ ID NO: 8579808 - DNA, 19 bp, Homo sapiens
gcctgggatgggcagaact

SEQ ID NO: 8579809 - DNA, 22 bp, Homo sapiens
gcctgggatagaggcaatgcat

SEQ ID NO: 8579810 - DNA, 22 bp, Homo sapiens
gcctgggagaatgacctccaac

SEQ ID NO: 8579811 - DNA, 21 bp, Homo sapiens
gcctgggatagtggcctccgg

SEQ ID NO: 8579812 - DNA, 22 bp, Homo sapiens
gcctgggaagactaagtgggag

SEQ ID NO: 8579813 - DNA, 22 bp, Homo sapiens
gcctgggacccttagctcttgg

SEQ ID NO: 8579814 - DNA, 21 bp, Homo sapiens
gcctgggaagagaaaggtaag

SEQ ID NO: 8579815 - DNA, 23 bp, Homo sapiens
gcctgggactcaggaggagctca

SEQ ID NO: 8579816 - DNA, 21 bp, Homo sapiens
gcctgggaaatctgggaagcc

SEQ ID NO: 8579817 - DNA, 22 bp, Homo sapiens
gcctgggaaagagtagggaaat

SEQ ID NO: 8579818 - DNA, 22 bp, Homo sapiens
gcctggaggggacagtctctgg

SEQ ID NO: 8579819 - DNA, 22 bp, Homo sapiens
gcctggagggtccctctctgga

SEQ ID NO: 8579820 - DNA, 22 bp, Homo sapiens
gcctgcctttgtatgaccctga

SEQ ID NO: 8579821 - DNA, 23 bp, Homo sapiens
gcctctggagccccagtgctcag

SEQ ID NO: 8579822 - DNA, 19 bp, Homo sapiens
gcctgccagatagtaatga

SEQ ID NO: 8579823 - DNA, 18 bp, Homo sapiens
gcctgccagccgagggac

SEQ ID NO: 8579824 - DNA, 22 bp, Homo sapiens
gcctgccagtgtttgaggattg

SEQ ID NO: 8579825 - DNA, 23 bp, Homo sapiens
gcctgccatatacctggaaacag

SEQ ID NO: 8579826 - DNA, 22 bp, Homo sapiens
gccaggctgtttttattactgt

SEQ ID NO: 8579827 - DNA, 22 bp, Homo sapiens
gccaggctgtggggaacttgaa

SEQ ID NO: 8579828 - DNA, 22 bp, Homo sapiens
gccagtgtggtgtagtcatgaa

SEQ ID NO: 8579829 - DNA, 22 bp, Homo sapiens
gccaggctggttatttaatgag

SEQ ID NO: 8579830 - DNA, 22 bp, Homo sapiens
gccaggctggttatttaatgag

SEQ ID NO: 8579831 - DNA, 22 bp, Homo sapiens
gccaggctggtgtcacaactct

SEQ ID NO: 8579832 - DNA, 22 bp, Homo sapiens
gccaggctcttggttatgtttt

SEQ ID NO: 8579833 - DNA, 22 bp, Homo sapiens
gccaggctgccttatctctagc

SEQ ID NO: 8579834 - DNA, 22 bp, Homo sapiens
gccaggctctcagtgactgccc

SEQ ID NO: 8579835 - DNA, 19 bp, Homo sapiens
gccaggctcttattctgtg

SEQ ID NO: 8579836 - DNA, 22 bp, Homo sapiens
gccggggctggggagagacatg

SEQ ID NO: 8579837 - DNA, 22 bp, Homo sapiens
gccgagcacagtgcagctgcct

SEQ ID NO: 8579838 - DNA, 22 bp, Homo sapiens
gcctctgcaattacattgtgcc

SEQ ID NO: 8579839 - DNA, 22 bp, Homo sapiens
gcctctgctcggactttgcctc

SEQ ID NO: 8579840 - DNA, 19 bp, Homo sapiens
gcctctgctggggacaggc

SEQ ID NO: 8579841 - DNA, 22 bp, Homo sapiens
gcctctgctgcaagcctggttg

SEQ ID NO: 8579842 - DNA, 22 bp, Homo sapiens
gccctttgtggtcagaggcctg

SEQ ID NO: 8579843 - DNA, 22 bp, Homo sapiens
gcccttctgctgttaggtagcc

SEQ ID NO: 8579844 - DNA, 22 bp, Homo sapiens
gcagggggatggagttgaaatg

SEQ ID NO: 8579845 - DNA, 22 bp, Homo sapiens
gcagggcaaatgtggaaaggag

SEQ ID NO: 8579846 - DNA, 22 bp, Homo sapiens
gcagggcagaaggtgctgagga

SEQ ID NO: 8579847 - DNA, 22 bp, Homo sapiens
gcaggcactcctaggaccatca

SEQ ID NO: 8579848 - DNA, 17 bp, Homo sapiens
gcaggcactgctgcctg

SEQ ID NO: 8579849 - DNA, 22 bp, Homo sapiens
gcaggcaccacggctcaggtct

SEQ ID NO: 8579850 - DNA, 22 bp, Homo sapiens
gcaggcaccgggttgctcccct

SEQ ID NO: 8579851 - DNA, 19 bp, Homo sapiens
gcaggcacagccctgggtg

SEQ ID NO: 8579852 - DNA, 22 bp, Homo sapiens
gcagctattgtctcctgggccc

SEQ ID NO: 8579853 - DNA, 22 bp, Homo sapiens
gcagctcaagagaggtgctatg

SEQ ID NO: 8579854 - DNA, 22 bp, Homo sapiens
gcagctcctttaggctgcaaag

SEQ ID NO: 8579855 - DNA, 22 bp, Homo sapiens
gcagctcccatcagggcacaga

SEQ ID NO: 8579856 - DNA, 22 bp, Homo sapiens
gcagctccctggctgcaaatga

SEQ ID NO: 8579857 - DNA, 19 bp, Homo sapiens
gcagtgtcatggtaggagc

SEQ ID NO: 8579858 - DNA, 22 bp, Homo sapiens
gcagtgttaggaataaaaatga

SEQ ID NO: 8579859 - DNA, 22 bp, Homo sapiens
gcagtgttgactatggtatgag

SEQ ID NO: 8579860 - DNA, 22 bp, Homo sapiens
gcagtgttgagtggtggctgaa

SEQ ID NO: 8579861 - DNA, 22 bp, Homo sapiens
gcagtgttgagccagctggggg

SEQ ID NO: 8579862 - DNA, 22 bp, Homo sapiens
gcagtgttcttgttgcttttat

SEQ ID NO: 8579863 - DNA, 22 bp, Homo sapiens
gcagtgttctaaattgggtgtg

SEQ ID NO: 8579864 - DNA, 22 bp, Homo sapiens
gcagtgttccttctactggggc

SEQ ID NO: 8579865 - DNA, 22 bp, Homo sapiens
gcagtgttcagtgaagcaggag

SEQ ID NO: 8579866 - DNA, 22 bp, Homo sapiens
gcagtgttatgttttctataat

SEQ ID NO: 8579867 - DNA, 22 bp, Homo sapiens
gcagtggggaatgctggggaga

SEQ ID NO: 8579868 - DNA, 22 bp, Homo sapiens
gcagtggggcgctgggagttgg

SEQ ID NO: 8579869 - DNA, 22 bp, Homo sapiens
gcagtgggcctgaggaagggtg

SEQ ID NO: 8579870 - DNA, 22 bp, Homo sapiens
gcagggtggatggcagggccag

SEQ ID NO: 8579871 - DNA, 22 bp, Homo sapiens
gcagggtgacgttgcccacctc

SEQ ID NO: 8579872 - DNA, 19 bp, Homo sapiens
gccagcagaatgatgaggc

SEQ ID NO: 8579873 - DNA, 22 bp, Homo sapiens
gccagcagcttcttctcatcct

SEQ ID NO: 8579874 - DNA, 20 bp, Homo sapiens
gccagaggccggcaggggct

SEQ ID NO: 8579875 - DNA, 22 bp, Homo sapiens
gccacaggcacttaagggctgg

SEQ ID NO: 8579876 - DNA, 17 bp, Homo sapiens
gcatgtagtacatgtaa

SEQ ID NO: 8579877 - DNA, 22 bp, Homo sapiens
gcagtgttgctaggtgcggtga

SEQ ID NO: 8579878 - DNA, 23 bp, Homo sapiens
gcagaaattctcacactgaggcc

SEQ ID NO: 8579879 - DNA, 22 bp, Homo sapiens
gcagaacaacgtaggagtggag

SEQ ID NO: 8579880 - DNA, 22 bp, Homo sapiens
gcaccgccttggaccgcccgct

SEQ ID NO: 8579881 - DNA, 22 bp, Homo sapiens
gattttcttgggaaacaatgag

SEQ ID NO: 8579882 - DNA, 22 bp, Homo sapiens
gcaaacataatatgaagacact

SEQ ID NO: 8579883 - DNA, 22 bp, Homo sapiens
gcaaacatccactgcccttgta

SEQ ID NO: 8579884 - DNA, 22 bp, Homo sapiens
gatttttcagtataaaatatat

SEQ ID NO: 8579885 - DNA, 22 bp, Homo sapiens
gcaaacatttggtctagtgtgt

SEQ ID NO: 8579886 - DNA, 22 bp, Homo sapiens
gcaaacattccacagaaggaag

SEQ ID NO: 8579887 - DNA, 18 bp, Homo sapiens
gcaaacattcttccagtc

SEQ ID NO: 8579888 - DNA, 22 bp, Homo sapiens
gcaaacatgctgagaaataaga

SEQ ID NO: 8579889 - DNA, 22 bp, Homo sapiens
gcaaacatctttatttggcaag

SEQ ID NO: 8579890 - DNA, 22 bp, Homo sapiens
gcaaacatcttagccatagagt

SEQ ID NO: 8579891 - DNA, 22 bp, Homo sapiens
gcaaacatgttgtgagatacca

SEQ ID NO: 8579892 - DNA, 22 bp, Homo sapiens
gcaaacatgtgctcattttgtg

SEQ ID NO: 8579893 - DNA, 22 bp, Homo sapiens
gcaaacattcaggagtacagga

SEQ ID NO: 8579894 - DNA, 22 bp, Homo sapiens
gcacaaaggtggaaggaggaag

SEQ ID NO: 8579895 - DNA, 22 bp, Homo sapiens
gcacaaaaggtacttcatgtag

SEQ ID NO: 8579896 - DNA, 22 bp, Homo sapiens
gcacaaaacacattttgacaat

SEQ ID NO: 8579897 - DNA, 22 bp, Homo sapiens
gattttcatttgcactctagaa

SEQ ID NO: 8579898 - DNA, 22 bp, Homo sapiens
gattttctgagccttcaaattt

SEQ ID NO: 8579899 - DNA, 22 bp, Homo sapiens
gattttcatgataaacttgtga

SEQ ID NO: 8579900 - DNA, 22 bp, Homo sapiens
gatttgtttcaagttagcatct

SEQ ID NO: 8579901 - DNA, 22 bp, Homo sapiens
gatttcttctctcccaagagga

SEQ ID NO: 8579902 - DNA, 22 bp, Homo sapiens
gatttctttatgaagtacagaa

SEQ ID NO: 8579903 - DNA, 22 bp, Homo sapiens
gatttctttaggtgtaatagtg

SEQ ID NO: 8579904 - DNA, 22 bp, Homo sapiens
gatttctttagctcatcagatc

SEQ ID NO: 8579905 - DNA, 22 bp, Homo sapiens
gatggcctcatggctgcaggcc

SEQ ID NO: 8579906 - DNA, 22 bp, Homo sapiens
gatgcgggcccgctccactgcc

SEQ ID NO: 8579907 - DNA, 22 bp, Homo sapiens
gatttacagatctaagggtcac

SEQ ID NO: 8579908 - DNA, 22 bp, Homo sapiens
gattagatgactaatgagctgt

SEQ ID NO: 8579909 - DNA, 22 bp, Homo sapiens
gattcaatgttgcagatggaat

SEQ ID NO: 8579910 - DNA, 22 bp, Homo sapiens
ctggagctcttctgagtgtgct

SEQ ID NO: 8579911 - DNA, 22 bp, Homo sapiens
ctggagtctcttctgtagctac

SEQ ID NO: 8579912 - DNA, 22 bp, Homo sapiens
ctggagtcactcatgtagctgc

SEQ ID NO: 8579913 - DNA, 18 bp, Homo sapiens
ctggagtcacagtgggga

SEQ ID NO: 8579914 - DNA, 22 bp, Homo sapiens
ctggagtcagcaaggacgaggc

SEQ ID NO: 8579915 - DNA, 22 bp, Homo sapiens
ctggaaggttctttgtgtgcct

SEQ ID NO: 8579916 - DNA, 22 bp, Homo sapiens
ctggcagcattaacagagagca

SEQ ID NO: 8579917 - DNA, 22 bp, Homo sapiens
ctggccacatgtgtgctgagca

SEQ ID NO: 8579918 - DNA, 22 bp, Homo sapiens
ctggcctggagcctctgggtgg

SEQ ID NO: 8579919 - DNA, 22 bp, Homo sapiens
ctggcctgaggccgccttcaga

SEQ ID NO: 8579920 - DNA, 22 bp, Homo sapiens
ctggccctgtggaggcaggaac

SEQ ID NO: 8579921 - DNA, 22 bp, Homo sapiens
ctggctctaagtgtcagctccc

SEQ ID NO: 8579922 - DNA, 22 bp, Homo sapiens
ctggcctggcgcagtggctcac

SEQ ID NO: 8579923 - DNA, 22 bp, Homo sapiens
ctggcctggggcctcagctgct

SEQ ID NO: 8579924 - DNA, 22 bp, Homo sapiens
ctggctccctctccctgagtca

SEQ ID NO: 8579925 - DNA, 22 bp, Homo sapiens
ctgcaaaagtaattgcaggttt

SEQ ID NO: 8579926 - DNA, 22 bp, Homo sapiens
ctgcaaaagtaattggggcttt

SEQ ID NO: 8579927 - DNA, 22 bp, Homo sapiens
ctgatcttaagtaacattattt

SEQ ID NO: 8579928 - DNA, 22 bp, Homo sapiens
ctgaggcactgtcagctgaggc

SEQ ID NO: 8579929 - DNA, 22 bp, Homo sapiens
ctgccaggctgtcccaggtccg

SEQ ID NO: 8579930 - DNA, 22 bp, Homo sapiens
ctgccaggtgagctccaggcct

SEQ ID NO: 8579931 - DNA, 22 bp, Homo sapiens
ctgccctgggttttatgggagt

SEQ ID NO: 8579932 - DNA, 22 bp, Homo sapiens
ctgccctggggggcctccttgc

SEQ ID NO: 8579933 - DNA, 22 bp, Homo sapiens
ctgccctgggtgctggggatcc

SEQ ID NO: 8579934 - DNA, 22 bp, Homo sapiens
ctctttttcagccttaccaaag

SEQ ID NO: 8579935 - DNA, 22 bp, Homo sapiens
ctctttttcacctctgtcagcg

SEQ ID NO: 8579936 - DNA, 22 bp, Homo sapiens
ctctttgtgctattatgatcct

SEQ ID NO: 8579937 - DNA, 22 bp, Homo sapiens
ctctttgtcactcatacagtca

SEQ ID NO: 8579938 - DNA, 21 bp, Homo sapiens
ctctttgtggcaatgtatttt

SEQ ID NO: 8579939 - DNA, 22 bp, Homo sapiens
ctctttgtggaacggcagtgtc

SEQ ID NO: 8579940 - DNA, 22 bp, Homo sapiens
ctctttgtggccacctaatctt

SEQ ID NO: 8579941 - DNA, 20 bp, Homo sapiens
ctctttgttggcaaactctt

SEQ ID NO: 8579942 - DNA, 22 bp, Homo sapiens
ctgagaagcaaagaactgcact

SEQ ID NO: 8579943 - DNA, 17 bp, Homo sapiens
ctgaagataatggcaac

SEQ ID NO: 8579944 - DNA, 22 bp, Homo sapiens
ctgaagatgtctgagatgctca

SEQ ID NO: 8579945 - DNA, 22 bp, Homo sapiens
tttgtcttgtaagttaaattca

SEQ ID NO: 8579946 - DNA, 22 bp, Homo sapiens
tttgtcttggccaaggttctga

SEQ ID NO: 8579947 - DNA, 22 bp, Homo sapiens
ctctggctgtttgcagctcaag

SEQ ID NO: 8579948 - DNA, 22 bp, Homo sapiens
ctctggctgcctctcaggcctg

SEQ ID NO: 8579949 - DNA, 22 bp, Homo sapiens
ctctggctggcacctgatctga

SEQ ID NO: 8579950 - DNA, 22 bp, Homo sapiens
ttcctggggacttaccgtcatt

SEQ ID NO: 8579951 - DNA, 20 bp, Homo sapiens
ttcctggggaatgatagaag

SEQ ID NO: 8579952 - DNA, 22 bp, Homo sapiens
ttccatttttctaactctcaga

SEQ ID NO: 8579953 - DNA, 22 bp, Homo sapiens
ttccgctgtttagttgaagttt

SEQ ID NO: 8579954 - DNA, 22 bp, Homo sapiens
ttccctggggaaggtgaccttt

SEQ ID NO: 8579955 - DNA, 22 bp, Homo sapiens
ttcccacagagattacattgaa

SEQ ID NO: 8579956 - DNA, 22 bp, Homo sapiens
ttcacagaccaggaggctgtga

SEQ ID NO: 8579957 - DNA, 22 bp, Homo sapiens
cctgggtggctgcctgcctttc

SEQ ID NO: 8579958 - DNA, 22 bp, Homo sapiens
cggcaggtgtgctcactctgcc

SEQ ID NO: 8579959 - DNA, 22 bp, Homo sapiens
ctaggctgtaaagagctaggag

SEQ ID NO: 8579960 - DNA, 22 bp, Homo sapiens
ttcctttgggaaatcactaagg

SEQ ID NO: 8579961 - DNA, 22 bp, Homo sapiens
ttcttcctcacactctcaccca

SEQ ID NO: 8579962 - DNA, 22 bp, Homo sapiens
ttgactcatacctgcctgaccc

SEQ ID NO: 8579963 - DNA, 22 bp, Homo sapiens
ttgacgtcctcgatggggaact

SEQ ID NO: 8579964 - DNA, 22 bp, Homo sapiens
ttgagctctcctcatcaccctg

SEQ ID NO: 8579965 - DNA, 22 bp, Homo sapiens
ttgaggagaagactttgcttcc

SEQ ID NO: 8579966 - DNA, 22 bp, Homo sapiens
ctcctggctatgactacatttc

SEQ ID NO: 8579967 - DNA, 22 bp, Homo sapiens
ctcctctttagccccagctgga

SEQ ID NO: 8579968 - DNA, 22 bp, Homo sapiens
ctcctcttctgagtaccaggga

SEQ ID NO: 8579969 - DNA, 22 bp, Homo sapiens
ctcctctggaaattcctctgcc

SEQ ID NO: 8579970 - DNA, 22 bp, Homo sapiens
tttaaatttagaagaaacactg

SEQ ID NO: 8579971 - DNA, 22 bp, Homo sapiens
tttaaattctgtctgccgctta

SEQ ID NO: 8579972 - DNA, 22 bp, Homo sapiens
tttaaatttgtgtttagagggt

SEQ ID NO: 8579973 - DNA, 22 bp, Homo sapiens
tttacatggaatattgtcttgt

SEQ ID NO: 8579974 - DNA, 22 bp, Homo sapiens
tttacatgagtagcagatgttc

SEQ ID NO: 8579975 - DNA, 22 bp, Homo sapiens
ctctcccccacagcagccttct

SEQ ID NO: 8579976 - DNA, 22 bp, Homo sapiens
tttcagtgtgtaaattgaaata

SEQ ID NO: 8579977 - DNA, 22 bp, Homo sapiens
tttcagtgttatgactttcatt

SEQ ID NO: 8579978 - DNA, 22 bp, Homo sapiens
ctcctgggagcagggatggatg

SEQ ID NO: 8579979 - DNA, 22 bp, Homo sapiens
ctcctgggagctgtggcagagc

SEQ ID NO: 8579980 - DNA, 22 bp, Homo sapiens
ctcctgggaggatgcggacccg

SEQ ID NO: 8579981 - DNA, 22 bp, Homo sapiens
ctcctgggagtcttcctggatg

SEQ ID NO: 8579982 - DNA, 22 bp, Homo sapiens
ctcctgggctcaagtgatcctc

SEQ ID NO: 8579983 - DNA, 22 bp, Homo sapiens
ctcctgggctcatatcattcag

SEQ ID NO: 8579984 - DNA, 22 bp, Homo sapiens
ctcctgggctatgtctgcttgg

SEQ ID NO: 8579985 - DNA, 21 bp, Homo sapiens
ctcctgggctaagatatagtg

SEQ ID NO: 8579986 - DNA, 22 bp, Homo sapiens
ctcctgggatgactctttcttt

SEQ ID NO: 8579987 - DNA, 22 bp, Homo sapiens
ctcctgggctgtcggcgctctg

SEQ ID NO: 8579988 - DNA, 22 bp, Homo sapiens
ctcctgggctgggaactcagcc

SEQ ID NO: 8579989 - DNA, 18 bp, Homo sapiens
ctcctgggctgcagatgc

SEQ ID NO: 8579990 - DNA, 22 bp, Homo sapiens
ttgggttttcccttgaaactga

SEQ ID NO: 8579991 - DNA, 22 bp, Homo sapiens
ttgggttttgatacatgtctaa

SEQ ID NO: 8579992 - DNA, 22 bp, Homo sapiens
ctccagggagctgtggaggttt

SEQ ID NO: 8579993 - DNA, 22 bp, Homo sapiens
ttgtatttgattgtcatatcgt

SEQ ID NO: 8579994 - DNA, 22 bp, Homo sapiens
ctccagggttccccgatccact

SEQ ID NO: 8579995 - DNA, 20 bp, Homo sapiens
ctccaggggaagagccttcc

SEQ ID NO: 8579996 - DNA, 22 bp, Homo sapiens
ctccagggcagcatggcagtgg

SEQ ID NO: 8579997 - DNA, 22 bp, Homo sapiens
ctccaggggccagaagcctggc

SEQ ID NO: 8579998 - DNA, 22 bp, Homo sapiens
ctccaggggccagaagcctggc

SEQ ID NO: 8579999 - DNA, 22 bp, Homo sapiens
ttgttaaaactccattggtttg

SEQ ID NO: 8580000 - DNA, 22 bp, Homo sapiens
tttaaaaaactagtctgagtct

SEQ ID NO: 8580001 - DNA, 22 bp, Homo sapiens
ctccagtgagcgcggggcatgg

SEQ ID NO: 8580002 - DNA, 22 bp, Homo sapiens
ctccagtgagtgagcaggcgac

SEQ ID NO: 8580003 - DNA, 22 bp, Homo sapiens
ttgctttttaattaggaggcag

SEQ ID NO: 8580004 - DNA, 22 bp, Homo sapiens
ttggcattggagatgcaagaac

SEQ ID NO: 8580005 - DNA, 22 bp, Homo sapiens
ttggcattgaagtttcattggt

SEQ ID NO: 8580006 - DNA, 22 bp, Homo sapiens
ttggcattcatgggacaacaaa

SEQ ID NO: 8580007 - DNA, 22 bp, Homo sapiens
ttgcttttccctgtctctgatt

SEQ ID NO: 8580008 - DNA, 22 bp, Homo sapiens
ttgcttttgtctcgggtttgga

SEQ ID NO: 8580009 - DNA, 22 bp, Homo sapiens
ttgggcaaagtgtttctggagc

SEQ ID NO: 8580010 - DNA, 23 bp, Homo sapiens
ttgggcaaatcactaacgtctcc

SEQ ID NO: 8580011 - DNA, 22 bp, Homo sapiens
ccccagcccacaagcatattaa

SEQ ID NO: 8580012 - DNA, 22 bp, Homo sapiens
tgcctgggacatgctgtggact

SEQ ID NO: 8580013 - DNA, 22 bp, Homo sapiens
cccagctccttacagggccgaa

SEQ ID NO: 8580014 - DNA, 22 bp, Homo sapiens
tctgtggcctgcctcctcattt

SEQ ID NO: 8580015 - DNA, 22 bp, Homo sapiens
tctgtggcctccttccacttac

SEQ ID NO: 8580016 - DNA, 23 bp, Homo sapiens
tctgtggccccttcgccccactc

SEQ ID NO: 8580017 - DNA, 22 bp, Homo sapiens
tctgtggcccaagtgatggctg

SEQ ID NO: 8580018 - DNA, 22 bp, Homo sapiens
tctgtggcatgttgcacttgta

SEQ ID NO: 8580019 - DNA, 19 bp, Homo sapiens
tctgtggccttccctgatg

SEQ ID NO: 8580020 - DNA, 22 bp, Homo sapiens
cccagcctactctgccatagca

SEQ ID NO: 8580021 - DNA, 22 bp, Homo sapiens
cccagcctgtgacagccgtcct

SEQ ID NO: 8580022 - DNA, 22 bp, Homo sapiens
cccagcctgtctttcccaatga

SEQ ID NO: 8580023 - DNA, 22 bp, Homo sapiens
cccagcctttgcttcctggttc

SEQ ID NO: 8580024 - DNA, 22 bp, Homo sapiens
cccagccttccaccctggacta

SEQ ID NO: 8580025 - DNA, 22 bp, Homo sapiens
tggccctgctgggtcagagctg

SEQ ID NO: 8580026 - DNA, 22 bp, Homo sapiens
cctccctgctcctcaactggca

SEQ ID NO: 8580027 - DNA, 22 bp, Homo sapiens
cctccctgggtgacgggctcct

SEQ ID NO: 8580028 - DNA, 22 bp, Homo sapiens
cctcccttccccagtagtcaag

SEQ ID NO: 8580029 - DNA, 22 bp, Homo sapiens
cctcccttcagtagagcccaat

SEQ ID NO: 8580030 - DNA, 22 bp, Homo sapiens
cctctggctgtaccactggcac

SEQ ID NO: 8580031 - DNA, 22 bp, Homo sapiens
cctctgtacaggtcagcatcta

SEQ ID NO: 8580032 - DNA, 22 bp, Homo sapiens
tggcaaggctgtgggggcagag

SEQ ID NO: 8580033 - DNA, 22 bp, Homo sapiens
tggccaggcaggtagaacggcc

SEQ ID NO: 8580034 - DNA, 22 bp, Homo sapiens
tggccaggaggctgcttctgac

SEQ ID NO: 8580035 - DNA, 22 bp, Homo sapiens
tggatgagtctgagattgggca

SEQ ID NO: 8580036 - DNA, 22 bp, Homo sapiens
ccctggctcttcaccacctgcc

SEQ ID NO: 8580037 - DNA, 22 bp, Homo sapiens
ccctggctctgcctcagagccc

SEQ ID NO: 8580038 - DNA, 19 bp, Homo sapiens
ccctggagaataccctgga

SEQ ID NO: 8580039 - DNA, 22 bp, Homo sapiens
tgtcatgggtctaaacattgat

SEQ ID NO: 8580040 - DNA, 22 bp, Homo sapiens
tgtcatgggcatttattgaggg

SEQ ID NO: 8580041 - DNA, 22 bp, Homo sapiens
cctggcactgaccaggcactga

SEQ ID NO: 8580042 - DNA, 22 bp, Homo sapiens
cctggagaccagaggatacttc

SEQ ID NO: 8580043 - DNA, 22 bp, Homo sapiens
tggtccagttctgtgatattgc

SEQ ID NO: 8580044 - DNA, 22 bp, Homo sapiens
tggtccagtttagcattgagtg

SEQ ID NO: 8580045 - DNA, 18 bp, Homo sapiens
tggtccagttcagatata

SEQ ID NO: 8580046 - DNA, 22 bp, Homo sapiens
tggtccagtcgttcctttcctt

SEQ ID NO: 8580047 - DNA, 22 bp, Homo sapiens
tggtccagtgacagataggcac

SEQ ID NO: 8580048 - DNA, 22 bp, Homo sapiens
tggtccagtaagggtggagaga

SEQ ID NO: 8580049 - DNA, 22 bp, Homo sapiens
tggtccagtagcagggatacca

SEQ ID NO: 8580050 - DNA, 21 bp, Homo sapiens
cctctgtgctaaagggctccc

SEQ ID NO: 8580051 - DNA, 22 bp, Homo sapiens
cctggcaggcaagaggaaggga

SEQ ID NO: 8580052 - DNA, 22 bp, Homo sapiens
cctggcaggtggaggttgcagt

SEQ ID NO: 8580053 - DNA, 22 bp, Homo sapiens
tgtcctccagcagcatggtatg

SEQ ID NO: 8580054 - DNA, 22 bp, Homo sapiens
tgtccagtccttggggtgctgt

SEQ ID NO: 8580055 - DNA, 22 bp, Homo sapiens
cctggccagcgccggctgctcg

SEQ ID NO: 8580056 - DNA, 22 bp, Homo sapiens
cctggccctggaatagggcagg

SEQ ID NO: 8580057 - DNA, 22 bp, Homo sapiens
tgtctcatctcttaaccccact

SEQ ID NO: 8580058 - DNA, 21 bp, Homo sapiens
tgtctttggcctcattcccag

SEQ ID NO: 8580059 - DNA, 22 bp, Homo sapiens
tgtgaaggcagagccagtgaaa

SEQ ID NO: 8580060 - DNA, 22 bp, Homo sapiens
tgtgaaggacttgttccattgt

SEQ ID NO: 8580061 - DNA, 22 bp, Homo sapiens
tgtgaagctggatcctggagct

SEQ ID NO: 8580062 - DNA, 22 bp, Homo sapiens
tgtgaaggtaaggaggggcaag

SEQ ID NO: 8580063 - DNA, 22 bp, Homo sapiens
tgtgaaggtaaggtttgcttga

SEQ ID NO: 8580064 - DNA, 22 bp, Homo sapiens
tgtgaaggtagctcttggcact

SEQ ID NO: 8580065 - DNA, 22 bp, Homo sapiens
cctgggagccgactgactgtgc

SEQ ID NO: 8580066 - DNA, 22 bp, Homo sapiens
cctgggagccaagcctctgtgt

SEQ ID NO: 8580067 - DNA, 22 bp, Homo sapiens
cctgggagagccatctgtggcc

SEQ ID NO: 8580068 - DNA, 22 bp, Homo sapiens
tgtggcttttgctagctttgca

SEQ ID NO: 8580069 - DNA, 17 bp, Homo sapiens
cctgggaggagttatga

SEQ ID NO: 8580070 - DNA, 22 bp, Homo sapiens
cctgggcaatatagtgaggccc

SEQ ID NO: 8580071 - DNA, 22 bp, Homo sapiens
cctgggcaatatagtgaggccc

SEQ ID NO: 8580072 - DNA, 22 bp, Homo sapiens
tgtgtctgtcctcggttgatgc

SEQ ID NO: 8580073 - DNA, 22 bp, Homo sapiens
tgtggggatcttctagcttttc

SEQ ID NO: 8580074 - DNA, 22 bp, Homo sapiens
cctggggaagtcacttctcttt

SEQ ID NO: 8580075 - DNA, 22 bp, Homo sapiens
cctgggtgcccggcccttctct

SEQ ID NO: 8580076 - DNA, 22 bp, Homo sapiens
cctgggtgatgtgctgccctcg

SEQ ID NO: 8580077 - DNA, 22 bp, Homo sapiens
cctgggtcttcagtctgctggt

SEQ ID NO: 8580078 - DNA, 22 bp, Homo sapiens
tgtgttcatttaactgttcttt

SEQ ID NO: 8580079 - DNA, 22 bp, Homo sapiens
tgtgttcatttctctctgctgt

SEQ ID NO: 8580080 - DNA, 22 bp, Homo sapiens
tgtgttcagaatttgctgcttt

SEQ ID NO: 8580081 - DNA, 22 bp, Homo sapiens
tgtgttcaccaaagtgtagaaa

SEQ ID NO: 8580082 - DNA, 22 bp, Homo sapiens
tgtgttcatgtatgtatacata

SEQ ID NO: 8580083 - DNA, 22 bp, Homo sapiens
cctggggacctgcctcagccct

SEQ ID NO: 8580084 - DNA, 22 bp, Homo sapiens
cctggggacctgcctcagccct

SEQ ID NO: 8580085 - DNA, 22 bp, Homo sapiens
tgtgttcaatccctagtctcag

SEQ ID NO: 8580086 - DNA, 22 bp, Homo sapiens
caggaggcccacaggcccctgc

SEQ ID NO: 8580087 - DNA, 22 bp, Homo sapiens
taaatgctttctatgaaagagg

SEQ ID NO: 8580088 - DNA, 22 bp, Homo sapiens
taaagcagtgtggttgtgtccc

SEQ ID NO: 8580089 - DNA, 22 bp, Homo sapiens
gttttctaagtaggtagcacca

SEQ ID NO: 8580090 - DNA, 22 bp, Homo sapiens
gttttctgattagcaaatctga

SEQ ID NO: 8580091 - DNA, 22 bp, Homo sapiens
taaaaagtagtgagaatggcgc

SEQ ID NO: 8580092 - DNA, 22 bp, Homo sapiens
caggcaaggaggcactgaggga

SEQ ID NO: 8580093 - DNA, 22 bp, Homo sapiens
caggcaagattagagatgagca

SEQ ID NO: 8580094 - DNA, 22 bp, Homo sapiens
caggcaaggagctggctcaagt

SEQ ID NO: 8580095 - DNA, 20 bp, Homo sapiens
taacagaagtagaagtgggt

SEQ ID NO: 8580096 - DNA, 22 bp, Homo sapiens
taacagaaatagaaatgagagt

SEQ ID NO: 8580097 - DNA, 22 bp, Homo sapiens
taacagaaaggggacagaaata

SEQ ID NO: 8580098 - DNA, 22 bp, Homo sapiens
caggatcctggctgcatggacg

SEQ ID NO: 8580099 - DNA, 22 bp, Homo sapiens
tacatatttgtctttgtactgt

SEQ ID NO: 8580100 - DNA, 21 bp, Homo sapiens
tacatcatgctacttctctga

SEQ ID NO: 8580101 - DNA, 22 bp, Homo sapiens
caggcagggagccactgtataa

SEQ ID NO: 8580102 - DNA, 22 bp, Homo sapiens
tacaaatgggttaaaatatagt

SEQ ID NO: 8580103 - DNA, 22 bp, Homo sapiens
caggcaggctgctttttgttca

SEQ ID NO: 8580104 - DNA, 23 bp, Homo sapiens
caggcaggatgaggactacactc

SEQ ID NO: 8580105 - DNA, 22 bp, Homo sapiens
caggcaggagaggaggatttct

SEQ ID NO: 8580106 - DNA, 22 bp, Homo sapiens
caggcaggagacatttggttgg

SEQ ID NO: 8580107 - DNA, 22 bp, Homo sapiens
caggcaggagccagggattcca

SEQ ID NO: 8580108 - DNA, 22 bp, Homo sapiens
caggaacaatatctgtcctggt

SEQ ID NO: 8580109 - DNA, 22 bp, Homo sapiens
caggaacaactcccagcatctc

SEQ ID NO: 8580110 - DNA, 22 bp, Homo sapiens
gttctgtctgagcaccacagga

SEQ ID NO: 8580111 - DNA, 22 bp, Homo sapiens
gtttcctgtggccacagaataa

SEQ ID NO: 8580112 - DNA, 22 bp, Homo sapiens
gtttacagtggcttcattggat

SEQ ID NO: 8580113 - DNA, 22 bp, Homo sapiens
cagcttcagggacagcttcttt

SEQ ID NO: 8580114 - DNA, 22 bp, Homo sapiens
cagcttcatgacaaacagtttt

SEQ ID NO: 8580115 - DNA, 22 bp, Homo sapiens
cagcttcaactgcacagtcaac

SEQ ID NO: 8580116 - DNA, 22 bp, Homo sapiens
gtgtgtctgaagttgagtagac

SEQ ID NO: 8580117 - DNA, 22 bp, Homo sapiens
caggaaaatggaatcacctgta

SEQ ID NO: 8580118 - DNA, 22 bp, Homo sapiens
caggaaaatgtcaatggaaagc

SEQ ID NO: 8580119 - DNA, 22 bp, Homo sapiens
caggaaagaaatgagaacacca

SEQ ID NO: 8580120 - DNA, 22 bp, Homo sapiens
gtgtgagagaagctgccatgga

SEQ ID NO: 8580121 - DNA, 20 bp, Homo sapiens
gtgtgaagccctcaggagga

SEQ ID NO: 8580122 - DNA, 22 bp, Homo sapiens
gtgtgaaatggttctctttgtt

SEQ ID NO: 8580123 - DNA, 22 bp, Homo sapiens
gtgtgaaagtaattgcggtttt

SEQ ID NO: 8580124 - DNA, 22 bp, Homo sapiens
gtggctttataggaagaggaac

SEQ ID NO: 8580125 - DNA, 22 bp, Homo sapiens
tctgaggcagcttgccactcta

SEQ ID NO: 8580126 - DNA, 22 bp, Homo sapiens
ccagcctttgcatcccccatct

SEQ ID NO: 8580127 - DNA, 22 bp, Homo sapiens
ccagctcatctcagtgaaatgc

SEQ ID NO: 8580128 - DNA, 22 bp, Homo sapiens
ccagctccagcatagccaccat

SEQ ID NO: 8580129 - DNA, 22 bp, Homo sapiens
ccagctctaaacggctctgtgg

SEQ ID NO: 8580130 - DNA, 22 bp, Homo sapiens
tctgccaccttcatcctccact

SEQ ID NO: 8580131 - DNA, 22 bp, Homo sapiens
tctggcttcccactctgccggg

SEQ ID NO: 8580132 - DNA, 22 bp, Homo sapiens
ccagctggtgggtctttctctg

SEQ ID NO: 8580133 - DNA, 22 bp, Homo sapiens
tctgtggcacgattgcactgca

SEQ ID NO: 8580134 - DNA, 17 bp, Homo sapiens
tctgtcttgactgtcac

SEQ ID NO: 8580135 - DNA, 22 bp, Homo sapiens
ccagaggagcaggctggctcca

SEQ ID NO: 8580136 - DNA, 22 bp, Homo sapiens
ccagacaggaacacacatctcc

SEQ ID NO: 8580137 - DNA, 20 bp, Homo sapiens
ccagacagcacctgcctggt

SEQ ID NO: 8580138 - DNA, 22 bp, Homo sapiens
ccacaggtacggattgaggacc

SEQ ID NO: 8580139 - DNA, 20 bp, Homo sapiens
tcctggtggatactgcttaa

SEQ ID NO: 8580140 - DNA, 22 bp, Homo sapiens
tcctggtgatcaaaattcattt

SEQ ID NO: 8580141 - DNA, 22 bp, Homo sapiens
tcctggtgcctggagctctcca

SEQ ID NO: 8580142 - DNA, 22 bp, Homo sapiens
tcctggggagggttctggctcc

SEQ ID NO: 8580143 - DNA, 22 bp, Homo sapiens
ccacagtgacacgggctggccc

SEQ ID NO: 8580144 - DNA, 21 bp, Homo sapiens
ccactctgagtgttgaacaga

SEQ ID NO: 8580145 - DNA, 22 bp, Homo sapiens
ccaaatattaacaaagtaattt

SEQ ID NO: 8580146 - DNA, 22 bp, Homo sapiens
tcctgcagtgtgtctcctgcac

SEQ ID NO: 8580147 - DNA, 20 bp, Homo sapiens
tcctgcagttcctaggaggg

SEQ ID NO: 8580148 - DNA, 17 bp, Homo sapiens
tcctgccacctgtcagg

SEQ ID NO: 8580149 - DNA, 22 bp, Homo sapiens
tcctgccaggagtgctggccct

SEQ ID NO: 8580150 - DNA, 23 bp, Homo sapiens
tcctgccagatgactcctttctt

SEQ ID NO: 8580151 - DNA, 23 bp, Homo sapiens
tcctgccagatgactcctttctt

SEQ ID NO: 8580152 - DNA, 22 bp, Homo sapiens
tcctgccagctggggctgcttc

SEQ ID NO: 8580153 - DNA, 22 bp, Homo sapiens
ccacagctagggcaatctgatt

SEQ ID NO: 8580154 - DNA, 22 bp, Homo sapiens
catttgctgaggccttcagagg

SEQ ID NO: 8580155 - DNA, 22 bp, Homo sapiens
catttgctagcaggccttttat

SEQ ID NO: 8580156 - DNA, 22 bp, Homo sapiens
catttgctctgtgtcagtggca

SEQ ID NO: 8580157 - DNA, 22 bp, Homo sapiens
catttgctgtattttcagattc

SEQ ID NO: 8580158 - DNA, 22 bp, Homo sapiens
ccaaagtgatatgtgctgtaag

SEQ ID NO: 8580159 - DNA, 21 bp, Homo sapiens
tcccagggccaggtgccatca

SEQ ID NO: 8580160 - DNA, 22 bp, Homo sapiens
tcccagggtcagtggtgaggcc

SEQ ID NO: 8580161 - DNA, 22 bp, Homo sapiens
tcccagggctctagagtgctgg

SEQ ID NO: 8580162 - DNA, 22 bp, Homo sapiens
tccaggcacagagttggtcagt

SEQ ID NO: 8580163 - DNA, 20 bp, Homo sapiens
tccaggcagacagctatggg

SEQ ID NO: 8580164 - DNA, 22 bp, Homo sapiens
tcagtttcacagtctgtgcaga

SEQ ID NO: 8580165 - DNA, 22 bp, Homo sapiens
catgagtgtcatctcagcagct

SEQ ID NO: 8580166 - DNA, 22 bp, Homo sapiens
tccaggcaaagggactagcagg

SEQ ID NO: 8580167 - DNA, 22 bp, Homo sapiens
tccaggcaaagccttgtagacg

SEQ ID NO: 8580168 - DNA, 22 bp, Homo sapiens
tccaggcaaagtgctgggctgc

SEQ ID NO: 8580169 - DNA, 22 bp, Homo sapiens
catgtcttatttatgcttctta

SEQ ID NO: 8580170 - DNA, 22 bp, Homo sapiens
catgtcttatatcctgtcttca

SEQ ID NO: 8580171 - DNA, 22 bp, Homo sapiens
catggccagccctgaggttcag

SEQ ID NO: 8580172 - DNA, 22 bp, Homo sapiens
catggccaggcacgcgcatagc

SEQ ID NO: 8580173 - DNA, 22 bp, Homo sapiens
catccagctcctgggggccacc

SEQ ID NO: 8580174 - DNA, 22 bp, Homo sapiens
catccaggctgaagtgcagtgg

SEQ ID NO: 8580175 - DNA, 22 bp, Homo sapiens
catccagggcagccatggcctg

SEQ ID NO: 8580176 - DNA, 22 bp, Homo sapiens
catcatctggcttttagaaaaa

SEQ ID NO: 8580177 - DNA, 22 bp, Homo sapiens
tcagctctgttttgagtggaac

SEQ ID NO: 8580178 - DNA, 22 bp, Homo sapiens
cagtttcttaagactgagatct

SEQ ID NO: 8580179 - DNA, 22 bp, Homo sapiens
cagtttctgtggtctcttttca

SEQ ID NO: 8580180 - DNA, 22 bp, Homo sapiens
cagtgctggaggggtgcttgca

SEQ ID NO: 8580181 - DNA, 22 bp, Homo sapiens
tcactcaggctggagtgcagtg

SEQ ID NO: 8580182 - DNA, 22 bp, Homo sapiens
tcacttcccagacggggtggca

SEQ ID NO: 8580183 - DNA, 22 bp, Homo sapiens
tcagaacaattcctttataaca

SEQ ID NO: 8580184 - DNA, 22 bp, Homo sapiens
cagtgcaattacaagctaattc

SEQ ID NO: 8580185 - DNA, 22 bp, Homo sapiens
cagtgcaatgttaaataggaaa

SEQ ID NO: 8580186 - DNA, 22 bp, Homo sapiens
cagtgcaagtgactgatcaagg

SEQ ID NO: 8580187 - DNA, 17 bp, Homo sapiens
cagtgatcattacatta

SEQ ID NO: 8580188 - DNA, 22 bp, Homo sapiens
cagtgcaacagattcgagaagc

SEQ ID NO: 8580189 - DNA, 20 bp, Homo sapiens
cagtgcaactgaagaactga

SEQ ID NO: 8580190 - DNA, 20 bp, Homo sapiens
cagtgcaactgaagaactga

SEQ ID NO: 8580191 - DNA, 20 bp, Homo sapiens
tatttacaacttagagcctc

SEQ ID NO: 8580192 - DNA, 22 bp, Homo sapiens
cagtcctgggcaggtcaggcca

SEQ ID NO: 8580193 - DNA, 22 bp, Homo sapiens
tatacaggaaattttggaacag

SEQ ID NO: 8580194 - DNA, 22 bp, Homo sapiens
tatacaggaactgttggctccc

SEQ ID NO: 8580195 - DNA, 22 bp, Homo sapiens
caggtccacggcgcccaggggt

SEQ ID NO: 8580196 - DNA, 22 bp, Homo sapiens
caggtccagaaaccaaaggatt

SEQ ID NO: 8580197 - DNA, 22 bp, Homo sapiens
caggtccaccatgcctcaagcc

SEQ ID NO: 8580198 - DNA, 20 bp, Homo sapiens
caggtccagcacgtgcacgg

SEQ ID NO: 8580199 - DNA, 22 bp, Homo sapiens
caggtctcgggttcagcagtga

SEQ ID NO: 8580200 - DNA, 22 bp, Homo sapiens
caggtctctcccaagctacaat

SEQ ID NO: 8580201 - DNA, 22 bp, Homo sapiens
tacatgtgttctgtttcaagtt

SEQ ID NO: 8580202 - DNA, 18 bp, Homo sapiens
caggtctgtctgcctccc

SEQ ID NO: 8580203 - DNA, 22 bp, Homo sapiens
ttatttgccagaatttctcttg

SEQ ID NO: 8580204 - DNA, 22 bp, Homo sapiens
ttcagcaggtggtgagttctgc

SEQ ID NO: 8580205 - DNA, 22 bp, Homo sapiens
ttcacctgtgttttgtggctga

SEQ ID NO: 8580206 - DNA, 22 bp, Homo sapiens
ttcaccctggaccagaaattgg

SEQ ID NO: 8580207 - DNA, 22 bp, Homo sapiens
ttcagcttgaatctggctttga

SEQ ID NO: 8580208 - DNA, 22 bp, Homo sapiens
ttcaggaaggtcctatagcaga

SEQ ID NO: 8580209 - DNA, 21 bp, Homo sapiens
ttcagcttatgtgtcacttgc

SEQ ID NO: 8580210 - DNA, 22 bp, Homo sapiens
ttcagcttcatttgtctttatg

SEQ ID NO: 8580211 - DNA, 22 bp, Homo sapiens
ttcagcctgttcatgctgttgc

SEQ ID NO: 8580212 - DNA, 22 bp, Homo sapiens
ttcatgttttattcagtaatta

SEQ ID NO: 8580213 - DNA, 22 bp, Homo sapiens
ttccagctaactcacatccctt

SEQ ID NO: 8580214 - DNA, 22 bp, Homo sapiens
ttccagcccgcgacttgttcag

SEQ ID NO: 8580215 - DNA, 22 bp, Homo sapiens
ttacaagattaattattggagt

SEQ ID NO: 8580216 - DNA, 22 bp, Homo sapiens
ttacaagatgggaaagggaagt

SEQ ID NO: 8580217 - DNA, 22 bp, Homo sapiens
ttacaagattgatttgcttggc

SEQ ID NO: 8580218 - DNA, 22 bp, Homo sapiens
ttacaagatatgtgagaactag

SEQ ID NO: 8580219 - DNA, 22 bp, Homo sapiens
ttacaagatctttgaaggcaag

SEQ ID NO: 8580220 - DNA, 22 bp, Homo sapiens
ttacaagataacctgatgctgt

SEQ ID NO: 8580221 - DNA, 22 bp, Homo sapiens
ttacaagataacggagaaagca

SEQ ID NO: 8580222 - DNA, 22 bp, Homo sapiens
ttacaagacagtgtggtaaata

SEQ ID NO: 8580223 - DNA, 22 bp, Homo sapiens
ttacaagacactgctgacacag

SEQ ID NO: 8580224 - DNA, 22 bp, Homo sapiens
ttacaacaaaggcacgtgcatg

SEQ ID NO: 8580225 - DNA, 22 bp, Homo sapiens
ttacaagacacagtgctgaagg

SEQ ID NO: 8580226 - DNA, 22 bp, Homo sapiens
ttatttcattgatttctaagac

SEQ ID NO: 8580227 - DNA, 22 bp, Homo sapiens
ttatgacagaaatgaaaagctg

SEQ ID NO: 8580228 - DNA, 22 bp, Homo sapiens
ttagatacctttgtgttgtaga

SEQ ID NO: 8580229 - DNA, 22 bp, Homo sapiens
tgtctgctacttggttctacca

SEQ ID NO: 8580230 - DNA, 22 bp, Homo sapiens
tgtctttaagcaaacagtgttt

SEQ ID NO: 8580231 - DNA, 22 bp, Homo sapiens
tgtcttttacctaatgagctgg

SEQ ID NO: 8580232 - DNA, 22 bp, Homo sapiens
tgtcttttataactgacatata

SEQ ID NO: 8580233 - DNA, 22 bp, Homo sapiens
tgtctttttactatgttcaatc

SEQ ID NO: 8580234 - DNA, 22 bp, Homo sapiens
tgtcttttggagcatctttctt

SEQ ID NO: 8580235 - DNA, 22 bp, Homo sapiens
tgtctgtggcaattgtgggtaa

SEQ ID NO: 8580236 - DNA, 22 bp, Homo sapiens
tgtgaatggacaattaaatcta

SEQ ID NO: 8580237 - DNA, 22 bp, Homo sapiens
tgtgaatatttccttctttgga

SEQ ID NO: 8580238 - DNA, 22 bp, Homo sapiens
tgtgaatatccatttgtttcag

SEQ ID NO: 8580239 - DNA, 22 bp, Homo sapiens
tgtgaaggttaaataatatgat

SEQ ID NO: 8580240 - DNA, 22 bp, Homo sapiens
tgtgacagtgccagcttcatag

SEQ ID NO: 8580241 - DNA, 22 bp, Homo sapiens
tgtgacagccagtaaagtaagc

SEQ ID NO: 8580242 - DNA, 22 bp, Homo sapiens
tgtgaaagtcaaattaattgaa

SEQ ID NO: 8580243 - DNA, 20 bp, Homo sapiens
tgtgaaagcagtagaatgac

SEQ ID NO: 8580244 - DNA, 22 bp, Homo sapiens
tgtgagtctaggtcagggtgtt

SEQ ID NO: 8580245 - DNA, 21 bp, Homo sapiens
tgtgagtccatctgagcagaa

SEQ ID NO: 8580246 - DNA, 22 bp, Homo sapiens
tgtgcaaaataataaatcactg

SEQ ID NO: 8580247 - DNA, 22 bp, Homo sapiens
tgtgcaaagtgtacaaattaat

SEQ ID NO: 8580248 - DNA, 22 bp, Homo sapiens
tgtgcagagaagccactggggg

SEQ ID NO: 8580249 - DNA, 22 bp, Homo sapiens
tgtgcacaggaagctattctct

SEQ ID NO: 8580250 - DNA, 22 bp, Homo sapiens
tgtgcacatatactcatattcc

SEQ ID NO: 8580251 - DNA, 20 bp, Homo sapiens
tgtgccctgcagacttcttt

SEQ ID NO: 8580252 - DNA, 22 bp, Homo sapiens
tgtggaatgctcctaagtgaat

SEQ ID NO: 8580253 - DNA, 22 bp, Homo sapiens
tgtggaatttctttcaggtatg

SEQ ID NO: 8580254 - DNA, 22 bp, Homo sapiens
tgtggaatattagattaggttg

SEQ ID NO: 8580255 - DNA, 22 bp, Homo sapiens
tgtggctctcctcctgctgccc

SEQ ID NO: 8580256 - DNA, 22 bp, Homo sapiens
tgtggctcggccagctgctgaa

SEQ ID NO: 8580257 - DNA, 22 bp, Homo sapiens
tgtggctcggccagctgctgaa

SEQ ID NO: 8580258 - DNA, 22 bp, Homo sapiens
tgtggctgactcctggtcccca

SEQ ID NO: 8580259 - DNA, 22 bp, Homo sapiens
tgtgggaggtctggaaggctcc

SEQ ID NO: 8580260 - DNA, 22 bp, Homo sapiens
tgtggggaagagtatgacttgg

SEQ ID NO: 8580261 - DNA, 22 bp, Homo sapiens
tgtgtacatatctatcctagat

SEQ ID NO: 8580262 - DNA, 22 bp, Homo sapiens
tgttaaagtggataagctgaat

SEQ ID NO: 8580263 - DNA, 22 bp, Homo sapiens
tgtgtgttatcttagttcatct

SEQ ID NO: 8580264 - DNA, 22 bp, Homo sapiens
tgtgtgtgtcctcatttgcaga

SEQ ID NO: 8580265 - DNA, 22 bp, Homo sapiens
tgtgtgctaatgtatgctctaa

SEQ ID NO: 8580266 - DNA, 22 bp, Homo sapiens
tgtgtggcaagctgtatgctag

SEQ ID NO: 8580267 - DNA, 22 bp, Homo sapiens
tgtgtgtgagtcctggctttcc

SEQ ID NO: 8580268 - DNA, 22 bp, Homo sapiens
tgtgtgtgagtcctggctttcc

SEQ ID NO: 8580269 - DNA, 22 bp, Homo sapiens
ttaaacacctgtctagtgtagc

SEQ ID NO: 8580270 - DNA, 22 bp, Homo sapiens
ttaaaatttccccaccatgtat

SEQ ID NO: 8580271 - DNA, 22 bp, Homo sapiens
ttaaaatgcagattatgactca

SEQ ID NO: 8580272 - DNA, 22 bp, Homo sapiens
ttaaaaatatgtagggcccgat

SEQ ID NO: 8580273 - DNA, 22 bp, Homo sapiens
tgtttttccatgtgcagaacaa

SEQ ID NO: 8580274 - DNA, 22 bp, Homo sapiens
tgtttttccatgtgcagaacaa

SEQ ID NO: 8580275 - DNA, 19 bp, Homo sapiens
tgttgaagattatttgtgg

SEQ ID NO: 8580276 - DNA, 23 bp, Homo sapiens
tgttgaagtaactgttacataga

SEQ ID NO: 8580277 - DNA, 21 bp, Homo sapiens
tgggctctttaacccaggcac

SEQ ID NO: 8580278 - DNA, 22 bp, Homo sapiens
tgggctgccggcaggctctgcc

SEQ ID NO: 8580279 - DNA, 22 bp, Homo sapiens
tgggctctcaaagtgcggcttg

SEQ ID NO: 8580280 - DNA, 22 bp, Homo sapiens
tgggctctctttacctcataac

SEQ ID NO: 8580281 - DNA, 22 bp, Homo sapiens
tgggctctgaagggtcccggat

SEQ ID NO: 8580282 - DNA, 22 bp, Homo sapiens
tgggctctgcatcagtgcccat

SEQ ID NO: 8580283 - DNA, 20 bp, Homo sapiens
tgggctctgcttcctggagt

SEQ ID NO: 8580284 - DNA, 22 bp, Homo sapiens
tgggctctggtttcctggctgg

SEQ ID NO: 8580285 - DNA, 22 bp, Homo sapiens
tgggctctggggaaactgtgat

SEQ ID NO: 8580286 - DNA, 22 bp, Homo sapiens
tgggctctggagggcctaggat

SEQ ID NO: 8580287 - DNA, 22 bp, Homo sapiens
tgggcagggatctcttttgcaa

SEQ ID NO: 8580288 - DNA, 22 bp, Homo sapiens
tgggcagggagctggaaccaca

SEQ ID NO: 8580289 - DNA, 22 bp, Homo sapiens
tgggccacgggggtggagagct

SEQ ID NO: 8580290 - DNA, 22 bp, Homo sapiens
tgggccacagagtgagaaatgt

SEQ ID NO: 8580291 - DNA, 22 bp, Homo sapiens
tgggccagctgaagtgccgccc

SEQ ID NO: 8580292 - DNA, 22 bp, Homo sapiens
tgggccagcactgggtgctcat

SEQ ID NO: 8580293 - DNA, 19 bp, Homo sapiens
tgggcaggttcagtaatgg

SEQ ID NO: 8580294 - DNA, 22 bp, Homo sapiens
tgggcaggggccctgcttccgt

SEQ ID NO: 8580295 - DNA, 22 bp, Homo sapiens
tgggcaggggccctgcttccgt

SEQ ID NO: 8580296 - DNA, 22 bp, Homo sapiens
tgggagtcaaccctcacgagca

SEQ ID NO: 8580297 - DNA, 22 bp, Homo sapiens
tgggagtcagtcgttctcagag

SEQ ID NO: 8580298 - DNA, 22 bp, Homo sapiens
tgggagtccaaggcaggcggat

SEQ ID NO: 8580299 - DNA, 20 bp, Homo sapiens
tgggattgttttttagcttc

SEQ ID NO: 8580300 - DNA, 22 bp, Homo sapiens
tgggcaaactgtcaaccatgtc

SEQ ID NO: 8580301 - DNA, 22 bp, Homo sapiens
tgggcaaatgtcactttctttt

SEQ ID NO: 8580302 - DNA, 22 bp, Homo sapiens
tgggcaaatgctttttagtcaa

SEQ ID NO: 8580303 - DNA, 22 bp, Homo sapiens
tgggcaaagtcacatacatgat

SEQ ID NO: 8580304 - DNA, 22 bp, Homo sapiens
tgggcaaaggctgtaacccatc

SEQ ID NO: 8580305 - DNA, 22 bp, Homo sapiens
tgggctggctgaggcattcact

SEQ ID NO: 8580306 - DNA, 22 bp, Homo sapiens
tgggctggctgaacttcaacct

SEQ ID NO: 8580307 - DNA, 22 bp, Homo sapiens
tgggctttgagctcggtcacct

SEQ ID NO: 8580308 - DNA, 22 bp, Homo sapiens
tgggctttatcatgggtctggt

SEQ ID NO: 8580309 - DNA, 17 bp, Homo sapiens
tggggatggttcatgag

SEQ ID NO: 8580310 - DNA, 22 bp, Homo sapiens
tgggggctagaacccagggatt

SEQ ID NO: 8580311 - DNA, 17 bp, Homo sapiens
tgggggcgccagggtct

SEQ ID NO: 8580312 - DNA, 22 bp, Homo sapiens
tgggggctccaggctccaggga

SEQ ID NO: 8580313 - DNA, 22 bp, Homo sapiens
tgggtgaggagaggctgtctaa

SEQ ID NO: 8580314 - DNA, 19 bp, Homo sapiens
tggtaaagactgtccccca

SEQ ID NO: 8580315 - DNA, 22 bp, Homo sapiens
tgtagaaagaatatgtttcata

SEQ ID NO: 8580316 - DNA, 22 bp, Homo sapiens
tgtatacattctcttgggtttg

SEQ ID NO: 8580317 - DNA, 22 bp, Homo sapiens
tgtatttttaggaatgcgctat

SEQ ID NO: 8580318 - DNA, 22 bp, Homo sapiens
tgtcaaaaccttggaggcaagg

SEQ ID NO: 8580319 - DNA, 22 bp, Homo sapiens
tgtcaaaaataagagagattgt

SEQ ID NO: 8580320 - DNA, 22 bp, Homo sapiens
tgtcaaaaagctgggacaagca

SEQ ID NO: 8580321 - DNA, 22 bp, Homo sapiens
tgtattttgtgaggatcactct

SEQ ID NO: 8580322 - DNA, 22 bp, Homo sapiens
tgtattttcagagtggcatttc

SEQ ID NO: 8580323 - DNA, 22 bp, Homo sapiens
tgtcactttggccaagccattg

SEQ ID NO: 8580324 - DNA, 22 bp, Homo sapiens
tgtcagtgagttgggtcctgag

SEQ ID NO: 8580325 - DNA, 22 bp, Homo sapiens
tgtcattttctaatctgttgtc

SEQ ID NO: 8580326 - DNA, 21 bp, Homo sapiens
tgtccaaggtatgcactgggg

SEQ ID NO: 8580327 - DNA, 22 bp, Homo sapiens
tgtccactttgtcagtgtcata

SEQ ID NO: 8580328 - DNA, 22 bp, Homo sapiens
tgtcatttagtcctctgtgtgt

SEQ ID NO: 8580329 - DNA, 22 bp, Homo sapiens
tgtcatttattctcttattcta

SEQ ID NO: 8580330 - DNA, 23 bp, Homo sapiens
tgtcatctccagactcccagtgc

SEQ ID NO: 8580331 - DNA, 22 bp, Homo sapiens
tgtccagggatggggtcaggga

SEQ ID NO: 8580332 - DNA, 22 bp, Homo sapiens
tgtccagggggcttacctggag

SEQ ID NO: 8580333 - DNA, 19 bp, Homo sapiens
tgtccctggtcaccagact

SEQ ID NO: 8580334 - DNA, 22 bp, Homo sapiens
tgtcctgtgacctggcaccaca

SEQ ID NO: 8580335 - DNA, 22 bp, Homo sapiens
tgtcctgttcttgctgtgtcct

SEQ ID NO: 8580336 - DNA, 22 bp, Homo sapiens
tgtcctagatccagctgtgctg

SEQ ID NO: 8580337 - DNA, 20 bp, Homo sapiens
tggtcctgtcccacccactc

SEQ ID NO: 8580338 - DNA, 22 bp, Homo sapiens
tggtcctgtctcaaggagcctt

SEQ ID NO: 8580339 - DNA, 22 bp, Homo sapiens
tggtgcaatattatgaaaggta

SEQ ID NO: 8580340 - DNA, 22 bp, Homo sapiens
tggtccagacatttctgaggta

SEQ ID NO: 8580341 - DNA, 22 bp, Homo sapiens
tggtccagactttgacctctca

SEQ ID NO: 8580342 - DNA, 22 bp, Homo sapiens
tggtccagatgccttggcttta

SEQ ID NO: 8580343 - DNA, 19 bp, Homo sapiens
tggtccagcttcttctcct

SEQ ID NO: 8580344 - DNA, 22 bp, Homo sapiens
tggtccagaagatattcaacca

SEQ ID NO: 8580345 - DNA, 17 bp, Homo sapiens
tggtccaggtggagcca

SEQ ID NO: 8580346 - DNA, 22 bp, Homo sapiens
tggtccagggtgtagtacagag

SEQ ID NO: 8580347 - DNA, 22 bp, Homo sapiens
tggtccaggcacccttctagag

SEQ ID NO: 8580348 - DNA, 20 bp, Homo sapiens
tggtccaggacctggtgtcc

SEQ ID NO: 8580349 - DNA, 22 bp, Homo sapiens
tggtccagcttgattctcttct

SEQ ID NO: 8580350 - DNA, 22 bp, Homo sapiens
tggtcctggccttgaccccagg

SEQ ID NO: 8580351 - DNA, 23 bp, Homo sapiens
tggtcctgccaacggtgcccctc

SEQ ID NO: 8580352 - DNA, 22 bp, Homo sapiens
tgtacctggagagctcttggcc

SEQ ID NO: 8580353 - DNA, 22 bp, Homo sapiens
tgtaagccttccctgagaaagt

SEQ ID NO: 8580354 - DNA, 22 bp, Homo sapiens
tggtttgagagtgtgagctttt

SEQ ID NO: 8580355 - DNA, 22 bp, Homo sapiens
tggttaaaatgcagattcagta

SEQ ID NO: 8580356 - DNA, 22 bp, Homo sapiens
tggttgtgtcacttagattaga

SEQ ID NO: 8580357 - DNA, 22 bp, Homo sapiens
tggttaagtccagaaaggaagc

SEQ ID NO: 8580358 - DNA, 22 bp, Homo sapiens
tggactttctagggtagaggaa

SEQ ID NO: 8580359 - DNA, 22 bp, Homo sapiens
tggagaatatttccaaatctaa

SEQ ID NO: 8580360 - DNA, 22 bp, Homo sapiens
tggagagcgcgacgggaggaag

SEQ ID NO: 8580361 - DNA, 22 bp, Homo sapiens
tggagaggaaagtgcagttttg

SEQ ID NO: 8580362 - DNA, 19 bp, Homo sapiens
tggagaggaaatgctgctc

SEQ ID NO: 8580363 - DNA, 22 bp, Homo sapiens
tggagaggagcaccatggccat

SEQ ID NO: 8580364 - DNA, 22 bp, Homo sapiens
tggagaggttgaataacttgtc

SEQ ID NO: 8580365 - DNA, 22 bp, Homo sapiens
tggagaggtttaaacaaaagtt

SEQ ID NO: 8580366 - DNA, 22 bp, Homo sapiens
tggagcatgagagtctttagct

SEQ ID NO: 8580367 - DNA, 22 bp, Homo sapiens
tggagctgaactttgaggccag

SEQ ID NO: 8580368 - DNA, 22 bp, Homo sapiens
tggatatccttgttaactttct

SEQ ID NO: 8580369 - DNA, 21 bp, Homo sapiens
tggataaaggcacttttcatc

SEQ ID NO: 8580370 - DNA, 22 bp, Homo sapiens
tggagtgcagttgggaggacac

SEQ ID NO: 8580371 - DNA, 22 bp, Homo sapiens
tggagtcacttccatatgggaa

SEQ ID NO: 8580372 - DNA, 22 bp, Homo sapiens
tggagtcacagtgacctgagtc

SEQ ID NO: 8580373 - DNA, 22 bp, Homo sapiens
tggagtcagaatgcgacaggcc

SEQ ID NO: 8580374 - DNA, 22 bp, Homo sapiens
tggagtcagtggctattgggca

SEQ ID NO: 8580375 - DNA, 22 bp, Homo sapiens
tggagtcatcttaatctaggca

SEQ ID NO: 8580376 - DNA, 22 bp, Homo sapiens
tggaggctggagtgcagtggcg

SEQ ID NO: 8580377 - DNA, 23 bp, Homo sapiens
tggagggcagaataacagactac

SEQ ID NO: 8580378 - DNA, 22 bp, Homo sapiens
tggagggcatgctgtccatggg

SEQ ID NO: 8580379 - DNA, 19 bp, Homo sapiens
tggaaaatggattgaatca

SEQ ID NO: 8580380 - DNA, 19 bp, Homo sapiens
tggaaaatggattgaatca

SEQ ID NO: 8580381 - DNA, 22 bp, Homo sapiens
tggaaacagatcataactaagc

SEQ ID NO: 8580382 - DNA, 22 bp, Homo sapiens
tggaaacactcaagcttatatt

SEQ ID NO: 8580383 - DNA, 18 bp, Homo sapiens
tggaaattgaaacagaaa

SEQ ID NO: 8580384 - DNA, 22 bp, Homo sapiens
tgcttgcaagagatgcaatgac

SEQ ID NO: 8580385 - DNA, 22 bp, Homo sapiens
tgctttaaaccatggatgtgag

SEQ ID NO: 8580386 - DNA, 22 bp, Homo sapiens
tggaatctctttggggactgaa

SEQ ID NO: 8580387 - DNA, 22 bp, Homo sapiens
tggaatctttaggaagcacata

SEQ ID NO: 8580388 - DNA, 22 bp, Homo sapiens
tggaatcttgcgggcacatggc

SEQ ID NO: 8580389 - DNA, 22 bp, Homo sapiens
tggaatctctggtatctgggga

SEQ ID NO: 8580390 - DNA, 22 bp, Homo sapiens
tggaaggggccaggcgcggagt

SEQ ID NO: 8580391 - DNA, 22 bp, Homo sapiens
tggaaggggttacgcagcagga

SEQ ID NO: 8580392 - DNA, 22 bp, Homo sapiens
tggaagggagtgacagtcagag

SEQ ID NO: 8580393 - DNA, 22 bp, Homo sapiens
tggaaggagctaaggacctggg

SEQ ID NO: 8580394 - DNA, 23 bp, Homo sapiens
tggaagcagaagtttcaatatcc

SEQ ID NO: 8580395 - DNA, 22 bp, Homo sapiens
tggactcaagtccaagttcacg

SEQ ID NO: 8580396 - DNA, 22 bp, Homo sapiens
tggactccagtgtctgtgttct

SEQ ID NO: 8580397 - DNA, 22 bp, Homo sapiens
tggactcagtgctgccattccc

SEQ ID NO: 8580398 - DNA, 22 bp, Homo sapiens
tggacctcactgtctgctggta

SEQ ID NO: 8580399 - DNA, 20 bp, Homo sapiens
tgctgctttgccactagttg

SEQ ID NO: 8580400 - DNA, 22 bp, Homo sapiens
tgctgctttgatgtgtaaatca

SEQ ID NO: 8580401 - DNA, 22 bp, Homo sapiens
tgctgggccaaagcagggtttt

SEQ ID NO: 8580402 - DNA, 22 bp, Homo sapiens
tgcttaaacacatacatacata

SEQ ID NO: 8580403 - DNA, 22 bp, Homo sapiens
tgcttaaaggatagtttaaact

SEQ ID NO: 8580404 - DNA, 22 bp, Homo sapiens
tgcttaaaaagctccatcaata

SEQ ID NO: 8580405 - DNA, 22 bp, Homo sapiens
tgcttaaaatgatgattatttt

SEQ ID NO: 8580406 - DNA, 22 bp, Homo sapiens
tgctcctgctgcatgcatctcc

SEQ ID NO: 8580407 - DNA, 22 bp, Homo sapiens
tgctcctgctgcatgcatctcc

SEQ ID NO: 8580408 - DNA, 22 bp, Homo sapiens
tgctgaaattagaacattgagg

SEQ ID NO: 8580409 - DNA, 20 bp, Homo sapiens
tgctgaagaatcacagatgg

SEQ ID NO: 8580410 - DNA, 20 bp, Homo sapiens
tgccttggagcagccaaggt

SEQ ID NO: 8580411 - DNA, 21 bp, Homo sapiens
tgccttggcaaatgaccatga

SEQ ID NO: 8580412 - DNA, 20 bp, Homo sapiens
tgccttgggacagtgcctgt

SEQ ID NO: 8580413 - DNA, 22 bp, Homo sapiens
tgcctggctgaggtgacaggtt

SEQ ID NO: 8580414 - DNA, 22 bp, Homo sapiens
tgcctgggttgactcttagctg

SEQ ID NO: 8580415 - DNA, 19 bp, Homo sapiens
tgctatttgaagaagtgta

SEQ ID NO: 8580416 - DNA, 22 bp, Homo sapiens
tgctcatcaacatgatgatcat

SEQ ID NO: 8580417 - DNA, 22 bp, Homo sapiens
tggcaggaaataccctgcctag

SEQ ID NO: 8580418 - DNA, 22 bp, Homo sapiens
tggcaggggaggtgcttgctta

SEQ ID NO: 8580419 - DNA, 21 bp, Homo sapiens
tggcaggggtagtagtacagc

SEQ ID NO: 8580420 - DNA, 21 bp, Homo sapiens
tggcaggcagctggaagcttg

SEQ ID NO: 8580421 - DNA, 22 bp, Homo sapiens
tggcagccatcagagcaggggt

SEQ ID NO: 8580422 - DNA, 22 bp, Homo sapiens
tggcagcctggaatctctcagc

SEQ ID NO: 8580423 - DNA, 22 bp, Homo sapiens
tggcaaactggaggaagccctg

SEQ ID NO: 8580424 - DNA, 22 bp, Homo sapiens
tggatgtgtcgccctggctctc

SEQ ID NO: 8580425 - DNA, 20 bp, Homo sapiens
tggatgtcaaattaggctgg

SEQ ID NO: 8580426 - DNA, 22 bp, Homo sapiens
tggcacttagatcaggttgggt

SEQ ID NO: 8580427 - DNA, 22 bp, Homo sapiens
tggcacttaatgcatgtgctat

SEQ ID NO: 8580428 - DNA, 22 bp, Homo sapiens
tggccaggttgggctttgcagc

SEQ ID NO: 8580429 - DNA, 19 bp, Homo sapiens
tggccaggtactgtctgct

SEQ ID NO: 8580430 - DNA, 22 bp, Homo sapiens
tggccagcagagttcactctct

SEQ ID NO: 8580431 - DNA, 22 bp, Homo sapiens
tggccagccctcttcccacact

SEQ ID NO: 8580432 - DNA, 22 bp, Homo sapiens
tggccagccttgtcatcgcttt

SEQ ID NO: 8580433 - DNA, 22 bp, Homo sapiens
tggccaggcattcagataagac

SEQ ID NO: 8580434 - DNA, 22 bp, Homo sapiens
tggccaggccggggacagaact

SEQ ID NO: 8580435 - DNA, 22 bp, Homo sapiens
tggccaccttcccacttctgcc

SEQ ID NO: 8580436 - DNA, 19 bp, Homo sapiens
tggccacctctgctgttct

SEQ ID NO: 8580437 - DNA, 22 bp, Homo sapiens
tggccaccttatggctattgga

SEQ ID NO: 8580438 - DNA, 20 bp, Homo sapiens
tggccacctgcgtcccagcc

SEQ ID NO: 8580439 - DNA, 22 bp, Homo sapiens
tggccacccctttctctgcact

SEQ ID NO: 8580440 - DNA, 22 bp, Homo sapiens
tggccacccagctgacgccttc

SEQ ID NO: 8580441 - DNA, 22 bp, Homo sapiens
tggccacccccaatgtcagtag

SEQ ID NO: 8580442 - DNA, 22 bp, Homo sapiens
tggccaccaccaatacttgcct

SEQ ID NO: 8580443 - DNA, 22 bp, Homo sapiens
tggccacccaccctaatctttc

SEQ ID NO: 8580444 - DNA, 20 bp, Homo sapiens
tggccaccactgtatatcaa

SEQ ID NO: 8580445 - DNA, 22 bp, Homo sapiens
tggcatttagttgcgtattgca

SEQ ID NO: 8580446 - DNA, 21 bp, Homo sapiens
tggcatggaggtagcagtgtg

SEQ ID NO: 8580447 - DNA, 22 bp, Homo sapiens
tggcatggcaaccctgcaggga

SEQ ID NO: 8580448 - DNA, 22 bp, Homo sapiens
tggcaggtggagacagcagagc

SEQ ID NO: 8580449 - DNA, 22 bp, Homo sapiens
tggcaggtggcacagcctggga

SEQ ID NO: 8580450 - DNA, 20 bp, Homo sapiens
tggcaggtggcctcagttcc

SEQ ID NO: 8580451 - DNA, 23 bp, Homo sapiens
tggcaggtggttagatgttttgt

SEQ ID NO: 8580452 - DNA, 22 bp, Homo sapiens
tggcaggtggctctggcattct

SEQ ID NO: 8580453 - DNA, 22 bp, Homo sapiens
tggcaggttatgcgggccacat

SEQ ID NO: 8580454 - DNA, 22 bp, Homo sapiens
tggcaggttaacttacaactgt

SEQ ID NO: 8580455 - DNA, 18 bp, Homo sapiens
tggcaggtccagctgtgg

SEQ ID NO: 8580456 - DNA, 22 bp, Homo sapiens
tggcaggtccactcacagatct

SEQ ID NO: 8580457 - DNA, 22 bp, Homo sapiens
tggcaggtgaagttgttaggga

SEQ ID NO: 8580458 - DNA, 22 bp, Homo sapiens
tggcaggtgccatgggctcaga

SEQ ID NO: 8580459 - DNA, 22 bp, Homo sapiens
tggcaggtgcacttttggtttc

SEQ ID NO: 8580460 - DNA, 22 bp, Homo sapiens
tggcaggtgcctgtaatctcag

SEQ ID NO: 8580461 - DNA, 22 bp, Homo sapiens
tggcaggtcatgagtggccacc

SEQ ID NO: 8580462 - DNA, 22 bp, Homo sapiens
tggcaggtttcctcctcatagt

SEQ ID NO: 8580463 - DNA, 22 bp, Homo sapiens
tggcaggttggcctttggttca

SEQ ID NO: 8580464 - DNA, 21 bp, Homo sapiens
tggcaggttcaaaggcctatc

SEQ ID NO: 8580465 - DNA, 16 bp, Homo sapiens
tggcaggtttttatct

SEQ ID NO: 8580466 - DNA, 22 bp, Homo sapiens
tggcaggtttcgttaaaaatgg

SEQ ID NO: 8580467 - DNA, 22 bp, Homo sapiens
tggccagtgattaatgacgctt

SEQ ID NO: 8580468 - DNA, 22 bp, Homo sapiens
tggccctgaggacccagtgtgg

SEQ ID NO: 8580469 - DNA, 22 bp, Homo sapiens
tggcctgagttgtctgcaggcc

SEQ ID NO: 8580470 - DNA, 22 bp, Homo sapiens
tggctcctttccgggtctccag

SEQ ID NO: 8580471 - DNA, 22 bp, Homo sapiens
tggctccttcattctcctgcca

SEQ ID NO: 8580472 - DNA, 21 bp, Homo sapiens
tggctctgctcagagcagtcc

SEQ ID NO: 8580473 - DNA, 22 bp, Homo sapiens
tggctctggccaccgggagggc

SEQ ID NO: 8580474 - DNA, 23 bp, Homo sapiens
tggctctgtgtcacatacaggat

SEQ ID NO: 8580475 - DNA, 22 bp, Homo sapiens
tggctctgttcgccatcaggag

SEQ ID NO: 8580476 - DNA, 19 bp, Homo sapiens
tggctctgtttctctggag

SEQ ID NO: 8580477 - DNA, 19 bp, Homo sapiens
tggctctttttatgacatt

SEQ ID NO: 8580478 - DNA, 22 bp, Homo sapiens
tggctcctggcaggtgtttcaa

SEQ ID NO: 8580479 - DNA, 18 bp, Homo sapiens
tggctcctgcctcctgca

SEQ ID NO: 8580480 - DNA, 22 bp, Homo sapiens
tggctcctccctgtgtgtgcgt

SEQ ID NO: 8580481 - DNA, 22 bp, Homo sapiens
tggctcctgcagaccatctgga

SEQ ID NO: 8580482 - DNA, 22 bp, Homo sapiens
tggctcctcttctgggtgtccc

SEQ ID NO: 8580483 - DNA, 22 bp, Homo sapiens
tggctcctaggatggtgcctgg

SEQ ID NO: 8580484 - DNA, 23 bp, Homo sapiens
tggctaaacagtggagaaagctt

SEQ ID NO: 8580485 - DNA, 22 bp, Homo sapiens
tggcggggcagctctggcttct

SEQ ID NO: 8580486 - DNA, 21 bp, Homo sapiens
tggcggggacttgtggctgcc

SEQ ID NO: 8580487 - DNA, 22 bp, Homo sapiens
tggccttgtgtttaagcaagaa

SEQ ID NO: 8580488 - DNA, 20 bp, Homo sapiens
tggccttggggagctcacac

SEQ ID NO: 8580489 - DNA, 22 bp, Homo sapiens
tggccttggagaggcacggccc

SEQ ID NO: 8580490 - DNA, 21 bp, Homo sapiens
tggcttttatggagctctggg

SEQ ID NO: 8580491 - DNA, 22 bp, Homo sapiens
tgggaaatattctaaaagtctt

SEQ ID NO: 8580492 - DNA, 22 bp, Homo sapiens
tgggagcagcagggagatgcgg

SEQ ID NO: 8580493 - DNA, 19 bp, Homo sapiens
tgggagaggcaacagagta

SEQ ID NO: 8580494 - DNA, 22 bp, Homo sapiens
tgggagaggctgccatcttgca

SEQ ID NO: 8580495 - DNA, 22 bp, Homo sapiens
tgggagagtctaaaaccgaggt

SEQ ID NO: 8580496 - DNA, 22 bp, Homo sapiens
tgggagagtgctcaatgtgcaa

SEQ ID NO: 8580497 - DNA, 22 bp, Homo sapiens
tgggagaatcttgctctgctac

SEQ ID NO: 8580498 - DNA, 22 bp, Homo sapiens
tgggaagggccgatggagcctc

SEQ ID NO: 8580499 - DNA, 22 bp, Homo sapiens
tgagggagtcatgattaaggaa

SEQ ID NO: 8580500 - DNA, 22 bp, Homo sapiens
tgagtagacgtgatctagtaac

SEQ ID NO: 8580501 - DNA, 22 bp, Homo sapiens
tgagtcttcttccgggattgct

SEQ ID NO: 8580502 - DNA, 22 bp, Homo sapiens
tgagtctttccaaagccgtcat

SEQ ID NO: 8580503 - DNA, 22 bp, Homo sapiens
tgaggtagaagcctgggttgag

SEQ ID NO: 8580504 - DNA, 23 bp, Homo sapiens
tgaggcaggcggatcacgaggtc

SEQ ID NO: 8580505 - DNA, 22 bp, Homo sapiens
tgaggcagggagtttaattgtc

SEQ ID NO: 8580506 - DNA, 22 bp, Homo sapiens
tgaggcagggagagtggatatg

SEQ ID NO: 8580507 - DNA, 22 bp, Homo sapiens
tgaggcagttcttacttgtatt

SEQ ID NO: 8580508 - DNA, 21 bp, Homo sapiens
tgaggcaggggtgcttttgtc

SEQ ID NO: 8580509 - DNA, 22 bp, Homo sapiens
tgaggcagttgagcttcctgag

SEQ ID NO: 8580510 - DNA, 22 bp, Homo sapiens
tgaggcaggagttcaggctgcg

SEQ ID NO: 8580511 - DNA, 22 bp, Homo sapiens
tgaggcaggatgcttgcacagg

SEQ ID NO: 8580512 - DNA, 22 bp, Homo sapiens
tgaggcaggaggattgcaggat

SEQ ID NO: 8580513 - DNA, 22 bp, Homo sapiens
tgaggcaggaggttgagaactg

SEQ ID NO: 8580514 - DNA, 22 bp, Homo sapiens
tgaggcaggaggttgagaactg

SEQ ID NO: 8580515 - DNA, 22 bp, Homo sapiens
tgaggcaggagttaatgtgctc

SEQ ID NO: 8580516 - DNA, 22 bp, Homo sapiens
tgaggcaggagaatggcgggaa

SEQ ID NO: 8580517 - DNA, 22 bp, Homo sapiens
tgaggccagagagtttgcattt

SEQ ID NO: 8580518 - DNA, 22 bp, Homo sapiens
tgaggcctgaagcctggagcct

SEQ ID NO: 8580519 - DNA, 22 bp, Homo sapiens
tgaggcaggacatggacaactg

SEQ ID NO: 8580520 - DNA, 22 bp, Homo sapiens
tgaggcaggaatggggaaaagt

SEQ ID NO: 8580521 - DNA, 22 bp, Homo sapiens
tgaggcaggaagttatataatg

SEQ ID NO: 8580522 - DNA, 22 bp, Homo sapiens
tgaggcagctttttctgtgtgt

SEQ ID NO: 8580523 - DNA, 22 bp, Homo sapiens
tgaggcagctttttctgtgtgt

SEQ ID NO: 8580524 - DNA, 22 bp, Homo sapiens
tgaggcaggactgagcgggatg

SEQ ID NO: 8580525 - DNA, 22 bp, Homo sapiens
tgaggcaggactgagcgggatg

SEQ ID NO: 8580526 - DNA, 22 bp, Homo sapiens
tgaggcaggacttgcataaagt

SEQ ID NO: 8580527 - DNA, 22 bp, Homo sapiens
tgaggcaggagaatcaccggaa

SEQ ID NO: 8580528 - DNA, 20 bp, Homo sapiens
tgaggcaggagaatggcatg

SEQ ID NO: 8580529 - DNA, 22 bp, Homo sapiens
tgaggcaggagaatcacatgaa

SEQ ID NO: 8580530 - DNA, 22 bp, Homo sapiens
tgaggaaattgaggctcacaga

SEQ ID NO: 8580531 - DNA, 22 bp, Homo sapiens
tgagctccggcatatggaatta

SEQ ID NO: 8580532 - DNA, 22 bp, Homo sapiens
tgagaatgtgcaatatccttcc

SEQ ID NO: 8580533 - DNA, 18 bp, Homo sapiens
tgagaatgtaagaaatgg

SEQ ID NO: 8580534 - DNA, 22 bp, Homo sapiens
tgagaagcccacactctttcct

SEQ ID NO: 8580535 - DNA, 22 bp, Homo sapiens
tgagaaatgggtctgctgaaga

SEQ ID NO: 8580536 - DNA, 22 bp, Homo sapiens
tgagagaggggactgcctgctt

SEQ ID NO: 8580537 - DNA, 22 bp, Homo sapiens
tgaactcctgacctcatgatcc

SEQ ID NO: 8580538 - DNA, 22 bp, Homo sapiens
tgaactcctgacctcatgatcc

SEQ ID NO: 8580539 - DNA, 22 bp, Homo sapiens
tgaacacacacatcttaataat

SEQ ID NO: 8580540 - DNA, 22 bp, Homo sapiens
tgaagcagaggggtcttgagct

SEQ ID NO: 8580541 - DNA, 22 bp, Homo sapiens
tgaagcagagtgaaggtgaatt

SEQ ID NO: 8580542 - DNA, 20 bp, Homo sapiens
tgaagcagccttgattctgt

SEQ ID NO: 8580543 - DNA, 19 bp, Homo sapiens
tgaagcagcaaactctcag

SEQ ID NO: 8580544 - DNA, 22 bp, Homo sapiens
tgaagcaggaaccagcagcatt

SEQ ID NO: 8580545 - DNA, 22 bp, Homo sapiens
tgaagcagttactgggtgttaa

SEQ ID NO: 8580546 - DNA, 22 bp, Homo sapiens
tgaagcagggtggccagattgt

SEQ ID NO: 8580547 - DNA, 22 bp, Homo sapiens
tgaagcaggtgaatggatgtcg

SEQ ID NO: 8580548 - DNA, 22 bp, Homo sapiens
tctttgctattgtgagtagtgc

SEQ ID NO: 8580549 - DNA, 21 bp, Homo sapiens
tcttttaacaccaggaattcc

SEQ ID NO: 8580550 - DNA, 22 bp, Homo sapiens
tcttttattaggctgaaatggg

SEQ ID NO: 8580551 - DNA, 21 bp, Homo sapiens
tgaaagaggatgtggtcattc

SEQ ID NO: 8580552 - DNA, 22 bp, Homo sapiens
tgaaagaagtgtcacattgcca

SEQ ID NO: 8580553 - DNA, 22 bp, Homo sapiens
tgaaagaactagcatcttcaag

SEQ ID NO: 8580554 - DNA, 22 bp, Homo sapiens
tgaaaccactgatggtaccaag

SEQ ID NO: 8580555 - DNA, 22 bp, Homo sapiens
tctttttttcctgtgcagagct

SEQ ID NO: 8580556 - DNA, 22 bp, Homo sapiens
tctttttcttattcccacactg

SEQ ID NO: 8580557 - DNA, 22 bp, Homo sapiens
tctttttatattgacaaaaggt

SEQ ID NO: 8580558 - DNA, 22 bp, Homo sapiens
tgaaaatgcacgctggaaagca

SEQ ID NO: 8580559 - DNA, 22 bp, Homo sapiens
tgacctattagatttccttgcc

SEQ ID NO: 8580560 - DNA, 22 bp, Homo sapiens
tgacttgtctctttgggagaca

SEQ ID NO: 8580561 - DNA, 22 bp, Homo sapiens
tgacttcctgcactcaggtgat

SEQ ID NO: 8580562 - DNA, 22 bp, Homo sapiens
tgacctgtgtttgctgttgctc

SEQ ID NO: 8580563 - DNA, 22 bp, Homo sapiens
tgactacaacctccacctcccg

SEQ ID NO: 8580564 - DNA, 18 bp, Homo sapiens
tgacagaacctggagcct

SEQ ID NO: 8580565 - DNA, 22 bp, Homo sapiens
tgacagaacaggttgggagcaa

SEQ ID NO: 8580566 - DNA, 22 bp, Homo sapiens
tgaagcagttctcagaagtggg

SEQ ID NO: 8580567 - DNA, 22 bp, Homo sapiens
tgaagccagggactgacacttc

SEQ ID NO: 8580568 - DNA, 22 bp, Homo sapiens
tgaagctgtgggcagtggagcc

SEQ ID NO: 8580569 - DNA, 22 bp, Homo sapiens
tgaagctggaagttaggtagac

SEQ ID NO: 8580570 - DNA, 23 bp, Homo sapiens
tgaaggtattacctgagatgctc

SEQ ID NO: 8580571 - DNA, 22 bp, Homo sapiens
tgaaggtcatggtaatattttt

SEQ ID NO: 8580572 - DNA, 22 bp, Homo sapiens
tgaaggtaaaggaaggaggctt

SEQ ID NO: 8580573 - DNA, 22 bp, Homo sapiens
tgaatgtgatgctaaacatatg

SEQ ID NO: 8580574 - DNA, 22 bp, Homo sapiens
tgaatgcttggagtcataaaat

SEQ ID NO: 8580575 - DNA, 20 bp, Homo sapiens
tgacaaagagtaagaggagg

SEQ ID NO: 8580576 - DNA, 23 bp, Homo sapiens
tgacaaagcgagactccagctca

SEQ ID NO: 8580577 - DNA, 22 bp, Homo sapiens
tgacaaagacaaagatatgtcc

SEQ ID NO: 8580578 - DNA, 22 bp, Homo sapiens
tgacaaaccctgcaaatagctc

SEQ ID NO: 8580579 - DNA, 18 bp, Homo sapiens
tgatctttgagtataatg

SEQ ID NO: 8580580 - DNA, 22 bp, Homo sapiens
tgatgcagtgtcctcccatgca

SEQ ID NO: 8580581 - DNA, 23 bp, Homo sapiens
tgatgcagtaaattggtctctaa

SEQ ID NO: 8580582 - DNA, 22 bp, Homo sapiens
tgatgatttcatttctagctgt

SEQ ID NO: 8580583 - DNA, 22 bp, Homo sapiens
tgatgattgggagacatttggg

SEQ ID NO: 8580584 - DNA, 22 bp, Homo sapiens
tgatgatttgaaaccagtttct

SEQ ID NO: 8580585 - DNA, 18 bp, Homo sapiens
tgatggaggagggctggt

SEQ ID NO: 8580586 - DNA, 22 bp, Homo sapiens
tgattcaataggaattgagtag

SEQ ID NO: 8580587 - DNA, 22 bp, Homo sapiens
tgatttaaaagaaacattgtct

SEQ ID NO: 8580588 - DNA, 22 bp, Homo sapiens
tgattctgttctccttgagaat

SEQ ID NO: 8580589 - DNA, 21 bp, Homo sapiens
tgagtgccacctgctggccaa

SEQ ID NO: 8580590 - DNA, 22 bp, Homo sapiens
tgagtcttttcattgtgtggat

SEQ ID NO: 8580591 - DNA, 22 bp, Homo sapiens
tgagtcttttatcctgggaatg

SEQ ID NO: 8580592 - DNA, 22 bp, Homo sapiens
tgagtggacacctgcttcttta

SEQ ID NO: 8580593 - DNA, 22 bp, Homo sapiens
tgataccctttggctgcgagca

SEQ ID NO: 8580594 - DNA, 22 bp, Homo sapiens
tgatcccaatctttcctgctcc

SEQ ID NO: 8580595 - DNA, 22 bp, Homo sapiens
tgcaaaaattgctggaatcttt

SEQ ID NO: 8580596 - DNA, 22 bp, Homo sapiens
tgcaaaaaggcagactggtgat

SEQ ID NO: 8580597 - DNA, 22 bp, Homo sapiens
tgcaaaaactgcaattgctttt

SEQ ID NO: 8580598 - DNA, 22 bp, Homo sapiens
tgcaaaaactgcaattgctttt

SEQ ID NO: 8580599 - DNA, 22 bp, Homo sapiens
tgattttctccattgtaaattc

SEQ ID NO: 8580600 - DNA, 20 bp, Homo sapiens
tgattttctgaaacagcaca

SEQ ID NO: 8580601 - DNA, 22 bp, Homo sapiens
tgattttcatgggtgatctttg

SEQ ID NO: 8580602 - DNA, 22 bp, Homo sapiens
tgatttttggatctgagctgca

SEQ ID NO: 8580603 - DNA, 22 bp, Homo sapiens
tgatttttagctattctgaaga

SEQ ID NO: 8580604 - DNA, 22 bp, Homo sapiens
tgcaaacagttaagatgcaggc

SEQ ID NO: 8580605 - DNA, 22 bp, Homo sapiens
tgcacaaacacagagaatagat

SEQ ID NO: 8580606 - DNA, 22 bp, Homo sapiens
tgcacaaagcattctagacgca

SEQ ID NO: 8580607 - DNA, 22 bp, Homo sapiens
tgcacaaaggctccctgctgag

SEQ ID NO: 8580608 - DNA, 22 bp, Homo sapiens
tgcaagaatgacccatctaccc

SEQ ID NO: 8580609 - DNA, 22 bp, Homo sapiens
tgcaagtaattccagctactga

SEQ ID NO: 8580610 - DNA, 22 bp, Homo sapiens
tgcaagtaacttgtttgggagg

SEQ ID NO: 8580611 - DNA, 22 bp, Homo sapiens
tgcaagtaaccatcactatctc

SEQ ID NO: 8580612 - DNA, 21 bp, Homo sapiens
tgcagcagaagtctctgtgtc

SEQ ID NO: 8580613 - DNA, 23 bp, Homo sapiens
tgcagaggcatgatcactgctca

SEQ ID NO: 8580614 - DNA, 21 bp, Homo sapiens
tgcactttgggggacaggctg

SEQ ID NO: 8580615 - DNA, 22 bp, Homo sapiens
tgcacttttatatcactctggc

SEQ ID NO: 8580616 - DNA, 22 bp, Homo sapiens
tgcacgtgggctctctgctctt

SEQ ID NO: 8580617 - DNA, 22 bp, Homo sapiens
tgcagaaggaggaggaaatcca

SEQ ID NO: 8580618 - DNA, 21 bp, Homo sapiens
tgcagcagatttgggggaaga

SEQ ID NO: 8580619 - DNA, 22 bp, Homo sapiens
tgcagcagagtgggcctgggtg

SEQ ID NO: 8580620 - DNA, 22 bp, Homo sapiens
tgcagcccttccttcctctggg

SEQ ID NO: 8580621 - DNA, 22 bp, Homo sapiens
tgcagcccaggcgtcaggtggt

SEQ ID NO: 8580622 - DNA, 22 bp, Homo sapiens
tgcagccccccagatggccgta

SEQ ID NO: 8580623 - DNA, 19 bp, Homo sapiens
tgcagcccctaccacattc

SEQ ID NO: 8580624 - DNA, 22 bp, Homo sapiens
tgcagcccctgaaaatggcagc

SEQ ID NO: 8580625 - DNA, 22 bp, Homo sapiens
tgcagcccctatcgcggacagg

SEQ ID NO: 8580626 - DNA, 22 bp, Homo sapiens
tgcagccctgtgcacatcccct

SEQ ID NO: 8580627 - DNA, 22 bp, Homo sapiens
tgcagccatttgaaaagcagtt

SEQ ID NO: 8580628 - DNA, 22 bp, Homo sapiens
tgcagcccagccccagaacctt

SEQ ID NO: 8580629 - DNA, 23 bp, Homo sapiens
tgcagccactcaggagctcagtg

SEQ ID NO: 8580630 - DNA, 22 bp, Homo sapiens
tgcaggagagtgagtcagtagg

SEQ ID NO: 8580631 - DNA, 22 bp, Homo sapiens
tgcaggagctgctgtcctgctc

SEQ ID NO: 8580632 - DNA, 22 bp, Homo sapiens
tgcagtctccacctcctgggtg

SEQ ID NO: 8580633 - DNA, 22 bp, Homo sapiens
tgcaggtctatttaaatgattg

SEQ ID NO: 8580634 - DNA, 22 bp, Homo sapiens
tgcaggtcatccctgtgcttct

SEQ ID NO: 8580635 - DNA, 22 bp, Homo sapiens
tgcaggtcatgtggcgggactg

SEQ ID NO: 8580636 - DNA, 22 bp, Homo sapiens
tgcaggtcatccctgtgcttct

SEQ ID NO: 8580637 - DNA, 22 bp, Homo sapiens
tgcaggtcaatcttcaggttcc

SEQ ID NO: 8580638 - DNA, 22 bp, Homo sapiens
tgcaggtctccattggcagact

SEQ ID NO: 8580639 - DNA, 22 bp, Homo sapiens
tgcaggtctctgcaaggcctat

SEQ ID NO: 8580640 - DNA, 22 bp, Homo sapiens
tgcattcctttgtctgttaaag

SEQ ID NO: 8580641 - DNA, 22 bp, Homo sapiens
tgccacctggacaaccttatgc

SEQ ID NO: 8580642 - DNA, 22 bp, Homo sapiens
tgccacctagtggtctttagtc

SEQ ID NO: 8580643 - DNA, 22 bp, Homo sapiens
tgccactggctcaatggtgcag

SEQ ID NO: 8580644 - DNA, 22 bp, Homo sapiens
tgccagccagggaagctcaccc

SEQ ID NO: 8580645 - DNA, 22 bp, Homo sapiens
tgcatgttaagaaaatattgag

SEQ ID NO: 8580646 - DNA, 22 bp, Homo sapiens
tgcatgtcaaggcactcaggat

SEQ ID NO: 8580647 - DNA, 22 bp, Homo sapiens
tgcataaaatatgagaaatgta

SEQ ID NO: 8580648 - DNA, 22 bp, Homo sapiens
tgcatacataaagtgctatcat

SEQ ID NO: 8580649 - DNA, 22 bp, Homo sapiens
tgcatcctcctttgtcctcttg

SEQ ID NO: 8580650 - DNA, 22 bp, Homo sapiens
tgcctccttcaggagggcccgg

SEQ ID NO: 8580651 - DNA, 22 bp, Homo sapiens
tgcctctgttgagccttggctg

SEQ ID NO: 8580652 - DNA, 22 bp, Homo sapiens
tgcctctgtgtgcaggtgagca

SEQ ID NO: 8580653 - DNA, 22 bp, Homo sapiens
tgcctggcacagagcaggtggc

SEQ ID NO: 8580654 - DNA, 22 bp, Homo sapiens
tgcctaggctggaatgcagtgg

SEQ ID NO: 8580655 - DNA, 22 bp, Homo sapiens
tgcctagttctgtatttacagt

SEQ ID NO: 8580656 - DNA, 22 bp, Homo sapiens
tgccgctccaggtctcgcggtg

SEQ ID NO: 8580657 - DNA, 22 bp, Homo sapiens
tgccctgggaggctttcctgtt

SEQ ID NO: 8580658 - DNA, 22 bp, Homo sapiens
tgccctggctggagtgcagtgg

SEQ ID NO: 8580659 - DNA, 22 bp, Homo sapiens
tgccctgggaacacagatgcca

SEQ ID NO: 8580660 - DNA, 22 bp, Homo sapiens
tgcccttgaggacagctcccag

SEQ ID NO: 8580661 - DNA, 22 bp, Homo sapiens
tgcccttgggtaacttgctgat

SEQ ID NO: 8580662 - DNA, 22 bp, Homo sapiens
tgccctgtgggtatctgatggc

SEQ ID NO: 8580663 - DNA, 22 bp, Homo sapiens
tgccctggctcttcttgttcca

SEQ ID NO: 8580664 - DNA, 22 bp, Homo sapiens
tgccctggaaccatctacagtc

SEQ ID NO: 8580665 - DNA, 22 bp, Homo sapiens
tgccatccaacagttccatctt

SEQ ID NO: 8580666 - DNA, 23 bp, Homo sapiens
tgccagggtttgtttgtggttca

SEQ ID NO: 8580667 - DNA, 22 bp, Homo sapiens
tgccagggtgtcaggagagcta

SEQ ID NO: 8580668 - DNA, 22 bp, Homo sapiens
tgccagggctgctactggctga

SEQ ID NO: 8580669 - DNA, 20 bp, Homo sapiens
tgccagggccagcagaggct

SEQ ID NO: 8580670 - DNA, 21 bp, Homo sapiens
tgccagggatttacagagcct

SEQ ID NO: 8580671 - DNA, 22 bp, Homo sapiens
tgccagctcccttttctcctcc

SEQ ID NO: 8580672 - DNA, 17 bp, Homo sapiens
tgccagcctgtcccagg

SEQ ID NO: 8580673 - DNA, 22 bp, Homo sapiens
tgccagcctcctgatatcatcc

SEQ ID NO: 8580674 - DNA, 22 bp, Homo sapiens
tgccccctggtggccagagccg

SEQ ID NO: 8580675 - DNA, 22 bp, Homo sapiens
tgcccagcactgtgccagtcac

SEQ ID NO: 8580676 - DNA, 22 bp, Homo sapiens
tgccatttctttcaatattctt

SEQ ID NO: 8580677 - DNA, 22 bp, Homo sapiens
tctcagctgactgctttcctcg

SEQ ID NO: 8580678 - DNA, 22 bp, Homo sapiens
tctcagctcttttttcacagaa

SEQ ID NO: 8580679 - DNA, 22 bp, Homo sapiens
tctcactcatttcctaggtctt

SEQ ID NO: 8580680 - DNA, 22 bp, Homo sapiens
tctcgatctcctgaccttgtga

SEQ ID NO: 8580681 - DNA, 22 bp, Homo sapiens
tctccttgctacccagtatgtc

SEQ ID NO: 8580682 - DNA, 22 bp, Homo sapiens
tctcgctctgtcgcccaggctg

SEQ ID NO: 8580683 - DNA, 22 bp, Homo sapiens
tctcgctctgtcgcccaggctg

SEQ ID NO: 8580684 - DNA, 22 bp, Homo sapiens
tctcccagaagtcctcagtaca

SEQ ID NO: 8580685 - DNA, 22 bp, Homo sapiens
tctcccagaggatcccagtgga

SEQ ID NO: 8580686 - DNA, 22 bp, Homo sapiens
tctcccagtgtctggcagtcag

SEQ ID NO: 8580687 - DNA, 22 bp, Homo sapiens
tctcccagtggtgcagaaagca

SEQ ID NO: 8580688 - DNA, 22 bp, Homo sapiens
tctcccagtcctctgtgcttac

SEQ ID NO: 8580689 - DNA, 22 bp, Homo sapiens
tctcccaggtcatacacagaga

SEQ ID NO: 8580690 - DNA, 22 bp, Homo sapiens
tctcccaggtgggtgcctggag

SEQ ID NO: 8580691 - DNA, 22 bp, Homo sapiens
tctcccaggctgccctgtggac

SEQ ID NO: 8580692 - DNA, 22 bp, Homo sapiens
tctcccaggctggagtgcagtg

SEQ ID NO: 8580693 - DNA, 20 bp, Homo sapiens
tctcccaggctcagggaaga

SEQ ID NO: 8580694 - DNA, 22 bp, Homo sapiens
tctcccaggcaggagtgcagtg

SEQ ID NO: 8580695 - DNA, 19 bp, Homo sapiens
tctcccagctgagaagggc

SEQ ID NO: 8580696 - DNA, 22 bp, Homo sapiens
tctcttcacactacccctgtgt

SEQ ID NO: 8580697 - DNA, 22 bp, Homo sapiens
tctcttctagcttcttgtggtt

SEQ ID NO: 8580698 - DNA, 22 bp, Homo sapiens
tctcttctaattagggtccatg

SEQ ID NO: 8580699 - DNA, 19 bp, Homo sapiens
tctcttctccctggtttta

SEQ ID NO: 8580700 - DNA, 18 bp, Homo sapiens
tctcttcttggcagtcaa

SEQ ID NO: 8580701 - DNA, 22 bp, Homo sapiens
tctcttctttggggtgggctca

SEQ ID NO: 8580702 - DNA, 22 bp, Homo sapiens
tctctttgaccctttagctcca

SEQ ID NO: 8580703 - DNA, 22 bp, Homo sapiens
tctgaaatactgcaggttctct

SEQ ID NO: 8580704 - DNA, 22 bp, Homo sapiens
tctctttgtctgctcttagttg

SEQ ID NO: 8580705 - DNA, 22 bp, Homo sapiens
tctctttgtggccaggagagga

SEQ ID NO: 8580706 - DNA, 23 bp, Homo sapiens
tctctgggtgggctgtgtctata

SEQ ID NO: 8580707 - DNA, 22 bp, Homo sapiens
tctctgggttctcactcagcac

SEQ ID NO: 8580708 - DNA, 20 bp, Homo sapiens
tctctgggttctcactcagc

SEQ ID NO: 8580709 - DNA, 22 bp, Homo sapiens
tctctgagcccaatgtagcaat

SEQ ID NO: 8580710 - DNA, 20 bp, Homo sapiens
tcctggagtattccatgctt

SEQ ID NO: 8580711 - DNA, 22 bp, Homo sapiens
tcctggagtaggccttagccat

SEQ ID NO: 8580712 - DNA, 22 bp, Homo sapiens
tcctggaggcaaatgagcacat

SEQ ID NO: 8580713 - DNA, 20 bp, Homo sapiens
tcctggaggcttcatccata

SEQ ID NO: 8580714 - DNA, 22 bp, Homo sapiens
tcctggccctgtggcctgcagt

SEQ ID NO: 8580715 - DNA, 22 bp, Homo sapiens
tcctggccgccgcgtggggccg

SEQ ID NO: 8580716 - DNA, 22 bp, Homo sapiens
tcctggcctagagtttgtgttc

SEQ ID NO: 8580717 - DNA, 22 bp, Homo sapiens
tcctggcccaatctgcccatga

SEQ ID NO: 8580718 - DNA, 22 bp, Homo sapiens
tcctggcccactatgccagcat

SEQ ID NO: 8580719 - DNA, 22 bp, Homo sapiens
tcctggcccggccgggcctgct

SEQ ID NO: 8580720 - DNA, 22 bp, Homo sapiens
tcctggcccgatccctgtgaag

SEQ ID NO: 8580721 - DNA, 21 bp, Homo sapiens
tcctggcccactctatcccca

SEQ ID NO: 8580722 - DNA, 17 bp, Homo sapiens
tcctggcctggtgtgtg

SEQ ID NO: 8580723 - DNA, 20 bp, Homo sapiens
tcctggcctccctggggctc

SEQ ID NO: 8580724 - DNA, 18 bp, Homo sapiens
tcctggccacactacctt

SEQ ID NO: 8580725 - DNA, 22 bp, Homo sapiens
tcctggagtggagtctgttgtt

SEQ ID NO: 8580726 - DNA, 22 bp, Homo sapiens
tcctggagttgtctgtactcat

SEQ ID NO: 8580727 - DNA, 22 bp, Homo sapiens
tcctgggactcaacttagaagg

SEQ ID NO: 8580728 - DNA, 22 bp, Homo sapiens
tcctgggaggcaggaccccttt

SEQ ID NO: 8580729 - DNA, 22 bp, Homo sapiens
tcctgggaagagacctgagcat

SEQ ID NO: 8580730 - DNA, 22 bp, Homo sapiens
tcctgggaagagacctgagcat

SEQ ID NO: 8580731 - DNA, 22 bp, Homo sapiens
tcctgggaagttgcatcaccgt

SEQ ID NO: 8580732 - DNA, 22 bp, Homo sapiens
tcctgggaagttgcatcaccgt

SEQ ID NO: 8580733 - DNA, 22 bp, Homo sapiens
tcctgggaccaggcacctactg

SEQ ID NO: 8580734 - DNA, 18 bp, Homo sapiens
tcctgggaacttgctagc

SEQ ID NO: 8580735 - DNA, 18 bp, Homo sapiens
tcctgggaacttgctagc

SEQ ID NO: 8580736 - DNA, 22 bp, Homo sapiens
tcctgggaactcggaaagctct

SEQ ID NO: 8580737 - DNA, 21 bp, Homo sapiens
tcctggctttatgctacctct

SEQ ID NO: 8580738 - DNA, 18 bp, Homo sapiens
tcctgggaaaggcataca

SEQ ID NO: 8580739 - DNA, 22 bp, Homo sapiens
tcctgggctgtgtgccactctg

SEQ ID NO: 8580740 - DNA, 22 bp, Homo sapiens
tcctgggcgattttctgaatat

SEQ ID NO: 8580741 - DNA, 22 bp, Homo sapiens
tcctgggcggttatgtgatctg

SEQ ID NO: 8580742 - DNA, 19 bp, Homo sapiens
tcctgggctgcgtcttgcc

SEQ ID NO: 8580743 - DNA, 22 bp, Homo sapiens
tcctgggcctgtactccatccg

SEQ ID NO: 8580744 - DNA, 22 bp, Homo sapiens
tcctgggcagcgggacgctcag

SEQ ID NO: 8580745 - DNA, 22 bp, Homo sapiens
tcctgggccaagggctgtgagg

SEQ ID NO: 8580746 - DNA, 22 bp, Homo sapiens
tcctgggattaaggtggtgatt

SEQ ID NO: 8580747 - DNA, 22 bp, Homo sapiens
tcctgggattctgcatttctaa

SEQ ID NO: 8580748 - DNA, 22 bp, Homo sapiens
tcctgggcagcctctctggaag

SEQ ID NO: 8580749 - DNA, 22 bp, Homo sapiens
tcctgggcacaagtgagtctcc

SEQ ID NO: 8580750 - DNA, 22 bp, Homo sapiens
tcctgggagtggccatgtaatg

SEQ ID NO: 8580751 - DNA, 22 bp, Homo sapiens
tcctgggatcaagtgatcctcc

SEQ ID NO: 8580752 - DNA, 21 bp, Homo sapiens
tcctgggagtctgagatcctg

SEQ ID NO: 8580753 - DNA, 22 bp, Homo sapiens
tcctgggagtaattgagtcatg

SEQ ID NO: 8580754 - DNA, 19 bp, Homo sapiens
tcctggggatgtggtcacc

SEQ ID NO: 8580755 - DNA, 22 bp, Homo sapiens
tcctggggctctttgatgtgat

SEQ ID NO: 8580756 - DNA, 21 bp, Homo sapiens
tcctggggggtaggtgagttt

SEQ ID NO: 8580757 - DNA, 22 bp, Homo sapiens
tcctgggttaattatgattcac

SEQ ID NO: 8580758 - DNA, 22 bp, Homo sapiens
tcctgggtgtgatattcataga

SEQ ID NO: 8580759 - DNA, 23 bp, Homo sapiens
tcctgggtttgaattctagtctt

SEQ ID NO: 8580760 - DNA, 22 bp, Homo sapiens
tcctgggtcccgcacatctgtc

SEQ ID NO: 8580761 - DNA, 22 bp, Homo sapiens
tcctgggtctgggtgtctgagg

SEQ ID NO: 8580762 - DNA, 22 bp, Homo sapiens
tcctggggtcctgactgcttcc

SEQ ID NO: 8580763 - DNA, 22 bp, Homo sapiens
tcctgtggtatgggagtgatgt

SEQ ID NO: 8580764 - DNA, 22 bp, Homo sapiens
tcctgtggaagacagtgttggg

SEQ ID NO: 8580765 - DNA, 22 bp, Homo sapiens
tcctgtggaagacagtgttggg

SEQ ID NO: 8580766 - DNA, 22 bp, Homo sapiens
tcctgtggagaggactggaggt

SEQ ID NO: 8580767 - DNA, 22 bp, Homo sapiens
tcctgtggcgttatcatgtgat

SEQ ID NO: 8580768 - DNA, 22 bp, Homo sapiens
tcctggtgtttatgtcacatag

SEQ ID NO: 8580769 - DNA, 22 bp, Homo sapiens
tcctggtggtgccagctgcagg

SEQ ID NO: 8580770 - DNA, 22 bp, Homo sapiens
tccttaaatgtgatctagattt

SEQ ID NO: 8580771 - DNA, 22 bp, Homo sapiens
tccttagacaaagagtgggctt

SEQ ID NO: 8580772 - DNA, 22 bp, Homo sapiens
tccttcaagatgccacagcttt

SEQ ID NO: 8580773 - DNA, 22 bp, Homo sapiens
tccttcaactttttacttgccc

SEQ ID NO: 8580774 - DNA, 22 bp, Homo sapiens
tccttcaaagctcctagtgagc

SEQ ID NO: 8580775 - DNA, 22 bp, Homo sapiens
tccttcaaagctcctagtgagc

SEQ ID NO: 8580776 - DNA, 22 bp, Homo sapiens
tccttcaaaagttgagagagcc

SEQ ID NO: 8580777 - DNA, 22 bp, Homo sapiens
tccttcaaaagttgagagagcc

SEQ ID NO: 8580778 - DNA, 22 bp, Homo sapiens
tccttcaagtgcagtacctgag

SEQ ID NO: 8580779 - DNA, 23 bp, Homo sapiens
tccttcaagttaggaagtgaaca

SEQ ID NO: 8580780 - DNA, 22 bp, Homo sapiens
tccttcaatcacccagtgggga

SEQ ID NO: 8580781 - DNA, 22 bp, Homo sapiens
tccttctttgacaagtggcaga

SEQ ID NO: 8580782 - DNA, 22 bp, Homo sapiens
tccttctttccccctagtcatt

SEQ ID NO: 8580783 - DNA, 22 bp, Homo sapiens
tccttggaggtgttcatctgcc

SEQ ID NO: 8580784 - DNA, 22 bp, Homo sapiens
tccttctcctccttgagtgaca

SEQ ID NO: 8580785 - DNA, 22 bp, Homo sapiens
tcgtgatctgtccacctcggcc

SEQ ID NO: 8580786 - DNA, 22 bp, Homo sapiens
tcgcccaggctggaagtgcagt

SEQ ID NO: 8580787 - DNA, 22 bp, Homo sapiens
tcgtgaagtcacaataaagtct

SEQ ID NO: 8580788 - DNA, 22 bp, Homo sapiens
tccttgggaaacatcatgtaat

SEQ ID NO: 8580789 - DNA, 22 bp, Homo sapiens
tcgaactcatagtcgtagctgt

SEQ ID NO: 8580790 - DNA, 22 bp, Homo sapiens
tcgaactcatagtcgtagctgt

SEQ ID NO: 8580791 - DNA, 22 bp, Homo sapiens
tctacagtgtcaatgtgtcttg

SEQ ID NO: 8580792 - DNA, 22 bp, Homo sapiens
tctagctgagggtaggagacct

SEQ ID NO: 8580793 - DNA, 22 bp, Homo sapiens
tctacctggagtccgttgttaa

SEQ ID NO: 8580794 - DNA, 19 bp, Homo sapiens
tctcaatgttcagaaagct

SEQ ID NO: 8580795 - DNA, 18 bp, Homo sapiens
tctcaaaaataatggctt

SEQ ID NO: 8580796 - DNA, 22 bp, Homo sapiens
tctggggtgcagcctggacata

SEQ ID NO: 8580797 - DNA, 22 bp, Homo sapiens
tctgggtgtggtatcttagcca

SEQ ID NO: 8580798 - DNA, 22 bp, Homo sapiens
tctgggtgccctttgctctgtt

SEQ ID NO: 8580799 - DNA, 22 bp, Homo sapiens
tctgggcttggattggctctgc

SEQ ID NO: 8580800 - DNA, 22 bp, Homo sapiens
tctgggctttacactgtgctta

SEQ ID NO: 8580801 - DNA, 22 bp, Homo sapiens
tctgggcttggattggctctgc

SEQ ID NO: 8580802 - DNA, 22 bp, Homo sapiens
tctgtcattagccttgactgta

SEQ ID NO: 8580803 - DNA, 22 bp, Homo sapiens
tctgtccagctctggggctcac

SEQ ID NO: 8580804 - DNA, 22 bp, Homo sapiens
tctgtggctgtgctgggccaga

SEQ ID NO: 8580805 - DNA, 22 bp, Homo sapiens
tctgtggcttcctatttcttgg

SEQ ID NO: 8580806 - DNA, 22 bp, Homo sapiens
tctgtggctgttatctttatat

SEQ ID NO: 8580807 - DNA, 22 bp, Homo sapiens
tctgtggcttgggcctgcctgt

SEQ ID NO: 8580808 - DNA, 22 bp, Homo sapiens
tctgtggctttcttatgttgta

SEQ ID NO: 8580809 - DNA, 23 bp, Homo sapiens
tctgtgtagccaggtctggaggg

SEQ ID NO: 8580810 - DNA, 22 bp, Homo sapiens
tctgtctttgagatctcagcct

SEQ ID NO: 8580811 - DNA, 22 bp, Homo sapiens
tctgtgtggtagtttcagtgaa

SEQ ID NO: 8580812 - DNA, 22 bp, Homo sapiens
tctgtgtgtgcctgttaatatt

SEQ ID NO: 8580813 - DNA, 22 bp, Homo sapiens
tctgtgtgggatagtttgagga

SEQ ID NO: 8580814 - DNA, 22 bp, Homo sapiens
tctgtgtgccctaaagcctgct

SEQ ID NO: 8580815 - DNA, 22 bp, Homo sapiens
tctgtgtgcccacctgacacct

SEQ ID NO: 8580816 - DNA, 22 bp, Homo sapiens
tcttataagcaaactgctgaga

SEQ ID NO: 8580817 - DNA, 22 bp, Homo sapiens
tcttataaaaggactcccattt

SEQ ID NO: 8580818 - DNA, 22 bp, Homo sapiens
tcttataatgttgaagggttgg

SEQ ID NO: 8580819 - DNA, 22 bp, Homo sapiens
tcttataatctctattttaatg

SEQ ID NO: 8580820 - DNA, 22 bp, Homo sapiens
tctgttttgtgtctctctggtg

SEQ ID NO: 8580821 - DNA, 22 bp, Homo sapiens
tctgttttgcataatgttcttt

SEQ ID NO: 8580822 - DNA, 23 bp, Homo sapiens
tctgttttgcaacatgtgacaag

SEQ ID NO: 8580823 - DNA, 22 bp, Homo sapiens
tctgttttcatttgtcttgaga

SEQ ID NO: 8580824 - DNA, 22 bp, Homo sapiens
tctgttttcatttgtcttgaga

SEQ ID NO: 8580825 - DNA, 22 bp, Homo sapiens
tcttgggagtcccaggacatag

SEQ ID NO: 8580826 - DNA, 22 bp, Homo sapiens
tcttggctgcagagccggcaag

SEQ ID NO: 8580827 - DNA, 22 bp, Homo sapiens
tcttggctcctcacagcatcag

SEQ ID NO: 8580828 - DNA, 22 bp, Homo sapiens
tcttgctagaatcatttggaga

SEQ ID NO: 8580829 - DNA, 22 bp, Homo sapiens
tcttgctaggagctatggaaga

SEQ ID NO: 8580830 - DNA, 22 bp, Homo sapiens
tcttgatgctttttctaaatgt

SEQ ID NO: 8580831 - DNA, 22 bp, Homo sapiens
tcttgagtgcgcttgggtgttc

SEQ ID NO: 8580832 - DNA, 19 bp, Homo sapiens
tcttgatgaggtttctcca

SEQ ID NO: 8580833 - DNA, 22 bp, Homo sapiens
tcttgaaggggggcagtgttga

SEQ ID NO: 8580834 - DNA, 22 bp, Homo sapiens
tcttggctacttaggaggattc

SEQ ID NO: 8580835 - DNA, 22 bp, Homo sapiens
tcttggaacttattattgtaga

SEQ ID NO: 8580836 - DNA, 22 bp, Homo sapiens
tcttggaatctccatagagtga

SEQ ID NO: 8580837 - DNA, 22 bp, Homo sapiens
tctttcagctcttcaggaccca

SEQ ID NO: 8580838 - DNA, 22 bp, Homo sapiens
tcttctgttttagattgcatac

SEQ ID NO: 8580839 - DNA, 22 bp, Homo sapiens
tcttctttggatgaaagaatat

SEQ ID NO: 8580840 - DNA, 22 bp, Homo sapiens
tcttctttgaatcatagtgacc

SEQ ID NO: 8580841 - DNA, 22 bp, Homo sapiens
tcttcacaccgggcagcaggaa

SEQ ID NO: 8580842 - DNA, 22 bp, Homo sapiens
tcttcaaaaatacaggttttca

SEQ ID NO: 8580843 - DNA, 22 bp, Homo sapiens
tcttcaaaccctggttttgtga

SEQ ID NO: 8580844 - DNA, 22 bp, Homo sapiens
tcttcaaaccctggctcttcct

SEQ ID NO: 8580845 - DNA, 22 bp, Homo sapiens
tctggagtctgagatctgagga

SEQ ID NO: 8580846 - DNA, 22 bp, Homo sapiens
tctggagtaattacagtgactg

SEQ ID NO: 8580847 - DNA, 21 bp, Homo sapiens
tctggagtcatctttaccata

SEQ ID NO: 8580848 - DNA, 22 bp, Homo sapiens
tctggagtagggtctgggaatt

SEQ ID NO: 8580849 - DNA, 22 bp, Homo sapiens
tctggagtgtgtgtattcagct

SEQ ID NO: 8580850 - DNA, 22 bp, Homo sapiens
tctggagttgtgcagtggacct

SEQ ID NO: 8580851 - DNA, 22 bp, Homo sapiens
tctggcccaagttttcggtgag

SEQ ID NO: 8580852 - DNA, 22 bp, Homo sapiens
tctggcccagcccctgaggtca

SEQ ID NO: 8580853 - DNA, 22 bp, Homo sapiens
tctgggagttagaatacatggg

SEQ ID NO: 8580854 - DNA, 22 bp, Homo sapiens
tctgggaggtgttttgagaact

SEQ ID NO: 8580855 - DNA, 22 bp, Homo sapiens
tctgggaggtgttttgagaact

SEQ ID NO: 8580856 - DNA, 22 bp, Homo sapiens
tctgggagtgaagcaacagatg

SEQ ID NO: 8580857 - DNA, 22 bp, Homo sapiens
tctgggagagcacgtggctgac

SEQ ID NO: 8580858 - DNA, 22 bp, Homo sapiens
tctgggagagggaaagaagact

SEQ ID NO: 8580859 - DNA, 22 bp, Homo sapiens
tctgggagaagctgatgtgaag

SEQ ID NO: 8580860 - DNA, 22 bp, Homo sapiens
tctggcccctggcagtcctgga

SEQ ID NO: 8580861 - DNA, 22 bp, Homo sapiens
tctggccccgcatgcactttat

SEQ ID NO: 8580862 - DNA, 22 bp, Homo sapiens
tctggccccggtcttcacagct

SEQ ID NO: 8580863 - DNA, 23 bp, Homo sapiens
tctggctttgctggaagttttga

SEQ ID NO: 8580864 - DNA, 19 bp, Homo sapiens
tctggctgccaaggattga

SEQ ID NO: 8580865 - DNA, 22 bp, Homo sapiens
tctggctgcgtggcctttagca

SEQ ID NO: 8580866 - DNA, 22 bp, Homo sapiens
tctgcccttggctctcttgttg

SEQ ID NO: 8580867 - DNA, 22 bp, Homo sapiens
tctgcctgagggagctgaggaa

SEQ ID NO: 8580868 - DNA, 22 bp, Homo sapiens
tctgcaggcatttttggttgtc

SEQ ID NO: 8580869 - DNA, 22 bp, Homo sapiens
tctgcagcttactttcacatga

SEQ ID NO: 8580870 - DNA, 22 bp, Homo sapiens
tctgcaggactgaggcctgttt

SEQ ID NO: 8580871 - DNA, 22 bp, Homo sapiens
tctgcatattgttaatggaatg

SEQ ID NO: 8580872 - DNA, 22 bp, Homo sapiens
tctgaggccctaccctgagcct

SEQ ID NO: 8580873 - DNA, 22 bp, Homo sapiens
tctgcaaacttaagttgaaata

SEQ ID NO: 8580874 - DNA, 22 bp, Homo sapiens
tctgacccgtggctctgcctcc

SEQ ID NO: 8580875 - DNA, 22 bp, Homo sapiens
acatttctcttgatgtctctat

SEQ ID NO: 8580876 - DNA, 22 bp, Homo sapiens
aaggctcaattaactaagaagt

SEQ ID NO: 8580877 - DNA, 22 bp, Homo sapiens
acattttacagttgtctggcta

SEQ ID NO: 8580878 - DNA, 22 bp, Homo sapiens
accctgatataggtccaagagc

SEQ ID NO: 8580879 - DNA, 22 bp, Homo sapiens
acatatgcgatcataggatgca

SEQ ID NO: 8580880 - DNA, 22 bp, Homo sapiens
acagtgtttaaaaatcagatct

SEQ ID NO: 8580881 - DNA, 22 bp, Homo sapiens
aagcattttgttttaagaatga

SEQ ID NO: 8580882 - DNA, 22 bp, Homo sapiens
acctacagatctttgaatgtgt

SEQ ID NO: 8580883 - DNA, 22 bp, Homo sapiens
acctacagagatctgcattttt

SEQ ID NO: 8580884 - DNA, 22 bp, Homo sapiens
actgagttatgggtatgccttg

SEQ ID NO: 8580885 - DNA, 22 bp, Homo sapiens
aatcaggacccactctacagtt

SEQ ID NO: 8580886 - DNA, 22 bp, Homo sapiens
acaagcagagattaaatgtttt

SEQ ID NO: 8580887 - DNA, 22 bp, Homo sapiens
aattgcatatatatgaggccat

SEQ ID NO: 8580888 - DNA, 22 bp, Homo sapiens
aattgcataaaattcaactctg

SEQ ID NO: 8580889 - DNA, 22 bp, Homo sapiens
aattgcataaatttcatagcat

SEQ ID NO: 8580890 - DNA, 22 bp, Homo sapiens
aattgcatgttaatgactaagt

SEQ ID NO: 8580891 - DNA, 22 bp, Homo sapiens
aattgcattacagaaactttca

SEQ ID NO: 8580892 - DNA, 22 bp, Homo sapiens
aattgatggacagagatgaaga

SEQ ID NO: 8580893 - DNA, 22 bp, Homo sapiens
agaggcttgacaatatgattgg

SEQ ID NO: 8580894 - DNA, 22 bp, Homo sapiens
agaggcttctttctgatttgcg

SEQ ID NO: 8580895 - DNA, 22 bp, Homo sapiens
acagaattaatgaaaattacaa

SEQ ID NO: 8580896 - DNA, 22 bp, Homo sapiens
agcagagaggaggtggccctgt

SEQ ID NO: 8580897 - DNA, 18 bp, Homo sapiens
agcagagagtgaatggga

SEQ ID NO: 8580898 - DNA, 22 bp, Homo sapiens
agcagcaaaagagaatagtttg

SEQ ID NO: 8580899 - DNA, 22 bp, Homo sapiens
acacagagtttgacacatggga

SEQ ID NO: 8580900 - DNA, 22 bp, Homo sapiens
acacagagttattatgtgaact

SEQ ID NO: 8580901 - DNA, 22 bp, Homo sapiens
acacagagcttctcaactggga

SEQ ID NO: 8580902 - DNA, 22 bp, Homo sapiens
acacagaggcatgacagtggct

SEQ ID NO: 8580903 - DNA, 22 bp, Homo sapiens
aaagtgattatgctgtcaaaga

SEQ ID NO: 8580904 - DNA, 22 bp, Homo sapiens
aaagtttccaagttacaccatt

SEQ ID NO: 8580905 - DNA, 22 bp, Homo sapiens
aaatctgtttcaggtatatttg

SEQ ID NO: 8580906 - DNA, 22 bp, Homo sapiens
aagatgtttagatttatacaat

SEQ ID NO: 8580907 - DNA, 22 bp, Homo sapiens
aagaaataagacttctctgtcc

SEQ ID NO: 8580908 - DNA, 22 bp, Homo sapiens
aaagatgttttataagttatgg

SEQ ID NO: 8580909 - DNA, 22 bp, Homo sapiens
aaagatttgagttctgcttata

SEQ ID NO: 8580910 - DNA, 22 bp, Homo sapiens
aaagcagaggtgatatgactta

SEQ ID NO: 8580911 - DNA, 22 bp, Homo sapiens
aacataatgtggccaaagtcac

SEQ ID NO: 8580912 - DNA, 22 bp, Homo sapiens
aaagatgtgtaagaaataaaca

SEQ ID NO: 8580913 - DNA, 22 bp, Homo sapiens
aaacatgatgtcatatatgcca

SEQ ID NO: 8580914 - DNA, 22 bp, Homo sapiens
aaacatgtaagttcagatcacc

SEQ ID NO: 8580915 - DNA, 22 bp, Homo sapiens
aaacagcaatggagaagccagg

SEQ ID NO: 8580916 - DNA, 22 bp, Homo sapiens
aaaaggatgttttcatgaaaca

SEQ ID NO: 8580917 - DNA, 22 bp, Homo sapiens
aaaaactgcaattacttttgtc

SEQ ID NO: 8580918 - DNA, 22 bp, Homo sapiens
aaacagtattatcaatatattt

SEQ ID NO: 8580919 - DNA, 22 bp, Homo sapiens
aaaatatgaagttgtcagtatg

SEQ ID NO: 8580920 - DNA, 22 bp, Homo sapiens
aaacagtaagttctagtattat

SEQ ID NO: 8580921 - DNA, 22 bp, Homo sapiens
aaacagtactcgatttttgtag

SEQ ID NO: 8580922 - DNA, 22 bp, Homo sapiens
aaacagtagaagtgtattttat

SEQ ID NO: 8580923 - DNA, 22 bp, Homo sapiens
aaacacattagccctgtggaaa

SEQ ID NO: 8580924 - DNA, 22 bp, Homo sapiens
aagaaacaaccactgctctcct

SEQ ID NO: 8580925 - DNA, 20 bp, Homo sapiens
aagaaacttgaaagtacaag

SEQ ID NO: 8580926 - DNA, 22 bp, Homo sapiens
acacaaagttggatgacaaaat

SEQ ID NO: 8580927 - DNA, 22 bp, Homo sapiens
aagagcaacttggaaacactca

SEQ ID NO: 8580928 - DNA, 21 bp, Homo sapiens
acagcagagatcaagactaag

SEQ ID NO: 8580929 - DNA, 22 bp, Homo sapiens
aagcagagcctgagacagggat

SEQ ID NO: 8580930 - DNA, 22 bp, Homo sapiens
aagcaatagggtaatctactca

SEQ ID NO: 8580931 - DNA, 22 bp, Homo sapiens
aagcaatatactgatatgatta

SEQ ID NO: 8580932 - DNA, 20 bp, Homo sapiens
aagcaatatagtgcaaatgt

SEQ ID NO: 8580933 - DNA, 22 bp, Homo sapiens
aagcaataatcccaaagtgctg

SEQ ID NO: 8580934 - DNA, 22 bp, Homo sapiens
aagcaataaataatttttagta

SEQ ID NO: 8580935 - DNA, 22 bp, Homo sapiens
aagatgttagaggtcatgcaga

SEQ ID NO: 8580936 - DNA, 22 bp, Homo sapiens
aatagattcatggttaagagca

SEQ ID NO: 8580937 - DNA, 22 bp, Homo sapiens
aacatcatcatgaacaactaat

SEQ ID NO: 8580938 - DNA, 22 bp, Homo sapiens
aacataaatttgaagtggcaaa

SEQ ID NO: 8580939 - DNA, 22 bp, Homo sapiens
aatgctttcaaaaatgtgcagt

SEQ ID NO: 8580940 - DNA, 22 bp, Homo sapiens
aacatgtgtcttgcatttcttg

SEQ ID NO: 8580941 - DNA, 22 bp, Homo sapiens
aaatgtcagaagctttacttct

SEQ ID NO: 8580942 - DNA, 22 bp, Homo sapiens
aaatgtcagaggaacatattga

SEQ ID NO: 8580943 - DNA, 22 bp, Homo sapiens
aacacagatcaaaatatttcct

SEQ ID NO: 8580944 - DNA, 22 bp, Homo sapiens
aacagaatcttgggttcttttc

SEQ ID NO: 8580945 - DNA, 22 bp, Homo sapiens
aggaatgtaaatctagatttta

SEQ ID NO: 8580946 - DNA, 22 bp, Homo sapiens
acataaatagattattgggagg

SEQ ID NO: 8580947 - DNA, 22 bp, Homo sapiens
acagtgttttcttaaggagaaa

SEQ ID NO: 8580948 - DNA, 22 bp, Homo sapiens
accctcaacaaattcactctat

SEQ ID NO: 8580949 - DNA, 22 bp, Homo sapiens
acccaggcgggagtgcagtgtc

SEQ ID NO: 8580950 - DNA, 22 bp, Homo sapiens
acccaggctagggtgcagtggc

SEQ ID NO: 8580951 - DNA, 22 bp, Homo sapiens
acccaggctagagtgcagtggt

SEQ ID NO: 8580952 - DNA, 22 bp, Homo sapiens
agggaagcagcagccgcctgtc

SEQ ID NO: 8580953 - DNA, 22 bp, Homo sapiens
agggaagcaggaatagctctga

SEQ ID NO: 8580954 - DNA, 22 bp, Homo sapiens
agggaagcaatgattattattc

SEQ ID NO: 8580955 - DNA, 22 bp, Homo sapiens
agggaagcaatattagatatca

SEQ ID NO: 8580956 - DNA, 22 bp, Homo sapiens
agggaagctgctgggtccacct

SEQ ID NO: 8580957 - DNA, 22 bp, Homo sapiens
agggaagcttgttactgagaag

SEQ ID NO: 8580958 - DNA, 22 bp, Homo sapiens
agggaagccccgaggaggcacc

SEQ ID NO: 8580959 - DNA, 22 bp, Homo sapiens
agggaagccaagccttagagaa

SEQ ID NO: 8580960 - DNA, 22 bp, Homo sapiens
agggaagccctggctgagaccc

SEQ ID NO: 8580961 - DNA, 22 bp, Homo sapiens
aggctaggggaacactagaatc

SEQ ID NO: 8580962 - DNA, 22 bp, Homo sapiens
aggctatttccactcttctcat

SEQ ID NO: 8580963 - DNA, 22 bp, Homo sapiens
actgtgaatcactactagtaga

SEQ ID NO: 8580964 - DNA, 22 bp, Homo sapiens
agtttacacttttgattcttat

SEQ ID NO: 8580965 - DNA, 22 bp, Homo sapiens
agttgcagccttcaggagaccc

SEQ ID NO: 8580966 - DNA, 22 bp, Homo sapiens
acttgcatttaaatattgaata

SEQ ID NO: 8580967 - DNA, 22 bp, Homo sapiens
acttgcatgtcaggaaattaac

SEQ ID NO: 8580968 - DNA, 22 bp, Homo sapiens
atccacttgccactgtatagtt

SEQ ID NO: 8580969 - DNA, 22 bp, Homo sapiens
atccacttggctggttgttcta

SEQ ID NO: 8580970 - DNA, 22 bp, Homo sapiens
agaaacagaagggaaagctttt

SEQ ID NO: 8580971 - DNA, 22 bp, Homo sapiens
agaaacagaagggaaagctttt

SEQ ID NO: 8580972 - DNA, 20 bp, Homo sapiens
agaaacagcacaattctgtt

SEQ ID NO: 8580973 - DNA, 20 bp, Homo sapiens
agaaacagcacaattctgtt

SEQ ID NO: 8580974 - DNA, 22 bp, Homo sapiens
agaaacatcattggaacacaag

SEQ ID NO: 8580975 - DNA, 22 bp, Homo sapiens
agaaacatcattgtttggtatt

SEQ ID NO: 8580976 - DNA, 22 bp, Homo sapiens
agaaacagcattagcatcaatt

SEQ ID NO: 8580977 - DNA, 22 bp, Homo sapiens
agaaacagcattagcatcaatt

SEQ ID NO: 8580978 - DNA, 22 bp, Homo sapiens
agaaacatttagattatatgtc

SEQ ID NO: 8580979 - DNA, 22 bp, Homo sapiens
agaaacatcctgctttccattt

SEQ ID NO: 8580980 - DNA, 22 bp, Homo sapiens
agaaacatcgcttagtcctcat

SEQ ID NO: 8580981 - DNA, 23 bp, Homo sapiens
atcaccagcggaagctgcagacc

SEQ ID NO: 8580982 - DNA, 22 bp, Homo sapiens
atcaccaggcaaaatgtcagag

SEQ ID NO: 8580983 - DNA, 22 bp, Homo sapiens
atatataacctggataaggctt

SEQ ID NO: 8580984 - DNA, 22 bp, Homo sapiens
atatatttgagaatattcatga

SEQ ID NO: 8580985 - DNA, 22 bp, Homo sapiens
atatatttactctcctgttgca

SEQ ID NO: 8580986 - DNA, 22 bp, Homo sapiens
agaaacaacttgtttctcttgc

SEQ ID NO: 8580987 - DNA, 22 bp, Homo sapiens
agaaacagaaccaggtgtcatt

SEQ ID NO: 8580988 - DNA, 22 bp, Homo sapiens
actgcaacacctcctgggttca

SEQ ID NO: 8580989 - DNA, 22 bp, Homo sapiens
actgcaacctccacctcctggg

SEQ ID NO: 8580990 - DNA, 22 bp, Homo sapiens
actgcaacctccacctcctggg

SEQ ID NO: 8580991 - DNA, 22 bp, Homo sapiens
actgcaaagggaagccctttct

SEQ ID NO: 8580992 - DNA, 22 bp, Homo sapiens
actgcaaaaatgggtgcattca

SEQ ID NO: 8580993 - DNA, 22 bp, Homo sapiens
actgcaaacatagtacttgagc

SEQ ID NO: 8580994 - DNA, 22 bp, Homo sapiens
actggatggtgtcatgagcagc

SEQ ID NO: 8580995 - DNA, 22 bp, Homo sapiens
accttcagacatcaactatctc

SEQ ID NO: 8580996 - DNA, 21 bp, Homo sapiens
accttcagtgttctcagctgc

SEQ ID NO: 8580997 - DNA, 22 bp, Homo sapiens
accttcaggtgagcacacagat

SEQ ID NO: 8580998 - DNA, 22 bp, Homo sapiens
actaaagtcatcaaagaacttt

SEQ ID NO: 8580999 - DNA, 22 bp, Homo sapiens
agcagtttgaatcaatggccag

SEQ ID NO: 8581000 - DNA, 22 bp, Homo sapiens
agcagttgtagtcatggaaaat

SEQ ID NO: 8581001 - DNA, 22 bp, Homo sapiens
agcagctgggctcagagctggg

SEQ ID NO: 8581002 - DNA, 22 bp, Homo sapiens
cacagtatgatctaaagtaagt

SEQ ID NO: 8581003 - DNA, 22 bp, Homo sapiens
cacagtattcactgggcagatt

SEQ ID NO: 8581004 - DNA, 22 bp, Homo sapiens
caaatgtttggtggcattttgt

SEQ ID NO: 8581005 - DNA, 22 bp, Homo sapiens
caaatgtttcttatctattgtt

SEQ ID NO: 8581006 - DNA, 22 bp, Homo sapiens
caaatgttattcattcttgttt

SEQ ID NO: 8581007 - DNA, 22 bp, Homo sapiens
agcccggcttccccggttgcta

SEQ ID NO: 8581008 - DNA, 22 bp, Homo sapiens
cagcagagcttattaactaaaa

SEQ ID NO: 8581009 - DNA, 22 bp, Homo sapiens
cagcagaggttggaacagttct

SEQ ID NO: 8581010 - DNA, 22 bp, Homo sapiens
cagcagaggtggttcacattgt

SEQ ID NO: 8581011 - DNA, 22 bp, Homo sapiens
cagcagagggagccattgaaat

SEQ ID NO: 8581012 - DNA, 22 bp, Homo sapiens
cagcagaggaaagcaaatctaa

SEQ ID NO: 8581013 - DNA, 17 bp, Homo sapiens
agcaaaagtatcaaagc

SEQ ID NO: 8581014 - DNA, 22 bp, Homo sapiens
atttaaattttctgatggagag

SEQ ID NO: 8581015 - DNA, 22 bp, Homo sapiens
attagcaaggcagcatcaggca

SEQ ID NO: 8581016 - DNA, 22 bp, Homo sapiens
atgtttgctattgttctagtgg

SEQ ID NO: 8581017 - DNA, 23 bp, Homo sapiens
atgtttgcagtaacccatcctgg

SEQ ID NO: 8581018 - DNA, 22 bp, Homo sapiens
atgtttctgaagtttacagata

SEQ ID NO: 8581019 - DNA, 22 bp, Homo sapiens
attcacagttcattagctgtaa

SEQ ID NO: 8581020 - DNA, 22 bp, Homo sapiens
atggagtttggggtcaaatact

SEQ ID NO: 8581021 - DNA, 19 bp, Homo sapiens
atggaaaatgccagactga

SEQ ID NO: 8581022 - DNA, 22 bp, Homo sapiens
atggaaatcaggttcatccaag

SEQ ID NO: 8581023 - DNA, 22 bp, Homo sapiens
atggaaatccaagtcaccgtag

SEQ ID NO: 8581024 - DNA, 22 bp, Homo sapiens
atgtcaaatcagttttatcaga

SEQ ID NO: 8581025 - DNA, 22 bp, Homo sapiens
agaagacagagtctacattcta

SEQ ID NO: 8581026 - DNA, 22 bp, Homo sapiens
agaatacatcaatctattttct

SEQ ID NO: 8581027 - DNA, 22 bp, Homo sapiens
cattatgttcagtagcttaaaa

SEQ ID NO: 8581028 - DNA, 22 bp, Homo sapiens
catgccatttggtggattgaga

SEQ ID NO: 8581029 - DNA, 22 bp, Homo sapiens
catgccatgtgtgaggagagga

SEQ ID NO: 8581030 - DNA, 20 bp, Homo sapiens
catgccatgtctactgaggc

SEQ ID NO: 8581031 - DNA, 22 bp, Homo sapiens
aggacagcaaccgttattcaca

SEQ ID NO: 8581032 - DNA, 22 bp, Homo sapiens
aggaagcttggggcagggctac

SEQ ID NO: 8581033 - DNA, 22 bp, Homo sapiens
aggacagcccccaacagcaaca

SEQ ID NO: 8581034 - DNA, 22 bp, Homo sapiens
agctgggaagagttttctgcag

SEQ ID NO: 8581035 - DNA, 22 bp, Homo sapiens
ccatgaattcactccatgctag

SEQ ID NO: 8581036 - DNA, 22 bp, Homo sapiens
cccttcagggttaagtagaggg

SEQ ID NO: 8581037 - DNA, 22 bp, Homo sapiens
cgggttcacgccattctcctgc

SEQ ID NO: 8581038 - DNA, 22 bp, Homo sapiens
aggtggctctgacagctctggt

SEQ ID NO: 8581039 - DNA, 22 bp, Homo sapiens
cggctcactgcagctccgcctc

SEQ ID NO: 8581040 - DNA, 22 bp, Homo sapiens
cggctcactgcagctccgcctc

SEQ ID NO: 8581041 - DNA, 22 bp, Homo sapiens
ataatattgagtcaggacctga

SEQ ID NO: 8581042 - DNA, 22 bp, Homo sapiens
atacttctggtgacaaagtctt

SEQ ID NO: 8581043 - DNA, 18 bp, Homo sapiens
agttgcttattctgtgca

SEQ ID NO: 8581044 - DNA, 23 bp, Homo sapiens
atatgtcatgcaccagcacttta

SEQ ID NO: 8581045 - DNA, 22 bp, Homo sapiens
atcatttttaagagactcttct

SEQ ID NO: 8581046 - DNA, 22 bp, Homo sapiens
gggaagctgcgtggtctagggc

SEQ ID NO: 8581047 - DNA, 22 bp, Homo sapiens
gggaagctgaagctagagaaaa

SEQ ID NO: 8581048 - DNA, 23 bp, Homo sapiens
gggaagctccatggaggtgctgg

SEQ ID NO: 8581049 - DNA, 22 bp, Homo sapiens
cagcaatagtgtgtttgtttca

SEQ ID NO: 8581050 - DNA, 22 bp, Homo sapiens
cagcagagctgtgtgggaaggg

SEQ ID NO: 8581051 - DNA, 22 bp, Homo sapiens
cagcagagtttggcttctaatg

SEQ ID NO: 8581052 - DNA, 22 bp, Homo sapiens
gtattttactgctcaaagctct

SEQ ID NO: 8581053 - DNA, 22 bp, Homo sapiens
cagcattgtaagaatgaagacc

SEQ ID NO: 8581054 - DNA, 17 bp, Homo sapiens
ggaaaagaagagtagga

SEQ ID NO: 8581055 - DNA, 22 bp, Homo sapiens
cacccaggttggagtgcagtgg

SEQ ID NO: 8581056 - DNA, 22 bp, Homo sapiens
cacccaggctggaatgcaatgg

SEQ ID NO: 8581057 - DNA, 22 bp, Homo sapiens
cacccaggctagagtgcagtgg

SEQ ID NO: 8581058 - DNA, 22 bp, Homo sapiens
atgtgaaaaatttcttattaca

SEQ ID NO: 8581059 - DNA, 22 bp, Homo sapiens
atgtgaaacctgtgagtagagt

SEQ ID NO: 8581060 - DNA, 22 bp, Homo sapiens
atgtgaaaatccaatggcagca

SEQ ID NO: 8581061 - DNA, 22 bp, Homo sapiens
atggaaatgatggaacattaaa

SEQ ID NO: 8581062 - DNA, 21 bp, Homo sapiens
atggaaattggcaaatgctac

SEQ ID NO: 8581063 - DNA, 22 bp, Homo sapiens
atggaaatgttccatatattga

SEQ ID NO: 8581064 - DNA, 22 bp, Homo sapiens
gagaaatgagtgattcactttt

SEQ ID NO: 8581065 - DNA, 22 bp, Homo sapiens
cttgcctttgtcttcaaaggct

SEQ ID NO: 8581066 - DNA, 22 bp, Homo sapiens
atgaaatatcttgaagaaattc

SEQ ID NO: 8581067 - DNA, 22 bp, Homo sapiens
atgcagaatcttgagaaaaatt

SEQ ID NO: 8581068 - DNA, 22 bp, Homo sapiens
atgcaaatcttaagtatgtgtg

SEQ ID NO: 8581069 - DNA, 22 bp, Homo sapiens
atgcaaataaacagtctagttg

SEQ ID NO: 8581070 - DNA, 22 bp, Homo sapiens
atgcatgatcctgagcaaccca

SEQ ID NO: 8581071 - DNA, 22 bp, Homo sapiens
atgcatttatgtgtgtacattg

SEQ ID NO: 8581072 - DNA, 22 bp, Homo sapiens
atgagttcattgcatttgacag

SEQ ID NO: 8581073 - DNA, 22 bp, Homo sapiens
atgtttttggcttcaagtttct

SEQ ID NO: 8581074 - DNA, 22 bp, Homo sapiens
atgtttttcataccagtgttgg

SEQ ID NO: 8581075 - DNA, 22 bp, Homo sapiens
attacaaaagaagggagaaggt

SEQ ID NO: 8581076 - DNA, 22 bp, Homo sapiens
attcttaattccaaagactgag

SEQ ID NO: 8581077 - DNA, 22 bp, Homo sapiens
attctatctctatatttctgca

SEQ ID NO: 8581078 - DNA, 22 bp, Homo sapiens
attctattaatatttctaggaa

SEQ ID NO: 8581079 - DNA, 22 bp, Homo sapiens
attctattttttaagaagtagt

SEQ ID NO: 8581080 - DNA, 21 bp, Homo sapiens
attcagagtaattcatcttta

SEQ ID NO: 8581081 - DNA, 22 bp, Homo sapiens
attcagagattgttattcagac

SEQ ID NO: 8581082 - DNA, 22 bp, Homo sapiens
attcctgaagaaggtatgttgc

SEQ ID NO: 8581083 - DNA, 22 bp, Homo sapiens
attcctgagacttatctgtttc

SEQ ID NO: 8581084 - DNA, 22 bp, Homo sapiens
atttaattttctcaacagtgct

SEQ ID NO: 8581085 - DNA, 22 bp, Homo sapiens
atttcagaatgtcctaatttag

SEQ ID NO: 8581086 - DNA, 21 bp, Homo sapiens
atttcagagcacacaagtaaa

SEQ ID NO: 8581087 - DNA, 22 bp, Homo sapiens
atttctacagtacacatgcatt

SEQ ID NO: 8581088 - DNA, 22 bp, Homo sapiens
caaaacattcagagagctcact

SEQ ID NO: 8581089 - DNA, 22 bp, Homo sapiens
attttttagaacctggcctgat

SEQ ID NO: 8581090 - DNA, 22 bp, Homo sapiens
caaactctgtaggacagttcaa

SEQ ID NO: 8581091 - DNA, 22 bp, Homo sapiens
tattgcatttcccacgttcact

SEQ ID NO: 8581092 - DNA, 22 bp, Homo sapiens
catgcaaaatgtattttattag

SEQ ID NO: 8581093 - DNA, 22 bp, Homo sapiens
catgtgaattccaaagctaggt

SEQ ID NO: 8581094 - DNA, 22 bp, Homo sapiens
catgatgtcacagagaagcaca

SEQ ID NO: 8581095 - DNA, 22 bp, Homo sapiens
tcatgtaaatgtggatgcttcc

SEQ ID NO: 8581096 - DNA, 22 bp, Homo sapiens
catctttagttattgaatatag

SEQ ID NO: 8581097 - DNA, 22 bp, Homo sapiens
catttatgatagtaatatgaaa

SEQ ID NO: 8581098 - DNA, 22 bp, Homo sapiens
catttgaacctggatgttctta

SEQ ID NO: 8581099 - DNA, 22 bp, Homo sapiens
ccacaagactctgtcagcataa

SEQ ID NO: 8581100 - DNA, 16 bp, Homo sapiens
ccacctgcagctctca

SEQ ID NO: 8581101 - DNA, 22 bp, Homo sapiens
ccactgatcctgactttggagc

SEQ ID NO: 8581102 - DNA, 22 bp, Homo sapiens
ccagatatcactgccgtgttgt

SEQ ID NO: 8581103 - DNA, 22 bp, Homo sapiens
tctgagtttaggaccaggctga

SEQ ID NO: 8581104 - DNA, 22 bp, Homo sapiens
tctgagttcataccaggctacc

SEQ ID NO: 8581105 - DNA, 22 bp, Homo sapiens
tctcttgtaatttaaaaaatct

SEQ ID NO: 8581106 - DNA, 22 bp, Homo sapiens
tacaaactaacatgtctcatcc

SEQ ID NO: 8581107 - DNA, 22 bp, Homo sapiens
taacattaggtagacataagcc

SEQ ID NO: 8581108 - DNA, 22 bp, Homo sapiens
taacaatacccattctaattac

SEQ ID NO: 8581109 - DNA, 19 bp, Homo sapiens
taacaaagtctgaagtcag

SEQ ID NO: 8581110 - DNA, 22 bp, Homo sapiens
taagattatacttaaagagaaa

SEQ ID NO: 8581111 - DNA, 22 bp, Homo sapiens
taagattacagtgagaaataaa

SEQ ID NO: 8581112 - DNA, 22 bp, Homo sapiens
taagcaaataatgcatcaaggg

SEQ ID NO: 8581113 - DNA, 22 bp, Homo sapiens
taaaaagtagtgagaatggcgc

SEQ ID NO: 8581114 - DNA, 22 bp, Homo sapiens
taaaaatcttatgaatggcaag

SEQ ID NO: 8581115 - DNA, 22 bp, Homo sapiens
taaaatcaccaaaagcaggtgg

SEQ ID NO: 8581116 - DNA, 22 bp, Homo sapiens
caggagatgacagggaagaacc

SEQ ID NO: 8581117 - DNA, 22 bp, Homo sapiens
taacaaagtaccatagattggg

SEQ ID NO: 8581118 - DNA, 22 bp, Homo sapiens
taacaaaggttgccaaactaag

SEQ ID NO: 8581119 - DNA, 22 bp, Homo sapiens
tgtctttctgcaccacctcaca

SEQ ID NO: 8581120 - DNA, 22 bp, Homo sapiens
tgtctcatctcttaaccccact

SEQ ID NO: 8581121 - DNA, 22 bp, Homo sapiens
tgtctattaacacaagaaagga

SEQ ID NO: 8581122 - DNA, 23 bp, Homo sapiens
tggtggcttgtggtggccaccag

SEQ ID NO: 8581123 - DNA, 22 bp, Homo sapiens
tgtattaacattaataaaatgg

SEQ ID NO: 8581124 - DNA, 22 bp, Homo sapiens
tgtaggaattccagtgacttca

SEQ ID NO: 8581125 - DNA, 22 bp, Homo sapiens
ctcatattgctggtggtctaag

SEQ ID NO: 8581126 - DNA, 22 bp, Homo sapiens
ctcatatatttctgcattcaat

SEQ ID NO: 8581127 - DNA, 22 bp, Homo sapiens
tttaaatttagaagaaacactg

SEQ ID NO: 8581128 - DNA, 22 bp, Homo sapiens
ttgacttttcttggtcacatga

SEQ ID NO: 8581129 - DNA, 22 bp, Homo sapiens
ttgactttacagttttcttagg

SEQ ID NO: 8581130 - DNA, 23 bp, Homo sapiens
ctatttctcatagttcaggtctt

SEQ ID NO: 8581131 - DNA, 22 bp, Homo sapiens
ttcctttctgtcagcctgagtg

SEQ ID NO: 8581132 - DNA, 22 bp, Homo sapiens
ttcagaaaaaacttcaataagt

SEQ ID NO: 8581133 - DNA, 19 bp, Homo sapiens
ttcattctcttattgttgt

SEQ ID NO: 8581134 - DNA, 22 bp, Homo sapiens
ttccttcagcaagtcctgagca

SEQ ID NO: 8581135 - DNA, 22 bp, Homo sapiens
ctacaaagtaccacagactggg

SEQ ID NO: 8581136 - DNA, 23 bp, Homo sapiens
ctacaaagtatgagaagacccct

SEQ ID NO: 8581137 - DNA, 22 bp, Homo sapiens
ctacaaagctcttctacaggca

SEQ ID NO: 8581138 - DNA, 22 bp, Homo sapiens
ctacaaagaatttctctagctc

SEQ ID NO: 8581139 - DNA, 22 bp, Homo sapiens
ctacaaagaaagctgaggggaa

SEQ ID NO: 8581140 - DNA, 22 bp, Homo sapiens
ctacaaagaaagtatactggac

SEQ ID NO: 8581141 - DNA, 22 bp, Homo sapiens
ctaattctgaaacagtgtcaat

SEQ ID NO: 8581142 - DNA, 22 bp, Homo sapiens
tttgtgaataggttggcttcca

SEQ ID NO: 8581143 - DNA, 22 bp, Homo sapiens
tttgtgaataggttggcttcca

SEQ ID NO: 8581144 - DNA, 22 bp, Homo sapiens
tttgtgaaatgaagtcacaact

SEQ ID NO: 8581145 - DNA, 22 bp, Homo sapiens
tttgtgaacactgcgcagaact

SEQ ID NO: 8581146 - DNA, 22 bp, Homo sapiens
tttgtgaacaaacatgaagatg

SEQ ID NO: 8581147 - DNA, 22 bp, Homo sapiens
tttgtgaagggaacagaagtgt

SEQ ID NO: 8581148 - DNA, 22 bp, Homo sapiens
ctctttgtagcctttgcatatt

SEQ ID NO: 8581149 - DNA, 22 bp, Homo sapiens
ctgatgctctggatgtagtcaa

SEQ ID NO: 8581150 - DNA, 22 bp, Homo sapiens
gatgtgtttccaggatttgttt

SEQ ID NO: 8581151 - DNA, 22 bp, Homo sapiens
gcaatcaatgatttatatttgt

SEQ ID NO: 8581152 - DNA, 22 bp, Homo sapiens
gcaatataaccagttgtcatgc

SEQ ID NO: 8581153 - DNA, 22 bp, Homo sapiens
gatttttatataaagtgagaaa

SEQ ID NO: 8581154 - DNA, 22 bp, Homo sapiens
gcatgttttgcaacaagtgacc

SEQ ID NO: 8581155 - DNA, 22 bp, Homo sapiens
gcagtactttatcacatggaat

SEQ ID NO: 8581156 - DNA, 22 bp, Homo sapiens
gcagtactttaagggatgaagc

SEQ ID NO: 8581157 - DNA, 22 bp, Homo sapiens
gcaggagactggctgtggtagt

SEQ ID NO: 8581158 - DNA, 22 bp, Homo sapiens
gccgggttcaagccattctcct

SEQ ID NO: 8581159 - DNA, 22 bp, Homo sapiens
gctgggatgcgtcttcccaggc

SEQ ID NO: 8581160 - DNA, 22 bp, Homo sapiens
gaccatcctggccaacgtggta

SEQ ID NO: 8581161 - DNA, 22 bp, Homo sapiens
gagaaacaacacttgatgcctt

SEQ ID NO: 8581162 - DNA, 22 bp, Homo sapiens
gaaatttacaactttctcatgg

SEQ ID NO: 8581163 - DNA, 22 bp, Homo sapiens
cttctttcccaggcatgtttta

SEQ ID NO: 8581164 - DNA, 20 bp, Homo sapiens
gataaattgtctcttaagtg

SEQ ID NO: 8581165 - DNA, 22 bp, Homo sapiens
gataaatggctgaagaaatagt

SEQ ID NO: 8581166 - DNA, 22 bp, Homo sapiens
gatctttatactgtaataatga

SEQ ID NO: 8581167 - DNA, 22 bp, Homo sapiens
gaggaatgttattaaaggagct

SEQ ID NO: 8581168 - DNA, 19 bp, Homo sapiens
ggaaacaggggccagagga

SEQ ID NO: 8581169 - DNA, 22 bp, Homo sapiens
ggagtagctgcattccgagcac

SEQ ID NO: 8581170 - DNA, 22 bp, Homo sapiens
gtgacaatattagctcaggggc

SEQ ID NO: 8581171 - DNA, 22 bp, Homo sapiens
gtggaccaaggtggaagataaa

SEQ ID NO: 8581172 - DNA, 22 bp, Homo sapiens
gtatgtctatagtttttaaata

SEQ ID NO: 8581173 - DNA, 22 bp, Homo sapiens
gtcaggacaggctctggactga

SEQ ID NO: 8581174 - DNA, 22 bp, Homo sapiens
gtaaataactggtaattggggt

SEQ ID NO: 8581175 - DNA, 22 bp, Homo sapiens
taaatgagatgtacataactca

SEQ ID NO: 8581176 - DNA, 22 bp, Homo sapiens
gttctattactccctgcttctt

SEQ ID NO: 8581177 - DNA, 22 bp, Homo sapiens
gttgtgaatagtgccgcaataa

SEQ ID NO: 8581178 - DNA, 21 bp, Homo sapiens
gttctattttgcaaacttctg

SEQ ID NO: 8581179 - DNA, 22 bp, Homo sapiens
gttctcatagtggaaaataggt

SEQ ID NO: 8581180 - DNA, 22 bp, Homo sapiens
tctgcaacagtgccctgtaaat

SEQ ID NO: 8581181 - DNA, 22 bp, Homo sapiens
tctgcaagctcagttctgactt

SEQ ID NO: 8581182 - DNA, 22 bp, Homo sapiens
tctgcaagagcttcaaggtaga

SEQ ID NO: 8581183 - DNA, 22 bp, Homo sapiens
tctgcaagtagatgacagtgag

SEQ ID NO: 8581184 - DNA, 22 bp, Homo sapiens
tctgcaagtttatcacttggga

SEQ ID NO: 8581185 - DNA, 22 bp, Homo sapiens
tctttcattctagtctgaggtt

SEQ ID NO: 8581186 - DNA, 23 bp, Homo sapiens
tctttcctaatgaaacagtgaaa

SEQ ID NO: 8581187 - DNA, 22 bp, Homo sapiens
tctttcctaggtgatatgcaat

SEQ ID NO: 8581188 - DNA, 22 bp, Homo sapiens
tctttcctactttattgtgaac

SEQ ID NO: 8581189 - DNA, 22 bp, Homo sapiens
tctttcctagaggctgatgagt

SEQ ID NO: 8581190 - DNA, 22 bp, Homo sapiens
tctttcctctgagctcctgtag

SEQ ID NO: 8581191 - DNA, 23 bp, Homo sapiens
tctttcctcagcacacaccaaga

SEQ ID NO: 8581192 - DNA, 21 bp, Homo sapiens
tctttcctgcccagttgccct

SEQ ID NO: 8581193 - DNA, 17 bp, Homo sapiens
tctttcctgccatgctc

SEQ ID NO: 8581194 - DNA, 22 bp, Homo sapiens
tctttcctgtaactgctgttca

SEQ ID NO: 8581195 - DNA, 22 bp, Homo sapiens
tctttccttagaataattcttt

SEQ ID NO: 8581196 - DNA, 22 bp, Homo sapiens
tctttaatatctgccccagagc

SEQ ID NO: 8581197 - DNA, 22 bp, Homo sapiens
tctttaatgtactttctttcac

SEQ ID NO: 8581198 - DNA, 22 bp, Homo sapiens
tctattcattcaatttagctct

SEQ ID NO: 8581199 - DNA, 22 bp, Homo sapiens
tctagaaaaccaatattacatg

SEQ ID NO: 8581200 - DNA, 22 bp, Homo sapiens
tctacaaataaattactatgta

SEQ ID NO: 8581201 - DNA, 22 bp, Homo sapiens
tctacaaagaagaattaatgtc

SEQ ID NO: 8581202 - DNA, 19 bp, Homo sapiens
tcctttctgttcctgagat

SEQ ID NO: 8581203 - DNA, 22 bp, Homo sapiens
tcgcccaggctggaagtgcagt

SEQ ID NO: 8581204 - DNA, 17 bp, Homo sapiens
tcggtttgccaggcttc

SEQ ID NO: 8581205 - DNA, 22 bp, Homo sapiens
tccttcagggggccgcctgcac

SEQ ID NO: 8581206 - DNA, 19 bp, Homo sapiens
tccttcagtcagatctggg

SEQ ID NO: 8581207 - DNA, 22 bp, Homo sapiens
tccttcagaaaacctcagtctt

SEQ ID NO: 8581208 - DNA, 22 bp, Homo sapiens
tccttcagaggataaggaagaa

SEQ ID NO: 8581209 - DNA, 22 bp, Homo sapiens
tccttcagaggacggcagccag

SEQ ID NO: 8581210 - DNA, 22 bp, Homo sapiens
tccttcagattcctgcttctgg

SEQ ID NO: 8581211 - DNA, 20 bp, Homo sapiens
tccttcagacgacaagcaag

SEQ ID NO: 8581212 - DNA, 22 bp, Homo sapiens
tccttcagccatgggctctcca

SEQ ID NO: 8581213 - DNA, 22 bp, Homo sapiens
tccttcagctactcagtttcca

SEQ ID NO: 8581214 - DNA, 22 bp, Homo sapiens
tccttcagcttgttagagtgac

SEQ ID NO: 8581215 - DNA, 22 bp, Homo sapiens
tccttcagctctctatttagat

SEQ ID NO: 8581216 - DNA, 22 bp, Homo sapiens
tccttcaggcctcattctcata

SEQ ID NO: 8581217 - DNA, 22 bp, Homo sapiens
tctctttctttgtatgtctatt

SEQ ID NO: 8581218 - DNA, 22 bp, Homo sapiens
tctctttctcaaaatgtaagca

SEQ ID NO: 8581219 - DNA, 22 bp, Homo sapiens
tctcgctctgtcgcccaggctg

SEQ ID NO: 8581220 - DNA, 22 bp, Homo sapiens
tctcgctctgtcgcccaggctg

SEQ ID NO: 8581221 - DNA, 22 bp, Homo sapiens
tgcctgatgcaggagtatcaga

SEQ ID NO: 8581222 - DNA, 22 bp, Homo sapiens
tgcatagggaacctcatgcatt

SEQ ID NO: 8581223 - DNA, 22 bp, Homo sapiens
tgcatagaggatccagtgtggt

SEQ ID NO: 8581224 - DNA, 22 bp, Homo sapiens
tgcagttctaagtagacaagtc

SEQ ID NO: 8581225 - DNA, 22 bp, Homo sapiens
tgcatgtgtttcccagcaagct

SEQ ID NO: 8581226 - DNA, 22 bp, Homo sapiens
tgcattctgacttagttaatat

SEQ ID NO: 8581227 - DNA, 22 bp, Homo sapiens
tgcattgggttgacatactaaa

SEQ ID NO: 8581228 - DNA, 22 bp, Homo sapiens
tgcatttttgataactgtgtac

SEQ ID NO: 8581229 - DNA, 22 bp, Homo sapiens
tgcagattcaaatgaaatgcaa

SEQ ID NO: 8581230 - DNA, 22 bp, Homo sapiens
tgcaaggcagcaccagctcttg

SEQ ID NO: 8581231 - DNA, 22 bp, Homo sapiens
tgcaaacagaaagtttattgtg

SEQ ID NO: 8581232 - DNA, 18 bp, Homo sapiens
tgcaaatggctgtttgat

SEQ ID NO: 8581233 - DNA, 22 bp, Homo sapiens
tgcaaatgggaaacccagcagt

SEQ ID NO: 8581234 - DNA, 22 bp, Homo sapiens
tgcaaattgcgatttttattag

SEQ ID NO: 8581235 - DNA, 22 bp, Homo sapiens
tgcaaatgcccatttattttct

SEQ ID NO: 8581236 - DNA, 22 bp, Homo sapiens
tgcaaatatttccttatagcca

SEQ ID NO: 8581237 - DNA, 22 bp, Homo sapiens
tgcaaagatgaaatattaaagg

SEQ ID NO: 8581238 - DNA, 22 bp, Homo sapiens
tgatcacaagtctgaagaatga

SEQ ID NO: 8581239 - DNA, 22 bp, Homo sapiens
tgagttctcatgaaatctagtt

SEQ ID NO: 8581240 - DNA, 22 bp, Homo sapiens
tgattctttggagagctatata

SEQ ID NO: 8581241 - DNA, 22 bp, Homo sapiens
tgatgcattgccgacttactgg

SEQ ID NO: 8581242 - DNA, 22 bp, Homo sapiens
tgatctttggtagtacgataat

SEQ ID NO: 8581243 - DNA, 22 bp, Homo sapiens
tgatctttttggtcatttgggt

SEQ ID NO: 8581244 - DNA, 22 bp, Homo sapiens
tgacaaagaccttcaacaagat

SEQ ID NO: 8581245 - DNA, 22 bp, Homo sapiens
tgaatgtgatgctaaacatatg

SEQ ID NO: 8581246 - DNA, 22 bp, Homo sapiens
tgaatgtttgatgagaaataga

SEQ ID NO: 8581247 - DNA, 22 bp, Homo sapiens
tgacttcctgcactcaggtgat

SEQ ID NO: 8581248 - DNA, 22 bp, Homo sapiens
tgacatttcttgttgatataaa

SEQ ID NO: 8581249 - DNA, 22 bp, Homo sapiens
tgacatgtcctgagaagatggc

SEQ ID NO: 8581250 - DNA, 22 bp, Homo sapiens
tgaaacagtctccagacttgga

SEQ ID NO: 8581251 - DNA, 22 bp, Homo sapiens
tctttgcatgcattttccctta

SEQ ID NO: 8581252 - DNA, 22 bp, Homo sapiens
tgaagactcagaagctaagata

SEQ ID NO: 8581253 - DNA, 22 bp, Homo sapiens
tgagaagcagcttacaggtgtc

SEQ ID NO: 8581254 - DNA, 22 bp, Homo sapiens
tgagaacggatactaagggctg

SEQ ID NO: 8581255 - DNA, 22 bp, Homo sapiens
tgctaaattcattattgattta

SEQ ID NO: 8581256 - DNA, 20 bp, Homo sapiens
tgcctttcctgtttcatctt

SEQ ID NO: 8581257 - DNA, 20 bp, Homo sapiens
tgctgctttgccactagttg

SEQ ID NO: 8581258 - DNA, 19 bp, Homo sapiens
tgctgcttccagctcactc

SEQ ID NO: 8581259 - DNA, 20 bp, Homo sapiens
tggaccataaacaccaggta

SEQ ID NO: 8581260 - DNA, 22 bp, Homo sapiens
tggaccatgagctgcaggtgtt

SEQ ID NO: 8581261 - DNA, 22 bp, Homo sapiens
tggacacaaagatcaaatattg

SEQ ID NO: 8581262 - DNA, 22 bp, Homo sapiens
tggaagctcaaggcagggtgag

SEQ ID NO: 8581263 - DNA, 22 bp, Homo sapiens
tggttctaggctttgtcttttg

SEQ ID NO: 8581264 - DNA, 22 bp, Homo sapiens
tgtaaatgaaacagctaaatcc

SEQ ID NO: 8581265 - DNA, 18 bp, Homo sapiens
tgtcatctgtttaaaacc

SEQ ID NO: 8581266 - DNA, 22 bp, Homo sapiens
tgtcatctcactgatatagatg

SEQ ID NO: 8581267 - DNA, 22 bp, Homo sapiens
tgtcatttatcttatagtaatc

SEQ ID NO: 8581268 - DNA, 22 bp, Homo sapiens
tgtatgctttccttctttctgg

SEQ ID NO: 8581269 - DNA, 22 bp, Homo sapiens
tgtcaccatgccagcttctgcc

SEQ ID NO: 8581270 - DNA, 22 bp, Homo sapiens
tgtcaccactggctgaaacacc

SEQ ID NO: 8581271 - DNA, 22 bp, Homo sapiens
tgtagaaagctcttctgaaatc

SEQ ID NO: 8581272 - DNA, 22 bp, Homo sapiens
tgtagaaattagtaagatcaac

SEQ ID NO: 8581273 - DNA, 22 bp, Homo sapiens
tgtagaaagaatatgtttcata

SEQ ID NO: 8581274 - DNA, 22 bp, Homo sapiens
tgtagaaaattggagcattcat

SEQ ID NO: 8581275 - DNA, 22 bp, Homo sapiens
tgtaggaactcacagatattct

SEQ ID NO: 8581276 - DNA, 22 bp, Homo sapiens
tgtaggaaaaacaatgatctgc

SEQ ID NO: 8581277 - DNA, 22 bp, Homo sapiens
tgtagcattttatgtaataagt

SEQ ID NO: 8581278 - DNA, 22 bp, Homo sapiens
tggtatgaccgtggtgcaagca

SEQ ID NO: 8581279 - DNA, 22 bp, Homo sapiens
tgggtgcaggtcttgtgccagg

SEQ ID NO: 8581280 - DNA, 22 bp, Homo sapiens
tgggagtagatgaggagtgggc

SEQ ID NO: 8581281 - DNA, 20 bp, Homo sapiens
tgggagtacaatcatgagca

SEQ ID NO: 8581282 - DNA, 22 bp, Homo sapiens
tgttagtattggcaaatttgtt

SEQ ID NO: 8581283 - DNA, 22 bp, Homo sapiens
tgttttaagggtcaactgtcac

SEQ ID NO: 8581284 - DNA, 20 bp, Homo sapiens
ttaaaaagagtcacaggaga

SEQ ID NO: 8581285 - DNA, 22 bp, Homo sapiens
ttaaaccatagtttaacataag

SEQ ID NO: 8581286 - DNA, 22 bp, Homo sapiens
tgtgaaagcaagtctagttctc

SEQ ID NO: 8581287 - DNA, 22 bp, Homo sapiens
tgtgaaagagtcttatagtttc

SEQ ID NO: 8581288 - DNA, 22 bp, Homo sapiens
tgtgaaagtcaaattaattgaa

SEQ ID NO: 8581289 - DNA, 22 bp, Homo sapiens
tgtgaatggacaattaaatcta

SEQ ID NO: 8581290 - DNA, 22 bp, Homo sapiens
tgtcttaatttggatgatgttt

SEQ ID NO: 8581291 - DNA, 22 bp, Homo sapiens
tgtgaaaaaagttctagaagga

SEQ ID NO: 8581292 - DNA, 22 bp, Homo sapiens
tgtgaaacggagtcagggaagg

SEQ ID NO: 8581293 - DNA, 22 bp, Homo sapiens
ttatgaaagacatttctgttgg

SEQ ID NO: 8581294 - DNA, 22 bp, Homo sapiens
ttatgaaaacaatcagtaggca

SEQ ID NO: 8581295 - DNA, 22 bp, Homo sapiens
ttattcttggatctgagtctct

SEQ ID NO: 8581296 - DNA, 22 bp, Homo sapiens
ttattcttcttctcttgccagg

SEQ ID NO: 8581297 - DNA, 18 bp, Homo sapiens
ttattcttccaggccacc

SEQ ID NO: 8581298 - DNA, 19 bp, Homo sapiens
ttattcttaaagtagctta

SEQ ID NO: 8581299 - DNA, 22 bp, Homo sapiens
ttacaaagagaagttgtagaat

SEQ ID NO: 8581300 - DNA, 20 bp, Homo sapiens
ttacaaagaggcatcgcttt

SEQ ID NO: 8581301 - DNA, 22 bp, Homo sapiens
ttacaaaggtagttttgtctat

SEQ ID NO: 8581302 - DNA, 22 bp, Homo sapiens
ttacaaagtgctgcaccatttt

SEQ ID NO: 8581303 - DNA, 22 bp, Homo sapiens
ttacaaagtgttatgataaaca

SEQ ID NO: 8581304 - DNA, 22 bp, Homo sapiens
ttacaaagtttaaggtggcact

SEQ ID NO: 8581305 - DNA, 22 bp, Homo sapiens
ttacaaagttctgagttcaaac

SEQ ID NO: 8581306 - DNA, 22 bp, Homo sapiens
ttacaattgagtctattgtatg

SEQ ID NO: 8581307 - DNA, 22 bp, Homo sapiens
ttacagagctcatttctaaggg

SEQ ID NO: 8581308 - DNA, 22 bp, Homo sapiens
ttcattctttgaatctgaggta

SEQ ID NO: 8581309 - DNA, 22 bp, Homo sapiens
ttcagccagtcatcagtcttgt

SEQ ID NO: 8581310 - DNA, 19 bp, Homo sapiens
ttcactaattgtaagattt

SEQ ID NO: 8581311 - DNA, 17 bp, Homo sapiens
ttcagcagtgtttctcc

SEQ ID NO: 8581312 - DNA, 22 bp, Homo sapiens
aataacagggttgatttgcaat

SEQ ID NO: 8581313 - DNA, 22 bp, Homo sapiens
aatatgttgagtctatctttat

SEQ ID NO: 8581314 - DNA, 22 bp, Homo sapiens
aatctttttcacaagaaagcac

SEQ ID NO: 8581315 - DNA, 22 bp, Homo sapiens
aagtaaatgttggagctcaaat

SEQ ID NO: 8581316 - DNA, 18 bp, Homo sapiens
aagtaacagaagagcaca

SEQ ID NO: 8581317 - DNA, 22 bp, Homo sapiens
aataacagagtcttcaagatag

SEQ ID NO: 8581318 - DNA, 22 bp, Homo sapiens
acagatgagagacaatgtgcta

SEQ ID NO: 8581319 - DNA, 22 bp, Homo sapiens
acattcttaacagttaaaaact

SEQ ID NO: 8581320 - DNA, 22 bp, Homo sapiens
acataacaatcataggacatag

SEQ ID NO: 8581321 - DNA, 18 bp, Homo sapiens
acatacattctgtctgca

SEQ ID NO: 8581322 - DNA, 22 bp, Homo sapiens
acattagaacattaatattggg

SEQ ID NO: 8581323 - DNA, 22 bp, Homo sapiens
acattagagaagcttggagatg

SEQ ID NO: 8581324 - DNA, 22 bp, Homo sapiens
acattagatgactctttctttc

SEQ ID NO: 8581325 - DNA, 22 bp, Homo sapiens
agcatcttgaaatataaagtca

SEQ ID NO: 8581326 - DNA, 22 bp, Homo sapiens
agcattccacactgaagtctgc

SEQ ID NO: 8581327 - DNA, 21 bp, Homo sapiens
agcagccatggatggtatgta

SEQ ID NO: 8581328 - DNA, 22 bp, Homo sapiens
aatgctttttgcgaaatgtgca

SEQ ID NO: 8581329 - DNA, 22 bp, Homo sapiens
aatgaaactagtagaatctttg

SEQ ID NO: 8581330 - DNA, 22 bp, Homo sapiens
agagaaacccttcagtgttttg

SEQ ID NO: 8581331 - DNA, 22 bp, Homo sapiens
agagaaacaggtcagctgggag

SEQ ID NO: 8581332 - DNA, 22 bp, Homo sapiens
agagaaacccttcagtgttttg

SEQ ID NO: 8581333 - DNA, 22 bp, Homo sapiens
agagaaactgatgtcctttgaa

SEQ ID NO: 8581334 - DNA, 22 bp, Homo sapiens
agatgttttgtgtatttcatca

SEQ ID NO: 8581335 - DNA, 22 bp, Homo sapiens
aactttctctggatggcttcct

SEQ ID NO: 8581336 - DNA, 20 bp, Homo sapiens
aactcctagcctcaagtgat

SEQ ID NO: 8581337 - DNA, 20 bp, Homo sapiens
aactcctagcctcaagtgat

SEQ ID NO: 8581338 - DNA, 22 bp, Homo sapiens
aattcaaattacaatagttgtt

SEQ ID NO: 8581339 - DNA, 22 bp, Homo sapiens
aagatttgtggatttaaggata

SEQ ID NO: 8581340 - DNA, 22 bp, Homo sapiens
aagatacattttcttcagagaa

SEQ ID NO: 8581341 - DNA, 22 bp, Homo sapiens
acacggcactttaggaaggggc

SEQ ID NO: 8581342 - DNA, 22 bp, Homo sapiens
acactacagggagaagactcac

SEQ ID NO: 8581343 - DNA, 22 bp, Homo sapiens
aagagtatagctttaggattga

SEQ ID NO: 8581344 - DNA, 22 bp, Homo sapiens
aaatttcagttggaatgagctc

SEQ ID NO: 8581345 - DNA, 22 bp, Homo sapiens
aaatttcaagcaaagtagctat

SEQ ID NO: 8581346 - DNA, 22 bp, Homo sapiens
aacaagttagggtcttttactt

SEQ ID NO: 8581347 - DNA, 22 bp, Homo sapiens
aatcacattagtgaaacactga

SEQ ID NO: 8581348 - DNA, 22 bp, Homo sapiens
aaccagtgaaacaccaggcaag

SEQ ID NO: 8581349 - DNA, 19 bp, Homo sapiens
aagttctcagagttcaaag

SEQ ID NO: 8581350 - DNA, 22 bp, Homo sapiens
aagttgctaatgatgtgtttgc

SEQ ID NO: 8581351 - DNA, 22 bp, Homo sapiens
aaatatgtgatcagtgaataaa

SEQ ID NO: 8581352 - DNA, 22 bp, Homo sapiens
aaatactgttttattccatgat

SEQ ID NO: 8581353 - DNA, 22 bp, Homo sapiens
aaatgctgagtgtttagagatc

SEQ ID NO: 8581354 - DNA, 22 bp, Homo sapiens
aaatcatctctgcatccttagc

SEQ ID NO: 8581355 - DNA, 22 bp, Homo sapiens
aaatatgtgatcagtgaataaa

SEQ ID NO: 8581356 - DNA, 22 bp, Homo sapiens
aaagatgtcagtttgaaataac

SEQ ID NO: 8581357 - DNA, 22 bp, Homo sapiens
aaagatgtccaagtaaagttaa

SEQ ID NO: 8581358 - DNA, 22 bp, Homo sapiens
aaagatgtcatacacattaaga

SEQ ID NO: 8581359 - DNA, 22 bp, Homo sapiens
aaagatgtgcctgtttcatagt

SEQ ID NO: 8581360 - DNA, 22 bp, Homo sapiens
aaagcaatggatgagaatctgt

SEQ ID NO: 8581361 - DNA, 22 bp, Homo sapiens
aaaccatcagataattcatact

SEQ ID NO: 8581362 - DNA, 22 bp, Homo sapiens
aaaccatggagtaagttcacat

SEQ ID NO: 8581363 - DNA, 22 bp, Homo sapiens
aaacatgagcatctcttcaagc

SEQ ID NO: 8581364 - DNA, 22 bp, Homo sapiens
aaacatgaatagatattaaaca

SEQ ID NO: 8581365 - DNA, 22 bp, Homo sapiens
aaaaactgtaattacttttgca

SEQ ID NO: 8581366 - DNA, 22 bp, Homo sapiens
aaacaaacataggtttgaaagt

SEQ ID NO: 8581367 - DNA, 22 bp, Homo sapiens
aaagcacattacaagctcagtc

SEQ ID NO: 8581368 - DNA, 22 bp, Homo sapiens
aacagtatctacgggaactatt

SEQ ID NO: 8581369 - DNA, 22 bp, Homo sapiens
aacagtatcttttatcagaaat

SEQ ID NO: 8581370 - DNA, 22 bp, Homo sapiens
aacagtattggttgaactcaag

SEQ ID NO: 8581371 - DNA, 22 bp, Homo sapiens
aagaatgtggcatttatttata

SEQ ID NO: 8581372 - DNA, 22 bp, Homo sapiens
aagagcatctatttcacagtgg

SEQ ID NO: 8581373 - DNA, 22 bp, Homo sapiens
aagagcatttggtgagatttga

SEQ ID NO: 8581374 - DNA, 22 bp, Homo sapiens
aagaatgttcttgtagtcatga

SEQ ID NO: 8581375 - DNA, 22 bp, Homo sapiens
aagcaactggctcattgtctca

SEQ ID NO: 8581376 - DNA, 22 bp, Homo sapiens
aagcaactgccttcaatattta

SEQ ID NO: 8581377 - DNA, 22 bp, Homo sapiens
aagcaactcctaggaggaaagg

SEQ ID NO: 8581378 - DNA, 22 bp, Homo sapiens
aagcaactaaggcaaggaaatg

SEQ ID NO: 8581379 - DNA, 22 bp, Homo sapiens
aagcactgtgcctcatatctga

SEQ ID NO: 8581380 - DNA, 22 bp, Homo sapiens
aagccactgagatttcactgca

SEQ ID NO: 8581381 - DNA, 20 bp, Homo sapiens
cagcaactttggactgagtt

SEQ ID NO: 8581382 - DNA, 22 bp, Homo sapiens
cagcaactggtcattgctctcc

SEQ ID NO: 8581383 - DNA, 22 bp, Homo sapiens
cagcaaatactactagttttta

SEQ ID NO: 8581384 - DNA, 22 bp, Homo sapiens
cagatgtacatgaagggcaatg

SEQ ID NO: 8581385 - DNA, 22 bp, Homo sapiens
caaaggctttgctatgatgcat

SEQ ID NO: 8581386 - DNA, 22 bp, Homo sapiens
agcagagacctggttttgttga

SEQ ID NO: 8581387 - DNA, 22 bp, Homo sapiens
agcagagaccatatagcccaga

SEQ ID NO: 8581388 - DNA, 22 bp, Homo sapiens
agcagtaagacttttttctgtg

SEQ ID NO: 8581389 - DNA, 22 bp, Homo sapiens
agcatgaagacttcagagctag

SEQ ID NO: 8581390 - DNA, 23 bp, Homo sapiens
agcatgttgtgatgttaccactg

SEQ ID NO: 8581391 - DNA, 22 bp, Homo sapiens
agcatgttcatcttctgttggt

SEQ ID NO: 8581392 - DNA, 22 bp, Homo sapiens
cacagcaagagctaaatgacca

SEQ ID NO: 8581393 - DNA, 22 bp, Homo sapiens
agcaggaaggtctgtgtgagtc

SEQ ID NO: 8581394 - DNA, 22 bp, Homo sapiens
agactgtactttctgcagctct

SEQ ID NO: 8581395 - DNA, 22 bp, Homo sapiens
agagacaatgccaatgcacacg

SEQ ID NO: 8581396 - DNA, 22 bp, Homo sapiens
agaatcaaagagaaatactttg

SEQ ID NO: 8581397 - DNA, 22 bp, Homo sapiens
agaatcaactgaaaattggtga

SEQ ID NO: 8581398 - DNA, 22 bp, Homo sapiens
agacaacatctagtttggtgga

SEQ ID NO: 8581399 - DNA, 22 bp, Homo sapiens
atgaaggatggctggctgccct

SEQ ID NO: 8581400 - DNA, 22 bp, Homo sapiens
agcaaatgggtttatatttgac

SEQ ID NO: 8581401 - DNA, 22 bp, Homo sapiens
agcaaatattttgttgaagtgc

SEQ ID NO: 8581402 - DNA, 22 bp, Homo sapiens
agatgtgtttctagttcctgca

SEQ ID NO: 8581403 - DNA, 22 bp, Homo sapiens
agatcacagtggcaactccctt

SEQ ID NO: 8581404 - DNA, 22 bp, Homo sapiens
acccaggctggcgtgcagtggc

SEQ ID NO: 8581405 - DNA, 22 bp, Homo sapiens
acattctttcaccttgtgtcca

SEQ ID NO: 8581406 - DNA, 22 bp, Homo sapiens
acattctttcgatgtctgattt

SEQ ID NO: 8581407 - DNA, 22 bp, Homo sapiens
acattctttgagttttgttaaa

SEQ ID NO: 8581408 - DNA, 22 bp, Homo sapiens
acatgaaaactggttccttcag

SEQ ID NO: 8581409 - DNA, 22 bp, Homo sapiens
aggaagagcattcacatggtag

SEQ ID NO: 8581410 - DNA, 23 bp, Homo sapiens
actagaaaatgactttctccctg

SEQ ID NO: 8581411 - DNA, 22 bp, Homo sapiens
agtagaaagaaggcactgggcc

SEQ ID NO: 8581412 - DNA, 22 bp, Homo sapiens
agtgctatcgagttctaatgct

SEQ ID NO: 8581413 - DNA, 21 bp, Homo sapiens
agaaaaacacgatataagccc

SEQ ID NO: 8581414 - DNA, 22 bp, Homo sapiens
agaaatcaggaacagtaaggag

SEQ ID NO: 8581415 - DNA, 22 bp, Homo sapiens
agaaatcatgtcttatttctat

SEQ ID NO: 8581416 - DNA, 22 bp, Homo sapiens
atcccacacccctacaacatat

SEQ ID NO: 8581417 - DNA, 22 bp, Homo sapiens
agttctcagcttagtatgctgt

SEQ ID NO: 8581418 - DNA, 22 bp, Homo sapiens
agttctcaggtcagctgagtct

SEQ ID NO: 8581419 - DNA, 23 bp, Homo sapiens
agttctcattcatcacggcctat

SEQ ID NO: 8581420 - DNA, 22 bp, Homo sapiens
agttctcaagacaattacctgt

SEQ ID NO: 8581421 - DNA, 23 bp, Homo sapiens
agttctcaaaaccagcttgacaa

SEQ ID NO: 8581422 - DNA, 22 bp, Homo sapiens
atagttttatagatattgtgta

SEQ ID NO: 8581423 - DNA, 22 bp, Homo sapiens
atatacttggagactatcattg

SEQ ID NO: 8581424 - DNA, 22 bp, Homo sapiens
atcacagattgtgaataactat

SEQ ID NO: 8581425 - DNA, 22 bp, Homo sapiens
atcaagaattgggagctattga

SEQ ID NO: 8581426 - DNA, 22 bp, Homo sapiens
atcataaaccactttgtaatct

SEQ ID NO: 8581427 - DNA, 22 bp, Homo sapiens
atcaagaatgttcattcttcta

SEQ ID NO: 8581428 - DNA, 22 bp, Homo sapiens
atctccgccatcgcgaacgcct

SEQ ID NO: 8581429 - DNA, 22 bp, Homo sapiens
atccatgattgcccagaggtgt

SEQ ID NO: 8581430 - DNA, 22 bp, Homo sapiens
cttaatctcacctgcaaagtcc

SEQ ID NO: 8581431 - DNA, 22 bp, Homo sapiens
ctatgaccccagcatgaataag

SEQ ID NO: 8581432 - DNA, 22 bp, Homo sapiens
ctattctagtctgtcatgtcca

SEQ ID NO: 8581433 - DNA, 22 bp, Homo sapiens
agtaaacagtatctttagtgtc

SEQ ID NO: 8581434 - DNA, 22 bp, Homo sapiens
ccttccagtatgttaagatggt

SEQ ID NO: 8581435 - DNA, 22 bp, Homo sapiens
agtaaacatagaatgttcttcc

SEQ ID NO: 8581436 - DNA, 22 bp, Homo sapiens
agtaacaagtgccaacgttaga

SEQ ID NO: 8581437 - DNA, 22 bp, Homo sapiens
agtaacagagcatgggttcaga

SEQ ID NO: 8581438 - DNA, 22 bp, Homo sapiens
agtaacagaaggcctgacttaa

SEQ ID NO: 8581439 - DNA, 22 bp, Homo sapiens
agtagaaagttgcaggaggaat

SEQ ID NO: 8581440 - DNA, 22 bp, Homo sapiens
agtagaaatgtaagaaggatta

SEQ ID NO: 8581441 - DNA, 22 bp, Homo sapiens
agtagaaatgtagtgtagagaa

SEQ ID NO: 8581442 - DNA, 22 bp, Homo sapiens
cctgagtagctggaattaaagg

SEQ ID NO: 8581443 - DNA, 22 bp, Homo sapiens
agtgaggggcagctgagtgggc

SEQ ID NO: 8581444 - DNA, 22 bp, Homo sapiens
agtgaaaggttgagaatattct

SEQ ID NO: 8581445 - DNA, 22 bp, Homo sapiens
agtgaaaggttgagaatattct

SEQ ID NO: 8581446 - DNA, 22 bp, Homo sapiens
agtggaccagaagactgaagct

SEQ ID NO: 8581447 - DNA, 22 bp, Homo sapiens
agtgatgtgggagagtatagct

SEQ ID NO: 8581448 - DNA, 22 bp, Homo sapiens
catcatgccccgctacagtgca

SEQ ID NO: 8581449 - DNA, 22 bp, Homo sapiens
ccatttcattgcctgtaaagtg

SEQ ID NO: 8581450 - DNA, 18 bp, Homo sapiens
attttgaacaatgctgta

SEQ ID NO: 8581451 - DNA, 22 bp, Homo sapiens
attttgaaaagcatttgagtaa

SEQ ID NO: 8581452 - DNA, 22 bp, Homo sapiens
atttgcatgacctttgcaagtg

SEQ ID NO: 8581453 - DNA, 22 bp, Homo sapiens
gctatgttcccttttgctataa

SEQ ID NO: 8581454 - DNA, 22 bp, Homo sapiens
gctattcatggagcatgtactg

SEQ ID NO: 8581455 - DNA, 22 bp, Homo sapiens
attgtaaaagtattctaagatt

SEQ ID NO: 8581456 - DNA, 22 bp, Homo sapiens
gcaaatgtggcttcctttctag

SEQ ID NO: 8581457 - DNA, 22 bp, Homo sapiens
gcaacacagatcttctttgttg

SEQ ID NO: 8581458 - DNA, 22 bp, Homo sapiens
gcaaatgttctatatttgctgt

SEQ ID NO: 8581459 - DNA, 22 bp, Homo sapiens
atgtaagactttaagaacctaa

SEQ ID NO: 8581460 - DNA, 22 bp, Homo sapiens
gagcagtaggagaaccctgagc

SEQ ID NO: 8581461 - DNA, 22 bp, Homo sapiens
gagttacatggacattctctcc

SEQ ID NO: 8581462 - DNA, 22 bp, Homo sapiens
atgtttcaatgcactttagcct

SEQ ID NO: 8581463 - DNA, 22 bp, Homo sapiens
atgtttcatccactggcctttc

SEQ ID NO: 8581464 - DNA, 22 bp, Homo sapiens
gaaaacatccagagatagacct

SEQ ID NO: 8581465 - DNA, 22 bp, Homo sapiens
atgcaaatgaacatgttgctag

SEQ ID NO: 8581466 - DNA, 22 bp, Homo sapiens
atgcaaatgcagccattgcaga

SEQ ID NO: 8581467 - DNA, 22 bp, Homo sapiens
atgcaagggtaaccccagacat

SEQ ID NO: 8581468 - DNA, 22 bp, Homo sapiens
cacagagacatgatgtcattgc

SEQ ID NO: 8581469 - DNA, 22 bp, Homo sapiens
caagttgctctgcctctgtagg

SEQ ID NO: 8581470 - DNA, 22 bp, Homo sapiens
caagttgtgaatgacagacttc

SEQ ID NO: 8581471 - DNA, 22 bp, Homo sapiens
ggaacacagtgccttacaaact

SEQ ID NO: 8581472 - DNA, 20 bp, Homo sapiens
gctgaggtccctgtggtttt

SEQ ID NO: 8581473 - DNA, 22 bp, Homo sapiens
cagcagtacttctcagaggtat

SEQ ID NO: 8581474 - DNA, 22 bp, Homo sapiens
cagcagtaattagtgctgcatg

SEQ ID NO: 8581475 - DNA, 22 bp, Homo sapiens
cagcagagctgggaataaaatt

SEQ ID NO: 8581476 - DNA, 22 bp, Homo sapiens
cagcagagctgggctttgaatt

SEQ ID NO: 8581477 - DNA, 22 bp, Homo sapiens
cagcagagatgagattcctata

SEQ ID NO: 8581478 - DNA, 22 bp, Homo sapiens
cagcagagacggtaagcagaac

SEQ ID NO: 8581479 - DNA, 22 bp, Homo sapiens
gggctcaggcctggcctctcac

SEQ ID NO: 8581480 - DNA, 22 bp, Homo sapiens
cagaagatgctttgtaaaatga

SEQ ID NO: 8581481 - DNA, 18 bp, Homo sapiens
cagcagagacattcaaaa

SEQ ID NO: 8581482 - DNA, 22 bp, Homo sapiens
cagcagagaaattacatatttg

SEQ ID NO: 8581483 - DNA, 22 bp, Homo sapiens
cagcagagaaattaaacttctg

SEQ ID NO: 8581484 - DNA, 22 bp, Homo sapiens
cagataaaattaatattaccaa

SEQ ID NO: 8581485 - DNA, 22 bp, Homo sapiens
catgcttgctgcctcattgttc

SEQ ID NO: 8581486 - DNA, 21 bp, Homo sapiens
catttcatgattatagaaatg

SEQ ID NO: 8581487 - DNA, 22 bp, Homo sapiens
catttccacttctgaaaactgg

SEQ ID NO: 8581488 - DNA, 22 bp, Homo sapiens
catttcaccttagagaattatt

SEQ ID NO: 8581489 - DNA, 19 bp, Homo sapiens
cattttcccatcatccttt

SEQ ID NO: 8581490 - DNA, 22 bp, Homo sapiens
tcaaattagtggaataataatg

SEQ ID NO: 8581491 - DNA, 22 bp, Homo sapiens
tatgtacatggagagcaattga

SEQ ID NO: 8581492 - DNA, 22 bp, Homo sapiens
tacacagaggctgatgtcttag

SEQ ID NO: 8581493 - DNA, 22 bp, Homo sapiens
tagcataacaggtaagagtgag

SEQ ID NO: 8581494 - DNA, 22 bp, Homo sapiens
tagaaatgttggtattaacatt

SEQ ID NO: 8581495 - DNA, 22 bp, Homo sapiens
tagaaacaagggagaggattct

SEQ ID NO: 8581496 - DNA, 22 bp, Homo sapiens
tgagttcttcacattacctacg

SEQ ID NO: 8581497 - DNA, 22 bp, Homo sapiens
ccaggcttcctaatgtgtgcag

SEQ ID NO: 8581498 - DNA, 22 bp, Homo sapiens
gaaacacatatgaacagttgat

SEQ ID NO: 8581499 - DNA, 22 bp, Homo sapiens
gacagagaggctgagcagtaca

SEQ ID NO: 8581500 - DNA, 22 bp, Homo sapiens
gagaaacactgttagtttatta

SEQ ID NO: 8581501 - DNA, 22 bp, Homo sapiens
gagaaacactgttagtttatta

SEQ ID NO: 8581502 - DNA, 22 bp, Homo sapiens
gagaaacaggaattgagtcgct

SEQ ID NO: 8581503 - DNA, 22 bp, Homo sapiens
gagaaacaggaattgagtcgct

SEQ ID NO: 8581504 - DNA, 22 bp, Homo sapiens
gaagcatcagcaatggctggaa

SEQ ID NO: 8581505 - DNA, 22 bp, Homo sapiens
gaagggaaggaaagaaccagca

SEQ ID NO: 8581506 - DNA, 22 bp, Homo sapiens
gaatgaaaaccttggctcaaat

SEQ ID NO: 8581507 - DNA, 22 bp, Homo sapiens
ctaaattatcatgagaattatg

SEQ ID NO: 8581508 - DNA, 22 bp, Homo sapiens
ttctacatgagaaaatgtattt

SEQ ID NO: 8581509 - DNA, 22 bp, Homo sapiens
ttctacatatatttttctcact

SEQ ID NO: 8581510 - DNA, 22 bp, Homo sapiens
ctagttctagatccctgaggaa

SEQ ID NO: 8581511 - DNA, 22 bp, Homo sapiens
ttctcagtagttagcatttgtg

SEQ ID NO: 8581512 - DNA, 22 bp, Homo sapiens
cgtcccgggttcacgccattct

SEQ ID NO: 8581513 - DNA, 23 bp, Homo sapiens
ttgcacagtgtatacacatattt

SEQ ID NO: 8581514 - DNA, 22 bp, Homo sapiens
ttgcacagggctggaatgtcct

SEQ ID NO: 8581515 - DNA, 22 bp, Homo sapiens
ttgcacagagtggatattcagt

SEQ ID NO: 8581516 - DNA, 22 bp, Homo sapiens
ttgcacagaatgacaatatgta

SEQ ID NO: 8581517 - DNA, 22 bp, Homo sapiens
ttctcttttgtgatgtgagatg

SEQ ID NO: 8581518 - DNA, 22 bp, Homo sapiens
ttctctttttgcatctcaacct

SEQ ID NO: 8581519 - DNA, 22 bp, Homo sapiens
ttcttaagaggaacatttttgt

SEQ ID NO: 8581520 - DNA, 21 bp, Homo sapiens
ttacaaagctacagatgttgc

SEQ ID NO: 8581521 - DNA, 20 bp, Homo sapiens
ttacaagtttctaataacca

SEQ ID NO: 8581522 - DNA, 22 bp, Homo sapiens
ttaatgaatgtgtgctaacgtt

SEQ ID NO: 8581523 - DNA, 19 bp, Homo sapiens
cctttgaatcaggacactt

SEQ ID NO: 8581524 - DNA, 22 bp, Homo sapiens
cctttcttgctaagagtttatg

SEQ ID NO: 8581525 - DNA, 22 bp, Homo sapiens
cgcaccactgaattccagcctg

SEQ ID NO: 8581526 - DNA, 18 bp, Homo sapiens
ttatggctgtgaaagagt

SEQ ID NO: 8581527 - DNA, 22 bp, Homo sapiens
tttgaagggcacgacaatagtt

SEQ ID NO: 8581528 - DNA, 22 bp, Homo sapiens
gtaaattatttcaagatcatct

SEQ ID NO: 8581529 - DNA, 20 bp, Homo sapiens
gtaatgaatgtaaacagtaa

SEQ ID NO: 8581530 - DNA, 22 bp, Homo sapiens
gtagagtttaatgaaaaatctg

SEQ ID NO: 8581531 - DNA, 22 bp, Homo sapiens
gtagagttgagtagtggtaaca

SEQ ID NO: 8581532 - DNA, 20 bp, Homo sapiens
gtgcaatggcaccatctcag

SEQ ID NO: 8581533 - DNA, 20 bp, Homo sapiens
gtgcaatggcgcaatctcgg

SEQ ID NO: 8581534 - DNA, 22 bp, Homo sapiens
ggatgttgattgaatggccatt

SEQ ID NO: 8581535 - DNA, 22 bp, Homo sapiens
gccttcagccctgactggccag

SEQ ID NO: 8581536 - DNA, 22 bp, Homo sapiens
gccttcaggagggttccagaca

SEQ ID NO: 8581537 - DNA, 22 bp, Homo sapiens
gccttcagcggccgctcgctgc

SEQ ID NO: 8581538 - DNA, 23 bp, Homo sapiens
gccttcagctcgggaaggctccc

SEQ ID NO: 8581539 - DNA, 22 bp, Homo sapiens
gccttcagtagtgtcagctgta

SEQ ID NO: 8581540 - DNA, 22 bp, Homo sapiens
gccttcaggtgctgccaggcta

SEQ ID NO: 8581541 - DNA, 22 bp, Homo sapiens
gccttcagtaactgagacggaa

SEQ ID NO: 8581542 - DNA, 22 bp, Homo sapiens
gccttcagtagtatcctcatga

SEQ ID NO: 8581543 - DNA, 22 bp, Homo sapiens
gctgattttgagaagcacagtc

SEQ ID NO: 8581544 - DNA, 22 bp, Homo sapiens
ggaaggaacaaaccctgtgtgg

SEQ ID NO: 8581545 - DNA, 22 bp, Homo sapiens
ggaaggaaattggggcagttgt

SEQ ID NO: 8581546 - DNA, 22 bp, Homo sapiens
ggaaggaagaggaccgagctgg

SEQ ID NO: 8581547 - DNA, 22 bp, Homo sapiens
gctgggttttcttccgggccta

SEQ ID NO: 8581548 - DNA, 22 bp, Homo sapiens
gctgggttttcttccgggccta

SEQ ID NO: 8581549 - DNA, 22 bp, Homo sapiens
gcagcagtgcgggcagctacag

SEQ ID NO: 8581550 - DNA, 19 bp, Homo sapiens
gcagcagtggaaggaaaaa

SEQ ID NO: 8581551 - DNA, 22 bp, Homo sapiens
gcagcagtaggaaataacacag

SEQ ID NO: 8581552 - DNA, 22 bp, Homo sapiens
gcagcagtggtctgtagaagga

SEQ ID NO: 8581553 - DNA, 21 bp, Homo sapiens
gcagcagtgttctagaatact

SEQ ID NO: 8581554 - DNA, 22 bp, Homo sapiens
gcaagattccgctctagagcct

SEQ ID NO: 8581555 - DNA, 22 bp, Homo sapiens
gcattttataaagagttatttg

SEQ ID NO: 8581556 - DNA, 22 bp, Homo sapiens
gcattttaatgaggtttatgag

SEQ ID NO: 8581557 - DNA, 22 bp, Homo sapiens
tatatgcagtgtgtcattcaag

SEQ ID NO: 8581558 - DNA, 22 bp, Homo sapiens
tatttcaacgtatgaaaagctg

SEQ ID NO: 8581559 - DNA, 22 bp, Homo sapiens
tattgcattatggtaggaaagg

SEQ ID NO: 8581560 - DNA, 22 bp, Homo sapiens
tattgcatcttagtgtaagtca

SEQ ID NO: 8581561 - DNA, 22 bp, Homo sapiens
tattgcatgtgatagaggcagg

SEQ ID NO: 8581562 - DNA, 23 bp, Homo sapiens
tattgcacacatagaaacataga

SEQ ID NO: 8581563 - DNA, 22 bp, Homo sapiens
tattgcatccccattgtgcccc

SEQ ID NO: 8581564 - DNA, 22 bp, Homo sapiens
tattgcatctcttcatatctgt

SEQ ID NO: 8581565 - DNA, 22 bp, Homo sapiens
tattgcatattgtacttgaatg

SEQ ID NO: 8581566 - DNA, 22 bp, Homo sapiens
tattgcatcatcctgcaggggt

SEQ ID NO: 8581567 - DNA, 22 bp, Homo sapiens
tattgcatcagtaatttagtgt

SEQ ID NO: 8581568 - DNA, 22 bp, Homo sapiens
tattgcataaaatcaggttaga

SEQ ID NO: 8581569 - DNA, 22 bp, Homo sapiens
tattgcatattattctagtggc

SEQ ID NO: 8581570 - DNA, 22 bp, Homo sapiens
tattgcatagaaggaaggagtt

SEQ ID NO: 8581571 - DNA, 22 bp, Homo sapiens
tattgcatacttaaatttccgg

SEQ ID NO: 8581572 - DNA, 21 bp, Homo sapiens
tattgcataccatgaatctga

SEQ ID NO: 8581573 - DNA, 21 bp, Homo sapiens
tattgcataacaaattaccct

SEQ ID NO: 8581574 - DNA, 22 bp, Homo sapiens
tattcatattgtaaaagaagtg

SEQ ID NO: 8581575 - DNA, 22 bp, Homo sapiens
tagcagtgccctgtggaataag

SEQ ID NO: 8581576 - DNA, 22 bp, Homo sapiens
tagcatttcactgatcttcact

SEQ ID NO: 8581577 - DNA, 22 bp, Homo sapiens
tagatgttttaactcttggtta

SEQ ID NO: 8581578 - DNA, 22 bp, Homo sapiens
tactttctgtccttctgttaaa

SEQ ID NO: 8581579 - DNA, 22 bp, Homo sapiens
tacttgtagcaggtggcattta

SEQ ID NO: 8581580 - DNA, 22 bp, Homo sapiens
taggaatgataatagtaaagag

SEQ ID NO: 8581581 - DNA, 22 bp, Homo sapiens
gttacaaaggtcataaaagtgt

SEQ ID NO: 8581582 - DNA, 22 bp, Homo sapiens
gtttagaattctaactttaagg

SEQ ID NO: 8581583 - DNA, 22 bp, Homo sapiens
gtttagaagccaagatttgggt

SEQ ID NO: 8581584 - DNA, 21 bp, Homo sapiens
taaataataagttgctgagat

SEQ ID NO: 8581585 - DNA, 22 bp, Homo sapiens
taactgttgtgcgggtctctgg

SEQ ID NO: 8581586 - DNA, 22 bp, Homo sapiens
taagatgaccttataaagagca

SEQ ID NO: 8581587 - DNA, 22 bp, Homo sapiens
tacatacagtggatgctttagg

SEQ ID NO: 8581588 - DNA, 22 bp, Homo sapiens
tacatacaagcattcaatttta

SEQ ID NO: 8581589 - DNA, 22 bp, Homo sapiens
tacatacagagatgctagttaa

SEQ ID NO: 8581590 - DNA, 22 bp, Homo sapiens
tacatacaagatgtgtttaaaa

SEQ ID NO: 8581591 - DNA, 22 bp, Homo sapiens
tactgcatgaaggcacctattt

SEQ ID NO: 8581592 - DNA, 22 bp, Homo sapiens
taataaatgaaagtgctggcat

SEQ ID NO: 8581593 - DNA, 22 bp, Homo sapiens
taataacaattgtaggacatga

SEQ ID NO: 8581594 - DNA, 22 bp, Homo sapiens
taatttcaccgttgctagaaat

SEQ ID NO: 8581595 - DNA, 22 bp, Homo sapiens
taattttacttcctgagcacct

SEQ ID NO: 8581596 - DNA, 22 bp, Homo sapiens
taattttaactgtgctgtttgg

SEQ ID NO: 8581597 - DNA, 22 bp, Homo sapiens
taattttaatagtatgtggcat

SEQ ID NO: 8581598 - DNA, 22 bp, Homo sapiens
tccaccatgtaacaagctctgt

SEQ ID NO: 8581599 - DNA, 22 bp, Homo sapiens
tcccttcaataattcaacatta

SEQ ID NO: 8581600 - DNA, 22 bp, Homo sapiens
tcagttacctgacagtggttat

SEQ ID NO: 8581601 - DNA, 22 bp, Homo sapiens
tcaggaaagagttagatgatta

SEQ ID NO: 8581602 - DNA, 22 bp, Homo sapiens
tcaccgaggctggagtgcagtg

SEQ ID NO: 8581603 - DNA, 22 bp, Homo sapiens
tcaccgaggctggagtgcagtg

SEQ ID NO: 8581604 - DNA, 22 bp, Homo sapiens
tcagagaatccgtaagtcacaa

SEQ ID NO: 8581605 - DNA, 22 bp, Homo sapiens
tcagagaatgtccttcttcatt

SEQ ID NO: 8581606 - DNA, 23 bp, Homo sapiens
tcagagaatggtatgcttttcct

SEQ ID NO: 8581607 - DNA, 21 bp, Homo sapiens
tcagagaatggcctactctca

SEQ ID NO: 8581608 - DNA, 22 bp, Homo sapiens
tcacatagtggggcattggaat

SEQ ID NO: 8581609 - DNA, 22 bp, Homo sapiens
tcacagaatttttgcttccagt

SEQ ID NO: 8581610 - DNA, 22 bp, Homo sapiens
tcacacataaaaagaagactag

SEQ ID NO: 8581611 - DNA, 22 bp, Homo sapiens
tcaaacagaggaacaattgttt

SEQ ID NO: 8581612 - DNA, 23 bp, Homo sapiens
ttctctttagatttacattactc

SEQ ID NO: 8581613 - DNA, 22 bp, Homo sapiens
ttctcttgtgccaagttgttgc

SEQ ID NO: 8581614 - DNA, 22 bp, Homo sapiens
ttctctttgacattattcaggt

SEQ ID NO: 8581615 - DNA, 22 bp, Homo sapiens
ttgaaacagacaagtaaatgtc

SEQ ID NO: 8581616 - DNA, 22 bp, Homo sapiens
ttctttctttgtagtcctgaac

SEQ ID NO: 8581617 - DNA, 22 bp, Homo sapiens
ttcaagcagagatatttcaaga

SEQ ID NO: 8581618 - DNA, 23 bp, Homo sapiens
tcctcgcaggagggagatgatgc

SEQ ID NO: 8581619 - DNA, 22 bp, Homo sapiens
ttcatattttctgcttgctcac

SEQ ID NO: 8581620 - DNA, 22 bp, Homo sapiens
ttcaagtactgtagatttcagg

SEQ ID NO: 8581621 - DNA, 22 bp, Homo sapiens
ttcagaaatcgagtttcatgtc

SEQ ID NO: 8581622 - DNA, 22 bp, Homo sapiens
ttccatattgtactctttggag

SEQ ID NO: 8581623 - DNA, 22 bp, Homo sapiens
ttccatgagtagcagtatttcc

SEQ ID NO: 8581624 - DNA, 22 bp, Homo sapiens
ttccatatctgttgcatatcat

SEQ ID NO: 8581625 - DNA, 21 bp, Homo sapiens
ttggatgtatttatgttttag

SEQ ID NO: 8581626 - DNA, 22 bp, Homo sapiens
ttgtattctgttacagcaacat

SEQ ID NO: 8581627 - DNA, 22 bp, Homo sapiens
ttgtagaaaattagatgcatgg

SEQ ID NO: 8581628 - DNA, 22 bp, Homo sapiens
ttgtgatactgagcttggcatt

SEQ ID NO: 8581629 - DNA, 22 bp, Homo sapiens
tttcccaaagcctggggtgagt

SEQ ID NO: 8581630 - DNA, 22 bp, Homo sapiens
tttcacaacgttgtggtgagag

SEQ ID NO: 8581631 - DNA, 22 bp, Homo sapiens
tttacagagaatgtacataaag

SEQ ID NO: 8581632 - DNA, 22 bp, Homo sapiens
tttattgctgtgttagggacag

SEQ ID NO: 8581633 - DNA, 22 bp, Homo sapiens
tttatctgatattcagcgattt

SEQ ID NO: 8581634 - DNA, 22 bp, Homo sapiens
tttaggaatgtggtttttgagc

SEQ ID NO: 8581635 - DNA, 22 bp, Homo sapiens
tttaggaatattttctttcagg

SEQ ID NO: 8581636 - DNA, 20 bp, Homo sapiens
tttgagaccagtctgcccaa

SEQ ID NO: 8581637 - DNA, 22 bp, Homo sapiens
tttgacagtcccctgatgtttg

SEQ ID NO: 8581638 - DNA, 22 bp, Homo sapiens
tttctattctggatctgtggca

SEQ ID NO: 8581639 - DNA, 22 bp, Homo sapiens
tttctattgatctaataaacat

SEQ ID NO: 8581640 - DNA, 22 bp, Homo sapiens
tttctattggcgtcactgttgt

SEQ ID NO: 8581641 - DNA, 22 bp, Homo sapiens
ttttgtctaagaactttgcaaa

SEQ ID NO: 8581642 - DNA, 22 bp, Homo sapiens
ttttgtgttgccatgttaagca

SEQ ID NO: 8581643 - DNA, 22 bp, Homo sapiens
ttttacttcattcctgacttca

SEQ ID NO: 8581644 - DNA, 22 bp, Homo sapiens
ttttagaaatactgatttagtg

SEQ ID NO: 8581645 - DNA, 22 bp, Homo sapiens
ttttactttggatacagtactt

SEQ ID NO: 8581646 - DNA, 22 bp, Homo sapiens
acaaagatgtttaaagcattta

SEQ ID NO: 8581647 - DNA, 22 bp, Homo sapiens
aagagattggttataagagatt

SEQ ID NO: 8581648 - DNA, 22 bp, Homo sapiens
aagaaatacatggtttttgagt

SEQ ID NO: 8581649 - DNA, 22 bp, Homo sapiens
aagatgttctattttcactttt

SEQ ID NO: 8581650 - DNA, 22 bp, Homo sapiens
aagatttaccactttattcaag

SEQ ID NO: 8581651 - DNA, 22 bp, Homo sapiens
acagaattgatggaaatctcag

SEQ ID NO: 8581652 - DNA, 22 bp, Homo sapiens
acagaatttacacatctctaaa

SEQ ID NO: 8581653 - DNA, 22 bp, Homo sapiens
acagagtaggtgctcagtaaat

SEQ ID NO: 8581654 - DNA, 22 bp, Homo sapiens
aagcatttcaatataatattca

SEQ ID NO: 8581655 - DNA, 22 bp, Homo sapiens
aagcatttatagataagaattt

SEQ ID NO: 8581656 - DNA, 22 bp, Homo sapiens
aagcatttcaatataatattca

SEQ ID NO: 8581657 - DNA, 22 bp, Homo sapiens
aacgcccgtggttgccaaggta

SEQ ID NO: 8581658 - DNA, 22 bp, Homo sapiens
aactgcaataacttgtgcacca

SEQ ID NO: 8581659 - DNA, 22 bp, Homo sapiens
aacatgctttgataaataaaag

SEQ ID NO: 8581660 - DNA, 22 bp, Homo sapiens
aacagtaaaaatcatttagttg

SEQ ID NO: 8581661 - DNA, 22 bp, Homo sapiens
aacaaactcaaatggaagagtg

SEQ ID NO: 8581662 - DNA, 20 bp, Homo sapiens
aacaaactacaaaattatgt

SEQ ID NO: 8581663 - DNA, 22 bp, Homo sapiens
aaattgcacaatatagacatga

SEQ ID NO: 8581664 - DNA, 22 bp, Homo sapiens
aaattgcagatgctaaatgact

SEQ ID NO: 8581665 - DNA, 19 bp, Homo sapiens
aaatgtgcactgttttcca

SEQ ID NO: 8581666 - DNA, 22 bp, Homo sapiens
aaatgtgatactgttcttttta

SEQ ID NO: 8581667 - DNA, 22 bp, Homo sapiens
aacaaagtttcaggaagataga

SEQ ID NO: 8581668 - DNA, 22 bp, Homo sapiens
aacagcatatttcatatattga

SEQ ID NO: 8581669 - DNA, 22 bp, Homo sapiens
aacagcatcaccccataacatt

SEQ ID NO: 8581670 - DNA, 22 bp, Homo sapiens
aaatgtaagtctttgtttctta

SEQ ID NO: 8581671 - DNA, 22 bp, Homo sapiens
aagcatctcctcatcatttggg

SEQ ID NO: 8581672 - DNA, 19 bp, Homo sapiens
aagcatctttgaaactggg

SEQ ID NO: 8581673 - DNA, 20 bp, Homo sapiens
aagcatctggatgtagcaat

SEQ ID NO: 8581674 - DNA, 22 bp, Homo sapiens
aagcatcttaaaaagtatcaga

SEQ ID NO: 8581675 - DNA, 22 bp, Homo sapiens
aagctcttgagtaaactagttt

SEQ ID NO: 8581676 - DNA, 22 bp, Homo sapiens
aaattttagactcctgggtcta

SEQ ID NO: 8581677 - DNA, 22 bp, Homo sapiens
aaagccacagttctatgtctgc

SEQ ID NO: 8581678 - DNA, 22 bp, Homo sapiens
aaagatatgtctccaaagagat

SEQ ID NO: 8581679 - DNA, 22 bp, Homo sapiens
aacagagtggagccaaactttg

SEQ ID NO: 8581680 - DNA, 22 bp, Homo sapiens
aacagcaatagcactattcatt

SEQ ID NO: 8581681 - DNA, 22 bp, Homo sapiens
aaattaagggtgagaagagttg

SEQ ID NO: 8581682 - DNA, 22 bp, Homo sapiens
aaattaagggtgagaagagttg

SEQ ID NO: 8581683 - DNA, 22 bp, Homo sapiens
aaattaagagtaactctgtaga

SEQ ID NO: 8581684 - DNA, 22 bp, Homo sapiens
aaagagtctggcgttttaatgg

SEQ ID NO: 8581685 - DNA, 21 bp, Homo sapiens
aaactgaccttgcctgagaca

SEQ ID NO: 8581686 - DNA, 22 bp, Homo sapiens
aaagaataccctgggtcataaa

SEQ ID NO: 8581687 - DNA, 22 bp, Homo sapiens
aaactctagtaaaatgtattca

SEQ ID NO: 8581688 - DNA, 22 bp, Homo sapiens
aaagttcagtgccttctataca

SEQ ID NO: 8581689 - DNA, 22 bp, Homo sapiens
aaacagtgtttttatgatttat

SEQ ID NO: 8581690 - DNA, 22 bp, Homo sapiens
aaacagtggccaattctggaga

SEQ ID NO: 8581691 - DNA, 22 bp, Homo sapiens
aaaagacatctatttcaggcag

SEQ ID NO: 8581692 - DNA, 22 bp, Homo sapiens
aaaagacatctatttcaggcag

SEQ ID NO: 8581693 - DNA, 22 bp, Homo sapiens
aaaaaccattgtcttcagtctc

SEQ ID NO: 8581694 - DNA, 22 bp, Homo sapiens
aaacaaacaattagttgtgtgg

SEQ ID NO: 8581695 - DNA, 22 bp, Homo sapiens
aaacaagcaagcacataatttt

SEQ ID NO: 8581696 - DNA, 23 bp, Homo sapiens
acaaatgcccatacatctagttc

SEQ ID NO: 8581697 - DNA, 22 bp, Homo sapiens
acaaatgccatatataaattct

SEQ ID NO: 8581698 - DNA, 22 bp, Homo sapiens
acaaacagctaacatatgttaa

SEQ ID NO: 8581699 - DNA, 22 bp, Homo sapiens
acaaaattacctagttattttc

SEQ ID NO: 8581700 - DNA, 22 bp, Homo sapiens
acaatgttttgaaacatctagg

SEQ ID NO: 8581701 - DNA, 22 bp, Homo sapiens
agcaagattttccttgaatgtt

SEQ ID NO: 8581702 - DNA, 22 bp, Homo sapiens
agcaagctgtcaagagagctga

SEQ ID NO: 8581703 - DNA, 22 bp, Homo sapiens
agcaagctaacataggagattg

SEQ ID NO: 8581704 - DNA, 22 bp, Homo sapiens
acaaatgttacataagtttgga

SEQ ID NO: 8581705 - DNA, 21 bp, Homo sapiens
aatgtcattgaatggtgagac

SEQ ID NO: 8581706 - DNA, 22 bp, Homo sapiens
aatgtcatgggaatttattcat

SEQ ID NO: 8581707 - DNA, 22 bp, Homo sapiens
aatgtcatagcatttcttcaat

SEQ ID NO: 8581708 - DNA, 22 bp, Homo sapiens
aatgtcatgagcctgctcttgt

SEQ ID NO: 8581709 - DNA, 22 bp, Homo sapiens
aatgtcatattagtttgtgcct

SEQ ID NO: 8581710 - DNA, 22 bp, Homo sapiens
aatgtcatttttaaatgtgaga

SEQ ID NO: 8581711 - DNA, 22 bp, Homo sapiens
aatgtcatttaggattatgttt

SEQ ID NO: 8581712 - DNA, 22 bp, Homo sapiens
aatgtcattggtaaagattagg

SEQ ID NO: 8581713 - DNA, 22 bp, Homo sapiens
aatgtcattgtgagttaggctt

SEQ ID NO: 8581714 - DNA, 22 bp, Homo sapiens
aatgtcatttaaaataattctg

SEQ ID NO: 8581715 - DNA, 22 bp, Homo sapiens
aatgtttcgtaaattgtctatg

SEQ ID NO: 8581716 - DNA, 22 bp, Homo sapiens
aatgtttctggatattgtgggt

SEQ ID NO: 8581717 - DNA, 22 bp, Homo sapiens
aatgtttcatttagttgtctcc

SEQ ID NO: 8581718 - DNA, 22 bp, Homo sapiens
aatgtttcaattaagtctttta

SEQ ID NO: 8581719 - DNA, 18 bp, Homo sapiens
agcagtgtggcaagcaga

SEQ ID NO: 8581720 - DNA, 22 bp, Homo sapiens
agccattttcctgaaatataac

SEQ ID NO: 8581721 - DNA, 22 bp, Homo sapiens
agccattttggtaatgataaca

SEQ ID NO: 8581722 - DNA, 23 bp, Homo sapiens
aagtaacagggataatagcagtt

SEQ ID NO: 8581723 - DNA, 22 bp, Homo sapiens
aaggcttgtagatttgggcttt

SEQ ID NO: 8581724 - DNA, 22 bp, Homo sapiens
aaggcttggtctagtcatgcca

SEQ ID NO: 8581725 - DNA, 22 bp, Homo sapiens
acagtagtctcaggaataggca

SEQ ID NO: 8581726 - DNA, 22 bp, Homo sapiens
aagttagagattccatcatgct

SEQ ID NO: 8581727 - DNA, 23 bp, Homo sapiens
aagtcagagccaagtcaatgaga

SEQ ID NO: 8581728 - DNA, 22 bp, Homo sapiens
aagtcagaaaacagagcaatta

SEQ ID NO: 8581729 - DNA, 22 bp, Homo sapiens
aagtttcaaatataaaattaca

SEQ ID NO: 8581730 - DNA, 21 bp, Homo sapiens
aagttgtctcttttggttcct

SEQ ID NO: 8581731 - DNA, 22 bp, Homo sapiens
aatattcatttgcagaagaagt

SEQ ID NO: 8581732 - DNA, 22 bp, Homo sapiens
aatatatttgaatcaggaacaa

SEQ ID NO: 8581733 - DNA, 22 bp, Homo sapiens
atggctaaacctgaactggtct

SEQ ID NO: 8581734 - DNA, 22 bp, Homo sapiens
agagacagggttttgtcgtgtt

SEQ ID NO: 8581735 - DNA, 22 bp, Homo sapiens
agacattttacattcttccatt

SEQ ID NO: 8581736 - DNA, 22 bp, Homo sapiens
agagcatccatttttgtcacat

SEQ ID NO: 8581737 - DNA, 22 bp, Homo sapiens
atgaaatttgctgctaagttcc

SEQ ID NO: 8581738 - DNA, 22 bp, Homo sapiens
agacagcatgatacatgatgct

SEQ ID NO: 8581739 - DNA, 22 bp, Homo sapiens
agacatttggaagatacacata

SEQ ID NO: 8581740 - DNA, 22 bp, Homo sapiens
atgacaaaggctgaaagggaaa

SEQ ID NO: 8581741 - DNA, 22 bp, Homo sapiens
attcatttgctattgtgtatgg

SEQ ID NO: 8581742 - DNA, 22 bp, Homo sapiens
attgcattgtttgaggcagagg

SEQ ID NO: 8581743 - DNA, 22 bp, Homo sapiens
agataaaatggttcaaaggcta

SEQ ID NO: 8581744 - DNA, 22 bp, Homo sapiens
atttcactctccctgccactta

SEQ ID NO: 8581745 - DNA, 17 bp, Homo sapiens
atttcacttagcatgag

SEQ ID NO: 8581746 - DNA, 22 bp, Homo sapiens
atttgtttatcgtcgattgtag

SEQ ID NO: 8581747 - DNA, 22 bp, Homo sapiens
cacccaggctggagtgcagtga

SEQ ID NO: 8581748 - DNA, 22 bp, Homo sapiens
cactgctacctctgcctcccgg

SEQ ID NO: 8581749 - DNA, 22 bp, Homo sapiens
cacccaggctggagtgcattgg

SEQ ID NO: 8581750 - DNA, 22 bp, Homo sapiens
cacccaggctggagtgcagtgg

SEQ ID NO: 8581751 - DNA, 22 bp, Homo sapiens
agcagcaggcttaaggaaaagt

SEQ ID NO: 8581752 - DNA, 22 bp, Homo sapiens
agcagcagggacaaaggaacag

SEQ ID NO: 8581753 - DNA, 22 bp, Homo sapiens
caagcactgtggcactcgcagg

SEQ ID NO: 8581754 - DNA, 22 bp, Homo sapiens
caaatagtttttcatgtattat

SEQ ID NO: 8581755 - DNA, 22 bp, Homo sapiens
agcacattttatttaagaaaat

SEQ ID NO: 8581756 - DNA, 22 bp, Homo sapiens
cagagaaaaaatcctgctctca

SEQ ID NO: 8581757 - DNA, 22 bp, Homo sapiens
cagagaaaaaatcctgctctca

SEQ ID NO: 8581758 - DNA, 22 bp, Homo sapiens
cagagaaactcagatagctgat

SEQ ID NO: 8581759 - DNA, 22 bp, Homo sapiens
cagagaaagaagcccattcatt

SEQ ID NO: 8581760 - DNA, 22 bp, Homo sapiens
cagagaaagacttgcccttagt

SEQ ID NO: 8581761 - DNA, 22 bp, Homo sapiens
cagagaaagggtgaattccttc

SEQ ID NO: 8581762 - DNA, 22 bp, Homo sapiens
cagagaaagggtgaattccttc

SEQ ID NO: 8581763 - DNA, 22 bp, Homo sapiens
cagcagttatgagtagaatagt

SEQ ID NO: 8581764 - DNA, 22 bp, Homo sapiens
agtaaacactgtctttatatat

SEQ ID NO: 8581765 - DNA, 22 bp, Homo sapiens
agtaaacacgtggggtttcttt

SEQ ID NO: 8581766 - DNA, 22 bp, Homo sapiens
acgcccggtctccatagttttt

SEQ ID NO: 8581767 - DNA, 22 bp, Homo sapiens
acgcccagactcccatactttg

SEQ ID NO: 8581768 - DNA, 22 bp, Homo sapiens
atattcatcgtgtagaaatact

SEQ ID NO: 8581769 - DNA, 22 bp, Homo sapiens
atatttataagcaagcaggact

SEQ ID NO: 8581770 - DNA, 22 bp, Homo sapiens
atattcttccaaaacatcattt

SEQ ID NO: 8581771 - DNA, 22 bp, Homo sapiens
atattcttatccttttctctgt

SEQ ID NO: 8581772 - DNA, 22 bp, Homo sapiens
atatgaaagtaagcatgtgtgt

SEQ ID NO: 8581773 - DNA, 22 bp, Homo sapiens
actttcatggtagttgtattct

SEQ ID NO: 8581774 - DNA, 22 bp, Homo sapiens
actttcatggatctctgttcag

SEQ ID NO: 8581775 - DNA, 22 bp, Homo sapiens
actttcaagaacttctttaatg

SEQ ID NO: 8581776 - DNA, 22 bp, Homo sapiens
actttccttatggatggggaaa

SEQ ID NO: 8581777 - DNA, 22 bp, Homo sapiens
actttcctgccaaggccagagt

SEQ ID NO: 8581778 - DNA, 22 bp, Homo sapiens
actttcctggccctgtcctctg

SEQ ID NO: 8581779 - DNA, 22 bp, Homo sapiens
actttcctagacttcagtgaca

SEQ ID NO: 8581780 - DNA, 22 bp, Homo sapiens
atcctttcatctggtaatatat

SEQ ID NO: 8581781 - DNA, 22 bp, Homo sapiens
acagtacaccactgtgtacagt

SEQ ID NO: 8581782 - DNA, 22 bp, Homo sapiens
acagtatgaatgcagaatgtag

SEQ ID NO: 8581783 - DNA, 22 bp, Homo sapiens
acatatttccatgcagcatgtc

SEQ ID NO: 8581784 - DNA, 22 bp, Homo sapiens
acatcatgagagacttaaattg

SEQ ID NO: 8581785 - DNA, 22 bp, Homo sapiens
aggcttgtggggaatctgtgtg

SEQ ID NO: 8581786 - DNA, 22 bp, Homo sapiens
aggcttgtctcagaagatgctg

SEQ ID NO: 8581787 - DNA, 22 bp, Homo sapiens
acccaggctggagtgcagtgtc

SEQ ID NO: 8581788 - DNA, 22 bp, Homo sapiens
acccaggctggagtgcagtggt

SEQ ID NO: 8581789 - DNA, 22 bp, Homo sapiens
acccaggctggagtgcagtgat

SEQ ID NO: 8581790 - DNA, 22 bp, Homo sapiens
acccaggctggagtgcagtggg

SEQ ID NO: 8581791 - DNA, 22 bp, Homo sapiens
acccaggctggagtgcagtggc

SEQ ID NO: 8581792 - DNA, 22 bp, Homo sapiens
acccaggctggagtgcagtgac

SEQ ID NO: 8581793 - DNA, 22 bp, Homo sapiens
ataatgttgatgattgtctttg

SEQ ID NO: 8581794 - DNA, 22 bp, Homo sapiens
ataggcttggcttattcttggg

SEQ ID NO: 8581795 - DNA, 20 bp, Homo sapiens
atagacaaagacatgccaga

SEQ ID NO: 8581796 - DNA, 22 bp, Homo sapiens
atagaattctttgaaatttatg

SEQ ID NO: 8581797 - DNA, 22 bp, Homo sapiens
atagaatttgcactaaatctgc

SEQ ID NO: 8581798 - DNA, 22 bp, Homo sapiens
ctgatacaatgtctgctttata

SEQ ID NO: 8581799 - DNA, 22 bp, Homo sapiens
ctgatacatagtagcatgtcat

SEQ ID NO: 8581800 - DNA, 22 bp, Homo sapiens
atccttcaaaaggaatagcagg

SEQ ID NO: 8581801 - DNA, 22 bp, Homo sapiens
cttcagcagcctcttgcataaa

SEQ ID NO: 8581802 - DNA, 22 bp, Homo sapiens
cttcagcaactttggaatgttt

SEQ ID NO: 8581803 - DNA, 22 bp, Homo sapiens
agtcagagagctctcagcatag

SEQ ID NO: 8581804 - DNA, 22 bp, Homo sapiens
ctacacagttctgcctaatggc

SEQ ID NO: 8581805 - DNA, 21 bp, Homo sapiens
ctacacagctttctataggaa

SEQ ID NO: 8581806 - DNA, 22 bp, Homo sapiens
agtaacagggtatttgtgtggg

SEQ ID NO: 8581807 - DNA, 19 bp, Homo sapiens
aggagaagtagcagaaatt

SEQ ID NO: 8581808 - DNA, 22 bp, Homo sapiens
catattgtaaaaggttgaatcc

SEQ ID NO: 8581809 - DNA, 22 bp, Homo sapiens
cataggaatgaggacaattagc

SEQ ID NO: 8581810 - DNA, 22 bp, Homo sapiens
cagtggcgtgatctctgctcac

SEQ ID NO: 8581811 - DNA, 22 bp, Homo sapiens
ccaagctggatttagctgcaca

SEQ ID NO: 8581812 - DNA, 22 bp, Homo sapiens
cccttcagtgctaggctgcctg

SEQ ID NO: 8581813 - DNA, 22 bp, Homo sapiens
ccgaggtcctggacttggccct

SEQ ID NO: 8581814 - DNA, 22 bp, Homo sapiens
aggctcatctgagcagaaacct

SEQ ID NO: 8581815 - DNA, 22 bp, Homo sapiens
aggctcagcctgggcctagagc

SEQ ID NO: 8581816 - DNA, 22 bp, Homo sapiens
attttagagctccaagtacagc

SEQ ID NO: 8581817 - DNA, 22 bp, Homo sapiens
caaagaatgagtgagtacataa

SEQ ID NO: 8581818 - DNA, 22 bp, Homo sapiens
atttcaacgttagatgtaatag

SEQ ID NO: 8581819 - DNA, 22 bp, Homo sapiens
gccatcatatcccctgtgacct

SEQ ID NO: 8581820 - DNA, 22 bp, Homo sapiens
atttcaacagagtttgaaggca

SEQ ID NO: 8581821 - DNA, 22 bp, Homo sapiens
atttcccaggactagaaatata

SEQ ID NO: 8581822 - DNA, 22 bp, Homo sapiens
attataggcttgagccaccgtg

SEQ ID NO: 8581823 - DNA, 22 bp, Homo sapiens
attataggcttgagccaccgtg

SEQ ID NO: 8581824 - DNA, 22 bp, Homo sapiens
attatgaagttgagggaccctg

SEQ ID NO: 8581825 - DNA, 22 bp, Homo sapiens
gcagagaaggattgaaaccaga

SEQ ID NO: 8581826 - DNA, 21 bp, Homo sapiens
gcagagaatgaactttggctt

SEQ ID NO: 8581827 - DNA, 22 bp, Homo sapiens
attccacaagaccataaattag

SEQ ID NO: 8581828 - DNA, 22 bp, Homo sapiens
attctttccagacactgattgc

SEQ ID NO: 8581829 - DNA, 22 bp, Homo sapiens
attcttttcccaactgctttaa

SEQ ID NO: 8581830 - DNA, 22 bp, Homo sapiens
atgcagtggcttcagtgtcagt

SEQ ID NO: 8581831 - DNA, 21 bp, Homo sapiens
gagaatcaggaaggattgatg

SEQ ID NO: 8581832 - DNA, 22 bp, Homo sapiens
atgtcagatcctcagaaagtct

SEQ ID NO: 8581833 - DNA, 22 bp, Homo sapiens
atgtcagatgtttatctgattt

SEQ ID NO: 8581834 - DNA, 22 bp, Homo sapiens
atgttacagggagagaaggcca

SEQ ID NO: 8581835 - DNA, 22 bp, Homo sapiens
caatagcaggtctacagagaga

SEQ ID NO: 8581836 - DNA, 22 bp, Homo sapiens
caatagcagacctagaaagcaa

SEQ ID NO: 8581837 - DNA, 22 bp, Homo sapiens
caaggctgctgcgggtcgcacc

SEQ ID NO: 8581838 - DNA, 22 bp, Homo sapiens
caaggctgcaaaactacatggg

SEQ ID NO: 8581839 - DNA, 22 bp, Homo sapiens
caatcacaaagagacaagtgtc

SEQ ID NO: 8581840 - DNA, 22 bp, Homo sapiens
caatttcaagattctgttcttt

SEQ ID NO: 8581841 - DNA, 22 bp, Homo sapiens
caattctttcagctgcatttgt

SEQ ID NO: 8581842 - DNA, 18 bp, Homo sapiens
caatttcatccttaagcc

SEQ ID NO: 8581843 - DNA, 22 bp, Homo sapiens
caatttcagacctttccttgga

SEQ ID NO: 8581844 - DNA, 22 bp, Homo sapiens
caagaagccgagctacaggctc

SEQ ID NO: 8581845 - DNA, 22 bp, Homo sapiens
caaattttgtgtgttctctagt

SEQ ID NO: 8581846 - DNA, 22 bp, Homo sapiens
cactgcaacctccacctcctgg

SEQ ID NO: 8581847 - DNA, 22 bp, Homo sapiens
ggcaatttggtcatttgtattg

SEQ ID NO: 8581848 - DNA, 22 bp, Homo sapiens
cacatgtttgctacatttttct

SEQ ID NO: 8581849 - DNA, 22 bp, Homo sapiens
cacagtgactggcacatagtaa

SEQ ID NO: 8581850 - DNA, 22 bp, Homo sapiens
cagaaacacttgtagagaagtt

SEQ ID NO: 8581851 - DNA, 22 bp, Homo sapiens
cagacaaagcggaaactgttta

SEQ ID NO: 8581852 - DNA, 22 bp, Homo sapiens
cagaaacaggcaacgtgtgcac

SEQ ID NO: 8581853 - DNA, 22 bp, Homo sapiens
cagaaacagagaaatattggct

SEQ ID NO: 8581854 - DNA, 22 bp, Homo sapiens
cagaaacagacatgacgcagta

SEQ ID NO: 8581855 - DNA, 22 bp, Homo sapiens
gtcacacaatagtaagtggtcc

SEQ ID NO: 8581856 - DNA, 22 bp, Homo sapiens
cagattttgatgaatgtggaaa

SEQ ID NO: 8581857 - DNA, 22 bp, Homo sapiens
ccacttttgggaacagtgagta

SEQ ID NO: 8581858 - DNA, 22 bp, Homo sapiens
tcctgaagtatgggtatggagt

SEQ ID NO: 8581859 - DNA, 22 bp, Homo sapiens
tcctgaagtcacaggctctgag

SEQ ID NO: 8581860 - DNA, 22 bp, Homo sapiens
ccaccgccatggcgttgtacag

SEQ ID NO: 8581861 - DNA, 22 bp, Homo sapiens
tccctagtcgcatctgtggaga

SEQ ID NO: 8581862 - DNA, 18 bp, Homo sapiens
cattcttggcagcttttg

SEQ ID NO: 8581863 - DNA, 22 bp, Homo sapiens
tccccagaggaatatgagattg

SEQ ID NO: 8581864 - DNA, 22 bp, Homo sapiens
tccctaaactctgaactgattc

SEQ ID NO: 8581865 - DNA, 22 bp, Homo sapiens
cattcattcacattttgtctat

SEQ ID NO: 8581866 - DNA, 22 bp, Homo sapiens
cattcattagaatagatatgta

SEQ ID NO: 8581867 - DNA, 22 bp, Homo sapiens
tcattcttgcgtatgccatggt

SEQ ID NO: 8581868 - DNA, 22 bp, Homo sapiens
tatttcttttcgtgacttattg

SEQ ID NO: 8581869 - DNA, 21 bp, Homo sapiens
tcaggaaacacctcttaagga

SEQ ID NO: 8581870 - DNA, 22 bp, Homo sapiens
tcaggaaagagtaatgtataca

SEQ ID NO: 8581871 - DNA, 22 bp, Homo sapiens
cagtgccagaggtactagtgga

SEQ ID NO: 8581872 - DNA, 22 bp, Homo sapiens
cagtgccatattgaaagacatt

SEQ ID NO: 8581873 - DNA, 22 bp, Homo sapiens
tagctaatggtgaagattcaga

SEQ ID NO: 8581874 - DNA, 22 bp, Homo sapiens
tagcaagatgtcactccaagtt

SEQ ID NO: 8581875 - DNA, 22 bp, Homo sapiens
tagtctttttaataaataatgc

SEQ ID NO: 8581876 - DNA, 22 bp, Homo sapiens
tagtgaaacctgacagatcatg

SEQ ID NO: 8581877 - DNA, 22 bp, Homo sapiens
tgtcaacagatactagagagct

SEQ ID NO: 8581878 - DNA, 22 bp, Homo sapiens
tgtaatgaaaaggaggaaatag

SEQ ID NO: 8581879 - DNA, 22 bp, Homo sapiens
ccaggcttggtgtgtggtcagg

SEQ ID NO: 8581880 - DNA, 22 bp, Homo sapiens
ccaggctttaagaggtggaaac

SEQ ID NO: 8581881 - DNA, 19 bp, Homo sapiens
ccaggctttatgcaaatac

SEQ ID NO: 8581882 - DNA, 22 bp, Homo sapiens
tgagaaaactcaaagacagatc

SEQ ID NO: 8581883 - DNA, 22 bp, Homo sapiens
tgaaggaaagagggaacatccc

SEQ ID NO: 8581884 - DNA, 22 bp, Homo sapiens
tgaagctttaggatgggttcat

SEQ ID NO: 8581885 - DNA, 22 bp, Homo sapiens
tgaaggaatgagtatactgttt

SEQ ID NO: 8581886 - DNA, 22 bp, Homo sapiens
tgaaggaatgagggagtgggtc

SEQ ID NO: 8581887 - DNA, 22 bp, Homo sapiens
tttctattttaaaggcatatgg

SEQ ID NO: 8581888 - DNA, 22 bp, Homo sapiens
ctctctttttcgtgtgccgaag

SEQ ID NO: 8581889 - DNA, 22 bp, Homo sapiens
tttccacccagagcatttgttt

SEQ ID NO: 8581890 - DNA, 22 bp, Homo sapiens
ttattgcaactcctaaatagag

SEQ ID NO: 8581891 - DNA, 23 bp, Homo sapiens
ttattgcaaggtaaaattgctga

SEQ ID NO: 8581892 - DNA, 22 bp, Homo sapiens
cggagtcttgctatgttgccca

SEQ ID NO: 8581893 - DNA, 22 bp, Homo sapiens
ttcaaatgcaagttactacttt

SEQ ID NO: 8581894 - DNA, 22 bp, Homo sapiens
ttacaaagagtgccagagtgtg

SEQ ID NO: 8581895 - DNA, 21 bp, Homo sapiens
ttacaaagcaagtgctgtgtc

SEQ ID NO: 8581896 - DNA, 22 bp, Homo sapiens
ttacaaagattatattcagtta

SEQ ID NO: 8581897 - DNA, 22 bp, Homo sapiens
ttacaaagagtgttcttttcca

SEQ ID NO: 8581898 - DNA, 22 bp, Homo sapiens
ttacaaagcgctttacctctga

SEQ ID NO: 8581899 - DNA, 22 bp, Homo sapiens
ttacaaagcaggtcagctgaaa

SEQ ID NO: 8581900 - DNA, 22 bp, Homo sapiens
ttacaaagcgttgagacaagta

SEQ ID NO: 8581901 - DNA, 22 bp, Homo sapiens
ttaaattatttctagtgaggtg

SEQ ID NO: 8581902 - DNA, 22 bp, Homo sapiens
ttaaattattgagggattgtca

SEQ ID NO: 8581903 - DNA, 22 bp, Homo sapiens
ttaaattatttctagtgaggtg

SEQ ID NO: 8581904 - DNA, 22 bp, Homo sapiens
ttaaattagtcaagcttctctg

SEQ ID NO: 8581905 - DNA, 22 bp, Homo sapiens
ttaaattagtcaagcttctctg

SEQ ID NO: 8581906 - DNA, 22 bp, Homo sapiens
ttagcaaatatcttgaaacagg

SEQ ID NO: 8581907 - DNA, 22 bp, Homo sapiens
ttagacagagctccttgagggc

SEQ ID NO: 8581908 - DNA, 23 bp, Homo sapiens
ccttcagaagaagtaacaggggc

SEQ ID NO: 8581909 - DNA, 22 bp, Homo sapiens
ccttcagaatgaaattctaatg

SEQ ID NO: 8581910 - DNA, 22 bp, Homo sapiens
ccttcagaggtgtagattgcgt

SEQ ID NO: 8581911 - DNA, 22 bp, Homo sapiens
ttgcatagtgctgaggttcggg

SEQ ID NO: 8581912 - DNA, 22 bp, Homo sapiens
ctagagaaacagtgctctgaac

SEQ ID NO: 8581913 - DNA, 22 bp, Homo sapiens
ctagagaaaatgatagcaggaa

SEQ ID NO: 8581914 - DNA, 22 bp, Homo sapiens
ctagagaatcttttaagaagtg

SEQ ID NO: 8581915 - DNA, 22 bp, Homo sapiens
ctagagaacaacattcatatgg

SEQ ID NO: 8581916 - DNA, 22 bp, Homo sapiens
ctagagaattgtcttgagagtt

SEQ ID NO: 8581917 - DNA, 22 bp, Homo sapiens
ttctatttccagtccttcagag

SEQ ID NO: 8581918 - DNA, 21 bp, Homo sapiens
ttctttctgaatctgaagtat

SEQ ID NO: 8581919 - DNA, 22 bp, Homo sapiens
ttctttctgtcatggtgtactg

SEQ ID NO: 8581920 - DNA, 22 bp, Homo sapiens
gaaagacatagttgcaagatgg

SEQ ID NO: 8581921 - DNA, 20 bp, Homo sapiens
gaaatgtatctcttgattct

SEQ ID NO: 8581922 - DNA, 22 bp, Homo sapiens
gaaatgtaggcataattatttt

SEQ ID NO: 8581923 - DNA, 22 bp, Homo sapiens
gaagaagggagtgacaaatgca

SEQ ID NO: 8581924 - DNA, 22 bp, Homo sapiens
gaaattgtcagcttctttcagt

SEQ ID NO: 8581925 - DNA, 22 bp, Homo sapiens
gaaaaatgctccaaatctgtgg

SEQ ID NO: 8581926 - DNA, 22 bp, Homo sapiens
cttgctttatctggtttctcat

SEQ ID NO: 8581927 - DNA, 22 bp, Homo sapiens
ctgtgaattgcaacaattgcaa

SEQ ID NO: 8581928 - DNA, 22 bp, Homo sapiens
ctgtgaatttaaagcacacatc

SEQ ID NO: 8581929 - DNA, 22 bp, Homo sapiens
ctgtggcaggaagggactagca

SEQ ID NO: 8581930 - DNA, 22 bp, Homo sapiens
ctgtggcattgtgaggactgca

SEQ ID NO: 8581931 - DNA, 22 bp, Homo sapiens
gaatggaaactgggagatggcc

SEQ ID NO: 8581932 - DNA, 20 bp, Homo sapiens
gaattttatgaacactacca

SEQ ID NO: 8581933 - DNA, 22 bp, Homo sapiens
gaattttattactagtcaactg

SEQ ID NO: 8581934 - DNA, 22 bp, Homo sapiens
gacaaaagtgttttgaacaagg

SEQ ID NO: 8581935 - DNA, 22 bp, Homo sapiens
gacaaaactgagatcacactgt

SEQ ID NO: 8581936 - DNA, 18 bp, Homo sapiens
gacaaaagtacagacaga

SEQ ID NO: 8581937 - DNA, 22 bp, Homo sapiens
gaccttcagtgtgtttctcaca

SEQ ID NO: 8581938 - DNA, 22 bp, Homo sapiens
gaccttcaagcaccatatttat

SEQ ID NO: 8581939 - DNA, 22 bp, Homo sapiens
gagcactgtactcatttgcact

SEQ ID NO: 8581940 - DNA, 22 bp, Homo sapiens
gagcactgatttatttttgtct

SEQ ID NO: 8581941 - DNA, 22 bp, Homo sapiens
gagcaacttcaatagtactatt

SEQ ID NO: 8581942 - DNA, 22 bp, Homo sapiens
gagaagcaggtttagcagacaa

SEQ ID NO: 8581943 - DNA, 22 bp, Homo sapiens
gagaagcaatttccaactgtgc

SEQ ID NO: 8581944 - DNA, 22 bp, Homo sapiens
gagaagcaatcgtgacatctcc

SEQ ID NO: 8581945 - DNA, 22 bp, Homo sapiens
gagaagcaatcagcagccaccc

SEQ ID NO: 8581946 - DNA, 22 bp, Homo sapiens
gagaagcaatcagtggccaccc

SEQ ID NO: 8581947 - DNA, 22 bp, Homo sapiens
gaggctatgaggagtgaggttt

SEQ ID NO: 8581948 - DNA, 22 bp, Homo sapiens
gaggtggcttagtctctggaca

SEQ ID NO: 8581949 - DNA, 22 bp, Homo sapiens
tccattatacttctgattcaaa

SEQ ID NO: 8581950 - DNA, 22 bp, Homo sapiens
tcctgaaggagcagttgctggg

SEQ ID NO: 8581951 - DNA, 22 bp, Homo sapiens
tcctgaaggcagatggggatca

SEQ ID NO: 8581952 - DNA, 22 bp, Homo sapiens
tcctgaagcctgagtgatgact

SEQ ID NO: 8581953 - DNA, 22 bp, Homo sapiens
tcctgaagctctcttaaggaaa

SEQ ID NO: 8581954 - DNA, 22 bp, Homo sapiens
tcctgaagatgaaaagagaggt

SEQ ID NO: 8581955 - DNA, 22 bp, Homo sapiens
tcctgaagcagttagcatgagc

SEQ ID NO: 8581956 - DNA, 22 bp, Homo sapiens
tcctgaagagccctgctctgtg

SEQ ID NO: 8581957 - DNA, 22 bp, Homo sapiens
tcctgaagaaggcagatatttg

SEQ ID NO: 8581958 - DNA, 22 bp, Homo sapiens
tcctgaagaacgaagtcatgta

SEQ ID NO: 8581959 - DNA, 22 bp, Homo sapiens
tcagaatctctggaggcttggc

SEQ ID NO: 8581960 - DNA, 22 bp, Homo sapiens
tcagaatctaaataggctccag

SEQ ID NO: 8581961 - DNA, 22 bp, Homo sapiens
tcagaatctgaaaagcgcttgg

SEQ ID NO: 8581962 - DNA, 22 bp, Homo sapiens
tcagaatctttctagagtctag

SEQ ID NO: 8581963 - DNA, 22 bp, Homo sapiens
tcactgcaacctccacctcccg

SEQ ID NO: 8581964 - DNA, 22 bp, Homo sapiens
tcactgcaacctccacctcctg

SEQ ID NO: 8581965 - DNA, 18 bp, Homo sapiens
tcagacaagttagacagg

SEQ ID NO: 8581966 - DNA, 22 bp, Homo sapiens
tcagatttccttgcagtttgga

SEQ ID NO: 8581967 - DNA, 22 bp, Homo sapiens
tcagatttactgcagagcagat

SEQ ID NO: 8581968 - DNA, 22 bp, Homo sapiens
tcaggacagaaggctgccaggg

SEQ ID NO: 8581969 - DNA, 22 bp, Homo sapiens
tccaaatattatgattatagga

SEQ ID NO: 8581970 - DNA, 21 bp, Homo sapiens
tcatttctctatgtatttcac

SEQ ID NO: 8581971 - DNA, 22 bp, Homo sapiens
tcatttctattgctactgtctg

SEQ ID NO: 8581972 - DNA, 17 bp, Homo sapiens
tcatttcagtaaatcca

SEQ ID NO: 8581973 - DNA, 23 bp, Homo sapiens
tcatttcatccagccttgagagt

SEQ ID NO: 8581974 - DNA, 22 bp, Homo sapiens
tcatttcagccatttttaaatg

SEQ ID NO: 8581975 - DNA, 22 bp, Homo sapiens
tcatttcagccatttttaaatg

SEQ ID NO: 8581976 - DNA, 22 bp, Homo sapiens
tatgtcatgtcttagagaatga

SEQ ID NO: 8581977 - DNA, 22 bp, Homo sapiens
tatgaaaatttagctgaagcat

SEQ ID NO: 8581978 - DNA, 22 bp, Homo sapiens
tatgaaaaggtggccaatgtag

SEQ ID NO: 8581979 - DNA, 22 bp, Homo sapiens
tatttgcaaagaactacactag

SEQ ID NO: 8581980 - DNA, 22 bp, Homo sapiens
tattgtattaaggattcaagta

SEQ ID NO: 8581981 - DNA, 22 bp, Homo sapiens
tcaaatatgtgatagaagctaa

SEQ ID NO: 8581982 - DNA, 22 bp, Homo sapiens
tagcaaagagaaaaattatgct

SEQ ID NO: 8581983 - DNA, 22 bp, Homo sapiens
tagatgaatgacttatatgtca

SEQ ID NO: 8581984 - DNA, 21 bp, Homo sapiens
tagatgaaatcagagtatttc

SEQ ID NO: 8581985 - DNA, 22 bp, Homo sapiens
tagatgaaatgtgtgttattat

SEQ ID NO: 8581986 - DNA, 22 bp, Homo sapiens
tagcaaatacatgatgtaattt

SEQ ID NO: 8581987 - DNA, 22 bp, Homo sapiens
tagcaaatacatgatgtaattt

SEQ ID NO: 8581988 - DNA, 22 bp, Homo sapiens
tagcaaataaaacagtattgaa

SEQ ID NO: 8581989 - DNA, 22 bp, Homo sapiens
tagcaagaagctgtcacaggtg

SEQ ID NO: 8581990 - DNA, 22 bp, Homo sapiens
tagcaaatgtgttatgctatgc

SEQ ID NO: 8581991 - DNA, 22 bp, Homo sapiens
taagcattaactctgctgcaag

SEQ ID NO: 8581992 - DNA, 22 bp, Homo sapiens
tacacatacattgcttacaagg

SEQ ID NO: 8581993 - DNA, 21 bp, Homo sapiens
tacatgagtgtatgagcatat

SEQ ID NO: 8581994 - DNA, 22 bp, Homo sapiens
taccaaagattaaatagcaaca

SEQ ID NO: 8581995 - DNA, 22 bp, Homo sapiens
taagagacttaagaataattga

SEQ ID NO: 8581996 - DNA, 22 bp, Homo sapiens
taacagtatagcctaacatttc

SEQ ID NO: 8581997 - DNA, 22 bp, Homo sapiens
taacagtattgaagataaacta

SEQ ID NO: 8581998 - DNA, 22 bp, Homo sapiens
taacagtatatttaccaaacct

SEQ ID NO: 8581999 - DNA, 21 bp, Homo sapiens
taaaagatgacaagacagctc

SEQ ID NO: 8582000 - DNA, 22 bp, Homo sapiens
taaaagattttataggaacaag

SEQ ID NO: 8582001 - DNA, 22 bp, Homo sapiens
gttatattggcagaagagaaga

SEQ ID NO: 8582002 - DNA, 22 bp, Homo sapiens
gtttcacatgaaacttggggaa

SEQ ID NO: 8582003 - DNA, 22 bp, Homo sapiens
gctgtatgtgaggccacagtga

SEQ ID NO: 8582004 - DNA, 22 bp, Homo sapiens
gccaggcgggtctcaaactcct

SEQ ID NO: 8582005 - DNA, 22 bp, Homo sapiens
gcattcttggtggagtgctaaa

SEQ ID NO: 8582006 - DNA, 22 bp, Homo sapiens
gcattctttagactgagagata

SEQ ID NO: 8582007 - DNA, 21 bp, Homo sapiens
gcattcttcatgtgattcaga

SEQ ID NO: 8582008 - DNA, 22 bp, Homo sapiens
gcattcttcgaagtaagtagtg

SEQ ID NO: 8582009 - DNA, 22 bp, Homo sapiens
gtacaaagtggacctgatagta

SEQ ID NO: 8582010 - DNA, 22 bp, Homo sapiens
gtacaaaggcagaattgggtag

SEQ ID NO: 8582011 - DNA, 22 bp, Homo sapiens
gtgcaggatgttgggaatcagg

SEQ ID NO: 8582012 - DNA, 22 bp, Homo sapiens
ggaggaggggtgactgaatgct

SEQ ID NO: 8582013 - DNA, 22 bp, Homo sapiens
ggctcactgcaacttccgcctc

SEQ ID NO: 8582014 - DNA, 20 bp, Homo sapiens
ttctttgttccttacatttg

SEQ ID NO: 8582015 - DNA, 22 bp, Homo sapiens
ttctctgcctctagctatattc

SEQ ID NO: 8582016 - DNA, 22 bp, Homo sapiens
ttattcttttctccagaatccc

SEQ ID NO: 8582017 - DNA, 22 bp, Homo sapiens
ttattatgtggatgaaagatgt

SEQ ID NO: 8582018 - DNA, 22 bp, Homo sapiens
ttattatgtgctagagaatgta

SEQ ID NO: 8582019 - DNA, 22 bp, Homo sapiens
ttattctttaaacatatatgtt

SEQ ID NO: 8582020 - DNA, 22 bp, Homo sapiens
ttattatgccattacctccctg

SEQ ID NO: 8582021 - DNA, 22 bp, Homo sapiens
ttattatggcagttttctaggt

SEQ ID NO: 8582022 - DNA, 22 bp, Homo sapiens
ttattatggtatttctttgcag

SEQ ID NO: 8582023 - DNA, 22 bp, Homo sapiens
ttagctgctgattaaatatgtt

SEQ ID NO: 8582024 - DNA, 22 bp, Homo sapiens
ttaggaaagggttttctaacag

SEQ ID NO: 8582025 - DNA, 19 bp, Homo sapiens
ttaggaaaccactttcctt

SEQ ID NO: 8582026 - DNA, 22 bp, Homo sapiens
ttaggaaaagaagacatttcta

SEQ ID NO: 8582027 - DNA, 21 bp, Homo sapiens
ttcacagatgggaaaactgag

SEQ ID NO: 8582028 - DNA, 22 bp, Homo sapiens
tttatctcttttgaccaagatt

SEQ ID NO: 8582029 - DNA, 22 bp, Homo sapiens
tttatctgacctcacttcttaa

SEQ ID NO: 8582030 - DNA, 22 bp, Homo sapiens
tttatctgaaaaaactcttgga

SEQ ID NO: 8582031 - DNA, 22 bp, Homo sapiens
tttcaccatcttggccaggctg

SEQ ID NO: 8582032 - DNA, 20 bp, Homo sapiens
tttcaccatcttggccaggc

SEQ ID NO: 8582033 - DNA, 22 bp, Homo sapiens
tttcattgagactatagacatc

SEQ ID NO: 8582034 - DNA, 22 bp, Homo sapiens
tttcattcagcaccctgaggtg

SEQ ID NO: 8582035 - DNA, 22 bp, Homo sapiens
tttcaactcatgctaaaggaag

SEQ ID NO: 8582036 - DNA, 23 bp, Homo sapiens
ttgcattaatgtggaggcacagg

SEQ ID NO: 8582037 - DNA, 22 bp, Homo sapiens
ttgcagagatcagcaggtttga

SEQ ID NO: 8582038 - DNA, 21 bp, Homo sapiens
ttgcacagaaaaccatagaga

SEQ ID NO: 8582039 - DNA, 22 bp, Homo sapiens
ttgtcatcatgttttccaaagg

SEQ ID NO: 8582040 - DNA, 22 bp, Homo sapiens
ttgtcacctatactgagcttaa

SEQ ID NO: 8582041 - DNA, 22 bp, Homo sapiens
ttgtcaccatatttcattttga

SEQ ID NO: 8582042 - DNA, 22 bp, Homo sapiens
ttgtcacccctagaggaattct

SEQ ID NO: 8582043 - DNA, 22 bp, Homo sapiens
ttgtaaatgaccttttctaatt

SEQ ID NO: 8582044 - DNA, 22 bp, Homo sapiens
ttttcatttttgtagatgcaag

SEQ ID NO: 8582045 - DNA, 22 bp, Homo sapiens
ttttctgacctatctacattta

SEQ ID NO: 8582046 - DNA, 22 bp, Homo sapiens
ttttaaaggatactcttgtcta

SEQ ID NO: 8582047 - DNA, 22 bp, Homo sapiens
ttttaatgtgctctgcaatgat

SEQ ID NO: 8582048 - DNA, 22 bp, Homo sapiens
ttttatgtcataaggacactca

SEQ ID NO: 8582049 - DNA, 18 bp, Homo sapiens
tttgctttccttcttcag

SEQ ID NO: 8582050 - DNA, 19 bp, Homo sapiens
tttgacagagtttgagcat

SEQ ID NO: 8582051 - DNA, 22 bp, Homo sapiens
tttgaatgagaattattgtcat

SEQ ID NO: 8582052 - DNA, 22 bp, Homo sapiens
tttccctacttgtaactggaaa

SEQ ID NO: 8582053 - DNA, 22 bp, Homo sapiens
tttttataccacctctcactta

SEQ ID NO: 8582054 - DNA, 22 bp, Homo sapiens
agaactgtcacgagtgacaaag

SEQ ID NO: 8582055 - DNA, 17 bp, Homo sapiens
agaactgtagtagctcc

SEQ ID NO: 8582056 - DNA, 22 bp, Homo sapiens
agaactgtgccaaaaattttgt

SEQ ID NO: 8582057 - DNA, 22 bp, Homo sapiens
aatagcatgttcatgataaaat

SEQ ID NO: 8582058 - DNA, 22 bp, Homo sapiens
aatagcatgtaagtttaaaaga

SEQ ID NO: 8582059 - DNA, 22 bp, Homo sapiens
aataggaaaatatttaacaaga

SEQ ID NO: 8582060 - DNA, 20 bp, Homo sapiens
aagcttcacttcatttgatc

SEQ ID NO: 8582061 - DNA, 22 bp, Homo sapiens
aaggatgcagggacccaaggct

SEQ ID NO: 8582062 - DNA, 22 bp, Homo sapiens
aaggacaagtagtatttgcatc

SEQ ID NO: 8582063 - DNA, 22 bp, Homo sapiens
aaggcaactgtaaaacatgcac

SEQ ID NO: 8582064 - DNA, 22 bp, Homo sapiens
acatttcagattcatgaagtga

SEQ ID NO: 8582065 - DNA, 22 bp, Homo sapiens
acagatataaactatagtagtg

SEQ ID NO: 8582066 - DNA, 22 bp, Homo sapiens
acagatatatgattgtgtaaat

SEQ ID NO: 8582067 - DNA, 22 bp, Homo sapiens
acagcagagtgtgagatagcca

SEQ ID NO: 8582068 - DNA, 22 bp, Homo sapiens
acagcagtgcacagagaaccct

SEQ ID NO: 8582069 - DNA, 22 bp, Homo sapiens
acagcagtcagtgaatatttaa

SEQ ID NO: 8582070 - DNA, 22 bp, Homo sapiens
agctaaatgtgaaatgtcaacc

SEQ ID NO: 8582071 - DNA, 22 bp, Homo sapiens
agctaaatcacttattctttca

SEQ ID NO: 8582072 - DNA, 22 bp, Homo sapiens
agcaaatacatttttagcataa

SEQ ID NO: 8582073 - DNA, 22 bp, Homo sapiens
agcaaatacttgaataaaaaga

SEQ ID NO: 8582074 - DNA, 23 bp, Homo sapiens
agcaaataatctgcttgcttttt

SEQ ID NO: 8582075 - DNA, 22 bp, Homo sapiens
agcaaataattgtctttgaggg

SEQ ID NO: 8582076 - DNA, 19 bp, Homo sapiens
agcaaatacatcaaaattg

SEQ ID NO: 8582077 - DNA, 22 bp, Homo sapiens
agagcaacgaggtgatactaga

SEQ ID NO: 8582078 - DNA, 22 bp, Homo sapiens
agagcaagtgacagaaacaggg

SEQ ID NO: 8582079 - DNA, 22 bp, Homo sapiens
agagaagggggaaagatctcac

SEQ ID NO: 8582080 - DNA, 22 bp, Homo sapiens
aattaatatttgtggaattaat

SEQ ID NO: 8582081 - DNA, 22 bp, Homo sapiens
aattaagaaaatgttttatgat

SEQ ID NO: 8582082 - DNA, 22 bp, Homo sapiens
aattaagagagagttgaagcaa

SEQ ID NO: 8582083 - DNA, 23 bp, Homo sapiens
aaatattcttttttagtaagtgc

SEQ ID NO: 8582084 - DNA, 23 bp, Homo sapiens
aaatgacatatggtttctgaagg

SEQ ID NO: 8582085 - DNA, 22 bp, Homo sapiens
aaatgctgcagctagtgtgttt

SEQ ID NO: 8582086 - DNA, 22 bp, Homo sapiens
aaatgctgtaactgatattctg

SEQ ID NO: 8582087 - DNA, 22 bp, Homo sapiens
aaatgctgtagatcagtgagtt

SEQ ID NO: 8582088 - DNA, 22 bp, Homo sapiens
aaagttgcacaactttgtatac

SEQ ID NO: 8582089 - DNA, 22 bp, Homo sapiens
aaagttgctggctttggttcat

SEQ ID NO: 8582090 - DNA, 22 bp, Homo sapiens
aaaggcatgattaattctgtgt

SEQ ID NO: 8582091 - DNA, 22 bp, Homo sapiens
aaaggcatgcctccatttctat

SEQ ID NO: 8582092 - DNA, 22 bp, Homo sapiens
aacatgaagttttctatagtga

SEQ ID NO: 8582093 - DNA, 22 bp, Homo sapiens
aaagcatgctactttatatagg

SEQ ID NO: 8582094 - DNA, 21 bp, Homo sapiens
aaagcatcacgaacatttggg

SEQ ID NO: 8582095 - DNA, 22 bp, Homo sapiens
aaagcagcaagtatttgttact

SEQ ID NO: 8582096 - DNA, 22 bp, Homo sapiens
aaaatctgcttccttttacaga

SEQ ID NO: 8582097 - DNA, 22 bp, Homo sapiens
aaagcagcctgctcatcctgga

SEQ ID NO: 8582098 - DNA, 22 bp, Homo sapiens
aaaatgcatgagaatgtgctcg

SEQ ID NO: 8582099 - DNA, 22 bp, Homo sapiens
aaaatgcaaacctacctacata

SEQ ID NO: 8582100 - DNA, 22 bp, Homo sapiens
aaaacatgtccatacagaaact

SEQ ID NO: 8582101 - DNA, 22 bp, Homo sapiens
aaaaccaagttttccttagtct

SEQ ID NO: 8582102 - DNA, 22 bp, Homo sapiens
aaaagcaagaggctggattaaa

SEQ ID NO: 8582103 - DNA, 22 bp, Homo sapiens
aaaacacactggaccaatttaa

SEQ ID NO: 8582104 - DNA, 22 bp, Homo sapiens
aaaacacaagaagcagggtaca

SEQ ID NO: 8582105 - DNA, 22 bp, Homo sapiens
aaaacactgcctgcttgactga

SEQ ID NO: 8582106 - DNA, 22 bp, Homo sapiens
aaaacagttataaacagagtca

SEQ ID NO: 8582107 - DNA, 22 bp, Homo sapiens
aaaacagtttaggcatcacagt

SEQ ID NO: 8582108 - DNA, 22 bp, Homo sapiens
aaaagcaattgcagttcttgcc

SEQ ID NO: 8582109 - DNA, 22 bp, Homo sapiens
aaaagcaagttgcctaggttga

SEQ ID NO: 8582110 - DNA, 22 bp, Homo sapiens
aaaagccaaggtcctcttcaga

SEQ ID NO: 8582111 - DNA, 22 bp, Homo sapiens
aaagtcagttggccagatcact

SEQ ID NO: 8582112 - DNA, 23 bp, Homo sapiens
aaatgtgagggaaaatctttctg

SEQ ID NO: 8582113 - DNA, 22 bp, Homo sapiens
aatattgtttcaagatcacaga

SEQ ID NO: 8582114 - DNA, 22 bp, Homo sapiens
aatgctttaattgcatgtagtg

SEQ ID NO: 8582115 - DNA, 22 bp, Homo sapiens
aagtgaaacatgtatctcttta

SEQ ID NO: 8582116 - DNA, 22 bp, Homo sapiens
aagaagaagtgttatttttaga

SEQ ID NO: 8582117 - DNA, 22 bp, Homo sapiens
acaatattgtacccagaagttt

SEQ ID NO: 8582118 - DNA, 22 bp, Homo sapiens
acaaatttcataggcaaatttt

SEQ ID NO: 8582119 - DNA, 17 bp, Homo sapiens
acacagagattaacaca

SEQ ID NO: 8582120 - DNA, 22 bp, Homo sapiens
acaatgttctacatatacataa

SEQ ID NO: 8582121 - DNA, 22 bp, Homo sapiens
acacagagccagggaatacagt

SEQ ID NO: 8582122 - DNA, 22 bp, Homo sapiens
acagagcaactttatttcatgg

SEQ ID NO: 8582123 - DNA, 22 bp, Homo sapiens
cagaaacatgtataaagttgta

SEQ ID NO: 8582124 - DNA, 22 bp, Homo sapiens
agcattttctgagagtatagat

SEQ ID NO: 8582125 - DNA, 17 bp, Homo sapiens
agcatttgtgttaacag

SEQ ID NO: 8582126 - DNA, 22 bp, Homo sapiens
cactgcaacctccacctcctgg

SEQ ID NO: 8582127 - DNA, 20 bp, Homo sapiens
cacaggctatatgagagcca

SEQ ID NO: 8582128 - DNA, 22 bp, Homo sapiens
cacagaaatattgtgtcccttg

SEQ ID NO: 8582129 - DNA, 22 bp, Homo sapiens
caattttattggtccaaataca

SEQ ID NO: 8582130 - DNA, 22 bp, Homo sapiens
agcagagacatgaaatatgctt

SEQ ID NO: 8582131 - DNA, 22 bp, Homo sapiens
agcagagaagacacaggcttca

SEQ ID NO: 8582132 - DNA, 22 bp, Homo sapiens
caagcagaggtttatgtattag

SEQ ID NO: 8582133 - DNA, 22 bp, Homo sapiens
caagctggctgggagaggcacg

SEQ ID NO: 8582134 - DNA, 22 bp, Homo sapiens
caattacatttattgagcattc

SEQ ID NO: 8582135 - DNA, 22 bp, Homo sapiens
cagatgaactgtgactgaaaat

SEQ ID NO: 8582136 - DNA, 22 bp, Homo sapiens
agcaagatgaaggattcaagac

SEQ ID NO: 8582137 - DNA, 22 bp, Homo sapiens
attttgtggcagatgcagaacc

SEQ ID NO: 8582138 - DNA, 22 bp, Homo sapiens
attttgtgaaccctcaagcaat

SEQ ID NO: 8582139 - DNA, 22 bp, Homo sapiens
attttttagccaagactctgca

SEQ ID NO: 8582140 - DNA, 22 bp, Homo sapiens
atgtgcatgtgcacacatgcgt

SEQ ID NO: 8582141 - DNA, 22 bp, Homo sapiens
atgttacagaaagcaaagatga

SEQ ID NO: 8582142 - DNA, 22 bp, Homo sapiens
atgttacacataggcataaatg

SEQ ID NO: 8582143 - DNA, 22 bp, Homo sapiens
atgtagtttggggctagattta

SEQ ID NO: 8582144 - DNA, 22 bp, Homo sapiens
agagaacatgacgtaatagtgg

SEQ ID NO: 8582145 - DNA, 22 bp, Homo sapiens
agagaacagcctcctagagaaa

SEQ ID NO: 8582146 - DNA, 22 bp, Homo sapiens
agagaacatattttgtatgatt

SEQ ID NO: 8582147 - DNA, 22 bp, Homo sapiens
atgaccagccgagataaacaga

SEQ ID NO: 8582148 - DNA, 22 bp, Homo sapiens
atcttagggttctgtttttaag

SEQ ID NO: 8582149 - DNA, 22 bp, Homo sapiens
atgattttctgataaagaactg

SEQ ID NO: 8582150 - DNA, 22 bp, Homo sapiens
agagaacagacagatgcaatga

SEQ ID NO: 8582151 - DNA, 22 bp, Homo sapiens
agagaacacgtgcatctgcaat

SEQ ID NO: 8582152 - DNA, 22 bp, Homo sapiens
agagaaatttccctgccttctg

SEQ ID NO: 8582153 - DNA, 22 bp, Homo sapiens
atgccagaagccaaaaaatatt

SEQ ID NO: 8582154 - DNA, 22 bp, Homo sapiens
ataaattctctgatgtatagta

SEQ ID NO: 8582155 - DNA, 22 bp, Homo sapiens
ataaattatgaatggccctttt

SEQ ID NO: 8582156 - DNA, 19 bp, Homo sapiens
ataaataaaaagtgggaga

SEQ ID NO: 8582157 - DNA, 22 bp, Homo sapiens
atacaaagacaaatctcaatct

SEQ ID NO: 8582158 - DNA, 20 bp, Homo sapiens
atacaaagagattgatgtat

SEQ ID NO: 8582159 - DNA, 17 bp, Homo sapiens
atacaaagccataaacc

SEQ ID NO: 8582160 - DNA, 20 bp, Homo sapiens
agaaacatttcttgagaact

SEQ ID NO: 8582161 - DNA, 22 bp, Homo sapiens
atattaaatggattttgggagc

SEQ ID NO: 8582162 - DNA, 22 bp, Homo sapiens
atcctgcagggggttttattca

SEQ ID NO: 8582163 - DNA, 20 bp, Homo sapiens
agaagcatcattctgatgtc

SEQ ID NO: 8582164 - DNA, 20 bp, Homo sapiens
agaagcatcattctgatgtc

SEQ ID NO: 8582165 - DNA, 22 bp, Homo sapiens
agaagcattatttaattttact

SEQ ID NO: 8582166 - DNA, 22 bp, Homo sapiens
agaagcattataacatgcaagg

SEQ ID NO: 8582167 - DNA, 20 bp, Homo sapiens
agaagcattcaaagaaaact

SEQ ID NO: 8582168 - DNA, 22 bp, Homo sapiens
agaagcattggaccaggggccc

SEQ ID NO: 8582169 - DNA, 22 bp, Homo sapiens
agaaatgtgagccccttatcaa

SEQ ID NO: 8582170 - DNA, 22 bp, Homo sapiens
agtaacagtaacatcttcctag

SEQ ID NO: 8582171 - DNA, 22 bp, Homo sapiens
agtaacatgagtttttctaatg

SEQ ID NO: 8582172 - DNA, 22 bp, Homo sapiens
acagcagtgggttgccagtggg

SEQ ID NO: 8582173 - DNA, 22 bp, Homo sapiens
acagcagttactgaaataaagt

SEQ ID NO: 8582174 - DNA, 22 bp, Homo sapiens
aggcaatcctcttacagatggg

SEQ ID NO: 8582175 - DNA, 20 bp, Homo sapiens
cattgcatatttcattgagg

SEQ ID NO: 8582176 - DNA, 22 bp, Homo sapiens
catttcaaaagaattgccagaa

SEQ ID NO: 8582177 - DNA, 22 bp, Homo sapiens
catttctccgccgagatcactg

SEQ ID NO: 8582178 - DNA, 22 bp, Homo sapiens
catttcaatacagtttgtaaat

SEQ ID NO: 8582179 - DNA, 22 bp, Homo sapiens
catttcaattatttgctcttct

SEQ ID NO: 8582180 - DNA, 22 bp, Homo sapiens
ccacgtccagctaattttcgta

SEQ ID NO: 8582181 - DNA, 22 bp, Homo sapiens
aggatgtgagtggacacagtcc

SEQ ID NO: 8582182 - DNA, 22 bp, Homo sapiens
aggaatcaggagatgagcacgg

SEQ ID NO: 8582183 - DNA, 22 bp, Homo sapiens
cagtaacatgaagagacatgga

SEQ ID NO: 8582184 - DNA, 22 bp, Homo sapiens
cagtaacatgtctgttaagaaa

SEQ ID NO: 8582185 - DNA, 22 bp, Homo sapiens
cagtaacatttcaaggtagagg

SEQ ID NO: 8582186 - DNA, 22 bp, Homo sapiens
cagtatgtttgggagacatgac

SEQ ID NO: 8582187 - DNA, 22 bp, Homo sapiens
cagtatgagagttgaatcaagg

SEQ ID NO: 8582188 - DNA, 22 bp, Homo sapiens
cagtatgactacaaacagcttt

SEQ ID NO: 8582189 - DNA, 22 bp, Homo sapiens
cagtatgtccttcctcgttggc

SEQ ID NO: 8582190 - DNA, 22 bp, Homo sapiens
cagtatgtctactggacaaagt

SEQ ID NO: 8582191 - DNA, 22 bp, Homo sapiens
cagtatgtgatgcaacggaata

SEQ ID NO: 8582192 - DNA, 23 bp, Homo sapiens
ataaattactatctccctagagc

SEQ ID NO: 8582193 - DNA, 22 bp, Homo sapiens
ataaattaggatctggggttcc

SEQ ID NO: 8582194 - DNA, 22 bp, Homo sapiens
ataacagtgacctctcagcacc

SEQ ID NO: 8582195 - DNA, 22 bp, Homo sapiens
atacaaagctttctgtctggta

SEQ ID NO: 8582196 - DNA, 22 bp, Homo sapiens
atacaaagctaaatatggtttc

SEQ ID NO: 8582197 - DNA, 22 bp, Homo sapiens
atacaaagtattaatcctggat

SEQ ID NO: 8582198 - DNA, 22 bp, Homo sapiens
atacaaaggaacacaggcatgt

SEQ ID NO: 8582199 - DNA, 22 bp, Homo sapiens
atacaaagtattgatcctgagt

SEQ ID NO: 8582200 - DNA, 22 bp, Homo sapiens
ctgcaagattggaagatgcaat

SEQ ID NO: 8582201 - DNA, 22 bp, Homo sapiens
ctgcaagatgttgtcatatgct

SEQ ID NO: 8582202 - DNA, 22 bp, Homo sapiens
atacctgcagtattttattgtt

SEQ ID NO: 8582203 - DNA, 22 bp, Homo sapiens
atacagtagacaatctcatgaa

SEQ ID NO: 8582204 - DNA, 22 bp, Homo sapiens
atacagtaatttgtaactcatc

SEQ ID NO: 8582205 - DNA, 22 bp, Homo sapiens
atatgcattaacattgtaggag

SEQ ID NO: 8582206 - DNA, 22 bp, Homo sapiens
atattcttcttgttcagactat

SEQ ID NO: 8582207 - DNA, 22 bp, Homo sapiens
atattcttgaaagatcctggta

SEQ ID NO: 8582208 - DNA, 22 bp, Homo sapiens
atattcttgaagggagattata

SEQ ID NO: 8582209 - DNA, 22 bp, Homo sapiens
atattcttgtgattataaagta

SEQ ID NO: 8582210 - DNA, 20 bp, Homo sapiens
atattgcaaggaagctggat

SEQ ID NO: 8582211 - DNA, 22 bp, Homo sapiens
atattgcaatagatgcatcatt

SEQ ID NO: 8582212 - DNA, 22 bp, Homo sapiens
atattgcagtgtgtttatgtga

SEQ ID NO: 8582213 - DNA, 22 bp, Homo sapiens
atattgcagggacagtctggat

SEQ ID NO: 8582214 - DNA, 22 bp, Homo sapiens
atattgcattggctggtcttga

SEQ ID NO: 8582215 - DNA, 22 bp, Homo sapiens
atattgcatggctttgctggtt

SEQ ID NO: 8582216 - DNA, 22 bp, Homo sapiens
atatttaaacagggtaccaata

SEQ ID NO: 8582217 - DNA, 22 bp, Homo sapiens
atattgtgtgtacaagtagtta

SEQ ID NO: 8582218 - DNA, 22 bp, Homo sapiens
atatttaaacagggtaccaata

SEQ ID NO: 8582219 - DNA, 22 bp, Homo sapiens
atatttaactggtcccaatata

SEQ ID NO: 8582220 - DNA, 22 bp, Homo sapiens
atcagaacaaaagaacagttta

SEQ ID NO: 8582221 - DNA, 22 bp, Homo sapiens
atcaacaggtatggatgagatt

SEQ ID NO: 8582222 - DNA, 22 bp, Homo sapiens
atctgagtcaaatatttcattt

SEQ ID NO: 8582223 - DNA, 22 bp, Homo sapiens
atctgagtgttggatttattgt

SEQ ID NO: 8582224 - DNA, 22 bp, Homo sapiens
cttagagatgggttttacttag

SEQ ID NO: 8582225 - DNA, 22 bp, Homo sapiens
ctgtggctcaaaatcccatgat

SEQ ID NO: 8582226 - DNA, 22 bp, Homo sapiens
ctgtggctcaattgcctactga

SEQ ID NO: 8582227 - DNA, 22 bp, Homo sapiens
agtcttcagcatagcatatggc

SEQ ID NO: 8582228 - DNA, 22 bp, Homo sapiens
ctcattgcaacctccgcctccc

SEQ ID NO: 8582229 - DNA, 22 bp, Homo sapiens
ctcattgcaacctccgcctccc

SEQ ID NO: 8582230 - DNA, 22 bp, Homo sapiens
ctgacaaacttaattttctgaa

SEQ ID NO: 8582231 - DNA, 22 bp, Homo sapiens
agtatgtcagagtgaaaatggt

SEQ ID NO: 8582232 - DNA, 22 bp, Homo sapiens
ctaagaaatgttgtgaatgcca

SEQ ID NO: 8582233 - DNA, 22 bp, Homo sapiens
caagtttggattatgaaaaagt

SEQ ID NO: 8582234 - DNA, 22 bp, Homo sapiens
ggaaggggagctggaaagggta

SEQ ID NO: 8582235 - DNA, 22 bp, Homo sapiens
ggcattgtctatttgcattcat

SEQ ID NO: 8582236 - DNA, 22 bp, Homo sapiens
ggctgaggcggcgatgcccttg

SEQ ID NO: 8582237 - DNA, 22 bp, Homo sapiens
cagctagtaaatggcaagacta

SEQ ID NO: 8582238 - DNA, 22 bp, Homo sapiens
cagctatattgttttctactgt

SEQ ID NO: 8582239 - DNA, 22 bp, Homo sapiens
ggtgacctcacctggtcccacc

SEQ ID NO: 8582240 - DNA, 19 bp, Homo sapiens
gaattttaggacttcagca

SEQ ID NO: 8582241 - DNA, 22 bp, Homo sapiens
gaaggcaagatctcagtggagg

SEQ ID NO: 8582242 - DNA, 22 bp, Homo sapiens
gacaatgtgaggcgagtttgtt

SEQ ID NO: 8582243 - DNA, 22 bp, Homo sapiens
ctttcccagagtagttgatgct

SEQ ID NO: 8582244 - DNA, 22 bp, Homo sapiens
ctttcccacgcagtggatgaga

SEQ ID NO: 8582245 - DNA, 22 bp, Homo sapiens
ctttccctgcttagaaggattt

SEQ ID NO: 8582246 - DNA, 22 bp, Homo sapiens
ctttcaactacatacaggcgat

SEQ ID NO: 8582247 - DNA, 23 bp, Homo sapiens
atgaacattagtttcagatattg

SEQ ID NO: 8582248 - DNA, 22 bp, Homo sapiens
atgaaacagagtacttaatata

SEQ ID NO: 8582249 - DNA, 22 bp, Homo sapiens
atgaaacaagggtattttctct

SEQ ID NO: 8582250 - DNA, 22 bp, Homo sapiens
gaaacagtcaactttctttccc

SEQ ID NO: 8582251 - DNA, 22 bp, Homo sapiens
gaaacagtgagaacttttcctg

SEQ ID NO: 8582252 - DNA, 22 bp, Homo sapiens
ctttctttcgaagacgtgatta

SEQ ID NO: 8582253 - DNA, 20 bp, Homo sapiens
gaaacattggcagcaactga

SEQ ID NO: 8582254 - DNA, 22 bp, Homo sapiens
gaggtggcactgtgaggagcac

SEQ ID NO: 8582255 - DNA, 22 bp, Homo sapiens
atgttgtgtttgactgttaccc

SEQ ID NO: 8582256 - DNA, 22 bp, Homo sapiens
atgttggctggattttagattt

SEQ ID NO: 8582257 - DNA, 22 bp, Homo sapiens
atgttggccaggctggtcttga

SEQ ID NO: 8582258 - DNA, 22 bp, Homo sapiens
atgtgaaatattaagccgagga

SEQ ID NO: 8582259 - DNA, 21 bp, Homo sapiens
atgtgaaatatcatcagagca

SEQ ID NO: 8582260 - DNA, 20 bp, Homo sapiens
atgtgaaagatcagttgtct

SEQ ID NO: 8582261 - DNA, 22 bp, Homo sapiens
atgtgaaatagctggatatgaa

SEQ ID NO: 8582262 - DNA, 22 bp, Homo sapiens
atgtgaaacgcaatgggatcat

SEQ ID NO: 8582263 - DNA, 22 bp, Homo sapiens
atgtagaagctgacagtgctgt

SEQ ID NO: 8582264 - DNA, 22 bp, Homo sapiens
atgtcccttgtctgtgatgtct

SEQ ID NO: 8582265 - DNA, 22 bp, Homo sapiens
atgtcattgccaagatgctaat

SEQ ID NO: 8582266 - DNA, 22 bp, Homo sapiens
caaagccaggctttctaatgta

SEQ ID NO: 8582267 - DNA, 22 bp, Homo sapiens
attttactttgtgaatattgac

SEQ ID NO: 8582268 - DNA, 22 bp, Homo sapiens
attttagagctccaagtacagc

SEQ ID NO: 8582269 - DNA, 22 bp, Homo sapiens
caaatactgagtttattttcaa

SEQ ID NO: 8582270 - DNA, 22 bp, Homo sapiens
gcacggctaatttttgtatttt

SEQ ID NO: 8582271 - DNA, 22 bp, Homo sapiens
attcagaattgtgggcagtaca

SEQ ID NO: 8582272 - DNA, 22 bp, Homo sapiens
attacatatgttggcaacattt

SEQ ID NO: 8582273 - DNA, 22 bp, Homo sapiens
attcaaagtaataaccagaact

SEQ ID NO: 8582274 - DNA, 22 bp, Homo sapiens
attaggcaattctgggcatctc

SEQ ID NO: 8582275 - DNA, 22 bp, Homo sapiens
attaggcactagaatgtcaatt

SEQ ID NO: 8582276 - DNA, 22 bp, Homo sapiens
attaggcattctgaatgaggtc

SEQ ID NO: 8582277 - DNA, 22 bp, Homo sapiens
attaggcattatggggataagg

SEQ ID NO: 8582278 - DNA, 19 bp, Homo sapiens
attcttgttaagtgtcatc

SEQ ID NO: 8582279 - DNA, 22 bp, Homo sapiens
attctttcaaggaatagttatt

SEQ ID NO: 8582280 - DNA, 22 bp, Homo sapiens
gcagtgtgtggtgagggctgcc

SEQ ID NO: 8582281 - DNA, 22 bp, Homo sapiens
attgtgaatagtgccgcagtaa

SEQ ID NO: 8582282 - DNA, 22 bp, Homo sapiens
ccattattataggaggctcatt

SEQ ID NO: 8582283 - DNA, 22 bp, Homo sapiens
ccatgttgtcaaacttagagta

SEQ ID NO: 8582284 - DNA, 22 bp, Homo sapiens
tgcaaatattagcattcgatat

SEQ ID NO: 8582285 - DNA, 22 bp, Homo sapiens
tgcaaagggctttgcatacaga

SEQ ID NO: 8582286 - DNA, 22 bp, Homo sapiens
tgcaaatagcctatatttatag

SEQ ID NO: 8582287 - DNA, 22 bp, Homo sapiens
tgcaaataagctattatggaat

SEQ ID NO: 8582288 - DNA, 22 bp, Homo sapiens
tgacaaattcatatttcagagg

SEQ ID NO: 8582289 - DNA, 22 bp, Homo sapiens
tgaatgatatgtgaaaaggaac

SEQ ID NO: 8582290 - DNA, 22 bp, Homo sapiens
tctgctttagaatccagtagct

SEQ ID NO: 8582291 - DNA, 22 bp, Homo sapiens
tctttgggagatgttatttata

SEQ ID NO: 8582292 - DNA, 22 bp, Homo sapiens
tctttcttcctggagcccaaca

SEQ ID NO: 8582293 - DNA, 22 bp, Homo sapiens
tctttcttggtataaagcaggg

SEQ ID NO: 8582294 - DNA, 22 bp, Homo sapiens
cctagagctctgctttatctaa

SEQ ID NO: 8582295 - DNA, 22 bp, Homo sapiens
tgggaagctactcatgcaggca

SEQ ID NO: 8582296 - DNA, 22 bp, Homo sapiens
tgggaagctgcattttaacaag

SEQ ID NO: 8582297 - DNA, 22 bp, Homo sapiens
tgccatagcaatggtaagctga

SEQ ID NO: 8582298 - DNA, 22 bp, Homo sapiens
cccaggctggagtgcaatggca

SEQ ID NO: 8582299 - DNA, 22 bp, Homo sapiens
cccaggctggagtgcagtggcg

SEQ ID NO: 8582300 - DNA, 22 bp, Homo sapiens
cccaggctggagtgcaatggtg

SEQ ID NO: 8582301 - DNA, 22 bp, Homo sapiens
cccaggctggagtgtaatggtg

SEQ ID NO: 8582302 - DNA, 22 bp, Homo sapiens
cccgactagctgggattacagg

SEQ ID NO: 8582303 - DNA, 18 bp, Homo sapiens
cccggctaatttttggta

SEQ ID NO: 8582304 - DNA, 22 bp, Homo sapiens
catgcagtattcaggacagttc

SEQ ID NO: 8582305 - DNA, 22 bp, Homo sapiens
catgcagtgactcagacacagg

SEQ ID NO: 8582306 - DNA, 22 bp, Homo sapiens
catgcagttgaagcacagagag

SEQ ID NO: 8582307 - DNA, 22 bp, Homo sapiens
catgcagtggtaaaaagtcagg

SEQ ID NO: 8582308 - DNA, 22 bp, Homo sapiens
cataatttgatatgcttgatgg

SEQ ID NO: 8582309 - DNA, 22 bp, Homo sapiens
tcaatagcaatcaagccttcca

SEQ ID NO: 8582310 - DNA, 22 bp, Homo sapiens
tccttcagttatcacagtactg

SEQ ID NO: 8582311 - DNA, 22 bp, Homo sapiens
tccttcagttcaattagtccgt

SEQ ID NO: 8582312 - DNA, 21 bp, Homo sapiens
tccttcagttctgcactttct

SEQ ID NO: 8582313 - DNA, 17 bp, Homo sapiens
tccttcagtgcctctgc

SEQ ID NO: 8582314 - DNA, 22 bp, Homo sapiens
tccttcagttaaagatctcaca

SEQ ID NO: 8582315 - DNA, 22 bp, Homo sapiens
tccttcagtgtcccgctcaggt

SEQ ID NO: 8582316 - DNA, 22 bp, Homo sapiens
tccttcagtcttctgagccata

SEQ ID NO: 8582317 - DNA, 21 bp, Homo sapiens
tccttcagtctagatgattgt

SEQ ID NO: 8582318 - DNA, 22 bp, Homo sapiens
ccaaggcttcccagagatgctc

SEQ ID NO: 8582319 - DNA, 22 bp, Homo sapiens
cattcatttatgaaatatctat

SEQ ID NO: 8582320 - DNA, 22 bp, Homo sapiens
cattagagcagataatatgtgt

SEQ ID NO: 8582321 - DNA, 22 bp, Homo sapiens
cattcttacacaatattttaat

SEQ ID NO: 8582322 - DNA, 22 bp, Homo sapiens
cattgttgaacacctgctggat

SEQ ID NO: 8582323 - DNA, 22 bp, Homo sapiens
tattttaaagtgaagggtcttg

SEQ ID NO: 8582324 - DNA, 22 bp, Homo sapiens
tcaacaaatacttaaagcagag

SEQ ID NO: 8582325 - DNA, 22 bp, Homo sapiens
tattatgaggtatttggacttt

SEQ ID NO: 8582326 - DNA, 22 bp, Homo sapiens
tattatgatcccagccctggag

SEQ ID NO: 8582327 - DNA, 22 bp, Homo sapiens
tattatgatcgtgactcaagga

SEQ ID NO: 8582328 - DNA, 22 bp, Homo sapiens
tattatgattcggacgtggcag

SEQ ID NO: 8582329 - DNA, 22 bp, Homo sapiens
tattatgaggactggtgtaagg

SEQ ID NO: 8582330 - DNA, 22 bp, Homo sapiens
tattatgaggcttagggatgac

SEQ ID NO: 8582331 - DNA, 22 bp, Homo sapiens
tattatgaggggcagagggcat

SEQ ID NO: 8582332 - DNA, 20 bp, Homo sapiens
tattatgacctgtgttctgg

SEQ ID NO: 8582333 - DNA, 22 bp, Homo sapiens
tattatgagccaggtgctgtct

SEQ ID NO: 8582334 - DNA, 22 bp, Homo sapiens
caggtggcagaggtctctggaa

SEQ ID NO: 8582335 - DNA, 22 bp, Homo sapiens
taatatgtgttactgacttttt

SEQ ID NO: 8582336 - DNA, 22 bp, Homo sapiens
caggcttttgcatagcactggg

SEQ ID NO: 8582337 - DNA, 22 bp, Homo sapiens
tagaaacaaaatctgatgactc

SEQ ID NO: 8582338 - DNA, 22 bp, Homo sapiens
tagaaacaaagacctgggtgct

SEQ ID NO: 8582339 - DNA, 22 bp, Homo sapiens
caggctatatttaaagaagaac

SEQ ID NO: 8582340 - DNA, 22 bp, Homo sapiens
tttcacaaagcatagcacttta

SEQ ID NO: 8582341 - DNA, 20 bp, Homo sapiens
tttcctaagtggtttgctga

SEQ ID NO: 8582342 - DNA, 22 bp, Homo sapiens
tttcctaaggctcattttaaaa

SEQ ID NO: 8582343 - DNA, 20 bp, Homo sapiens
tttccactgtaatgtatgat

SEQ ID NO: 8582344 - DNA, 22 bp, Homo sapiens
tttaatcataagaaggaaaata

SEQ ID NO: 8582345 - DNA, 22 bp, Homo sapiens
ctcccaggcacagggaggagcc

SEQ ID NO: 8582346 - DNA, 22 bp, Homo sapiens
ttgtggttaaccgcacattttt

SEQ ID NO: 8582347 - DNA, 22 bp, Homo sapiens
ttgtcttttgtgggaaatatgg

SEQ ID NO: 8582348 - DNA, 22 bp, Homo sapiens
ttcttttaatttctgtctgcag

SEQ ID NO: 8582349 - DNA, 22 bp, Homo sapiens
ttcttttacattaagatttcag

SEQ ID NO: 8582350 - DNA, 19 bp, Homo sapiens
ttttaagtcctctctattc

SEQ ID NO: 8582351 - DNA, 20 bp, Homo sapiens
ttttagcacttgttatggtg

SEQ ID NO: 8582352 - DNA, 22 bp, Homo sapiens
ttttagaatcaggttgtctggg

SEQ ID NO: 8582353 - DNA, 22 bp, Homo sapiens
ttttcaccatagacactggtcc

SEQ ID NO: 8582354 - DNA, 22 bp, Homo sapiens
ctgcaaataggggtgtgaataa

SEQ ID NO: 8582355 - DNA, 19 bp, Homo sapiens
ctctttccattgtatttgc

SEQ ID NO: 8582356 - DNA, 22 bp, Homo sapiens
ctacagagttcacaggatttta

SEQ ID NO: 8582357 - DNA, 22 bp, Homo sapiens
ctattaaatactcttcaaattg

SEQ ID NO: 8582358 - DNA, 22 bp, Homo sapiens
ctcacagagcctctgtgtcttc

SEQ ID NO: 8582359 - DNA, 22 bp, Homo sapiens
ttcacagaagaggtcacatttc

SEQ ID NO: 8582360 - DNA, 22 bp, Homo sapiens
ttcagagtcagggatctcagag

SEQ ID NO: 8582361 - DNA, 22 bp, Homo sapiens
ttcagagttagacgaaaagcaa

SEQ ID NO: 8582362 - DNA, 22 bp, Homo sapiens
ttcacacagaatctgaggagct

SEQ ID NO: 8582363 - DNA, 22 bp, Homo sapiens
ttaggaatttatcacagactgg

SEQ ID NO: 8582364 - DNA, 22 bp, Homo sapiens
ttaggaatttattccattgttg

SEQ ID NO: 8582365 - DNA, 22 bp, Homo sapiens
ttaggaatatgtattttaaagt

SEQ ID NO: 8582366 - DNA, 22 bp, Homo sapiens
cctttcctttttagtgtgggag

SEQ ID NO: 8582367 - DNA, 22 bp, Homo sapiens
cctttcctgtgtccttttaagg

SEQ ID NO: 8582368 - DNA, 18 bp, Homo sapiens
cctttcctcccctcagct

SEQ ID NO: 8582369 - DNA, 22 bp, Homo sapiens
cctttcctgcctcaggaagtag

SEQ ID NO: 8582370 - DNA, 22 bp, Homo sapiens
ccttcagtcccatgtttctctt

SEQ ID NO: 8582371 - DNA, 22 bp, Homo sapiens
ccttcgagatttaaacactgat

SEQ ID NO: 8582372 - DNA, 20 bp, Homo sapiens
ctgtggctcatgcatctgcc

SEQ ID NO: 8582373 - DNA, 22 bp, Homo sapiens
ctgtggctgcagccttggtcct

SEQ ID NO: 8582374 - DNA, 22 bp, Homo sapiens
cttcagaagaaaagcagtgtgt

SEQ ID NO: 8582375 - DNA, 22 bp, Homo sapiens
cttcagtatcctccacatgtta

SEQ ID NO: 8582376 - DNA, 22 bp, Homo sapiens
ctttcattcttagatattagtg

SEQ ID NO: 8582377 - DNA, 22 bp, Homo sapiens
gaagatttaagcacaatagtct

SEQ ID NO: 8582378 - DNA, 22 bp, Homo sapiens
gaagatttataaggaccttatt

SEQ ID NO: 8582379 - DNA, 22 bp, Homo sapiens
gaagattttctcctttaaatga

SEQ ID NO: 8582380 - DNA, 22 bp, Homo sapiens
gaagatttgcccatgcactttt

SEQ ID NO: 8582381 - DNA, 22 bp, Homo sapiens
gaagatttgaaacacatagaca

SEQ ID NO: 8582382 - DNA, 22 bp, Homo sapiens
gaagagctccaaaaacagtgag

SEQ ID NO: 8582383 - DNA, 21 bp, Homo sapiens
gaacatttgggttgtttctac

SEQ ID NO: 8582384 - DNA, 22 bp, Homo sapiens
gacagtatccaggtggtgaaga

SEQ ID NO: 8582385 - DNA, 22 bp, Homo sapiens
gagcagcagttgttacaatgat

SEQ ID NO: 8582386 - DNA, 22 bp, Homo sapiens
gagatgaatgtaaacaaaggca

SEQ ID NO: 8582387 - DNA, 22 bp, Homo sapiens
gaggaggaagttctctgtaggc

SEQ ID NO: 8582388 - DNA, 22 bp, Homo sapiens
gagctactgaaatattgatttt

SEQ ID NO: 8582389 - DNA, 22 bp, Homo sapiens
gggattacagatgtgagccatt

SEQ ID NO: 8582390 - DNA, 23 bp, Homo sapiens
ggagtgcaatggcgccatctcgg

SEQ ID NO: 8582391 - DNA, 23 bp, Homo sapiens
ggagtgcaatggcgccatctcgg

SEQ ID NO: 8582392 - DNA, 22 bp, Homo sapiens
ggcatgttgtttatgtttctgg

SEQ ID NO: 8582393 - DNA, 22 bp, Homo sapiens
gtagacagaaagcggaatcata

SEQ ID NO: 8582394 - DNA, 22 bp, Homo sapiens
gtattgcaattactcttcttct

SEQ ID NO: 8582395 - DNA, 22 bp, Homo sapiens
gtattgcatagacctgggatga

SEQ ID NO: 8582396 - DNA, 21 bp, Homo sapiens
gtattgcagagttatgtgctc

SEQ ID NO: 8582397 - DNA, 22 bp, Homo sapiens
gtattgcattttgaatgcatgg

SEQ ID NO: 8582398 - DNA, 22 bp, Homo sapiens
gtattcttggttatcaaaatac

SEQ ID NO: 8582399 - DNA, 22 bp, Homo sapiens
gtattcttgagtggcaactagg

SEQ ID NO: 8582400 - DNA, 17 bp, Homo sapiens
gtattctttgccttcca

SEQ ID NO: 8582401 - DNA, 21 bp, Homo sapiens
gtattctttatgaagtgaaaa

SEQ ID NO: 8582402 - DNA, 22 bp, Homo sapiens
gtattcttatactcagtgagct

SEQ ID NO: 8582403 - DNA, 22 bp, Homo sapiens
gtattcttaaggattgagcaaa

SEQ ID NO: 8582404 - DNA, 22 bp, Homo sapiens
gtgaaggaggggccacagatat

SEQ ID NO: 8582405 - DNA, 22 bp, Homo sapiens
gtgcatttgtgcatgcacatgt

SEQ ID NO: 8582406 - DNA, 22 bp, Homo sapiens
ggtcgctgtgtaggttcagcta

SEQ ID NO: 8582407 - DNA, 22 bp, Homo sapiens
gcgtctcaaggcccccaggcca

SEQ ID NO: 8582408 - DNA, 23 bp, Homo sapiens
gctacagctgactgtcattccct

SEQ ID NO: 8582409 - DNA, 22 bp, Homo sapiens
gcctttcacagagatttaaaaa

SEQ ID NO: 8582410 - DNA, 19 bp, Homo sapiens
gctcagagtccccctgcgg

SEQ ID NO: 8582411 - DNA, 17 bp, Homo sapiens
gctttccttgcccctcc

SEQ ID NO: 8582412 - DNA, 22 bp, Homo sapiens
gctttcctggccctgtccctgc

SEQ ID NO: 8582413 - DNA, 22 bp, Homo sapiens
ggagcatctgaacagggagaag

SEQ ID NO: 8582414 - DNA, 22 bp, Homo sapiens
ggaccatctctagccagagctt

SEQ ID NO: 8582415 - DNA, 22 bp, Homo sapiens
gcagaggatcaggctctggaaa

SEQ ID NO: 8582416 - DNA, 22 bp, Homo sapiens
gcagagaagatgcccaggcttc

SEQ ID NO: 8582417 - DNA, 22 bp, Homo sapiens
gcagagaaagttttgtcctcag

SEQ ID NO: 8582418 - DNA, 22 bp, Homo sapiens
gcagagaacccagcagattggc

SEQ ID NO: 8582419 - DNA, 22 bp, Homo sapiens
tcatattagggtaatgataaga

SEQ ID NO: 8582420 - DNA, 22 bp, Homo sapiens
tcattcaatgtaagcatatata

SEQ ID NO: 8582421 - DNA, 22 bp, Homo sapiens
tcacaaagctttgataagcaga

SEQ ID NO: 8582422 - DNA, 22 bp, Homo sapiens
tcacaggagtcaaggaatagta

SEQ ID NO: 8582423 - DNA, 22 bp, Homo sapiens
tcaattttatgaaacaaagtga

SEQ ID NO: 8582424 - DNA, 22 bp, Homo sapiens
tcaatttcttggtttgataata

SEQ ID NO: 8582425 - DNA, 22 bp, Homo sapiens
tcagagaactccacaccttagg

SEQ ID NO: 8582426 - DNA, 22 bp, Homo sapiens
tcagagaactgcagcccttcct

SEQ ID NO: 8582427 - DNA, 22 bp, Homo sapiens
tcagagaaggctgagtcacggc

SEQ ID NO: 8582428 - DNA, 20 bp, Homo sapiens
tcagagaaggagctttcctg

SEQ ID NO: 8582429 - DNA, 22 bp, Homo sapiens
tcagcaaggctgcattctcatc

SEQ ID NO: 8582430 - DNA, 22 bp, Homo sapiens
tcactacaacctccgcctcctg

SEQ ID NO: 8582431 - DNA, 22 bp, Homo sapiens
tcactacaacctccgcctcctg

SEQ ID NO: 8582432 - DNA, 22 bp, Homo sapiens
tcattgcagactaacaatctca

SEQ ID NO: 8582433 - DNA, 18 bp, Homo sapiens
gttttgaattgtcttaca

SEQ ID NO: 8582434 - DNA, 22 bp, Homo sapiens
gtttcccaggctgtggggccct

SEQ ID NO: 8582435 - DNA, 23 bp, Homo sapiens
taaatttcttgattcttatgtga

SEQ ID NO: 8582436 - DNA, 20 bp, Homo sapiens
taaattagccttgaagatta

SEQ ID NO: 8582437 - DNA, 22 bp, Homo sapiens
taaattaaagattggagaagga

SEQ ID NO: 8582438 - DNA, 22 bp, Homo sapiens
taatagaatagtggaaacattg

SEQ ID NO: 8582439 - DNA, 22 bp, Homo sapiens
tacaaagcagttccaacacgaa

SEQ ID NO: 8582440 - DNA, 22 bp, Homo sapiens
tacaaagaggcagctccatttt

SEQ ID NO: 8582441 - DNA, 22 bp, Homo sapiens
tacaaacttgttttaagtaagt

SEQ ID NO: 8582442 - DNA, 22 bp, Homo sapiens
tacaaagaggtaattgcatata

SEQ ID NO: 8582443 - DNA, 22 bp, Homo sapiens
tacaaactctttatatttcata

SEQ ID NO: 8582444 - DNA, 22 bp, Homo sapiens
tacaaactccgaagtttgtacc

SEQ ID NO: 8582445 - DNA, 22 bp, Homo sapiens
tacagaaatcacatcgctttga

SEQ ID NO: 8582446 - DNA, 22 bp, Homo sapiens
tacaaagtgctttagaaatgaa

SEQ ID NO: 8582447 - DNA, 22 bp, Homo sapiens
tacaaagtgaaataattctgag

SEQ ID NO: 8582448 - DNA, 22 bp, Homo sapiens
tacatacattacctcatttagt

SEQ ID NO: 8582449 - DNA, 22 bp, Homo sapiens
tacatagattttgaaactggac

SEQ ID NO: 8582450 - DNA, 22 bp, Homo sapiens
tacatagagggtaatagcatca

SEQ ID NO: 8582451 - DNA, 22 bp, Homo sapiens
tataaatgccaggactttagat

SEQ ID NO: 8582452 - DNA, 22 bp, Homo sapiens
tattctctgcagctgaatgttt

SEQ ID NO: 8582453 - DNA, 22 bp, Homo sapiens
tatgtacagggatagaacttga

SEQ ID NO: 8582454 - DNA, 22 bp, Homo sapiens
tattacatccacttttattgca

SEQ ID NO: 8582455 - DNA, 22 bp, Homo sapiens
tatgtgcagtttgctcttaaca

SEQ ID NO: 8582456 - DNA, 22 bp, Homo sapiens
tatgtgaatacagcagtggatg

SEQ ID NO: 8582457 - DNA, 22 bp, Homo sapiens
tagcagagaggggacagtggca

SEQ ID NO: 8582458 - DNA, 21 bp, Homo sapiens
tagcccttctccacctcgccc

SEQ ID NO: 8582459 - DNA, 22 bp, Homo sapiens
tagaaacatgttctgttctgtt

SEQ ID NO: 8582460 - DNA, 22 bp, Homo sapiens
tagaaacatgagagaaactctt

SEQ ID NO: 8582461 - DNA, 22 bp, Homo sapiens
tagaaacatatgtttgagacat

SEQ ID NO: 8582462 - DNA, 22 bp, Homo sapiens
tagaaacattcagttgcagtcc

SEQ ID NO: 8582463 - DNA, 22 bp, Homo sapiens
tagaaacagaaaactgtaatag

SEQ ID NO: 8582464 - DNA, 22 bp, Homo sapiens
tagaaacagcatatattagccc

SEQ ID NO: 8582465 - DNA, 22 bp, Homo sapiens
tagaaacatataggatggcagg

SEQ ID NO: 8582466 - DNA, 22 bp, Homo sapiens
tagaaacagagcaggtggccca

SEQ ID NO: 8582467 - DNA, 22 bp, Homo sapiens
tagaaacagatgtttttgaaga

SEQ ID NO: 8582468 - DNA, 22 bp, Homo sapiens
tagaaacagagagatatgcccc

SEQ ID NO: 8582469 - DNA, 22 bp, Homo sapiens
tagaaacagaatatgagtgaga

SEQ ID NO: 8582470 - DNA, 22 bp, Homo sapiens
tactttgaccaccatctgatta

SEQ ID NO: 8582471 - DNA, 22 bp, Homo sapiens
tagaaatgcccagattctgcta

SEQ ID NO: 8582472 - DNA, 22 bp, Homo sapiens
tagaaatggagaacagattaat

SEQ ID NO: 8582473 - DNA, 22 bp, Homo sapiens
tagaaatgattttgatgcttca

SEQ ID NO: 8582474 - DNA, 22 bp, Homo sapiens
tagaaatgattgagctgtaata

SEQ ID NO: 8582475 - DNA, 22 bp, Homo sapiens
tagaaatgaatgtttaaaagtc

SEQ ID NO: 8582476 - DNA, 22 bp, Homo sapiens
ttaagagacaggagaatgatgt

SEQ ID NO: 8582477 - DNA, 22 bp, Homo sapiens
ttaagagacaggagaatgatgt

SEQ ID NO: 8582478 - DNA, 22 bp, Homo sapiens
ttaagagaagagtatctagaac

SEQ ID NO: 8582479 - DNA, 22 bp, Homo sapiens
ttaagagatttaggaacattat

SEQ ID NO: 8582480 - DNA, 22 bp, Homo sapiens
tgttttctgatggttaatgagt

SEQ ID NO: 8582481 - DNA, 22 bp, Homo sapiens
ttaaatagtaggtctattttgg

SEQ ID NO: 8582482 - DNA, 22 bp, Homo sapiens
ttaaatgaacgagatatgcaac

SEQ ID NO: 8582483 - DNA, 22 bp, Homo sapiens
ttaaattaggactctagttctg

SEQ ID NO: 8582484 - DNA, 22 bp, Homo sapiens
ttaaattaggactctagttctg

SEQ ID NO: 8582485 - DNA, 22 bp, Homo sapiens
ttaacaaaaatatcaggcatca

SEQ ID NO: 8582486 - DNA, 22 bp, Homo sapiens
ttactttcaagtggctgggggt

SEQ ID NO: 8582487 - DNA, 22 bp, Homo sapiens
ttacaaagaaaattaggcattt

SEQ ID NO: 8582488 - DNA, 22 bp, Homo sapiens
ttacatattatccaaaactgct

SEQ ID NO: 8582489 - DNA, 22 bp, Homo sapiens
tgtggcatggttgcaaggacaa

SEQ ID NO: 8582490 - DNA, 22 bp, Homo sapiens
tgtggcatggcagaagggcaca

SEQ ID NO: 8582491 - DNA, 20 bp, Homo sapiens
tgtgtcttcctttctttatg

SEQ ID NO: 8582492 - DNA, 22 bp, Homo sapiens
tgttatcctcagctcacctcta

SEQ ID NO: 8582493 - DNA, 22 bp, Homo sapiens
tgtttcactgaaagccttacta

SEQ ID NO: 8582494 - DNA, 17 bp, Homo sapiens
tgtttcacttggggaaa

SEQ ID NO: 8582495 - DNA, 22 bp, Homo sapiens
tgtttgaaaagtggagatttat

SEQ ID NO: 8582496 - DNA, 22 bp, Homo sapiens
ttccagagaggctcatgttccc

SEQ ID NO: 8582497 - DNA, 22 bp, Homo sapiens
ttcagtaaaacactgcaatgtc

SEQ ID NO: 8582498 - DNA, 22 bp, Homo sapiens
ttcacaaaaatgctgaacagtt

SEQ ID NO: 8582499 - DNA, 22 bp, Homo sapiens
ttcaagaaagagtggctattcc

SEQ ID NO: 8582500 - DNA, 22 bp, Homo sapiens
ttctttccaaccagatattggt

SEQ ID NO: 8582501 - DNA, 22 bp, Homo sapiens
ttctttcccagaagatatgttt

SEQ ID NO: 8582502 - DNA, 22 bp, Homo sapiens
ttctttcccagtagatgtgaaa

SEQ ID NO: 8582503 - DNA, 22 bp, Homo sapiens
ttctcttttcaccagttgctaa

SEQ ID NO: 8582504 - DNA, 22 bp, Homo sapiens
tttattatgtacaggcactata

SEQ ID NO: 8582505 - DNA, 22 bp, Homo sapiens
tttattattctctggagaatgt

SEQ ID NO: 8582506 - DNA, 22 bp, Homo sapiens
tttattattctgttctctctac

SEQ ID NO: 8582507 - DNA, 22 bp, Homo sapiens
tttattatccagtgttgtcatg

SEQ ID NO: 8582508 - DNA, 22 bp, Homo sapiens
tttattatgatggacaccttcg

SEQ ID NO: 8582509 - DNA, 22 bp, Homo sapiens
tttattatagtggtggggactg

SEQ ID NO: 8582510 - DNA, 22 bp, Homo sapiens
tttaattgcatttaaagatgga

SEQ ID NO: 8582511 - DNA, 22 bp, Homo sapiens
tttaatttgaaatgagtaaccc

SEQ ID NO: 8582512 - DNA, 22 bp, Homo sapiens
ttgtgaatggtgccgcaataaa

SEQ ID NO: 8582513 - DNA, 20 bp, Homo sapiens
ttgttagaggaatgccatag

SEQ ID NO: 8582514 - DNA, 22 bp, Homo sapiens
ttgtgaatagtgccgctataaa

SEQ ID NO: 8582515 - DNA, 22 bp, Homo sapiens
ttgtgaatagtgccgcaataaa

SEQ ID NO: 8582516 - DNA, 22 bp, Homo sapiens
ttgtgaaatgtttcaaaatagt

SEQ ID NO: 8582517 - DNA, 22 bp, Homo sapiens
tttcctgagccagagtttcatt

SEQ ID NO: 8582518 - DNA, 22 bp, Homo sapiens
tttcctgagtcagagacaccag

SEQ ID NO: 8582519 - DNA, 22 bp, Homo sapiens
tttctcctccagagagacacag

SEQ ID NO: 8582520 - DNA, 22 bp, Homo sapiens
tttctattgtaagtctcctata

SEQ ID NO: 8582521 - DNA, 22 bp, Homo sapiens
tttctatttacagtgctaggta

SEQ ID NO: 8582522 - DNA, 22 bp, Homo sapiens
tttcttctatgtgtgatatttt

SEQ ID NO: 8582523 - DNA, 22 bp, Homo sapiens
tttgttttcaatgtgtcattca

SEQ ID NO: 8582524 - DNA, 22 bp, Homo sapiens
tttgttttgaactagctcagaa

SEQ ID NO: 8582525 - DNA, 22 bp, Homo sapiens
tttgtcaccagtggctttggta

SEQ ID NO: 8582526 - DNA, 22 bp, Homo sapiens
attgtgaggcagggaaaggtgg

SEQ ID NO: 8582527 - DNA, 22 bp, Homo sapiens
attgtctttccactgagaagtt

SEQ ID NO: 8582528 - DNA, 22 bp, Homo sapiens
attgtataacagcatgtatttt

SEQ ID NO: 8582529 - DNA, 22 bp, Homo sapiens
attgtatttgtacaagacatgt

SEQ ID NO: 8582530 - DNA, 22 bp, Homo sapiens
gcagctggaagtgacactctgt

SEQ ID NO: 8582531 - DNA, 18 bp, Homo sapiens
attgattgggagaggatt

SEQ ID NO: 8582532 - DNA, 22 bp, Homo sapiens
attcaaagtaataaccagaact

SEQ ID NO: 8582533 - DNA, 22 bp, Homo sapiens
gcagatggaaagtgcttgaggg

SEQ ID NO: 8582534 - DNA, 21 bp, Homo sapiens
gcagcagaggcttgacagaca

SEQ ID NO: 8582535 - DNA, 22 bp, Homo sapiens
gcagcagagaccccaggaagga

SEQ ID NO: 8582536 - DNA, 22 bp, Homo sapiens
attcatatcatagagttattga

SEQ ID NO: 8582537 - DNA, 22 bp, Homo sapiens
attcataagtaaatgattacct

SEQ ID NO: 8582538 - DNA, 22 bp, Homo sapiens
gcagcagagtagacagagccct

SEQ ID NO: 8582539 - DNA, 22 bp, Homo sapiens
gcacggctaatttttgtatttt

SEQ ID NO: 8582540 - DNA, 22 bp, Homo sapiens
gcacgtggaatgctcatgagcc

SEQ ID NO: 8582541 - DNA, 22 bp, Homo sapiens
gcacctggggtacacagctaca

SEQ ID NO: 8582542 - DNA, 21 bp, Homo sapiens
attcagaaagggaataaactc

SEQ ID NO: 8582543 - DNA, 22 bp, Homo sapiens
attcaccaagaatgatttcagt

SEQ ID NO: 8582544 - DNA, 23 bp, Homo sapiens
gctgactgtgaaattctggagct

SEQ ID NO: 8582545 - DNA, 22 bp, Homo sapiens
gctgactggttcaggtcccgct

SEQ ID NO: 8582546 - DNA, 22 bp, Homo sapiens
gctgactgtccgctgctcccgg

SEQ ID NO: 8582547 - DNA, 22 bp, Homo sapiens
caaatgcatgagaaataagagg

SEQ ID NO: 8582548 - DNA, 22 bp, Homo sapiens
atttttatgacaaaccatcctc

SEQ ID NO: 8582549 - DNA, 22 bp, Homo sapiens
attttttagaacctggcctgat

SEQ ID NO: 8582550 - DNA, 22 bp, Homo sapiens
caaagcagacgcagtaagggta

SEQ ID NO: 8582551 - DNA, 22 bp, Homo sapiens
caaagcagcctgcagtgtggac

SEQ ID NO: 8582552 - DNA, 22 bp, Homo sapiens
caaagcagcggattgggatagt

SEQ ID NO: 8582553 - DNA, 22 bp, Homo sapiens
caaagcaggaagaatattgaaa

SEQ ID NO: 8582554 - DNA, 22 bp, Homo sapiens
caaagcagagccagagcttgtc

SEQ ID NO: 8582555 - DNA, 22 bp, Homo sapiens
caaaatgatgtgattttattgt

SEQ ID NO: 8582556 - DNA, 22 bp, Homo sapiens
atttctgttgcttataaattac

SEQ ID NO: 8582557 - DNA, 22 bp, Homo sapiens
gccccaggttgcctgtcccagg

SEQ ID NO: 8582558 - DNA, 22 bp, Homo sapiens
gcccacagttaatgggggctct

SEQ ID NO: 8582559 - DNA, 21 bp, Homo sapiens
gcccacagtgaggaggatccc

SEQ ID NO: 8582560 - DNA, 22 bp, Homo sapiens
gccacagggcgagcggaggcca

SEQ ID NO: 8582561 - DNA, 22 bp, Homo sapiens
gccaggctggggggagatgtct

SEQ ID NO: 8582562 - DNA, 22 bp, Homo sapiens
gccaggctggtcttgaactcct

SEQ ID NO: 8582563 - DNA, 22 bp, Homo sapiens
gccaggctggtgcaaggatatt

SEQ ID NO: 8582564 - DNA, 22 bp, Homo sapiens
gccaggctggccagcaccttct

SEQ ID NO: 8582565 - DNA, 22 bp, Homo sapiens
gccaggctggcaaaaggaaacc

SEQ ID NO: 8582566 - DNA, 22 bp, Homo sapiens
gccaggctggaaagaacagaca

SEQ ID NO: 8582567 - DNA, 22 bp, Homo sapiens
gccaggtgagaggactgaggct

SEQ ID NO: 8582568 - DNA, 22 bp, Homo sapiens
gccaggtgagaggactgaggct

SEQ ID NO: 8582569 - DNA, 22 bp, Homo sapiens
gccaggtggaggttgcagtgag

SEQ ID NO: 8582570 - DNA, 22 bp, Homo sapiens
gccaggtgcatattagaagcat

SEQ ID NO: 8582571 - DNA, 22 bp, Homo sapiens
gccaggtggctgagcagctgca

SEQ ID NO: 8582572 - DNA, 22 bp, Homo sapiens
gcctcaagacatttttaattgc

SEQ ID NO: 8582573 - DNA, 22 bp, Homo sapiens
gcctagtggtgggtatgcagag

SEQ ID NO: 8582574 - DNA, 22 bp, Homo sapiens
gcctagtgcactggcagggctc

SEQ ID NO: 8582575 - DNA, 22 bp, Homo sapiens
gcccccagaagggccacagatt

SEQ ID NO: 8582576 - DNA, 22 bp, Homo sapiens
gcctgagaaggacacagcaggt

SEQ ID NO: 8582577 - DNA, 22 bp, Homo sapiens
gcctgagatcaggagaaagcca

SEQ ID NO: 8582578 - DNA, 22 bp, Homo sapiens
gcctgagagaactgaccaagag

SEQ ID NO: 8582579 - DNA, 22 bp, Homo sapiens
gcctggcaatggcctcaggaag

SEQ ID NO: 8582580 - DNA, 22 bp, Homo sapiens
gcctggagttgtggtgaagcca

SEQ ID NO: 8582581 - DNA, 22 bp, Homo sapiens
atgtcctcaaaactgattgcag

SEQ ID NO: 8582582 - DNA, 20 bp, Homo sapiens
atgtcctcagccactgccct

SEQ ID NO: 8582583 - DNA, 22 bp, Homo sapiens
atgtcctcttctgcctcaggcc

SEQ ID NO: 8582584 - DNA, 22 bp, Homo sapiens
atgtcctcttctgcctcaggcc

SEQ ID NO: 8582585 - DNA, 22 bp, Homo sapiens
atgtcctcggctctgtgctgct

SEQ ID NO: 8582586 - DNA, 22 bp, Homo sapiens
gaggcagcgggtcaggaccgtg

SEQ ID NO: 8582587 - DNA, 22 bp, Homo sapiens
gagggcctggcacagggaggct

SEQ ID NO: 8582588 - DNA, 22 bp, Homo sapiens
gagggcagagacagtgattcac

SEQ ID NO: 8582589 - DNA, 22 bp, Homo sapiens
gagggctcctcacattctctat

SEQ ID NO: 8582590 - DNA, 22 bp, Homo sapiens
gagggctctaccaagtaactct

SEQ ID NO: 8582591 - DNA, 22 bp, Homo sapiens
gagggctgaagattgtggcccc

SEQ ID NO: 8582592 - DNA, 22 bp, Homo sapiens
atgttgtgtttgactgttaccc

SEQ ID NO: 8582593 - DNA, 22 bp, Homo sapiens
gatacaaattcatgtctgaatt

SEQ ID NO: 8582594 - DNA, 22 bp, Homo sapiens
gatacaaaatataaatggagag

SEQ ID NO: 8582595 - DNA, 22 bp, Homo sapiens
gataatggggaatgataagtca

SEQ ID NO: 8582596 - DNA, 22 bp, Homo sapiens
gaggtggcactgtgaggagcac

SEQ ID NO: 8582597 - DNA, 22 bp, Homo sapiens
gaggtggccaagcgaggaaggg

SEQ ID NO: 8582598 - DNA, 22 bp, Homo sapiens
atgtgtccttgttcccattcca

SEQ ID NO: 8582599 - DNA, 22 bp, Homo sapiens
atgtgtccttataagaagaaga

SEQ ID NO: 8582600 - DNA, 22 bp, Homo sapiens
atgttctttgtgattctgagct

SEQ ID NO: 8582601 - DNA, 22 bp, Homo sapiens
atggccagagaaggcagggtca

SEQ ID NO: 8582602 - DNA, 22 bp, Homo sapiens
atggccagagaaggcagggtca

SEQ ID NO: 8582603 - DNA, 17 bp, Homo sapiens
gagatgggtggatcacc

SEQ ID NO: 8582604 - DNA, 21 bp, Homo sapiens
atggcttctcaggtgcactga

SEQ ID NO: 8582605 - DNA, 22 bp, Homo sapiens
atggcttctcgctggcacctgt

SEQ ID NO: 8582606 - DNA, 22 bp, Homo sapiens
atggccagagagagcacacctg

SEQ ID NO: 8582607 - DNA, 22 bp, Homo sapiens
atggccagagaggccagcctgg

SEQ ID NO: 8582608 - DNA, 21 bp, Homo sapiens
atggccagatctattaggtgg

SEQ ID NO: 8582609 - DNA, 22 bp, Homo sapiens
gagatgggcgagaaggtggact

SEQ ID NO: 8582610 - DNA, 22 bp, Homo sapiens
gagagagaggtgctgccaggca

SEQ ID NO: 8582611 - DNA, 23 bp, Homo sapiens
gagagcaatgagatgtaaacact

SEQ ID NO: 8582612 - DNA, 22 bp, Homo sapiens
gaggcagcatctatggtgggaa

SEQ ID NO: 8582613 - DNA, 22 bp, Homo sapiens
gaggcagcattcgcatagacag

SEQ ID NO: 8582614 - DNA, 18 bp, Homo sapiens
atggtctcatactgggag

SEQ ID NO: 8582615 - DNA, 22 bp, Homo sapiens
atggtctgctgagtcatgaggc

SEQ ID NO: 8582616 - DNA, 18 bp, Homo sapiens
atggtctcatactgggag

SEQ ID NO: 8582617 - DNA, 22 bp, Homo sapiens
gaggaaggctaaggggcttaga

SEQ ID NO: 8582618 - DNA, 22 bp, Homo sapiens
atggggagagaagggctgagct

SEQ ID NO: 8582619 - DNA, 22 bp, Homo sapiens
atggggagagcctctgtcccca

SEQ ID NO: 8582620 - DNA, 22 bp, Homo sapiens
atgggctgacaagacatgcata

SEQ ID NO: 8582621 - DNA, 22 bp, Homo sapiens
gaaacaggtggcaggctagatt

SEQ ID NO: 8582622 - DNA, 22 bp, Homo sapiens
atgacaggaggcagctgggcag

SEQ ID NO: 8582623 - DNA, 21 bp, Homo sapiens
atgatatgcttgtatttccaa

SEQ ID NO: 8582624 - DNA, 22 bp, Homo sapiens
gaaagtattagcctagaagtca

SEQ ID NO: 8582625 - DNA, 22 bp, Homo sapiens
gaaagtatttacattaacatct

SEQ ID NO: 8582626 - DNA, 23 bp, Homo sapiens
gaaagtcaatatggtagctttga

SEQ ID NO: 8582627 - DNA, 22 bp, Homo sapiens
atgaaacaacagacttggtcaa

SEQ ID NO: 8582628 - DNA, 22 bp, Homo sapiens
atgaaacaacagacttggtcaa

SEQ ID NO: 8582629 - DNA, 22 bp, Homo sapiens
atgaaacagtgaattagtcaag

SEQ ID NO: 8582630 - DNA, 22 bp, Homo sapiens
atgaactaagagtcattagtgt

SEQ ID NO: 8582631 - DNA, 22 bp, Homo sapiens
atgaactttctttacagttttg

SEQ ID NO: 8582632 - DNA, 22 bp, Homo sapiens
gacatttctagcccataaaact

SEQ ID NO: 8582633 - DNA, 22 bp, Homo sapiens
gacatttgtatcttaggggaaa

SEQ ID NO: 8582634 - DNA, 22 bp, Homo sapiens
gacatttgttcctctaagtgac

SEQ ID NO: 8582635 - DNA, 22 bp, Homo sapiens
atgctcctcgagtgtctcacag

SEQ ID NO: 8582636 - DNA, 22 bp, Homo sapiens
atgctccagtgtgatgcttcat

SEQ ID NO: 8582637 - DNA, 18 bp, Homo sapiens
atgctcctatctctgagc

SEQ ID NO: 8582638 - DNA, 22 bp, Homo sapiens
gacggcagaaactcatgaggtc

SEQ ID NO: 8582639 - DNA, 22 bp, Homo sapiens
gactggcctggggctgggcaca

SEQ ID NO: 8582640 - DNA, 22 bp, Homo sapiens
gactggcctggagatgcagctg

SEQ ID NO: 8582641 - DNA, 21 bp, Homo sapiens
gactggagagaggaagtctgg

SEQ ID NO: 8582642 - DNA, 22 bp, Homo sapiens
gactggagcccccaaggacacc

SEQ ID NO: 8582643 - DNA, 22 bp, Homo sapiens
gaaggctgtggctggtctcagt

SEQ ID NO: 8582644 - DNA, 22 bp, Homo sapiens
cagcaagacttcagggcttggt

SEQ ID NO: 8582645 - DNA, 21 bp, Homo sapiens
cagcaaggaagtcgagtaggt

SEQ ID NO: 8582646 - DNA, 22 bp, Homo sapiens
cagcaagatttttaaagcaagg

SEQ ID NO: 8582647 - DNA, 23 bp, Homo sapiens
cagcacagtacatttcctgtctc

SEQ ID NO: 8582648 - DNA, 22 bp, Homo sapiens
cagcacacagtgactcgcacct

SEQ ID NO: 8582649 - DNA, 22 bp, Homo sapiens
ggtgctgggaacgaggaattca

SEQ ID NO: 8582650 - DNA, 22 bp, Homo sapiens
ggtgctggacacgtggcactcc

SEQ ID NO: 8582651 - DNA, 22 bp, Homo sapiens
cagcaccattttcctggtcagc

SEQ ID NO: 8582652 - DNA, 22 bp, Homo sapiens
cagcacagtttgcttggcagag

SEQ ID NO: 8582653 - DNA, 22 bp, Homo sapiens
cagcacagtcctttgcttactg

SEQ ID NO: 8582654 - DNA, 22 bp, Homo sapiens
cagcacagtagagtagttgtaa

SEQ ID NO: 8582655 - DNA, 22 bp, Homo sapiens
cagcacagtgcagatgctgact

SEQ ID NO: 8582656 - DNA, 22 bp, Homo sapiens
cagcacagtgaccagacccact

SEQ ID NO: 8582657 - DNA, 22 bp, Homo sapiens
cagcacagtttcccccatgagc

SEQ ID NO: 8582658 - DNA, 22 bp, Homo sapiens
cagcacagtttctggcccgccg

SEQ ID NO: 8582659 - DNA, 22 bp, Homo sapiens
ggtcatgcagccttcaaaagag

SEQ ID NO: 8582660 - DNA, 22 bp, Homo sapiens
cagagtcattgacttccaggag

SEQ ID NO: 8582661 - DNA, 22 bp, Homo sapiens
cagagtcatatcagagaatatg

SEQ ID NO: 8582662 - DNA, 22 bp, Homo sapiens
cagagtcctggacacagagaca

SEQ ID NO: 8582663 - DNA, 17 bp, Homo sapiens
cagagtctgtctgcatc

SEQ ID NO: 8582664 - DNA, 22 bp, Homo sapiens
ggtcagtggcagggggtacttc

SEQ ID NO: 8582665 - DNA, 22 bp, Homo sapiens
ggtcagtgctgccagagtgacc

SEQ ID NO: 8582666 - DNA, 22 bp, Homo sapiens
ggtcagtggacaaaggagtttc

SEQ ID NO: 8582667 - DNA, 21 bp, Homo sapiens
cagagggtttctcaggtgttt

SEQ ID NO: 8582668 - DNA, 22 bp, Homo sapiens
cagagggttgatgtgaggctta

SEQ ID NO: 8582669 - DNA, 22 bp, Homo sapiens
ggggagcaatagttgaggtgtg

SEQ ID NO: 8582670 - DNA, 22 bp, Homo sapiens
ggggagcaggctgggctgtctg

SEQ ID NO: 8582671 - DNA, 22 bp, Homo sapiens
cagagggtggaggccaggctct

SEQ ID NO: 8582672 - DNA, 22 bp, Homo sapiens
cagagggtcaccaggaagtgca

SEQ ID NO: 8582673 - DNA, 23 bp, Homo sapiens
cagagggttccatggagcatggt

SEQ ID NO: 8582674 - DNA, 22 bp, Homo sapiens
gggctgagtctgctgcctgtca

SEQ ID NO: 8582675 - DNA, 22 bp, Homo sapiens
gggctgagtgacctcaggccaa

SEQ ID NO: 8582676 - DNA, 22 bp, Homo sapiens
cagagcctctcagaggtcagac

SEQ ID NO: 8582677 - DNA, 22 bp, Homo sapiens
cagagctgggatcccatgggcg

SEQ ID NO: 8582678 - DNA, 22 bp, Homo sapiens
cagagctgggcatggtgaaagg

SEQ ID NO: 8582679 - DNA, 22 bp, Homo sapiens
gggccagagcttggcagctggg

SEQ ID NO: 8582680 - DNA, 22 bp, Homo sapiens
gggccagcctactgctagaccc

SEQ ID NO: 8582681 - DNA, 21 bp, Homo sapiens
gggccactctagagaaagaaa

SEQ ID NO: 8582682 - DNA, 22 bp, Homo sapiens
gggccactgggtcctgctggcc

SEQ ID NO: 8582683 - DNA, 22 bp, Homo sapiens
gggccactcctggctgctgagt

SEQ ID NO: 8582684 - DNA, 22 bp, Homo sapiens
gggcagtgtggtcgtgcctttg

SEQ ID NO: 8582685 - DNA, 22 bp, Homo sapiens
gggcagtgtcgaggtctggtcc

SEQ ID NO: 8582686 - DNA, 22 bp, Homo sapiens
cagagcctaaaacgactccact

SEQ ID NO: 8582687 - DNA, 21 bp, Homo sapiens
gggcaggtctctgatgtcaac

SEQ ID NO: 8582688 - DNA, 22 bp, Homo sapiens
gggcaggtatttatcttctatt

SEQ ID NO: 8582689 - DNA, 22 bp, Homo sapiens
cagagacaggatctcgaagact

SEQ ID NO: 8582690 - DNA, 22 bp, Homo sapiens
gggcagtggttacacagctgag

SEQ ID NO: 8582691 - DNA, 22 bp, Homo sapiens
gggcagtgggaccaggcaccag

SEQ ID NO: 8582692 - DNA, 22 bp, Homo sapiens
gggcagtgggtggctgcagcct

SEQ ID NO: 8582693 - DNA, 22 bp, Homo sapiens
gggcagcagagccctgccgagt

SEQ ID NO: 8582694 - DNA, 22 bp, Homo sapiens
gggcagcatgaggaccctcatc

SEQ ID NO: 8582695 - DNA, 22 bp, Homo sapiens
ggcttcagaggggaggtagtgc

SEQ ID NO: 8582696 - DNA, 22 bp, Homo sapiens
cagacagggtcctgtccgtcac

SEQ ID NO: 8582697 - DNA, 22 bp, Homo sapiens
ggcttcagaagactggacaggt

SEQ ID NO: 8582698 - DNA, 22 bp, Homo sapiens
cagacccttttctgagaggacc

SEQ ID NO: 8582699 - DNA, 22 bp, Homo sapiens
cagactgggctggtggaaagct

SEQ ID NO: 8582700 - DNA, 22 bp, Homo sapiens
cagactgggagtcaggaagaag

SEQ ID NO: 8582701 - DNA, 22 bp, Homo sapiens
cagactggctgaaggccgagtg

SEQ ID NO: 8582702 - DNA, 22 bp, Homo sapiens
cagctagggagtggcagagctt

SEQ ID NO: 8582703 - DNA, 22 bp, Homo sapiens
cagctagggagtggcagagctt

SEQ ID NO: 8582704 - DNA, 22 bp, Homo sapiens
cagctaggaagtccttggcgaa

SEQ ID NO: 8582705 - DNA, 22 bp, Homo sapiens
cagcctgtggcagaggtctaat

SEQ ID NO: 8582706 - DNA, 22 bp, Homo sapiens
cagctaggaaaccagagggcag

SEQ ID NO: 8582707 - DNA, 22 bp, Homo sapiens
cagcctgtcggctccttcattc

SEQ ID NO: 8582708 - DNA, 22 bp, Homo sapiens
cagcctgtagtctggtccaggt

SEQ ID NO: 8582709 - DNA, 22 bp, Homo sapiens
cagcctgtctgggcagagtgga

SEQ ID NO: 8582710 - DNA, 22 bp, Homo sapiens
cagcctggtccccggctcaccc

SEQ ID NO: 8582711 - DNA, 22 bp, Homo sapiens
cagcctgctctcagatgttgag

SEQ ID NO: 8582712 - DNA, 22 bp, Homo sapiens
cagcctgctagggcaatgcctt

SEQ ID NO: 8582713 - DNA, 22 bp, Homo sapiens
cagcctggacagcgaccagagt

SEQ ID NO: 8582714 - DNA, 22 bp, Homo sapiens
cagcctggattgcagaatgcta

SEQ ID NO: 8582715 - DNA, 22 bp, Homo sapiens
cagcctggagccacagcccagg

SEQ ID NO: 8582716 - DNA, 22 bp, Homo sapiens
cagccctgctgccttagtgcct

SEQ ID NO: 8582717 - DNA, 22 bp, Homo sapiens
cagccctggaacagctgactca

SEQ ID NO: 8582718 - DNA, 22 bp, Homo sapiens
cagcctgacaccagctttgggc

SEQ ID NO: 8582719 - DNA, 22 bp, Homo sapiens
cagcctgactatggctgcaggt

SEQ ID NO: 8582720 - DNA, 22 bp, Homo sapiens
cagcctgcagggctgcctgttg

SEQ ID NO: 8582721 - DNA, 22 bp, Homo sapiens
cagcctgcaggaggccgtcagc

SEQ ID NO: 8582722 - DNA, 22 bp, Homo sapiens
cagcctgagccttctgtagcaa

SEQ ID NO: 8582723 - DNA, 22 bp, Homo sapiens
cagcctgccgtcagccaggtag

SEQ ID NO: 8582724 - DNA, 20 bp, Homo sapiens
cagcctgcatcatctgcagc

SEQ ID NO: 8582725 - DNA, 20 bp, Homo sapiens
gtgcccagttggtgacagac

SEQ ID NO: 8582726 - DNA, 18 bp, Homo sapiens
gtgctgtgggcagtggcc

SEQ ID NO: 8582727 - DNA, 22 bp, Homo sapiens
gtgctgtgtgatccatgctggc

SEQ ID NO: 8582728 - DNA, 22 bp, Homo sapiens
gtcccaggcagagtcaggaggg

SEQ ID NO: 8582729 - DNA, 22 bp, Homo sapiens
gtcccagcttcccactagcagc

SEQ ID NO: 8582730 - DNA, 21 bp, Homo sapiens
gtcatccacctctcgggctct

SEQ ID NO: 8582731 - DNA, 22 bp, Homo sapiens
cagcaggacatggaggagtaaa

SEQ ID NO: 8582732 - DNA, 22 bp, Homo sapiens
cagcaggacatggaggagtaaa

SEQ ID NO: 8582733 - DNA, 22 bp, Homo sapiens
gtcagcattagcaatgactggt

SEQ ID NO: 8582734 - DNA, 22 bp, Homo sapiens
cagcagctggtgagacacagcc

SEQ ID NO: 8582735 - DNA, 22 bp, Homo sapiens
cagcagctgtttacggaacacc

SEQ ID NO: 8582736 - DNA, 22 bp, Homo sapiens
cagcagctggtgagacacagcc

SEQ ID NO: 8582737 - DNA, 22 bp, Homo sapiens
cagcagcttctgttgatcagaa

SEQ ID NO: 8582738 - DNA, 22 bp, Homo sapiens
cagcagctttgccaagtcagcc

SEQ ID NO: 8582739 - DNA, 22 bp, Homo sapiens
cagcagcttctgttgatcagaa

SEQ ID NO: 8582740 - DNA, 22 bp, Homo sapiens
cagcagctgatggggaagtgat

SEQ ID NO: 8582741 - DNA, 22 bp, Homo sapiens
cagcagctgcctcagctgggga

SEQ ID NO: 8582742 - DNA, 22 bp, Homo sapiens
cagcagctgcgtgcccaggccg

SEQ ID NO: 8582743 - DNA, 22 bp, Homo sapiens
cagcagctgggaaggaggctga

SEQ ID NO: 8582744 - DNA, 22 bp, Homo sapiens
cagcagctgggaaggaggctga

SEQ ID NO: 8582745 - DNA, 22 bp, Homo sapiens
cagcagctagaggaagggcaga

SEQ ID NO: 8582746 - DNA, 22 bp, Homo sapiens
gtcccaggcaggccactggcag

SEQ ID NO: 8582747 - DNA, 22 bp, Homo sapiens
gtcccaggctccatggcagcca

SEQ ID NO: 8582748 - DNA, 22 bp, Homo sapiens
gtcccaggcttatgtggagctt

SEQ ID NO: 8582749 - DNA, 22 bp, Homo sapiens
gtctggagacttgggtcatcaa

SEQ ID NO: 8582750 - DNA, 22 bp, Homo sapiens
gtctgtggagttgcttgctgga

SEQ ID NO: 8582751 - DNA, 22 bp, Homo sapiens
cagcccaggctcagatgttggg

SEQ ID NO: 8582752 - DNA, 22 bp, Homo sapiens
cagcccctcacagagctgtcct

SEQ ID NO: 8582753 - DNA, 22 bp, Homo sapiens
ggctgaggcggcgatgcccttg

SEQ ID NO: 8582754 - DNA, 22 bp, Homo sapiens
ggctgagctcaggggcagcagg

SEQ ID NO: 8582755 - DNA, 22 bp, Homo sapiens
ggctccagtttccccttggggc

SEQ ID NO: 8582756 - DNA, 18 bp, Homo sapiens
ggctccagtcttcagtgg

SEQ ID NO: 8582757 - DNA, 18 bp, Homo sapiens
ggctccagtcttcagtgg

SEQ ID NO: 8582758 - DNA, 22 bp, Homo sapiens
ggctccaggtttaagggtatgt

SEQ ID NO: 8582759 - DNA, 22 bp, Homo sapiens
ggctccaggtgcatgccaggct

SEQ ID NO: 8582760 - DNA, 22 bp, Homo sapiens
ggctccaggtgcatgccaggct

SEQ ID NO: 8582761 - DNA, 22 bp, Homo sapiens
ggctccaggtgcatgccaggct

SEQ ID NO: 8582762 - DNA, 22 bp, Homo sapiens
ggctccaggtgcatgccaggct

SEQ ID NO: 8582763 - DNA, 22 bp, Homo sapiens
ggctcaggttaccagtccctcc

SEQ ID NO: 8582764 - DNA, 22 bp, Homo sapiens
ggctccaggtacgtatgggagg

SEQ ID NO: 8582765 - DNA, 22 bp, Homo sapiens
ggctccaggtacgtatgggagg

SEQ ID NO: 8582766 - DNA, 22 bp, Homo sapiens
ggctccagggtacccctggatg

SEQ ID NO: 8582767 - DNA, 22 bp, Homo sapiens
ggctccagggtctctccttgtg

SEQ ID NO: 8582768 - DNA, 22 bp, Homo sapiens
ggctccagggtctctccttgtg

SEQ ID NO: 8582769 - DNA, 22 bp, Homo sapiens
ggcctgtgcaagacagcacccc

SEQ ID NO: 8582770 - DNA, 22 bp, Homo sapiens
ggcctgagctctggggaggcaa

SEQ ID NO: 8582771 - DNA, 20 bp, Homo sapiens
ggcctgagcatggctggcag

SEQ ID NO: 8582772 - DNA, 22 bp, Homo sapiens
ggctcagggaatgaggaagaat

SEQ ID NO: 8582773 - DNA, 19 bp, Homo sapiens
ggcctgtgcagagcccgtc

SEQ ID NO: 8582774 - DNA, 22 bp, Homo sapiens
ggctcaatgcaacttctgcctc

SEQ ID NO: 8582775 - DNA, 22 bp, Homo sapiens
ggcctgtgtctgtgcctgtcct

SEQ ID NO: 8582776 - DNA, 22 bp, Homo sapiens
ggcctgtgtcctccttgccctg

SEQ ID NO: 8582777 - DNA, 22 bp, Homo sapiens
ggctgtaggttggtgctggaca

SEQ ID NO: 8582778 - DNA, 23 bp, Homo sapiens
cagaaagccctttccccacagta

SEQ ID NO: 8582779 - DNA, 22 bp, Homo sapiens
cagaaaacaaacctatcctgag

SEQ ID NO: 8582780 - DNA, 22 bp, Homo sapiens
cagaaaaggaagagctatgtaa

SEQ ID NO: 8582781 - DNA, 22 bp, Homo sapiens
cagaaaagggtgtttgttcagg

SEQ ID NO: 8582782 - DNA, 22 bp, Homo sapiens
ggcatcaggacagggtttctag

SEQ ID NO: 8582783 - DNA, 22 bp, Homo sapiens
ggcatttagttttcatattctg

SEQ ID NO: 8582784 - DNA, 22 bp, Homo sapiens
ggcatttatctaatatagttta

SEQ ID NO: 8582785 - DNA, 20 bp, Homo sapiens
ggcatttatgaaccaagcct

SEQ ID NO: 8582786 - DNA, 22 bp, Homo sapiens
ggcatttgactcagtgactggg

SEQ ID NO: 8582787 - DNA, 22 bp, Homo sapiens
ggcatttatttgtctcattctt

SEQ ID NO: 8582788 - DNA, 22 bp, Homo sapiens
ggcatttaatccatctgattga

SEQ ID NO: 8582789 - DNA, 22 bp, Homo sapiens
ggcatttacataatcttattta

SEQ ID NO: 8582790 - DNA, 22 bp, Homo sapiens
ggcatttacgatactgcatagg

SEQ ID NO: 8582791 - DNA, 22 bp, Homo sapiens
ggcatttagagggcttttctga

SEQ ID NO: 8582792 - DNA, 22 bp, Homo sapiens
ggcatttactagagccacattt

SEQ ID NO: 8582793 - DNA, 22 bp, Homo sapiens
ggcatttagattgaatttctgt

SEQ ID NO: 8582794 - DNA, 22 bp, Homo sapiens
ggcatttaggcagataacagac

SEQ ID NO: 8582795 - DNA, 22 bp, Homo sapiens
ggcatttaggatctttagttga

SEQ ID NO: 8582796 - DNA, 22 bp, Homo sapiens
ggccaaggatggtggctctggt

SEQ ID NO: 8582797 - DNA, 19 bp, Homo sapiens
ggccactcctggtgactgg

SEQ ID NO: 8582798 - DNA, 22 bp, Homo sapiens
ggcaggtgcccagagagcacga

SEQ ID NO: 8582799 - DNA, 22 bp, Homo sapiens
ggcaggtgcccagagagcacga

SEQ ID NO: 8582800 - DNA, 22 bp, Homo sapiens
ggcaggtgcccagagagcacga

SEQ ID NO: 8582801 - DNA, 22 bp, Homo sapiens
ggcaggtgccagttggcttggg

SEQ ID NO: 8582802 - DNA, 22 bp, Homo sapiens
ggcaggtgatctagagtcaata

SEQ ID NO: 8582803 - DNA, 22 bp, Homo sapiens
ggcaggtgcacctgagccatct

SEQ ID NO: 8582804 - DNA, 22 bp, Homo sapiens
ggcaggtgcacctgagccatct

SEQ ID NO: 8582805 - DNA, 22 bp, Homo sapiens
ggcagggcaggaaagtcaggaa

SEQ ID NO: 8582806 - DNA, 22 bp, Homo sapiens
ggcagggcaggaaagtcaggaa

SEQ ID NO: 8582807 - DNA, 22 bp, Homo sapiens
ggcagggcaggaaagtcaggaa

SEQ ID NO: 8582808 - DNA, 22 bp, Homo sapiens
ggcagggcagcgctgattaggg

SEQ ID NO: 8582809 - DNA, 22 bp, Homo sapiens
ggccgctctccggtgtggatct

SEQ ID NO: 8582810 - DNA, 22 bp, Homo sapiens
cacgaggccatctccttctgga

SEQ ID NO: 8582811 - DNA, 22 bp, Homo sapiens
ggccactgctgctctggtggag

SEQ ID NO: 8582812 - DNA, 22 bp, Homo sapiens
ggccactgctctccagcctggg

SEQ ID NO: 8582813 - DNA, 22 bp, Homo sapiens
ggccactgacctacatctgggg

SEQ ID NO: 8582814 - DNA, 22 bp, Homo sapiens
ggaggtggagctggaagttcca

SEQ ID NO: 8582815 - DNA, 22 bp, Homo sapiens
ggaggtgcagagtagggttggt

SEQ ID NO: 8582816 - DNA, 22 bp, Homo sapiens
ggcaggcaggtcttcatggccc

SEQ ID NO: 8582817 - DNA, 21 bp, Homo sapiens
cacagaatatacattttagtt

SEQ ID NO: 8582818 - DNA, 22 bp, Homo sapiens
cacacagcaacaagaatagcca

SEQ ID NO: 8582819 - DNA, 22 bp, Homo sapiens
cacacagctagtgacaggagaa

SEQ ID NO: 8582820 - DNA, 22 bp, Homo sapiens
cacacagctagtgacaggagaa

SEQ ID NO: 8582821 - DNA, 22 bp, Homo sapiens
cacacagctcaggggcactgcc

SEQ ID NO: 8582822 - DNA, 22 bp, Homo sapiens
cacacagatggtaagggaggga

SEQ ID NO: 8582823 - DNA, 22 bp, Homo sapiens
cacagacagtgtccctttgttg

SEQ ID NO: 8582824 - DNA, 22 bp, Homo sapiens
cacagaattttctctttacaat

SEQ ID NO: 8582825 - DNA, 22 bp, Homo sapiens
cacagaatggaccagttttaga

SEQ ID NO: 8582826 - DNA, 22 bp, Homo sapiens
cacagaggatgcccaagcgatc

SEQ ID NO: 8582827 - DNA, 22 bp, Homo sapiens
cacagagagctacgtgcagcgt

SEQ ID NO: 8582828 - DNA, 22 bp, Homo sapiens
cacagaggaatgcatcagcaga

SEQ ID NO: 8582829 - DNA, 22 bp, Homo sapiens
cacaggactcgactgcagacag

SEQ ID NO: 8582830 - DNA, 22 bp, Homo sapiens
ggaggccaaagtgtgggcggct

SEQ ID NO: 8582831 - DNA, 22 bp, Homo sapiens
ggaggccaaggaggagcttgcc

SEQ ID NO: 8582832 - DNA, 22 bp, Homo sapiens
ggaggccaaggaggagcttgcc

SEQ ID NO: 8582833 - DNA, 22 bp, Homo sapiens
ggaggccaaggaggagcttgcc

SEQ ID NO: 8582834 - DNA, 22 bp, Homo sapiens
ggaggccaaggcaggtggatca

SEQ ID NO: 8582835 - DNA, 22 bp, Homo sapiens
ggaggccaaggcaggtggatca

SEQ ID NO: 8582836 - DNA, 22 bp, Homo sapiens
cacaggctgggaagcctaggcc

SEQ ID NO: 8582837 - DNA, 19 bp, Homo sapiens
cacagatgattgacacata

SEQ ID NO: 8582838 - DNA, 22 bp, Homo sapiens
cacagattatgagacgagatac

SEQ ID NO: 8582839 - DNA, 22 bp, Homo sapiens
cacagatttctggtcttcaccc

SEQ ID NO: 8582840 - DNA, 22 bp, Homo sapiens
ggagctggcagcgcaacccaga

SEQ ID NO: 8582841 - DNA, 20 bp, Homo sapiens
ggagctggcatccagcctct

SEQ ID NO: 8582842 - DNA, 22 bp, Homo sapiens
ggagcctgagcggcccagggcc

SEQ ID NO: 8582843 - DNA, 23 bp, Homo sapiens
ggagctgctgttgggggagctgc

SEQ ID NO: 8582844 - DNA, 19 bp, Homo sapiens
ggagcctggagcacgtgcc

SEQ ID NO: 8582845 - DNA, 22 bp, Homo sapiens
gctttctgtaggtagttactgt

SEQ ID NO: 8582846 - DNA, 22 bp, Homo sapiens
caaggtgccatgctgggcgggg

SEQ ID NO: 8582847 - DNA, 22 bp, Homo sapiens
gctggctgtatcacctggccag

SEQ ID NO: 8582848 - DNA, 21 bp, Homo sapiens
gctggctgtcccagggaagca

SEQ ID NO: 8582849 - DNA, 22 bp, Homo sapiens
gctggctggctgtgcaaaggca

SEQ ID NO: 8582850 - DNA, 22 bp, Homo sapiens
caaggccatattgcctgtatgt

SEQ ID NO: 8582851 - DNA, 22 bp, Homo sapiens
gctggaggctggagtgcagtgg

SEQ ID NO: 8582852 - DNA, 22 bp, Homo sapiens
gctggaggctggagtgcagtgg

SEQ ID NO: 8582853 - DNA, 22 bp, Homo sapiens
caagccaggtgaacataacaag

SEQ ID NO: 8582854 - DNA, 22 bp, Homo sapiens
caagcatactgtgagagtttta

SEQ ID NO: 8582855 - DNA, 22 bp, Homo sapiens
caagcagggtttatgcatggag

SEQ ID NO: 8582856 - DNA, 22 bp, Homo sapiens
gctggaggaggaagtgtgaggg

SEQ ID NO: 8582857 - DNA, 22 bp, Homo sapiens
gctggaggatggactggaagaa

SEQ ID NO: 8582858 - DNA, 22 bp, Homo sapiens
gctggaggatggactggaagaa

SEQ ID NO: 8582859 - DNA, 22 bp, Homo sapiens
caaatgtgacttttgggcttct

SEQ ID NO: 8582860 - DNA, 22 bp, Homo sapiens
caagcaggcctggctggaccgt

SEQ ID NO: 8582861 - DNA, 22 bp, Homo sapiens
caagcaggatgaagcccaggga

SEQ ID NO: 8582862 - DNA, 22 bp, Homo sapiens
cgcagggccgcgagcgggacca

SEQ ID NO: 8582863 - DNA, 22 bp, Homo sapiens
cgcaggtgaaagaggctgggca

SEQ ID NO: 8582864 - DNA, 22 bp, Homo sapiens
cgcaggtgaactgttctgcagt

SEQ ID NO: 8582865 - DNA, 22 bp, Homo sapiens
cgcagctgtccatgtgtggggg

SEQ ID NO: 8582866 - DNA, 22 bp, Homo sapiens
cgaggccatgcatgctgaggac

SEQ ID NO: 8582867 - DNA, 22 bp, Homo sapiens
cgcaggaagacaagggtggaaa

SEQ ID NO: 8582868 - DNA, 19 bp, Homo sapiens
cgcaggagccgaggtgacc

SEQ ID NO: 8582869 - DNA, 22 bp, Homo sapiens
cgcaggcacagagtggacagcg

SEQ ID NO: 8582870 - DNA, 23 bp, Homo sapiens
agtattcaaaaggcaagctatat

SEQ ID NO: 8582871 - DNA, 22 bp, Homo sapiens
ctaggtgatccactgctctctt

SEQ ID NO: 8582872 - DNA, 22 bp, Homo sapiens
ctagggtgtgcagattttgcct

SEQ ID NO: 8582873 - DNA, 22 bp, Homo sapiens
agtccagggagcccaggctttg

SEQ ID NO: 8582874 - DNA, 22 bp, Homo sapiens
cctgggctccactccaagagca

SEQ ID NO: 8582875 - DNA, 22 bp, Homo sapiens
cctgggctcacagccaaggctc

SEQ ID NO: 8582876 - DNA, 22 bp, Homo sapiens
cctggctctggtgaggagaagt

SEQ ID NO: 8582877 - DNA, 22 bp, Homo sapiens
cctggctctgcgtgcagctccg

SEQ ID NO: 8582878 - DNA, 22 bp, Homo sapiens
cctgggctcgcgcacttcaccc

SEQ ID NO: 8582879 - DNA, 22 bp, Homo sapiens
cctgggcttgcatctgtgctgg

SEQ ID NO: 8582880 - DNA, 22 bp, Homo sapiens
cctgggctttcggcggcttcct

SEQ ID NO: 8582881 - DNA, 22 bp, Homo sapiens
cctgtctccctggcatggctca

SEQ ID NO: 8582882 - DNA, 22 bp, Homo sapiens
cctgtgatccataggcatccag

SEQ ID NO: 8582883 - DNA, 22 bp, Homo sapiens
aggtggggccaaatgctacagt

SEQ ID NO: 8582884 - DNA, 22 bp, Homo sapiens
aggtggggagtatatgtaattg

SEQ ID NO: 8582885 - DNA, 21 bp, Homo sapiens
aggtggggctgcacctctgct

SEQ ID NO: 8582886 - DNA, 22 bp, Homo sapiens
aggtggggcccaccaatttgca

SEQ ID NO: 8582887 - DNA, 21 bp, Homo sapiens
cctgccaggaaactgagtgtc

SEQ ID NO: 8582888 - DNA, 22 bp, Homo sapiens
cctgccagctgtgggccagcct

SEQ ID NO: 8582889 - DNA, 22 bp, Homo sapiens
aggtagggttaatggagatata

SEQ ID NO: 8582890 - DNA, 23 bp, Homo sapiens
aggtaggttattgctgctacctg

SEQ ID NO: 8582891 - DNA, 22 bp, Homo sapiens
aggtagggctaggctgcgtctg

SEQ ID NO: 8582892 - DNA, 22 bp, Homo sapiens
aggtagggggtttgggaactgc

SEQ ID NO: 8582893 - DNA, 19 bp, Homo sapiens
aggtaggcagtggcatgga

SEQ ID NO: 8582894 - DNA, 22 bp, Homo sapiens
aggtagggaagaaggcatgaaa

SEQ ID NO: 8582895 - DNA, 22 bp, Homo sapiens
cctgccagatcccctgagctga

SEQ ID NO: 8582896 - DNA, 22 bp, Homo sapiens
cctgcagagcaggagaggcatc

SEQ ID NO: 8582897 - DNA, 22 bp, Homo sapiens
cctgcagagggactggcaggaa

SEQ ID NO: 8582898 - DNA, 22 bp, Homo sapiens
cctgcagcccttcaaaggctga

SEQ ID NO: 8582899 - DNA, 22 bp, Homo sapiens
cctggatgatccatgtcatgga

SEQ ID NO: 8582900 - DNA, 22 bp, Homo sapiens
aggtcctctgtgcctgctggcg

SEQ ID NO: 8582901 - DNA, 22 bp, Homo sapiens
ctgagaaaagctttcttataca

SEQ ID NO: 8582902 - DNA, 22 bp, Homo sapiens
ctgaaggaagcaggtggcctgt

SEQ ID NO: 8582903 - DNA, 22 bp, Homo sapiens
ctgaggagacagaagccaaata

SEQ ID NO: 8582904 - DNA, 17 bp, Homo sapiens
ctgaggagaacagaaag

SEQ ID NO: 8582905 - DNA, 22 bp, Homo sapiens
ctgaggagaggtggcctgtgtt

SEQ ID NO: 8582906 - DNA, 22 bp, Homo sapiens
ctgaggagaccatcaactaatt

SEQ ID NO: 8582907 - DNA, 22 bp, Homo sapiens
ctctggctttgctcatgcatcc

SEQ ID NO: 8582908 - DNA, 22 bp, Homo sapiens
ctctgggcttgttgacctgcac

SEQ ID NO: 8582909 - DNA, 22 bp, Homo sapiens
agtccgtcctgtcaagcagctg

SEQ ID NO: 8582910 - DNA, 22 bp, Homo sapiens
ctccaggctggggtgcaggttg

SEQ ID NO: 8582911 - DNA, 22 bp, Homo sapiens
ctccaggaaaatagggaatgag

SEQ ID NO: 8582912 - DNA, 22 bp, Homo sapiens
ctccaggaaagcctgaggcccg

SEQ ID NO: 8582913 - DNA, 22 bp, Homo sapiens
ctccaggaaagcctgaggcccg

SEQ ID NO: 8582914 - DNA, 22 bp, Homo sapiens
ctccagctttagctctccaggg

SEQ ID NO: 8582915 - DNA, 22 bp, Homo sapiens
agtggcagaggttgactgcagt

SEQ ID NO: 8582916 - DNA, 22 bp, Homo sapiens
agtggcagaggttgactgcagt

SEQ ID NO: 8582917 - DNA, 22 bp, Homo sapiens
agtggcagatctctggtctgga

SEQ ID NO: 8582918 - DNA, 22 bp, Homo sapiens
agtggcagagtgcactcaggca

SEQ ID NO: 8582919 - DNA, 22 bp, Homo sapiens
ctctcagaagtttatgtcagaa

SEQ ID NO: 8582920 - DNA, 19 bp, Homo sapiens
agtggcagatctggaagta

SEQ ID NO: 8582921 - DNA, 22 bp, Homo sapiens
ctctcagacacccatttggaaa

SEQ ID NO: 8582922 - DNA, 22 bp, Homo sapiens
ctcctgggtcattgccagcaaa

SEQ ID NO: 8582923 - DNA, 22 bp, Homo sapiens
ctcctgggggacagcggcaggg

SEQ ID NO: 8582924 - DNA, 22 bp, Homo sapiens
ctcctggggcacttagaagcaa

SEQ ID NO: 8582925 - DNA, 22 bp, Homo sapiens
ctcctggggccatggaaggaac

SEQ ID NO: 8582926 - DNA, 22 bp, Homo sapiens
ctcctgggaaatgaaggggcag

SEQ ID NO: 8582927 - DNA, 20 bp, Homo sapiens
ctccagggaacagactggag

SEQ ID NO: 8582928 - DNA, 22 bp, Homo sapiens
ctcctgccaccgcggtgtcctg

SEQ ID NO: 8582929 - DNA, 22 bp, Homo sapiens
ctcctcaaggtctcaggaataa

SEQ ID NO: 8582930 - DNA, 22 bp, Homo sapiens
ctgtggctcaaaatcccatgat

SEQ ID NO: 8582931 - DNA, 22 bp, Homo sapiens
ctgtgggaatactgcgagtgta

SEQ ID NO: 8582932 - DNA, 23 bp, Homo sapiens
ctgtgggaagtcggggagcgcgc

SEQ ID NO: 8582933 - DNA, 22 bp, Homo sapiens
ctgtggccttggaccagcatct

SEQ ID NO: 8582934 - DNA, 22 bp, Homo sapiens
ctgtggcctttgttggaggtcc

SEQ ID NO: 8582935 - DNA, 21 bp, Homo sapiens
ctgtggcctggctagcaccgt

SEQ ID NO: 8582936 - DNA, 22 bp, Homo sapiens
ctgtggagttccatcaggggag

SEQ ID NO: 8582937 - DNA, 22 bp, Homo sapiens
ctgtggagtgtagatgctgggt

SEQ ID NO: 8582938 - DNA, 23 bp, Homo sapiens
ctgtggccctgcttcatgcagcc

SEQ ID NO: 8582939 - DNA, 19 bp, Homo sapiens
ctgtggcctccaggaggga

SEQ ID NO: 8582940 - DNA, 19 bp, Homo sapiens
ctgtggcctccaggaggga

SEQ ID NO: 8582941 - DNA, 22 bp, Homo sapiens
atcagacaattgttgagtactg

SEQ ID NO: 8582942 - DNA, 22 bp, Homo sapiens
atcagacactagtggactagaa

SEQ ID NO: 8582943 - DNA, 22 bp, Homo sapiens
atcctgggcagtgtgtcactct

SEQ ID NO: 8582944 - DNA, 18 bp, Homo sapiens
atcctgggccagtctttc

SEQ ID NO: 8582945 - DNA, 22 bp, Homo sapiens
atcctgggtaagttccttttaa

SEQ ID NO: 8582946 - DNA, 19 bp, Homo sapiens
atcctgggtcctccagctg

SEQ ID NO: 8582947 - DNA, 22 bp, Homo sapiens
cttagagccttactcttcttgt

SEQ ID NO: 8582948 - DNA, 22 bp, Homo sapiens
cttagagatgggttttacttag

SEQ ID NO: 8582949 - DNA, 22 bp, Homo sapiens
cttagagatgggttttacttag

SEQ ID NO: 8582950 - DNA, 22 bp, Homo sapiens
cttcctcccggcccatgctctg

SEQ ID NO: 8582951 - DNA, 19 bp, Homo sapiens
atctgagattataaacaga

SEQ ID NO: 8582952 - DNA, 22 bp, Homo sapiens
atctgcagtttgttttctcttg

SEQ ID NO: 8582953 - DNA, 22 bp, Homo sapiens
atcagaaactcttagagcaggg

SEQ ID NO: 8582954 - DNA, 22 bp, Homo sapiens
atcagaaaaatgagaagagctg

SEQ ID NO: 8582955 - DNA, 21 bp, Homo sapiens
atattggtatctttttaaatc

SEQ ID NO: 8582956 - DNA, 22 bp, Homo sapiens
atattggtgattagccaatgct

SEQ ID NO: 8582957 - DNA, 22 bp, Homo sapiens
atattggtgaaatgctagcaaa

SEQ ID NO: 8582958 - DNA, 22 bp, Homo sapiens
atattggtaaagtggattaaca

SEQ ID NO: 8582959 - DNA, 22 bp, Homo sapiens
atattgagatgaggatattaac

SEQ ID NO: 8582960 - DNA, 22 bp, Homo sapiens
atattgagataagaactgacat

SEQ ID NO: 8582961 - DNA, 19 bp, Homo sapiens
ctgggctgaggtctgcctt

SEQ ID NO: 8582962 - DNA, 22 bp, Homo sapiens
ctgggctgagcctgggctgtgt

SEQ ID NO: 8582963 - DNA, 22 bp, Homo sapiens
atattatagacagagtcttctg

SEQ ID NO: 8582964 - DNA, 22 bp, Homo sapiens
ctgggctctgcggtgtcgctct

SEQ ID NO: 8582965 - DNA, 22 bp, Homo sapiens
ctgggctctgtgtttcagtttc

SEQ ID NO: 8582966 - DNA, 22 bp, Homo sapiens
ctgggctcttctcaccctgttt

SEQ ID NO: 8582967 - DNA, 22 bp, Homo sapiens
ctgggctcttcccagatccaga

SEQ ID NO: 8582968 - DNA, 22 bp, Homo sapiens
atattataagttatttcaagtt

SEQ ID NO: 8582969 - DNA, 22 bp, Homo sapiens
ctgggctcagaaccttgttaag

SEQ ID NO: 8582970 - DNA, 21 bp, Homo sapiens
ctgggctcaagcaatcctttc

SEQ ID NO: 8582971 - DNA, 22 bp, Homo sapiens
ctgggctcaagaagtcttccct

SEQ ID NO: 8582972 - DNA, 20 bp, Homo sapiens
ctgggctcaagtgagcctcc

SEQ ID NO: 8582973 - DNA, 22 bp, Homo sapiens
ctgggctcaagtgatccaccca

SEQ ID NO: 8582974 - DNA, 20 bp, Homo sapiens
ctgggctcaagtgatcctcc

SEQ ID NO: 8582975 - DNA, 20 bp, Homo sapiens
ctgggctcaagtgatcctcc

SEQ ID NO: 8582976 - DNA, 22 bp, Homo sapiens
ctggcttccatgctgtagtggc

SEQ ID NO: 8582977 - DNA, 19 bp, Homo sapiens
ctggcttcaagcagtcctc

SEQ ID NO: 8582978 - DNA, 22 bp, Homo sapiens
ctggctgtgtgcccccggcacc

SEQ ID NO: 8582979 - DNA, 22 bp, Homo sapiens
atacagatgttaaagcaatttc

SEQ ID NO: 8582980 - DNA, 22 bp, Homo sapiens
ctggagaagtactgagacattt

SEQ ID NO: 8582981 - DNA, 22 bp, Homo sapiens
ctggagagaaatgacaaagcta

SEQ ID NO: 8582982 - DNA, 22 bp, Homo sapiens
ataccttttagacatgtagttg

SEQ ID NO: 8582983 - DNA, 22 bp, Homo sapiens
ataccaaagcacatactgtttg

SEQ ID NO: 8582984 - DNA, 22 bp, Homo sapiens
ctggctccatccttgagctctg

SEQ ID NO: 8582985 - DNA, 22 bp, Homo sapiens
ctggctccattactcagcatct

SEQ ID NO: 8582986 - DNA, 22 bp, Homo sapiens
ctggctccatctttgcttcctg

SEQ ID NO: 8582987 - DNA, 22 bp, Homo sapiens
ctggctccagtgacaagtcgat

SEQ ID NO: 8582988 - DNA, 22 bp, Homo sapiens
ctggctccatcctaggcaaatg

SEQ ID NO: 8582989 - DNA, 22 bp, Homo sapiens
ctggctcccatgagctctcacg

SEQ ID NO: 8582990 - DNA, 22 bp, Homo sapiens
ctggctcccagctttcagggag

SEQ ID NO: 8582991 - DNA, 22 bp, Homo sapiens
ctggctcccgaagccctcagtg

SEQ ID NO: 8582992 - DNA, 22 bp, Homo sapiens
ctggctcccctacttcttattg

SEQ ID NO: 8582993 - DNA, 22 bp, Homo sapiens
ctggctcccgtctggtggccat

SEQ ID NO: 8582994 - DNA, 22 bp, Homo sapiens
ctggctcccggggatcgagcac

SEQ ID NO: 8582995 - DNA, 22 bp, Homo sapiens
ctggctcccgttgtccttgaag

SEQ ID NO: 8582996 - DNA, 22 bp, Homo sapiens
atagcaaactggcagcttgtgg

SEQ ID NO: 8582997 - DNA, 22 bp, Homo sapiens
ctggcccatggtgagctctggg

SEQ ID NO: 8582998 - DNA, 22 bp, Homo sapiens
ctggccccatctggagtctgag

SEQ ID NO: 8582999 - DNA, 22 bp, Homo sapiens
atagatgttttagtaatactgt

SEQ ID NO: 8583000 - DNA, 22 bp, Homo sapiens
atactacactatgcatggatgt

SEQ ID NO: 8583001 - DNA, 22 bp, Homo sapiens
atactacaaggtatgtgctaaa

SEQ ID NO: 8583002 - DNA, 22 bp, Homo sapiens
atactacacattgactatattt

SEQ ID NO: 8583003 - DNA, 22 bp, Homo sapiens
atactacacattgactatattt

SEQ ID NO: 8583004 - DNA, 22 bp, Homo sapiens
agttattgagtgcagagcaggg

SEQ ID NO: 8583005 - DNA, 22 bp, Homo sapiens
agttattgttcagtacaatgtc

SEQ ID NO: 8583006 - DNA, 22 bp, Homo sapiens
ctgaggagcgttggtcacgtgt

SEQ ID NO: 8583007 - DNA, 20 bp, Homo sapiens
ctgcagggttagaggctcca

SEQ ID NO: 8583008 - DNA, 23 bp, Homo sapiens
ctgcagagaactgagggacagcc

SEQ ID NO: 8583009 - DNA, 22 bp, Homo sapiens
atacaacagaaaatgattattc

SEQ ID NO: 8583010 - DNA, 22 bp, Homo sapiens
ataagcagggtcaaatgcctac

SEQ ID NO: 8583011 - DNA, 22 bp, Homo sapiens
ataagagctatggtgggagttg

SEQ ID NO: 8583012 - DNA, 22 bp, Homo sapiens
cagtaacagtgatcacctgtgg

SEQ ID NO: 8583013 - DNA, 22 bp, Homo sapiens
cagtaacacaaccactccgtga

SEQ ID NO: 8583014 - DNA, 22 bp, Homo sapiens
aggacagagggaccagagccca

SEQ ID NO: 8583015 - DNA, 23 bp, Homo sapiens
aggaagttatgaagggagaatag

SEQ ID NO: 8583016 - DNA, 22 bp, Homo sapiens
aggacagacctaggactggagc

SEQ ID NO: 8583017 - DNA, 22 bp, Homo sapiens
aggacagagcctgtgcagaccg

SEQ ID NO: 8583018 - DNA, 22 bp, Homo sapiens
caggtgggattttgctgcttga

SEQ ID NO: 8583019 - DNA, 22 bp, Homo sapiens
caggtgggccatgaaaaatgac

SEQ ID NO: 8583020 - DNA, 22 bp, Homo sapiens
caggtggtgcctccaggctggt

SEQ ID NO: 8583021 - DNA, 22 bp, Homo sapiens
caggtggtgcctcctcccttcc

SEQ ID NO: 8583022 - DNA, 22 bp, Homo sapiens
caggtggttccatgtttcatga

SEQ ID NO: 8583023 - DNA, 22 bp, Homo sapiens
caggtggttatgaggaaggtga

SEQ ID NO: 8583024 - DNA, 22 bp, Homo sapiens
cagggcttcgctcctggtgcac

SEQ ID NO: 8583025 - DNA, 22 bp, Homo sapiens
caggtgtctaattctcaccccc

SEQ ID NO: 8583026 - DNA, 22 bp, Homo sapiens
caggtgtcggtcaggcggtttt

SEQ ID NO: 8583027 - DNA, 22 bp, Homo sapiens
caggtgtcaaaatactaagtgg

SEQ ID NO: 8583028 - DNA, 22 bp, Homo sapiens
caggtgtcagcagcactgtact

SEQ ID NO: 8583029 - DNA, 16 bp, Homo sapiens
caggtgtcagtcacct

SEQ ID NO: 8583030 - DNA, 22 bp, Homo sapiens
caggtggttgagagctgtaggc

SEQ ID NO: 8583031 - DNA, 22 bp, Homo sapiens
caggtggttgtttggattctaa

SEQ ID NO: 8583032 - DNA, 22 bp, Homo sapiens
caggtggtttgataggataact

SEQ ID NO: 8583033 - DNA, 18 bp, Homo sapiens
cagggctgtggggtcact

SEQ ID NO: 8583034 - DNA, 22 bp, Homo sapiens
aggaagagctggaccagaggac

SEQ ID NO: 8583035 - DNA, 22 bp, Homo sapiens
aggaagagctggaccagaggac

SEQ ID NO: 8583036 - DNA, 22 bp, Homo sapiens
aggaagagctggaccagaggac

SEQ ID NO: 8583037 - DNA, 22 bp, Homo sapiens
aggaagaaacctactagagttt

SEQ ID NO: 8583038 - DNA, 22 bp, Homo sapiens
aggaaaggcctttgcatttggt

SEQ ID NO: 8583039 - DNA, 22 bp, Homo sapiens
cagggctggctcatgaaaagtt

SEQ ID NO: 8583040 - DNA, 22 bp, Homo sapiens
agctttggatttcttatagccc

SEQ ID NO: 8583041 - DNA, 22 bp, Homo sapiens
agctttggcatctgactagccg

SEQ ID NO: 8583042 - DNA, 22 bp, Homo sapiens
agctttggcttctgttgaacct

SEQ ID NO: 8583043 - DNA, 22 bp, Homo sapiens
agctttggctgtgttgctctgt

SEQ ID NO: 8583044 - DNA, 22 bp, Homo sapiens
agctttgggcaaaggcttgtga

SEQ ID NO: 8583045 - DNA, 22 bp, Homo sapiens
agctttggccctggaggttact

SEQ ID NO: 8583046 - DNA, 22 bp, Homo sapiens
agctttgggattcaggcaggaa

SEQ ID NO: 8583047 - DNA, 22 bp, Homo sapiens
agctttgggcagaagaggattc

SEQ ID NO: 8583048 - DNA, 19 bp, Homo sapiens
agctttggacttgcatttc

SEQ ID NO: 8583049 - DNA, 22 bp, Homo sapiens
agctttggaaatcaatgtaaaa

SEQ ID NO: 8583050 - DNA, 22 bp, Homo sapiens
agctttggagctgggtgaaaga

SEQ ID NO: 8583051 - DNA, 22 bp, Homo sapiens
agctttggagactgactccatc

SEQ ID NO: 8583052 - DNA, 22 bp, Homo sapiens
agctttggatgatctttgatac

SEQ ID NO: 8583053 - DNA, 22 bp, Homo sapiens
cagggcagtaacgggaacatct

SEQ ID NO: 8583054 - DNA, 22 bp, Homo sapiens
cagggcagtaacgggaacatct

SEQ ID NO: 8583055 - DNA, 22 bp, Homo sapiens
cagggcagggagcttagaatga

SEQ ID NO: 8583056 - DNA, 22 bp, Homo sapiens
cagggcagggatgttgcggcag

SEQ ID NO: 8583057 - DNA, 22 bp, Homo sapiens
cagggcagggccacaccccctg

SEQ ID NO: 8583058 - DNA, 22 bp, Homo sapiens
cagggcaggatgctgtgattat

SEQ ID NO: 8583059 - DNA, 22 bp, Homo sapiens
agctggtggaagggagcccaaa

SEQ ID NO: 8583060 - DNA, 22 bp, Homo sapiens
caggcagtgtcccaggaagcca

SEQ ID NO: 8583061 - DNA, 22 bp, Homo sapiens
caggcagctcaaccttgggagc

SEQ ID NO: 8583062 - DNA, 22 bp, Homo sapiens
caggcagcctgcggtctgcaca

SEQ ID NO: 8583063 - DNA, 22 bp, Homo sapiens
caggcagccttctcgtctcaca

SEQ ID NO: 8583064 - DNA, 22 bp, Homo sapiens
caggcagcgctcgtggcctggc

SEQ ID NO: 8583065 - DNA, 22 bp, Homo sapiens
caggcccatttgtagccacttt

SEQ ID NO: 8583066 - DNA, 22 bp, Homo sapiens
agcttccattaactgctacact

SEQ ID NO: 8583067 - DNA, 18 bp, Homo sapiens
caggagcaggagttgaac

SEQ ID NO: 8583068 - DNA, 22 bp, Homo sapiens
caggagcaggcccaaggacaca

SEQ ID NO: 8583069 - DNA, 22 bp, Homo sapiens
caggagcagagggtggtcagca

SEQ ID NO: 8583070 - DNA, 22 bp, Homo sapiens
caggagcatgctgatgccagaa

SEQ ID NO: 8583071 - DNA, 22 bp, Homo sapiens
caggagcagttagaagcccact

SEQ ID NO: 8583072 - DNA, 22 bp, Homo sapiens
caggagccagaggcggatggag

SEQ ID NO: 8583073 - DNA, 22 bp, Homo sapiens
caggagccacattccaccttga

SEQ ID NO: 8583074 - DNA, 22 bp, Homo sapiens
caggagcccagagtcctcagct

SEQ ID NO: 8583075 - DNA, 22 bp, Homo sapiens
caggatgggatgtagtgggccc

SEQ ID NO: 8583076 - DNA, 22 bp, Homo sapiens
caggatgggtgtcggccagcac

SEQ ID NO: 8583077 - DNA, 22 bp, Homo sapiens
caggcacacaggctccctgggc

SEQ ID NO: 8583078 - DNA, 22 bp, Homo sapiens
caggcacacatccgtgagagat

SEQ ID NO: 8583079 - DNA, 22 bp, Homo sapiens
caggcacacatccgtgagagat

SEQ ID NO: 8583080 - DNA, 22 bp, Homo sapiens
caggacgggcaaacaggatggt

SEQ ID NO: 8583081 - DNA, 22 bp, Homo sapiens
caggactgatgttcctccagcc

SEQ ID NO: 8583082 - DNA, 22 bp, Homo sapiens
caggactgaagggcacagggaa

SEQ ID NO: 8583083 - DNA, 22 bp, Homo sapiens
caggactggctcgcagtgggtg

SEQ ID NO: 8583084 - DNA, 22 bp, Homo sapiens
caggagcaaggagcagtgggat

SEQ ID NO: 8583085 - DNA, 22 bp, Homo sapiens
cagctgtccttcctggtgggcg

SEQ ID NO: 8583086 - DNA, 22 bp, Homo sapiens
cagctgggtttagtggggtgtg

SEQ ID NO: 8583087 - DNA, 22 bp, Homo sapiens
cagctggtcaactgaatgaaca

SEQ ID NO: 8583088 - DNA, 22 bp, Homo sapiens
cagctggttggaagggagctga

SEQ ID NO: 8583089 - DNA, 22 bp, Homo sapiens
cagctggttcagtgtctggtga

SEQ ID NO: 8583090 - DNA, 22 bp, Homo sapiens
cagctggtgtccagggaagtgg

SEQ ID NO: 8583091 - DNA, 22 bp, Homo sapiens
cagctggttatcagagaggcct

SEQ ID NO: 8583092 - DNA, 22 bp, Homo sapiens
cagctggttatcagagaggcct

SEQ ID NO: 8583093 - DNA, 22 bp, Homo sapiens
aggatgtctgctgctgtgggct

SEQ ID NO: 8583094 - DNA, 22 bp, Homo sapiens
aggatgtctctggaccaggatg

SEQ ID NO: 8583095 - DNA, 22 bp, Homo sapiens
aggatgtctctccagcctggag

SEQ ID NO: 8583096 - DNA, 22 bp, Homo sapiens
aggatgtcagcattggctagag

SEQ ID NO: 8583097 - DNA, 22 bp, Homo sapiens
aggatgtcagtcagcttggatt

SEQ ID NO: 8583098 - DNA, 20 bp, Homo sapiens
aggatgtccccgagggcctg

SEQ ID NO: 8583099 - DNA, 22 bp, Homo sapiens
aggatgtccacccagaccttgc

SEQ ID NO: 8583100 - DNA, 19 bp, Homo sapiens
catgaggcagctgcacccc

SEQ ID NO: 8583101 - DNA, 22 bp, Homo sapiens
aggatggcttgcaggaggctgt

SEQ ID NO: 8583102 - DNA, 22 bp, Homo sapiens
aggatggcttgcaggaggctgt

SEQ ID NO: 8583103 - DNA, 22 bp, Homo sapiens
catctctgtgtccccagagctt

SEQ ID NO: 8583104 - DNA, 22 bp, Homo sapiens
aggaggctctcaggtcctcccc

SEQ ID NO: 8583105 - DNA, 22 bp, Homo sapiens
aggaggcctgttttctcctgga

SEQ ID NO: 8583106 - DNA, 22 bp, Homo sapiens
aggaggctgaactagggtctgg

SEQ ID NO: 8583107 - DNA, 22 bp, Homo sapiens
catacaaatgtgtccaggctct

SEQ ID NO: 8583108 - DNA, 22 bp, Homo sapiens
cagtccagagcccaccagagga

SEQ ID NO: 8583109 - DNA, 22 bp, Homo sapiens
cagtccaggcctggaggagcca

SEQ ID NO: 8583110 - DNA, 22 bp, Homo sapiens
cagtgtggctgagacagaggct

SEQ ID NO: 8583111 - DNA, 22 bp, Homo sapiens
cagtgtggagggagagagcctg

SEQ ID NO: 8583112 - DNA, 21 bp, Homo sapiens
cagtgtggtgaccagggtctc

SEQ ID NO: 8583113 - DNA, 22 bp, Homo sapiens
cagtgtgggtttgggaggagta

SEQ ID NO: 8583114 - DNA, 22 bp, Homo sapiens
cagtgtgtctcttgtcctggct

SEQ ID NO: 8583115 - DNA, 22 bp, Homo sapiens
cagtgtgtttcatgtaggtcct

SEQ ID NO: 8583116 - DNA, 22 bp, Homo sapiens
aggagccagaatccagactcgg

SEQ ID NO: 8583117 - DNA, 21 bp, Homo sapiens
aggagccagcctgtcagtcta

SEQ ID NO: 8583118 - DNA, 22 bp, Homo sapiens
aggagctgtcagagtgccagag

SEQ ID NO: 8583119 - DNA, 22 bp, Homo sapiens
aggaggcagatgcttggctgta

SEQ ID NO: 8583120 - DNA, 22 bp, Homo sapiens
cataacatgtacatataaatgc

SEQ ID NO: 8583121 - DNA, 22 bp, Homo sapiens
ccacccagcagaggaggcaaga

SEQ ID NO: 8583122 - DNA, 22 bp, Homo sapiens
ccaatgagacagaaagagcctc

SEQ ID NO: 8583123 - DNA, 22 bp, Homo sapiens
ccacagagacagggtccttgct

SEQ ID NO: 8583124 - DNA, 19 bp, Homo sapiens
ccacagagactagaagaca

SEQ ID NO: 8583125 - DNA, 22 bp, Homo sapiens
ccacagagactctgcaggactg

SEQ ID NO: 8583126 - DNA, 23 bp, Homo sapiens
ccacagagctgccaattcctgtg

SEQ ID NO: 8583127 - DNA, 22 bp, Homo sapiens
catttctcctgggtgataaatt

SEQ ID NO: 8583128 - DNA, 22 bp, Homo sapiens
catttattggttaggccagcag

SEQ ID NO: 8583129 - DNA, 22 bp, Homo sapiens
aggcaaggtgctacagacagtg

SEQ ID NO: 8583130 - DNA, 22 bp, Homo sapiens
aggcaagctgcagagagtcctt

SEQ ID NO: 8583131 - DNA, 22 bp, Homo sapiens
aggcaaggaagaattctcccct

SEQ ID NO: 8583132 - DNA, 22 bp, Homo sapiens
aggcaagcccccagtgaggctc

SEQ ID NO: 8583133 - DNA, 21 bp, Homo sapiens
agggcctgtgctctccaggtc

SEQ ID NO: 8583134 - DNA, 22 bp, Homo sapiens
ccctggcaagtgctgtgtagct

SEQ ID NO: 8583135 - DNA, 22 bp, Homo sapiens
ccctggcagaaggtgtagaagc

SEQ ID NO: 8583136 - DNA, 17 bp, Homo sapiens
ccctggcaaagaatggc

SEQ ID NO: 8583137 - DNA, 22 bp, Homo sapiens
agggcccatgtgggagcacttg

SEQ ID NO: 8583138 - DNA, 22 bp, Homo sapiens
agggctcttcctttgcctctca

SEQ ID NO: 8583139 - DNA, 22 bp, Homo sapiens
cctaccagtaggaggccagaga

SEQ ID NO: 8583140 - DNA, 22 bp, Homo sapiens
cctctgtgtctccaagaggcct

SEQ ID NO: 8583141 - DNA, 22 bp, Homo sapiens
aggggaaggccagcctgtagag

SEQ ID NO: 8583142 - DNA, 22 bp, Homo sapiens
aggggctctgagtgggccagga

SEQ ID NO: 8583143 - DNA, 22 bp, Homo sapiens
aggggctcctggcctggagagc

SEQ ID NO: 8583144 - DNA, 22 bp, Homo sapiens
aggggctctaaagatcatggaa

SEQ ID NO: 8583145 - DNA, 22 bp, Homo sapiens
aggggctcagttactttggcag

SEQ ID NO: 8583146 - DNA, 22 bp, Homo sapiens
aggggcgtgctcttccccgacg

SEQ ID NO: 8583147 - DNA, 22 bp, Homo sapiens
cctcgacctccccaggctcagg

SEQ ID NO: 8583148 - DNA, 22 bp, Homo sapiens
cccaggaactccagagctcctc

SEQ ID NO: 8583149 - DNA, 19 bp, Homo sapiens
cccaggaagcggaggttgc

SEQ ID NO: 8583150 - DNA, 22 bp, Homo sapiens
cccaggaagggatgccaaggaa

SEQ ID NO: 8583151 - DNA, 22 bp, Homo sapiens
aggcttggctggcagccctggg

SEQ ID NO: 8583152 - DNA, 22 bp, Homo sapiens
aggctttgaacatctacctgag

SEQ ID NO: 8583153 - DNA, 21 bp, Homo sapiens
aggctttgaatcatccttcga

SEQ ID NO: 8583154 - DNA, 22 bp, Homo sapiens
aggctttggaatcagagttctg

SEQ ID NO: 8583155 - DNA, 22 bp, Homo sapiens
aggctttgttttatctcattta

SEQ ID NO: 8583156 - DNA, 22 bp, Homo sapiens
agggactccctgggccgacacg

SEQ ID NO: 8583157 - DNA, 22 bp, Homo sapiens
agggactccgtgcacagtggtt

SEQ ID NO: 8583158 - DNA, 22 bp, Homo sapiens
agggacagttacatcatcagac

SEQ ID NO: 8583159 - DNA, 22 bp, Homo sapiens
cccaggaatgagcaggcagggg

SEQ ID NO: 8583160 - DNA, 22 bp, Homo sapiens
cccaggaatgagcaggcagggg

SEQ ID NO: 8583161 - DNA, 22 bp, Homo sapiens
agggagctgagctgtgagcagc

SEQ ID NO: 8583162 - DNA, 22 bp, Homo sapiens
agggagctgtggtcagctcagt

SEQ ID NO: 8583163 - DNA, 22 bp, Homo sapiens
agggagcttccgaactacagct

SEQ ID NO: 8583164 - DNA, 22 bp, Homo sapiens
agggagcttctggcctcagcct

SEQ ID NO: 8583165 - DNA, 22 bp, Homo sapiens
agggccaccagagcagggcagt

SEQ ID NO: 8583166 - DNA, 22 bp, Homo sapiens
ccctgaggatagggcaggaccc

SEQ ID NO: 8583167 - DNA, 22 bp, Homo sapiens
ccctgaggatagggcaggaccc

SEQ ID NO: 8583168 - DNA, 22 bp, Homo sapiens
ccctgaggctgaggataggtgg

SEQ ID NO: 8583169 - DNA, 22 bp, Homo sapiens
ccctgaggcagtaggagctttt

SEQ ID NO: 8583170 - DNA, 23 bp, Homo sapiens
agggcccaagcctggacagcagg

SEQ ID NO: 8583171 - DNA, 22 bp, Homo sapiens
agggagctttaccccagatcac

SEQ ID NO: 8583172 - DNA, 22 bp, Homo sapiens
agggcagaaatattgatactgt

SEQ ID NO: 8583173 - DNA, 22 bp, Homo sapiens
agggcagactaggatggaagtg

SEQ ID NO: 8583174 - DNA, 22 bp, Homo sapiens
ccagtgggagggagctaggcca

SEQ ID NO: 8583175 - DNA, 22 bp, Homo sapiens
ccagtgggtgctgggctctgcc

SEQ ID NO: 8583176 - DNA, 22 bp, Homo sapiens
ccagtgggtaggccatggtgag

SEQ ID NO: 8583177 - DNA, 22 bp, Homo sapiens
aggctgccctgccgccagtggg

SEQ ID NO: 8583178 - DNA, 22 bp, Homo sapiens
aggctgccagaagccttcagga

SEQ ID NO: 8583179 - DNA, 19 bp, Homo sapiens
aggctgcccagtctctgcc

SEQ ID NO: 8583180 - DNA, 22 bp, Homo sapiens
aggctgccaaagcttctgtctc

SEQ ID NO: 8583181 - DNA, 22 bp, Homo sapiens
aggctgcagtgcaggtaggatt

SEQ ID NO: 8583182 - DNA, 22 bp, Homo sapiens
aggctgcagtgcaggtaggatt

SEQ ID NO: 8583183 - DNA, 22 bp, Homo sapiens
ccagtgtgcaatctctggctta

SEQ ID NO: 8583184 - DNA, 22 bp, Homo sapiens
ccagtgtgaaaggtcatttatc

SEQ ID NO: 8583185 - DNA, 22 bp, Homo sapiens
cccagaggtgcttcagaggtgc

SEQ ID NO: 8583186 - DNA, 22 bp, Homo sapiens
aggctgtggccctggtctagca

SEQ ID NO: 8583187 - DNA, 22 bp, Homo sapiens
aggctgtgcgaggtctcagagt

SEQ ID NO: 8583188 - DNA, 22 bp, Homo sapiens
aggctgtgggagttgagagtct

SEQ ID NO: 8583189 - DNA, 22 bp, Homo sapiens
aggctgtgcacagggcacctgc

SEQ ID NO: 8583190 - DNA, 22 bp, Homo sapiens
aggctgtgactacgcagggaag

SEQ ID NO: 8583191 - DNA, 22 bp, Homo sapiens
ccaggtggtgaaagtgggccct

SEQ ID NO: 8583192 - DNA, 16 bp, Homo sapiens
ccaggtggggctgtga

SEQ ID NO: 8583193 - DNA, 22 bp, Homo sapiens
ccagggcagccaacccagatgc

SEQ ID NO: 8583194 - DNA, 22 bp, Homo sapiens
ccagggcagcgcccctccacgc

SEQ ID NO: 8583195 - DNA, 22 bp, Homo sapiens
ccagggcagcgcccctccacgc

SEQ ID NO: 8583196 - DNA, 22 bp, Homo sapiens
ccagggcagaaaaagagggaat

SEQ ID NO: 8583197 - DNA, 22 bp, Homo sapiens
ccagggcagcagaattggggca

SEQ ID NO: 8583198 - DNA, 22 bp, Homo sapiens
ccagggcacttaggcccagccc

SEQ ID NO: 8583199 - DNA, 22 bp, Homo sapiens
aggctctgtcaggcggagcagc

SEQ ID NO: 8583200 - DNA, 22 bp, Homo sapiens
ccaggtggtgcctctgttcgca

SEQ ID NO: 8583201 - DNA, 20 bp, Homo sapiens
ccaggtggtgcctggagagg

SEQ ID NO: 8583202 - DNA, 20 bp, Homo sapiens
ccaggtggtgcctggagagg

SEQ ID NO: 8583203 - DNA, 18 bp, Homo sapiens
ccaggtggtgacagagat

SEQ ID NO: 8583204 - DNA, 22 bp, Homo sapiens
ccaggtggtgaaagtgggccct

SEQ ID NO: 8583205 - DNA, 20 bp, Homo sapiens
ccaggtggtgcctggagagg

SEQ ID NO: 8583206 - DNA, 22 bp, Homo sapiens
ccaggtggttcaggtcaccata

SEQ ID NO: 8583207 - DNA, 22 bp, Homo sapiens
ccaggtgtgtctggccccgaag

SEQ ID NO: 8583208 - DNA, 22 bp, Homo sapiens
ccaggtgtttggcctgcatgat

SEQ ID NO: 8583209 - DNA, 22 bp, Homo sapiens
ccaggtgttctttgtccctgtt

SEQ ID NO: 8583210 - DNA, 22 bp, Homo sapiens
ccaggtgttacacgagtgttaa

SEQ ID NO: 8583211 - DNA, 17 bp, Homo sapiens
ccagtcacaccaccctt

SEQ ID NO: 8583212 - DNA, 22 bp, Homo sapiens
ccagtcacaggtgtgtttatat

SEQ ID NO: 8583213 - DNA, 20 bp, Homo sapiens
ccaggcctgggcctgctcta

SEQ ID NO: 8583214 - DNA, 22 bp, Homo sapiens
ccaggcctttcttcttggtctg

SEQ ID NO: 8583215 - DNA, 22 bp, Homo sapiens
aggctctggttcatcatgatgg

SEQ ID NO: 8583216 - DNA, 22 bp, Homo sapiens
aggctctggttggcaagtaaag

SEQ ID NO: 8583217 - DNA, 22 bp, Homo sapiens
aggctctgggaacagacgggtg

SEQ ID NO: 8583218 - DNA, 22 bp, Homo sapiens
aggctcagcccctgggaggaga

SEQ ID NO: 8583219 - DNA, 22 bp, Homo sapiens
aggctcagcccaaggtggagag

SEQ ID NO: 8583220 - DNA, 20 bp, Homo sapiens
ccagaggctgacagactttg

SEQ ID NO: 8583221 - DNA, 22 bp, Homo sapiens
ccagaggcggaggtttgcagtg

SEQ ID NO: 8583222 - DNA, 21 bp, Homo sapiens
ccagaggcctctcttggccac

SEQ ID NO: 8583223 - DNA, 22 bp, Homo sapiens
ccagaggtgggagtgatctggt

SEQ ID NO: 8583224 - DNA, 22 bp, Homo sapiens
ccagaggtggtggtgtctagaa

SEQ ID NO: 8583225 - DNA, 21 bp, Homo sapiens
ccagaggttctgggcctccct

SEQ ID NO: 8583226 - DNA, 22 bp, Homo sapiens
ccagaggcagacttacactcca

SEQ ID NO: 8583227 - DNA, 19 bp, Homo sapiens
aggcaggtgcagaggtccc

SEQ ID NO: 8583228 - DNA, 22 bp, Homo sapiens
aggcaggtagaaggatctttat

SEQ ID NO: 8583229 - DNA, 22 bp, Homo sapiens
aggcaggtcacatgcttggcga

SEQ ID NO: 8583230 - DNA, 22 bp, Homo sapiens
aggcaggtcacatgcttggcga

SEQ ID NO: 8583231 - DNA, 22 bp, Homo sapiens
aggcaggtgagtcaaaacagac

SEQ ID NO: 8583232 - DNA, 22 bp, Homo sapiens
aggcaggtctgtatctagtctc

SEQ ID NO: 8583233 - DNA, 22 bp, Homo sapiens
aggcaggtcccctggaaggcac

SEQ ID NO: 8583234 - DNA, 22 bp, Homo sapiens
aggcaggtcccctggaaggcac

SEQ ID NO: 8583235 - DNA, 22 bp, Homo sapiens
ccagagtcattttgagtcataa

SEQ ID NO: 8583236 - DNA, 22 bp, Homo sapiens
ccagagtctgtgtgtgtcatcc

SEQ ID NO: 8583237 - DNA, 22 bp, Homo sapiens
aggctagaggcttctggcttca

SEQ ID NO: 8583238 - DNA, 22 bp, Homo sapiens
aggcctgggcaagaaggggcgt

SEQ ID NO: 8583239 - DNA, 20 bp, Homo sapiens
aggctcagagcagtagtaca

SEQ ID NO: 8583240 - DNA, 22 bp, Homo sapiens
ccaggaggggtctctgtctccc

SEQ ID NO: 8583241 - DNA, 22 bp, Homo sapiens
ccaggagggtggttactcaatc

SEQ ID NO: 8583242 - DNA, 22 bp, Homo sapiens
ccaggaggtgaaacttcaccag

SEQ ID NO: 8583243 - DNA, 22 bp, Homo sapiens
ccaggaggtctgagtgtggaca

SEQ ID NO: 8583244 - DNA, 22 bp, Homo sapiens
ccaggagggaggagttcctgag

SEQ ID NO: 8583245 - DNA, 22 bp, Homo sapiens
ccaggaggatcatcctgttttc

SEQ ID NO: 8583246 - DNA, 22 bp, Homo sapiens
ccaggaggatgaggggcataga

SEQ ID NO: 8583247 - DNA, 22 bp, Homo sapiens
ccaggaggtggaggttgcggtg

SEQ ID NO: 8583248 - DNA, 22 bp, Homo sapiens
ccaggaggtggcaggacttgcc

SEQ ID NO: 8583249 - DNA, 22 bp, Homo sapiens
ccaggaggtggagattgcagtg

SEQ ID NO: 8583250 - DNA, 22 bp, Homo sapiens
ccaggaggtgctggaagaaagc

SEQ ID NO: 8583251 - DNA, 22 bp, Homo sapiens
acagcatggataacaaggcact

SEQ ID NO: 8583252 - DNA, 22 bp, Homo sapiens
acagccagaggagccaggctgg

SEQ ID NO: 8583253 - DNA, 22 bp, Homo sapiens
acaggaagaaagtgcagtagat

SEQ ID NO: 8583254 - DNA, 22 bp, Homo sapiens
acaggaagaaagtgcagtagat

SEQ ID NO: 8583255 - DNA, 22 bp, Homo sapiens
acaggaagtgggaagaaacagg

SEQ ID NO: 8583256 - DNA, 22 bp, Homo sapiens
acaggaagtgctggcacttaca

SEQ ID NO: 8583257 - DNA, 22 bp, Homo sapiens
acaggaagctggagacccttga

SEQ ID NO: 8583258 - DNA, 22 bp, Homo sapiens
acaggacaaggggaagaagata

SEQ ID NO: 8583259 - DNA, 22 bp, Homo sapiens
acaggaagtttggaaagcctca

SEQ ID NO: 8583260 - DNA, 22 bp, Homo sapiens
acaggacatgtaccaggtggtc

SEQ ID NO: 8583261 - DNA, 22 bp, Homo sapiens
acaggacatgtaccaggtggtc

SEQ ID NO: 8583262 - DNA, 22 bp, Homo sapiens
agcttccatactaagacaaaag

SEQ ID NO: 8583263 - DNA, 22 bp, Homo sapiens
acaggcaaggccagtgagaaat

SEQ ID NO: 8583264 - DNA, 22 bp, Homo sapiens
aggaaaggggtaggtgtggacg

SEQ ID NO: 8583265 - DNA, 21 bp, Homo sapiens
acaggcaatttcatatggttc

SEQ ID NO: 8583266 - DNA, 22 bp, Homo sapiens
aggaaaggtagcgtgccagcag

SEQ ID NO: 8583267 - DNA, 22 bp, Homo sapiens
acaggccttggtcctgacctaa

SEQ ID NO: 8583268 - DNA, 22 bp, Homo sapiens
acagggcatttcctctatgtgt

SEQ ID NO: 8583269 - DNA, 23 bp, Homo sapiens
acagggcattgctggcctcgagg

SEQ ID NO: 8583270 - DNA, 21 bp, Homo sapiens
acagggcatgcagctggctgt

SEQ ID NO: 8583271 - DNA, 22 bp, Homo sapiens
acagggcatgtgcaagagacat

SEQ ID NO: 8583272 - DNA, 21 bp, Homo sapiens
acagggcatgcagctggctgt

SEQ ID NO: 8583273 - DNA, 22 bp, Homo sapiens
acagggcaggtggctactggtc

SEQ ID NO: 8583274 - DNA, 22 bp, Homo sapiens
acagggcagtgtcttgaaaaat

SEQ ID NO: 8583275 - DNA, 17 bp, Homo sapiens
acagggcagaaacagct

SEQ ID NO: 8583276 - DNA, 22 bp, Homo sapiens
aggactggccctgaggggaggc

SEQ ID NO: 8583277 - DNA, 22 bp, Homo sapiens
aggacatgtaaatggagaggga

SEQ ID NO: 8583278 - DNA, 22 bp, Homo sapiens
aggactgggtgcagagggcatc

SEQ ID NO: 8583279 - DNA, 22 bp, Homo sapiens
aggacatgaagaaagggcaagg

SEQ ID NO: 8583280 - DNA, 22 bp, Homo sapiens
acagggctatattcctcagagc

SEQ ID NO: 8583281 - DNA, 22 bp, Homo sapiens
acagggccctgtgggccccact

SEQ ID NO: 8583282 - DNA, 22 bp, Homo sapiens
aggaggcaggaagtctatggga

SEQ ID NO: 8583283 - DNA, 22 bp, Homo sapiens
acagtgacactcaggtgggatg

SEQ ID NO: 8583284 - DNA, 23 bp, Homo sapiens
acagtgaaacacgcagtaagagt

SEQ ID NO: 8583285 - DNA, 22 bp, Homo sapiens
aggaggccgatttcagaggtcg

SEQ ID NO: 8583286 - DNA, 19 bp, Homo sapiens
aggaggccatgccactaga

SEQ ID NO: 8583287 - DNA, 21 bp, Homo sapiens
aggaggccagtactgctgaac

SEQ ID NO: 8583288 - DNA, 20 bp, Homo sapiens
aggaggcatgaggggattta

SEQ ID NO: 8583289 - DNA, 20 bp, Homo sapiens
aggaggcatagtctggaaag

SEQ ID NO: 8583290 - DNA, 19 bp, Homo sapiens
aggcaccttgatggcttcc

SEQ ID NO: 8583291 - DNA, 22 bp, Homo sapiens
aggcaccttgcggtccagtgaa

SEQ ID NO: 8583292 - DNA, 22 bp, Homo sapiens
aggcacctcatagccagccccc

SEQ ID NO: 8583293 - DNA, 20 bp, Homo sapiens
aggcacctgtcacaggtgag

SEQ ID NO: 8583294 - DNA, 20 bp, Homo sapiens
aggcacctgtcacaggtgag

SEQ ID NO: 8583295 - DNA, 22 bp, Homo sapiens
aggcacctgaggtggccagcct

SEQ ID NO: 8583296 - DNA, 22 bp, Homo sapiens
aggcagaaaatagtcatccaaa

SEQ ID NO: 8583297 - DNA, 22 bp, Homo sapiens
acagtgttcctttgttgtgact

SEQ ID NO: 8583298 - DNA, 22 bp, Homo sapiens
aggcacagcacacctggccccc

SEQ ID NO: 8583299 - DNA, 22 bp, Homo sapiens
aggcaccaggttgtggtttgtc

SEQ ID NO: 8583300 - DNA, 22 bp, Homo sapiens
aggcacctcagctgagcctggg

SEQ ID NO: 8583301 - DNA, 20 bp, Homo sapiens
acagtggaaattgatgtctg

SEQ ID NO: 8583302 - DNA, 22 bp, Homo sapiens
aggcaggtgttacctctggttt

SEQ ID NO: 8583303 - DNA, 22 bp, Homo sapiens
aggcaggtgttgggagacacca

SEQ ID NO: 8583304 - DNA, 22 bp, Homo sapiens
aggcaggttggggaaaagcact

SEQ ID NO: 8583305 - DNA, 22 bp, Homo sapiens
aggcaggttacaaaaactttat

SEQ ID NO: 8583306 - DNA, 22 bp, Homo sapiens
aggcaggtgttaaccctctgag

SEQ ID NO: 8583307 - DNA, 22 bp, Homo sapiens
aggcaggtgcttatgacttgct

SEQ ID NO: 8583308 - DNA, 22 bp, Homo sapiens
aggcaggtgggtcacttgagtc

SEQ ID NO: 8583309 - DNA, 22 bp, Homo sapiens
aggcaggtgggagtgattcctt

SEQ ID NO: 8583310 - DNA, 22 bp, Homo sapiens
aggcaggggagctggaagggta

SEQ ID NO: 8583311 - DNA, 18 bp, Homo sapiens
aggcaggtgctggaagtc

SEQ ID NO: 8583312 - DNA, 22 bp, Homo sapiens
aggcagcaaagaaatgatgctg

SEQ ID NO: 8583313 - DNA, 22 bp, Homo sapiens
aggcagagaaaaaccagatatg

SEQ ID NO: 8583314 - DNA, 22 bp, Homo sapiens
aggctgctggcaggcgtggacg

SEQ ID NO: 8583315 - DNA, 17 bp, Homo sapiens
aggctgctgggccaggg

SEQ ID NO: 8583316 - DNA, 23 bp, Homo sapiens
aggctgcagaagaatagggtcat

SEQ ID NO: 8583317 - DNA, 22 bp, Homo sapiens
aggctgtgattccaccactctc

SEQ ID NO: 8583318 - DNA, 22 bp, Homo sapiens
accactggttttgcagaggcgc

SEQ ID NO: 8583319 - DNA, 19 bp, Homo sapiens
aggctgtgagggaggactc

SEQ ID NO: 8583320 - DNA, 22 bp, Homo sapiens
aggctccagtctcctctggcag

SEQ ID NO: 8583321 - DNA, 22 bp, Homo sapiens
aggctctagatcaaggtgggag

SEQ ID NO: 8583322 - DNA, 22 bp, Homo sapiens
aggctctaaggagggctgtcta

SEQ ID NO: 8583323 - DNA, 22 bp, Homo sapiens
aggctctggagttagccaggca

SEQ ID NO: 8583324 - DNA, 22 bp, Homo sapiens
aggctctataccgctgggagtt

SEQ ID NO: 8583325 - DNA, 22 bp, Homo sapiens
acatgtgtaaaagtggataaaa

SEQ ID NO: 8583326 - DNA, 22 bp, Homo sapiens
acatgtggaggaggcgagggta

SEQ ID NO: 8583327 - DNA, 20 bp, Homo sapiens
aggctcagctgagctcttgg

SEQ ID NO: 8583328 - DNA, 22 bp, Homo sapiens
agggctcagggcacgtcatcca

SEQ ID NO: 8583329 - DNA, 22 bp, Homo sapiens
agggctcagcatctcattctgt

SEQ ID NO: 8583330 - DNA, 22 bp, Homo sapiens
aggggagccagggctgcgagtt

SEQ ID NO: 8583331 - DNA, 22 bp, Homo sapiens
aggggaggagcttttcttgcct

SEQ ID NO: 8583332 - DNA, 22 bp, Homo sapiens
aggggcaggtgctgcacttaga

SEQ ID NO: 8583333 - DNA, 22 bp, Homo sapiens
aggggagcttgaggcatggcct

SEQ ID NO: 8583334 - DNA, 22 bp, Homo sapiens
agggtcagtgatgagggagccc

SEQ ID NO: 8583335 - DNA, 22 bp, Homo sapiens
acctcaagtgatccactcacct

SEQ ID NO: 8583336 - DNA, 22 bp, Homo sapiens
acctcaaggaaaatctagacag

SEQ ID NO: 8583337 - DNA, 21 bp, Homo sapiens
acctcaagcaacaaccaaggt

SEQ ID NO: 8583338 - DNA, 22 bp, Homo sapiens
agggccagcactcctggcagga

SEQ ID NO: 8583339 - DNA, 22 bp, Homo sapiens
agggccagcactcctggcagga

SEQ ID NO: 8583340 - DNA, 22 bp, Homo sapiens
agggccagccaggccctacaaa

SEQ ID NO: 8583341 - DNA, 22 bp, Homo sapiens
agggccagcactcctggcagga

SEQ ID NO: 8583342 - DNA, 22 bp, Homo sapiens
agggccagtaccaggtgggtgg

SEQ ID NO: 8583343 - DNA, 22 bp, Homo sapiens
agggccagttcagaggacatgg

SEQ ID NO: 8583344 - DNA, 22 bp, Homo sapiens
agggccagttctacctctgaat

SEQ ID NO: 8583345 - DNA, 22 bp, Homo sapiens
accagagaaaacacagcaggct

SEQ ID NO: 8583346 - DNA, 22 bp, Homo sapiens
accagagcagactactggaggt

SEQ ID NO: 8583347 - DNA, 22 bp, Homo sapiens
agggaggcaggaaagttgtctg

SEQ ID NO: 8583348 - DNA, 22 bp, Homo sapiens
accagagcccatctgctcctag

SEQ ID NO: 8583349 - DNA, 22 bp, Homo sapiens
agggagctgactggctgccatt

SEQ ID NO: 8583350 - DNA, 22 bp, Homo sapiens
agggaggcattagctactgcga

SEQ ID NO: 8583351 - DNA, 22 bp, Homo sapiens
actcagaggcagctgctcaccc

SEQ ID NO: 8583352 - DNA, 22 bp, Homo sapiens
agtcaggtactccgagggcatg

SEQ ID NO: 8583353 - DNA, 22 bp, Homo sapiens
agtcaggggatctagacttgaa

SEQ ID NO: 8583354 - DNA, 22 bp, Homo sapiens
agtcagtgtagaaagcccaggc

SEQ ID NO: 8583355 - DNA, 22 bp, Homo sapiens
agtcagtgggcttggcacagaa

SEQ ID NO: 8583356 - DNA, 22 bp, Homo sapiens
agtcagtgaaggcattgctcaa

SEQ ID NO: 8583357 - DNA, 22 bp, Homo sapiens
actctgctcaaagtcctgaggc

SEQ ID NO: 8583358 - DNA, 18 bp, Homo sapiens
agggtcagtgtcactggc

SEQ ID NO: 8583359 - DNA, 19 bp, Homo sapiens
agggtccaggccctgtgga

SEQ ID NO: 8583360 - DNA, 22 bp, Homo sapiens
agggtgcagaaggagcctagga

SEQ ID NO: 8583361 - DNA, 22 bp, Homo sapiens
agggtgcaggtgtggagtctag

SEQ ID NO: 8583362 - DNA, 22 bp, Homo sapiens
aggtggagaagagatgggcagt

SEQ ID NO: 8583363 - DNA, 22 bp, Homo sapiens
aggtggagacccagagaaggcg

SEQ ID NO: 8583364 - DNA, 22 bp, Homo sapiens
aggtggagacccagagaaggcg

SEQ ID NO: 8583365 - DNA, 22 bp, Homo sapiens
aggtggggaggagtgtctcttt

SEQ ID NO: 8583366 - DNA, 22 bp, Homo sapiens
aggtggtcttaaactgctctgg

SEQ ID NO: 8583367 - DNA, 23 bp, Homo sapiens
aggtggtcttgtggatgctgcaa

SEQ ID NO: 8583368 - DNA, 21 bp, Homo sapiens
aggtggtctgcagcagctgaa

SEQ ID NO: 8583369 - DNA, 19 bp, Homo sapiens
aggtggtctaggctggaga

SEQ ID NO: 8583370 - DNA, 22 bp, Homo sapiens
aggtgtctggacttgtgaagca

SEQ ID NO: 8583371 - DNA, 20 bp, Homo sapiens
aggtgtcctgtagcttgagt

SEQ ID NO: 8583372 - DNA, 22 bp, Homo sapiens
aggtgtccaggaagatgctggc

SEQ ID NO: 8583373 - DNA, 22 bp, Homo sapiens
aggtgtccaatcctggttggat

SEQ ID NO: 8583374 - DNA, 22 bp, Homo sapiens
agtgcaaagggatcagattggg

SEQ ID NO: 8583375 - DNA, 22 bp, Homo sapiens
agtggcagagcaggtgctggaa

SEQ ID NO: 8583376 - DNA, 22 bp, Homo sapiens
agtgggagccagcagcttgggg

SEQ ID NO: 8583377 - DNA, 22 bp, Homo sapiens
agtgggaggcggctgacgggcg

SEQ ID NO: 8583378 - DNA, 20 bp, Homo sapiens
agtgggagagggcagactgc

SEQ ID NO: 8583379 - DNA, 22 bp, Homo sapiens
agtgtgggtgagggaggccctc

SEQ ID NO: 8583380 - DNA, 22 bp, Homo sapiens
agtgtgggttttatggagccct

SEQ ID NO: 8583381 - DNA, 20 bp, Homo sapiens
agtgtggttttcaggaatat

SEQ ID NO: 8583382 - DNA, 22 bp, Homo sapiens
agtggggccggtgaggccgagg

SEQ ID NO: 8583383 - DNA, 22 bp, Homo sapiens
agtggggcggacaggaccagga

SEQ ID NO: 8583384 - DNA, 22 bp, Homo sapiens
agtggggtcctcagtatggttc

SEQ ID NO: 8583385 - DNA, 22 bp, Homo sapiens
agtggggtctcctccagccccc

SEQ ID NO: 8583386 - DNA, 22 bp, Homo sapiens
agttacaaccatgacacaagca

SEQ ID NO: 8583387 - DNA, 22 bp, Homo sapiens
actggggtttaggcctgggcaa

SEQ ID NO: 8583388 - DNA, 22 bp, Homo sapiens
actggggtgaaattggagtgtc

SEQ ID NO: 8583389 - DNA, 18 bp, Homo sapiens
agaagcaggttctcccag

SEQ ID NO: 8583390 - DNA, 18 bp, Homo sapiens
agaagcaggtaaaattct

SEQ ID NO: 8583391 - DNA, 22 bp, Homo sapiens
agaagcagttattttttgcaca

SEQ ID NO: 8583392 - DNA, 22 bp, Homo sapiens
agaagcagggcagggaaaagca

SEQ ID NO: 8583393 - DNA, 22 bp, Homo sapiens
agaagcaggcagatttcagctc

SEQ ID NO: 8583394 - DNA, 22 bp, Homo sapiens
agaagcaggcctcacagatctg

SEQ ID NO: 8583395 - DNA, 22 bp, Homo sapiens
atcctgaggaaggtgcagagat

SEQ ID NO: 8583396 - DNA, 22 bp, Homo sapiens
agaaagaggatgcagatctcat

SEQ ID NO: 8583397 - DNA, 22 bp, Homo sapiens
agaaagagctcgggattaacag

SEQ ID NO: 8583398 - DNA, 22 bp, Homo sapiens
agaaagagatgaatgctttaag

SEQ ID NO: 8583399 - DNA, 22 bp, Homo sapiens
atatagaaggtgctatttacat

SEQ ID NO: 8583400 - DNA, 22 bp, Homo sapiens
atatagatcaaatgatgctaat

SEQ ID NO: 8583401 - DNA, 19 bp, Homo sapiens
atatagcattattcaattt

SEQ ID NO: 8583402 - DNA, 22 bp, Homo sapiens
atatagattccatggttccttt

SEQ ID NO: 8583403 - DNA, 22 bp, Homo sapiens
agaaatgctcaggtcaacttaa

SEQ ID NO: 8583404 - DNA, 22 bp, Homo sapiens
atcaatatcagatcagacagga

SEQ ID NO: 8583405 - DNA, 21 bp, Homo sapiens
agttcacaggaacaagcaggg

SEQ ID NO: 8583406 - DNA, 22 bp, Homo sapiens
agttctttgtgagtaatacaga

SEQ ID NO: 8583407 - DNA, 22 bp, Homo sapiens
atagaataaggcacagattctt

SEQ ID NO: 8583408 - DNA, 22 bp, Homo sapiens
actttactcaacaaatatttat

SEQ ID NO: 8583409 - DNA, 22 bp, Homo sapiens
atagatgtacgtatgtaaatca

SEQ ID NO: 8583410 - DNA, 22 bp, Homo sapiens
atacacttccaaatattgatta

SEQ ID NO: 8583411 - DNA, 22 bp, Homo sapiens
atagctttcttaaatatataaa

SEQ ID NO: 8583412 - DNA, 22 bp, Homo sapiens
atagctttacagaagagtttag

SEQ ID NO: 8583413 - DNA, 17 bp, Homo sapiens
agaaaagagaccagcag

SEQ ID NO: 8583414 - DNA, 17 bp, Homo sapiens
agaaaagagaccagcag

SEQ ID NO: 8583415 - DNA, 23 bp, Homo sapiens
agaaaagcttggacacatggcct

SEQ ID NO: 8583416 - DNA, 22 bp, Homo sapiens
agaaaaggattgatggatcaga

SEQ ID NO: 8583417 - DNA, 22 bp, Homo sapiens
atgcttaatgagggtatatatg

SEQ ID NO: 8583418 - DNA, 22 bp, Homo sapiens
atgagaaaattcattccatcca

SEQ ID NO: 8583419 - DNA, 22 bp, Homo sapiens
atcttagacccttggtagaaaa

SEQ ID NO: 8583420 - DNA, 22 bp, Homo sapiens
atctgggtttaaatctcagctt

SEQ ID NO: 8583421 - DNA, 22 bp, Homo sapiens
atctggggccccggaagttcct

SEQ ID NO: 8583422 - DNA, 22 bp, Homo sapiens
atggacaatgtgaaactacaag

SEQ ID NO: 8583423 - DNA, 22 bp, Homo sapiens
atggacagcaactggaagcttc

SEQ ID NO: 8583424 - DNA, 18 bp, Homo sapiens
atgggaggggccaagaga

SEQ ID NO: 8583425 - DNA, 22 bp, Homo sapiens
atgggcagttaggaggccagga

SEQ ID NO: 8583426 - DNA, 22 bp, Homo sapiens
atgggcagttaggaggccagga

SEQ ID NO: 8583427 - DNA, 22 bp, Homo sapiens
atggacaggtggataggtggat

SEQ ID NO: 8583428 - DNA, 22 bp, Homo sapiens
atggacaggtactgcagtgggt

SEQ ID NO: 8583429 - DNA, 22 bp, Homo sapiens
agagatggcgtctcagagcctg

SEQ ID NO: 8583430 - DNA, 20 bp, Homo sapiens
agagatggggtatcaccgta

SEQ ID NO: 8583431 - DNA, 22 bp, Homo sapiens
agagatgggcgggggcttctgc

SEQ ID NO: 8583432 - DNA, 18 bp, Homo sapiens
agagatgggagttggaaa

SEQ ID NO: 8583433 - DNA, 18 bp, Homo sapiens
agagatgggagttggaaa

SEQ ID NO: 8583434 - DNA, 22 bp, Homo sapiens
agagatgggaaggcagacttca

SEQ ID NO: 8583435 - DNA, 22 bp, Homo sapiens
agagagaagcaatcagtggcca

SEQ ID NO: 8583436 - DNA, 22 bp, Homo sapiens
agagactgtacgtggcaagtat

SEQ ID NO: 8583437 - DNA, 22 bp, Homo sapiens
agagactggagatgggcagtgt

SEQ ID NO: 8583438 - DNA, 22 bp, Homo sapiens
atgggctctatgtctaggagat

SEQ ID NO: 8583439 - DNA, 22 bp, Homo sapiens
agagccaggactgtgtctcact

SEQ ID NO: 8583440 - DNA, 22 bp, Homo sapiens
agagccagcaagtgaatagtga

SEQ ID NO: 8583441 - DNA, 18 bp, Homo sapiens
agagatggtgtagagttt

SEQ ID NO: 8583442 - DNA, 18 bp, Homo sapiens
agagatggtgtagagttt

SEQ ID NO: 8583443 - DNA, 22 bp, Homo sapiens
agagatggtagaacagtcataa

SEQ ID NO: 8583444 - DNA, 22 bp, Homo sapiens
atgttctacagatggaaagggg

SEQ ID NO: 8583445 - DNA, 22 bp, Homo sapiens
agagcctgttttgtgggagatg

SEQ ID NO: 8583446 - DNA, 22 bp, Homo sapiens
attaaggaagcctattctctcc

SEQ ID NO: 8583447 - DNA, 22 bp, Homo sapiens
attaagctggtccagacaagtt

SEQ ID NO: 8583448 - DNA, 22 bp, Homo sapiens
agagctctgtgtctctttgggt

SEQ ID NO: 8583449 - DNA, 22 bp, Homo sapiens
agagctctcaatggtcaatgct

SEQ ID NO: 8583450 - DNA, 22 bp, Homo sapiens
attttttagccaagactctgca

SEQ ID NO: 8583451 - DNA, 22 bp, Homo sapiens
attttggtggtatattaggatt

SEQ ID NO: 8583452 - DNA, 22 bp, Homo sapiens
attttggtagtgggaggttgag

SEQ ID NO: 8583453 - DNA, 20 bp, Homo sapiens
attttggtgaacacagcttc

SEQ ID NO: 8583454 - DNA, 22 bp, Homo sapiens
agatttaaatttgctacaattc

SEQ ID NO: 8583455 - DNA, 22 bp, Homo sapiens
agatttaaatttgctacaattc

SEQ ID NO: 8583456 - DNA, 22 bp, Homo sapiens
agattcaggactggccacagcc

SEQ ID NO: 8583457 - DNA, 22 bp, Homo sapiens
atttcttgtgggaaatgcagca

SEQ ID NO: 8583458 - DNA, 22 bp, Homo sapiens
agatacaactcagaagtgtggt

SEQ ID NO: 8583459 - DNA, 22 bp, Homo sapiens
attgtattataattaggccaaa

SEQ ID NO: 8583460 - DNA, 22 bp, Homo sapiens
attgtatttaggagaaaagggt

SEQ ID NO: 8583461 - DNA, 22 bp, Homo sapiens
attgtgtcctcattgaccttca

SEQ ID NO: 8583462 - DNA, 22 bp, Homo sapiens
attggtggtgaggacatgccag

SEQ ID NO: 8583463 - DNA, 22 bp, Homo sapiens
attggtgcaattatgagggtgt

SEQ ID NO: 8583464 - DNA, 19 bp, Homo sapiens
agaggcctcagcagctggc

SEQ ID NO: 8583465 - DNA, 22 bp, Homo sapiens
attatttctcactcacataata

SEQ ID NO: 8583466 - DNA, 22 bp, Homo sapiens
agaggcctctagggcccctcag

SEQ ID NO: 8583467 - DNA, 22 bp, Homo sapiens
attctacaatcatgtagatcct

SEQ ID NO: 8583468 - DNA, 20 bp, Homo sapiens
attctacaagaataagcatg

SEQ ID NO: 8583469 - DNA, 22 bp, Homo sapiens
attctctgggttccagtaaatg

SEQ ID NO: 8583470 - DNA, 22 bp, Homo sapiens
attcaaagagctgccagaactg

SEQ ID NO: 8583471 - DNA, 22 bp, Homo sapiens
attctacaaaagaactggatct

SEQ ID NO: 8583472 - DNA, 22 bp, Homo sapiens
attctacaacccaataataatt

SEQ ID NO: 8583473 - DNA, 22 bp, Homo sapiens
cagatctgtttgccagatcagc

SEQ ID NO: 8583474 - DNA, 22 bp, Homo sapiens
cagatctgctcctctgtccatg

SEQ ID NO: 8583475 - DNA, 22 bp, Homo sapiens
agcctaggtctgggtctagcag

SEQ ID NO: 8583476 - DNA, 22 bp, Homo sapiens
agcctagggttctgatgtcact

SEQ ID NO: 8583477 - DNA, 22 bp, Homo sapiens
agcctaggaggttggggctgca

SEQ ID NO: 8583478 - DNA, 22 bp, Homo sapiens
agcctagggggtcctgggccac

SEQ ID NO: 8583479 - DNA, 18 bp, Homo sapiens
cagaggagagacattcag

SEQ ID NO: 8583480 - DNA, 22 bp, Homo sapiens
cagagcttaaaactccatggaa

SEQ ID NO: 8583481 - DNA, 22 bp, Homo sapiens
cagagtgaaataggggatcaag

SEQ ID NO: 8583482 - DNA, 22 bp, Homo sapiens
cagagcaccagtgggagacaag

SEQ ID NO: 8583483 - DNA, 22 bp, Homo sapiens
agccagggctgcgagcagacag

SEQ ID NO: 8583484 - DNA, 22 bp, Homo sapiens
cagagctgtccaaaccctgaca

SEQ ID NO: 8583485 - DNA, 22 bp, Homo sapiens
cagagccatggtatgggcttgt

SEQ ID NO: 8583486 - DNA, 22 bp, Homo sapiens
cagagccataaaggtgaaagag

SEQ ID NO: 8583487 - DNA, 22 bp, Homo sapiens
cagagccatcccagcctgtggt

SEQ ID NO: 8583488 - DNA, 22 bp, Homo sapiens
cagagccatccaggtgcctgtt

SEQ ID NO: 8583489 - DNA, 22 bp, Homo sapiens
cagagccagggctaggaactgg

SEQ ID NO: 8583490 - DNA, 19 bp, Homo sapiens
cagagccaggcctttggcc

SEQ ID NO: 8583491 - DNA, 22 bp, Homo sapiens
cagagccagggttgcacccctg

SEQ ID NO: 8583492 - DNA, 22 bp, Homo sapiens
cagagccagtcagtcagaaact

SEQ ID NO: 8583493 - DNA, 22 bp, Homo sapiens
cagagccaggtggtgttggggc

SEQ ID NO: 8583494 - DNA, 22 bp, Homo sapiens
cagagccaggtcttgaactcag

SEQ ID NO: 8583495 - DNA, 22 bp, Homo sapiens
cagagcagtaaatctggggcac

SEQ ID NO: 8583496 - DNA, 22 bp, Homo sapiens
cagagcagtagaaaacagcctt

SEQ ID NO: 8583497 - DNA, 22 bp, Homo sapiens
cagagcagtccttgtcaatcag

SEQ ID NO: 8583498 - DNA, 22 bp, Homo sapiens
agcgaggtgagtcctccagctc

SEQ ID NO: 8583499 - DNA, 22 bp, Homo sapiens
agcgcctgcaccactctgcggc

SEQ ID NO: 8583500 - DNA, 22 bp, Homo sapiens
cagcatgggggcaattcaggtg

SEQ ID NO: 8583501 - DNA, 22 bp, Homo sapiens
cagcatggggcttggagtcagc

SEQ ID NO: 8583502 - DNA, 22 bp, Homo sapiens
cagcactgcttcgcagccaggg

SEQ ID NO: 8583503 - DNA, 22 bp, Homo sapiens
cagcactggggccactggagtt

SEQ ID NO: 8583504 - DNA, 22 bp, Homo sapiens
cagcatggacaggggtggcgtt

SEQ ID NO: 8583505 - DNA, 22 bp, Homo sapiens
cagcatggacaggggtggcgtt

SEQ ID NO: 8583506 - DNA, 22 bp, Homo sapiens
cagcatcagcctggctcaggcc

SEQ ID NO: 8583507 - DNA, 22 bp, Homo sapiens
cagctgggtggctcttctgctc

SEQ ID NO: 8583508 - DNA, 22 bp, Homo sapiens
cagctggatgggagaccatgtt

SEQ ID NO: 8583509 - DNA, 22 bp, Homo sapiens
cagctggcaagtggagcagggt

SEQ ID NO: 8583510 - DNA, 20 bp, Homo sapiens
agctgaggcacctgaggtta

SEQ ID NO: 8583511 - DNA, 19 bp, Homo sapiens
cagctggaatcatctgagg

SEQ ID NO: 8583512 - DNA, 22 bp, Homo sapiens
cagctggacttttgatagaagt

SEQ ID NO: 8583513 - DNA, 22 bp, Homo sapiens
cagctggatccctgcagaactt

SEQ ID NO: 8583514 - DNA, 22 bp, Homo sapiens
cagctggaggagcagcttccag

SEQ ID NO: 8583515 - DNA, 22 bp, Homo sapiens
cagcggaggacagatgggagct

SEQ ID NO: 8583516 - DNA, 22 bp, Homo sapiens
caagtcacttatgtgcagatat

SEQ ID NO: 8583517 - DNA, 22 bp, Homo sapiens
caagggctgctatcagctactg

SEQ ID NO: 8583518 - DNA, 22 bp, Homo sapiens
caagggcagatagctggtccaa

SEQ ID NO: 8583519 - DNA, 22 bp, Homo sapiens
caagcagagaggttagaacaca

SEQ ID NO: 8583520 - DNA, 22 bp, Homo sapiens
caagctggctgggagaggcacg

SEQ ID NO: 8583521 - DNA, 22 bp, Homo sapiens
caagctgggtgcgggcagtata

SEQ ID NO: 8583522 - DNA, 22 bp, Homo sapiens
agcagagaagacacaggcttca

SEQ ID NO: 8583523 - DNA, 22 bp, Homo sapiens
agcagagacatgaaatatgctt

SEQ ID NO: 8583524 - DNA, 22 bp, Homo sapiens
agcagagaccatatagcccaga

SEQ ID NO: 8583525 - DNA, 21 bp, Homo sapiens
agcagacagatgcacgcacac

SEQ ID NO: 8583526 - DNA, 22 bp, Homo sapiens
caatttctggaactaattctga

SEQ ID NO: 8583527 - DNA, 22 bp, Homo sapiens
cacacatggctgccagggaggt

SEQ ID NO: 8583528 - DNA, 22 bp, Homo sapiens
cacacatggttccgcaggatgc

SEQ ID NO: 8583529 - DNA, 22 bp, Homo sapiens
cacagaaatattgtgtcccttg

SEQ ID NO: 8583530 - DNA, 22 bp, Homo sapiens
agcaggccactgcagctggagc

SEQ ID NO: 8583531 - DNA, 22 bp, Homo sapiens
agcaggcaggcccagcggctgg

SEQ ID NO: 8583532 - DNA, 20 bp, Homo sapiens
cacaggaaagctactcagtt

SEQ ID NO: 8583533 - DNA, 20 bp, Homo sapiens
agcaggccttggggagagga

SEQ ID NO: 8583534 - DNA, 19 bp, Homo sapiens
agcaggccaggcaggtggc

SEQ ID NO: 8583535 - DNA, 22 bp, Homo sapiens
agcaggcccaagctggggggaa

SEQ ID NO: 8583536 - DNA, 21 bp, Homo sapiens
agcaggcccaatggagggggc

SEQ ID NO: 8583537 - DNA, 21 bp, Homo sapiens
cacatgtgaattactgaactg

SEQ ID NO: 8583538 - DNA, 22 bp, Homo sapiens
cacatggcagaatcatgcatct

SEQ ID NO: 8583539 - DNA, 22 bp, Homo sapiens
agcaggtgggatcaagctggca

SEQ ID NO: 8583540 - DNA, 18 bp, Homo sapiens
agcaggtggcgtctgcag

SEQ ID NO: 8583541 - DNA, 22 bp, Homo sapiens
agcaggtggcctcctgtctgtc

SEQ ID NO: 8583542 - DNA, 18 bp, Homo sapiens
agcaggtggatttattgg

SEQ ID NO: 8583543 - DNA, 22 bp, Homo sapiens
agcaggtggccacgaggaggag

SEQ ID NO: 8583544 - DNA, 22 bp, Homo sapiens
agcaggtggatttagacgggag

SEQ ID NO: 8583545 - DNA, 22 bp, Homo sapiens
cacggtggcccacaggtgcaag

SEQ ID NO: 8583546 - DNA, 22 bp, Homo sapiens
cacattgataattaaggcctcc

SEQ ID NO: 8583547 - DNA, 22 bp, Homo sapiens
cacattgattcagtcctgtgtg

SEQ ID NO: 8583548 - DNA, 22 bp, Homo sapiens
cactgcaacctccacctcctgg

SEQ ID NO: 8583549 - DNA, 22 bp, Homo sapiens
cactgcactccagcccgggcaa

SEQ ID NO: 8583550 - DNA, 22 bp, Homo sapiens
cactgcactccatcctgggaaa

SEQ ID NO: 8583551 - DNA, 22 bp, Homo sapiens
cactgcactccatcctgggaaa

SEQ ID NO: 8583552 - DNA, 22 bp, Homo sapiens
cactgcactccagcccgggcaa

SEQ ID NO: 8583553 - DNA, 22 bp, Homo sapiens
agcatttaggagaatttgagaa

SEQ ID NO: 8583554 - DNA, 20 bp, Homo sapiens
agcatttagcctttatccac

SEQ ID NO: 8583555 - DNA, 22 bp, Homo sapiens
cactgcacttcagcctgggtga

SEQ ID NO: 8583556 - DNA, 22 bp, Homo sapiens
cactgcacttcagcctgggtga

SEQ ID NO: 8583557 - DNA, 22 bp, Homo sapiens
cactgcacttcagcctgggtga

SEQ ID NO: 8583558 - DNA, 22 bp, Homo sapiens
agcatttattgagtgccctggg

SEQ ID NO: 8583559 - DNA, 22 bp, Homo sapiens
agcatttattgacctgctgctg

SEQ ID NO: 8583560 - DNA, 22 bp, Homo sapiens
agcatttatttcttagaaattg

SEQ ID NO: 8583561 - DNA, 22 bp, Homo sapiens
agcatttagtctttattgcagc

SEQ ID NO: 8583562 - DNA, 22 bp, Homo sapiens
agcatttagttagtaaatgttt

SEQ ID NO: 8583563 - DNA, 22 bp, Homo sapiens
agcatttatgactaatgtaaaa

SEQ ID NO: 8583564 - DNA, 22 bp, Homo sapiens
agcatttatcttttgtttgagt

SEQ ID NO: 8583565 - DNA, 22 bp, Homo sapiens
agcatttatagcccctatcatc

SEQ ID NO: 8583566 - DNA, 22 bp, Homo sapiens
agcatttatagataccctatgg

SEQ ID NO: 8583567 - DNA, 22 bp, Homo sapiens
cactgggtaaatttgaggctga

SEQ ID NO: 8583568 - DNA, 22 bp, Homo sapiens
cactggggtgggcctggtagag

SEQ ID NO: 8583569 - DNA, 23 bp, Homo sapiens
cactgggggctgctacagagagg

SEQ ID NO: 8583570 - DNA, 20 bp, Homo sapiens
cagaaagaaggtagattttt

SEQ ID NO: 8583571 - DNA, 22 bp, Homo sapiens
cagaaagacctgggctcaagag

SEQ ID NO: 8583572 - DNA, 22 bp, Homo sapiens
cagaaagacctgggctcaagag

SEQ ID NO: 8583573 - DNA, 22 bp, Homo sapiens
cagaaagacctgattggcagtt

SEQ ID NO: 8583574 - DNA, 22 bp, Homo sapiens
acagagatggcacagagaaggt

SEQ ID NO: 8583575 - DNA, 23 bp, Homo sapiens
acagaaagttctgctggacagag

SEQ ID NO: 8583576 - DNA, 22 bp, Homo sapiens
acagaaataactttttatgttt

SEQ ID NO: 8583577 - DNA, 23 bp, Homo sapiens
acagacaacactgatgagagaaa

SEQ ID NO: 8583578 - DNA, 22 bp, Homo sapiens
acacttctcatttgatactaac

SEQ ID NO: 8583579 - DNA, 22 bp, Homo sapiens
acagcaggttacagtggcacag

SEQ ID NO: 8583580 - DNA, 21 bp, Homo sapiens
acagctggaaattacttgccc

SEQ ID NO: 8583581 - DNA, 18 bp, Homo sapiens
aagcagggtccattgtgc

SEQ ID NO: 8583582 - DNA, 22 bp, Homo sapiens
aagcagggtcttcctcagttgg

SEQ ID NO: 8583583 - DNA, 22 bp, Homo sapiens
aagcagggctttaagcggtttt

SEQ ID NO: 8583584 - DNA, 22 bp, Homo sapiens
aagcagggctagaccaagaaga

SEQ ID NO: 8583585 - DNA, 22 bp, Homo sapiens
aagcagggctccctggggactc

SEQ ID NO: 8583586 - DNA, 22 bp, Homo sapiens
aagcagggtgtcttgacccatg

SEQ ID NO: 8583587 - DNA, 22 bp, Homo sapiens
aagcagggtttttccaccgcag

SEQ ID NO: 8583588 - DNA, 22 bp, Homo sapiens
aagcaggcgagggcctggagca

SEQ ID NO: 8583589 - DNA, 23 bp, Homo sapiens
aagcagggagattcttagctgag

SEQ ID NO: 8583590 - DNA, 21 bp, Homo sapiens
aagcagggactgcccaggtcc

SEQ ID NO: 8583591 - DNA, 22 bp, Homo sapiens
aagcagggagaaatttttcttc

SEQ ID NO: 8583592 - DNA, 21 bp, Homo sapiens
acagcagggctggcatgacag

SEQ ID NO: 8583593 - DNA, 22 bp, Homo sapiens
acagcaggggtggaataaacgt

SEQ ID NO: 8583594 - DNA, 22 bp, Homo sapiens
acagcagggtcacattccctct

SEQ ID NO: 8583595 - DNA, 22 bp, Homo sapiens
acagcaggtagctttgtgcctc

SEQ ID NO: 8583596 - DNA, 22 bp, Homo sapiens
acagcaggaagctggagggaaa

SEQ ID NO: 8583597 - DNA, 22 bp, Homo sapiens
aagcagtttttcaactgtttag

SEQ ID NO: 8583598 - DNA, 19 bp, Homo sapiens
aagcagtttatatatttgt

SEQ ID NO: 8583599 - DNA, 22 bp, Homo sapiens
aagcagttactatttactatta

SEQ ID NO: 8583600 - DNA, 22 bp, Homo sapiens
acacagagccagggaatacagt

SEQ ID NO: 8583601 - DNA, 22 bp, Homo sapiens
acacagagcaaatcatgacaga

SEQ ID NO: 8583602 - DNA, 22 bp, Homo sapiens
acacagagctggaactgcttca

SEQ ID NO: 8583603 - DNA, 22 bp, Homo sapiens
acacagcaacttgcagtatgga

SEQ ID NO: 8583604 - DNA, 22 bp, Homo sapiens
acacagagcttctcaactggga

SEQ ID NO: 8583605 - DNA, 22 bp, Homo sapiens
acaatgttctacatatacataa

SEQ ID NO: 8583606 - DNA, 22 bp, Homo sapiens
acacagagatgtaaagttaggc

SEQ ID NO: 8583607 - DNA, 17 bp, Homo sapiens
acacagacaggcagaca

SEQ ID NO: 8583608 - DNA, 20 bp, Homo sapiens
acaatagatttgagcaaagt

SEQ ID NO: 8583609 - DNA, 22 bp, Homo sapiens
acaaaaagggagatgaggtaga

SEQ ID NO: 8583610 - DNA, 22 bp, Homo sapiens
aagaatcatcctgcaagagtct

SEQ ID NO: 8583611 - DNA, 23 bp, Homo sapiens
aagaatcagtaagtaaggagacc

SEQ ID NO: 8583612 - DNA, 22 bp, Homo sapiens
acaaaagtgtaggaattcctta

SEQ ID NO: 8583613 - DNA, 22 bp, Homo sapiens
acaaatatttactgaatccact

SEQ ID NO: 8583614 - DNA, 22 bp, Homo sapiens
aacagtgtttttcttcagcact

SEQ ID NO: 8583615 - DNA, 22 bp, Homo sapiens
aacagtgttttgctctttgccc

SEQ ID NO: 8583616 - DNA, 22 bp, Homo sapiens
aacagtgtcaggattacagata

SEQ ID NO: 8583617 - DNA, 22 bp, Homo sapiens
aacagtgtgttttgttattaag

SEQ ID NO: 8583618 - DNA, 22 bp, Homo sapiens
aagggctggaatatctcttaga

SEQ ID NO: 8583619 - DNA, 22 bp, Homo sapiens
aaggtgtcactgtttctggcct

SEQ ID NO: 8583620 - DNA, 22 bp, Homo sapiens
aaggtgtcaggcttgggaaagt

SEQ ID NO: 8583621 - DNA, 22 bp, Homo sapiens
aaggtgtcatccaggatggtgg

SEQ ID NO: 8583622 - DNA, 23 bp, Homo sapiens
aaggtgtcattgatgggattcta

SEQ ID NO: 8583623 - DNA, 22 bp, Homo sapiens
aaggtgtcattgtttatggaga

SEQ ID NO: 8583624 - DNA, 22 bp, Homo sapiens
aaggtgtctctctgcttcttgg

SEQ ID NO: 8583625 - DNA, 22 bp, Homo sapiens
aaggtgtcgggttagctcagcc

SEQ ID NO: 8583626 - DNA, 22 bp, Homo sapiens
aaggtgtcggcagagccgcttc

SEQ ID NO: 8583627 - DNA, 19 bp, Homo sapiens
aaggtgtcccaactgcgtt

SEQ ID NO: 8583628 - DNA, 22 bp, Homo sapiens
aagggcagggagtttgtgtcta

SEQ ID NO: 8583629 - DNA, 22 bp, Homo sapiens
aagggcaggtgggcatttctgg

SEQ ID NO: 8583630 - DNA, 22 bp, Homo sapiens
aaggagtctgggccattcagag

SEQ ID NO: 8583631 - DNA, 23 bp, Homo sapiens
aaggccagagagaggctagtgtc

SEQ ID NO: 8583632 - DNA, 23 bp, Homo sapiens
aaggccagagagaggctagtgtc

SEQ ID NO: 8583633 - DNA, 22 bp, Homo sapiens
aaggccaggtccctgcagtgca

SEQ ID NO: 8583634 - DNA, 22 bp, Homo sapiens
aaggccaggtccctgcagtgca

SEQ ID NO: 8583635 - DNA, 22 bp, Homo sapiens
aagggcaggcagagatcatata

SEQ ID NO: 8583636 - DNA, 22 bp, Homo sapiens
aagggcaggcagagatcatata

SEQ ID NO: 8583637 - DNA, 22 bp, Homo sapiens
aagggcagggagtttgtgtcta

SEQ ID NO: 8583638 - DNA, 22 bp, Homo sapiens
aagggcaggcacccaccctcac

SEQ ID NO: 8583639 - DNA, 22 bp, Homo sapiens
aagggcaggagaagacggatat

SEQ ID NO: 8583640 - DNA, 22 bp, Homo sapiens
aagggcaggagaagacggatat

SEQ ID NO: 8583641 - DNA, 22 bp, Homo sapiens
aagggcaggaaaagatggatgt

SEQ ID NO: 8583642 - DNA, 22 bp, Homo sapiens
aaggctgaccagtttacacttt

SEQ ID NO: 8583643 - DNA, 22 bp, Homo sapiens
aaggctgagagtcacagtccta

SEQ ID NO: 8583644 - DNA, 22 bp, Homo sapiens
aatacagaggggtcacaattca

SEQ ID NO: 8583645 - DNA, 22 bp, Homo sapiens
aatacagatgagcttctgcctc

SEQ ID NO: 8583646 - DNA, 22 bp, Homo sapiens
aagttacagttattatttaaaa

SEQ ID NO: 8583647 - DNA, 22 bp, Homo sapiens
aaagacacacagccagcaagtg

SEQ ID NO: 8583648 - DNA, 22 bp, Homo sapiens
aaagacacacagtgcttcagtt

SEQ ID NO: 8583649 - DNA, 22 bp, Homo sapiens
aaagacacatgtctcttagatt

SEQ ID NO: 8583650 - DNA, 22 bp, Homo sapiens
aaagacacatatgcttaaccca

SEQ ID NO: 8583651 - DNA, 21 bp, Homo sapiens
aaatacagatgcaaatctgtt

SEQ ID NO: 8583652 - DNA, 22 bp, Homo sapiens
aaagtcacttccttctgtcagc

SEQ ID NO: 8583653 - DNA, 22 bp, Homo sapiens
aaagtcattggaatattaatga

SEQ ID NO: 8583654 - DNA, 22 bp, Homo sapiens
aaagtcattgctgttatcaatg

SEQ ID NO: 8583655 - DNA, 22 bp, Homo sapiens
aaagtcatgtaatgatatgatt

SEQ ID NO: 8583656 - DNA, 22 bp, Homo sapiens
aaagctcacagtaatacaaggc

SEQ ID NO: 8583657 - DNA, 22 bp, Homo sapiens
aaagctagtaatattttaatcc

SEQ ID NO: 8583658 - DNA, 22 bp, Homo sapiens
aaagctagaaggaaattttatg

SEQ ID NO: 8583659 - DNA, 20 bp, Homo sapiens
aaaagcagccagagatggta

SEQ ID NO: 8583660 - DNA, 22 bp, Homo sapiens
aaaagcaggtactcagcttggg

SEQ ID NO: 8583661 - DNA, 22 bp, Homo sapiens
aaaagcactacaatttcgcttc

SEQ ID NO: 8583662 - DNA, 22 bp, Homo sapiens
aaaacagttataaacagagtca

SEQ ID NO: 8583663 - DNA, 22 bp, Homo sapiens
aaaagattgttagggagaatgt

SEQ ID NO: 8583664 - DNA, 22 bp, Homo sapiens
aaagcaggcagcaggctggatt

SEQ ID NO: 8583665 - DNA, 22 bp, Homo sapiens
aaaagctcattgataaaaagtc

SEQ ID NO: 8583666 - DNA, 22 bp, Homo sapiens
aaattgtaatgacttcacttga

SEQ ID NO: 8583667 - DNA, 23 bp, Homo sapiens
aaattcagtccttcaactctgag

SEQ ID NO: 8583668 - DNA, 22 bp, Homo sapiens
aaagcatgactcaagaattact

SEQ ID NO: 8583669 - DNA, 22 bp, Homo sapiens
aaagcatattaggactgaatta

SEQ ID NO: 8583670 - DNA, 22 bp, Homo sapiens
aaagcatttcatgtctagaaag

SEQ ID NO: 8583671 - DNA, 22 bp, Homo sapiens
aaagcattgtttcaagattaac

SEQ ID NO: 8583672 - DNA, 22 bp, Homo sapiens
aaaggcagagtgctcagctggc

SEQ ID NO: 8583673 - DNA, 22 bp, Homo sapiens
aaagtcctgttaactgttaaca

SEQ ID NO: 8583674 - DNA, 22 bp, Homo sapiens
aacttccaggccttgaattatt

SEQ ID NO: 8583675 - DNA, 22 bp, Homo sapiens
aacttccttctagttcatatgt

SEQ ID NO: 8583676 - DNA, 22 bp, Homo sapiens
aaagttacacatctagtaagtg

SEQ ID NO: 8583677 - DNA, 22 bp, Homo sapiens
aaatacagtgtgtgttctttga

SEQ ID NO: 8583678 - DNA, 22 bp, Homo sapiens
aagagttttagacaaactgatt

SEQ ID NO: 8583679 - DNA, 22 bp, Homo sapiens
aagagttttctataatcttggc

SEQ ID NO: 8583680 - DNA, 22 bp, Homo sapiens
aaatatagtgacacttatagtc

SEQ ID NO: 8583681 - DNA, 22 bp, Homo sapiens
aagagtttctttattaaccttt

SEQ ID NO: 8583682 - DNA, 22 bp, Homo sapiens
aaatatacggtccctaacagtc

SEQ ID NO: 8583683 - DNA, 20 bp, Homo sapiens
aaatgctgtaatgtttggga

SEQ ID NO: 8583684 - DNA, 22 bp, Homo sapiens
aaatgaggccagatcatgcaga

SEQ ID NO: 8583685 - DNA, 22 bp, Homo sapiens
aaatgagtttgcctctagatag

SEQ ID NO: 8583686 - DNA, 22 bp, Homo sapiens
agagcacagcagatctctgatg

SEQ ID NO: 8583687 - DNA, 22 bp, Homo sapiens
agagcacagaagttatatgtta

SEQ ID NO: 8583688 - DNA, 22 bp, Homo sapiens
aattaattttgttcattcagtc

SEQ ID NO: 8583689 - DNA, 22 bp, Homo sapiens
agagcctggctcccagctaccg

SEQ ID NO: 8583690 - DNA, 22 bp, Homo sapiens
agagctggaagctgctcttaga

SEQ ID NO: 8583691 - DNA, 22 bp, Homo sapiens
aattcattaagaaagagctaaa

SEQ ID NO: 8583692 - DNA, 22 bp, Homo sapiens
aattcatcattttatagctagt

SEQ ID NO: 8583693 - DNA, 21 bp, Homo sapiens
agagctggtaggtaggtaggt

SEQ ID NO: 8583694 - DNA, 21 bp, Homo sapiens
agaggaagtgattggtctggc

SEQ ID NO: 8583695 - DNA, 22 bp, Homo sapiens
agaggaagtaatcaggacctgc

SEQ ID NO: 8583696 - DNA, 22 bp, Homo sapiens
agaggaagtaatcaggacctgc

SEQ ID NO: 8583697 - DNA, 22 bp, Homo sapiens
aatttcggttcaaggcccagtt

SEQ ID NO: 8583698 - DNA, 22 bp, Homo sapiens
agaggatgattttaaggacact

SEQ ID NO: 8583699 - DNA, 22 bp, Homo sapiens
agagaaggggtaaagagtcctg

SEQ ID NO: 8583700 - DNA, 22 bp, Homo sapiens
agagaagggggaaagatctcac

SEQ ID NO: 8583701 - DNA, 22 bp, Homo sapiens
agagaaggcatagaacttgagt

SEQ ID NO: 8583702 - DNA, 22 bp, Homo sapiens
agagcaagtgacagaaacaggg

SEQ ID NO: 8583703 - DNA, 22 bp, Homo sapiens
aatgtgtctatgtggttcacag

SEQ ID NO: 8583704 - DNA, 22 bp, Homo sapiens
aatgtgtcatttcccacaggtg

SEQ ID NO: 8583705 - DNA, 22 bp, Homo sapiens
aatgtgtcccttatttcacagg

SEQ ID NO: 8583706 - DNA, 22 bp, Homo sapiens
aatgtgtcagcttgtcgatctt

SEQ ID NO: 8583707 - DNA, 22 bp, Homo sapiens
aatgtgtatactggcaattaag

SEQ ID NO: 8583708 - DNA, 22 bp, Homo sapiens
agacatgtcaccaattcttact

SEQ ID NO: 8583709 - DNA, 22 bp, Homo sapiens
agacatgtggtataatcagggg

SEQ ID NO: 8583710 - DNA, 22 bp, Homo sapiens
agacatgtccacaaagcattca

SEQ ID NO: 8583711 - DNA, 21 bp, Homo sapiens
agacatgtgaactaaaggtga

SEQ ID NO: 8583712 - DNA, 22 bp, Homo sapiens
agacaggtaaatagagatgctg

SEQ ID NO: 8583713 - DNA, 22 bp, Homo sapiens
agacaggtagcaggacagatat

SEQ ID NO: 8583714 - DNA, 22 bp, Homo sapiens
agcaaagtatgtgctgggagct

SEQ ID NO: 8583715 - DNA, 22 bp, Homo sapiens
agcacaagtttctggcagacag

SEQ ID NO: 8583716 - DNA, 22 bp, Homo sapiens
agcacacaggacttgattcatg

SEQ ID NO: 8583717 - DNA, 22 bp, Homo sapiens
agcacaggaccaaggaagctgt

SEQ ID NO: 8583718 - DNA, 22 bp, Homo sapiens
acaaagtgctgacattacaggc

SEQ ID NO: 8583719 - DNA, 22 bp, Homo sapiens
acaacagggtaaggcaggccat

SEQ ID NO: 8583720 - DNA, 22 bp, Homo sapiens
agatgctgaattattgtgcttt

SEQ ID NO: 8583721 - DNA, 22 bp, Homo sapiens
aatttctctctcatgcttcatg

SEQ ID NO: 8583722 - DNA, 20 bp, Homo sapiens
agagtgggtgtcacaggctg

SEQ ID NO: 8583723 - DNA, 22 bp, Homo sapiens
agagtgggttataggcagactt

SEQ ID NO: 8583724 - DNA, 22 bp, Homo sapiens
agagtgtaccaaatatcctaca

SEQ ID NO: 8583725 - DNA, 22 bp, Homo sapiens
acagaagctcaagagagcagtg

SEQ ID NO: 8583726 - DNA, 22 bp, Homo sapiens
acagcaggttttaactttgaag

SEQ ID NO: 8583727 - DNA, 18 bp, Homo sapiens
acagcaggtttcattctt

SEQ ID NO: 8583728 - DNA, 22 bp, Homo sapiens
acagcaggttattgttatggca

SEQ ID NO: 8583729 - DNA, 17 bp, Homo sapiens
acagcaggcccggaggg

SEQ ID NO: 8583730 - DNA, 22 bp, Homo sapiens
acagcaggcccatactggaagg

SEQ ID NO: 8583731 - DNA, 17 bp, Homo sapiens
acagcagggaagtgttg

SEQ ID NO: 8583732 - DNA, 22 bp, Homo sapiens
acagcagggaatatgggaattg

SEQ ID NO: 8583733 - DNA, 22 bp, Homo sapiens
agctgagggttcggtgtccaca

SEQ ID NO: 8583734 - DNA, 18 bp, Homo sapiens
agctgaggggactgaaga

SEQ ID NO: 8583735 - DNA, 23 bp, Homo sapiens
agctgaggtgcagatccaaagaa

SEQ ID NO: 8583736 - DNA, 21 bp, Homo sapiens
agctgaggtaaggcaagagag

SEQ ID NO: 8583737 - DNA, 21 bp, Homo sapiens
agctgaggtaaggcaagagag

SEQ ID NO: 8583738 - DNA, 22 bp, Homo sapiens
acagcaggcatgaatgacactg

SEQ ID NO: 8583739 - DNA, 22 bp, Homo sapiens
acagcagagtgtgagatagcca

SEQ ID NO: 8583740 - DNA, 22 bp, Homo sapiens
acagcagatctggctacaggtt

SEQ ID NO: 8583741 - DNA, 22 bp, Homo sapiens
acagcagagtggagatgagcac

SEQ ID NO: 8583742 - DNA, 22 bp, Homo sapiens
acagcagagtggagatgagcac

SEQ ID NO: 8583743 - DNA, 22 bp, Homo sapiens
acagcagaccactactagtagg

SEQ ID NO: 8583744 - DNA, 22 bp, Homo sapiens
acagatataaactatagtagtg

SEQ ID NO: 8583745 - DNA, 22 bp, Homo sapiens
acagcagcaatagcagtgacat

SEQ ID NO: 8583746 - DNA, 22 bp, Homo sapiens
acagcagatctggctacaggtt

SEQ ID NO: 8583747 - DNA, 22 bp, Homo sapiens
acagcagatctggctacaggtt

SEQ ID NO: 8583748 - DNA, 22 bp, Homo sapiens
acagcagatttccctgggctcc

SEQ ID NO: 8583749 - DNA, 22 bp, Homo sapiens
acagcagatttccctgggctcc

SEQ ID NO: 8583750 - DNA, 22 bp, Homo sapiens
agcaggtggtctgttgctgctg

SEQ ID NO: 8583751 - DNA, 22 bp, Homo sapiens
agcaggtggtgggccagatttg

SEQ ID NO: 8583752 - DNA, 21 bp, Homo sapiens
agcaggtgtaaaggaggaaat

SEQ ID NO: 8583753 - DNA, 22 bp, Homo sapiens
agcaggtgatcgcgtgtgctcc

SEQ ID NO: 8583754 - DNA, 22 bp, Homo sapiens
agcaggtggtaggcagtcagca

SEQ ID NO: 8583755 - DNA, 22 bp, Homo sapiens
agcaggtgtatataaggctgag

SEQ ID NO: 8583756 - DNA, 22 bp, Homo sapiens
agcaggtgtatcggtcacctac

SEQ ID NO: 8583757 - DNA, 22 bp, Homo sapiens
agcaggtgtatataaggctgag

SEQ ID NO: 8583758 - DNA, 16 bp, Homo sapiens
agcaggtgtatagtgt

SEQ ID NO: 8583759 - DNA, 22 bp, Homo sapiens
agcaggtgtagggctctttgta

SEQ ID NO: 8583760 - DNA, 22 bp, Homo sapiens
acaccagggcctagccagggcg

SEQ ID NO: 8583761 - DNA, 22 bp, Homo sapiens
agcaggtgtcactttcactcca

SEQ ID NO: 8583762 - DNA, 22 bp, Homo sapiens
agcatttaattacagtttaatt

SEQ ID NO: 8583763 - DNA, 20 bp, Homo sapiens
agcatttacatcccttggtg

SEQ ID NO: 8583764 - DNA, 22 bp, Homo sapiens
agcatttacctcaatgcatctg

SEQ ID NO: 8583765 - DNA, 22 bp, Homo sapiens
acacccagcttttgaatgccct

SEQ ID NO: 8583766 - DNA, 22 bp, Homo sapiens
acactgtgtgacttctgagact

SEQ ID NO: 8583767 - DNA, 22 bp, Homo sapiens
agccagctgttctggggcagca

SEQ ID NO: 8583768 - DNA, 22 bp, Homo sapiens
agccagcttctttacggtggca

SEQ ID NO: 8583769 - DNA, 19 bp, Homo sapiens
agccagagtggcccagggg

SEQ ID NO: 8583770 - DNA, 22 bp, Homo sapiens
agccagctgctcgggggaaaca

SEQ ID NO: 8583771 - DNA, 22 bp, Homo sapiens
agccagaggtcatgagcacagg

SEQ ID NO: 8583772 - DNA, 22 bp, Homo sapiens
agccagagattgagatgcaggc

SEQ ID NO: 8583773 - DNA, 22 bp, Homo sapiens
acactgtgtggtctctctcgga

SEQ ID NO: 8583774 - DNA, 22 bp, Homo sapiens
acacagttcgttgttttctact

SEQ ID NO: 8583775 - DNA, 22 bp, Homo sapiens
acacagttcatgcatgaggtct

SEQ ID NO: 8583776 - DNA, 22 bp, Homo sapiens
acacagttcgtgcttttctatt

SEQ ID NO: 8583777 - DNA, 22 bp, Homo sapiens
acacagtttatggtattctgtt

SEQ ID NO: 8583778 - DNA, 22 bp, Homo sapiens
acacagttgattgtcactcagg

SEQ ID NO: 8583779 - DNA, 22 bp, Homo sapiens
acacagtgtcagggcaggggcc

SEQ ID NO: 8583780 - DNA, 22 bp, Homo sapiens
acacagtgtcttaggtagtgtc

SEQ ID NO: 8583781 - DNA, 22 bp, Homo sapiens
acacagttcaggatcaaatagc

SEQ ID NO: 8583782 - DNA, 22 bp, Homo sapiens
aagggctggatctctctgagca

SEQ ID NO: 8583783 - DNA, 22 bp, Homo sapiens
aagggcagaatagagaagatgg

SEQ ID NO: 8583784 - DNA, 20 bp, Homo sapiens
aagggcagagggaacagact

SEQ ID NO: 8583785 - DNA, 22 bp, Homo sapiens
aagggcagagggaatcccacat

SEQ ID NO: 8583786 - DNA, 22 bp, Homo sapiens
aagggcagaaagggacgctttg

SEQ ID NO: 8583787 - DNA, 22 bp, Homo sapiens
aagggcagaatagagaagatgg

SEQ ID NO: 8583788 - DNA, 22 bp, Homo sapiens
aagggcagaaagggacgctttg

SEQ ID NO: 8583789 - DNA, 22 bp, Homo sapiens
accagagcttacatgctagaaa

SEQ ID NO: 8583790 - DNA, 22 bp, Homo sapiens
accagagctggctctgagcacc

SEQ ID NO: 8583791 - DNA, 22 bp, Homo sapiens
accagaggctctgccacctcca

SEQ ID NO: 8583792 - DNA, 22 bp, Homo sapiens
accagagggcaaaccccagtgt

SEQ ID NO: 8583793 - DNA, 22 bp, Homo sapiens
acccaggatgataatgttcaca

SEQ ID NO: 8583794 - DNA, 22 bp, Homo sapiens
aagtatctcaaaaacagtaatc

SEQ ID NO: 8583795 - DNA, 23 bp, Homo sapiens
aagtagatagctaaagttttgtt

SEQ ID NO: 8583796 - DNA, 22 bp, Homo sapiens
acccagggtagaacctcagagc

SEQ ID NO: 8583797 - DNA, 22 bp, Homo sapiens
aaggtggtcttactgatggtat

SEQ ID NO: 8583798 - DNA, 22 bp, Homo sapiens
acccaggggcgaagctggccac

SEQ ID NO: 8583799 - DNA, 22 bp, Homo sapiens
aaggtggtgatcatcttgaagg

SEQ ID NO: 8583800 - DNA, 22 bp, Homo sapiens
aaggtggtgagtacagttaggt

SEQ ID NO: 8583801 - DNA, 22 bp, Homo sapiens
aaggtggtgcttctgctcctct

SEQ ID NO: 8583802 - DNA, 22 bp, Homo sapiens
aaggtggttcgctggtacccag

SEQ ID NO: 8583803 - DNA, 22 bp, Homo sapiens
aaggtggttgcaattaccataa

SEQ ID NO: 8583804 - DNA, 22 bp, Homo sapiens
aaggtggttgtaggctggtctg

SEQ ID NO: 8583805 - DNA, 22 bp, Homo sapiens
aaggtggtttgattatcccact

SEQ ID NO: 8583806 - DNA, 22 bp, Homo sapiens
aaggtggtttgcagacagaata

SEQ ID NO: 8583807 - DNA, 22 bp, Homo sapiens
aaggtggtttgctaatcccaac

SEQ ID NO: 8583808 - DNA, 22 bp, Homo sapiens
acccagggctcaagcgtaggca

SEQ ID NO: 8583809 - DNA, 22 bp, Homo sapiens
acctcctggcctcaagcaatcc

SEQ ID NO: 8583810 - DNA, 22 bp, Homo sapiens
aaggtgtcaccagattggcagg

SEQ ID NO: 8583811 - DNA, 19 bp, Homo sapiens
aaggtggtttgtctctgta

SEQ ID NO: 8583812 - DNA, 22 bp, Homo sapiens
aaggtgtcaaactagaagatgt

SEQ ID NO: 8583813 - DNA, 22 bp, Homo sapiens
acctcaagaatgtataacacag

SEQ ID NO: 8583814 - DNA, 22 bp, Homo sapiens
aaggcaaggccaagccatcagt

SEQ ID NO: 8583815 - DNA, 22 bp, Homo sapiens
aaggcacatattgcagatcttg

SEQ ID NO: 8583816 - DNA, 18 bp, Homo sapiens
aaggcacaggagaacatt

SEQ ID NO: 8583817 - DNA, 22 bp, Homo sapiens
aaggcacagccacttgatcatc

SEQ ID NO: 8583818 - DNA, 22 bp, Homo sapiens
aaggcacaacacaagagggtga

SEQ ID NO: 8583819 - DNA, 22 bp, Homo sapiens
aaggccagattctctctagggg

SEQ ID NO: 8583820 - DNA, 22 bp, Homo sapiens
aaggccagcagtttgagaccag

SEQ ID NO: 8583821 - DNA, 22 bp, Homo sapiens
aaggccagagttgaactgctcc

SEQ ID NO: 8583822 - DNA, 22 bp, Homo sapiens
aaggccagagtactagaggctg

SEQ ID NO: 8583823 - DNA, 22 bp, Homo sapiens
aaggccagagcgtgtcctgcct

SEQ ID NO: 8583824 - DNA, 22 bp, Homo sapiens
aaggccagagcagactggagtt

SEQ ID NO: 8583825 - DNA, 22 bp, Homo sapiens
aaggccagagcagactggagtt

SEQ ID NO: 8583826 - DNA, 22 bp, Homo sapiens
aaggcaccatgagatgctggtt

SEQ ID NO: 8583827 - DNA, 22 bp, Homo sapiens
acatgacacctctggctgggtg

SEQ ID NO: 8583828 - DNA, 22 bp, Homo sapiens
aaggacaaagcagagctggatg

SEQ ID NO: 8583829 - DNA, 22 bp, Homo sapiens
aaggacagaaacagattgctgg

SEQ ID NO: 8583830 - DNA, 19 bp, Homo sapiens
aaggacacaacagagatag

SEQ ID NO: 8583831 - DNA, 22 bp, Homo sapiens
aaggacacggggctggctctgg

SEQ ID NO: 8583832 - DNA, 22 bp, Homo sapiens
aaggacagagagccattccaga

SEQ ID NO: 8583833 - DNA, 22 bp, Homo sapiens
aaggaggcctgcgagaaggggc

SEQ ID NO: 8583834 - DNA, 22 bp, Homo sapiens
aaggaggcctggcagatgaaga

SEQ ID NO: 8583835 - DNA, 22 bp, Homo sapiens
aaggatgcagggacccaaggct

SEQ ID NO: 8583836 - DNA, 22 bp, Homo sapiens
aaggaaggtactcagtgattct

SEQ ID NO: 8583837 - DNA, 22 bp, Homo sapiens
aaggaaggttcatagtcaaaga

SEQ ID NO: 8583838 - DNA, 22 bp, Homo sapiens
aaggacaaagcagagctggatg

SEQ ID NO: 8583839 - DNA, 22 bp, Homo sapiens
aaggaaggaattgatcatgcgc

SEQ ID NO: 8583840 - DNA, 22 bp, Homo sapiens
aaggaagctgttagacatgcat

SEQ ID NO: 8583841 - DNA, 22 bp, Homo sapiens
aaggaagggaaatagtgatgtc

SEQ ID NO: 8583842 - DNA, 22 bp, Homo sapiens
aaggaagcagcaatgcatgatt

SEQ ID NO: 8583843 - DNA, 22 bp, Homo sapiens
aaggaagcagccagagaccctc

SEQ ID NO: 8583844 - DNA, 22 bp, Homo sapiens
aaggaagccttgcctgaataca

SEQ ID NO: 8583845 - DNA, 22 bp, Homo sapiens
acagctggagtgaggatggagt

SEQ ID NO: 8583846 - DNA, 22 bp, Homo sapiens
acagctggagtgaggatggagt

SEQ ID NO: 8583847 - DNA, 22 bp, Homo sapiens
acagctggaggtctgtgagcac

SEQ ID NO: 8583848 - DNA, 22 bp, Homo sapiens
acagctggacaggggagagttt

SEQ ID NO: 8583849 - DNA, 22 bp, Homo sapiens
acagctggacaggggagagttt

SEQ ID NO: 8583850 - DNA, 22 bp, Homo sapiens
acagctggagccctatggctgg

SEQ ID NO: 8583851 - DNA, 22 bp, Homo sapiens
acagctggaggccccattgtcc

SEQ ID NO: 8583852 - DNA, 22 bp, Homo sapiens
acagctggagccctatggctgg

SEQ ID NO: 8583853 - DNA, 22 bp, Homo sapiens
acagctggaggccccattgtcc

SEQ ID NO: 8583854 - DNA, 22 bp, Homo sapiens
acagctggaggggctgcagagg

SEQ ID NO: 8583855 - DNA, 22 bp, Homo sapiens
acagctggaggggctgcagagg

SEQ ID NO: 8583856 - DNA, 22 bp, Homo sapiens
acttttatgataatcaatgttc

SEQ ID NO: 8583857 - DNA, 22 bp, Homo sapiens
agaaagggagcgtggatcaatt

SEQ ID NO: 8583858 - DNA, 22 bp, Homo sapiens
agaaagggaactggcaaagcca

SEQ ID NO: 8583859 - DNA, 19 bp, Homo sapiens
agaactgggtccatggctt

SEQ ID NO: 8583860 - DNA, 22 bp, Homo sapiens
agaagccactgctcccagtgag

SEQ ID NO: 8583861 - DNA, 22 bp, Homo sapiens
agaagccaccagctgaggaaga

SEQ ID NO: 8583862 - DNA, 22 bp, Homo sapiens
agaagcagctttcaaggtgatt

SEQ ID NO: 8583863 - DNA, 22 bp, Homo sapiens
aatgaagtgttatttagtttca

SEQ ID NO: 8583864 - DNA, 22 bp, Homo sapiens
agaagccagcttcagctgcccg

SEQ ID NO: 8583865 - DNA, 22 bp, Homo sapiens
aagtgtttggggatcattttaa

SEQ ID NO: 8583866 - DNA, 22 bp, Homo sapiens
aagtgtttccgggagacttggt

SEQ ID NO: 8583867 - DNA, 22 bp, Homo sapiens
aagtgtttcttggaatgttgcg

SEQ ID NO: 8583868 - DNA, 22 bp, Homo sapiens
aagtgtttaggtttgcagtcga

SEQ ID NO: 8583869 - DNA, 22 bp, Homo sapiens
aagtgtttatggttattgttaa

SEQ ID NO: 8583870 - DNA, 22 bp, Homo sapiens
aagtgtttcaataatttggacc

SEQ ID NO: 8583871 - DNA, 22 bp, Homo sapiens
aagtgtttaaattatttgcagg

SEQ ID NO: 8583872 - DNA, 22 bp, Homo sapiens
aagtgtttaatggttttgatga

SEQ ID NO: 8583873 - DNA, 22 bp, Homo sapiens
aagtgtttaacggtgattgagc

SEQ ID NO: 8583874 - DNA, 22 bp, Homo sapiens
aagtgggtcagggacagatctt

SEQ ID NO: 8583875 - DNA, 22 bp, Homo sapiens
aagtgggtcataaaaaattgca

SEQ ID NO: 8583876 - DNA, 22 bp, Homo sapiens
aagtgggtgcactcaactttat

SEQ ID NO: 8583877 - DNA, 22 bp, Homo sapiens
aagtgggttcatgtggcattat

SEQ ID NO: 8583878 - DNA, 19 bp, Homo sapiens
aagtgggtagcacattcac

SEQ ID NO: 8583879 - DNA, 22 bp, Homo sapiens
actgaaaatgaattagaaacag

SEQ ID NO: 8583880 - DNA, 22 bp, Homo sapiens
actgcaggccttggtgccagca

SEQ ID NO: 8583881 - DNA, 22 bp, Homo sapiens
aagttctaacatctacgtggaa

SEQ ID NO: 8583882 - DNA, 22 bp, Homo sapiens
actgcaggagacacagctgctg

SEQ ID NO: 8583883 - DNA, 22 bp, Homo sapiens
actgtcctgaatactgcatgac

SEQ ID NO: 8583884 - DNA, 19 bp, Homo sapiens
aatagcaggagcagttccc

SEQ ID NO: 8583885 - DNA, 21 bp, Homo sapiens
aataaaacagttggtgtcaat

SEQ ID NO: 8583886 - DNA, 22 bp, Homo sapiens
actgggaggcaaagagcaagga

SEQ ID NO: 8583887 - DNA, 22 bp, Homo sapiens
actgggagtcatgaggaaggag

SEQ ID NO: 8583888 - DNA, 22 bp, Homo sapiens
actgggagggtcttgaagaggg

SEQ ID NO: 8583889 - DNA, 22 bp, Homo sapiens
actgggaggcatctggagctga

SEQ ID NO: 8583890 - DNA, 22 bp, Homo sapiens
aataatacatgagattaatgtt

SEQ ID NO: 8583891 - DNA, 22 bp, Homo sapiens
actgggagttctccatgtccct

SEQ ID NO: 8583892 - DNA, 22 bp, Homo sapiens
tagaatgtggaggtaacagact

SEQ ID NO: 8583893 - DNA, 22 bp, Homo sapiens
tagacacatcaagtatagttaa

SEQ ID NO: 8583894 - DNA, 22 bp, Homo sapiens
taccaaaaccaagccattatct

SEQ ID NO: 8583895 - DNA, 22 bp, Homo sapiens
tactttttatgataagaactga

SEQ ID NO: 8583896 - DNA, 22 bp, Homo sapiens
tagaaaagccccagctggaggg

SEQ ID NO: 8583897 - DNA, 22 bp, Homo sapiens
tagctttaatgagttggtaaga

SEQ ID NO: 8583898 - DNA, 22 bp, Homo sapiens
tagcagagaggggacagtggca

SEQ ID NO: 8583899 - DNA, 22 bp, Homo sapiens
tagcagaaccagtcagtgagcc

SEQ ID NO: 8583900 - DNA, 22 bp, Homo sapiens
tagaggtgttcattctctccat

SEQ ID NO: 8583901 - DNA, 22 bp, Homo sapiens
tagcagagtgattggccatgag

SEQ ID NO: 8583902 - DNA, 22 bp, Homo sapiens
taggatatgagtaagcctttgt

SEQ ID NO: 8583903 - DNA, 22 bp, Homo sapiens
taggatatgcatttttatacat

SEQ ID NO: 8583904 - DNA, 22 bp, Homo sapiens
taggatatgtgaaatcatatta

SEQ ID NO: 8583905 - DNA, 22 bp, Homo sapiens
taggatatggtagaaatcattc

SEQ ID NO: 8583906 - DNA, 22 bp, Homo sapiens
taggatgtagctatgtcatcat

SEQ ID NO: 8583907 - DNA, 22 bp, Homo sapiens
tagctttagtgaaaaatatcag

SEQ ID NO: 8583908 - DNA, 22 bp, Homo sapiens
tagctttacaaagtgctgcacc

SEQ ID NO: 8583909 - DNA, 22 bp, Homo sapiens
tagctttgtattatcagcattg

SEQ ID NO: 8583910 - DNA, 22 bp, Homo sapiens
tagctttgccatctgtcacata

SEQ ID NO: 8583911 - DNA, 22 bp, Homo sapiens
tagggactagtttcaaggctaa

SEQ ID NO: 8583912 - DNA, 20 bp, Homo sapiens
tagggagatatgctcttttc

SEQ ID NO: 8583913 - DNA, 22 bp, Homo sapiens
tagggagatgcaagggacggag

SEQ ID NO: 8583914 - DNA, 22 bp, Homo sapiens
tagggactgtgtgagggacttg

SEQ ID NO: 8583915 - DNA, 22 bp, Homo sapiens
tagggcagagcttgtacacgat

SEQ ID NO: 8583916 - DNA, 22 bp, Homo sapiens
tatgtcttttgcttgcaaatag

SEQ ID NO: 8583917 - DNA, 22 bp, Homo sapiens
tatgtctttgtcccactcccag

SEQ ID NO: 8583918 - DNA, 22 bp, Homo sapiens
tatgtgtctttatctggctctt

SEQ ID NO: 8583919 - DNA, 21 bp, Homo sapiens
tatgtgtctgtggaaaactag

SEQ ID NO: 8583920 - DNA, 18 bp, Homo sapiens
tatgtgtctgttacaact

SEQ ID NO: 8583921 - DNA, 22 bp, Homo sapiens
tatgtgtcctgttaccggcagc

SEQ ID NO: 8583922 - DNA, 22 bp, Homo sapiens
tatgtgtctcagttgtgattga

SEQ ID NO: 8583923 - DNA, 16 bp, Homo sapiens
tatgtgtctcatctac

SEQ ID NO: 8583924 - DNA, 22 bp, Homo sapiens
tatgtgtctgtcgtgcataaat

SEQ ID NO: 8583925 - DNA, 22 bp, Homo sapiens
tattacagttcgagtttctagg

SEQ ID NO: 8583926 - DNA, 22 bp, Homo sapiens
tattctgtgtgatatgtaaatg

SEQ ID NO: 8583927 - DNA, 22 bp, Homo sapiens
tattcaaagtaccttcattgcc

SEQ ID NO: 8583928 - DNA, 22 bp, Homo sapiens
tattattgacatttacttggtg

SEQ ID NO: 8583929 - DNA, 22 bp, Homo sapiens
tatttattcattcagcaagcat

SEQ ID NO: 8583930 - DNA, 22 bp, Homo sapiens
tatttattggacagtgttgctg

SEQ ID NO: 8583931 - DNA, 22 bp, Homo sapiens
tatttattctttgtactgcctt

SEQ ID NO: 8583932 - DNA, 22 bp, Homo sapiens
tatttattggacagtgttgctg

SEQ ID NO: 8583933 - DNA, 21 bp, Homo sapiens
tatttattaatttgtaaggct

SEQ ID NO: 8583934 - DNA, 22 bp, Homo sapiens
taggtgtcttgtgtatggtaca

SEQ ID NO: 8583935 - DNA, 22 bp, Homo sapiens
taggtgtctttctgtccttgtt

SEQ ID NO: 8583936 - DNA, 22 bp, Homo sapiens
taggtcccagcatcttctgagc

SEQ ID NO: 8583937 - DNA, 22 bp, Homo sapiens
taggtgaggttacaagagttca

SEQ ID NO: 8583938 - DNA, 22 bp, Homo sapiens
taggtgagggagcattgtgaga

SEQ ID NO: 8583939 - DNA, 20 bp, Homo sapiens
taggtgagggcagatagagg

SEQ ID NO: 8583940 - DNA, 22 bp, Homo sapiens
tagggcagagcttgtacacgat

SEQ ID NO: 8583941 - DNA, 22 bp, Homo sapiens
taggtgtctgctcttatttaac

SEQ ID NO: 8583942 - DNA, 23 bp, Homo sapiens
taggtgtctagtgtccactatgt

SEQ ID NO: 8583943 - DNA, 22 bp, Homo sapiens
taggtgtcttgtcactaccgtt

SEQ ID NO: 8583944 - DNA, 22 bp, Homo sapiens
taggtgtctggacaactttgta

SEQ ID NO: 8583945 - DNA, 22 bp, Homo sapiens
taggtgtctgtcctgggctgtg

SEQ ID NO: 8583946 - DNA, 22 bp, Homo sapiens
taggtgtcaggcctcctccagc

SEQ ID NO: 8583947 - DNA, 22 bp, Homo sapiens
taggtgtcaggtatagaattta

SEQ ID NO: 8583948 - DNA, 22 bp, Homo sapiens
taggtgtccatatatgtgtgta

SEQ ID NO: 8583949 - DNA, 19 bp, Homo sapiens
taggtgtccgccggaggtg

SEQ ID NO: 8583950 - DNA, 22 bp, Homo sapiens
taggtgtcctcgtccaaagatt

SEQ ID NO: 8583951 - DNA, 22 bp, Homo sapiens
taggtgtctaacaataagtgta

SEQ ID NO: 8583952 - DNA, 22 bp, Homo sapiens
taggtgagtttggggaagatag

SEQ ID NO: 8583953 - DNA, 22 bp, Homo sapiens
taggtggtagagcctggcttgc

SEQ ID NO: 8583954 - DNA, 22 bp, Homo sapiens
taggtggttataaattcaaggc

SEQ ID NO: 8583955 - DNA, 22 bp, Homo sapiens
taggtggtgggatatgagcatc

SEQ ID NO: 8583956 - DNA, 22 bp, Homo sapiens
taggtggtgtgcgaagagcgtg

SEQ ID NO: 8583957 - DNA, 22 bp, Homo sapiens
taggtggttgtctgctttccta

SEQ ID NO: 8583958 - DNA, 22 bp, Homo sapiens
taggtggttatgtcagcctaga

SEQ ID NO: 8583959 - DNA, 17 bp, Homo sapiens
taggtggttgctggtct

SEQ ID NO: 8583960 - DNA, 22 bp, Homo sapiens
tataatttggggaaagtggtgt

SEQ ID NO: 8583961 - DNA, 22 bp, Homo sapiens
tatacacatgtgtgtattcata

SEQ ID NO: 8583962 - DNA, 22 bp, Homo sapiens
tatagcatctaggatgattgca

SEQ ID NO: 8583963 - DNA, 22 bp, Homo sapiens
tatagcatggctatattgttgc

SEQ ID NO: 8583964 - DNA, 22 bp, Homo sapiens
tatagcatatacagataagctg

SEQ ID NO: 8583965 - DNA, 22 bp, Homo sapiens
tatatcatggagattaacattc

SEQ ID NO: 8583966 - DNA, 22 bp, Homo sapiens
tatgacaccattttggtcagtg

SEQ ID NO: 8583967 - DNA, 22 bp, Homo sapiens
tatgacattatgtattacatgt

SEQ ID NO: 8583968 - DNA, 22 bp, Homo sapiens
tatgacattgctttttagaact

SEQ ID NO: 8583969 - DNA, 23 bp, Homo sapiens
tacattctgtatttttatagagt

SEQ ID NO: 8583970 - DNA, 22 bp, Homo sapiens
tacatatactgagtgatttgct

SEQ ID NO: 8583971 - DNA, 22 bp, Homo sapiens
tacaacaggaatttcaactttg

SEQ ID NO: 8583972 - DNA, 22 bp, Homo sapiens
tacaacaatttccacattagaa

SEQ ID NO: 8583973 - DNA, 22 bp, Homo sapiens
tacagaaaaacatctggagccg

SEQ ID NO: 8583974 - DNA, 22 bp, Homo sapiens
tacagatacagatctagataca

SEQ ID NO: 8583975 - DNA, 22 bp, Homo sapiens
tacagcaataatgacaccgctc

SEQ ID NO: 8583976 - DNA, 22 bp, Homo sapiens
tacagcaatgcctgaaatagta

SEQ ID NO: 8583977 - DNA, 22 bp, Homo sapiens
tacagcaatgctacaagatgac

SEQ ID NO: 8583978 - DNA, 18 bp, Homo sapiens
tacagattatagatacat

SEQ ID NO: 8583979 - DNA, 22 bp, Homo sapiens
tacagattgaggtttttaatat

SEQ ID NO: 8583980 - DNA, 22 bp, Homo sapiens
tacagatatagagatttataga

SEQ ID NO: 8583981 - DNA, 22 bp, Homo sapiens
tacaaactgttattattattgt

SEQ ID NO: 8583982 - DNA, 22 bp, Homo sapiens
tacaaagaggtaattgcatata

SEQ ID NO: 8583983 - DNA, 22 bp, Homo sapiens
tacaaagagtttggtctctaga

SEQ ID NO: 8583984 - DNA, 20 bp, Homo sapiens
tacaaagaatgaggttcagg

SEQ ID NO: 8583985 - DNA, 22 bp, Homo sapiens
tacaaagatagtgttagagtaa

SEQ ID NO: 8583986 - DNA, 22 bp, Homo sapiens
tacaaagtagaaattcagtaaa

SEQ ID NO: 8583987 - DNA, 22 bp, Homo sapiens
taatagctgttattgttataac

SEQ ID NO: 8583988 - DNA, 22 bp, Homo sapiens
taaagtcaaggtactgtttcac

SEQ ID NO: 8583989 - DNA, 22 bp, Homo sapiens
gttttggtaagaatagtcatcc

SEQ ID NO: 8583990 - DNA, 22 bp, Homo sapiens
gttttggtaggactgtaaaaga

SEQ ID NO: 8583991 - DNA, 22 bp, Homo sapiens
gttttggtaggaaaagctaata

SEQ ID NO: 8583992 - DNA, 22 bp, Homo sapiens
gtttttatctaatagcagttat

SEQ ID NO: 8583993 - DNA, 22 bp, Homo sapiens
gtttttatatcctgtggagtgt

SEQ ID NO: 8583994 - DNA, 22 bp, Homo sapiens
gtttttattgtgtaaatgtggg

SEQ ID NO: 8583995 - DNA, 22 bp, Homo sapiens
taaaatgtttgcaagagaccag

SEQ ID NO: 8583996 - DNA, 22 bp, Homo sapiens
taaacactcacttcatagccat

SEQ ID NO: 8583997 - DNA, 22 bp, Homo sapiens
gtgtggctgattgacatggtca

SEQ ID NO: 8583998 - DNA, 22 bp, Homo sapiens
gtgctctaaggcaccactgagc

SEQ ID NO: 8583999 - DNA, 22 bp, Homo sapiens
gtgctctacatgctccatgttt

SEQ ID NO: 8584000 - DNA, 22 bp, Homo sapiens
gtgctctagaaattgtcagtgg

SEQ ID NO: 8584001 - DNA, 22 bp, Homo sapiens
gtgctctagaaatagtcagtgg

SEQ ID NO: 8584002 - DNA, 22 bp, Homo sapiens
gtgctctaggggtcagtggtta

SEQ ID NO: 8584003 - DNA, 22 bp, Homo sapiens
gtgctctaggctacagggatgc

SEQ ID NO: 8584004 - DNA, 22 bp, Homo sapiens
gtgctctgcctggggtcatggc

SEQ ID NO: 8584005 - DNA, 22 bp, Homo sapiens
gtgctctggccaagcgcgtgcg

SEQ ID NO: 8584006 - DNA, 23 bp, Homo sapiens
gtgctctgcggtctgctagtctg

SEQ ID NO: 8584007 - DNA, 22 bp, Homo sapiens
gtgctcagcccggatgagatca

SEQ ID NO: 8584008 - DNA, 22 bp, Homo sapiens
gtgctctgtgtattaggatgtc

SEQ ID NO: 8584009 - DNA, 22 bp, Homo sapiens
gtgctctgtggattgagttgaa

SEQ ID NO: 8584010 - DNA, 21 bp, Homo sapiens
gtgctctgggcagcagagggc

SEQ ID NO: 8584011 - DNA, 22 bp, Homo sapiens
gttgcagatgtggaactcgtgc

SEQ ID NO: 8584012 - DNA, 20 bp, Homo sapiens
gttggtcactttgagcagga

SEQ ID NO: 8584013 - DNA, 22 bp, Homo sapiens
gttggtcaaggacagaggttca

SEQ ID NO: 8584014 - DNA, 22 bp, Homo sapiens
gttggtcaggatggtctcaaac

SEQ ID NO: 8584015 - DNA, 22 bp, Homo sapiens
gttggtcatatcattgaagctt

SEQ ID NO: 8584016 - DNA, 19 bp, Homo sapiens
gttggtcattctacacaac

SEQ ID NO: 8584017 - DNA, 22 bp, Homo sapiens
gttggggtccaatgaagcgagc

SEQ ID NO: 8584018 - DNA, 22 bp, Homo sapiens
gttggggtgctataaaaatgat

SEQ ID NO: 8584019 - DNA, 22 bp, Homo sapiens
gttgtacagacatgaaacttgc

SEQ ID NO: 8584020 - DNA, 22 bp, Homo sapiens
gtttcagagttagtgctggctg

SEQ ID NO: 8584021 - DNA, 22 bp, Homo sapiens
gtttcagaaatgttctcctgct

SEQ ID NO: 8584022 - DNA, 19 bp, Homo sapiens
tccagaagtccctgagcgg

SEQ ID NO: 8584023 - DNA, 22 bp, Homo sapiens
tccagacattttatagcagtct

SEQ ID NO: 8584024 - DNA, 19 bp, Homo sapiens
tccagaagtccctgagcgg

SEQ ID NO: 8584025 - DNA, 20 bp, Homo sapiens
tccagagagtggcaaagctc

SEQ ID NO: 8584026 - DNA, 22 bp, Homo sapiens
tccagagaggtttctccatgct

SEQ ID NO: 8584027 - DNA, 22 bp, Homo sapiens
tccagagcctgcgcactggctg

SEQ ID NO: 8584028 - DNA, 22 bp, Homo sapiens
tccagagcctatatgttcaact

SEQ ID NO: 8584029 - DNA, 22 bp, Homo sapiens
tccagagcctttccacccactt

SEQ ID NO: 8584030 - DNA, 22 bp, Homo sapiens
tccagagcctttctgcttgaca

SEQ ID NO: 8584031 - DNA, 22 bp, Homo sapiens
tccagagccttcgataagaaga

SEQ ID NO: 8584032 - DNA, 22 bp, Homo sapiens
tccagagcctggggtttgtaac

SEQ ID NO: 8584033 - DNA, 18 bp, Homo sapiens
tccagagctactgtggtg

SEQ ID NO: 8584034 - DNA, 22 bp, Homo sapiens
tccagagctaattcagcagctg

SEQ ID NO: 8584035 - DNA, 22 bp, Homo sapiens
tccagagctacttgctcaactt

SEQ ID NO: 8584036 - DNA, 23 bp, Homo sapiens
tccagagctcatgctctcaacca

SEQ ID NO: 8584037 - DNA, 22 bp, Homo sapiens
tccagagctacttgctcaactt

SEQ ID NO: 8584038 - DNA, 17 bp, Homo sapiens
tccagagcacagagctc

SEQ ID NO: 8584039 - DNA, 17 bp, Homo sapiens
tccagagcacagagctc

SEQ ID NO: 8584040 - DNA, 22 bp, Homo sapiens
tccagagcaaagtttgctaaca

SEQ ID NO: 8584041 - DNA, 22 bp, Homo sapiens
tccagagcaggtgtctacacag

SEQ ID NO: 8584042 - DNA, 18 bp, Homo sapiens
tccagagcagtctttggc

SEQ ID NO: 8584043 - DNA, 22 bp, Homo sapiens
tccagagcaggtggtcagaagg

SEQ ID NO: 8584044 - DNA, 22 bp, Homo sapiens
tccagagccccagtctagtggg

SEQ ID NO: 8584045 - DNA, 22 bp, Homo sapiens
tccagagccccaattcacctct

SEQ ID NO: 8584046 - DNA, 22 bp, Homo sapiens
tccagagcatgcagatcatcaa

SEQ ID NO: 8584047 - DNA, 22 bp, Homo sapiens
tccagagctgagggtcagtaga

SEQ ID NO: 8584048 - DNA, 22 bp, Homo sapiens
tccagagctgggtctgtgctca

SEQ ID NO: 8584049 - DNA, 22 bp, Homo sapiens
tccagagctgggtctgtgctca

SEQ ID NO: 8584050 - DNA, 22 bp, Homo sapiens
tccagagctgagcagtcattct

SEQ ID NO: 8584051 - DNA, 22 bp, Homo sapiens
tccagagctctgggcatagctg

SEQ ID NO: 8584052 - DNA, 22 bp, Homo sapiens
tccagagctctgggcatagctg

SEQ ID NO: 8584053 - DNA, 23 bp, Homo sapiens
tccagagctcatgctctcaacca

SEQ ID NO: 8584054 - DNA, 14 bp, Homo sapiens
tccagagctttccg

SEQ ID NO: 8584055 - DNA, 22 bp, Homo sapiens
tccagagctgtatgattttttt

SEQ ID NO: 8584056 - DNA, 18 bp, Homo sapiens
tccagagctggtgcttct

SEQ ID NO: 8584057 - DNA, 22 bp, Homo sapiens
tccagagctgtcctactgtgag

SEQ ID NO: 8584058 - DNA, 20 bp, Homo sapiens
tccagaggccacatccagtg

SEQ ID NO: 8584059 - DNA, 22 bp, Homo sapiens
tccagagggcgatggctggggg

SEQ ID NO: 8584060 - DNA, 22 bp, Homo sapiens
tccagaggggcagccctgtgct

SEQ ID NO: 8584061 - DNA, 23 bp, Homo sapiens
tccagcagagccttccaggaggg

SEQ ID NO: 8584062 - DNA, 23 bp, Homo sapiens
tccagcagagccttccaggaggg

SEQ ID NO: 8584063 - DNA, 22 bp, Homo sapiens
tccagcagagtctctgaggggg

SEQ ID NO: 8584064 - DNA, 23 bp, Homo sapiens
tccagcagccaagaagggtagaa

SEQ ID NO: 8584065 - DNA, 22 bp, Homo sapiens
tccagcagccacacctctggac

SEQ ID NO: 8584066 - DNA, 22 bp, Homo sapiens
tccagcagccacacctctggac

SEQ ID NO: 8584067 - DNA, 18 bp, Homo sapiens
tccagcaggtctgaggtg

SEQ ID NO: 8584068 - DNA, 18 bp, Homo sapiens
tccagcaggtctgaggtg

SEQ ID NO: 8584069 - DNA, 22 bp, Homo sapiens
tccagcaggttggtcaggtgca

SEQ ID NO: 8584070 - DNA, 22 bp, Homo sapiens
tccagcaggttggtcaggtgca

SEQ ID NO: 8584071 - DNA, 22 bp, Homo sapiens
tccagcagtccatgtgagacac

SEQ ID NO: 8584072 - DNA, 22 bp, Homo sapiens
tccagcagtgctctagagcgtg

SEQ ID NO: 8584073 - DNA, 22 bp, Homo sapiens
tccagcagtgctctagagcgtg

SEQ ID NO: 8584074 - DNA, 22 bp, Homo sapiens
tccagcattttgatacttgaaa

SEQ ID NO: 8584075 - DNA, 22 bp, Homo sapiens
tccagcctttctactcactgag

SEQ ID NO: 8584076 - DNA, 19 bp, Homo sapiens
tccaggaggctgccattga

SEQ ID NO: 8584077 - DNA, 22 bp, Homo sapiens
tccaggaggcctcatttcctgt

SEQ ID NO: 8584078 - DNA, 22 bp, Homo sapiens
tccaggaaacactcaagccatg

SEQ ID NO: 8584079 - DNA, 20 bp, Homo sapiens
tccagctgttgagatctgag

SEQ ID NO: 8584080 - DNA, 19 bp, Homo sapiens
tccagctgttttgagtcac

SEQ ID NO: 8584081 - DNA, 22 bp, Homo sapiens
tccagctcctgagttcactgct

SEQ ID NO: 8584082 - DNA, 22 bp, Homo sapiens
tccagctgtgctccaggaggtg

SEQ ID NO: 8584083 - DNA, 21 bp, Homo sapiens
tccagctgtgattatgaatgt

SEQ ID NO: 8584084 - DNA, 22 bp, Homo sapiens
tccagctgtactttgtcctggc

SEQ ID NO: 8584085 - DNA, 19 bp, Homo sapiens
tccagctggtatgcccaga

SEQ ID NO: 8584086 - DNA, 22 bp, Homo sapiens
tccagctggggccgaagtggat

SEQ ID NO: 8584087 - DNA, 22 bp, Homo sapiens
tccagctggggcagtggctggg

SEQ ID NO: 8584088 - DNA, 22 bp, Homo sapiens
tccagctggggacatgggcttc

SEQ ID NO: 8584089 - DNA, 22 bp, Homo sapiens
tccagggctacaaggcaccaga

SEQ ID NO: 8584090 - DNA, 22 bp, Homo sapiens
tccagtttatttttggcagggt

SEQ ID NO: 8584091 - DNA, 22 bp, Homo sapiens
tccagggctcattccctctgca

SEQ ID NO: 8584092 - DNA, 22 bp, Homo sapiens
tccagggccacagaggatgcta

SEQ ID NO: 8584093 - DNA, 22 bp, Homo sapiens
tccaggctggaaatgtcaaact

SEQ ID NO: 8584094 - DNA, 22 bp, Homo sapiens
tccaggctgccacagtgcaacg

SEQ ID NO: 8584095 - DNA, 22 bp, Homo sapiens
tccaggctgcagtcttgccctc

SEQ ID NO: 8584096 - DNA, 22 bp, Homo sapiens
tcccaaggccaggcatctagaa

SEQ ID NO: 8584097 - DNA, 22 bp, Homo sapiens
tccatgaggcagggaggctggc

SEQ ID NO: 8584098 - DNA, 22 bp, Homo sapiens
tccatgagggacactggatgct

SEQ ID NO: 8584099 - DNA, 22 bp, Homo sapiens
tccaggagtgataaggccactg

SEQ ID NO: 8584100 - DNA, 22 bp, Homo sapiens
tccaggagtggggcagaggtct

SEQ ID NO: 8584101 - DNA, 21 bp, Homo sapiens
tccaggagtggctgggcaggg

SEQ ID NO: 8584102 - DNA, 21 bp, Homo sapiens
tccaggagtggctgggcaggg

SEQ ID NO: 8584103 - DNA, 22 bp, Homo sapiens
tccaggagtttgacctgtgggc

SEQ ID NO: 8584104 - DNA, 22 bp, Homo sapiens
tccaggagtttgagactgcagt

SEQ ID NO: 8584105 - DNA, 22 bp, Homo sapiens
tccaggcagggcagccatcaag

SEQ ID NO: 8584106 - DNA, 22 bp, Homo sapiens
tccaggaggtatgagtggcccc

SEQ ID NO: 8584107 - DNA, 22 bp, Homo sapiens
tccaggaggtgaggggaccaaa

SEQ ID NO: 8584108 - DNA, 22 bp, Homo sapiens
tccaggaggttgagactgcagt

SEQ ID NO: 8584109 - DNA, 22 bp, Homo sapiens
tccaggagggttttctgccttc

SEQ ID NO: 8584110 - DNA, 22 bp, Homo sapiens
tccaggaggtagtgcttaattt

SEQ ID NO: 8584111 - DNA, 22 bp, Homo sapiens
tccaggaggggtaggcagtatg

SEQ ID NO: 8584112 - DNA, 22 bp, Homo sapiens
tccaggagggattgggctgtgg

SEQ ID NO: 8584113 - DNA, 22 bp, Homo sapiens
tccaggagggggagccgtgccg

SEQ ID NO: 8584114 - DNA, 22 bp, Homo sapiens
tccaggaggttgagtgagttcc

SEQ ID NO: 8584115 - DNA, 22 bp, Homo sapiens
tccaggaggtttggaggaagca

SEQ ID NO: 8584116 - DNA, 22 bp, Homo sapiens
tccaggagtcctgggagtgatt

SEQ ID NO: 8584117 - DNA, 22 bp, Homo sapiens
tccaggagtcagacagatggtg

SEQ ID NO: 8584118 - DNA, 22 bp, Homo sapiens
tccaggagtcctgggtggcccc

SEQ ID NO: 8584119 - DNA, 22 bp, Homo sapiens
tccaggagtctagcctcaggcc

SEQ ID NO: 8584120 - DNA, 22 bp, Homo sapiens
tccaggagtctagcctcaggcc

SEQ ID NO: 8584121 - DNA, 22 bp, Homo sapiens
tccaggccacgacctcctggat

SEQ ID NO: 8584122 - DNA, 22 bp, Homo sapiens
tccaggctaggtttacaggaca

SEQ ID NO: 8584123 - DNA, 22 bp, Homo sapiens
tccaggctcagcacttgctact

SEQ ID NO: 8584124 - DNA, 22 bp, Homo sapiens
tccaggctctcaggtgtcagca

SEQ ID NO: 8584125 - DNA, 22 bp, Homo sapiens
tccaggctctaggctgctctcc

SEQ ID NO: 8584126 - DNA, 19 bp, Homo sapiens
tccaggctgagagtcagct

SEQ ID NO: 8584127 - DNA, 22 bp, Homo sapiens
tccaggctgacgcagctattta

SEQ ID NO: 8584128 - DNA, 23 bp, Homo sapiens
tccaggctgaaggagcagatttt

SEQ ID NO: 8584129 - DNA, 21 bp, Homo sapiens
tccaggctgatgatgtcaact

SEQ ID NO: 8584130 - DNA, 22 bp, Homo sapiens
tccaggctgcaaggccacaggg

SEQ ID NO: 8584131 - DNA, 22 bp, Homo sapiens
tccaggctgatccatgaagaat

SEQ ID NO: 8584132 - DNA, 22 bp, Homo sapiens
tcccagggttacagccagggca

SEQ ID NO: 8584133 - DNA, 22 bp, Homo sapiens
tcccagggtgcgcctgccctcg

SEQ ID NO: 8584134 - DNA, 22 bp, Homo sapiens
tcccacaggagcctgagtccca

SEQ ID NO: 8584135 - DNA, 22 bp, Homo sapiens
tcccacagtctcacaatgcata

SEQ ID NO: 8584136 - DNA, 22 bp, Homo sapiens
tcacccaggctggactgcagtg

SEQ ID NO: 8584137 - DNA, 22 bp, Homo sapiens
tcacccaggctggagtgcagtg

SEQ ID NO: 8584138 - DNA, 22 bp, Homo sapiens
tcactgaatttcaagctagtgg

SEQ ID NO: 8584139 - DNA, 22 bp, Homo sapiens
tcagcaagcagggggatgttca

SEQ ID NO: 8584140 - DNA, 22 bp, Homo sapiens
tcagagaaggcaattttatggt

SEQ ID NO: 8584141 - DNA, 22 bp, Homo sapiens
tcagagaggttaaatatcttgt

SEQ ID NO: 8584142 - DNA, 22 bp, Homo sapiens
tcagagcattcgggtgacaaat

SEQ ID NO: 8584143 - DNA, 22 bp, Homo sapiens
tcagagctgggtgcttcttcct

SEQ ID NO: 8584144 - DNA, 20 bp, Homo sapiens
tcagagaaggagctttcctg

SEQ ID NO: 8584145 - DNA, 22 bp, Homo sapiens
tcagagaagctgccaggcgagc

SEQ ID NO: 8584146 - DNA, 22 bp, Homo sapiens
tcagagaagcttaagctgtaat

SEQ ID NO: 8584147 - DNA, 22 bp, Homo sapiens
tcagagaaggctgagtcacggc

SEQ ID NO: 8584148 - DNA, 22 bp, Homo sapiens
tcagagaaggaggcacgagggc

SEQ ID NO: 8584149 - DNA, 22 bp, Homo sapiens
tcagagaactgcagcccttcct

SEQ ID NO: 8584150 - DNA, 22 bp, Homo sapiens
tcagagaagacatcattgtgaa

SEQ ID NO: 8584151 - DNA, 23 bp, Homo sapiens
tcagagaactcgggcagatgacc

SEQ ID NO: 8584152 - DNA, 22 bp, Homo sapiens
tcagagaactccacaccttagg

SEQ ID NO: 8584153 - DNA, 22 bp, Homo sapiens
tcagacagtgtgatcagtctct

SEQ ID NO: 8584154 - DNA, 22 bp, Homo sapiens
tcagacagtttgcagtgtgcct

SEQ ID NO: 8584155 - DNA, 22 bp, Homo sapiens
tcagacagcttgggataactga

SEQ ID NO: 8584156 - DNA, 22 bp, Homo sapiens
tcagacaggcctctccagcctc

SEQ ID NO: 8584157 - DNA, 22 bp, Homo sapiens
tcagacagattttgacacttgc

SEQ ID NO: 8584158 - DNA, 22 bp, Homo sapiens
tcagacagcttgcagggaggtg

SEQ ID NO: 8584159 - DNA, 22 bp, Homo sapiens
tcagacagtcatcagagcttgt

SEQ ID NO: 8584160 - DNA, 20 bp, Homo sapiens
tcagacagtcgcagttctgg

SEQ ID NO: 8584161 - DNA, 22 bp, Homo sapiens
tcagacagtcatcagagcttgt

SEQ ID NO: 8584162 - DNA, 22 bp, Homo sapiens
tcagacagggagtcagaaaata

SEQ ID NO: 8584163 - DNA, 22 bp, Homo sapiens
tcagacagggcttctcaaactt

SEQ ID NO: 8584164 - DNA, 22 bp, Homo sapiens
tcagacaggcttctttctccct

SEQ ID NO: 8584165 - DNA, 22 bp, Homo sapiens
tcagacaggctggacagcttgc

SEQ ID NO: 8584166 - DNA, 22 bp, Homo sapiens
tcagaaaagactcaggggctga

SEQ ID NO: 8584167 - DNA, 22 bp, Homo sapiens
tcagaaaagaccacattattct

SEQ ID NO: 8584168 - DNA, 22 bp, Homo sapiens
tcaataatggcaggataaattt

SEQ ID NO: 8584169 - DNA, 22 bp, Homo sapiens
tcaaggctattaattctgtgag

SEQ ID NO: 8584170 - DNA, 22 bp, Homo sapiens
tcacagctcactgtagcctcga

SEQ ID NO: 8584171 - DNA, 22 bp, Homo sapiens
tcacaaaagcttttgaatttgg

SEQ ID NO: 8584172 - DNA, 22 bp, Homo sapiens
tcacaagagctggactgtcttt

SEQ ID NO: 8584173 - DNA, 22 bp, Homo sapiens
tcacaagagtaagttcatgcct

SEQ ID NO: 8584174 - DNA, 22 bp, Homo sapiens
tcacaagatatttcagtccttt

SEQ ID NO: 8584175 - DNA, 22 bp, Homo sapiens
tcacaagataaacatagctcca

SEQ ID NO: 8584176 - DNA, 22 bp, Homo sapiens
tcacaagatacagttagaagca

SEQ ID NO: 8584177 - DNA, 22 bp, Homo sapiens
tcattattttggactggagtgt

SEQ ID NO: 8584178 - DNA, 22 bp, Homo sapiens
tcattatttgctttagttatgt

SEQ ID NO: 8584179 - DNA, 22 bp, Homo sapiens
tcagtgttacattatatagaac

SEQ ID NO: 8584180 - DNA, 22 bp, Homo sapiens
tcatatactgccttgtagatta

SEQ ID NO: 8584181 - DNA, 22 bp, Homo sapiens
tcagtgttaatcagtggtacct

SEQ ID NO: 8584182 - DNA, 22 bp, Homo sapiens
tcaggtgtcaagcagggagctg

SEQ ID NO: 8584183 - DNA, 22 bp, Homo sapiens
tcaggtggccaaatgggagcgc

SEQ ID NO: 8584184 - DNA, 21 bp, Homo sapiens
tcaggtggcagagtgtttatg

SEQ ID NO: 8584185 - DNA, 22 bp, Homo sapiens
tcagggaataagtagatgagtg

SEQ ID NO: 8584186 - DNA, 22 bp, Homo sapiens
tcaggtgttagaagaaatttca

SEQ ID NO: 8584187 - DNA, 22 bp, Homo sapiens
tcaggtgtgttgtattttacca

SEQ ID NO: 8584188 - DNA, 22 bp, Homo sapiens
tcaggtgttctccactcagttt

SEQ ID NO: 8584189 - DNA, 22 bp, Homo sapiens
tcaggtgtttaaggatagtgat

SEQ ID NO: 8584190 - DNA, 22 bp, Homo sapiens
tcaggtgtgtggctctggacca

SEQ ID NO: 8584191 - DNA, 22 bp, Homo sapiens
tcaggtgtgtggtggaaggcag

SEQ ID NO: 8584192 - DNA, 22 bp, Homo sapiens
tcaggtgtggtcaccacagggt

SEQ ID NO: 8584193 - DNA, 22 bp, Homo sapiens
tcaggtgtctgcctctttgagt

SEQ ID NO: 8584194 - DNA, 22 bp, Homo sapiens
tcaggtgtctatctaacctggt

SEQ ID NO: 8584195 - DNA, 22 bp, Homo sapiens
tcaggtgtgaactatttggaaa

SEQ ID NO: 8584196 - DNA, 22 bp, Homo sapiens
tcaggtgtcttgtgggatttta

SEQ ID NO: 8584197 - DNA, 23 bp, Homo sapiens
tcaggtgtgcggactgctgagtc

SEQ ID NO: 8584198 - DNA, 16 bp, Homo sapiens
tcaggtgtgacttttt

SEQ ID NO: 8584199 - DNA, 22 bp, Homo sapiens
tcaggtgtggaccgaggtcaga

SEQ ID NO: 8584200 - DNA, 22 bp, Homo sapiens
tcaggtgtgggcagagaaacca

SEQ ID NO: 8584201 - DNA, 18 bp, Homo sapiens
tcaggtgttttctgtata

SEQ ID NO: 8584202 - DNA, 22 bp, Homo sapiens
tcaggtgtttctggagaagtaa

SEQ ID NO: 8584203 - DNA, 18 bp, Homo sapiens
tcagcctgttgtctgcct

SEQ ID NO: 8584204 - DNA, 18 bp, Homo sapiens
tcagcctgttgtctgcct

SEQ ID NO: 8584205 - DNA, 22 bp, Homo sapiens
tcagcctggtgattcctctgtc

SEQ ID NO: 8584206 - DNA, 22 bp, Homo sapiens
tcagcctggcaggatggcctgg

SEQ ID NO: 8584207 - DNA, 21 bp, Homo sapiens
tcagcaggcaccagaaggctg

SEQ ID NO: 8584208 - DNA, 22 bp, Homo sapiens
tcagcaggcacggacaggctgc

SEQ ID NO: 8584209 - DNA, 22 bp, Homo sapiens
tcagcctgctccaagtgctgcc

SEQ ID NO: 8584210 - DNA, 22 bp, Homo sapiens
tcagcagaagtatagaggccat

SEQ ID NO: 8584211 - DNA, 22 bp, Homo sapiens
tcagcagaagtatagaggccat

SEQ ID NO: 8584212 - DNA, 22 bp, Homo sapiens
tcaggagtcctgcctgcagcct

SEQ ID NO: 8584213 - DNA, 22 bp, Homo sapiens
tcaggagtactggtgtctacag

SEQ ID NO: 8584214 - DNA, 17 bp, Homo sapiens
tcaggaggtgtttctag

SEQ ID NO: 8584215 - DNA, 22 bp, Homo sapiens
tcaggaggtttggattcagtta

SEQ ID NO: 8584216 - DNA, 22 bp, Homo sapiens
tcaggaggttgaccacggggca

SEQ ID NO: 8584217 - DNA, 22 bp, Homo sapiens
tcaggaggtgtaacgaatacag

SEQ ID NO: 8584218 - DNA, 22 bp, Homo sapiens
tcaggaagggctcagtctgtgc

SEQ ID NO: 8584219 - DNA, 22 bp, Homo sapiens
tcaggaggtgtaggtcaagtga

SEQ ID NO: 8584220 - DNA, 22 bp, Homo sapiens
tcaggaaggcacttggtgtgtt

SEQ ID NO: 8584221 - DNA, 22 bp, Homo sapiens
tcaggaaggcttcacacgagtg

SEQ ID NO: 8584222 - DNA, 22 bp, Homo sapiens
tcaggaaggcttcacacgagtg

SEQ ID NO: 8584223 - DNA, 22 bp, Homo sapiens
tcaggaaggcgccccatcagga

SEQ ID NO: 8584224 - DNA, 22 bp, Homo sapiens
tcaggaaggcgccccatcagga

SEQ ID NO: 8584225 - DNA, 22 bp, Homo sapiens
tcaggaagctgaattacaaaaa

SEQ ID NO: 8584226 - DNA, 22 bp, Homo sapiens
tcaggaagctgctctgggtggt

SEQ ID NO: 8584227 - DNA, 22 bp, Homo sapiens
tcaggaagctgctctgggtggt

SEQ ID NO: 8584228 - DNA, 22 bp, Homo sapiens
tcaggaaggcaaattgcatgat

SEQ ID NO: 8584229 - DNA, 22 bp, Homo sapiens
tcaggaaggagctggcctgcca

SEQ ID NO: 8584230 - DNA, 22 bp, Homo sapiens
tcaggaagctactgccagcagc

SEQ ID NO: 8584231 - DNA, 22 bp, Homo sapiens
tcaggaagctactgccagcagc

SEQ ID NO: 8584232 - DNA, 22 bp, Homo sapiens
tcaggaagctcttgctgattct

SEQ ID NO: 8584233 - DNA, 22 bp, Homo sapiens
tcaggaagccggttaaatagat

SEQ ID NO: 8584234 - DNA, 22 bp, Homo sapiens
tcaggaagccactccacagaga

SEQ ID NO: 8584235 - DNA, 22 bp, Homo sapiens
tcaggaagccactccacagaga

SEQ ID NO: 8584236 - DNA, 21 bp, Homo sapiens
tcaggaagagccagttcatgc

SEQ ID NO: 8584237 - DNA, 21 bp, Homo sapiens
tcaggaagagccagttcatgc

SEQ ID NO: 8584238 - DNA, 21 bp, Homo sapiens
tcaggaagagcttctcccact

SEQ ID NO: 8584239 - DNA, 22 bp, Homo sapiens
tcaggaagattagtttcctacc

SEQ ID NO: 8584240 - DNA, 22 bp, Homo sapiens
tcaggaagcatcctgaggtgtc

SEQ ID NO: 8584241 - DNA, 22 bp, Homo sapiens
tcaggaagcatcctgaggtgtc

SEQ ID NO: 8584242 - DNA, 22 bp, Homo sapiens
tcaggaagacaatctttggctc

SEQ ID NO: 8584243 - DNA, 22 bp, Homo sapiens
tcaggaagaagacggggcagga

SEQ ID NO: 8584244 - DNA, 22 bp, Homo sapiens
tcaggaagaaattctgtatctt

SEQ ID NO: 8584245 - DNA, 22 bp, Homo sapiens
tcaggaagaaagaagggagtgt

SEQ ID NO: 8584246 - DNA, 22 bp, Homo sapiens
tcaggaagaaagaagggagtgt

SEQ ID NO: 8584247 - DNA, 22 bp, Homo sapiens
tcaggctggagtgcagtggcgc

SEQ ID NO: 8584248 - DNA, 22 bp, Homo sapiens
tcaggctggaatgcagtggggc

SEQ ID NO: 8584249 - DNA, 22 bp, Homo sapiens
tcaggatggtgtggaggaaata

SEQ ID NO: 8584250 - DNA, 22 bp, Homo sapiens
tcaggatgaccacgagcctcta

SEQ ID NO: 8584251 - DNA, 22 bp, Homo sapiens
tcaggagtttggcctacagagg

SEQ ID NO: 8584252 - DNA, 22 bp, Homo sapiens
tcaggccacggctcactgagac

SEQ ID NO: 8584253 - DNA, 22 bp, Homo sapiens
tcaggccaggagatcagattga

SEQ ID NO: 8584254 - DNA, 22 bp, Homo sapiens
tcaggcattgtgcagagccttg

SEQ ID NO: 8584255 - DNA, 20 bp, Homo sapiens
tcaggcagtggggaaaggca

SEQ ID NO: 8584256 - DNA, 22 bp, Homo sapiens
gcagagaacccagcagattggc

SEQ ID NO: 8584257 - DNA, 22 bp, Homo sapiens
gcagagaagatgcccaggcttc

SEQ ID NO: 8584258 - DNA, 22 bp, Homo sapiens
gcagagaagatgcccaggcttc

SEQ ID NO: 8584259 - DNA, 22 bp, Homo sapiens
gcagagaaagttttgtcctcag

SEQ ID NO: 8584260 - DNA, 22 bp, Homo sapiens
gcagagaaagttttgtcctcag

SEQ ID NO: 8584261 - DNA, 22 bp, Homo sapiens
gcagacatgtgttctaacagga

SEQ ID NO: 8584262 - DNA, 19 bp, Homo sapiens
gcagacaggtccagagagg

SEQ ID NO: 8584263 - DNA, 19 bp, Homo sapiens
gcagacaggtccagagagg

SEQ ID NO: 8584264 - DNA, 22 bp, Homo sapiens
gcacagtggagtgtgtccaggg

SEQ ID NO: 8584265 - DNA, 22 bp, Homo sapiens
gcacagtggtgaaagcatgggt

SEQ ID NO: 8584266 - DNA, 22 bp, Homo sapiens
gcagagcagaggtgcaggttgg

SEQ ID NO: 8584267 - DNA, 20 bp, Homo sapiens
gcagagtgtgagagggtgaa

SEQ ID NO: 8584268 - DNA, 22 bp, Homo sapiens
gcagatggagacgaggttccgc

SEQ ID NO: 8584269 - DNA, 22 bp, Homo sapiens
gcagaggtctagcaccaagaat

SEQ ID NO: 8584270 - DNA, 22 bp, Homo sapiens
gcagaggtgaccagcagcaggg

SEQ ID NO: 8584271 - DNA, 22 bp, Homo sapiens
gcagaggtcaaatacctcattt

SEQ ID NO: 8584272 - DNA, 22 bp, Homo sapiens
gcagagggtcctgtgccagcag

SEQ ID NO: 8584273 - DNA, 18 bp, Homo sapiens
gcaaagacaggctgggct

SEQ ID NO: 8584274 - DNA, 22 bp, Homo sapiens
gcaaagacggactcaggagtgc

SEQ ID NO: 8584275 - DNA, 22 bp, Homo sapiens
gaggccaggaggatctctctaa

SEQ ID NO: 8584276 - DNA, 22 bp, Homo sapiens
gaggccagtgaaatgttataaa

SEQ ID NO: 8584277 - DNA, 22 bp, Homo sapiens
gaggccagtgtgctgtgttttc

SEQ ID NO: 8584278 - DNA, 22 bp, Homo sapiens
gcaaaggtagccaaggagctca

SEQ ID NO: 8584279 - DNA, 17 bp, Homo sapiens
gcaaaggtgaggagaga

SEQ ID NO: 8584280 - DNA, 22 bp, Homo sapiens
gcacactgcggtgatgtgagtc

SEQ ID NO: 8584281 - DNA, 22 bp, Homo sapiens
gcacaggctccggaggagagct

SEQ ID NO: 8584282 - DNA, 22 bp, Homo sapiens
gcacacagtactatatgctaca

SEQ ID NO: 8584283 - DNA, 22 bp, Homo sapiens
gcagatggctgagcctgcagat

SEQ ID NO: 8584284 - DNA, 22 bp, Homo sapiens
gcagatggatcacctgaggtcg

SEQ ID NO: 8584285 - DNA, 22 bp, Homo sapiens
gcagctttctgggacagaaagg

SEQ ID NO: 8584286 - DNA, 22 bp, Homo sapiens
gcagctttggaggtggaactct

SEQ ID NO: 8584287 - DNA, 22 bp, Homo sapiens
gcagctttgtaaagtatgaagc

SEQ ID NO: 8584288 - DNA, 22 bp, Homo sapiens
gcagctttctacttcctacagc

SEQ ID NO: 8584289 - DNA, 22 bp, Homo sapiens
gcagctttttggatgtcagtta

SEQ ID NO: 8584290 - DNA, 22 bp, Homo sapiens
gcagctttgtcacggagtgtcg

SEQ ID NO: 8584291 - DNA, 18 bp, Homo sapiens
gcagcttttgattcaccc

SEQ ID NO: 8584292 - DNA, 22 bp, Homo sapiens
gcaggaactggagctggatgtt

SEQ ID NO: 8584293 - DNA, 22 bp, Homo sapiens
gcaggaagaggctcgaagcccc

SEQ ID NO: 8584294 - DNA, 22 bp, Homo sapiens
gcaggaagatgagctcaggtaa

SEQ ID NO: 8584295 - DNA, 22 bp, Homo sapiens
gcaggaagaggctcgaagcccc

SEQ ID NO: 8584296 - DNA, 22 bp, Homo sapiens
gcaggaagatgagctcaggtaa

SEQ ID NO: 8584297 - DNA, 22 bp, Homo sapiens
gcaggaagcatagaagaatgcc

SEQ ID NO: 8584298 - DNA, 22 bp, Homo sapiens
gcaggaagcatagaagaatgcc

SEQ ID NO: 8584299 - DNA, 22 bp, Homo sapiens
gcaggaagccttaccaagccca

SEQ ID NO: 8584300 - DNA, 22 bp, Homo sapiens
gcaggaagggaaaggttgactc

SEQ ID NO: 8584301 - DNA, 22 bp, Homo sapiens
gcaggacacagatgcaaggcca

SEQ ID NO: 8584302 - DNA, 22 bp, Homo sapiens
gcagggacaactgtgcacctga

SEQ ID NO: 8584303 - DNA, 22 bp, Homo sapiens
gcagggacaaggcaggtgttct

SEQ ID NO: 8584304 - DNA, 22 bp, Homo sapiens
gcagggacaaggcaggtgttct

SEQ ID NO: 8584305 - DNA, 22 bp, Homo sapiens
gcagggacatctttgtctagta

SEQ ID NO: 8584306 - DNA, 22 bp, Homo sapiens
gcagggacagggcagggccttt

SEQ ID NO: 8584307 - DNA, 22 bp, Homo sapiens
gcagggacagggcagggccttt

SEQ ID NO: 8584308 - DNA, 22 bp, Homo sapiens
gcagggaccaaaagaggcagta

SEQ ID NO: 8584309 - DNA, 22 bp, Homo sapiens
gcagggaccaaaagaggcagta

SEQ ID NO: 8584310 - DNA, 22 bp, Homo sapiens
gcagggacctgccactgctgtc

SEQ ID NO: 8584311 - DNA, 22 bp, Homo sapiens
gcagggctgttcaggagggtgg

SEQ ID NO: 8584312 - DNA, 22 bp, Homo sapiens
gccagcctgtgcttggccaggc

SEQ ID NO: 8584313 - DNA, 22 bp, Homo sapiens
gccagcctgtgggggctctgtg

SEQ ID NO: 8584314 - DNA, 23 bp, Homo sapiens
gccagccttgctctcctgcagcc

SEQ ID NO: 8584315 - DNA, 21 bp, Homo sapiens
gccagcctgtttacctgtggt

SEQ ID NO: 8584316 - DNA, 22 bp, Homo sapiens
gccagccttctgtggcctgcaa

SEQ ID NO: 8584317 - DNA, 22 bp, Homo sapiens
gccagctgaaatttcagttctg

SEQ ID NO: 8584318 - DNA, 22 bp, Homo sapiens
gccagctgaagccctggtggaa

SEQ ID NO: 8584319 - DNA, 22 bp, Homo sapiens
gccagctgaagccctggtggaa

SEQ ID NO: 8584320 - DNA, 22 bp, Homo sapiens
gccagctgaagccctggtggaa

SEQ ID NO: 8584321 - DNA, 22 bp, Homo sapiens
gccagctgaatttccaactgtt

SEQ ID NO: 8584322 - DNA, 22 bp, Homo sapiens
gccaggcagagccccgtgcagc

SEQ ID NO: 8584323 - DNA, 21 bp, Homo sapiens
gccagggaagagagttggctg

SEQ ID NO: 8584324 - DNA, 22 bp, Homo sapiens
gccaggcagatatgtgagctta

SEQ ID NO: 8584325 - DNA, 22 bp, Homo sapiens
gccaggcagccaccctctgcga

SEQ ID NO: 8584326 - DNA, 22 bp, Homo sapiens
gccaggcagcaggaagccagtg

SEQ ID NO: 8584327 - DNA, 22 bp, Homo sapiens
gccaggcagcagcgaggatggt

SEQ ID NO: 8584328 - DNA, 22 bp, Homo sapiens
gccaggcaggccacgctgtgtt

SEQ ID NO: 8584329 - DNA, 22 bp, Homo sapiens
gccacaggcttaggagggaggt

SEQ ID NO: 8584330 - DNA, 22 bp, Homo sapiens
gcagtgggaaggttggcacatg

SEQ ID NO: 8584331 - DNA, 22 bp, Homo sapiens
gcagtggccacatggaggagga

SEQ ID NO: 8584332 - DNA, 22 bp, Homo sapiens
gcagtggccacatggaggagga

SEQ ID NO: 8584333 - DNA, 22 bp, Homo sapiens
gcagtgggagcttaggcagtgc

SEQ ID NO: 8584334 - DNA, 22 bp, Homo sapiens
gcccaggagcctggagatgtgt

SEQ ID NO: 8584335 - DNA, 22 bp, Homo sapiens
gcccaggagaggccagggctga

SEQ ID NO: 8584336 - DNA, 22 bp, Homo sapiens
gcccaggactcagggtgtcgcg

SEQ ID NO: 8584337 - DNA, 22 bp, Homo sapiens
gcccaggactcagggtgtcgcg

SEQ ID NO: 8584338 - DNA, 22 bp, Homo sapiens
gcccaggagaggccagggctga

SEQ ID NO: 8584339 - DNA, 22 bp, Homo sapiens
gcccaggaaagatagggcctca

SEQ ID NO: 8584340 - DNA, 22 bp, Homo sapiens
gcccaggaaataaaagtgggct

SEQ ID NO: 8584341 - DNA, 22 bp, Homo sapiens
gcccaggaaataaaagtgggct

SEQ ID NO: 8584342 - DNA, 22 bp, Homo sapiens
gcccaggaaatgccccgtggtg

SEQ ID NO: 8584343 - DNA, 20 bp, Homo sapiens
gcccaggaatttgcatttct

SEQ ID NO: 8584344 - DNA, 16 bp, Homo sapiens
gcccaggacgggaggc

SEQ ID NO: 8584345 - DNA, 16 bp, Homo sapiens
gcccaggacgggaggc

SEQ ID NO: 8584346 - DNA, 22 bp, Homo sapiens
gcccaggaagttgaggctgccg

SEQ ID NO: 8584347 - DNA, 22 bp, Homo sapiens
gcccaggaagttgaggctgccg

SEQ ID NO: 8584348 - DNA, 22 bp, Homo sapiens
gcccaggaagtgactcagatgt

SEQ ID NO: 8584349 - DNA, 17 bp, Homo sapiens
gcccaggaaggacggcc

SEQ ID NO: 8584350 - DNA, 22 bp, Homo sapiens
gcccaggaagccaccgggaagt

SEQ ID NO: 8584351 - DNA, 22 bp, Homo sapiens
gcccaggaagccaccgggaagt

SEQ ID NO: 8584352 - DNA, 22 bp, Homo sapiens
gcccaggaagtgactcagatgt

SEQ ID NO: 8584353 - DNA, 17 bp, Homo sapiens
gcccaggaaggacggcc

SEQ ID NO: 8584354 - DNA, 22 bp, Homo sapiens
gcccagcctccaagctccaagg

SEQ ID NO: 8584355 - DNA, 22 bp, Homo sapiens
gcccagccctgaggtcacagct

SEQ ID NO: 8584356 - DNA, 22 bp, Homo sapiens
gcccagcagatctcagtgtctc

SEQ ID NO: 8584357 - DNA, 22 bp, Homo sapiens
gcccagcagatctcagtgtctc

SEQ ID NO: 8584358 - DNA, 22 bp, Homo sapiens
gcccagcacctctctcagggtt

SEQ ID NO: 8584359 - DNA, 22 bp, Homo sapiens
gcccagcactaaaagctttgct

SEQ ID NO: 8584360 - DNA, 22 bp, Homo sapiens
gcccagcactcctctctgacat

SEQ ID NO: 8584361 - DNA, 22 bp, Homo sapiens
gcccagcacattgctgaggacc

SEQ ID NO: 8584362 - DNA, 22 bp, Homo sapiens
gcccagcacatctggccttgaa

SEQ ID NO: 8584363 - DNA, 22 bp, Homo sapiens
gcccagcacagctggaagagtc

SEQ ID NO: 8584364 - DNA, 21 bp, Homo sapiens
gcccagcaaggtgagaaggcc

SEQ ID NO: 8584365 - DNA, 22 bp, Homo sapiens
gccaggggacgcggagcgacga

SEQ ID NO: 8584366 - DNA, 22 bp, Homo sapiens
gccagggggtcagcaggcactt

SEQ ID NO: 8584367 - DNA, 22 bp, Homo sapiens
gccagggttcgaatccgtatgg

SEQ ID NO: 8584368 - DNA, 22 bp, Homo sapiens
gcctcctggcctttgctcctca

SEQ ID NO: 8584369 - DNA, 22 bp, Homo sapiens
gccctggatgtacaggcatgtt

SEQ ID NO: 8584370 - DNA, 22 bp, Homo sapiens
gccccagcctcccgagtagctg

SEQ ID NO: 8584371 - DNA, 22 bp, Homo sapiens
ggagacagtgacttagagactg

SEQ ID NO: 8584372 - DNA, 22 bp, Homo sapiens
ggaccagtggcagggtgctgtg

SEQ ID NO: 8584373 - DNA, 20 bp, Homo sapiens
ggaccaggtggggcggtggc

SEQ ID NO: 8584374 - DNA, 20 bp, Homo sapiens
ggaccagctgtctgaggggc

SEQ ID NO: 8584375 - DNA, 22 bp, Homo sapiens
ggaccaggcaagctgaggcggg

SEQ ID NO: 8584376 - DNA, 19 bp, Homo sapiens
ggaccagctttcaggaggc

SEQ ID NO: 8584377 - DNA, 22 bp, Homo sapiens
ggacaggtgcaaagggcacatg

SEQ ID NO: 8584378 - DNA, 22 bp, Homo sapiens
ggacaggtgtgaggctggcaca

SEQ ID NO: 8584379 - DNA, 22 bp, Homo sapiens
ggacaggtgtgaggctggcaca

SEQ ID NO: 8584380 - DNA, 22 bp, Homo sapiens
ggacaggttcagcagtttataa

SEQ ID NO: 8584381 - DNA, 22 bp, Homo sapiens
ggacagtggcctggtggtatag

SEQ ID NO: 8584382 - DNA, 22 bp, Homo sapiens
ggacagtgtctgcttcaggccc

SEQ ID NO: 8584383 - DNA, 22 bp, Homo sapiens
ggacagggttggggcatataaa

SEQ ID NO: 8584384 - DNA, 22 bp, Homo sapiens
ggacaggtgactgcccagagtg

SEQ ID NO: 8584385 - DNA, 22 bp, Homo sapiens
ggacagggtaagtactagtgtg

SEQ ID NO: 8584386 - DNA, 22 bp, Homo sapiens
ggagcagggaattacagcgcag

SEQ ID NO: 8584387 - DNA, 22 bp, Homo sapiens
ggagcagggaattacagcgcag

SEQ ID NO: 8584388 - DNA, 22 bp, Homo sapiens
ggagcagggcagtgaattctgg

SEQ ID NO: 8584389 - DNA, 22 bp, Homo sapiens
ggagcatgtggggtgagcaggg

SEQ ID NO: 8584390 - DNA, 22 bp, Homo sapiens
ggagccagagcactggggagcc

SEQ ID NO: 8584391 - DNA, 22 bp, Homo sapiens
ggagccagaaatgctgtggttg

SEQ ID NO: 8584392 - DNA, 22 bp, Homo sapiens
ggagacagtggtagggcctaag

SEQ ID NO: 8584393 - DNA, 22 bp, Homo sapiens
ggagacagtgacttagagactg

SEQ ID NO: 8584394 - DNA, 22 bp, Homo sapiens
ggagaccaggtcagagatggtg

SEQ ID NO: 8584395 - DNA, 22 bp, Homo sapiens
ggagagaaattgaggtagcaag

SEQ ID NO: 8584396 - DNA, 22 bp, Homo sapiens
gctttattttgtgagggattac

SEQ ID NO: 8584397 - DNA, 22 bp, Homo sapiens
gctttgctgaggtctgaggatt

SEQ ID NO: 8584398 - DNA, 22 bp, Homo sapiens
ggaagaggctctcattgagggc

SEQ ID NO: 8584399 - DNA, 22 bp, Homo sapiens
ggaagacaagcagtggctgagc

SEQ ID NO: 8584400 - DNA, 22 bp, Homo sapiens
ggaagacagaagcctacagctt

SEQ ID NO: 8584401 - DNA, 20 bp, Homo sapiens
ggaagcagagaactgttttc

SEQ ID NO: 8584402 - DNA, 22 bp, Homo sapiens
ggaagcagcctgaagccaaggg

SEQ ID NO: 8584403 - DNA, 22 bp, Homo sapiens
ggaagcaggaggctggggtaaa

SEQ ID NO: 8584404 - DNA, 22 bp, Homo sapiens
ggaagagtaacaggaggtggaa

SEQ ID NO: 8584405 - DNA, 22 bp, Homo sapiens
ggaagatgagaagtggggctcc

SEQ ID NO: 8584406 - DNA, 22 bp, Homo sapiens
ggacacagataatcacacagat

SEQ ID NO: 8584407 - DNA, 19 bp, Homo sapiens
gctggctggaggagggaca

SEQ ID NO: 8584408 - DNA, 22 bp, Homo sapiens
gctggctggagtaaggagggag

SEQ ID NO: 8584409 - DNA, 22 bp, Homo sapiens
gctggctgctaggacagctaca

SEQ ID NO: 8584410 - DNA, 22 bp, Homo sapiens
gctggagaaactgcagctgagg

SEQ ID NO: 8584411 - DNA, 22 bp, Homo sapiens
gctgggaacacagccatgagag

SEQ ID NO: 8584412 - DNA, 22 bp, Homo sapiens
gctgggcttctcaatgctgcct

SEQ ID NO: 8584413 - DNA, 22 bp, Homo sapiens
gctgggcttcacctccagagtt

SEQ ID NO: 8584414 - DNA, 22 bp, Homo sapiens
gctgggctgtagtttgctgacc

SEQ ID NO: 8584415 - DNA, 23 bp, Homo sapiens
gctgggcttactctttcagtgag

SEQ ID NO: 8584416 - DNA, 22 bp, Homo sapiens
gctgggcttcacagagccttta

SEQ ID NO: 8584417 - DNA, 22 bp, Homo sapiens
gctggggctgggctgaggaaga

SEQ ID NO: 8584418 - DNA, 22 bp, Homo sapiens
gctggggctgggctgaggaaga

SEQ ID NO: 8584419 - DNA, 19 bp, Homo sapiens
gctggggcctgaccagaca

SEQ ID NO: 8584420 - DNA, 19 bp, Homo sapiens
gctggggcctgaccagaca

SEQ ID NO: 8584421 - DNA, 22 bp, Homo sapiens
gctggggcctgaacagtcagct

SEQ ID NO: 8584422 - DNA, 22 bp, Homo sapiens
gctggggcctgaacagtcagct

SEQ ID NO: 8584423 - DNA, 22 bp, Homo sapiens
gctggggaggcagcagagaaca

SEQ ID NO: 8584424 - DNA, 22 bp, Homo sapiens
gctgggcttggtttccctgctt

SEQ ID NO: 8584425 - DNA, 22 bp, Homo sapiens
gctgggcttggtttccctgctt

SEQ ID NO: 8584426 - DNA, 22 bp, Homo sapiens
gctgtggctgaccaccaggggg

SEQ ID NO: 8584427 - DNA, 22 bp, Homo sapiens
gctgtgggccatggccaagtga

SEQ ID NO: 8584428 - DNA, 19 bp, Homo sapiens
gcttctgtttgggcttaga

SEQ ID NO: 8584429 - DNA, 21 bp, Homo sapiens
gcttctgtatctagcaggaac

SEQ ID NO: 8584430 - DNA, 22 bp, Homo sapiens
gcttctggtgaggcctcaggaa

SEQ ID NO: 8584431 - DNA, 22 bp, Homo sapiens
gcttctgtggattggctggctt

SEQ ID NO: 8584432 - DNA, 22 bp, Homo sapiens
gcttgcagtggtgatgcccggg

SEQ ID NO: 8584433 - DNA, 22 bp, Homo sapiens
gctttatgtaagtccaaaggca

SEQ ID NO: 8584434 - DNA, 18 bp, Homo sapiens
gctttatttcttggggaa

SEQ ID NO: 8584435 - DNA, 22 bp, Homo sapiens
gctttatgtgagtagcactgtc

SEQ ID NO: 8584436 - DNA, 22 bp, Homo sapiens
gctcagaggccaagtgcccgcc

SEQ ID NO: 8584437 - DNA, 22 bp, Homo sapiens
gctcagctgagcgaaggacatg

SEQ ID NO: 8584438 - DNA, 22 bp, Homo sapiens
gctccaggaggctcccgcgtct

SEQ ID NO: 8584439 - DNA, 22 bp, Homo sapiens
gctccagggacccaagagaaaa

SEQ ID NO: 8584440 - DNA, 22 bp, Homo sapiens
gctccagggtcagctcagaact

SEQ ID NO: 8584441 - DNA, 18 bp, Homo sapiens
gctcagctatgggaggtt

SEQ ID NO: 8584442 - DNA, 21 bp, Homo sapiens
gctcagcaaaggtgaggtgca

SEQ ID NO: 8584443 - DNA, 20 bp, Homo sapiens
gctccaggtcagagaggacg

SEQ ID NO: 8584444 - DNA, 20 bp, Homo sapiens
gctccaggtcagagaggacg

SEQ ID NO: 8584445 - DNA, 22 bp, Homo sapiens
gcctttcactggtgccggctgt

SEQ ID NO: 8584446 - DNA, 22 bp, Homo sapiens
gcctttcatctcagctggccgg

SEQ ID NO: 8584447 - DNA, 22 bp, Homo sapiens
gcctttatttacgaaagggaaa

SEQ ID NO: 8584448 - DNA, 22 bp, Homo sapiens
gccttgtttctctcccagataa

SEQ ID NO: 8584449 - DNA, 22 bp, Homo sapiens
gcctttatccctgtacaaggtg

SEQ ID NO: 8584450 - DNA, 22 bp, Homo sapiens
gcgggggtggccagcaagacct

SEQ ID NO: 8584451 - DNA, 22 bp, Homo sapiens
gcctttggatatattcagggat

SEQ ID NO: 8584452 - DNA, 22 bp, Homo sapiens
gcgtctcaaggcccccaggcca

SEQ ID NO: 8584453 - DNA, 22 bp, Homo sapiens
gcggtaggagagacagaagtta

SEQ ID NO: 8584454 - DNA, 21 bp, Homo sapiens
gcctgagcatgtcttcaggtc

SEQ ID NO: 8584455 - DNA, 22 bp, Homo sapiens
gcctgaggaatgctcctgactt

SEQ ID NO: 8584456 - DNA, 22 bp, Homo sapiens
gccttgggccagctgctctgga

SEQ ID NO: 8584457 - DNA, 22 bp, Homo sapiens
gctgagggaggctgaactgagt

SEQ ID NO: 8584458 - DNA, 22 bp, Homo sapiens
gctgaggctcctcgggaggaca

SEQ ID NO: 8584459 - DNA, 22 bp, Homo sapiens
gctgaggctgggagcagcctgt

SEQ ID NO: 8584460 - DNA, 22 bp, Homo sapiens
gctgaggccaggccccaccgga

SEQ ID NO: 8584461 - DNA, 22 bp, Homo sapiens
gctgaggccccagggtgatggg

SEQ ID NO: 8584462 - DNA, 22 bp, Homo sapiens
gctctggctcaaaccaccggct

SEQ ID NO: 8584463 - DNA, 22 bp, Homo sapiens
gctctgggctgccctctggaca

SEQ ID NO: 8584464 - DNA, 22 bp, Homo sapiens
gctgccctgtggtccagcaggt

SEQ ID NO: 8584465 - DNA, 22 bp, Homo sapiens
gctgagggcatgtgtggcgact

SEQ ID NO: 8584466 - DNA, 22 bp, Homo sapiens
gctgagggcagcctcctaggtc

SEQ ID NO: 8584467 - DNA, 22 bp, Homo sapiens
gctgagggctgtaacagcagag

SEQ ID NO: 8584468 - DNA, 20 bp, Homo sapiens
gctgcctgtttctgtaagta

SEQ ID NO: 8584469 - DNA, 20 bp, Homo sapiens
gctgcggttacagagacaca

SEQ ID NO: 8584470 - DNA, 22 bp, Homo sapiens
gctgctagacagcatgtgagct

SEQ ID NO: 8584471 - DNA, 22 bp, Homo sapiens
gctgcctgttgaagggtctgtg

SEQ ID NO: 8584472 - DNA, 22 bp, Homo sapiens
ggtctcagctggagtccttggt

SEQ ID NO: 8584473 - DNA, 22 bp, Homo sapiens
ggtctcaggtagggcctaggaa

SEQ ID NO: 8584474 - DNA, 22 bp, Homo sapiens
ggtctcagtgaaggagtgtgct

SEQ ID NO: 8584475 - DNA, 22 bp, Homo sapiens
ggtagggcaaagtagggcacct

SEQ ID NO: 8584476 - DNA, 21 bp, Homo sapiens
gggtggccgcatgggtgcgtg

SEQ ID NO: 8584477 - DNA, 22 bp, Homo sapiens
gggtggcaggattggcaggagt

SEQ ID NO: 8584478 - DNA, 22 bp, Homo sapiens
ggtcagagggtgggctgcctgt

SEQ ID NO: 8584479 - DNA, 22 bp, Homo sapiens
ggtagggtgggccgaagctcaa

SEQ ID NO: 8584480 - DNA, 22 bp, Homo sapiens
ggtgttgcagttgaagactggt

SEQ ID NO: 8584481 - DNA, 22 bp, Homo sapiens
ggtgttgggctcactggtcctt

SEQ ID NO: 8584482 - DNA, 19 bp, Homo sapiens
ggtgtgtgctggggcctgt

SEQ ID NO: 8584483 - DNA, 22 bp, Homo sapiens
ggtgtccttagaaagcagacct

SEQ ID NO: 8584484 - DNA, 22 bp, Homo sapiens
ggtgtccttagaaagcagacct

SEQ ID NO: 8584485 - DNA, 22 bp, Homo sapiens
ggtgtccttcgtccgctggcat

SEQ ID NO: 8584486 - DNA, 22 bp, Homo sapiens
ggtgtccttgctccttcagctt

SEQ ID NO: 8584487 - DNA, 22 bp, Homo sapiens
ggtgtccttgcagaaggcggcg

SEQ ID NO: 8584488 - DNA, 17 bp, Homo sapiens
ggtggctcgggcgcggc

SEQ ID NO: 8584489 - DNA, 22 bp, Homo sapiens
ggtgtgggtccttgtgcttgct

SEQ ID NO: 8584490 - DNA, 22 bp, Homo sapiens
ggtgtggatcatctgaggtcag

SEQ ID NO: 8584491 - DNA, 18 bp, Homo sapiens
ggtggctcagtcatgggg

SEQ ID NO: 8584492 - DNA, 22 bp, Homo sapiens
ggtggcctcggtggtgcacagg

SEQ ID NO: 8584493 - DNA, 20 bp, Homo sapiens
ggtggccgtagcgggcggcg

SEQ ID NO: 8584494 - DNA, 22 bp, Homo sapiens
gggccaaggggagctggaaggg

SEQ ID NO: 8584495 - DNA, 22 bp, Homo sapiens
gggctgagagctggaatctgag

SEQ ID NO: 8584496 - DNA, 22 bp, Homo sapiens
gggctgagagtgactgttctgt

SEQ ID NO: 8584497 - DNA, 22 bp, Homo sapiens
gggctgagattggtgccctgtc

SEQ ID NO: 8584498 - DNA, 22 bp, Homo sapiens
gggctgagctgttctgagttta

SEQ ID NO: 8584499 - DNA, 22 bp, Homo sapiens
gggctgagccacagcttttgtt

SEQ ID NO: 8584500 - DNA, 22 bp, Homo sapiens
gggctgagcacatactgacagc

SEQ ID NO: 8584501 - DNA, 22 bp, Homo sapiens
gggctgagttcctgcctcactc

SEQ ID NO: 8584502 - DNA, 22 bp, Homo sapiens
gggctgagtgtcccaggccgaa

SEQ ID NO: 8584503 - DNA, 22 bp, Homo sapiens
gggctgagtgtcccaggccgaa

SEQ ID NO: 8584504 - DNA, 22 bp, Homo sapiens
gggctgctgctgccagcgacac

SEQ ID NO: 8584505 - DNA, 22 bp, Homo sapiens
gggctgctgggcaagaaacatt

SEQ ID NO: 8584506 - DNA, 21 bp, Homo sapiens
ggggttggcaagagcagagac

SEQ ID NO: 8584507 - DNA, 22 bp, Homo sapiens
ggggtgggcgtgcagggacacc

SEQ ID NO: 8584508 - DNA, 22 bp, Homo sapiens
ggggtgggcgtgcagggacacc

SEQ ID NO: 8584509 - DNA, 22 bp, Homo sapiens
ggggtgggcgtgcagggacacc

SEQ ID NO: 8584510 - DNA, 22 bp, Homo sapiens
gggtggagcttggacaccagta

SEQ ID NO: 8584511 - DNA, 22 bp, Homo sapiens
gggtggagcctgagaatttgca

SEQ ID NO: 8584512 - DNA, 22 bp, Homo sapiens
gggtaggctctgcaggctgggt

SEQ ID NO: 8584513 - DNA, 22 bp, Homo sapiens
gggtaggctgctcctggggccc

SEQ ID NO: 8584514 - DNA, 22 bp, Homo sapiens
gggtaggccagaagggcctgga

SEQ ID NO: 8584515 - DNA, 22 bp, Homo sapiens
gggtagggtgacttaggctggc

SEQ ID NO: 8584516 - DNA, 22 bp, Homo sapiens
gggtaggcagtgcgtcctgcct

SEQ ID NO: 8584517 - DNA, 22 bp, Homo sapiens
gggtaggagaggtgtctgtgtg

SEQ ID NO: 8584518 - DNA, 22 bp, Homo sapiens
ggggaagaatggcagaaaacat

SEQ ID NO: 8584519 - DNA, 22 bp, Homo sapiens
ggggaagagcattgcacggtgt

SEQ ID NO: 8584520 - DNA, 22 bp, Homo sapiens
ggggaagacctggcactacagc

SEQ ID NO: 8584521 - DNA, 22 bp, Homo sapiens
ggggaagatggccctccatgtg

SEQ ID NO: 8584522 - DNA, 22 bp, Homo sapiens
ggggctctgctctgagccgtgt

SEQ ID NO: 8584523 - DNA, 22 bp, Homo sapiens
ggggctctggagaaaggccagt

SEQ ID NO: 8584524 - DNA, 22 bp, Homo sapiens
ggggctcttagagagcctagtg

SEQ ID NO: 8584525 - DNA, 22 bp, Homo sapiens
ggggctctcaggtctccccaaa

SEQ ID NO: 8584526 - DNA, 22 bp, Homo sapiens
gtgcagagcaagggctgagggc

SEQ ID NO: 8584527 - DNA, 22 bp, Homo sapiens
gtgcagaggacgtggcggcctc

SEQ ID NO: 8584528 - DNA, 22 bp, Homo sapiens
gtgcagtggcagatcctagctc

SEQ ID NO: 8584529 - DNA, 22 bp, Homo sapiens
gtgagcaggatttcatggtgta

SEQ ID NO: 8584530 - DNA, 22 bp, Homo sapiens
gtgagcaggatttcatggtgta

SEQ ID NO: 8584531 - DNA, 22 bp, Homo sapiens
gtgagcagggcaggactgggga

SEQ ID NO: 8584532 - DNA, 22 bp, Homo sapiens
gtgagacaattcctcagtagac

SEQ ID NO: 8584533 - DNA, 22 bp, Homo sapiens
gtgagcagctcagggtggtctc

SEQ ID NO: 8584534 - DNA, 22 bp, Homo sapiens
gtgagcagctcagggtggtctc

SEQ ID NO: 8584535 - DNA, 22 bp, Homo sapiens
gtgagcaggataggggctccct

SEQ ID NO: 8584536 - DNA, 22 bp, Homo sapiens
gtgaccatcatctcagctagtt

SEQ ID NO: 8584537 - DNA, 22 bp, Homo sapiens
gtgaaggagttatcagtggtta

SEQ ID NO: 8584538 - DNA, 18 bp, Homo sapiens
gtctggaggtcaggagct

SEQ ID NO: 8584539 - DNA, 22 bp, Homo sapiens
gtctggaggagggctctgcggc

SEQ ID NO: 8584540 - DNA, 22 bp, Homo sapiens
gtcctgggggcagctgtgtcca

SEQ ID NO: 8584541 - DNA, 22 bp, Homo sapiens
gtcctgggggcagctgtgtcca

SEQ ID NO: 8584542 - DNA, 22 bp, Homo sapiens
gtcctggggatacagaagtgaa

SEQ ID NO: 8584543 - DNA, 22 bp, Homo sapiens
gtcctggggaatacagaagccg

SEQ ID NO: 8584544 - DNA, 22 bp, Homo sapiens
gtcctggggaatacagaagccg

SEQ ID NO: 8584545 - DNA, 22 bp, Homo sapiens
gtcctgggcggagggctgctgt

SEQ ID NO: 8584546 - DNA, 22 bp, Homo sapiens
gtcctgggcccaggggctgcct

SEQ ID NO: 8584547 - DNA, 22 bp, Homo sapiens
gtattgtatatttgcaaataca

SEQ ID NO: 8584548 - DNA, 22 bp, Homo sapiens
gtattgtattgaacacatgtga

SEQ ID NO: 8584549 - DNA, 22 bp, Homo sapiens
gtatttataggggaatgagagt

SEQ ID NO: 8584550 - DNA, 22 bp, Homo sapiens
gtacctgggggatccacttctt

SEQ ID NO: 8584551 - DNA, 22 bp, Homo sapiens
ggtttcactagaagaaggaatt

SEQ ID NO: 8584552 - DNA, 22 bp, Homo sapiens
ggtttcacaatttagagcagtg

SEQ ID NO: 8584553 - DNA, 22 bp, Homo sapiens
gtccacaaaattactatcttac

SEQ ID NO: 8584554 - DNA, 22 bp, Homo sapiens
gtccacaagcaggaagtgagcc

SEQ ID NO: 8584555 - DNA, 22 bp, Homo sapiens
gtccacaacatcagactaactg

SEQ ID NO: 8584556 - DNA, 18 bp, Homo sapiens
gtccacagccctcacagc

SEQ ID NO: 8584557 - DNA, 21 bp, Homo sapiens
gtccacaggggtttgtcctgg

SEQ ID NO: 8584558 - DNA, 22 bp, Homo sapiens
gtccacagggatggccacacat

SEQ ID NO: 8584559 - DNA, 17 bp, Homo sapiens
gtcctgggaggagagag

SEQ ID NO: 8584560 - DNA, 17 bp, Homo sapiens
gtcctgggaggagagag

SEQ ID NO: 8584561 - DNA, 22 bp, Homo sapiens
gtcctgggaggggctggtcctg

SEQ ID NO: 8584562 - DNA, 22 bp, Homo sapiens
gtcctgggaaggaagccaggga

SEQ ID NO: 8584563 - DNA, 22 bp, Homo sapiens
gtcctgggaaggaagccaggga

SEQ ID NO: 8584564 - DNA, 22 bp, Homo sapiens
ggccaaggtggagaaggcactg

SEQ ID NO: 8584565 - DNA, 22 bp, Homo sapiens
ggccaaggctcttgagggctga

SEQ ID NO: 8584566 - DNA, 19 bp, Homo sapiens
ggccaggctgactgtggtc

SEQ ID NO: 8584567 - DNA, 22 bp, Homo sapiens
ggccacagaacagctacaggac

SEQ ID NO: 8584568 - DNA, 22 bp, Homo sapiens
ggccagggggcttcagactcca

SEQ ID NO: 8584569 - DNA, 22 bp, Homo sapiens
ggccaggtccagtggaaggccc

SEQ ID NO: 8584570 - DNA, 22 bp, Homo sapiens
ggccagtgtgggagtagttctt

SEQ ID NO: 8584571 - DNA, 22 bp, Homo sapiens
ggccaggttgggtggaagtggc

SEQ ID NO: 8584572 - DNA, 22 bp, Homo sapiens
ggccagtaagagataggaggca

SEQ ID NO: 8584573 - DNA, 22 bp, Homo sapiens
ggccagtgaccagtaaccagtg

SEQ ID NO: 8584574 - DNA, 22 bp, Homo sapiens
ggccagtgtgcaggtcagagat

SEQ ID NO: 8584575 - DNA, 22 bp, Homo sapiens
ggccagtggctctgtgcttggg

SEQ ID NO: 8584576 - DNA, 21 bp, Homo sapiens
ggccagtggaattttatgtca

SEQ ID NO: 8584577 - DNA, 21 bp, Homo sapiens
ggccagtggccttgactttcc

SEQ ID NO: 8584578 - DNA, 19 bp, Homo sapiens
ggcatggggtccggggacc

SEQ ID NO: 8584579 - DNA, 15 bp, Homo sapiens
ggcaggtggatcact

SEQ ID NO: 8584580 - DNA, 22 bp, Homo sapiens
ggcaggtggacgtgctaaagct

SEQ ID NO: 8584581 - DNA, 22 bp, Homo sapiens
ggcaggtggattttctactcta

SEQ ID NO: 8584582 - DNA, 22 bp, Homo sapiens
ggcaggtggcactgctgctccc

SEQ ID NO: 8584583 - DNA, 22 bp, Homo sapiens
ggcaggcagaggctgagacagg

SEQ ID NO: 8584584 - DNA, 22 bp, Homo sapiens
ggcaggtgtgagatcgaggcca

SEQ ID NO: 8584585 - DNA, 22 bp, Homo sapiens
ggcaggtggccaagtgtctaag

SEQ ID NO: 8584586 - DNA, 22 bp, Homo sapiens
ggcaggtggccaagtgtctaag

SEQ ID NO: 8584587 - DNA, 22 bp, Homo sapiens
ggcaggtggtaaggatttcata

SEQ ID NO: 8584588 - DNA, 21 bp, Homo sapiens
ggcaggtgggtctctgttgct

SEQ ID NO: 8584589 - DNA, 22 bp, Homo sapiens
ggcaggtgggaaccctccccac

SEQ ID NO: 8584590 - DNA, 22 bp, Homo sapiens
ggccttggttctgtcacagccg

SEQ ID NO: 8584591 - DNA, 22 bp, Homo sapiens
ggcctttgctggccctcaggct

SEQ ID NO: 8584592 - DNA, 19 bp, Homo sapiens
ggcctttcacctggatgct

SEQ ID NO: 8584593 - DNA, 22 bp, Homo sapiens
ggcgaggccgggacaggctgga

SEQ ID NO: 8584594 - DNA, 22 bp, Homo sapiens
ggcctgagaatgtaccagatct

SEQ ID NO: 8584595 - DNA, 21 bp, Homo sapiens
ggcctgagcacctgtccacct

SEQ ID NO: 8584596 - DNA, 22 bp, Homo sapiens
ggcctgagaaccatggggccaa

SEQ ID NO: 8584597 - DNA, 21 bp, Homo sapiens
ggcctgagtataggacaggcc

SEQ ID NO: 8584598 - DNA, 18 bp, Homo sapiens
ggcctgcagtgaagcaag

SEQ ID NO: 8584599 - DNA, 22 bp, Homo sapiens
ggcctcagagaaggctgtgcgg

SEQ ID NO: 8584600 - DNA, 22 bp, Homo sapiens
ggcctcagagaaggctgtgcgg

SEQ ID NO: 8584601 - DNA, 22 bp, Homo sapiens
ggcctcagaccggagctggcca

SEQ ID NO: 8584602 - DNA, 19 bp, Homo sapiens
ggccatggcgggggtcaca

SEQ ID NO: 8584603 - DNA, 23 bp, Homo sapiens
ggccatggagacttagaatgggc

SEQ ID NO: 8584604 - DNA, 22 bp, Homo sapiens
ggccatgctgttgcctgctggt

SEQ ID NO: 8584605 - DNA, 22 bp, Homo sapiens
ggcctcagggtcactctgtaga

SEQ ID NO: 8584606 - DNA, 18 bp, Homo sapiens
ggcctcagcctggccgga

SEQ ID NO: 8584607 - DNA, 22 bp, Homo sapiens
ggcctcagaggaggtgtgagtc

SEQ ID NO: 8584608 - DNA, 21 bp, Homo sapiens
ggcctcagccacctggctctg

SEQ ID NO: 8584609 - DNA, 18 bp, Homo sapiens
ggcctcagcctggccgga

SEQ ID NO: 8584610 - DNA, 22 bp, Homo sapiens
ggcctctggttcacagggagga

SEQ ID NO: 8584611 - DNA, 21 bp, Homo sapiens
ggcctctgtcatcctgggaag

SEQ ID NO: 8584612 - DNA, 22 bp, Homo sapiens
ggcctctgtttggagccaggat

SEQ ID NO: 8584613 - DNA, 22 bp, Homo sapiens
ggcctcagtgggccgctgcagg

SEQ ID NO: 8584614 - DNA, 20 bp, Homo sapiens
ggcctcagtgtccttgtttg

SEQ ID NO: 8584615 - DNA, 22 bp, Homo sapiens
ggcctcagggttgggcccatta

SEQ ID NO: 8584616 - DNA, 22 bp, Homo sapiens
ggcctcagtttctccatgggtt

SEQ ID NO: 8584617 - DNA, 20 bp, Homo sapiens
ggcctcagtgtccttgtttg

SEQ ID NO: 8584618 - DNA, 22 bp, Homo sapiens
ggcctcagtttcttcaactgta

SEQ ID NO: 8584619 - DNA, 22 bp, Homo sapiens
ggcctcagtttcttcaactgta

SEQ ID NO: 8584620 - DNA, 22 bp, Homo sapiens
ggcaaagagacatgcatcgggg

SEQ ID NO: 8584621 - DNA, 22 bp, Homo sapiens
ggagtgctgggccgctgccaac

SEQ ID NO: 8584622 - DNA, 17 bp, Homo sapiens
ggcaacatgttcttctg

SEQ ID NO: 8584623 - DNA, 22 bp, Homo sapiens
ggcaacattctccagatccttt

SEQ ID NO: 8584624 - DNA, 22 bp, Homo sapiens
ggcaagctcaggcctcaggtgt

SEQ ID NO: 8584625 - DNA, 20 bp, Homo sapiens
ggcaagcaactgagggagga

SEQ ID NO: 8584626 - DNA, 22 bp, Homo sapiens
ggagtcctgtgtcttccaggaa

SEQ ID NO: 8584627 - DNA, 19 bp, Homo sapiens
ggagtctgagcccaggtat

SEQ ID NO: 8584628 - DNA, 22 bp, Homo sapiens
ggagtcagaatggcagggtggt

SEQ ID NO: 8584629 - DNA, 22 bp, Homo sapiens
ggagtcagcctgtcagagtgta

SEQ ID NO: 8584630 - DNA, 22 bp, Homo sapiens
ggagccagaggctgctgctgtg

SEQ ID NO: 8584631 - DNA, 22 bp, Homo sapiens
ggagccagagtctgcagtgtaa

SEQ ID NO: 8584632 - DNA, 23 bp, Homo sapiens
ggagccagcctgtggggagcggg

SEQ ID NO: 8584633 - DNA, 22 bp, Homo sapiens
ggagccagcagggtgacactga

SEQ ID NO: 8584634 - DNA, 22 bp, Homo sapiens
ggagccagcagggtgacactga

SEQ ID NO: 8584635 - DNA, 22 bp, Homo sapiens
ggagtatatcgtgtatcatatg

SEQ ID NO: 8584636 - DNA, 19 bp, Homo sapiens
ggagccagctgtggaaggc

SEQ ID NO: 8584637 - DNA, 17 bp, Homo sapiens
ggagccaggagcccacc

SEQ ID NO: 8584638 - DNA, 22 bp, Homo sapiens
ggcaggcaacggaccactagtc

SEQ ID NO: 8584639 - DNA, 22 bp, Homo sapiens
ggcaggcaatgaggatgggaag

SEQ ID NO: 8584640 - DNA, 22 bp, Homo sapiens
ggcaggcaccagctcagcaata

SEQ ID NO: 8584641 - DNA, 22 bp, Homo sapiens
ggcaggcacatttgggggccgt

SEQ ID NO: 8584642 - DNA, 22 bp, Homo sapiens
ggcaggcagaaaaatagaatat

SEQ ID NO: 8584643 - DNA, 22 bp, Homo sapiens
ggcagaggtagctggaaccagg

SEQ ID NO: 8584644 - DNA, 22 bp, Homo sapiens
ggcaggaggtgagtggcgggtg

SEQ ID NO: 8584645 - DNA, 22 bp, Homo sapiens
ggcaggagggcggacaatgacc

SEQ ID NO: 8584646 - DNA, 22 bp, Homo sapiens
ggcaggaggaagagttagcacc

SEQ ID NO: 8584647 - DNA, 22 bp, Homo sapiens
ggcacagcaggagctatgtgaa

SEQ ID NO: 8584648 - DNA, 22 bp, Homo sapiens
ggcagaggagctggaaacatgg

SEQ ID NO: 8584649 - DNA, 22 bp, Homo sapiens
gggatgtcgtgggtggcagctg

SEQ ID NO: 8584650 - DNA, 22 bp, Homo sapiens
gggatgtcactgtgcctggcac

SEQ ID NO: 8584651 - DNA, 22 bp, Homo sapiens
gggaggacggtccagggcaaag

SEQ ID NO: 8584652 - DNA, 22 bp, Homo sapiens
gggaggacggtccagggcaaag

SEQ ID NO: 8584653 - DNA, 22 bp, Homo sapiens
gggcaggagaaggtggatgtcc

SEQ ID NO: 8584654 - DNA, 22 bp, Homo sapiens
gggcagctctggctgtgggaag

SEQ ID NO: 8584655 - DNA, 18 bp, Homo sapiens
gggagctgggaagctggt

SEQ ID NO: 8584656 - DNA, 22 bp, Homo sapiens
gggagagcgggaggtgccacag

SEQ ID NO: 8584657 - DNA, 22 bp, Homo sapiens
gggagagcgcgctagggccgag

SEQ ID NO: 8584658 - DNA, 20 bp, Homo sapiens
gggagacagggccagtgtcc

SEQ ID NO: 8584659 - DNA, 22 bp, Homo sapiens
gggagacccccaatgccaggtc

SEQ ID NO: 8584660 - DNA, 22 bp, Homo sapiens
gggagacaagaagtagcctgct

SEQ ID NO: 8584661 - DNA, 22 bp, Homo sapiens
gggagacaaaggtgaggttctt

SEQ ID NO: 8584662 - DNA, 22 bp, Homo sapiens
gggagacacgctgcaggcataa

SEQ ID NO: 8584663 - DNA, 19 bp, Homo sapiens
gggagacagctctgggctg

SEQ ID NO: 8584664 - DNA, 22 bp, Homo sapiens
gggacatgaggccatagtgatt

SEQ ID NO: 8584665 - DNA, 22 bp, Homo sapiens
gggacatgcccctcagtgggtg

SEQ ID NO: 8584666 - DNA, 22 bp, Homo sapiens
gggacatgaagcatcggaggca

SEQ ID NO: 8584667 - DNA, 22 bp, Homo sapiens
gggacaggcccctcgctagctt

SEQ ID NO: 8584668 - DNA, 22 bp, Homo sapiens
gggacaggctgagacttgagct

SEQ ID NO: 8584669 - DNA, 22 bp, Homo sapiens
gggaccagaggctgtgcacaat

SEQ ID NO: 8584670 - DNA, 22 bp, Homo sapiens
gggacatggaggcgcgcaggca

SEQ ID NO: 8584671 - DNA, 22 bp, Homo sapiens
gggacatggctaggattccaat

SEQ ID NO: 8584672 - DNA, 22 bp, Homo sapiens
gggacatttgctatcggagttc

SEQ ID NO: 8584673 - DNA, 22 bp, Homo sapiens
gggacatttatcagatgaccat

SEQ ID NO: 8584674 - DNA, 22 bp, Homo sapiens
ggctttatagggtagaggatca

SEQ ID NO: 8584675 - DNA, 22 bp, Homo sapiens
ggctcttgggagctcagagttg

SEQ ID NO: 8584676 - DNA, 22 bp, Homo sapiens
ggctgaagaactgggagtctca

SEQ ID NO: 8584677 - DNA, 22 bp, Homo sapiens
ggctccagaaacttcagtccat

SEQ ID NO: 8584678 - DNA, 22 bp, Homo sapiens
ggctccagaaatcatagagcag

SEQ ID NO: 8584679 - DNA, 22 bp, Homo sapiens
ggctccagatgtcccctggcaa

SEQ ID NO: 8584680 - DNA, 22 bp, Homo sapiens
ggctccagatgtcccctggcaa

SEQ ID NO: 8584681 - DNA, 16 bp, Homo sapiens
ggctccagaatagcga

SEQ ID NO: 8584682 - DNA, 22 bp, Homo sapiens
ggctccagaggccttacctgca

SEQ ID NO: 8584683 - DNA, 22 bp, Homo sapiens
ggctccagaggccttacctgca

SEQ ID NO: 8584684 - DNA, 22 bp, Homo sapiens
ggctccaggagggccttggcca

SEQ ID NO: 8584685 - DNA, 23 bp, Homo sapiens
ggctccaggcctgacgggcgcgg

SEQ ID NO: 8584686 - DNA, 22 bp, Homo sapiens
ggctccaggagggccttggcca

SEQ ID NO: 8584687 - DNA, 22 bp, Homo sapiens
ggctccaggagatgctgggcag

SEQ ID NO: 8584688 - DNA, 22 bp, Homo sapiens
ggctccaggagatgctgggcag

SEQ ID NO: 8584689 - DNA, 22 bp, Homo sapiens
ggctctgctcctggtgccagtg

SEQ ID NO: 8584690 - DNA, 23 bp, Homo sapiens
ggctccaggcctgacgggcgcgg

SEQ ID NO: 8584691 - DNA, 22 bp, Homo sapiens
ggctccagctaatggtttctat

SEQ ID NO: 8584692 - DNA, 22 bp, Homo sapiens
ggctccagccctggctcttcac

SEQ ID NO: 8584693 - DNA, 22 bp, Homo sapiens
ggctccagatgtctcctggcaa

SEQ ID NO: 8584694 - DNA, 22 bp, Homo sapiens
ggctccagatgtctcctggcaa

SEQ ID NO: 8584695 - DNA, 22 bp, Homo sapiens
ggctccaggaacctcctctcct

SEQ ID NO: 8584696 - DNA, 22 bp, Homo sapiens
ggctccagctaatggtttctat

SEQ ID NO: 8584697 - DNA, 18 bp, Homo sapiens
ggctccaggacctaccca

SEQ ID NO: 8584698 - DNA, 22 bp, Homo sapiens
ggctgagcactttaggcaggag

SEQ ID NO: 8584699 - DNA, 22 bp, Homo sapiens
ggctgctgaagtgtggcaatct

SEQ ID NO: 8584700 - DNA, 19 bp, Homo sapiens
ggctgctgaagagaattac

SEQ ID NO: 8584701 - DNA, 22 bp, Homo sapiens
ggctgctgacaaacatgatcat

SEQ ID NO: 8584702 - DNA, 22 bp, Homo sapiens
ggctgctgacttcatccagctt

SEQ ID NO: 8584703 - DNA, 22 bp, Homo sapiens
ggctgctgagtcacgacagtga

SEQ ID NO: 8584704 - DNA, 22 bp, Homo sapiens
ggctgctgagtcacgacagtga

SEQ ID NO: 8584705 - DNA, 22 bp, Homo sapiens
ggctgctgagttggccaggaga

SEQ ID NO: 8584706 - DNA, 22 bp, Homo sapiens
ggctgctgagttggccaggaga

SEQ ID NO: 8584707 - DNA, 22 bp, Homo sapiens
ggctgctgcccacccctgcatg

SEQ ID NO: 8584708 - DNA, 22 bp, Homo sapiens
ggctgctgccctcctaagtgca

SEQ ID NO: 8584709 - DNA, 22 bp, Homo sapiens
ggctgctggaagactgaacaag

SEQ ID NO: 8584710 - DNA, 22 bp, Homo sapiens
ggctgctggagttgggtctctc

SEQ ID NO: 8584711 - DNA, 22 bp, Homo sapiens
ggctgctgctgtgtaggcctgt

SEQ ID NO: 8584712 - DNA, 22 bp, Homo sapiens
ggctgctggccagcctaggagt

SEQ ID NO: 8584713 - DNA, 22 bp, Homo sapiens
ggctgctgggaatatgccagct

SEQ ID NO: 8584714 - DNA, 22 bp, Homo sapiens
ggctgctggcattgaggtaggt

SEQ ID NO: 8584715 - DNA, 22 bp, Homo sapiens
ggctgctggcattgaggtaggt

SEQ ID NO: 8584716 - DNA, 22 bp, Homo sapiens
ggctgggcaaacaagactcttc

SEQ ID NO: 8584717 - DNA, 22 bp, Homo sapiens
ggctgggcagcagctgttaagc

SEQ ID NO: 8584718 - DNA, 22 bp, Homo sapiens
ggctgctggggacgtgggagag

SEQ ID NO: 8584719 - DNA, 22 bp, Homo sapiens
ggctggcttggtgagctgtcac

SEQ ID NO: 8584720 - DNA, 21 bp, Homo sapiens
ggctgggcaggacccacccct

SEQ ID NO: 8584721 - DNA, 22 bp, Homo sapiens
ggctgggcaggtctgcacaggg

SEQ ID NO: 8584722 - DNA, 22 bp, Homo sapiens
ggctgggccagggcctgtggac

SEQ ID NO: 8584723 - DNA, 19 bp, Homo sapiens
ggctgggccctgtttctcc

SEQ ID NO: 8584724 - DNA, 22 bp, Homo sapiens
ggctgggcatccatccatgaga

SEQ ID NO: 8584725 - DNA, 22 bp, Homo sapiens
ggctgggctccgggagcatgcg

SEQ ID NO: 8584726 - DNA, 22 bp, Homo sapiens
ggctgggctcgctgattggctg

SEQ ID NO: 8584727 - DNA, 22 bp, Homo sapiens
ggctgggcctctccctcagctg

SEQ ID NO: 8584728 - DNA, 22 bp, Homo sapiens
ggctgggccgcggctacccaga

SEQ ID NO: 8584729 - DNA, 22 bp, Homo sapiens
ggcttctccaggtactgagcat

SEQ ID NO: 8584730 - DNA, 22 bp, Homo sapiens
ggctgggctgcggctgtacctg

SEQ ID NO: 8584731 - DNA, 22 bp, Homo sapiens
ggctgggctgctgggtcagagc

SEQ ID NO: 8584732 - DNA, 22 bp, Homo sapiens
ggcttctctcttcacatggctt

SEQ ID NO: 8584733 - DNA, 22 bp, Homo sapiens
ggcttctgaaatctctgtgcgt

SEQ ID NO: 8584734 - DNA, 22 bp, Homo sapiens
ggcttctgaaatctctgtgcgt

SEQ ID NO: 8584735 - DNA, 22 bp, Homo sapiens
ggcttctgaaccaggccctgga

SEQ ID NO: 8584736 - DNA, 22 bp, Homo sapiens
ggcttctgagtgctctgctgtt

SEQ ID NO: 8584737 - DNA, 22 bp, Homo sapiens
ggcttctgagtgctctgctgtt

SEQ ID NO: 8584738 - DNA, 22 bp, Homo sapiens
gagctagagggagaagggcact

SEQ ID NO: 8584739 - DNA, 22 bp, Homo sapiens
gagcgggaggaacggctcgggc

SEQ ID NO: 8584740 - DNA, 22 bp, Homo sapiens
gagctctgttctcgtcctgctg

SEQ ID NO: 8584741 - DNA, 22 bp, Homo sapiens
gagctcttatagttctagcagt

SEQ ID NO: 8584742 - DNA, 22 bp, Homo sapiens
gagctctaaccagggacaatta

SEQ ID NO: 8584743 - DNA, 22 bp, Homo sapiens
gagcctggacatctcaggccca

SEQ ID NO: 8584744 - DNA, 22 bp, Homo sapiens
gagcctggagctggaacgaagc

SEQ ID NO: 8584745 - DNA, 22 bp, Homo sapiens
gagcctcgtggcggccactgcg

SEQ ID NO: 8584746 - DNA, 22 bp, Homo sapiens
gagcctcctcctggtgtgccga

SEQ ID NO: 8584747 - DNA, 22 bp, Homo sapiens
gagctcttgcttctagtccagg

SEQ ID NO: 8584748 - DNA, 22 bp, Homo sapiens
gagctcttccccatcttacatc

SEQ ID NO: 8584749 - DNA, 19 bp, Homo sapiens
gagctgagagtagcactgg

SEQ ID NO: 8584750 - DNA, 22 bp, Homo sapiens
gaggaggcactagttagtgaca

SEQ ID NO: 8584751 - DNA, 22 bp, Homo sapiens
gaggaggccagtggaaggaagc

SEQ ID NO: 8584752 - DNA, 22 bp, Homo sapiens
gaggaggcacttgagcagatgt

SEQ ID NO: 8584753 - DNA, 22 bp, Homo sapiens
gaggaggcagcctatcccttag

SEQ ID NO: 8584754 - DNA, 22 bp, Homo sapiens
gaggaggctaagtgggctctgg

SEQ ID NO: 8584755 - DNA, 22 bp, Homo sapiens
gaggaggctatcagcaatcagg

SEQ ID NO: 8584756 - DNA, 22 bp, Homo sapiens
gaggcaagagaagccagctttc

SEQ ID NO: 8584757 - DNA, 22 bp, Homo sapiens
gaggagccctgttccccaggcc

SEQ ID NO: 8584758 - DNA, 19 bp, Homo sapiens
gaggagctatcggagacag

SEQ ID NO: 8584759 - DNA, 22 bp, Homo sapiens
gaggagctgttccctcacctct

SEQ ID NO: 8584760 - DNA, 18 bp, Homo sapiens
gaggagccgtccctacta

SEQ ID NO: 8584761 - DNA, 22 bp, Homo sapiens
gaggagcttgtgagaagatgtc

SEQ ID NO: 8584762 - DNA, 22 bp, Homo sapiens
gaggagcttcagaggaatctta

SEQ ID NO: 8584763 - DNA, 22 bp, Homo sapiens
gaggagcttgaggctaggagcc

SEQ ID NO: 8584764 - DNA, 22 bp, Homo sapiens
gaggcaccagccccgctagcct

SEQ ID NO: 8584765 - DNA, 22 bp, Homo sapiens
gaggcaccagacatggcctcat

SEQ ID NO: 8584766 - DNA, 22 bp, Homo sapiens
gaggccagcgcgcagcactttt

SEQ ID NO: 8584767 - DNA, 22 bp, Homo sapiens
gaggccagcccctcttgaaggc

SEQ ID NO: 8584768 - DNA, 22 bp, Homo sapiens
gaggccagctacccaagggtca

SEQ ID NO: 8584769 - DNA, 22 bp, Homo sapiens
gaggccaggacatgaaagctga

SEQ ID NO: 8584770 - DNA, 22 bp, Homo sapiens
gagatgctgtcaggctatctgt

SEQ ID NO: 8584771 - DNA, 22 bp, Homo sapiens
gagatgctatggctattcccct

SEQ ID NO: 8584772 - DNA, 22 bp, Homo sapiens
gagaatctctttgacaagcaga

SEQ ID NO: 8584773 - DNA, 22 bp, Homo sapiens
gacctcatgatccacctgcctt

SEQ ID NO: 8584774 - DNA, 22 bp, Homo sapiens
gagcagatctcaggccttctgt

SEQ ID NO: 8584775 - DNA, 22 bp, Homo sapiens
gagcagatgtgtgccaggatgc

SEQ ID NO: 8584776 - DNA, 22 bp, Homo sapiens
gagatgctttgtgtatagacaa

SEQ ID NO: 8584777 - DNA, 22 bp, Homo sapiens
gagattgggtcttgctctgtca

SEQ ID NO: 8584778 - DNA, 22 bp, Homo sapiens
gagcagcttatgtcaagccaga

SEQ ID NO: 8584779 - DNA, 22 bp, Homo sapiens
gagccaggttggaggctgcagt

SEQ ID NO: 8584780 - DNA, 22 bp, Homo sapiens
gagccaggggtcagctccgagg

SEQ ID NO: 8584781 - DNA, 22 bp, Homo sapiens
gagccagagctacaagtgtctg

SEQ ID NO: 8584782 - DNA, 22 bp, Homo sapiens
gaccctggcaggtagcctcaca

SEQ ID NO: 8584783 - DNA, 22 bp, Homo sapiens
gacaggtgctaagggacctggc

SEQ ID NO: 8584784 - DNA, 20 bp, Homo sapiens
gacaggtgctaaagaggggc

SEQ ID NO: 8584785 - DNA, 20 bp, Homo sapiens
gacaggtgctaaagaggggc

SEQ ID NO: 8584786 - DNA, 22 bp, Homo sapiens
gacaggtgctaagggacctggc

SEQ ID NO: 8584787 - DNA, 22 bp, Homo sapiens
gacaggtggggaaactaaggta

SEQ ID NO: 8584788 - DNA, 18 bp, Homo sapiens
gacaggtgggtgagacca

SEQ ID NO: 8584789 - DNA, 22 bp, Homo sapiens
gacaggtgggtacctttatgga

SEQ ID NO: 8584790 - DNA, 18 bp, Homo sapiens
gacaggtgggtgagacca

SEQ ID NO: 8584791 - DNA, 22 bp, Homo sapiens
gacaggtgggttctcgtatctg

SEQ ID NO: 8584792 - DNA, 22 bp, Homo sapiens
gacaggtgtgtgtatattaggg

SEQ ID NO: 8584793 - DNA, 22 bp, Homo sapiens
gacaggtgtgatgatttaggct

SEQ ID NO: 8584794 - DNA, 21 bp, Homo sapiens
gacaggtgattcagagcaggg

SEQ ID NO: 8584795 - DNA, 20 bp, Homo sapiens
gacaggtgctaaagaggggc

SEQ ID NO: 8584796 - DNA, 21 bp, Homo sapiens
gacaggtgattcagagcaggg

SEQ ID NO: 8584797 - DNA, 22 bp, Homo sapiens
gacaggtgagatgaggaacacc

SEQ ID NO: 8584798 - DNA, 21 bp, Homo sapiens
gacaggtgattcagagcaggg

SEQ ID NO: 8584799 - DNA, 22 bp, Homo sapiens
gacaggtgaaacagcaaggtaa

SEQ ID NO: 8584800 - DNA, 22 bp, Homo sapiens
gacaggtgagatgaggaacacc

SEQ ID NO: 8584801 - DNA, 22 bp, Homo sapiens
gacaggtatttgagagctggga

SEQ ID NO: 8584802 - DNA, 22 bp, Homo sapiens
gacaggtgaaacagcaaggtaa

SEQ ID NO: 8584803 - DNA, 22 bp, Homo sapiens
gacagggtccaaaggcagggga

SEQ ID NO: 8584804 - DNA, 22 bp, Homo sapiens
gacagggtccaaaggcagggga

SEQ ID NO: 8584805 - DNA, 22 bp, Homo sapiens
gacagggacacagccagtgagg

SEQ ID NO: 8584806 - DNA, 22 bp, Homo sapiens
gacaggctgtgatggccgggag

SEQ ID NO: 8584807 - DNA, 22 bp, Homo sapiens
gacaggcttcatgatggcagga

SEQ ID NO: 8584808 - DNA, 22 bp, Homo sapiens
gacaggcctagattcactgctg

SEQ ID NO: 8584809 - DNA, 23 bp, Homo sapiens
gaagttctgttcagccagacaag

SEQ ID NO: 8584810 - DNA, 22 bp, Homo sapiens
gaatacatgtgtgtatagaggt

SEQ ID NO: 8584811 - DNA, 21 bp, Homo sapiens
gaacatttgggttgtttctac

SEQ ID NO: 8584812 - DNA, 22 bp, Homo sapiens
gaagacaattctgggtggagga

SEQ ID NO: 8584813 - DNA, 22 bp, Homo sapiens
gaagacacaattggtgggtcca

SEQ ID NO: 8584814 - DNA, 20 bp, Homo sapiens
gaagacacagagttcatctc

SEQ ID NO: 8584815 - DNA, 21 bp, Homo sapiens
gaagacacataacctctctcc

SEQ ID NO: 8584816 - DNA, 22 bp, Homo sapiens
gaagacattttatgcatactct

SEQ ID NO: 8584817 - DNA, 22 bp, Homo sapiens
gaagaccaatttgggccatggc

SEQ ID NO: 8584818 - DNA, 22 bp, Homo sapiens
gaagacatgtggattctagttt

SEQ ID NO: 8584819 - DNA, 22 bp, Homo sapiens
gaagacatgtttttaatatgta

SEQ ID NO: 8584820 - DNA, 22 bp, Homo sapiens
gaagacactctgcagagttatc

SEQ ID NO: 8584821 - DNA, 22 bp, Homo sapiens
gaagacactaaggcccagggag

SEQ ID NO: 8584822 - DNA, 22 bp, Homo sapiens
gaagacacctactgtcatttct

SEQ ID NO: 8584823 - DNA, 22 bp, Homo sapiens
gaagacactaaactggggcttc

SEQ ID NO: 8584824 - DNA, 22 bp, Homo sapiens
gaagccagattatcacaagcca

SEQ ID NO: 8584825 - DNA, 22 bp, Homo sapiens
gaagattgaaggctgggaatta

SEQ ID NO: 8584826 - DNA, 22 bp, Homo sapiens
gaagaggtagcattggcaggtg

SEQ ID NO: 8584827 - DNA, 22 bp, Homo sapiens
ctttcattcttagatattagtg

SEQ ID NO: 8584828 - DNA, 22 bp, Homo sapiens
gaaatcaaacccttttctgata

SEQ ID NO: 8584829 - DNA, 22 bp, Homo sapiens
gaaatcaatttcttggttgata

SEQ ID NO: 8584830 - DNA, 22 bp, Homo sapiens
gaaatcaaggctacattcaggt

SEQ ID NO: 8584831 - DNA, 22 bp, Homo sapiens
cttcaggaaaatctctaaggat

SEQ ID NO: 8584832 - DNA, 22 bp, Homo sapiens
cttcagctgtggtctccaaggc

SEQ ID NO: 8584833 - DNA, 20 bp, Homo sapiens
cttcaggacccatcctcccc

SEQ ID NO: 8584834 - DNA, 22 bp, Homo sapiens
cttcaggatttaggaagatgaa

SEQ ID NO: 8584835 - DNA, 23 bp, Homo sapiens
cttcagtgtgggactgcagcgtg

SEQ ID NO: 8584836 - DNA, 22 bp, Homo sapiens
cttatattttaggaacagacaa

SEQ ID NO: 8584837 - DNA, 22 bp, Homo sapiens
cttattgaaagcccctgtgcct

SEQ ID NO: 8584838 - DNA, 22 bp, Homo sapiens
cttattggagagttgggccctt

SEQ ID NO: 8584839 - DNA, 22 bp, Homo sapiens
cttattggtggagtcaggccct

SEQ ID NO: 8584840 - DNA, 22 bp, Homo sapiens
cttattgggatgagaggatgca

SEQ ID NO: 8584841 - DNA, 22 bp, Homo sapiens
cttattggtcccaggaggagaa

SEQ ID NO: 8584842 - DNA, 22 bp, Homo sapiens
cttattggtgctttttctcata

SEQ ID NO: 8584843 - DNA, 23 bp, Homo sapiens
cttgcaggaagcagatggcacac

SEQ ID NO: 8584844 - DNA, 20 bp, Homo sapiens
cttgtacatgataaagattt

SEQ ID NO: 8584845 - DNA, 22 bp, Homo sapiens
ctgtggctgcctcacctacagg

SEQ ID NO: 8584846 - DNA, 22 bp, Homo sapiens
ctgtggctgaactctgaagagg

SEQ ID NO: 8584847 - DNA, 22 bp, Homo sapiens
ctgtggctgtgaaacttctcag

SEQ ID NO: 8584848 - DNA, 22 bp, Homo sapiens
ctgtggctggctcatcataggt

SEQ ID NO: 8584849 - DNA, 22 bp, Homo sapiens
ctgtggctgtatttggccagag

SEQ ID NO: 8584850 - DNA, 22 bp, Homo sapiens
ctgtgtccttttagttgctgtg

SEQ ID NO: 8584851 - DNA, 22 bp, Homo sapiens
ctgtgtcctcccgctgcaccca

SEQ ID NO: 8584852 - DNA, 22 bp, Homo sapiens
ctgtgtcctttaaaaaagacac

SEQ ID NO: 8584853 - DNA, 22 bp, Homo sapiens
ctgtgtcctgtctcctaaggtg

SEQ ID NO: 8584854 - DNA, 22 bp, Homo sapiens
ctgtgtcctgcgtcaagccaat

SEQ ID NO: 8584855 - DNA, 22 bp, Homo sapiens
ctgttcagaaaaaatcttcatg

SEQ ID NO: 8584856 - DNA, 20 bp, Homo sapiens
ctgttcctgtcccatgaagc

SEQ ID NO: 8584857 - DNA, 22 bp, Homo sapiens
ctgttgctccagggaacacaga

SEQ ID NO: 8584858 - DNA, 22 bp, Homo sapiens
ctgttgcttcaggaaacagtaa

SEQ ID NO: 8584859 - DNA, 23 bp, Homo sapiens
ctgtggccctgcttcatgcagcc

SEQ ID NO: 8584860 - DNA, 22 bp, Homo sapiens
ctgtggctcatatctgtaatct

SEQ ID NO: 8584861 - DNA, 17 bp, Homo sapiens
ctgtggccacctggatg

SEQ ID NO: 8584862 - DNA, 17 bp, Homo sapiens
ctgtggccacctggatg

SEQ ID NO: 8584863 - DNA, 22 bp, Homo sapiens
ctgtggccagatggtgccagtt

SEQ ID NO: 8584864 - DNA, 23 bp, Homo sapiens
ctgtgcccggggctccacctgat

SEQ ID NO: 8584865 - DNA, 22 bp, Homo sapiens
ctgtgccctctttgctggcctt

SEQ ID NO: 8584866 - DNA, 22 bp, Homo sapiens
ctgtgccctctttgctggcctt

SEQ ID NO: 8584867 - DNA, 22 bp, Homo sapiens
ctgtgccaggcccagctgactt

SEQ ID NO: 8584868 - DNA, 22 bp, Homo sapiens
ctgtgccatcctagggctgctg

SEQ ID NO: 8584869 - DNA, 22 bp, Homo sapiens
ctgtgcccacctggctctgagg

SEQ ID NO: 8584870 - DNA, 22 bp, Homo sapiens
ctgtgcccacctggctctgagg

SEQ ID NO: 8584871 - DNA, 22 bp, Homo sapiens
ctgtgcccaggctggagtgcag

SEQ ID NO: 8584872 - DNA, 22 bp, Homo sapiens
ctgtcctgtggacctgaggacg

SEQ ID NO: 8584873 - DNA, 22 bp, Homo sapiens
ctgtgagggtcacagccatgcc

SEQ ID NO: 8584874 - DNA, 22 bp, Homo sapiens
ctgtgccagcctgtcccaggag

SEQ ID NO: 8584875 - DNA, 22 bp, Homo sapiens
ctgtgccactgccccaggcctc

SEQ ID NO: 8584876 - DNA, 22 bp, Homo sapiens
ctgtcctggggaaagccagccc

SEQ ID NO: 8584877 - DNA, 22 bp, Homo sapiens
ctgtcctggagggcataggacg

SEQ ID NO: 8584878 - DNA, 22 bp, Homo sapiens
ctgtcctgtagctccatcagtc

SEQ ID NO: 8584879 - DNA, 21 bp, Homo sapiens
ctgtcctggtctagaggcaca

SEQ ID NO: 8584880 - DNA, 22 bp, Homo sapiens
ctgtcctgatggtgccactggt

SEQ ID NO: 8584881 - DNA, 22 bp, Homo sapiens
ctgtcctgaagttttcatgaga

SEQ ID NO: 8584882 - DNA, 22 bp, Homo sapiens
ctggctttggtcccctgtgcct

SEQ ID NO: 8584883 - DNA, 22 bp, Homo sapiens
ctggcttttggaaacaggctca

SEQ ID NO: 8584884 - DNA, 22 bp, Homo sapiens
ctgggaagaaattgtgggaggc

SEQ ID NO: 8584885 - DNA, 22 bp, Homo sapiens
ctgggagctcagccctggggtg

SEQ ID NO: 8584886 - DNA, 22 bp, Homo sapiens
ctgggaggattcattgaggtga

SEQ ID NO: 8584887 - DNA, 22 bp, Homo sapiens
ctgggaggcaccgcgtcgtgct

SEQ ID NO: 8584888 - DNA, 22 bp, Homo sapiens
ctggctttcatttcaagcacgt

SEQ ID NO: 8584889 - DNA, 18 bp, Homo sapiens
ctggctttcttatccatc

SEQ ID NO: 8584890 - DNA, 22 bp, Homo sapiens
ctggctttctgaacatcagtga

SEQ ID NO: 8584891 - DNA, 22 bp, Homo sapiens
ctgggaggcccacgttgggaag

SEQ ID NO: 8584892 - DNA, 22 bp, Homo sapiens
ctgggaggcagtctctctagaa

SEQ ID NO: 8584893 - DNA, 22 bp, Homo sapiens
ctgggaggcagtctctctagaa

SEQ ID NO: 8584894 - DNA, 22 bp, Homo sapiens
ctgggaggcggagcttgcagtg

SEQ ID NO: 8584895 - DNA, 22 bp, Homo sapiens
ctgggaggcggagcttgcagtg

SEQ ID NO: 8584896 - DNA, 22 bp, Homo sapiens
ctgggaggcggagcttgcagtg

SEQ ID NO: 8584897 - DNA, 22 bp, Homo sapiens
ctgggaggcactattcaggagg

SEQ ID NO: 8584898 - DNA, 22 bp, Homo sapiens
ctgggaggcagaggttgcagtg

SEQ ID NO: 8584899 - DNA, 22 bp, Homo sapiens
ctgggaggcagtctctctagaa

SEQ ID NO: 8584900 - DNA, 22 bp, Homo sapiens
ctgggaggcagaggttgtagtg

SEQ ID NO: 8584901 - DNA, 22 bp, Homo sapiens
ctgggaggcagaggttgcagtg

SEQ ID NO: 8584902 - DNA, 22 bp, Homo sapiens
ctggggttggccagggccctag

SEQ ID NO: 8584903 - DNA, 22 bp, Homo sapiens
ctggggtgtgctcagagcaggg

SEQ ID NO: 8584904 - DNA, 22 bp, Homo sapiens
ctggggctgcggtggaggagcc

SEQ ID NO: 8584905 - DNA, 22 bp, Homo sapiens
ctggggctgcggacgggagccc

SEQ ID NO: 8584906 - DNA, 22 bp, Homo sapiens
ctggggccagtgaggaggcttt

SEQ ID NO: 8584907 - DNA, 22 bp, Homo sapiens
ctggggccagtgaggaggcttt

SEQ ID NO: 8584908 - DNA, 22 bp, Homo sapiens
ctggggcccatcgagggctgag

SEQ ID NO: 8584909 - DNA, 22 bp, Homo sapiens
ctggggctctctggaatgcttg

SEQ ID NO: 8584910 - DNA, 23 bp, Homo sapiens
ctgggctgcttgagtccctggct

SEQ ID NO: 8584911 - DNA, 22 bp, Homo sapiens
ctgggctgcttgctgaaggggt

SEQ ID NO: 8584912 - DNA, 22 bp, Homo sapiens
ctgggctgctgtccactagggt

SEQ ID NO: 8584913 - DNA, 20 bp, Homo sapiens
ctggggaggaggatgtgttc

SEQ ID NO: 8584914 - DNA, 22 bp, Homo sapiens
ctgggctgcggttctctgaagc

SEQ ID NO: 8584915 - DNA, 22 bp, Homo sapiens
ctgggctgcggtggtaggttgt

SEQ ID NO: 8584916 - DNA, 22 bp, Homo sapiens
ctgggctgcagttcctggtcct

SEQ ID NO: 8584917 - DNA, 22 bp, Homo sapiens
ctgggctgcaggagtggggcaa

SEQ ID NO: 8584918 - DNA, 22 bp, Homo sapiens
ctgggctgcagcgggagcgacg

SEQ ID NO: 8584919 - DNA, 19 bp, Homo sapiens
ctgggccagagctgtcctc

SEQ ID NO: 8584920 - DNA, 22 bp, Homo sapiens
ctgggctctgcagttgatgttt

SEQ ID NO: 8584921 - DNA, 22 bp, Homo sapiens
ctgggctctaggaaccattcct

SEQ ID NO: 8584922 - DNA, 22 bp, Homo sapiens
ctggctccaaattctgatgttc

SEQ ID NO: 8584923 - DNA, 22 bp, Homo sapiens
ctggctccaaggaagaggtttt

SEQ ID NO: 8584924 - DNA, 22 bp, Homo sapiens
ctggctccaaggaagaggtttt

SEQ ID NO: 8584925 - DNA, 22 bp, Homo sapiens
ctggctcttcagtgcttggttc

SEQ ID NO: 8584926 - DNA, 22 bp, Homo sapiens
ctggctcttgcgactcagcttg

SEQ ID NO: 8584927 - DNA, 22 bp, Homo sapiens
ctggctcattttagcatcaggt

SEQ ID NO: 8584928 - DNA, 22 bp, Homo sapiens
ctggctgtgcagtcttccagaa

SEQ ID NO: 8584929 - DNA, 22 bp, Homo sapiens
ctggctgcgctagtccagaaga

SEQ ID NO: 8584930 - DNA, 22 bp, Homo sapiens
ctggctgccacttcagggtctt

SEQ ID NO: 8584931 - DNA, 22 bp, Homo sapiens
ctggccctgtggaggcaggaac

SEQ ID NO: 8584932 - DNA, 22 bp, Homo sapiens
ctggctcacctccgctccagca

SEQ ID NO: 8584933 - DNA, 22 bp, Homo sapiens
ctggcccagtctcagagtgtca

SEQ ID NO: 8584934 - DNA, 22 bp, Homo sapiens
ctggcccagtctcagagtgtca

SEQ ID NO: 8584935 - DNA, 19 bp, Homo sapiens
ctggccaggccaggggccc

SEQ ID NO: 8584936 - DNA, 22 bp, Homo sapiens
ctggccaggcatcccctgatcc

SEQ ID NO: 8584937 - DNA, 22 bp, Homo sapiens
ctggccaggccccttgcagggc

SEQ ID NO: 8584938 - DNA, 22 bp, Homo sapiens
ctggcaggcagacttctgcaag

SEQ ID NO: 8584939 - DNA, 22 bp, Homo sapiens
ctggcaggagcattcacagagg

SEQ ID NO: 8584940 - DNA, 22 bp, Homo sapiens
ctggccaggaggtaaccagatg

SEQ ID NO: 8584941 - DNA, 22 bp, Homo sapiens
ctggccagctgacagcagggct

SEQ ID NO: 8584942 - DNA, 22 bp, Homo sapiens
ctggccagcctgtcgatgccct

SEQ ID NO: 8584943 - DNA, 22 bp, Homo sapiens
ctggccagcctcccaggtaccc

SEQ ID NO: 8584944 - DNA, 22 bp, Homo sapiens
ctggccagcctgtcgatgccct

SEQ ID NO: 8584945 - DNA, 22 bp, Homo sapiens
ctggccagcatttttgctttag

SEQ ID NO: 8584946 - DNA, 22 bp, Homo sapiens
ctggccagcatggctgaagtac

SEQ ID NO: 8584947 - DNA, 22 bp, Homo sapiens
ctggccagatgttacgtccaat

SEQ ID NO: 8584948 - DNA, 22 bp, Homo sapiens
ctggccagagttggagggtgtg

SEQ ID NO: 8584949 - DNA, 22 bp, Homo sapiens
ctggcagcccaacctagagtct

SEQ ID NO: 8584950 - DNA, 22 bp, Homo sapiens
ctgcatccatgttgctgcaaag

SEQ ID NO: 8584951 - DNA, 22 bp, Homo sapiens
ccttcctggagcccatgcagat

SEQ ID NO: 8584952 - DNA, 19 bp, Homo sapiens
cctgtgtggggtagagatc

SEQ ID NO: 8584953 - DNA, 22 bp, Homo sapiens
cctgtctgtcctctcatgagcc

SEQ ID NO: 8584954 - DNA, 22 bp, Homo sapiens
cctgtctggaacatggcctgtt

SEQ ID NO: 8584955 - DNA, 22 bp, Homo sapiens
cctgtcactgttgcagccagct

SEQ ID NO: 8584956 - DNA, 18 bp, Homo sapiens
cctgtcacgtccaggcct

SEQ ID NO: 8584957 - DNA, 22 bp, Homo sapiens
cctgtctgcagatatctcaggt

SEQ ID NO: 8584958 - DNA, 22 bp, Homo sapiens
cctgtctgaatcatgatttcct

SEQ ID NO: 8584959 - DNA, 22 bp, Homo sapiens
cctgtgggttttctgtagaaat

SEQ ID NO: 8584960 - DNA, 22 bp, Homo sapiens
cctgtgcttcagctggaggagg

SEQ ID NO: 8584961 - DNA, 19 bp, Homo sapiens
cctgtgctaggagctgacc

SEQ ID NO: 8584962 - DNA, 22 bp, Homo sapiens
tgtgtctcaagtcagagcatca

SEQ ID NO: 8584963 - DNA, 22 bp, Homo sapiens
cctgggagtgtcagacttgctt

SEQ ID NO: 8584964 - DNA, 22 bp, Homo sapiens
cctgggagtgtgccatctctgt

SEQ ID NO: 8584965 - DNA, 22 bp, Homo sapiens
cctgggagtgcacaggtttcgt

SEQ ID NO: 8584966 - DNA, 22 bp, Homo sapiens
cctgggagtggcactcacagca

SEQ ID NO: 8584967 - DNA, 19 bp, Homo sapiens
cctgggagtcagctgaagg

SEQ ID NO: 8584968 - DNA, 22 bp, Homo sapiens
cctgggaggtggatgttgcggt

SEQ ID NO: 8584969 - DNA, 23 bp, Homo sapiens
tggggccaagtgaggaagggtct

SEQ ID NO: 8584970 - DNA, 22 bp, Homo sapiens
cctgggcttacgacctctgact

SEQ ID NO: 8584971 - DNA, 22 bp, Homo sapiens
cctgggcttacgacctctgact

SEQ ID NO: 8584972 - DNA, 22 bp, Homo sapiens
cctgggctgggcgtctcatggg

SEQ ID NO: 8584973 - DNA, 22 bp, Homo sapiens
tgtgtctggaccggggaggagc

SEQ ID NO: 8584974 - DNA, 22 bp, Homo sapiens
cctgggctcaagtgatcctcct

SEQ ID NO: 8584975 - DNA, 19 bp, Homo sapiens
tgttcagatatgtcagctt

SEQ ID NO: 8584976 - DNA, 22 bp, Homo sapiens
tgttacagaatgaatttccgga

SEQ ID NO: 8584977 - DNA, 22 bp, Homo sapiens
tgttacagaaatattgcttctt

SEQ ID NO: 8584978 - DNA, 22 bp, Homo sapiens
tgttacagtcattgttttctga

SEQ ID NO: 8584979 - DNA, 22 bp, Homo sapiens
tgttacagtactacaattctgc

SEQ ID NO: 8584980 - DNA, 22 bp, Homo sapiens
tgttccagattcggcgtgggac

SEQ ID NO: 8584981 - DNA, 22 bp, Homo sapiens
tgttccagatttagccaaccga

SEQ ID NO: 8584982 - DNA, 23 bp, Homo sapiens
tgttccagatacgccttttcctc

SEQ ID NO: 8584983 - DNA, 22 bp, Homo sapiens
ttaggaagttatagtggaaatg

SEQ ID NO: 8584984 - DNA, 22 bp, Homo sapiens
ttaggaagtttcagaaaatgca

SEQ ID NO: 8584985 - DNA, 20 bp, Homo sapiens
ttaggaagtcacaatttcag

SEQ ID NO: 8584986 - DNA, 22 bp, Homo sapiens
cgcaggtgccggcagatggggt

SEQ ID NO: 8584987 - DNA, 19 bp, Homo sapiens
cgcaggtggaaggagccgc

SEQ ID NO: 8584988 - DNA, 22 bp, Homo sapiens
cgcagctggatatcatgtgcct

SEQ ID NO: 8584989 - DNA, 22 bp, Homo sapiens
cgcaggtgttcagtaaatgtat

SEQ ID NO: 8584990 - DNA, 22 bp, Homo sapiens
cgcaggtgggcccttcattgat

SEQ ID NO: 8584991 - DNA, 22 bp, Homo sapiens
cgcaggtgtgttttcaggacta

SEQ ID NO: 8584992 - DNA, 22 bp, Homo sapiens
cgccagtggcagctggaacagg

SEQ ID NO: 8584993 - DNA, 23 bp, Homo sapiens
cgcccagcctcagtgacctgggc

SEQ ID NO: 8584994 - DNA, 22 bp, Homo sapiens
cgcccacgaagtaggtggcatt

SEQ ID NO: 8584995 - DNA, 22 bp, Homo sapiens
ttaggatttgaaaaggggcaga

SEQ ID NO: 8584996 - DNA, 22 bp, Homo sapiens
ttaggctgttcttgtgttgtta

SEQ ID NO: 8584997 - DNA, 22 bp, Homo sapiens
ttcagaggtaagggtctcagaa

SEQ ID NO: 8584998 - DNA, 20 bp, Homo sapiens
ttcagaggtgaagttgtggt

SEQ ID NO: 8584999 - DNA, 21 bp, Homo sapiens
ttcagaggatgccaaggtcca

SEQ ID NO: 8585000 - DNA, 22 bp, Homo sapiens
ttcagaggctctgccaatgtgt

SEQ ID NO: 8585001 - DNA, 22 bp, Homo sapiens
ttcaggagtgtcaggagtgcct

SEQ ID NO: 8585002 - DNA, 20 bp, Homo sapiens
ttcaggattctagaccacac

SEQ ID NO: 8585003 - DNA, 22 bp, Homo sapiens
cgggggagttgaggcacatggg

SEQ ID NO: 8585004 - DNA, 22 bp, Homo sapiens
cggggctgtagcacagctgagc

SEQ ID NO: 8585005 - DNA, 22 bp, Homo sapiens
cgtaggtggctcagcacctggg

SEQ ID NO: 8585006 - DNA, 22 bp, Homo sapiens
ctaaatactagccttcagattt

SEQ ID NO: 8585007 - DNA, 22 bp, Homo sapiens
ctcacactgtgccaaatccttt

SEQ ID NO: 8585008 - DNA, 22 bp, Homo sapiens
ctagcagggattgggcactggg

SEQ ID NO: 8585009 - DNA, 22 bp, Homo sapiens
ctagcaggtcaaaccagctgat

SEQ ID NO: 8585010 - DNA, 22 bp, Homo sapiens
ctagatgccaatttttatggat

SEQ ID NO: 8585011 - DNA, 22 bp, Homo sapiens
ctacagagtatctaaagaggta

SEQ ID NO: 8585012 - DNA, 22 bp, Homo sapiens
ctacaggaaggatcttgctcaa

SEQ ID NO: 8585013 - DNA, 22 bp, Homo sapiens
ctacaggctcagggagccctct

SEQ ID NO: 8585014 - DNA, 22 bp, Homo sapiens
ttcctgggactggagcagccca

SEQ ID NO: 8585015 - DNA, 19 bp, Homo sapiens
ttcctggctcttctgtttt

SEQ ID NO: 8585016 - DNA, 22 bp, Homo sapiens
ctacaacaccaggcacggagtg

SEQ ID NO: 8585017 - DNA, 22 bp, Homo sapiens
ctacaacatagtcttctacaga

SEQ ID NO: 8585018 - DNA, 22 bp, Homo sapiens
ttcctgggctgcagagagcacc

SEQ ID NO: 8585019 - DNA, 22 bp, Homo sapiens
ttcctgggctgcagagagcacc

SEQ ID NO: 8585020 - DNA, 21 bp, Homo sapiens
ttcctggggaaggagctgcct

SEQ ID NO: 8585021 - DNA, 22 bp, Homo sapiens
ctgacagatgctgctggcagta

SEQ ID NO: 8585022 - DNA, 22 bp, Homo sapiens
ctgagcctgtgtttctctggca

SEQ ID NO: 8585023 - DNA, 22 bp, Homo sapiens
ctgagcccaggcgggagctgag

SEQ ID NO: 8585024 - DNA, 20 bp, Homo sapiens
ctgagcccccagcctgcagg

SEQ ID NO: 8585025 - DNA, 22 bp, Homo sapiens
ctgcaaagctgttcacaaattt

SEQ ID NO: 8585026 - DNA, 18 bp, Homo sapiens
ctgaggcccagagagggc

SEQ ID NO: 8585027 - DNA, 22 bp, Homo sapiens
ctgcaggggcagtccacttcct

SEQ ID NO: 8585028 - DNA, 22 bp, Homo sapiens
ctgcagggcccgcctgagccct

SEQ ID NO: 8585029 - DNA, 22 bp, Homo sapiens
ctgcagggatgtgaggcccgtt

SEQ ID NO: 8585030 - DNA, 22 bp, Homo sapiens
ctgcagggcagggcctcctggc

SEQ ID NO: 8585031 - DNA, 22 bp, Homo sapiens
ctgcacccatgagctcaaggga

SEQ ID NO: 8585032 - DNA, 22 bp, Homo sapiens
ctgcaggcatctaactgtgggc

SEQ ID NO: 8585033 - DNA, 22 bp, Homo sapiens
ttttcagaggcctaagaggttt

SEQ ID NO: 8585034 - DNA, 22 bp, Homo sapiens
ctcttccatattactcagggta

SEQ ID NO: 8585035 - DNA, 22 bp, Homo sapiens
ctcttccacctccttcaggaga

SEQ ID NO: 8585036 - DNA, 22 bp, Homo sapiens
tttgggaataattgcacagatt

SEQ ID NO: 8585037 - DNA, 22 bp, Homo sapiens
ctctgcccgcggatgccacgtc

SEQ ID NO: 8585038 - DNA, 22 bp, Homo sapiens
ctctgccagccaaagtcatcac

SEQ ID NO: 8585039 - DNA, 22 bp, Homo sapiens
ttgaaatagatgcgtcagagat

SEQ ID NO: 8585040 - DNA, 22 bp, Homo sapiens
ttggtcagcactgatgtttcag

SEQ ID NO: 8585041 - DNA, 22 bp, Homo sapiens
ttggtcagctaataaggacagg

SEQ ID NO: 8585042 - DNA, 22 bp, Homo sapiens
ttggtcagattgggcttccatt

SEQ ID NO: 8585043 - DNA, 22 bp, Homo sapiens
ttggtcagatgtgtctcctcct

SEQ ID NO: 8585044 - DNA, 22 bp, Homo sapiens
ttgtacaacgttttaaatttga

SEQ ID NO: 8585045 - DNA, 22 bp, Homo sapiens
ttgtcttttgtgggaaatatgg

SEQ ID NO: 8585046 - DNA, 22 bp, Homo sapiens
ctccatggaaccggggctgctt

SEQ ID NO: 8585047 - DNA, 22 bp, Homo sapiens
ctcccaggcacagggaggagcc

SEQ ID NO: 8585048 - DNA, 22 bp, Homo sapiens
ctcccaggactcagaggagaag

SEQ ID NO: 8585049 - DNA, 22 bp, Homo sapiens
ctcccaggcagggctgcccact

SEQ ID NO: 8585050 - DNA, 22 bp, Homo sapiens
ctcccaggcagggctgcccact

SEQ ID NO: 8585051 - DNA, 22 bp, Homo sapiens
ctcccaggccatgctctagcca

SEQ ID NO: 8585052 - DNA, 20 bp, Homo sapiens
tttaggtcctgtgcctgggt

SEQ ID NO: 8585053 - DNA, 22 bp, Homo sapiens
tttattgttgggtcttaagctg

SEQ ID NO: 8585054 - DNA, 22 bp, Homo sapiens
tttattgttatcatgggtgagt

SEQ ID NO: 8585055 - DNA, 22 bp, Homo sapiens
tttattgttgttagtcataagt

SEQ ID NO: 8585056 - DNA, 22 bp, Homo sapiens
tttattgtttagaagggggctg

SEQ ID NO: 8585057 - DNA, 22 bp, Homo sapiens
ctctctgatgtcaggtcgctga

SEQ ID NO: 8585058 - DNA, 22 bp, Homo sapiens
ctctctgaaactggagagtctc

SEQ ID NO: 8585059 - DNA, 22 bp, Homo sapiens
ctctctgaggaaggagcatctg

SEQ ID NO: 8585060 - DNA, 22 bp, Homo sapiens
ctctccagggcatgagttccac

SEQ ID NO: 8585061 - DNA, 18 bp, Homo sapiens
tactttattccccctcca

SEQ ID NO: 8585062 - DNA, 22 bp, Homo sapiens
tactttattcaggaaggctggt

SEQ ID NO: 8585063 - DNA, 22 bp, Homo sapiens
tactttattgtaaatgctgatg

SEQ ID NO: 8585064 - DNA, 22 bp, Homo sapiens
tactttatcagcgtcaaaggta

SEQ ID NO: 8585065 - DNA, 22 bp, Homo sapiens
tactttatattgtggctggcca

SEQ ID NO: 8585066 - DNA, 22 bp, Homo sapiens
caggccgggcactgcgctaggt

SEQ ID NO: 8585067 - DNA, 22 bp, Homo sapiens
tacatgttcaaatttgtctttc

SEQ ID NO: 8585068 - DNA, 22 bp, Homo sapiens
caggctggagttcagtggtgtg

SEQ ID NO: 8585069 - DNA, 22 bp, Homo sapiens
caggctggagtgcagtggtgcc

SEQ ID NO: 8585070 - DNA, 22 bp, Homo sapiens
caggcttttgcatagcactggg

SEQ ID NO: 8585071 - DNA, 22 bp, Homo sapiens
caggcttttatgaatttcagtg

SEQ ID NO: 8585072 - DNA, 22 bp, Homo sapiens
caggctttcaggacagcgagcc

SEQ ID NO: 8585073 - DNA, 22 bp, Homo sapiens
tagattcatgcagtatgctagt

SEQ ID NO: 8585074 - DNA, 22 bp, Homo sapiens
cagggacaatggcagagcctga

SEQ ID NO: 8585075 - DNA, 22 bp, Homo sapiens
taatcagggatgaaaaatgtca

SEQ ID NO: 8585076 - DNA, 22 bp, Homo sapiens
caggcatggaaaagcccagagg

SEQ ID NO: 8585077 - DNA, 22 bp, Homo sapiens
caggcatgcttctgtctgggca

SEQ ID NO: 8585078 - DNA, 22 bp, Homo sapiens
caggccaggtgctctagaatca

SEQ ID NO: 8585079 - DNA, 22 bp, Homo sapiens
caggccagggttgagaagagaa

SEQ ID NO: 8585080 - DNA, 19 bp, Homo sapiens
caggccagtgtcagggggc

SEQ ID NO: 8585081 - DNA, 22 bp, Homo sapiens
caggccaggtggcaggcaaaac

SEQ ID NO: 8585082 - DNA, 22 bp, Homo sapiens
caggccaggtggcaggcaaaac

SEQ ID NO: 8585083 - DNA, 22 bp, Homo sapiens
caggccagtgggaaatagggat

SEQ ID NO: 8585084 - DNA, 22 bp, Homo sapiens
caggccagtgtgcttcccaggc

SEQ ID NO: 8585085 - DNA, 22 bp, Homo sapiens
caggccagttttgatttaagcc

SEQ ID NO: 8585086 - DNA, 22 bp, Homo sapiens
tacaaaacagtgctctggtcct

SEQ ID NO: 8585087 - DNA, 22 bp, Homo sapiens
caggccagagcgcgtggttggg

SEQ ID NO: 8585088 - DNA, 22 bp, Homo sapiens
tacaaaaaattgatactgacga

SEQ ID NO: 8585089 - DNA, 22 bp, Homo sapiens
taataattggcaatgttgagca

SEQ ID NO: 8585090 - DNA, 22 bp, Homo sapiens
caggcagatgctgacaagagtt

SEQ ID NO: 8585091 - DNA, 22 bp, Homo sapiens
caggcagagttagagcaactgg

SEQ ID NO: 8585092 - DNA, 22 bp, Homo sapiens
cagctcaagtttcccaggtcag

SEQ ID NO: 8585093 - DNA, 22 bp, Homo sapiens
taagtcacttaagtttgcatgt

SEQ ID NO: 8585094 - DNA, 22 bp, Homo sapiens
caggtggcagaggtctctggaa

SEQ ID NO: 8585095 - DNA, 22 bp, Homo sapiens
caggtggccttgccatctcctg

SEQ ID NO: 8585096 - DNA, 22 bp, Homo sapiens
caggtggcatgactgcctacaa

SEQ ID NO: 8585097 - DNA, 22 bp, Homo sapiens
caggtggcattgtcccgccagc

SEQ ID NO: 8585098 - DNA, 20 bp, Homo sapiens
tattaggtagcactgggata

SEQ ID NO: 8585099 - DNA, 19 bp, Homo sapiens
caggtggcgctctacaggg

SEQ ID NO: 8585100 - DNA, 19 bp, Homo sapiens
caggtggcgctctacaggg

SEQ ID NO: 8585101 - DNA, 22 bp, Homo sapiens
caggtggctaacggcctcatag

SEQ ID NO: 8585102 - DNA, 22 bp, Homo sapiens
caggtgggtacatcacagagac

SEQ ID NO: 8585103 - DNA, 22 bp, Homo sapiens
caggtgggtacatcacagagac

SEQ ID NO: 8585104 - DNA, 22 bp, Homo sapiens
tattattaaatggcagaatttt

SEQ ID NO: 8585105 - DNA, 22 bp, Homo sapiens
caggtagggatatgatggtgat

SEQ ID NO: 8585106 - DNA, 22 bp, Homo sapiens
caggtaggggagagctccaaca

SEQ ID NO: 8585107 - DNA, 22 bp, Homo sapiens
caggtagtccacagtgagggag

SEQ ID NO: 8585108 - DNA, 22 bp, Homo sapiens
cagggtttcaccatgttagcag

SEQ ID NO: 8585109 - DNA, 22 bp, Homo sapiens
caggtaaaggttaactattaga

SEQ ID NO: 8585110 - DNA, 22 bp, Homo sapiens
caggtaaagcttcaaatcactt

SEQ ID NO: 8585111 - DNA, 22 bp, Homo sapiens
tattttatctgccagagtggag

SEQ ID NO: 8585112 - DNA, 22 bp, Homo sapiens
tattttacagactactttagat

SEQ ID NO: 8585113 - DNA, 22 bp, Homo sapiens
caggtgggtgtatgaatgcaaa

SEQ ID NO: 8585114 - DNA, 19 bp, Homo sapiens
caggtggtaatctgagcct

SEQ ID NO: 8585115 - DNA, 22 bp, Homo sapiens
caggtgggtgtatgaatgcaaa

SEQ ID NO: 8585116 - DNA, 22 bp, Homo sapiens
caggtggtacttaaagtcagaa

SEQ ID NO: 8585117 - DNA, 23 bp, Homo sapiens
caggtggtagagaaaaatccaga

SEQ ID NO: 8585118 - DNA, 22 bp, Homo sapiens
caggtggtcaggcaaggacacg

SEQ ID NO: 8585119 - DNA, 22 bp, Homo sapiens
cagtcacatttcgacataacta

SEQ ID NO: 8585120 - DNA, 22 bp, Homo sapiens
cagtcaccaccaggtggcagta

SEQ ID NO: 8585121 - DNA, 22 bp, Homo sapiens
cagtcacatggatgatggatag

SEQ ID NO: 8585122 - DNA, 22 bp, Homo sapiens
cagtcacctgaagacttgacca

SEQ ID NO: 8585123 - DNA, 22 bp, Homo sapiens
cagtcaccatagaataaaacat

SEQ ID NO: 8585124 - DNA, 22 bp, Homo sapiens
cagtcacctagacagaacttac

SEQ ID NO: 8585125 - DNA, 22 bp, Homo sapiens
cagtcaccttgaggactcagac

SEQ ID NO: 8585126 - DNA, 22 bp, Homo sapiens
cagtcactccagcctgcctcag

SEQ ID NO: 8585127 - DNA, 22 bp, Homo sapiens
cagtcacaagcgtacctaattt

SEQ ID NO: 8585128 - DNA, 22 bp, Homo sapiens
cagtcacataggtatacacata

SEQ ID NO: 8585129 - DNA, 22 bp, Homo sapiens
taggaggcatttgctcccaggg

SEQ ID NO: 8585130 - DNA, 22 bp, Homo sapiens
taggaggccatccagcctgcct

SEQ ID NO: 8585131 - DNA, 22 bp, Homo sapiens
taggaggctcatgttacaggaa

SEQ ID NO: 8585132 - DNA, 18 bp, Homo sapiens
taggaggctcctgggggc

SEQ ID NO: 8585133 - DNA, 22 bp, Homo sapiens
taggaggcttaaagctgctcag

SEQ ID NO: 8585134 - DNA, 22 bp, Homo sapiens
taggaggcagtcgttcttcagt

SEQ ID NO: 8585135 - DNA, 22 bp, Homo sapiens
taggccagaggagcagctttgg

SEQ ID NO: 8585136 - DNA, 22 bp, Homo sapiens
taggccagaggagcagctttgg

SEQ ID NO: 8585137 - DNA, 22 bp, Homo sapiens
cagggccattggcgtggctgtc

SEQ ID NO: 8585138 - DNA, 22 bp, Homo sapiens
cagggccatatcttgtgcacca

SEQ ID NO: 8585139 - DNA, 22 bp, Homo sapiens
cagggccagttctcgcagcagt

SEQ ID NO: 8585140 - DNA, 22 bp, Homo sapiens
cagggccattggaacaaagagg

SEQ ID NO: 8585141 - DNA, 22 bp, Homo sapiens
cagggccatgaggcacagggtc

SEQ ID NO: 8585142 - DNA, 22 bp, Homo sapiens
cagggccagggctatggtgaag

SEQ ID NO: 8585143 - DNA, 22 bp, Homo sapiens
cagggccagggctccatttcct

SEQ ID NO: 8585144 - DNA, 22 bp, Homo sapiens
cagggccagggacacgctgtca

SEQ ID NO: 8585145 - DNA, 22 bp, Homo sapiens
cagggccaggctgatggcctgg

SEQ ID NO: 8585146 - DNA, 22 bp, Homo sapiens
cagggccaggctgatggcctgg

SEQ ID NO: 8585147 - DNA, 22 bp, Homo sapiens
cagggccactgcatgaggttca

SEQ ID NO: 8585148 - DNA, 22 bp, Homo sapiens
cagggagcagcgctggggcctc

SEQ ID NO: 8585149 - DNA, 22 bp, Homo sapiens
cagggagcagcgctggggcctc

SEQ ID NO: 8585150 - DNA, 22 bp, Homo sapiens
cagggagcactgcgagcggcag

SEQ ID NO: 8585151 - DNA, 22 bp, Homo sapiens
cagggtcaccagagatctgcat

SEQ ID NO: 8585152 - DNA, 22 bp, Homo sapiens
cagggtcatggcacctgcacgg

SEQ ID NO: 8585153 - DNA, 22 bp, Homo sapiens
cagggtccggctgcctggctgt

SEQ ID NO: 8585154 - DNA, 22 bp, Homo sapiens
caggggtgtttttggccaggag

SEQ ID NO: 8585155 - DNA, 22 bp, Homo sapiens
caggggtggctgcagcagaggt

SEQ ID NO: 8585156 - DNA, 22 bp, Homo sapiens
cagggggtggtccaggctgcgc

SEQ ID NO: 8585157 - DNA, 22 bp, Homo sapiens
caggggcctgtcctggcttctg

SEQ ID NO: 8585158 - DNA, 22 bp, Homo sapiens
cagggggctcaaaggagagtgc

SEQ ID NO: 8585159 - DNA, 22 bp, Homo sapiens
caggggctgtttgcctcaggcc

SEQ ID NO: 8585160 - DNA, 22 bp, Homo sapiens
caggggctgtttgcctcaggcc

SEQ ID NO: 8585161 - DNA, 22 bp, Homo sapiens
catttattgagtggccacagtg

SEQ ID NO: 8585162 - DNA, 22 bp, Homo sapiens
catttattcatgatctgtagct

SEQ ID NO: 8585163 - DNA, 22 bp, Homo sapiens
catttattctcagatccttgtc

SEQ ID NO: 8585164 - DNA, 22 bp, Homo sapiens
catttattcatttgctagggct

SEQ ID NO: 8585165 - DNA, 22 bp, Homo sapiens
catttattcagctcagtcggtt

SEQ ID NO: 8585166 - DNA, 22 bp, Homo sapiens
tccctctccctattgcctggag

SEQ ID NO: 8585167 - DNA, 22 bp, Homo sapiens
cattagattggtgcaaaaataa

SEQ ID NO: 8585168 - DNA, 22 bp, Homo sapiens
cattcatttatgaaatatctat

SEQ ID NO: 8585169 - DNA, 22 bp, Homo sapiens
cattctatgaaaactaggcaat

SEQ ID NO: 8585170 - DNA, 19 bp, Homo sapiens
tccaggagcaaagccagtt

SEQ ID NO: 8585171 - DNA, 22 bp, Homo sapiens
tccaggagcatccaggtgaagc

SEQ ID NO: 8585172 - DNA, 21 bp, Homo sapiens
tccaggagcacgggactagga

SEQ ID NO: 8585173 - DNA, 22 bp, Homo sapiens
tccaggagacacaaggtacata

SEQ ID NO: 8585174 - DNA, 22 bp, Homo sapiens
tccaggagacacaaggtacata

SEQ ID NO: 8585175 - DNA, 22 bp, Homo sapiens
tccaggagacacccttgtgtgt

SEQ ID NO: 8585176 - DNA, 22 bp, Homo sapiens
tccaggagaccagatgtaggcc

SEQ ID NO: 8585177 - DNA, 17 bp, Homo sapiens
tccaggagaggcaatgg

SEQ ID NO: 8585178 - DNA, 22 bp, Homo sapiens
tccaggagaggcctgaccaggt

SEQ ID NO: 8585179 - DNA, 22 bp, Homo sapiens
tccaggagatacactgcaccag

SEQ ID NO: 8585180 - DNA, 22 bp, Homo sapiens
tccaggagattcattaggtcat

SEQ ID NO: 8585181 - DNA, 22 bp, Homo sapiens
catgggcccgtgagaggcaggg

SEQ ID NO: 8585182 - DNA, 22 bp, Homo sapiens
ccaaggcttcccagagatgctc

SEQ ID NO: 8585183 - DNA, 22 bp, Homo sapiens
tcctggcagcccgcaggtgctg

SEQ ID NO: 8585184 - DNA, 22 bp, Homo sapiens
tcctggcagagagcatgaggcc

SEQ ID NO: 8585185 - DNA, 22 bp, Homo sapiens
ccaaggctgtggggctgtgcag

SEQ ID NO: 8585186 - DNA, 22 bp, Homo sapiens
ccaaggcacactctgcaaggtt

SEQ ID NO: 8585187 - DNA, 22 bp, Homo sapiens
ccaaggcacactctgcaaggtt

SEQ ID NO: 8585188 - DNA, 22 bp, Homo sapiens
ccaaggcagaagatggctcttg

SEQ ID NO: 8585189 - DNA, 22 bp, Homo sapiens
ccaaggcaatgtgcagctggtg

SEQ ID NO: 8585190 - DNA, 22 bp, Homo sapiens
tcctgggagcccttgctccacc

SEQ ID NO: 8585191 - DNA, 22 bp, Homo sapiens
tcctgggagcacatggtcctgc

SEQ ID NO: 8585192 - DNA, 22 bp, Homo sapiens
tcctgggagcatggtgccgtga

SEQ ID NO: 8585193 - DNA, 22 bp, Homo sapiens
ccacacagtcagtttccaagaa

SEQ ID NO: 8585194 - DNA, 22 bp, Homo sapiens
tcctggcaggtgtattggctgt

SEQ ID NO: 8585195 - DNA, 22 bp, Homo sapiens
tcctggcagtaatttgatgttg

SEQ ID NO: 8585196 - DNA, 18 bp, Homo sapiens
tcctggcagtcagagagg

SEQ ID NO: 8585197 - DNA, 22 bp, Homo sapiens
tcctggcagtaatttgatgttg

SEQ ID NO: 8585198 - DNA, 22 bp, Homo sapiens
tcctggcagaaatggggctgtg

SEQ ID NO: 8585199 - DNA, 22 bp, Homo sapiens
tcctggcagggaacttgtcagc

SEQ ID NO: 8585200 - DNA, 22 bp, Homo sapiens
tcctggcagggaacttgtcagc

SEQ ID NO: 8585201 - DNA, 22 bp, Homo sapiens
tcctggcagggtctaggtctag

SEQ ID NO: 8585202 - DNA, 21 bp, Homo sapiens
tccttcagttctgcactttct

SEQ ID NO: 8585203 - DNA, 22 bp, Homo sapiens
tccttccaggtccagggatgtg

SEQ ID NO: 8585204 - DNA, 19 bp, Homo sapiens
tcctggggaggggcatggc

SEQ ID NO: 8585205 - DNA, 22 bp, Homo sapiens
ccagagaaccttgagctgtgag

SEQ ID NO: 8585206 - DNA, 22 bp, Homo sapiens
ccagagaagaaaagcacctttt

SEQ ID NO: 8585207 - DNA, 22 bp, Homo sapiens
ccagagaaccatctgcttgagg

SEQ ID NO: 8585208 - DNA, 22 bp, Homo sapiens
ccagacagttccttgaggttca

SEQ ID NO: 8585209 - DNA, 22 bp, Homo sapiens
ccagagaaggtggagcttgtgt

SEQ ID NO: 8585210 - DNA, 22 bp, Homo sapiens
ccagagaattttagacaaaaat

SEQ ID NO: 8585211 - DNA, 22 bp, Homo sapiens
ccagagaatccggagagtccat

SEQ ID NO: 8585212 - DNA, 22 bp, Homo sapiens
ccagagaagtcttgcctggatt

SEQ ID NO: 8585213 - DNA, 19 bp, Homo sapiens
ccagagacattggcatctt

SEQ ID NO: 8585214 - DNA, 22 bp, Homo sapiens
ccagacaggggctgttcctgct

SEQ ID NO: 8585215 - DNA, 22 bp, Homo sapiens
tctaagaggcatcaagacaagc

SEQ ID NO: 8585216 - DNA, 22 bp, Homo sapiens
ccacttcatcccagctcagata

SEQ ID NO: 8585217 - DNA, 22 bp, Homo sapiens
tcagagagtcctggtcatttgc

SEQ ID NO: 8585218 - DNA, 21 bp, Homo sapiens
tcagagagtcacagtgaactg

SEQ ID NO: 8585219 - DNA, 22 bp, Homo sapiens
tcagagaggttggtgataagaa

SEQ ID NO: 8585220 - DNA, 22 bp, Homo sapiens
cagttggtcttcccttggagca

SEQ ID NO: 8585221 - DNA, 22 bp, Homo sapiens
cagttggtgatgaggctagtag

SEQ ID NO: 8585222 - DNA, 22 bp, Homo sapiens
tcagagagttacacaaattgtt

SEQ ID NO: 8585223 - DNA, 22 bp, Homo sapiens
tcagagagtgcaaaatatagct

SEQ ID NO: 8585224 - DNA, 22 bp, Homo sapiens
tcagagagttagtgtcttagct

SEQ ID NO: 8585225 - DNA, 22 bp, Homo sapiens
tcagagagttttcactagggtg

SEQ ID NO: 8585226 - DNA, 22 bp, Homo sapiens
tcagatatagtcatttaaataa

SEQ ID NO: 8585227 - DNA, 22 bp, Homo sapiens
tcagatatgaattcatatctct

SEQ ID NO: 8585228 - DNA, 22 bp, Homo sapiens
tcagcagggtttgacttctaat

SEQ ID NO: 8585229 - DNA, 22 bp, Homo sapiens
tcagcaggtgaacatcatgcca

SEQ ID NO: 8585230 - DNA, 22 bp, Homo sapiens
tcagcaggtgcctcagattctt

SEQ ID NO: 8585231 - DNA, 17 bp, Homo sapiens
tcaggctgtgcctggta

SEQ ID NO: 8585232 - DNA, 22 bp, Homo sapiens
catggccacatctagctgcaag

SEQ ID NO: 8585233 - DNA, 23 bp, Homo sapiens
tccaggagaattccagggcccgg

SEQ ID NO: 8585234 - DNA, 22 bp, Homo sapiens
tccaggagaaggccatccagcg

SEQ ID NO: 8585235 - DNA, 20 bp, Homo sapiens
tccagctgggaacagctgat

SEQ ID NO: 8585236 - DNA, 22 bp, Homo sapiens
catggaaggcaaaagacacaga

SEQ ID NO: 8585237 - DNA, 22 bp, Homo sapiens
catggcagctcctccagtgtga

SEQ ID NO: 8585238 - DNA, 22 bp, Homo sapiens
catggcagagcctgcaggtggg

SEQ ID NO: 8585239 - DNA, 22 bp, Homo sapiens
catggcagagcctgcaggtggg

SEQ ID NO: 8585240 - DNA, 23 bp, Homo sapiens
catggcagcaagagctcatggcc

SEQ ID NO: 8585241 - DNA, 22 bp, Homo sapiens
catctggacaaaactctgaagg

SEQ ID NO: 8585242 - DNA, 22 bp, Homo sapiens
catctgggttctcagatggata

SEQ ID NO: 8585243 - DNA, 22 bp, Homo sapiens
catgaacaatttgctcactgat

SEQ ID NO: 8585244 - DNA, 22 bp, Homo sapiens
catcttaaaatgtgtcataact

SEQ ID NO: 8585245 - DNA, 22 bp, Homo sapiens
tcagtcacactcactgaggtag

SEQ ID NO: 8585246 - DNA, 22 bp, Homo sapiens
tcagtcaccaatgggaggagga

SEQ ID NO: 8585247 - DNA, 22 bp, Homo sapiens
tcagtcaccttgactatagctg

SEQ ID NO: 8585248 - DNA, 22 bp, Homo sapiens
tcaggtgtatcatggagttgaa

SEQ ID NO: 8585249 - DNA, 22 bp, Homo sapiens
tcaggtgtattgatgtctgtga

SEQ ID NO: 8585250 - DNA, 22 bp, Homo sapiens
tcagtcacttttgcctgctaca

SEQ ID NO: 8585251 - DNA, 22 bp, Homo sapiens
tgctgtggattcagagatgaaa

SEQ ID NO: 8585252 - DNA, 22 bp, Homo sapiens
tggaatgtaaactctgtgaggg

SEQ ID NO: 8585253 - DNA, 22 bp, Homo sapiens
tggaatgttatgatgatggtaa

SEQ ID NO: 8585254 - DNA, 22 bp, Homo sapiens
ccctcctttctaggcttccagc

SEQ ID NO: 8585255 - DNA, 22 bp, Homo sapiens
ccctctctcaggctgacagcct

SEQ ID NO: 8585256 - DNA, 20 bp, Homo sapiens
ccctgagacaaaggaggggc

SEQ ID NO: 8585257 - DNA, 22 bp, Homo sapiens
tggagcaaacccatggctgtgc

SEQ ID NO: 8585258 - DNA, 22 bp, Homo sapiens
tggagcaagctggagagaacat

SEQ ID NO: 8585259 - DNA, 22 bp, Homo sapiens
tgctgggcacacagtaggtgct

SEQ ID NO: 8585260 - DNA, 22 bp, Homo sapiens
tgctggccgtgagctctcggga

SEQ ID NO: 8585261 - DNA, 22 bp, Homo sapiens
tgctggcctcggcgctgggcct

SEQ ID NO: 8585262 - DNA, 21 bp, Homo sapiens
tgctggccatgtgctgggcat

SEQ ID NO: 8585263 - DNA, 22 bp, Homo sapiens
cccaggctggatttcggtggca

SEQ ID NO: 8585264 - DNA, 22 bp, Homo sapiens
cccaggctggagtgtaatggtg

SEQ ID NO: 8585265 - DNA, 22 bp, Homo sapiens
cccaggctggcactgctgaagt

SEQ ID NO: 8585266 - DNA, 22 bp, Homo sapiens
cccaggctggcctccgcagtgc

SEQ ID NO: 8585267 - DNA, 22 bp, Homo sapiens
cccaggctgggaacgattctag

SEQ ID NO: 8585268 - DNA, 22 bp, Homo sapiens
cccaggctggggctcctccagc

SEQ ID NO: 8585269 - DNA, 22 bp, Homo sapiens
cccagggaaggcagatggagga

SEQ ID NO: 8585270 - DNA, 22 bp, Homo sapiens
cccaggctggtcctgaactcct

SEQ ID NO: 8585271 - DNA, 21 bp, Homo sapiens
cccagggaagccgcagtcacc

SEQ ID NO: 8585272 - DNA, 22 bp, Homo sapiens
cccaggctggagtgcagtggcg

SEQ ID NO: 8585273 - DNA, 22 bp, Homo sapiens
cccaggctggagtgcaatggtg

SEQ ID NO: 8585274 - DNA, 22 bp, Homo sapiens
cccaggctggagtgcaatggca

SEQ ID NO: 8585275 - DNA, 22 bp, Homo sapiens
cccaggctggagggcagtgtca

SEQ ID NO: 8585276 - DNA, 22 bp, Homo sapiens
cccaggctgagttagaggtgtc

SEQ ID NO: 8585277 - DNA, 22 bp, Homo sapiens
tgcctgttgcccacctgataaa

SEQ ID NO: 8585278 - DNA, 22 bp, Homo sapiens
cccagggattataaaggtgaaa

SEQ ID NO: 8585279 - DNA, 22 bp, Homo sapiens
tgcctgtgtggtctgcgcatta

SEQ ID NO: 8585280 - DNA, 22 bp, Homo sapiens
cccagggacagctaggtggggc

SEQ ID NO: 8585281 - DNA, 22 bp, Homo sapiens
cccagggacagatgggcagcta

SEQ ID NO: 8585282 - DNA, 22 bp, Homo sapiens
cccaggggttcaaggctgcagt

SEQ ID NO: 8585283 - DNA, 22 bp, Homo sapiens
cccaggggttctagaccagctt

SEQ ID NO: 8585284 - DNA, 22 bp, Homo sapiens
cccaggggttctgagcagcagc

SEQ ID NO: 8585285 - DNA, 20 bp, Homo sapiens
cccaggggttgtggtgagga

SEQ ID NO: 8585286 - DNA, 22 bp, Homo sapiens
tgccagtgtgtgccttaagctc

SEQ ID NO: 8585287 - DNA, 22 bp, Homo sapiens
tgccagtgtggaactaggaaga

SEQ ID NO: 8585288 - DNA, 22 bp, Homo sapiens
tgccagtgtgagtggagttctt

SEQ ID NO: 8585289 - DNA, 20 bp, Homo sapiens
tgccagtgtgtcaatttata

SEQ ID NO: 8585290 - DNA, 22 bp, Homo sapiens
tgccagtgggtgtgcagagact

SEQ ID NO: 8585291 - DNA, 22 bp, Homo sapiens
tgccagtgtagtagctggttta

SEQ ID NO: 8585292 - DNA, 22 bp, Homo sapiens
tgccagtgtctgctatctgaga

SEQ ID NO: 8585293 - DNA, 22 bp, Homo sapiens
cccaggctagtatgatatcagt

SEQ ID NO: 8585294 - DNA, 19 bp, Homo sapiens
cccaggctacatggagagg

SEQ ID NO: 8585295 - DNA, 22 bp, Homo sapiens
cccaggctagaaaggccaacaa

SEQ ID NO: 8585296 - DNA, 22 bp, Homo sapiens
cccaggctcccaggtgggacaa

SEQ ID NO: 8585297 - DNA, 22 bp, Homo sapiens
cccaggctcagactggcttgtt

SEQ ID NO: 8585298 - DNA, 22 bp, Homo sapiens
cccaggctcactgtccgcttcc

SEQ ID NO: 8585299 - DNA, 22 bp, Homo sapiens
tgccagtgaaacgtggtctcat

SEQ ID NO: 8585300 - DNA, 22 bp, Homo sapiens
tgccagtgagccctgggatgtg

SEQ ID NO: 8585301 - DNA, 22 bp, Homo sapiens
tgccagtgcctgctgcccaata

SEQ ID NO: 8585302 - DNA, 22 bp, Homo sapiens
tgccagtgcttgtgtctgagca

SEQ ID NO: 8585303 - DNA, 22 bp, Homo sapiens
cccaggagataacgttcccaag

SEQ ID NO: 8585304 - DNA, 22 bp, Homo sapiens
tgccaggctaagtggaggactt

SEQ ID NO: 8585305 - DNA, 22 bp, Homo sapiens
tgccagtgaaacatggaagaat

SEQ ID NO: 8585306 - DNA, 22 bp, Homo sapiens
cccaggagagaggggataaagc

SEQ ID NO: 8585307 - DNA, 22 bp, Homo sapiens
cccaggagagaggccagttggc

SEQ ID NO: 8585308 - DNA, 22 bp, Homo sapiens
cccaggagactgagctgtaacc

SEQ ID NO: 8585309 - DNA, 22 bp, Homo sapiens
cccaggagagagacttgaatct

SEQ ID NO: 8585310 - DNA, 22 bp, Homo sapiens
tggctgagaatgggatgatgcc

SEQ ID NO: 8585311 - DNA, 22 bp, Homo sapiens
tggctgggagctggaactgggc

SEQ ID NO: 8585312 - DNA, 22 bp, Homo sapiens
tggcttcattcagcatgacagt

SEQ ID NO: 8585313 - DNA, 22 bp, Homo sapiens
tggcttcatctgcagcactgcc

SEQ ID NO: 8585314 - DNA, 17 bp, Homo sapiens
tggcttcaggctgagca

SEQ ID NO: 8585315 - DNA, 22 bp, Homo sapiens
cctgagcacaagggagctttga

SEQ ID NO: 8585316 - DNA, 22 bp, Homo sapiens
cctgagcaaaggcccagaggga

SEQ ID NO: 8585317 - DNA, 22 bp, Homo sapiens
cctgagaccaagttgcagccat

SEQ ID NO: 8585318 - DNA, 22 bp, Homo sapiens
cctgagctctgcactttttaga

SEQ ID NO: 8585319 - DNA, 22 bp, Homo sapiens
cctgagctgactctcctttcag

SEQ ID NO: 8585320 - DNA, 22 bp, Homo sapiens
cctgagctggaagagcttgtgc

SEQ ID NO: 8585321 - DNA, 22 bp, Homo sapiens
cctgagctggcagtgacctgga

SEQ ID NO: 8585322 - DNA, 22 bp, Homo sapiens
tgggctgcttcctcagctgaga

SEQ ID NO: 8585323 - DNA, 22 bp, Homo sapiens
cctgagctagggaaggaagacc

SEQ ID NO: 8585324 - DNA, 22 bp, Homo sapiens
tgggctccttgggagcaagtga

SEQ ID NO: 8585325 - DNA, 22 bp, Homo sapiens
tgggcccatcattgctgtgggc

SEQ ID NO: 8585326 - DNA, 21 bp, Homo sapiens
tgggcccagttcccgctgggc

SEQ ID NO: 8585327 - DNA, 22 bp, Homo sapiens
tgggcccaagagagtctccaac

SEQ ID NO: 8585328 - DNA, 21 bp, Homo sapiens
tgggcccagctctgtctgttt

SEQ ID NO: 8585329 - DNA, 22 bp, Homo sapiens
tggcaggtacccattggctgta

SEQ ID NO: 8585330 - DNA, 18 bp, Homo sapiens
tggcaggtagactcaggt

SEQ ID NO: 8585331 - DNA, 22 bp, Homo sapiens
tggcaggtagagttctgagatg

SEQ ID NO: 8585332 - DNA, 22 bp, Homo sapiens
tggcaggtagtcagaggcgaca

SEQ ID NO: 8585333 - DNA, 22 bp, Homo sapiens
cctcagaaggacaagagacaaa

SEQ ID NO: 8585334 - DNA, 22 bp, Homo sapiens
tggcagggtgggcttcagcccc

SEQ ID NO: 8585335 - DNA, 22 bp, Homo sapiens
tggcagggttggccaccttacc

SEQ ID NO: 8585336 - DNA, 22 bp, Homo sapiens
cctaggagttcgaagctgcagt

SEQ ID NO: 8585337 - DNA, 22 bp, Homo sapiens
tggcagaggagaattaagatta

SEQ ID NO: 8585338 - DNA, 21 bp, Homo sapiens
ccctgcaggccagggctgagc

SEQ ID NO: 8585339 - DNA, 22 bp, Homo sapiens
ccctgcaggctcagactggagt

SEQ ID NO: 8585340 - DNA, 22 bp, Homo sapiens
ccctgcaggctcagactggagt

SEQ ID NO: 8585341 - DNA, 22 bp, Homo sapiens
ccctgcagcttttgcatagtca

SEQ ID NO: 8585342 - DNA, 22 bp, Homo sapiens
ccctgcaggggacctgcagcct

SEQ ID NO: 8585343 - DNA, 22 bp, Homo sapiens
ccctgcaggggacctgcagcct

SEQ ID NO: 8585344 - DNA, 22 bp, Homo sapiens
ccctgcagggaggattctgaag

SEQ ID NO: 8585345 - DNA, 23 bp, Homo sapiens
ccctgcagtcagggtgagatggt

SEQ ID NO: 8585346 - DNA, 22 bp, Homo sapiens
tggagcagggcatcactgtgcg

SEQ ID NO: 8585347 - DNA, 22 bp, Homo sapiens
ccctgcagccttgcatgccttc

SEQ ID NO: 8585348 - DNA, 22 bp, Homo sapiens
ccctgcagccttgcatgccttc

SEQ ID NO: 8585349 - DNA, 20 bp, Homo sapiens
tggcccagcacgacgaggac

SEQ ID NO: 8585350 - DNA, 19 bp, Homo sapiens
tggcccagatggtcctggg

SEQ ID NO: 8585351 - DNA, 22 bp, Homo sapiens
tggcccagatctctgaccttga

SEQ ID NO: 8585352 - DNA, 22 bp, Homo sapiens
tggcccagagcactgctgggca

SEQ ID NO: 8585353 - DNA, 22 bp, Homo sapiens
cctcaggcttgtgagccttcag

SEQ ID NO: 8585354 - DNA, 22 bp, Homo sapiens
cctcaggcttctagttcagtga

SEQ ID NO: 8585355 - DNA, 22 bp, Homo sapiens
cctcagggaatgggaggctggg

SEQ ID NO: 8585356 - DNA, 22 bp, Homo sapiens
cctcaggcctctgcctcattgg

SEQ ID NO: 8585357 - DNA, 22 bp, Homo sapiens
cctcaggctgctcacacttgtc

SEQ ID NO: 8585358 - DNA, 22 bp, Homo sapiens
tggcctggctgccctgtctgga

SEQ ID NO: 8585359 - DNA, 22 bp, Homo sapiens
tggcctggggacctgtgagacc

SEQ ID NO: 8585360 - DNA, 22 bp, Homo sapiens
ccaggcctgcattccctctcag

SEQ ID NO: 8585361 - DNA, 22 bp, Homo sapiens
ccaggcctgcatctgctgcgca

SEQ ID NO: 8585362 - DNA, 22 bp, Homo sapiens
ccaggccagtgtttggtccagg

SEQ ID NO: 8585363 - DNA, 22 bp, Homo sapiens
ccaggccagggctgcagcgagc

SEQ ID NO: 8585364 - DNA, 22 bp, Homo sapiens
tctttggtcagaaagattacac

SEQ ID NO: 8585365 - DNA, 22 bp, Homo sapiens
tctttggtattcacttgtgaag

SEQ ID NO: 8585366 - DNA, 23 bp, Homo sapiens
tctttggtaaataaagtggggat

SEQ ID NO: 8585367 - DNA, 22 bp, Homo sapiens
tctttggcatttaggagcagga

SEQ ID NO: 8585368 - DNA, 19 bp, Homo sapiens
tctttggcttctggatcag

SEQ ID NO: 8585369 - DNA, 22 bp, Homo sapiens
tctttggtgaatggtcatccag

SEQ ID NO: 8585370 - DNA, 22 bp, Homo sapiens
tctttggtcatcatgggaagca

SEQ ID NO: 8585371 - DNA, 22 bp, Homo sapiens
tctttggtgatatctctttggt

SEQ ID NO: 8585372 - DNA, 22 bp, Homo sapiens
ccaggcctggacgggtggcctg

SEQ ID NO: 8585373 - DNA, 22 bp, Homo sapiens
ccaggccagcgctggctggagg

SEQ ID NO: 8585374 - DNA, 22 bp, Homo sapiens
ccaggccagcctggagcatggc

SEQ ID NO: 8585375 - DNA, 22 bp, Homo sapiens
ccaggagggaccgcggcatccc

SEQ ID NO: 8585376 - DNA, 22 bp, Homo sapiens
ccaggaggttgaggctgcagtg

SEQ ID NO: 8585377 - DNA, 22 bp, Homo sapiens
tctcagaataaattcctaactt

SEQ ID NO: 8585378 - DNA, 22 bp, Homo sapiens
ccagagagaaaatggagggcca

SEQ ID NO: 8585379 - DNA, 20 bp, Homo sapiens
ccagctgagccaaggggaga

SEQ ID NO: 8585380 - DNA, 22 bp, Homo sapiens
tctggcagcagcatcagtggct

SEQ ID NO: 8585381 - DNA, 22 bp, Homo sapiens
tctggccctgctgctgtgagca

SEQ ID NO: 8585382 - DNA, 22 bp, Homo sapiens
ccaggaaggatcgtttgggagt

SEQ ID NO: 8585383 - DNA, 22 bp, Homo sapiens
ccaggaaggatcgtttgggagt

SEQ ID NO: 8585384 - DNA, 22 bp, Homo sapiens
ccaggacagggagacgggagcc

SEQ ID NO: 8585385 - DNA, 22 bp, Homo sapiens
ccaggacactgcttcacagcag

SEQ ID NO: 8585386 - DNA, 22 bp, Homo sapiens
ccaggagaagcatctgagtgta

SEQ ID NO: 8585387 - DNA, 22 bp, Homo sapiens
ccaggagaataatggcagatta

SEQ ID NO: 8585388 - DNA, 22 bp, Homo sapiens
tctgggagagtctaacttgttt

SEQ ID NO: 8585389 - DNA, 22 bp, Homo sapiens
ccaggactgcagggggcgagga

SEQ ID NO: 8585390 - DNA, 19 bp, Homo sapiens
tctgggagagtgaatctga

SEQ ID NO: 8585391 - DNA, 22 bp, Homo sapiens
tctgggagatccaagcagaact

SEQ ID NO: 8585392 - DNA, 22 bp, Homo sapiens
tctgggagcacacgcagtgatc

SEQ ID NO: 8585393 - DNA, 22 bp, Homo sapiens
tctgggagcagatgatggtata

SEQ ID NO: 8585394 - DNA, 22 bp, Homo sapiens
tctgggagcagctcagcagatt

SEQ ID NO: 8585395 - DNA, 22 bp, Homo sapiens
tctgggagccatgccttggagt

SEQ ID NO: 8585396 - DNA, 22 bp, Homo sapiens
tctgggagcgctgtttttccca

SEQ ID NO: 8585397 - DNA, 22 bp, Homo sapiens
tctgggagcctgaaagtgaatg

SEQ ID NO: 8585398 - DNA, 22 bp, Homo sapiens
tctgggagctggctttgcctca

SEQ ID NO: 8585399 - DNA, 20 bp, Homo sapiens
tgacaacaaaatggtaattt

SEQ ID NO: 8585400 - DNA, 21 bp, Homo sapiens
tgacaacagaactgggcaagc

SEQ ID NO: 8585401 - DNA, 22 bp, Homo sapiens
tgacaacagccatcacttttag

SEQ ID NO: 8585402 - DNA, 22 bp, Homo sapiens
tgacaacatcatttttgtgtgg

SEQ ID NO: 8585403 - DNA, 20 bp, Homo sapiens
tgacaacatgccttttgctt

SEQ ID NO: 8585404 - DNA, 22 bp, Homo sapiens
tgacaacattgagttatgtgca

SEQ ID NO: 8585405 - DNA, 22 bp, Homo sapiens
ccaggctggagtgcagtggcac

SEQ ID NO: 8585406 - DNA, 22 bp, Homo sapiens
ccaggggaaacagggagcactc

SEQ ID NO: 8585407 - DNA, 22 bp, Homo sapiens
ccagggcttcccacgtgccctg

SEQ ID NO: 8585408 - DNA, 22 bp, Homo sapiens
ccaggtgtgtacagaacagcac

SEQ ID NO: 8585409 - DNA, 22 bp, Homo sapiens
ccaggtgtggtggcatacacct

SEQ ID NO: 8585410 - DNA, 22 bp, Homo sapiens
ccaggtgtggccacatggctgg

SEQ ID NO: 8585411 - DNA, 22 bp, Homo sapiens
ccaggtgtggggaggactcaca

SEQ ID NO: 8585412 - DNA, 22 bp, Homo sapiens
ccaggtgtgccagcagggactg

SEQ ID NO: 8585413 - DNA, 22 bp, Homo sapiens
ccaggtgtgctctgcagtggat

SEQ ID NO: 8585414 - DNA, 22 bp, Homo sapiens
ccaggtgtgatttggcagtgtc

SEQ ID NO: 8585415 - DNA, 22 bp, Homo sapiens
ccaggtgtgatttcatctgagg

SEQ ID NO: 8585416 - DNA, 22 bp, Homo sapiens
ccaggtgtaagacatggtccta

SEQ ID NO: 8585417 - DNA, 22 bp, Homo sapiens
ccaggtgggcgtgtcttcacct

SEQ ID NO: 8585418 - DNA, 22 bp, Homo sapiens
ccaggtgtagcactgctcacag

SEQ ID NO: 8585419 - DNA, 17 bp, Homo sapiens
ccaggtgggaggtgggg

SEQ ID NO: 8585420 - DNA, 22 bp, Homo sapiens
ccaggtgtccccgtcactgcag

SEQ ID NO: 8585421 - DNA, 22 bp, Homo sapiens
ccaggtgtctgtctctttttca

SEQ ID NO: 8585422 - DNA, 22 bp, Homo sapiens
ccaggtgtgagcattctgtctt

SEQ ID NO: 8585423 - DNA, 22 bp, Homo sapiens
ccaggtgtctgtggccagccct

SEQ ID NO: 8585424 - DNA, 22 bp, Homo sapiens
ccaggtgtcatggataatgggt

SEQ ID NO: 8585425 - DNA, 22 bp, Homo sapiens
ccaggtgtcatgcgtgtgaccc

SEQ ID NO: 8585426 - DNA, 22 bp, Homo sapiens
ccaggtgtaggacaccaaggga

SEQ ID NO: 8585427 - DNA, 22 bp, Homo sapiens
tgagacagttctgcagctgggt

SEQ ID NO: 8585428 - DNA, 22 bp, Homo sapiens
ccaggtggacggcgagtacagg

SEQ ID NO: 8585429 - DNA, 22 bp, Homo sapiens
ccagggggcttggtgaggccat

SEQ ID NO: 8585430 - DNA, 22 bp, Homo sapiens
ccaggggctgcagatccatggt

SEQ ID NO: 8585431 - DNA, 22 bp, Homo sapiens
ccaggggggcgtagatgctggg

SEQ ID NO: 8585432 - DNA, 22 bp, Homo sapiens
ccaggggctggtgctgagctgg

SEQ ID NO: 8585433 - DNA, 19 bp, Homo sapiens
ccaggtggaactgaggtag

SEQ ID NO: 8585434 - DNA, 19 bp, Homo sapiens
ccaggtggaactgaggtag

SEQ ID NO: 8585435 - DNA, 22 bp, Homo sapiens
ccaggtggaaggtctgtgctct

SEQ ID NO: 8585436 - DNA, 22 bp, Homo sapiens
ccaggtggacaaggctttcaca

SEQ ID NO: 8585437 - DNA, 22 bp, Homo sapiens
ccaggtggacggcgagtacagg

SEQ ID NO: 8585438 - DNA, 22 bp, Homo sapiens
ccaggtggaaggtctgtgctct

SEQ ID NO: 8585439 - DNA, 17 bp, Homo sapiens
ccaggtggaatcgtgga

SEQ ID NO: 8585440 - DNA, 22 bp, Homo sapiens
ccaggtggaaggtctgtgctct

SEQ ID NO: 8585441 - DNA, 22 bp, Homo sapiens
ccaggggctggtgctgagctgg

SEQ ID NO: 8585442 - DNA, 20 bp, Homo sapiens
cccagaagcttaacagagca

SEQ ID NO: 8585443 - DNA, 23 bp, Homo sapiens
cccagaccttgtgctgcccttgg

SEQ ID NO: 8585444 - DNA, 22 bp, Homo sapiens
ccattaaaatggaatgtagtga

SEQ ID NO: 8585445 - DNA, 22 bp, Homo sapiens
ccatgtgttgagattccagcct

SEQ ID NO: 8585446 - DNA, 22 bp, Homo sapiens
ccatgtgttgattctctgcaga

SEQ ID NO: 8585447 - DNA, 22 bp, Homo sapiens
ccagtcctgccaccctgtctat

SEQ ID NO: 8585448 - DNA, 22 bp, Homo sapiens
ccagtcctgtgtgaccctgcac

SEQ ID NO: 8585449 - DNA, 22 bp, Homo sapiens
ccagtcctgctccctgaccacc

SEQ ID NO: 8585450 - DNA, 22 bp, Homo sapiens
ccagtgttccctcgggttcatg

SEQ ID NO: 8585451 - DNA, 22 bp, Homo sapiens
ccagtgtttaggaataaaatgt

SEQ ID NO: 8585452 - DNA, 22 bp, Homo sapiens
ccagtgtttacagttgaacaaa

SEQ ID NO: 8585453 - DNA, 22 bp, Homo sapiens
ccagtgttggaggatggcttgc

SEQ ID NO: 8585454 - DNA, 22 bp, Homo sapiens
ccatgccctaaaggactggcag

SEQ ID NO: 8585455 - DNA, 22 bp, Homo sapiens
ccatgctgtgacacagtagtta

SEQ ID NO: 8585456 - DNA, 22 bp, Homo sapiens
ccagtgtttccccagaagagag

SEQ ID NO: 8585457 - DNA, 22 bp, Homo sapiens
ccatgcagtgctggagctgatt

SEQ ID NO: 8585458 - DNA, 22 bp, Homo sapiens
tgaggtagtgtttagtccagtc

SEQ ID NO: 8585459 - DNA, 22 bp, Homo sapiens
tgaggtaggataagacaatgag

SEQ ID NO: 8585460 - DNA, 22 bp, Homo sapiens
tgaggtaggtgtcgagagaggt

SEQ ID NO: 8585461 - DNA, 22 bp, Homo sapiens
tgaggtaggtgtcgagagaggt

SEQ ID NO: 8585462 - DNA, 22 bp, Homo sapiens
tgaggtaggtggtaagagatac

SEQ ID NO: 8585463 - DNA, 22 bp, Homo sapiens
ccatgtgggattttggtgtctg

SEQ ID NO: 8585464 - DNA, 22 bp, Homo sapiens
ccatgtggctgtgtggtttatt

SEQ ID NO: 8585465 - DNA, 18 bp, Homo sapiens
ccatgtgttccttttggg

SEQ ID NO: 8585466 - DNA, 22 bp, Homo sapiens
ccatgtgtctcccctggaagta

SEQ ID NO: 8585467 - DNA, 22 bp, Homo sapiens
ccatgtgttcaataagggagtt

SEQ ID NO: 8585468 - DNA, 22 bp, Homo sapiens
ccatgtgtaaattagataactc

SEQ ID NO: 8585469 - DNA, 22 bp, Homo sapiens
ccatgtgtcgggcctgcagtgg

SEQ ID NO: 8585470 - DNA, 22 bp, Homo sapiens
tttgttggttgcactggtgggt

SEQ ID NO: 8585471 - DNA, 22 bp, Homo sapiens
tttgtagcagcatgatttataa

SEQ ID NO: 8585472 - DNA, 22 bp, Homo sapiens
ttttctatctcctagaactgcc

SEQ ID NO: 8585473 - DNA, 22 bp, Homo sapiens
tttctgtcattactttcctccc

SEQ ID NO: 8585474 - DNA, 22 bp, Homo sapiens
tttcttatgtgcagagtgagta

SEQ ID NO: 8585475 - DNA, 22 bp, Homo sapiens
tttcttcctaaatatgatttcc

SEQ ID NO: 8585476 - DNA, 22 bp, Homo sapiens
tttcttcattcaccttcacccc

SEQ ID NO: 8585477 - DNA, 22 bp, Homo sapiens
tttctgtacacccactattcat

SEQ ID NO: 8585478 - DNA, 22 bp, Homo sapiens
tttctgacctgcaacagtttac

SEQ ID NO: 8585479 - DNA, 22 bp, Homo sapiens
tttctattttaaaggcatatgg

SEQ ID NO: 8585480 - DNA, 22 bp, Homo sapiens
tttctacatgttttctattgaa

SEQ ID NO: 8585481 - DNA, 22 bp, Homo sapiens
tttctacatttgtaaccagatt

SEQ ID NO: 8585482 - DNA, 22 bp, Homo sapiens
tttctacattcaaaaactacca

SEQ ID NO: 8585483 - DNA, 22 bp, Homo sapiens
tttcattgccataaggtgggat

SEQ ID NO: 8585484 - DNA, 22 bp, Homo sapiens
tttcattgtcaataaactgtat

SEQ ID NO: 8585485 - DNA, 22 bp, Homo sapiens
tttcattgtccccaggcaagac

SEQ ID NO: 8585486 - DNA, 22 bp, Homo sapiens
tttcagagtctggctgcagcct

SEQ ID NO: 8585487 - DNA, 20 bp, Homo sapiens
tttcaaaggcacctatgaag

SEQ ID NO: 8585488 - DNA, 22 bp, Homo sapiens
tttcaggattagtttaagcagg

SEQ ID NO: 8585489 - DNA, 22 bp, Homo sapiens
tttcaggattttatgagatagt

SEQ ID NO: 8585490 - DNA, 22 bp, Homo sapiens
tttcaggagagaccagaaatga

SEQ ID NO: 8585491 - DNA, 19 bp, Homo sapiens
tttcaggagctatgcaggg

SEQ ID NO: 8585492 - DNA, 22 bp, Homo sapiens
tttcaggatcaaatgaaatcgt

SEQ ID NO: 8585493 - DNA, 22 bp, Homo sapiens
tttcaggaaacatttaatggca

SEQ ID NO: 8585494 - DNA, 22 bp, Homo sapiens
tttcaggaaggacttcggtaat

SEQ ID NO: 8585495 - DNA, 22 bp, Homo sapiens
tttcaggaatacacacacatct

SEQ ID NO: 8585496 - DNA, 22 bp, Homo sapiens
tttcaggaaggtgaggcacatg

SEQ ID NO: 8585497 - DNA, 22 bp, Homo sapiens
tttcaggacacctttaaaaacg

SEQ ID NO: 8585498 - DNA, 22 bp, Homo sapiens
tttcaggactcaaaacgataat

SEQ ID NO: 8585499 - DNA, 22 bp, Homo sapiens
tttcagtcatgagttgttttca

SEQ ID NO: 8585500 - DNA, 22 bp, Homo sapiens
ttggtcatcttccgtttcctca

SEQ ID NO: 8585501 - DNA, 22 bp, Homo sapiens
ttggtctgcagggagggctgga

SEQ ID NO: 8585502 - DNA, 22 bp, Homo sapiens
ttggtcagtcagagaatggagt

SEQ ID NO: 8585503 - DNA, 20 bp, Homo sapiens
ttggtcagtggttcagtttg

SEQ ID NO: 8585504 - DNA, 22 bp, Homo sapiens
ttggtcagctcaatggagaggg

SEQ ID NO: 8585505 - DNA, 22 bp, Homo sapiens
ttggtcatttttcctgtgctca

SEQ ID NO: 8585506 - DNA, 22 bp, Homo sapiens
ttggtgtgccagagctgacatg

SEQ ID NO: 8585507 - DNA, 23 bp, Homo sapiens
ttgtttctttgtattgtctctat

SEQ ID NO: 8585508 - DNA, 17 bp, Homo sapiens
ttgtttcttctctgtgg

SEQ ID NO: 8585509 - DNA, 22 bp, Homo sapiens
tttaattgcatttaaagatgga

SEQ ID NO: 8585510 - DNA, 22 bp, Homo sapiens
tttaattgattcacagtctgta

SEQ ID NO: 8585511 - DNA, 22 bp, Homo sapiens
tttacaacctcatattctgatg

SEQ ID NO: 8585512 - DNA, 22 bp, Homo sapiens
tttaaaaaactagtctgagtct

SEQ ID NO: 8585513 - DNA, 22 bp, Homo sapiens
tttactgagtgacctagaataa

SEQ ID NO: 8585514 - DNA, 22 bp, Homo sapiens
tttacttgatatggagctgagg

SEQ ID NO: 8585515 - DNA, 22 bp, Homo sapiens
tttattatccagtgttgtcatg

SEQ ID NO: 8585516 - DNA, 22 bp, Homo sapiens
tttattagtgcttgtatcactg

SEQ ID NO: 8585517 - DNA, 22 bp, Homo sapiens
tttattagattatcaaagaggt

SEQ ID NO: 8585518 - DNA, 22 bp, Homo sapiens
tttattatgatggacaccttcg

SEQ ID NO: 8585519 - DNA, 22 bp, Homo sapiens
tttcaaaattttgcagtggtaa

SEQ ID NO: 8585520 - DNA, 22 bp, Homo sapiens
tttatttggcatccagggagaa

SEQ ID NO: 8585521 - DNA, 22 bp, Homo sapiens
tttatttggcatccagggagaa

SEQ ID NO: 8585522 - DNA, 22 bp, Homo sapiens
tttatttgaatcaggggagaat

SEQ ID NO: 8585523 - DNA, 22 bp, Homo sapiens
ttctagtgtccttggacttgct

SEQ ID NO: 8585524 - DNA, 22 bp, Homo sapiens
ttctgctttcagttcttctggg

SEQ ID NO: 8585525 - DNA, 22 bp, Homo sapiens
ttctgcttttctctgtctgagt

SEQ ID NO: 8585526 - DNA, 22 bp, Homo sapiens
ttctttatatctgctagtgggt

SEQ ID NO: 8585527 - DNA, 22 bp, Homo sapiens
ttctttatagctattggatgag

SEQ ID NO: 8585528 - DNA, 22 bp, Homo sapiens
ttctggtgtgttctctctaggc

SEQ ID NO: 8585529 - DNA, 22 bp, Homo sapiens
ttctggtggccagaagtctgaa

SEQ ID NO: 8585530 - DNA, 22 bp, Homo sapiens
ttctttatcctatttgtaggtg

SEQ ID NO: 8585531 - DNA, 22 bp, Homo sapiens
ttctttatggaatggtgatagt

SEQ ID NO: 8585532 - DNA, 22 bp, Homo sapiens
ttctttattagtttagtgagct

SEQ ID NO: 8585533 - DNA, 22 bp, Homo sapiens
ttgaggagtgtttagggtgagg

SEQ ID NO: 8585534 - DNA, 22 bp, Homo sapiens
ttgattactatgtgttgaaagc

SEQ ID NO: 8585535 - DNA, 22 bp, Homo sapiens
ttgatttcaaaatatatgcttg

SEQ ID NO: 8585536 - DNA, 22 bp, Homo sapiens
ttgatttcttactcttccaagg

SEQ ID NO: 8585537 - DNA, 22 bp, Homo sapiens
ttcacaaaatggtttgttgatg

SEQ ID NO: 8585538 - DNA, 22 bp, Homo sapiens
ttcacaaaaatgctgaacagtt

SEQ ID NO: 8585539 - DNA, 22 bp, Homo sapiens
ttcacaaaaatgctgaacagtt

SEQ ID NO: 8585540 - DNA, 22 bp, Homo sapiens
ttcacaaagctggagcatttcc

SEQ ID NO: 8585541 - DNA, 22 bp, Homo sapiens
ttcacaaagctggagcatttcc

SEQ ID NO: 8585542 - DNA, 21 bp, Homo sapiens
ttagagtagagaacatgatcc

SEQ ID NO: 8585543 - DNA, 22 bp, Homo sapiens
ttcaacaagtagtacacacagt

SEQ ID NO: 8585544 - DNA, 22 bp, Homo sapiens
ttcaacaaggctgtcaaaagtt

SEQ ID NO: 8585545 - DNA, 22 bp, Homo sapiens
ttcacagtggctaagttctgca

SEQ ID NO: 8585546 - DNA, 22 bp, Homo sapiens
ttccagagagttattcccctgg

SEQ ID NO: 8585547 - DNA, 22 bp, Homo sapiens
ttccagagaggctcatgttccc

SEQ ID NO: 8585548 - DNA, 22 bp, Homo sapiens
ttccagagcagttttcagatca

SEQ ID NO: 8585549 - DNA, 21 bp, Homo sapiens
ttccagagattgtttcacctg

SEQ ID NO: 8585550 - DNA, 22 bp, Homo sapiens
ttccctggccctggcacgctct

SEQ ID NO: 8585551 - DNA, 22 bp, Homo sapiens
ttccacaattcagattgttgcc

SEQ ID NO: 8585552 - DNA, 23 bp, Homo sapiens
ttccacaatgaaaataaagcagg

SEQ ID NO: 8585553 - DNA, 22 bp, Homo sapiens
ttccacaatgccaggggcatca

SEQ ID NO: 8585554 - DNA, 22 bp, Homo sapiens
ttccacaaacacatcctgagca

SEQ ID NO: 8585555 - DNA, 22 bp, Homo sapiens
ttccacaaatcaattctgctga

SEQ ID NO: 8585556 - DNA, 22 bp, Homo sapiens
ttccacaacaaccaagcatata

SEQ ID NO: 8585557 - DNA, 22 bp, Homo sapiens
ttccacaagatgtttcttagaa

SEQ ID NO: 8585558 - DNA, 22 bp, Homo sapiens
ttccacaagtgatatctagctg

SEQ ID NO: 8585559 - DNA, 22 bp, Homo sapiens
ttcctcaacaacttccctacag

SEQ ID NO: 8585560 - DNA, 22 bp, Homo sapiens
ttcctagggcagagccgctggg

SEQ ID NO: 8585561 - DNA, 22 bp, Homo sapiens
ttctagattgcctgtaagtaaa

SEQ ID NO: 8585562 - DNA, 22 bp, Homo sapiens
ttctagatatctagtgtataac

SEQ ID NO: 8585563 - DNA, 22 bp, Homo sapiens
ttctagaagtgtctatgtctgt

SEQ ID NO: 8585564 - DNA, 22 bp, Homo sapiens
ttctacaatatgaataatgaag

SEQ ID NO: 8585565 - DNA, 22 bp, Homo sapiens
ttctacaaatatttactgttcc

SEQ ID NO: 8585566 - DNA, 20 bp, Homo sapiens
tgtttctttaaggtgagaca

SEQ ID NO: 8585567 - DNA, 22 bp, Homo sapiens
tgtttcttgataaagcagaaaa

SEQ ID NO: 8585568 - DNA, 22 bp, Homo sapiens
tgttatctgagcaacgtcgacg

SEQ ID NO: 8585569 - DNA, 22 bp, Homo sapiens
tgttattgggtcccaactaggt

SEQ ID NO: 8585570 - DNA, 22 bp, Homo sapiens
tgttcctgtactgctgtggctt

SEQ ID NO: 8585571 - DNA, 22 bp, Homo sapiens
tgtgtttatagtgtatcttcca

SEQ ID NO: 8585572 - DNA, 20 bp, Homo sapiens
tgtgtgaacacggactctgt

SEQ ID NO: 8585573 - DNA, 22 bp, Homo sapiens
tgtgtcctttctaatgcccaga

SEQ ID NO: 8585574 - DNA, 22 bp, Homo sapiens
tgtgtccttctgggagtcccag

SEQ ID NO: 8585575 - DNA, 23 bp, Homo sapiens
tgtgtccttaactgtatatacta

SEQ ID NO: 8585576 - DNA, 22 bp, Homo sapiens
tgtgtccttatgaaaatactgt

SEQ ID NO: 8585577 - DNA, 22 bp, Homo sapiens
tgtgtccttccagtttttcctg

SEQ ID NO: 8585578 - DNA, 22 bp, Homo sapiens
tgtgtcctttcttaagagtgag

SEQ ID NO: 8585579 - DNA, 22 bp, Homo sapiens
tgtgtcctttggaggatcagcg

SEQ ID NO: 8585580 - DNA, 22 bp, Homo sapiens
tgtgtcctgcaggtgctgcctg

SEQ ID NO: 8585581 - DNA, 22 bp, Homo sapiens
tgtgtcctgcagacagactcag

SEQ ID NO: 8585582 - DNA, 22 bp, Homo sapiens
tgtgtcctcatgtggcagagag

SEQ ID NO: 8585583 - DNA, 22 bp, Homo sapiens
tgtgtcctccagggagatgtaa

SEQ ID NO: 8585584 - DNA, 22 bp, Homo sapiens
tgtgtcctcttacctctgaccc

SEQ ID NO: 8585585 - DNA, 22 bp, Homo sapiens
tgtgtcctgtgatctctagggt

SEQ ID NO: 8585586 - DNA, 22 bp, Homo sapiens
tgtgtcctgtgcaaggggatga

SEQ ID NO: 8585587 - DNA, 22 bp, Homo sapiens
tgtgtcctggtgttaattttat

SEQ ID NO: 8585588 - DNA, 22 bp, Homo sapiens
tgtgtcctgtccccttgctgct

SEQ ID NO: 8585589 - DNA, 22 bp, Homo sapiens
tgtgtcctactgaggagctcct

SEQ ID NO: 8585590 - DNA, 19 bp, Homo sapiens
tgtgtcctagcagccagtc

SEQ ID NO: 8585591 - DNA, 22 bp, Homo sapiens
tgtgtcctatgaaagagggtta

SEQ ID NO: 8585592 - DNA, 22 bp, Homo sapiens
tgtgtcctcactgtatgcaagg

SEQ ID NO: 8585593 - DNA, 22 bp, Homo sapiens
tgtgtcctcagggaagcagaga

SEQ ID NO: 8585594 - DNA, 22 bp, Homo sapiens
tgtgtcctcatgaggtttgcag

SEQ ID NO: 8585595 - DNA, 22 bp, Homo sapiens
tgtggtctccccagtgccagct

SEQ ID NO: 8585596 - DNA, 21 bp, Homo sapiens
tgtggtcttttagttccatca

SEQ ID NO: 8585597 - DNA, 22 bp, Homo sapiens
tgtgggtggcatcgtcctggcc

SEQ ID NO: 8585598 - DNA, 22 bp, Homo sapiens
tgtgggtggcatcgtcctggcc

SEQ ID NO: 8585599 - DNA, 22 bp, Homo sapiens
tgtggcctgggagctgaggtct

SEQ ID NO: 8585600 - DNA, 22 bp, Homo sapiens
tgtggcctctaagctcacgaag

SEQ ID NO: 8585601 - DNA, 19 bp, Homo sapiens
tgtggcctggggacaggcc

SEQ ID NO: 8585602 - DNA, 22 bp, Homo sapiens
tgtggcccagatgagtgtgcta

SEQ ID NO: 8585603 - DNA, 20 bp, Homo sapiens
tgtggatgaggtaaggatag

SEQ ID NO: 8585604 - DNA, 22 bp, Homo sapiens
tgtggcagaggaggcagcgtcc

SEQ ID NO: 8585605 - DNA, 22 bp, Homo sapiens
tgtggcagctgctgcaggagct

SEQ ID NO: 8585606 - DNA, 22 bp, Homo sapiens
tgtggagatgtgagcaagggga

SEQ ID NO: 8585607 - DNA, 22 bp, Homo sapiens
tccccctccaattgccatgtta

SEQ ID NO: 8585608 - DNA, 22 bp, Homo sapiens
ttacatattatccaaaactgct

SEQ ID NO: 8585609 - DNA, 22 bp, Homo sapiens
ttacagtcttaaactcctgggc

SEQ ID NO: 8585610 - DNA, 22 bp, Homo sapiens
ttacaaacaacagacatttatt

SEQ ID NO: 8585611 - DNA, 21 bp, Homo sapiens
ttaatttattcatgatagcta

SEQ ID NO: 8585612 - DNA, 22 bp, Homo sapiens
ttagagattggttgacagattt

SEQ ID NO: 8585613 - DNA, 22 bp, Homo sapiens
ttactttagatcatactgtgtg

SEQ ID NO: 8585614 - DNA, 22 bp, Homo sapiens
ttacttggaggcctgttaccag

SEQ ID NO: 8585615 - DNA, 23 bp, Homo sapiens
ttactacacaagtaacgattccc

SEQ ID NO: 8585616 - DNA, 22 bp, Homo sapiens
ttaaatattatgttgtctgcaa

SEQ ID NO: 8585617 - DNA, 22 bp, Homo sapiens
ttaaagcatgttgcttaacagg

SEQ ID NO: 8585618 - DNA, 22 bp, Homo sapiens
ttaaagcatcctgtcagtctgt

SEQ ID NO: 8585619 - DNA, 22 bp, Homo sapiens
ttaagacatgtgagcataactt

SEQ ID NO: 8585620 - DNA, 22 bp, Homo sapiens
ttaattctagtttaacacttag

SEQ ID NO: 8585621 - DNA, 22 bp, Homo sapiens
cagatttaggtcactagaattt

SEQ ID NO: 8585622 - DNA, 22 bp, Homo sapiens
cagatttaggcttagtccaagc

SEQ ID NO: 8585623 - DNA, 22 bp, Homo sapiens
cagattctcactgtattcaggt

SEQ ID NO: 8585624 - DNA, 22 bp, Homo sapiens
cagcaaaggtagaagcacagga

SEQ ID NO: 8585625 - DNA, 22 bp, Homo sapiens
cagcagccactagagggctcac

SEQ ID NO: 8585626 - DNA, 22 bp, Homo sapiens
gtactttagagtaaaatagacc

SEQ ID NO: 8585627 - DNA, 22 bp, Homo sapiens
gtactttaagactccagtagca

SEQ ID NO: 8585628 - DNA, 22 bp, Homo sapiens
gtactttaaatcaatgtagatt

SEQ ID NO: 8585629 - DNA, 22 bp, Homo sapiens
gtacacagatgcttgagaatct

SEQ ID NO: 8585630 - DNA, 22 bp, Homo sapiens
gtcacacagagccctgtgctca

SEQ ID NO: 8585631 - DNA, 22 bp, Homo sapiens
gtcacacaggttgaaatgcagt

SEQ ID NO: 8585632 - DNA, 22 bp, Homo sapiens
gtagggacttgttttactagta

SEQ ID NO: 8585633 - DNA, 22 bp, Homo sapiens
gtagggacccacagtctatatt

SEQ ID NO: 8585634 - DNA, 19 bp, Homo sapiens
gtagggacagtggttctga

SEQ ID NO: 8585635 - DNA, 22 bp, Homo sapiens
gtagggaagggagcactggaca

SEQ ID NO: 8585636 - DNA, 21 bp, Homo sapiens
gtagggacagagagttggtga

SEQ ID NO: 8585637 - DNA, 22 bp, Homo sapiens
gtcagcaagatgaatcagcagg

SEQ ID NO: 8585638 - DNA, 22 bp, Homo sapiens
gtccagagtattcaagtaactt

SEQ ID NO: 8585639 - DNA, 22 bp, Homo sapiens
gtccagagaggcaggaggctac

SEQ ID NO: 8585640 - DNA, 22 bp, Homo sapiens
gtccagagctggcacactgtca

SEQ ID NO: 8585641 - DNA, 22 bp, Homo sapiens
gtccagagggctgcaggatgct

SEQ ID NO: 8585642 - DNA, 20 bp, Homo sapiens
gtccagagtaatgtgctgac

SEQ ID NO: 8585643 - DNA, 22 bp, Homo sapiens
gtccagagggtcaagtttcttg

SEQ ID NO: 8585644 - DNA, 22 bp, Homo sapiens
cagaaacagacatgacgcagta

SEQ ID NO: 8585645 - DNA, 22 bp, Homo sapiens
gggagctgccaccacccctggg

SEQ ID NO: 8585646 - DNA, 22 bp, Homo sapiens
gggaggcacgaggcgcgcagtg

SEQ ID NO: 8585647 - DNA, 22 bp, Homo sapiens
gggaggcatgtgttatccactt

SEQ ID NO: 8585648 - DNA, 22 bp, Homo sapiens
gggaggcagtgctggaggctgg

SEQ ID NO: 8585649 - DNA, 22 bp, Homo sapiens
gggaggcagtgctggaggctgg

SEQ ID NO: 8585650 - DNA, 22 bp, Homo sapiens
gggcaggtacaagatgcttctt

SEQ ID NO: 8585651 - DNA, 22 bp, Homo sapiens
gggcaggtactgggtggtgagc

SEQ ID NO: 8585652 - DNA, 22 bp, Homo sapiens
gggcaggtaggtgaaataatga

SEQ ID NO: 8585653 - DNA, 22 bp, Homo sapiens
cagagcagtgaggagttgtgta

SEQ ID NO: 8585654 - DNA, 22 bp, Homo sapiens
gggcaggggtcagtggccccaa

SEQ ID NO: 8585655 - DNA, 22 bp, Homo sapiens
gggcaggggtagcattccaagt

SEQ ID NO: 8585656 - DNA, 18 bp, Homo sapiens
cagagcagaggtggagcg

SEQ ID NO: 8585657 - DNA, 22 bp, Homo sapiens
cagagcagaaggtccaagcctg

SEQ ID NO: 8585658 - DNA, 22 bp, Homo sapiens
cagagcatcgcgcagagagcct

SEQ ID NO: 8585659 - DNA, 22 bp, Homo sapiens
cagagccaaacctcagggcccg

SEQ ID NO: 8585660 - DNA, 22 bp, Homo sapiens
cagagccaaaaccgtaacagcc

SEQ ID NO: 8585661 - DNA, 22 bp, Homo sapiens
cagagcatttggaagccacgtg

SEQ ID NO: 8585662 - DNA, 22 bp, Homo sapiens
cagagcactgcttggaggattt

SEQ ID NO: 8585663 - DNA, 22 bp, Homo sapiens
cagagaggaggctatatgcaaa

SEQ ID NO: 8585664 - DNA, 22 bp, Homo sapiens
cagagaagaaagtgactataat

SEQ ID NO: 8585665 - DNA, 22 bp, Homo sapiens
cagagacagaaaatggatctag

SEQ ID NO: 8585666 - DNA, 22 bp, Homo sapiens
gggtccaggtttagtcatttgt

SEQ ID NO: 8585667 - DNA, 22 bp, Homo sapiens
gggtccagtagttggtggccgt

SEQ ID NO: 8585668 - DNA, 21 bp, Homo sapiens
gggtagcgtgtggaagatccg

SEQ ID NO: 8585669 - DNA, 22 bp, Homo sapiens
gggtaggaaatccagaggtggc

SEQ ID NO: 8585670 - DNA, 22 bp, Homo sapiens
gggtgggatctgtggagcctca

SEQ ID NO: 8585671 - DNA, 22 bp, Homo sapiens
gggttaggttctagaggcacaa

SEQ ID NO: 8585672 - DNA, 22 bp, Homo sapiens
ggtatggagtctgagtttctag

SEQ ID NO: 8585673 - DNA, 22 bp, Homo sapiens
ggtatggatcagatgggctcaa

SEQ ID NO: 8585674 - DNA, 22 bp, Homo sapiens
ggtagtgaggtgaaagagaggt

SEQ ID NO: 8585675 - DNA, 22 bp, Homo sapiens
ggtcctcaatcccaacaaggca

SEQ ID NO: 8585676 - DNA, 19 bp, Homo sapiens
ggtcctcagcagagcatgc

SEQ ID NO: 8585677 - DNA, 22 bp, Homo sapiens
cagatgctaagttatcagcagg

SEQ ID NO: 8585678 - DNA, 20 bp, Homo sapiens
cagatggcacgtcagggcat

SEQ ID NO: 8585679 - DNA, 22 bp, Homo sapiens
cagatgagggctggaggtgagc

SEQ ID NO: 8585680 - DNA, 22 bp, Homo sapiens
cagatgagcatgggcacaagca

SEQ ID NO: 8585681 - DNA, 22 bp, Homo sapiens
cagatatgtggattctattagc

SEQ ID NO: 8585682 - DNA, 22 bp, Homo sapiens
gggctgagtgggcctcttactt

SEQ ID NO: 8585683 - DNA, 22 bp, Homo sapiens
cagagccacttggagatgagaa

SEQ ID NO: 8585684 - DNA, 22 bp, Homo sapiens
cagagccactgtctgccaggca

SEQ ID NO: 8585685 - DNA, 21 bp, Homo sapiens
cagagccagactgctgaattt

SEQ ID NO: 8585686 - DNA, 22 bp, Homo sapiens
cagagccagagacctgctgtgc

SEQ ID NO: 8585687 - DNA, 22 bp, Homo sapiens
gggctgtgagagtggggctgct

SEQ ID NO: 8585688 - DNA, 18 bp, Homo sapiens
gggctgtgagatgggaag

SEQ ID NO: 8585689 - DNA, 18 bp, Homo sapiens
gggctgtgagatgggaag

SEQ ID NO: 8585690 - DNA, 22 bp, Homo sapiens
gggctgtgctgagtaggaggtg

SEQ ID NO: 8585691 - DNA, 22 bp, Homo sapiens
gggctgtgctgagtaggaggtg

SEQ ID NO: 8585692 - DNA, 22 bp, Homo sapiens
gggctgtggagccgcgagggct

SEQ ID NO: 8585693 - DNA, 22 bp, Homo sapiens
gggctgtgtactatgaggaggg

SEQ ID NO: 8585694 - DNA, 22 bp, Homo sapiens
gggtacagagagatgaggtaac

SEQ ID NO: 8585695 - DNA, 22 bp, Homo sapiens
gggtaaggtcagccagaagttc

SEQ ID NO: 8585696 - DNA, 22 bp, Homo sapiens
gggtaaatctcttttcatggct

SEQ ID NO: 8585697 - DNA, 22 bp, Homo sapiens
gggtaaatctcttttcatggct

SEQ ID NO: 8585698 - DNA, 20 bp, Homo sapiens
ggggttggctggcacaggga

SEQ ID NO: 8585699 - DNA, 22 bp, Homo sapiens
ggggcagaagtagtgcccctga

SEQ ID NO: 8585700 - DNA, 22 bp, Homo sapiens
ggggcagatggaacagagcaca

SEQ ID NO: 8585701 - DNA, 22 bp, Homo sapiens
ggcaagtggaggtgttcatcag

SEQ ID NO: 8585702 - DNA, 22 bp, Homo sapiens
cacaggtgtccaatacctgctt

SEQ ID NO: 8585703 - DNA, 17 bp, Homo sapiens
cacaggtgtggtttgag

SEQ ID NO: 8585704 - DNA, 22 bp, Homo sapiens
cacaggtgtctctagtagcgtt

SEQ ID NO: 8585705 - DNA, 22 bp, Homo sapiens
cacaggtggcttctttcatctt

SEQ ID NO: 8585706 - DNA, 21 bp, Homo sapiens
cacaggtgggtcagtgaggcc

SEQ ID NO: 8585707 - DNA, 22 bp, Homo sapiens
cacaggtgtatgaatatgtcca

SEQ ID NO: 8585708 - DNA, 23 bp, Homo sapiens
cacaggtgtttcatcttctcagt

SEQ ID NO: 8585709 - DNA, 22 bp, Homo sapiens
cacaggtgtttgttatactcag

SEQ ID NO: 8585710 - DNA, 22 bp, Homo sapiens
cacaggtgttcttgcagtgaaa

SEQ ID NO: 8585711 - DNA, 22 bp, Homo sapiens
cacaggtgtgtgccttatcaaa

SEQ ID NO: 8585712 - DNA, 22 bp, Homo sapiens
cacaggtgtgtcctggtcttgt

SEQ ID NO: 8585713 - DNA, 22 bp, Homo sapiens
cacagggcaggccccaggcctc

SEQ ID NO: 8585714 - DNA, 22 bp, Homo sapiens
cacaggccagtaagactgtgtt

SEQ ID NO: 8585715 - DNA, 22 bp, Homo sapiens
cacaggtggctccaagttagag

SEQ ID NO: 8585716 - DNA, 22 bp, Homo sapiens
cacaggtgctcctcggggagct

SEQ ID NO: 8585717 - DNA, 22 bp, Homo sapiens
cacaggtgccatctcttcatgg

SEQ ID NO: 8585718 - DNA, 22 bp, Homo sapiens
cacaggtgcaagaagttgcagt

SEQ ID NO: 8585719 - DNA, 22 bp, Homo sapiens
cacaggcacccctgactgctca

SEQ ID NO: 8585720 - DNA, 22 bp, Homo sapiens
cacatgtgtgctgaggactgtg

SEQ ID NO: 8585721 - DNA, 22 bp, Homo sapiens
cacatgtgcaaatactgaggct

SEQ ID NO: 8585722 - DNA, 22 bp, Homo sapiens
cacatgtgcagttacatgaatt

SEQ ID NO: 8585723 - DNA, 22 bp, Homo sapiens
cacatgtgtatatgtgaggggg

SEQ ID NO: 8585724 - DNA, 22 bp, Homo sapiens
cacatgtgggaaatggtgctta

SEQ ID NO: 8585725 - DNA, 22 bp, Homo sapiens
cacattaagaataatgagacta

SEQ ID NO: 8585726 - DNA, 22 bp, Homo sapiens
caccaggagccatcaggagtcc

SEQ ID NO: 8585727 - DNA, 22 bp, Homo sapiens
caccaggagcatctaggaggcg

SEQ ID NO: 8585728 - DNA, 22 bp, Homo sapiens
caccaggaccccacggtgggtt

SEQ ID NO: 8585729 - DNA, 22 bp, Homo sapiens
caccaggaagtggtggcctggg

SEQ ID NO: 8585730 - DNA, 22 bp, Homo sapiens
cacatgaaggctggggtcgtga

SEQ ID NO: 8585731 - DNA, 22 bp, Homo sapiens
cactgcactccagcctgggaga

SEQ ID NO: 8585732 - DNA, 22 bp, Homo sapiens
cactgcactccagcctgggaga

SEQ ID NO: 8585733 - DNA, 23 bp, Homo sapiens
cacggcagcctccgagggtgctg

SEQ ID NO: 8585734 - DNA, 21 bp, Homo sapiens
cactccacttagaacagggtt

SEQ ID NO: 8585735 - DNA, 22 bp, Homo sapiens
caccaggctgcccaggacaggg

SEQ ID NO: 8585736 - DNA, 22 bp, Homo sapiens
cacctgggctttctctgggact

SEQ ID NO: 8585737 - DNA, 22 bp, Homo sapiens
cacctgggctttctctggaact

SEQ ID NO: 8585738 - DNA, 22 bp, Homo sapiens
cacctggctgtgaagcctgggt

SEQ ID NO: 8585739 - DNA, 23 bp, Homo sapiens
cacctggcttgagttggtgggtc

SEQ ID NO: 8585740 - DNA, 22 bp, Homo sapiens
cacttccagagtctgggctggg

SEQ ID NO: 8585741 - DNA, 22 bp, Homo sapiens
cacttatttatgcagaaaagtt

SEQ ID NO: 8585742 - DNA, 22 bp, Homo sapiens
cacttattatgggctaggaact

SEQ ID NO: 8585743 - DNA, 17 bp, Homo sapiens
ggctgctgtgctggtgc

SEQ ID NO: 8585744 - DNA, 17 bp, Homo sapiens
ggctgctgtgctggtgc

SEQ ID NO: 8585745 - DNA, 22 bp, Homo sapiens
cactgcactccagcctgggtga

SEQ ID NO: 8585746 - DNA, 22 bp, Homo sapiens
cactgcactccagcctgggtga

SEQ ID NO: 8585747 - DNA, 22 bp, Homo sapiens
cactgcactccagcctgggtga

SEQ ID NO: 8585748 - DNA, 22 bp, Homo sapiens
cactgcactccagcctgggtca

SEQ ID NO: 8585749 - DNA, 22 bp, Homo sapiens
cactgcactccagcctgggtca

SEQ ID NO: 8585750 - DNA, 22 bp, Homo sapiens
cactgcactccagcctgggtca

SEQ ID NO: 8585751 - DNA, 22 bp, Homo sapiens
ggctctgcttcagaaggctcat

SEQ ID NO: 8585752 - DNA, 22 bp, Homo sapiens
cactggtgccagagaacagaat

SEQ ID NO: 8585753 - DNA, 22 bp, Homo sapiens
caacacaggttctgcaaaggaa

SEQ ID NO: 8585754 - DNA, 22 bp, Homo sapiens
caagaaacaccaatgactgctg

SEQ ID NO: 8585755 - DNA, 22 bp, Homo sapiens
gctgcctgcacagagctgcttt

SEQ ID NO: 8585756 - DNA, 22 bp, Homo sapiens
caaagtcagccagctagtaggt

SEQ ID NO: 8585757 - DNA, 17 bp, Homo sapiens
gctctggcacaggattg

SEQ ID NO: 8585758 - DNA, 22 bp, Homo sapiens
caaagtcatggggatgcaggtc

SEQ ID NO: 8585759 - DNA, 22 bp, Homo sapiens
caaagtcagggaagagtggctg

SEQ ID NO: 8585760 - DNA, 22 bp, Homo sapiens
gctctgcttgcatcatgactgc

SEQ ID NO: 8585761 - DNA, 22 bp, Homo sapiens
gctgccctgacaagctactccc

SEQ ID NO: 8585762 - DNA, 22 bp, Homo sapiens
caagaatataaatactttcaaa

SEQ ID NO: 8585763 - DNA, 19 bp, Homo sapiens
caagacaaagcccatcttc

SEQ ID NO: 8585764 - DNA, 22 bp, Homo sapiens
gctgcctgcacagagctgcttt

SEQ ID NO: 8585765 - DNA, 22 bp, Homo sapiens
gctgctggccgcccagcttctc

SEQ ID NO: 8585766 - DNA, 22 bp, Homo sapiens
gctgctggcgctgggcgtccgg

SEQ ID NO: 8585767 - DNA, 22 bp, Homo sapiens
gctggggagcaagagtagtgag

SEQ ID NO: 8585768 - DNA, 22 bp, Homo sapiens
gctgggcttgtggccagctggg

SEQ ID NO: 8585769 - DNA, 22 bp, Homo sapiens
gctgggcttgtggccagctggg

SEQ ID NO: 8585770 - DNA, 22 bp, Homo sapiens
caaggctgctgcgggtcgcacc

SEQ ID NO: 8585771 - DNA, 22 bp, Homo sapiens
gctggggaggcagcagagaaca

SEQ ID NO: 8585772 - DNA, 22 bp, Homo sapiens
gctggggagctagacctcagca

SEQ ID NO: 8585773 - DNA, 22 bp, Homo sapiens
cacacaggatgaagcagcagaa

SEQ ID NO: 8585774 - DNA, 22 bp, Homo sapiens
ggaccagcaatcaagaacctac

SEQ ID NO: 8585775 - DNA, 22 bp, Homo sapiens
cacacaggatgaagcagcagaa

SEQ ID NO: 8585776 - DNA, 20 bp, Homo sapiens
ggaccagctgtctgaggggc

SEQ ID NO: 8585777 - DNA, 22 bp, Homo sapiens
ggagaagggtatgtgtggcgga

SEQ ID NO: 8585778 - DNA, 22 bp, Homo sapiens
ggagaaggtgctggtcactgtg

SEQ ID NO: 8585779 - DNA, 22 bp, Homo sapiens
ggagagcattcttagtctgttt

SEQ ID NO: 8585780 - DNA, 22 bp, Homo sapiens
ggaagctgaggcccagtgaagg

SEQ ID NO: 8585781 - DNA, 18 bp, Homo sapiens
ggacaggagacatgggtg

SEQ ID NO: 8585782 - DNA, 22 bp, Homo sapiens
ggacagcttgcctggtaatgca

SEQ ID NO: 8585783 - DNA, 22 bp, Homo sapiens
ggacatgtgcaacttctttgga

SEQ ID NO: 8585784 - DNA, 22 bp, Homo sapiens
ggacatgttccttttcatcttt

SEQ ID NO: 8585785 - DNA, 23 bp, Homo sapiens
ggacatgtctctgggtattttga

SEQ ID NO: 8585786 - DNA, 22 bp, Homo sapiens
ggacatttgcacctacctcagc

SEQ ID NO: 8585787 - DNA, 22 bp, Homo sapiens
ggacatttttcttcctacaatg

SEQ ID NO: 8585788 - DNA, 22 bp, Homo sapiens
atgtggctcacatagctggaaa

SEQ ID NO: 8585789 - DNA, 22 bp, Homo sapiens
atgtggctcattgtttgcttac

SEQ ID NO: 8585790 - DNA, 21 bp, Homo sapiens
atgtggctcccttcctcagga

SEQ ID NO: 8585791 - DNA, 22 bp, Homo sapiens
atgtggctagtggctatgatct

SEQ ID NO: 8585792 - DNA, 22 bp, Homo sapiens
atgtggctgccacctgcctgaa

SEQ ID NO: 8585793 - DNA, 22 bp, Homo sapiens
atgtggctgatcgcagagctct

SEQ ID NO: 8585794 - DNA, 22 bp, Homo sapiens
atgttagtgtcactttgtacaa

SEQ ID NO: 8585795 - DNA, 22 bp, Homo sapiens
gaggcacagagccctaggagct

SEQ ID NO: 8585796 - DNA, 22 bp, Homo sapiens
gaggcacatatatacagagccc

SEQ ID NO: 8585797 - DNA, 22 bp, Homo sapiens
gaggcacagtcccgaggcaagg

SEQ ID NO: 8585798 - DNA, 22 bp, Homo sapiens
gaggagctgggtcagggagaca

SEQ ID NO: 8585799 - DNA, 22 bp, Homo sapiens
gaggctctgtgatgtgccaggc

SEQ ID NO: 8585800 - DNA, 22 bp, Homo sapiens
gagaatctacaggaaaccgaag

SEQ ID NO: 8585801 - DNA, 22 bp, Homo sapiens
gagacagcacaggccactggga

SEQ ID NO: 8585802 - DNA, 22 bp, Homo sapiens
gagacaggatttaaccaaagct

SEQ ID NO: 8585803 - DNA, 22 bp, Homo sapiens
gagacaggcagctagtgggtca

SEQ ID NO: 8585804 - DNA, 22 bp, Homo sapiens
gagacaggcagctagtgggtca

SEQ ID NO: 8585805 - DNA, 22 bp, Homo sapiens
gagacaggcagctagtgggtca

SEQ ID NO: 8585806 - DNA, 22 bp, Homo sapiens
gagacaggccaggtggtactta

SEQ ID NO: 8585807 - DNA, 18 bp, Homo sapiens
gagaagtgcatacattat

SEQ ID NO: 8585808 - DNA, 22 bp, Homo sapiens
atgctgggaagacaaggtggag

SEQ ID NO: 8585809 - DNA, 22 bp, Homo sapiens
atgctgggaagacaaggtggag

SEQ ID NO: 8585810 - DNA, 22 bp, Homo sapiens
atgctgggagtgaagcccctgg

SEQ ID NO: 8585811 - DNA, 22 bp, Homo sapiens
atgctgggacgtacttgttcat

SEQ ID NO: 8585812 - DNA, 22 bp, Homo sapiens
atgctgggaagtcctaaccaca

SEQ ID NO: 8585813 - DNA, 22 bp, Homo sapiens
atgctgggaaactgaaaggaat

SEQ ID NO: 8585814 - DNA, 22 bp, Homo sapiens
atgctgggaaactgaaaggaat

SEQ ID NO: 8585815 - DNA, 22 bp, Homo sapiens
atgctggggcctcagaccagaa

SEQ ID NO: 8585816 - DNA, 22 bp, Homo sapiens
atgggatcttgccctgagggct

SEQ ID NO: 8585817 - DNA, 22 bp, Homo sapiens
gagccccagccctgcttctata

SEQ ID NO: 8585818 - DNA, 22 bp, Homo sapiens
gagccctccatggagccaggca

SEQ ID NO: 8585819 - DNA, 20 bp, Homo sapiens
gagccctctgcactagcgcc

SEQ ID NO: 8585820 - DNA, 22 bp, Homo sapiens
atggctccttctgtgcagtttt

SEQ ID NO: 8585821 - DNA, 22 bp, Homo sapiens
gagcacagggaatagacagata

SEQ ID NO: 8585822 - DNA, 22 bp, Homo sapiens
atgggagggtggaaaggctctg

SEQ ID NO: 8585823 - DNA, 22 bp, Homo sapiens
gagcacagcagggctctgggtg

SEQ ID NO: 8585824 - DNA, 22 bp, Homo sapiens
gagcacagctggaggtagcatt

SEQ ID NO: 8585825 - DNA, 22 bp, Homo sapiens
gaaggaggtgtcagttggactg

SEQ ID NO: 8585826 - DNA, 22 bp, Homo sapiens
gaagcagcaaatctgcagtatc

SEQ ID NO: 8585827 - DNA, 22 bp, Homo sapiens
gaagcctggttcgctggccacc

SEQ ID NO: 8585828 - DNA, 22 bp, Homo sapiens
gaagcctgtggataggggcatc

SEQ ID NO: 8585829 - DNA, 23 bp, Homo sapiens
gaagcagatgtctgagtaggcag

SEQ ID NO: 8585830 - DNA, 22 bp, Homo sapiens
atgatgtacagccacggtgcta

SEQ ID NO: 8585831 - DNA, 22 bp, Homo sapiens
gaagagccaggtgtcgctgtgg

SEQ ID NO: 8585832 - DNA, 22 bp, Homo sapiens
atgctaaagctttgctttcatt

SEQ ID NO: 8585833 - DNA, 22 bp, Homo sapiens
atgcatttgacgggatatattt

SEQ ID NO: 8585834 - DNA, 21 bp, Homo sapiens
atctttattacgcagagaaga

SEQ ID NO: 8585835 - DNA, 22 bp, Homo sapiens
ctttattgtccttcttaggtgg

SEQ ID NO: 8585836 - DNA, 22 bp, Homo sapiens
ctttattgtccttcttaggtgg

SEQ ID NO: 8585837 - DNA, 22 bp, Homo sapiens
ctttattgtccttcttaggtgg

SEQ ID NO: 8585838 - DNA, 22 bp, Homo sapiens
ctttattagatgtagactttct

SEQ ID NO: 8585839 - DNA, 22 bp, Homo sapiens
ctttggctaacaaatcagcttg

SEQ ID NO: 8585840 - DNA, 22 bp, Homo sapiens
ctttggctgacaggtttctggt

SEQ ID NO: 8585841 - DNA, 22 bp, Homo sapiens
ctttggctacaagcgctgcaat

SEQ ID NO: 8585842 - DNA, 22 bp, Homo sapiens
ctttggtcagagggatggagtt

SEQ ID NO: 8585843 - DNA, 22 bp, Homo sapiens
ctttggtccagaagtggcctct

SEQ ID NO: 8585844 - DNA, 22 bp, Homo sapiens
ctttggtcaattgctgcgggga

SEQ ID NO: 8585845 - DNA, 21 bp, Homo sapiens
ctttggtcaacagtccctgaa

SEQ ID NO: 8585846 - DNA, 22 bp, Homo sapiens
ctttggctgacgaggaggaggc

SEQ ID NO: 8585847 - DNA, 22 bp, Homo sapiens
ctttggctgggcaaagggaggt

SEQ ID NO: 8585848 - DNA, 22 bp, Homo sapiens
ctttggcttgccctggcagtac

SEQ ID NO: 8585849 - DNA, 22 bp, Homo sapiens
atgacacttggtgatactttgt

SEQ ID NO: 8585850 - DNA, 22 bp, Homo sapiens
atgacaaaagaagacatgaggt

SEQ ID NO: 8585851 - DNA, 22 bp, Homo sapiens
ctttttatctcttaatgatgtt

SEQ ID NO: 8585852 - DNA, 22 bp, Homo sapiens
atgacagaggagtgcaggtgat

SEQ ID NO: 8585853 - DNA, 22 bp, Homo sapiens
ctttttatagctatgtcctatg

SEQ ID NO: 8585854 - DNA, 22 bp, Homo sapiens
ctttttataccgtgccagttga

SEQ ID NO: 8585855 - DNA, 22 bp, Homo sapiens
atgagataggaacaaacttaca

SEQ ID NO: 8585856 - DNA, 20 bp, Homo sapiens
gcagggcatcttggccccca

SEQ ID NO: 8585857 - DNA, 22 bp, Homo sapiens
gcagggcatccctgagcgggtg

SEQ ID NO: 8585858 - DNA, 20 bp, Homo sapiens
gcagggcatcttggccccca

SEQ ID NO: 8585859 - DNA, 22 bp, Homo sapiens
gcagggcatccctgagcgggtg

SEQ ID NO: 8585860 - DNA, 22 bp, Homo sapiens
gcagggcatagaggcacggagg

SEQ ID NO: 8585861 - DNA, 22 bp, Homo sapiens
gcagggcaaacccaggtgttca

SEQ ID NO: 8585862 - DNA, 22 bp, Homo sapiens
gcagggcagtaagagctagagt

SEQ ID NO: 8585863 - DNA, 22 bp, Homo sapiens
gcagggcagtgtgtctgtgggg

SEQ ID NO: 8585864 - DNA, 22 bp, Homo sapiens
gcaggtgtggagtggggtgagc

SEQ ID NO: 8585865 - DNA, 22 bp, Homo sapiens
gcaggtgtggagagtggtcggg

SEQ ID NO: 8585866 - DNA, 18 bp, Homo sapiens
gcaggtgtggagaagggg

SEQ ID NO: 8585867 - DNA, 19 bp, Homo sapiens
gcaggtggatgtggtcagc

SEQ ID NO: 8585868 - DNA, 22 bp, Homo sapiens
gcaggtgttttaagacattgaa

SEQ ID NO: 8585869 - DNA, 21 bp, Homo sapiens
gcaggtgtggtatcagcttcc

SEQ ID NO: 8585870 - DNA, 22 bp, Homo sapiens
gcaggtgttctcagaggaggct

SEQ ID NO: 8585871 - DNA, 22 bp, Homo sapiens
gcaggtgtgggtggctgccagg

SEQ ID NO: 8585872 - DNA, 22 bp, Homo sapiens
gcaggtgtggatttgcatccag

SEQ ID NO: 8585873 - DNA, 22 bp, Homo sapiens
gcaggcaggaaggactaagtaa

SEQ ID NO: 8585874 - DNA, 21 bp, Homo sapiens
gcagagaatgaactttggctt

SEQ ID NO: 8585875 - DNA, 22 bp, Homo sapiens
gcagagagttgggctgcgccag

SEQ ID NO: 8585876 - DNA, 22 bp, Homo sapiens
gcagagatgggccagtgacgca

SEQ ID NO: 8585877 - DNA, 22 bp, Homo sapiens
gcagagaaggattgaaaccaga

SEQ ID NO: 8585878 - DNA, 22 bp, Homo sapiens
attataggcttgagccaccgtg

SEQ ID NO: 8585879 - DNA, 22 bp, Homo sapiens
attagtttggtgcaaaagtaat

SEQ ID NO: 8585880 - DNA, 22 bp, Homo sapiens
attaagatcattgtagaagatt

SEQ ID NO: 8585881 - DNA, 22 bp, Homo sapiens
gcacacagagaggtggtatgtc

SEQ ID NO: 8585882 - DNA, 22 bp, Homo sapiens
gcacacagattaggaaacagaa

SEQ ID NO: 8585883 - DNA, 22 bp, Homo sapiens
gcaccaggcttagagccccagg

SEQ ID NO: 8585884 - DNA, 22 bp, Homo sapiens
gcaccagggagggtgtgcttca

SEQ ID NO: 8585885 - DNA, 22 bp, Homo sapiens
gcaccatgacagtgaggagaac

SEQ ID NO: 8585886 - DNA, 22 bp, Homo sapiens
gcaccaggcagctgagcaggcc

SEQ ID NO: 8585887 - DNA, 22 bp, Homo sapiens
gatggccacatacatggctggg

SEQ ID NO: 8585888 - DNA, 22 bp, Homo sapiens
atgttatttattgaaacacttt

SEQ ID NO: 8585889 - DNA, 22 bp, Homo sapiens
gagtgggcaccgtgggcacact

SEQ ID NO: 8585890 - DNA, 22 bp, Homo sapiens
gagtggggcccactgctgggtg

SEQ ID NO: 8585891 - DNA, 22 bp, Homo sapiens
gatgtgggtgtcttcagctggt

SEQ ID NO: 8585892 - DNA, 22 bp, Homo sapiens
gattcactcatattttacgttt

SEQ ID NO: 8585893 - DNA, 22 bp, Homo sapiens
gatgtgtcatttggtcatctgc

SEQ ID NO: 8585894 - DNA, 18 bp, Homo sapiens
gatggccatttcaatgtt

SEQ ID NO: 8585895 - DNA, 22 bp, Homo sapiens
gcccagtgctgagggtgctgct

SEQ ID NO: 8585896 - DNA, 22 bp, Homo sapiens
gcccagtgggaagctaaggtgg

SEQ ID NO: 8585897 - DNA, 19 bp, Homo sapiens
atttattgtatgattccat

SEQ ID NO: 8585898 - DNA, 19 bp, Homo sapiens
atttattgtatgattccat

SEQ ID NO: 8585899 - DNA, 19 bp, Homo sapiens
atttattgtatgattccat

SEQ ID NO: 8585900 - DNA, 22 bp, Homo sapiens
atttattggtttgcatggtgaa

SEQ ID NO: 8585901 - DNA, 22 bp, Homo sapiens
gccatctggcattgcagcacct

SEQ ID NO: 8585902 - DNA, 22 bp, Homo sapiens
gcccaggagttgaatgcagcag

SEQ ID NO: 8585903 - DNA, 22 bp, Homo sapiens
gcccaggagttgaatgcagcag

SEQ ID NO: 8585904 - DNA, 22 bp, Homo sapiens
atttcaagtccaagtcttgggt

SEQ ID NO: 8585905 - DNA, 22 bp, Homo sapiens
gccagctgcatctcctgggctg

SEQ ID NO: 8585906 - DNA, 21 bp, Homo sapiens
gccagctgcagggcttccttg

SEQ ID NO: 8585907 - DNA, 22 bp, Homo sapiens
gccagctgctcgcgtagggtag

SEQ ID NO: 8585908 - DNA, 22 bp, Homo sapiens
gccagctgccctctgctggtcc

SEQ ID NO: 8585909 - DNA, 22 bp, Homo sapiens
gccagctgccctctgctggtcc

SEQ ID NO: 8585910 - DNA, 22 bp, Homo sapiens
gccagctgcatctcctgggctg

SEQ ID NO: 8585911 - DNA, 22 bp, Homo sapiens
gccagccagggaagggagagac

SEQ ID NO: 8585912 - DNA, 22 bp, Homo sapiens
attgtactcacaaaacatgagt

SEQ ID NO: 8585913 - DNA, 22 bp, Homo sapiens
gccagccacgttagactggccc

SEQ ID NO: 8585914 - DNA, 22 bp, Homo sapiens
gccaggtggctgagcagctgca

SEQ ID NO: 8585915 - DNA, 22 bp, Homo sapiens
atttattatgggatttggcaca

SEQ ID NO: 8585916 - DNA, 22 bp, Homo sapiens
atttagtttaggaaaagtaggt

SEQ ID NO: 8585917 - DNA, 22 bp, Homo sapiens
gccagctggagtgagagtgggc

SEQ ID NO: 8585918 - DNA, 22 bp, Homo sapiens
gccagctggaaatctgcttgaa

SEQ ID NO: 8585919 - DNA, 22 bp, Homo sapiens
gccagctggagactggcagggg

SEQ ID NO: 8585920 - DNA, 22 bp, Homo sapiens
gccagctggagactggcagggg

SEQ ID NO: 8585921 - DNA, 22 bp, Homo sapiens
gccagctggaaatctgcttgaa

SEQ ID NO: 8585922 - DNA, 22 bp, Homo sapiens
atttatctctggaaactaagca

SEQ ID NO: 8585923 - DNA, 22 bp, Homo sapiens
caaagaagagatttacagagct

SEQ ID NO: 8585924 - DNA, 22 bp, Homo sapiens
gctctgagattgagcctttggt

SEQ ID NO: 8585925 - DNA, 22 bp, Homo sapiens
gctctgagattgagcctttggt

SEQ ID NO: 8585926 - DNA, 22 bp, Homo sapiens
gctctgagataaacgttgccct

SEQ ID NO: 8585927 - DNA, 22 bp, Homo sapiens
gctcccagggaccgcagggcag

SEQ ID NO: 8585928 - DNA, 22 bp, Homo sapiens
gctccagggaacagaatgtact

SEQ ID NO: 8585929 - DNA, 22 bp, Homo sapiens
gctccccagcttagccctggct

SEQ ID NO: 8585930 - DNA, 22 bp, Homo sapiens
atttggtcagaactctctttag

SEQ ID NO: 8585931 - DNA, 22 bp, Homo sapiens
atttggtcacaccagtccacat

SEQ ID NO: 8585932 - DNA, 22 bp, Homo sapiens
atttggtcactaggaaaatcaa

SEQ ID NO: 8585933 - DNA, 22 bp, Homo sapiens
atttggtctccatactggttag

SEQ ID NO: 8585934 - DNA, 22 bp, Homo sapiens
atttggtctacattttccaaat

SEQ ID NO: 8585935 - DNA, 22 bp, Homo sapiens
atttggtcctgctgggggattt

SEQ ID NO: 8585936 - DNA, 22 bp, Homo sapiens
atttggtcccttgttgtgtccc

SEQ ID NO: 8585937 - DNA, 22 bp, Homo sapiens
atttggtcccagggagtcctac

SEQ ID NO: 8585938 - DNA, 21 bp, Homo sapiens
atttggtcaaggacaactctg

SEQ ID NO: 8585939 - DNA, 22 bp, Homo sapiens
atttggtcaagcaaacccccat

SEQ ID NO: 8585940 - DNA, 21 bp, Homo sapiens
atttggtcaatgtctgcgtga

SEQ ID NO: 8585941 - DNA, 22 bp, Homo sapiens
atttggtcttgtatcctggagg

SEQ ID NO: 8585942 - DNA, 22 bp, Homo sapiens
atttggtctgtaattacatgga

SEQ ID NO: 8585943 - DNA, 22 bp, Homo sapiens
atttggtcatgttcagtgtaga

SEQ ID NO: 8585944 - DNA, 17 bp, Homo sapiens
ccaggagcgtgggtctc

SEQ ID NO: 8585945 - DNA, 22 bp, Homo sapiens
ccaggagctggagggtgcagtg

SEQ ID NO: 8585946 - DNA, 22 bp, Homo sapiens
ccaggaggaaattctaaaggta

SEQ ID NO: 8585947 - DNA, 22 bp, Homo sapiens
ccaggaggaaagaccagcccat

SEQ ID NO: 8585948 - DNA, 23 bp, Homo sapiens
aggctccacatgggcactttgca

SEQ ID NO: 8585949 - DNA, 20 bp, Homo sapiens
aggctcctccaggatgtgtg

SEQ ID NO: 8585950 - DNA, 17 bp, Homo sapiens
aggctcctcctaaggtc

SEQ ID NO: 8585951 - DNA, 22 bp, Homo sapiens
ccagggaatgtgggatgactct

SEQ ID NO: 8585952 - DNA, 22 bp, Homo sapiens
ccagggtgaggaggctcccacg

SEQ ID NO: 8585953 - DNA, 22 bp, Homo sapiens
ccatgtggctagcgtgcctgca

SEQ ID NO: 8585954 - DNA, 20 bp, Homo sapiens
aggctgcctaaggctctgca

SEQ ID NO: 8585955 - DNA, 22 bp, Homo sapiens
aggctgcctggctgtgagtgaa

SEQ ID NO: 8585956 - DNA, 20 bp, Homo sapiens
cccagagccatagccagaca

SEQ ID NO: 8585957 - DNA, 20 bp, Homo sapiens
cccagagcactttttcatgt

SEQ ID NO: 8585958 - DNA, 22 bp, Homo sapiens
cccagagcataacgtatcttga

SEQ ID NO: 8585959 - DNA, 19 bp, Homo sapiens
cccagagcatcctgaactt

SEQ ID NO: 8585960 - DNA, 23 bp, Homo sapiens
cccagagcacagcctccagatgc

SEQ ID NO: 8585961 - DNA, 22 bp, Homo sapiens
cccagagccggtggtgctcaca

SEQ ID NO: 8585962 - DNA, 22 bp, Homo sapiens
aggctggcgtcaggggctgtac

SEQ ID NO: 8585963 - DNA, 21 bp, Homo sapiens
cccagagcctagggagggcac

SEQ ID NO: 8585964 - DNA, 22 bp, Homo sapiens
ccatgcacaccagcaggcagac

SEQ ID NO: 8585965 - DNA, 22 bp, Homo sapiens
ccatggcttacagatggagcat

SEQ ID NO: 8585966 - DNA, 22 bp, Homo sapiens
aggctgaggtaggaggatcgct

SEQ ID NO: 8585967 - DNA, 22 bp, Homo sapiens
aggctgagtcgggaggatcact

SEQ ID NO: 8585968 - DNA, 22 bp, Homo sapiens
aggctgaggtgtgctgtgatcg

SEQ ID NO: 8585969 - DNA, 22 bp, Homo sapiens
aggctctgtgacaatcaagctg

SEQ ID NO: 8585970 - DNA, 22 bp, Homo sapiens
aggctctgtgatgtgccaggca

SEQ ID NO: 8585971 - DNA, 22 bp, Homo sapiens
aggctgaggggcgagggaccct

SEQ ID NO: 8585972 - DNA, 20 bp, Homo sapiens
aggctgagggtgattgtgtc

SEQ ID NO: 8585973 - DNA, 22 bp, Homo sapiens
ccagctttctcagaggcttcta

SEQ ID NO: 8585974 - DNA, 20 bp, Homo sapiens
ccagctttccctgcagcatc

SEQ ID NO: 8585975 - DNA, 22 bp, Homo sapiens
ccaggagcaaagatcactggga

SEQ ID NO: 8585976 - DNA, 22 bp, Homo sapiens
ccaggagatttttccatagcac

SEQ ID NO: 8585977 - DNA, 22 bp, Homo sapiens
ccaggagatgggaaagtagcag

SEQ ID NO: 8585978 - DNA, 22 bp, Homo sapiens
ccaggagagctctaaatggctg

SEQ ID NO: 8585979 - DNA, 22 bp, Homo sapiens
ccaggagagcattgcacagagg

SEQ ID NO: 8585980 - DNA, 22 bp, Homo sapiens
aggcccagagagccagttagtg

SEQ ID NO: 8585981 - DNA, 19 bp, Homo sapiens
aggcccagcgctgggggct

SEQ ID NO: 8585982 - DNA, 22 bp, Homo sapiens
aggcccagcccgtcctcgtgct

SEQ ID NO: 8585983 - DNA, 22 bp, Homo sapiens
ccagctttcatatcatgaggta

SEQ ID NO: 8585984 - DNA, 19 bp, Homo sapiens
ccagctggcctgggacctc

SEQ ID NO: 8585985 - DNA, 19 bp, Homo sapiens
ccagctggcctgggacctc

SEQ ID NO: 8585986 - DNA, 22 bp, Homo sapiens
aggccagagttaaggagaacag

SEQ ID NO: 8585987 - DNA, 22 bp, Homo sapiens
aggcatggatgtagcagtgacc

SEQ ID NO: 8585988 - DNA, 23 bp, Homo sapiens
aggcatggcatggatggtggctc

SEQ ID NO: 8585989 - DNA, 22 bp, Homo sapiens
aggcatggacatttcggcagct

SEQ ID NO: 8585990 - DNA, 22 bp, Homo sapiens
ccagagcagaaccggaacacca

SEQ ID NO: 8585991 - DNA, 19 bp, Homo sapiens
ccagcagaagccactcctg

SEQ ID NO: 8585992 - DNA, 22 bp, Homo sapiens
ccagcactgttctaaggaaaca

SEQ ID NO: 8585993 - DNA, 22 bp, Homo sapiens
aggccagaagccagaaatgctt

SEQ ID NO: 8585994 - DNA, 22 bp, Homo sapiens
aggccagaaatttggagtatgt

SEQ ID NO: 8585995 - DNA, 22 bp, Homo sapiens
ccagcagagggcgcttcacacc

SEQ ID NO: 8585996 - DNA, 22 bp, Homo sapiens
ccagcagaggcatcatccttcc

SEQ ID NO: 8585997 - DNA, 17 bp, Homo sapiens
aggcaggtaagagttat

SEQ ID NO: 8585998 - DNA, 22 bp, Homo sapiens
ccacagcttcgcagtctgctgc

SEQ ID NO: 8585999 - DNA, 22 bp, Homo sapiens
aggcagggtgatgataatgatt

SEQ ID NO: 8586000 - DNA, 22 bp, Homo sapiens
aggcagggtcttgctatgttgc

SEQ ID NO: 8586001 - DNA, 22 bp, Homo sapiens
ccacaggatccaagggaaggca

SEQ ID NO: 8586002 - DNA, 22 bp, Homo sapiens
ccagagaaagtgaagcaaatgt

SEQ ID NO: 8586003 - DNA, 22 bp, Homo sapiens
ccacaggacggaggtctggccg

SEQ ID NO: 8586004 - DNA, 22 bp, Homo sapiens
ccacaggacggaggtctggccg

SEQ ID NO: 8586005 - DNA, 22 bp, Homo sapiens
ccgcccacactaaatatgagcg

SEQ ID NO: 8586006 - DNA, 22 bp, Homo sapiens
ccgcatttccaatgaggcaaag

SEQ ID NO: 8586007 - DNA, 22 bp, Homo sapiens
agggccagaatccctcagtcta

SEQ ID NO: 8586008 - DNA, 22 bp, Homo sapiens
agggccagaggcaccttgcagc

SEQ ID NO: 8586009 - DNA, 22 bp, Homo sapiens
agggccagagtacatcagggct

SEQ ID NO: 8586010 - DNA, 22 bp, Homo sapiens
agggccagagtacatcagggct

SEQ ID NO: 8586011 - DNA, 22 bp, Homo sapiens
agggctctgttggggtcagcac

SEQ ID NO: 8586012 - DNA, 22 bp, Homo sapiens
agggctctgtccccagaggccc

SEQ ID NO: 8586013 - DNA, 22 bp, Homo sapiens
agggctctgtccccagaggccc

SEQ ID NO: 8586014 - DNA, 22 bp, Homo sapiens
agggctctggggtggcagagat

SEQ ID NO: 8586015 - DNA, 22 bp, Homo sapiens
agggctcctccccggcctccac

SEQ ID NO: 8586016 - DNA, 22 bp, Homo sapiens
agggctctcttggacaactgct

SEQ ID NO: 8586017 - DNA, 22 bp, Homo sapiens
agggctctgagctggaccacct

SEQ ID NO: 8586018 - DNA, 22 bp, Homo sapiens
agggctccgggcaggcgatgga

SEQ ID NO: 8586019 - DNA, 22 bp, Homo sapiens
agggccctccccgctcagggca

SEQ ID NO: 8586020 - DNA, 22 bp, Homo sapiens
agggccctctgggcactgtggc

SEQ ID NO: 8586021 - DNA, 22 bp, Homo sapiens
agggccctgagttgcagccctg

SEQ ID NO: 8586022 - DNA, 22 bp, Homo sapiens
agggcccttacgcaggcccttc

SEQ ID NO: 8586023 - DNA, 22 bp, Homo sapiens
agggctccaaggaagtgtagct

SEQ ID NO: 8586024 - DNA, 22 bp, Homo sapiens
agggctcccgtgaggtgactgc

SEQ ID NO: 8586025 - DNA, 22 bp, Homo sapiens
agggctccaggggctgggtgac

SEQ ID NO: 8586026 - DNA, 22 bp, Homo sapiens
cctgaggcaaggacttggtggc

SEQ ID NO: 8586027 - DNA, 22 bp, Homo sapiens
cctgaggccctggctgtgctga

SEQ ID NO: 8586028 - DNA, 22 bp, Homo sapiens
cctgaggatattcaccagcatg

SEQ ID NO: 8586029 - DNA, 17 bp, Homo sapiens
aggggagagtgggaaga

SEQ ID NO: 8586030 - DNA, 22 bp, Homo sapiens
aggggacatttagcaatgacta

SEQ ID NO: 8586031 - DNA, 22 bp, Homo sapiens
aggggagagaacataaggaagt

SEQ ID NO: 8586032 - DNA, 22 bp, Homo sapiens
agggaagaaaatccatcgctgc

SEQ ID NO: 8586033 - DNA, 20 bp, Homo sapiens
cccaggagtttgctcttact

SEQ ID NO: 8586034 - DNA, 22 bp, Homo sapiens
cccaggagtttgagttcagcat

SEQ ID NO: 8586035 - DNA, 23 bp, Homo sapiens
cccaggagtttcactgcaaaggt

SEQ ID NO: 8586036 - DNA, 22 bp, Homo sapiens
cccaggagttggaggctgcagt

SEQ ID NO: 8586037 - DNA, 22 bp, Homo sapiens
cccaggggtaaggcgcagcgtg

SEQ ID NO: 8586038 - DNA, 19 bp, Homo sapiens
cccaggggacccagcccta

SEQ ID NO: 8586039 - DNA, 22 bp, Homo sapiens
cccaggggaggtcctcagggaa

SEQ ID NO: 8586040 - DNA, 22 bp, Homo sapiens
aggcttcttgggcttcattctg

SEQ ID NO: 8586041 - DNA, 22 bp, Homo sapiens
aggcttcttgagccccacaggc

SEQ ID NO: 8586042 - DNA, 22 bp, Homo sapiens
cccaggagttggaggctacggt

SEQ ID NO: 8586043 - DNA, 22 bp, Homo sapiens
aggctggctgagctgcagcctg

SEQ ID NO: 8586044 - DNA, 19 bp, Homo sapiens
aggcttctaccctgtccag

SEQ ID NO: 8586045 - DNA, 20 bp, Homo sapiens
agggcagagggattacaggc

SEQ ID NO: 8586046 - DNA, 22 bp, Homo sapiens
agggcagagattaattaagaca

SEQ ID NO: 8586047 - DNA, 18 bp, Homo sapiens
agggatcatcactgcagc

SEQ ID NO: 8586048 - DNA, 22 bp, Homo sapiens
agggagttagaaatccaggata

SEQ ID NO: 8586049 - DNA, 22 bp, Homo sapiens
agggactcggttgagtgcccct

SEQ ID NO: 8586050 - DNA, 22 bp, Homo sapiens
agggagaaggtttagctgtgag

SEQ ID NO: 8586051 - DNA, 23 bp, Homo sapiens
aggcagcaggttgtccagggtga

SEQ ID NO: 8586052 - DNA, 22 bp, Homo sapiens
aggcagcagggccactggctga

SEQ ID NO: 8586053 - DNA, 22 bp, Homo sapiens
catttgttaagaaggaaaaagg

SEQ ID NO: 8586054 - DNA, 19 bp, Homo sapiens
aggcagcaggccagggatg

SEQ ID NO: 8586055 - DNA, 21 bp, Homo sapiens
aggcagcaggatccagggaca

SEQ ID NO: 8586056 - DNA, 17 bp, Homo sapiens
catttgttgatcagttg

SEQ ID NO: 8586057 - DNA, 22 bp, Homo sapiens
catttgttgggacaatgaaaag

SEQ ID NO: 8586058 - DNA, 22 bp, Homo sapiens
catggggagacacctagggaaa

SEQ ID NO: 8586059 - DNA, 21 bp, Homo sapiens
aggagggcacaaggccaggaa

SEQ ID NO: 8586060 - DNA, 22 bp, Homo sapiens
aggagggcaggctggctgccta

SEQ ID NO: 8586061 - DNA, 22 bp, Homo sapiens
cagtggcgtgatctctgctcac

SEQ ID NO: 8586062 - DNA, 22 bp, Homo sapiens
cagtggcgtgatctctgctcac

SEQ ID NO: 8586063 - DNA, 22 bp, Homo sapiens
cagtgggtgatgagtcctgggg

SEQ ID NO: 8586064 - DNA, 22 bp, Homo sapiens
cagtggcgtgatctctgctcac

SEQ ID NO: 8586065 - DNA, 22 bp, Homo sapiens
cagtgggtggctaagtggctga

SEQ ID NO: 8586066 - DNA, 22 bp, Homo sapiens
cagtgggtggcctcttgagtca

SEQ ID NO: 8586067 - DNA, 22 bp, Homo sapiens
cagtgggtgccatcgtgccctt

SEQ ID NO: 8586068 - DNA, 22 bp, Homo sapiens
cagtgggtgcctctcattatat

SEQ ID NO: 8586069 - DNA, 22 bp, Homo sapiens
cagtggtgaagagcaggggctc

SEQ ID NO: 8586070 - DNA, 22 bp, Homo sapiens
cagtttctctcaataagcatcg

SEQ ID NO: 8586071 - DNA, 22 bp, Homo sapiens
catagattttaggttagatcga

SEQ ID NO: 8586072 - DNA, 22 bp, Homo sapiens
catattctgttggtcacataga

SEQ ID NO: 8586073 - DNA, 22 bp, Homo sapiens
cagtggccaacttcctgcctct

SEQ ID NO: 8586074 - DNA, 22 bp, Homo sapiens
cagtggagaggcatgcttggca

SEQ ID NO: 8586075 - DNA, 22 bp, Homo sapiens
cagtggcatacttggctgatat

SEQ ID NO: 8586076 - DNA, 22 bp, Homo sapiens
cagtggcctctggctttgctgt

SEQ ID NO: 8586077 - DNA, 22 bp, Homo sapiens
cagtggccgcggggctgtgggt

SEQ ID NO: 8586078 - DNA, 19 bp, Homo sapiens
cagtgcccgacgcaggtct

SEQ ID NO: 8586079 - DNA, 22 bp, Homo sapiens
aggacgctctcgctgaacttct

SEQ ID NO: 8586080 - DNA, 22 bp, Homo sapiens
aggaccagcctccaggtctctt

SEQ ID NO: 8586081 - DNA, 22 bp, Homo sapiens
caggtggcttctctgcagcctt

SEQ ID NO: 8586082 - DNA, 22 bp, Homo sapiens
caggtggcttctccctaggcca

SEQ ID NO: 8586083 - DNA, 22 bp, Homo sapiens
caggtgggagcgaggagctact

SEQ ID NO: 8586084 - DNA, 22 bp, Homo sapiens
caggtgggagcggagactgatt

SEQ ID NO: 8586085 - DNA, 22 bp, Homo sapiens
aggacatgtgcctccagggcag

SEQ ID NO: 8586086 - DNA, 22 bp, Homo sapiens
aggacatgtgcctccagggcag

SEQ ID NO: 8586087 - DNA, 22 bp, Homo sapiens
aggacatgtttgtatcttcctt

SEQ ID NO: 8586088 - DNA, 22 bp, Homo sapiens
aggacaggattgagctgaactg

SEQ ID NO: 8586089 - DNA, 22 bp, Homo sapiens
agctgagggcaggatggggtga

SEQ ID NO: 8586090 - DNA, 22 bp, Homo sapiens
cagctgagaaatggggaaaggg

SEQ ID NO: 8586091 - DNA, 22 bp, Homo sapiens
caggaaggcgcggctgtgcctg

SEQ ID NO: 8586092 - DNA, 19 bp, Homo sapiens
caggaaggggcgaatctgg

SEQ ID NO: 8586093 - DNA, 22 bp, Homo sapiens
caggaaggcccacctgtcctgt

SEQ ID NO: 8586094 - DNA, 22 bp, Homo sapiens
caggaaggcccacctgtcctgt

SEQ ID NO: 8586095 - DNA, 22 bp, Homo sapiens
caggaaggggctcactctggcc

SEQ ID NO: 8586096 - DNA, 22 bp, Homo sapiens
agctgcagttagccccagatga

SEQ ID NO: 8586097 - DNA, 22 bp, Homo sapiens
caggaaggaccgtccagatcag

SEQ ID NO: 8586098 - DNA, 22 bp, Homo sapiens
caggaaggaccgtccagatcag

SEQ ID NO: 8586099 - DNA, 22 bp, Homo sapiens
agctgcagcactccagtagccg

SEQ ID NO: 8586100 - DNA, 22 bp, Homo sapiens
agctgcagcactccagtagccg

SEQ ID NO: 8586101 - DNA, 22 bp, Homo sapiens
agctgcagaggtttgtgcaaca

SEQ ID NO: 8586102 - DNA, 18 bp, Homo sapiens
agctgcagaccaggaggt

SEQ ID NO: 8586103 - DNA, 19 bp, Homo sapiens
agctgcagaccagaagtgc

SEQ ID NO: 8586104 - DNA, 22 bp, Homo sapiens
agctgctgagccatgtcctgct

SEQ ID NO: 8586105 - DNA, 22 bp, Homo sapiens
caggaggattgcttgaggccag

SEQ ID NO: 8586106 - DNA, 22 bp, Homo sapiens
agctgctgagccatgtcctgct

SEQ ID NO: 8586107 - DNA, 22 bp, Homo sapiens
caggaggattgcttgaggccag

SEQ ID NO: 8586108 - DNA, 22 bp, Homo sapiens
caggaggagctggccgcctcat

SEQ ID NO: 8586109 - DNA, 22 bp, Homo sapiens
caggaggacatactggctcaca

SEQ ID NO: 8586110 - DNA, 22 bp, Homo sapiens
caggagccccaggctgacaata

SEQ ID NO: 8586111 - DNA, 22 bp, Homo sapiens
caggcactggccagtcagcaca

SEQ ID NO: 8586112 - DNA, 22 bp, Homo sapiens
agctgctgcggaaagatgccac

SEQ ID NO: 8586113 - DNA, 19 bp, Homo sapiens
agctgctggcccagggacc

SEQ ID NO: 8586114 - DNA, 22 bp, Homo sapiens
agctgctgggaccccagatcca

SEQ ID NO: 8586115 - DNA, 19 bp, Homo sapiens
agctgctgattggtggagg

SEQ ID NO: 8586116 - DNA, 22 bp, Homo sapiens
agctgctgcccataggtgacat

SEQ ID NO: 8586117 - DNA, 22 bp, Homo sapiens
agctgctgccggtggccaccct

SEQ ID NO: 8586118 - DNA, 22 bp, Homo sapiens
caggccagagtccaactccaga

SEQ ID NO: 8586119 - DNA, 20 bp, Homo sapiens
caggccagaggtttgatggc

SEQ ID NO: 8586120 - DNA, 22 bp, Homo sapiens
caggccagcttcctgacatcct

SEQ ID NO: 8586121 - DNA, 19 bp, Homo sapiens
agctgggctgtcacagtga

SEQ ID NO: 8586122 - DNA, 19 bp, Homo sapiens
agctgggctgtcacagtga

SEQ ID NO: 8586123 - DNA, 19 bp, Homo sapiens
agctgggcttactcactcg

SEQ ID NO: 8586124 - DNA, 22 bp, Homo sapiens
agctgggcttggccaggtcgct

SEQ ID NO: 8586125 - DNA, 22 bp, Homo sapiens
agctgggctgggctgagctgag

SEQ ID NO: 8586126 - DNA, 22 bp, Homo sapiens
agctgggctggagctccaagcg

SEQ ID NO: 8586127 - DNA, 22 bp, Homo sapiens
caggccagggagaatatgaagc

SEQ ID NO: 8586128 - DNA, 20 bp, Homo sapiens
agctggcccacaggtgtggg

SEQ ID NO: 8586129 - DNA, 22 bp, Homo sapiens
agctggccggcctccaggtgga

SEQ ID NO: 8586130 - DNA, 22 bp, Homo sapiens
caggtgaggctgaacagatgaa

SEQ ID NO: 8586131 - DNA, 22 bp, Homo sapiens
caggtgagtaacaatgggtgat

SEQ ID NO: 8586132 - DNA, 22 bp, Homo sapiens
cagggtgcatacccatgcatac

SEQ ID NO: 8586133 - DNA, 22 bp, Homo sapiens
caggggctgtgggcggagcctc

SEQ ID NO: 8586134 - DNA, 22 bp, Homo sapiens
caggggctgagaaggaacgtcc

SEQ ID NO: 8586135 - DNA, 22 bp, Homo sapiens
caggggctgtggcacatggtgt

SEQ ID NO: 8586136 - DNA, 23 bp, Homo sapiens
cagggccaggcagcagctgtcac

SEQ ID NO: 8586137 - DNA, 22 bp, Homo sapiens
cagggcctcctaaggcatctaa

SEQ ID NO: 8586138 - DNA, 22 bp, Homo sapiens
cagggcctcctaaggcatctaa

SEQ ID NO: 8586139 - DNA, 22 bp, Homo sapiens
cagggcctcgaagcctctgggc

SEQ ID NO: 8586140 - DNA, 22 bp, Homo sapiens
cagggcctctcatcccacgggc

SEQ ID NO: 8586141 - DNA, 22 bp, Homo sapiens
caggggctccctgggtgccagt

SEQ ID NO: 8586142 - DNA, 22 bp, Homo sapiens
cagggcctgcctggttcctgga

SEQ ID NO: 8586143 - DNA, 22 bp, Homo sapiens
cagggagcggagtcccatgcct

SEQ ID NO: 8586144 - DNA, 22 bp, Homo sapiens
cagggagctttcccaggaccct

SEQ ID NO: 8586145 - DNA, 22 bp, Homo sapiens
cagggagctggctggctgtgcc

SEQ ID NO: 8586146 - DNA, 22 bp, Homo sapiens
cagggagctggctggctgtgcc

SEQ ID NO: 8586147 - DNA, 22 bp, Homo sapiens
cagggagctctgggccggactc

SEQ ID NO: 8586148 - DNA, 22 bp, Homo sapiens
cagggagctggagttggagtac

SEQ ID NO: 8586149 - DNA, 22 bp, Homo sapiens
caggctcactgtaaggtcagct

SEQ ID NO: 8586150 - DNA, 18 bp, Homo sapiens
agctggggcctctggtcc

SEQ ID NO: 8586151 - DNA, 22 bp, Homo sapiens
agctggggcatttatccactaa

SEQ ID NO: 8586152 - DNA, 22 bp, Homo sapiens
agctggggcatttatccactaa

SEQ ID NO: 8586153 - DNA, 22 bp, Homo sapiens
agctggggcatttatccactaa

SEQ ID NO: 8586154 - DNA, 18 bp, Homo sapiens
agctggggcctctggtcc

SEQ ID NO: 8586155 - DNA, 22 bp, Homo sapiens
caggctgctccagggtaggaaa

SEQ ID NO: 8586156 - DNA, 22 bp, Homo sapiens
caggctgcggtcggctctggtc

SEQ ID NO: 8586157 - DNA, 22 bp, Homo sapiens
agctgtggcagcactttggagt

SEQ ID NO: 8586158 - DNA, 22 bp, Homo sapiens
agctgtggaaatcaggcaatga

SEQ ID NO: 8586159 - DNA, 22 bp, Homo sapiens
agtaatttgttataaagcaata

SEQ ID NO: 8586160 - DNA, 20 bp, Homo sapiens
cctttattatttgtatgatg

SEQ ID NO: 8586161 - DNA, 22 bp, Homo sapiens
cctttatgtttctgcagccccc

SEQ ID NO: 8586162 - DNA, 22 bp, Homo sapiens
cctttattcaattagtcctaat

SEQ ID NO: 8586163 - DNA, 22 bp, Homo sapiens
cctttatgagatcctggggtga

SEQ ID NO: 8586164 - DNA, 22 bp, Homo sapiens
cctttatgatagatgctttcag

SEQ ID NO: 8586165 - DNA, 21 bp, Homo sapiens
cctttatgcaaggactggcat

SEQ ID NO: 8586166 - DNA, 22 bp, Homo sapiens
cctttatgtcactctggagagc

SEQ ID NO: 8586167 - DNA, 22 bp, Homo sapiens
aggttggcctcagggaggctct

SEQ ID NO: 8586168 - DNA, 22 bp, Homo sapiens
cctggtgagctgggtgcacggc

SEQ ID NO: 8586169 - DNA, 22 bp, Homo sapiens
aggtggggttcagtctcagccg

SEQ ID NO: 8586170 - DNA, 22 bp, Homo sapiens
aggtgtcttcagggtgagacag

SEQ ID NO: 8586171 - DNA, 22 bp, Homo sapiens
agtcagttgcaaacatcaggca

SEQ ID NO: 8586172 - DNA, 22 bp, Homo sapiens
cgtgccactgcactctagcctg

SEQ ID NO: 8586173 - DNA, 22 bp, Homo sapiens
cgcgaggtggaggttgcagtga

SEQ ID NO: 8586174 - DNA, 22 bp, Homo sapiens
cgtggccacccagtggtgcgtg

SEQ ID NO: 8586175 - DNA, 22 bp, Homo sapiens
cgtggccagccatttcctggaa

SEQ ID NO: 8586176 - DNA, 22 bp, Homo sapiens
cgtgctgggtctgcggggccgt

SEQ ID NO: 8586177 - DNA, 22 bp, Homo sapiens
cctggccttaagggcagggagc

SEQ ID NO: 8586178 - DNA, 22 bp, Homo sapiens
cctggagcccctctggccagcc

SEQ ID NO: 8586179 - DNA, 22 bp, Homo sapiens
cctgcctggctgtcagcagagc

SEQ ID NO: 8586180 - DNA, 23 bp, Homo sapiens
agggtgagcaagctatggagacc

SEQ ID NO: 8586181 - DNA, 22 bp, Homo sapiens
aggtggagtgaaggaaaggcag

SEQ ID NO: 8586182 - DNA, 22 bp, Homo sapiens
aggtggagtgtgcagggagagc

SEQ ID NO: 8586183 - DNA, 22 bp, Homo sapiens
cctgggcagggagaccaggctc

SEQ ID NO: 8586184 - DNA, 22 bp, Homo sapiens
aggtgagtcctgggcacaggta

SEQ ID NO: 8586185 - DNA, 22 bp, Homo sapiens
agtctgtgtgaatgtgggcttt

SEQ ID NO: 8586186 - DNA, 22 bp, Homo sapiens
ctcaggatccatctcctgccct

SEQ ID NO: 8586187 - DNA, 22 bp, Homo sapiens
agtctgtgaacttggcagggaa

SEQ ID NO: 8586188 - DNA, 22 bp, Homo sapiens
agtgcaggagcctggccagagc

SEQ ID NO: 8586189 - DNA, 22 bp, Homo sapiens
agtgcaggagcctggccagagc

SEQ ID NO: 8586190 - DNA, 22 bp, Homo sapiens
ctcccaggttccgacgcctctt

SEQ ID NO: 8586191 - DNA, 22 bp, Homo sapiens
ctcccaggttccgacgcctctt

SEQ ID NO: 8586192 - DNA, 21 bp, Homo sapiens
ctcccagggtgactgttcaac

SEQ ID NO: 8586193 - DNA, 22 bp, Homo sapiens
ctcccaggttacatctgagcct

SEQ ID NO: 8586194 - DNA, 22 bp, Homo sapiens
ctcccaggttacatctgagcct

SEQ ID NO: 8586195 - DNA, 22 bp, Homo sapiens
ctcccaggtgtcccttctgcca

SEQ ID NO: 8586196 - DNA, 22 bp, Homo sapiens
ctcccaggggagtcatctgctt

SEQ ID NO: 8586197 - DNA, 22 bp, Homo sapiens
ctcccaggggagtcatctgctt

SEQ ID NO: 8586198 - DNA, 22 bp, Homo sapiens
ctcccagggtctaggctgctgg

SEQ ID NO: 8586199 - DNA, 22 bp, Homo sapiens
ctcccagggtagggagagacta

SEQ ID NO: 8586200 - DNA, 22 bp, Homo sapiens
ctcccaggggaactatcaagta

SEQ ID NO: 8586201 - DNA, 22 bp, Homo sapiens
ctccagggagctgcgggagcca

SEQ ID NO: 8586202 - DNA, 20 bp, Homo sapiens
ctccagtgttcaggggagtg

SEQ ID NO: 8586203 - DNA, 22 bp, Homo sapiens
ctccagtgtctcagagcagatg

SEQ ID NO: 8586204 - DNA, 22 bp, Homo sapiens
ctccatcagctgttggttgagg

SEQ ID NO: 8586205 - DNA, 22 bp, Homo sapiens
ctccatcatgtttgatcctgag

SEQ ID NO: 8586206 - DNA, 22 bp, Homo sapiens
agtgacatgctctcaggcataa

SEQ ID NO: 8586207 - DNA, 22 bp, Homo sapiens
agtgacatcatgtcagcaaagt

SEQ ID NO: 8586208 - DNA, 22 bp, Homo sapiens
agtgcagactgaaatgaccttc

SEQ ID NO: 8586209 - DNA, 22 bp, Homo sapiens
ctgaagctgaaaacttccagca

SEQ ID NO: 8586210 - DNA, 22 bp, Homo sapiens
ctgaagccagtttgctgccctt

SEQ ID NO: 8586211 - DNA, 22 bp, Homo sapiens
agtgtcctggcaagggtttcag

SEQ ID NO: 8586212 - DNA, 22 bp, Homo sapiens
agtgtcctctattatgacttta

SEQ ID NO: 8586213 - DNA, 22 bp, Homo sapiens
agtggggacttatgccagcatt

SEQ ID NO: 8586214 - DNA, 22 bp, Homo sapiens
agtggggacttatgccagcatt

SEQ ID NO: 8586215 - DNA, 22 bp, Homo sapiens
agtggggacaatgagagcaggt

SEQ ID NO: 8586216 - DNA, 22 bp, Homo sapiens
ctcttaaaaacttgatatattt

SEQ ID NO: 8586217 - DNA, 22 bp, Homo sapiens
agtggcagccgagcaggagatg

SEQ ID NO: 8586218 - DNA, 22 bp, Homo sapiens
agtggcaggcagaagcttctca

SEQ ID NO: 8586219 - DNA, 17 bp, Homo sapiens
agtggcaggcagatggg

SEQ ID NO: 8586220 - DNA, 22 bp, Homo sapiens
agtggctggcataggaacagac

SEQ ID NO: 8586221 - DNA, 19 bp, Homo sapiens
agtggctgggcagaagcaa

SEQ ID NO: 8586222 - DNA, 22 bp, Homo sapiens
ctctctggggttccagacgtgg

SEQ ID NO: 8586223 - DNA, 22 bp, Homo sapiens
agtgcaggccccaggccaggcc

SEQ ID NO: 8586224 - DNA, 22 bp, Homo sapiens
agtgcaggccccaggccaggcc

SEQ ID NO: 8586225 - DNA, 22 bp, Homo sapiens
agtgcaggctcgcttgtgaggc

SEQ ID NO: 8586226 - DNA, 22 bp, Homo sapiens
agtgggcttactgagggagtgt

SEQ ID NO: 8586227 - DNA, 22 bp, Homo sapiens
agtgggctggtggcagggagaa

SEQ ID NO: 8586228 - DNA, 21 bp, Homo sapiens
agtgggatactggaaggtaga

SEQ ID NO: 8586229 - DNA, 22 bp, Homo sapiens
agtgggcaggcagggtgcgcag

SEQ ID NO: 8586230 - DNA, 22 bp, Homo sapiens
agtgggcagcccaggaggtctt

SEQ ID NO: 8586231 - DNA, 22 bp, Homo sapiens
agtggctggtctaaggtcacag

SEQ ID NO: 8586232 - DNA, 22 bp, Homo sapiens
ctctgagactcaagtgagtggg

SEQ ID NO: 8586233 - DNA, 22 bp, Homo sapiens
ctctgagaaagctgtgagctaa

SEQ ID NO: 8586234 - DNA, 22 bp, Homo sapiens
cttcagcacctcagctggagag

SEQ ID NO: 8586235 - DNA, 22 bp, Homo sapiens
cttcagcagcctcttgcataaa

SEQ ID NO: 8586236 - DNA, 22 bp, Homo sapiens
cttcagcagatgcaaaacccct

SEQ ID NO: 8586237 - DNA, 22 bp, Homo sapiens
cttcagcatctttttcttgggg

SEQ ID NO: 8586238 - DNA, 19 bp, Homo sapiens
cttcagcatctccggagct

SEQ ID NO: 8586239 - DNA, 22 bp, Homo sapiens
ctgtttctaaagggagcagatt

SEQ ID NO: 8586240 - DNA, 22 bp, Homo sapiens
ctgtttcaatttgaggatcagc

SEQ ID NO: 8586241 - DNA, 21 bp, Homo sapiens
cttcagcaaatacttggcagg

SEQ ID NO: 8586242 - DNA, 22 bp, Homo sapiens
cttcattaaccaaaatgcaata

SEQ ID NO: 8586243 - DNA, 22 bp, Homo sapiens
cttcatctttctgagcctcagt

SEQ ID NO: 8586244 - DNA, 22 bp, Homo sapiens
ctgtgcctggggggcagagctg

SEQ ID NO: 8586245 - DNA, 22 bp, Homo sapiens
ctgtgccctttcgctgcactgt

SEQ ID NO: 8586246 - DNA, 22 bp, Homo sapiens
atcaggaattaggtgagatgga

SEQ ID NO: 8586247 - DNA, 22 bp, Homo sapiens
atcaggaagaattggatgctac

SEQ ID NO: 8586248 - DNA, 22 bp, Homo sapiens
atcaggaacgttcatggactgt

SEQ ID NO: 8586249 - DNA, 20 bp, Homo sapiens
atcaggaagagagactgacc

SEQ ID NO: 8586250 - DNA, 19 bp, Homo sapiens
atcaggaacaaggctgatc

SEQ ID NO: 8586251 - DNA, 20 bp, Homo sapiens
ctgtgctccgggttcctgga

SEQ ID NO: 8586252 - DNA, 22 bp, Homo sapiens
ctgtgtccaatggccttagcag

SEQ ID NO: 8586253 - DNA, 22 bp, Homo sapiens
ctgtgtccatgttctaatttgg

SEQ ID NO: 8586254 - DNA, 22 bp, Homo sapiens
ctgtgtccatttatcattgtca

SEQ ID NO: 8586255 - DNA, 22 bp, Homo sapiens
ctgtgtcccacacgaggtgtat

SEQ ID NO: 8586256 - DNA, 22 bp, Homo sapiens
atcaggattcaccccagagctg

SEQ ID NO: 8586257 - DNA, 22 bp, Homo sapiens
atcaggctagtgtgtgtgttca

SEQ ID NO: 8586258 - DNA, 22 bp, Homo sapiens
ctgtgggagcacatgacagata

SEQ ID NO: 8586259 - DNA, 22 bp, Homo sapiens
atcattagcaattttcaataag

SEQ ID NO: 8586260 - DNA, 22 bp, Homo sapiens
ctgtgtcctccccatcacttct

SEQ ID NO: 8586261 - DNA, 22 bp, Homo sapiens
ctgtgtccccctcagccaggtg

SEQ ID NO: 8586262 - DNA, 22 bp, Homo sapiens
ctgtgtcccttgtcccagagcc

SEQ ID NO: 8586263 - DNA, 22 bp, Homo sapiens
ctgtgtcccagtaccttgggta

SEQ ID NO: 8586264 - DNA, 22 bp, Homo sapiens
ctgtgtcccagccaggataatg

SEQ ID NO: 8586265 - DNA, 22 bp, Homo sapiens
ctggggaggatgctacgacctg

SEQ ID NO: 8586266 - DNA, 22 bp, Homo sapiens
ctggggaggcagggctgcccct

SEQ ID NO: 8586267 - DNA, 22 bp, Homo sapiens
ctggggaggcagggctgcccct

SEQ ID NO: 8586268 - DNA, 23 bp, Homo sapiens
ctgggctgtcctgaggtcacctc

SEQ ID NO: 8586269 - DNA, 22 bp, Homo sapiens
ctgggctgtcccagggcggcag

SEQ ID NO: 8586270 - DNA, 22 bp, Homo sapiens
ctgggccatgggccagcgaggc

SEQ ID NO: 8586271 - DNA, 22 bp, Homo sapiens
ctgggctgtaatgtggcactga

SEQ ID NO: 8586272 - DNA, 20 bp, Homo sapiens
ctgggctgggctacagggtc

SEQ ID NO: 8586273 - DNA, 22 bp, Homo sapiens
ctgggctgatttagtcacgttt

SEQ ID NO: 8586274 - DNA, 22 bp, Homo sapiens
atatcagacagaaagcattgac

SEQ ID NO: 8586275 - DNA, 22 bp, Homo sapiens
atatcaaaataaacagcatgca

SEQ ID NO: 8586276 - DNA, 22 bp, Homo sapiens
agttttattccaatgtgcagca

SEQ ID NO: 8586277 - DNA, 22 bp, Homo sapiens
agtttcttgaagactgatgttt

SEQ ID NO: 8586278 - DNA, 22 bp, Homo sapiens
agtttctgttaccatatttgac

SEQ ID NO: 8586279 - DNA, 22 bp, Homo sapiens
agtttctgcaaatcatttttat

SEQ ID NO: 8586280 - DNA, 23 bp, Homo sapiens
agtttcacattttacatgtggct

SEQ ID NO: 8586281 - DNA, 22 bp, Homo sapiens
agtgttatttattgtttcataa

SEQ ID NO: 8586282 - DNA, 21 bp, Homo sapiens
agtttacaactgtccagcccc

SEQ ID NO: 8586283 - DNA, 22 bp, Homo sapiens
agtttatgttgtttataagcca

SEQ ID NO: 8586284 - DNA, 22 bp, Homo sapiens
agtttcacacaacatttgcatg

SEQ ID NO: 8586285 - DNA, 22 bp, Homo sapiens
agtttcacagtctgtcattgtt

SEQ ID NO: 8586286 - DNA, 18 bp, Homo sapiens
ctgccccttctctgagat

SEQ ID NO: 8586287 - DNA, 22 bp, Homo sapiens
agttttctcacatcaaaaatga

SEQ ID NO: 8586288 - DNA, 22 bp, Homo sapiens
atagaattctttgaaatttatg

SEQ ID NO: 8586289 - DNA, 22 bp, Homo sapiens
atagaaaacagatgtccttaaa

SEQ ID NO: 8586290 - DNA, 22 bp, Homo sapiens
atagaatatgacttttagatcc

SEQ ID NO: 8586291 - DNA, 22 bp, Homo sapiens
ctggccaggcttgggacagaca

SEQ ID NO: 8586292 - DNA, 22 bp, Homo sapiens
ctggccagaggttcctctgccc

SEQ ID NO: 8586293 - DNA, 22 bp, Homo sapiens
ctggccaggctctcacgtggtc

SEQ ID NO: 8586294 - DNA, 22 bp, Homo sapiens
ctggccagtgactgctcacccg

SEQ ID NO: 8586295 - DNA, 22 bp, Homo sapiens
ctggccagtgactgctcacccg

SEQ ID NO: 8586296 - DNA, 22 bp, Homo sapiens
ctggccagtgcctgtgggcccc

SEQ ID NO: 8586297 - DNA, 22 bp, Homo sapiens
ctggccaggcttgggacagaca

SEQ ID NO: 8586298 - DNA, 22 bp, Homo sapiens
ctggccaggttttgaacagttg

SEQ ID NO: 8586299 - DNA, 22 bp, Homo sapiens
ctggccagggtgcgatcgtggt

SEQ ID NO: 8586300 - DNA, 22 bp, Homo sapiens
ataatgtacaactgcttttaat

SEQ ID NO: 8586301 - DNA, 22 bp, Homo sapiens
ataatttaattttcacagtggt

SEQ ID NO: 8586302 - DNA, 20 bp, Homo sapiens
atacacattcatagaaaaat

SEQ ID NO: 8586303 - DNA, 20 bp, Homo sapiens
ataatttaccctgcaccact

SEQ ID NO: 8586304 - DNA, 22 bp, Homo sapiens
atacatctcatgtaagagataa

SEQ ID NO: 8586305 - DNA, 22 bp, Homo sapiens
atacatcttccttttaaaatgc

SEQ ID NO: 8586306 - DNA, 22 bp, Homo sapiens
atacatcttgtcagattcatgt

SEQ ID NO: 8586307 - DNA, 21 bp, Homo sapiens
ctggaagaagcagcaggattc

SEQ ID NO: 8586308 - DNA, 22 bp, Homo sapiens
accctcagtaatcgtgcagttt

SEQ ID NO: 8586309 - DNA, 22 bp, Homo sapiens
acccaggagacaggttgcagtg

SEQ ID NO: 8586310 - DNA, 22 bp, Homo sapiens
acccaggacttggcaacctcat

SEQ ID NO: 8586311 - DNA, 22 bp, Homo sapiens
acccaggacatgggcacccgtg

SEQ ID NO: 8586312 - DNA, 22 bp, Homo sapiens
acccaggactctcttccagtag

SEQ ID NO: 8586313 - DNA, 22 bp, Homo sapiens
acccaggactctcttccagtag

SEQ ID NO: 8586314 - DNA, 22 bp, Homo sapiens
acccaggagacggaggtgcagt

SEQ ID NO: 8586315 - DNA, 22 bp, Homo sapiens
acccaggagagagctataaaat

SEQ ID NO: 8586316 - DNA, 22 bp, Homo sapiens
acccaggagacggaggtgcagt

SEQ ID NO: 8586317 - DNA, 22 bp, Homo sapiens
acccaggagacaggttgcagtg

SEQ ID NO: 8586318 - DNA, 22 bp, Homo sapiens
acccaggacacagagatgaccc

SEQ ID NO: 8586319 - DNA, 22 bp, Homo sapiens
acccaggacaaaataaccaggt

SEQ ID NO: 8586320 - DNA, 22 bp, Homo sapiens
acccaggacaaaataaccaggt

SEQ ID NO: 8586321 - DNA, 22 bp, Homo sapiens
acccaggacatgggcacccgtg

SEQ ID NO: 8586322 - DNA, 22 bp, Homo sapiens
acccaggacacagagatgaccc

SEQ ID NO: 8586323 - DNA, 22 bp, Homo sapiens
acccaggaaaacatggtgcaga

SEQ ID NO: 8586324 - DNA, 22 bp, Homo sapiens
acccaggaaaacatggtgcaga

SEQ ID NO: 8586325 - DNA, 22 bp, Homo sapiens
accaggctggagtgcagtggcg

SEQ ID NO: 8586326 - DNA, 22 bp, Homo sapiens
accaggctctgccagtgtttac

SEQ ID NO: 8586327 - DNA, 22 bp, Homo sapiens
accaggctccccttggatcctg

SEQ ID NO: 8586328 - DNA, 22 bp, Homo sapiens
acccagccacagcattgaggga

SEQ ID NO: 8586329 - DNA, 22 bp, Homo sapiens
acccagcatgacacctgcacat

SEQ ID NO: 8586330 - DNA, 22 bp, Homo sapiens
acccagccatgttcagttctct

SEQ ID NO: 8586331 - DNA, 22 bp, Homo sapiens
acccagcctacaaagctcacct

SEQ ID NO: 8586332 - DNA, 22 bp, Homo sapiens
acccagcccagaatctggggcc

SEQ ID NO: 8586333 - DNA, 19 bp, Homo sapiens
acccagcccaggagtggca

SEQ ID NO: 8586334 - DNA, 22 bp, Homo sapiens
agggagacacatgaggaagtca

SEQ ID NO: 8586335 - DNA, 22 bp, Homo sapiens
agggagacaaaagcagctgcca

SEQ ID NO: 8586336 - DNA, 22 bp, Homo sapiens
accagcagttatgaggccagga

SEQ ID NO: 8586337 - DNA, 22 bp, Homo sapiens
accagagctggcagagtatcaa

SEQ ID NO: 8586338 - DNA, 22 bp, Homo sapiens
accagagctcttcagcacagga

SEQ ID NO: 8586339 - DNA, 22 bp, Homo sapiens
accagcagctgccagagtggag

SEQ ID NO: 8586340 - DNA, 16 bp, Homo sapiens
agggagagaggaacat

SEQ ID NO: 8586341 - DNA, 17 bp, Homo sapiens
accagcctctcctgggg

SEQ ID NO: 8586342 - DNA, 22 bp, Homo sapiens
accagcctggccaacatggcaa

SEQ ID NO: 8586343 - DNA, 22 bp, Homo sapiens
accagcctcctagctgctcctg

SEQ ID NO: 8586344 - DNA, 22 bp, Homo sapiens
accagcctgtctgagtcgtggg

SEQ ID NO: 8586345 - DNA, 22 bp, Homo sapiens
accagcctggccaacatggtga

SEQ ID NO: 8586346 - DNA, 22 bp, Homo sapiens
agggcagcaatgcagctgctgc

SEQ ID NO: 8586347 - DNA, 21 bp, Homo sapiens
agggcagattagctgtaagag

SEQ ID NO: 8586348 - DNA, 22 bp, Homo sapiens
agggcagcacagctgtgctcct

SEQ ID NO: 8586349 - DNA, 22 bp, Homo sapiens
agggcagcagcccatggctctg

SEQ ID NO: 8586350 - DNA, 22 bp, Homo sapiens
acatgtgtaagatgtgatatat

SEQ ID NO: 8586351 - DNA, 22 bp, Homo sapiens
acatgtgtaaggtctctcagtc

SEQ ID NO: 8586352 - DNA, 22 bp, Homo sapiens
aggcctcttgtcttcctcacat

SEQ ID NO: 8586353 - DNA, 22 bp, Homo sapiens
aggcctctgggtctcctctgac

SEQ ID NO: 8586354 - DNA, 22 bp, Homo sapiens
aggctgagaaagtgggaagatg

SEQ ID NO: 8586355 - DNA, 22 bp, Homo sapiens
aggcctgcccgtgggacctgtg

SEQ ID NO: 8586356 - DNA, 22 bp, Homo sapiens
aggctgaggagggatgttgctt

SEQ ID NO: 8586357 - DNA, 22 bp, Homo sapiens
acatttctttgctagacagcag

SEQ ID NO: 8586358 - DNA, 22 bp, Homo sapiens
aggctgagctggtagtgagtac

SEQ ID NO: 8586359 - DNA, 22 bp, Homo sapiens
acatttgacatttagtatcagc

SEQ ID NO: 8586360 - DNA, 22 bp, Homo sapiens
acatttggtaacacttgagcat

SEQ ID NO: 8586361 - DNA, 22 bp, Homo sapiens
acatttgggaccctctcttcac

SEQ ID NO: 8586362 - DNA, 20 bp, Homo sapiens
acatatcatggtagagtcct

SEQ ID NO: 8586363 - DNA, 21 bp, Homo sapiens
aggcagctcaggcccagagag

SEQ ID NO: 8586364 - DNA, 21 bp, Homo sapiens
aggcagctggaaggcctggct

SEQ ID NO: 8586365 - DNA, 22 bp, Homo sapiens
aggcagctggaaaactccaggc

SEQ ID NO: 8586366 - DNA, 17 bp, Homo sapiens
aggcagctcagaacatc

SEQ ID NO: 8586367 - DNA, 22 bp, Homo sapiens
aggcagctagagagtgaaactg

SEQ ID NO: 8586368 - DNA, 22 bp, Homo sapiens
aggatgccgcatttttattcaa

SEQ ID NO: 8586369 - DNA, 21 bp, Homo sapiens
aggatgccgcaggcggagaag

SEQ ID NO: 8586370 - DNA, 22 bp, Homo sapiens
aggatgccccgtgtcttcctga

SEQ ID NO: 8586371 - DNA, 22 bp, Homo sapiens
aggatgccttcattgcatggcc

SEQ ID NO: 8586372 - DNA, 22 bp, Homo sapiens
aggagcaaatgatgagacagca

SEQ ID NO: 8586373 - DNA, 22 bp, Homo sapiens
aggagcactgagccagcatggg

SEQ ID NO: 8586374 - DNA, 22 bp, Homo sapiens
aggagcactaattcctgcagag

SEQ ID NO: 8586375 - DNA, 22 bp, Homo sapiens
aggagcaccattgtgctggtgt

SEQ ID NO: 8586376 - DNA, 22 bp, Homo sapiens
acaggtgtacaatgcatgacag

SEQ ID NO: 8586377 - DNA, 22 bp, Homo sapiens
acaggtgttgactcacaggccc

SEQ ID NO: 8586378 - DNA, 22 bp, Homo sapiens
acaggtgttttggaggatgatt

SEQ ID NO: 8586379 - DNA, 22 bp, Homo sapiens
acagtatttgcgatactgatga

SEQ ID NO: 8586380 - DNA, 21 bp, Homo sapiens
acagtcacaaaaccaaggcag

SEQ ID NO: 8586381 - DNA, 22 bp, Homo sapiens
acagtgggacagtgacggggga

SEQ ID NO: 8586382 - DNA, 22 bp, Homo sapiens
acagtggggtcttaatagaaca

SEQ ID NO: 8586383 - DNA, 22 bp, Homo sapiens
acagtgggatgaggctggcccc

SEQ ID NO: 8586384 - DNA, 22 bp, Homo sapiens
acagctgggtgctgctcagagc

SEQ ID NO: 8586385 - DNA, 22 bp, Homo sapiens
acagctgggtgtcccacttctg

SEQ ID NO: 8586386 - DNA, 22 bp, Homo sapiens
acagctggtgaatgttctctgt

SEQ ID NO: 8586387 - DNA, 21 bp, Homo sapiens
acagctggtgcagggcgggga

SEQ ID NO: 8586388 - DNA, 21 bp, Homo sapiens
acagctggtgcagggcgggga

SEQ ID NO: 8586389 - DNA, 22 bp, Homo sapiens
acagctggcaggggggcatgaa

SEQ ID NO: 8586390 - DNA, 21 bp, Homo sapiens
acagctggccgcgcgggtcgg

SEQ ID NO: 8586391 - DNA, 22 bp, Homo sapiens
acagctgggaactcacacagca

SEQ ID NO: 8586392 - DNA, 22 bp, Homo sapiens
acagctggccgaggctcaggga

SEQ ID NO: 8586393 - DNA, 22 bp, Homo sapiens
acagctgggaatcagctgggga

SEQ ID NO: 8586394 - DNA, 22 bp, Homo sapiens
acagctgggaatcagctgggga

SEQ ID NO: 8586395 - DNA, 22 bp, Homo sapiens
agctggtggagaagcagacctc

SEQ ID NO: 8586396 - DNA, 22 bp, Homo sapiens
agctggtggggaagctgcaggt

SEQ ID NO: 8586397 - DNA, 22 bp, Homo sapiens
agctggtggattatgctgtaca

SEQ ID NO: 8586398 - DNA, 18 bp, Homo sapiens
agctggtggggagacagc

SEQ ID NO: 8586399 - DNA, 22 bp, Homo sapiens
agctggtgtgctctggaatcct

SEQ ID NO: 8586400 - DNA, 21 bp, Homo sapiens
agctggtgtcagagctctggg

SEQ ID NO: 8586401 - DNA, 22 bp, Homo sapiens
agctggtgtcctcctggagctg

SEQ ID NO: 8586402 - DNA, 22 bp, Homo sapiens
agctggtgtgccactgttgggg

SEQ ID NO: 8586403 - DNA, 22 bp, Homo sapiens
acaggagaattatctggaacaa

SEQ ID NO: 8586404 - DNA, 22 bp, Homo sapiens
acaggagggacaccttcctgct

SEQ ID NO: 8586405 - DNA, 23 bp, Homo sapiens
acaggaggggacaggtggccgtg

SEQ ID NO: 8586406 - DNA, 22 bp, Homo sapiens
acaggaggggcatgaaagacgg

SEQ ID NO: 8586407 - DNA, 22 bp, Homo sapiens
agctggattccagtgcagtcac

SEQ ID NO: 8586408 - DNA, 19 bp, Homo sapiens
acaggggctagcggaagca

SEQ ID NO: 8586409 - DNA, 22 bp, Homo sapiens
aggacacacaaagagtgagaac

SEQ ID NO: 8586410 - DNA, 22 bp, Homo sapiens
aggacacactgcaagagcctgg

SEQ ID NO: 8586411 - DNA, 19 bp, Homo sapiens
acaggggcctttccagggt

SEQ ID NO: 8586412 - DNA, 22 bp, Homo sapiens
acaggggcaagggctcacggcc

SEQ ID NO: 8586413 - DNA, 22 bp, Homo sapiens
acaggggcaagggctcacggcc

SEQ ID NO: 8586414 - DNA, 22 bp, Homo sapiens
acagggcttgtgacaactttaa

SEQ ID NO: 8586415 - DNA, 22 bp, Homo sapiens
acagggcttttaatcagtagtt

SEQ ID NO: 8586416 - DNA, 19 bp, Homo sapiens
acagggcttggcctgacat

SEQ ID NO: 8586417 - DNA, 22 bp, Homo sapiens
acagggctatattcctcagagt

SEQ ID NO: 8586418 - DNA, 22 bp, Homo sapiens
aggaagagcatctttgggtctg

SEQ ID NO: 8586419 - DNA, 18 bp, Homo sapiens
aggaagaccatcagatat

SEQ ID NO: 8586420 - DNA, 22 bp, Homo sapiens
aggaagacaatctgtgtgctgt

SEQ ID NO: 8586421 - DNA, 22 bp, Homo sapiens
acaggcagattaagggtaggca

SEQ ID NO: 8586422 - DNA, 22 bp, Homo sapiens
acaggcaggcgggacagcccga

SEQ ID NO: 8586423 - DNA, 22 bp, Homo sapiens
acaggcagcgtcattgctgctc

SEQ ID NO: 8586424 - DNA, 22 bp, Homo sapiens
acaggcagccctctccctggtt

SEQ ID NO: 8586425 - DNA, 22 bp, Homo sapiens
acaggcagggacctcttgagtt

SEQ ID NO: 8586426 - DNA, 22 bp, Homo sapiens
acaggcaggcttcggccagagc

SEQ ID NO: 8586427 - DNA, 22 bp, Homo sapiens
acaggctgttggggtccagggt

SEQ ID NO: 8586428 - DNA, 22 bp, Homo sapiens
acaggcagggaccttggctaag

SEQ ID NO: 8586429 - DNA, 18 bp, Homo sapiens
atcctgggagcagacagc

SEQ ID NO: 8586430 - DNA, 22 bp, Homo sapiens
atctaagagagagagcatgtct

SEQ ID NO: 8586431 - DNA, 22 bp, Homo sapiens
agaacagcagtagtatacagta

SEQ ID NO: 8586432 - DNA, 22 bp, Homo sapiens
agaaagggtcactgaaagagga

SEQ ID NO: 8586433 - DNA, 22 bp, Homo sapiens
agaaagttatcacaaaattgag

SEQ ID NO: 8586434 - DNA, 22 bp, Homo sapiens
actttcacatgtgtgcagacag

SEQ ID NO: 8586435 - DNA, 22 bp, Homo sapiens
actttcatttgtaataaacttc

SEQ ID NO: 8586436 - DNA, 22 bp, Homo sapiens
atatggaatggtaatctacaat

SEQ ID NO: 8586437 - DNA, 22 bp, Homo sapiens
agaaaagttttctgagactgac

SEQ ID NO: 8586438 - DNA, 22 bp, Homo sapiens
agaaaagtgctctagtgagagc

SEQ ID NO: 8586439 - DNA, 22 bp, Homo sapiens
atacatctatgcctttctgaca

SEQ ID NO: 8586440 - DNA, 22 bp, Homo sapiens
atacatctagagtcataaaaac

SEQ ID NO: 8586441 - DNA, 22 bp, Homo sapiens
atacatgttgtaccatatgttt

SEQ ID NO: 8586442 - DNA, 22 bp, Homo sapiens
atacatgttgagaaaatatctg

SEQ ID NO: 8586443 - DNA, 22 bp, Homo sapiens
atacattagctcatatgattaa

SEQ ID NO: 8586444 - DNA, 23 bp, Homo sapiens
acttaaatggttctttatctcag

SEQ ID NO: 8586445 - DNA, 21 bp, Homo sapiens
acttaaattccttgatattta

SEQ ID NO: 8586446 - DNA, 22 bp, Homo sapiens
actgtgccacaattcaccaggg

SEQ ID NO: 8586447 - DNA, 22 bp, Homo sapiens
actgtcactgacagaatcaaca

SEQ ID NO: 8586448 - DNA, 21 bp, Homo sapiens
actgggagaacgagcctttcc

SEQ ID NO: 8586449 - DNA, 22 bp, Homo sapiens
actgggagaaactgacacctta

SEQ ID NO: 8586450 - DNA, 22 bp, Homo sapiens
actgggagagtttgcttataat

SEQ ID NO: 8586451 - DNA, 22 bp, Homo sapiens
actgggagagcgaccagattct

SEQ ID NO: 8586452 - DNA, 20 bp, Homo sapiens
actgggagctaacggagatt

SEQ ID NO: 8586453 - DNA, 22 bp, Homo sapiens
acgcccagactcccatactttg

SEQ ID NO: 8586454 - DNA, 22 bp, Homo sapiens
acgctttggctgtgtctcttct

SEQ ID NO: 8586455 - DNA, 23 bp, Homo sapiens
acgctgggtggccagaacgacag

SEQ ID NO: 8586456 - DNA, 22 bp, Homo sapiens
agtaaacacgtggggtttcttt

SEQ ID NO: 8586457 - DNA, 22 bp, Homo sapiens
agtaaaattgtattggaaaaca

SEQ ID NO: 8586458 - DNA, 22 bp, Homo sapiens
agtaaacagaaagcaagatgat

SEQ ID NO: 8586459 - DNA, 22 bp, Homo sapiens
acctgaggcctccccagcagac

SEQ ID NO: 8586460 - DNA, 22 bp, Homo sapiens
acctctgggaaaagtatggaaa

SEQ ID NO: 8586461 - DNA, 22 bp, Homo sapiens
aggtctctgagtactgctggac

SEQ ID NO: 8586462 - DNA, 19 bp, Homo sapiens
aggtggccatgtccagcct

SEQ ID NO: 8586463 - DNA, 22 bp, Homo sapiens
aggtggctatgaggatgcagtc

SEQ ID NO: 8586464 - DNA, 22 bp, Homo sapiens
agtggcagagctgtgtcttgaa

SEQ ID NO: 8586465 - DNA, 22 bp, Homo sapiens
agtggcagggctggctgctgca

SEQ ID NO: 8586466 - DNA, 22 bp, Homo sapiens
agtggcaggtgtttcgtggtgc

SEQ ID NO: 8586467 - DNA, 22 bp, Homo sapiens
agtggcagtggaaagcacacgg

SEQ ID NO: 8586468 - DNA, 21 bp, Homo sapiens
agtggggtctctgtggaggcc

SEQ ID NO: 8586469 - DNA, 19 bp, Homo sapiens
agtgtagctaggatgtgct

SEQ ID NO: 8586470 - DNA, 22 bp, Homo sapiens
agtgtagcctagtggttaaggg

SEQ ID NO: 8586471 - DNA, 22 bp, Homo sapiens
actgcagactctacagttataa

SEQ ID NO: 8586472 - DNA, 22 bp, Homo sapiens
agtgttgtaataaatatcatct

SEQ ID NO: 8586473 - DNA, 18 bp, Homo sapiens
actggctttagcatcaga

SEQ ID NO: 8586474 - DNA, 22 bp, Homo sapiens
actggctttggcttcagatgag

SEQ ID NO: 8586475 - DNA, 22 bp, Homo sapiens
actctgtgaactctatcagata

SEQ ID NO: 8586476 - DNA, 22 bp, Homo sapiens
agtgcaggttaaggaactggcc

SEQ ID NO: 8586477 - DNA, 22 bp, Homo sapiens
agtgcagggggaaagggtgtct

SEQ ID NO: 8586478 - DNA, 22 bp, Homo sapiens
agtgcagggggaaagggtgtct

SEQ ID NO: 8586479 - DNA, 20 bp, Homo sapiens
agtgcatggagggagagggc

SEQ ID NO: 8586480 - DNA, 19 bp, Homo sapiens
agtgcatgggcgaggtgca

SEQ ID NO: 8586481 - DNA, 22 bp, Homo sapiens
agtgcatgcgcttgggaggggt

SEQ ID NO: 8586482 - DNA, 22 bp, Homo sapiens
actcggcagcctgagagttcac

SEQ ID NO: 8586483 - DNA, 22 bp, Homo sapiens
cagcagttatgagtagaatagt

SEQ ID NO: 8586484 - DNA, 22 bp, Homo sapiens
cagcagggtatacagggaattt

SEQ ID NO: 8586485 - DNA, 22 bp, Homo sapiens
cagcagggggcagcgcagatca

SEQ ID NO: 8586486 - DNA, 22 bp, Homo sapiens
cagcagggtaggttgtatcagt

SEQ ID NO: 8586487 - DNA, 22 bp, Homo sapiens
cagcaggggtgtcattgtagtt

SEQ ID NO: 8586488 - DNA, 22 bp, Homo sapiens
cagcaggggaactgtgggccag

SEQ ID NO: 8586489 - DNA, 22 bp, Homo sapiens
cagcagggtatacagggaattt

SEQ ID NO: 8586490 - DNA, 23 bp, Homo sapiens
cagccctgaaatcgaggtgacac

SEQ ID NO: 8586491 - DNA, 18 bp, Homo sapiens
agctcctgaactctgtgg

SEQ ID NO: 8586492 - DNA, 22 bp, Homo sapiens
cagcgtgggatttggaaaccag

SEQ ID NO: 8586493 - DNA, 22 bp, Homo sapiens
cagctcaggctctccatgctcc

SEQ ID NO: 8586494 - DNA, 22 bp, Homo sapiens
cagaggtccctatttctttgtt

SEQ ID NO: 8586495 - DNA, 22 bp, Homo sapiens
cagaggtctgacactgaatggt

SEQ ID NO: 8586496 - DNA, 22 bp, Homo sapiens
cagaggtctccatcaccctcct

SEQ ID NO: 8586497 - DNA, 19 bp, Homo sapiens
cagaggtgatatatgccca

SEQ ID NO: 8586498 - DNA, 22 bp, Homo sapiens
cagaggtgcatacaggtcatta

SEQ ID NO: 8586499 - DNA, 22 bp, Homo sapiens
cagcagctcactcaggtggctc

SEQ ID NO: 8586500 - DNA, 22 bp, Homo sapiens
cagcagctcactcaggtggctc

SEQ ID NO: 8586501 - DNA, 22 bp, Homo sapiens
cagcagctcagtctctcagtag

SEQ ID NO: 8586502 - DNA, 22 bp, Homo sapiens
cagcagctgactccaagagagc

SEQ ID NO: 8586503 - DNA, 22 bp, Homo sapiens
cagcagctccaaagaatagcca

SEQ ID NO: 8586504 - DNA, 22 bp, Homo sapiens
cagcagctccaaagaatagcca

SEQ ID NO: 8586505 - DNA, 22 bp, Homo sapiens
agcctggcactgaggcagggcg

SEQ ID NO: 8586506 - DNA, 22 bp, Homo sapiens
cagcaggatatggtggagagag

SEQ ID NO: 8586507 - DNA, 22 bp, Homo sapiens
cagcaggatatggtggagagag

SEQ ID NO: 8586508 - DNA, 22 bp, Homo sapiens
cagcagggcccccgggtgcgcc

SEQ ID NO: 8586509 - DNA, 22 bp, Homo sapiens
cagcagggctgtgctaccccat

SEQ ID NO: 8586510 - DNA, 22 bp, Homo sapiens
cagcagctgaggcgctggcgtg

SEQ ID NO: 8586511 - DNA, 22 bp, Homo sapiens
cagagaaagacttgcccttagt

SEQ ID NO: 8586512 - DNA, 22 bp, Homo sapiens
agccatcatttctgtcactggc

SEQ ID NO: 8586513 - DNA, 22 bp, Homo sapiens
cagagaaagaagcccattcatt

SEQ ID NO: 8586514 - DNA, 22 bp, Homo sapiens
cagagaaactcagatagctgat

SEQ ID NO: 8586515 - DNA, 22 bp, Homo sapiens
cagagaaaaaatcctgctctca

SEQ ID NO: 8586516 - DNA, 22 bp, Homo sapiens
cagacttttgacattaatacag

SEQ ID NO: 8586517 - DNA, 22 bp, Homo sapiens
cagacatggcgccaagtgctag

SEQ ID NO: 8586518 - DNA, 22 bp, Homo sapiens
agcccagagggtagcagaagaa

SEQ ID NO: 8586519 - DNA, 22 bp, Homo sapiens
agcccagcagtaagattagaga

SEQ ID NO: 8586520 - DNA, 22 bp, Homo sapiens
cagaggcatataattgctgggg

SEQ ID NO: 8586521 - DNA, 18 bp, Homo sapiens
cagaaatcacaccagcac

SEQ ID NO: 8586522 - DNA, 20 bp, Homo sapiens
agcatagagcaccagaaggc

SEQ ID NO: 8586523 - DNA, 22 bp, Homo sapiens
agcatagcttagctgtggaggc

SEQ ID NO: 8586524 - DNA, 22 bp, Homo sapiens
agcatataaatggacatatttg

SEQ ID NO: 8586525 - DNA, 22 bp, Homo sapiens
agcatatacaaactcatataca

SEQ ID NO: 8586526 - DNA, 22 bp, Homo sapiens
agccacagtctgtagccagctt

SEQ ID NO: 8586527 - DNA, 22 bp, Homo sapiens
agcatatagctatctttgattg

SEQ ID NO: 8586528 - DNA, 22 bp, Homo sapiens
agccacaggaaacagagacagc

SEQ ID NO: 8586529 - DNA, 22 bp, Homo sapiens
cagaatgagtagcatcttcacc

SEQ ID NO: 8586530 - DNA, 22 bp, Homo sapiens
agccagagagtgttggagatgt

SEQ ID NO: 8586531 - DNA, 22 bp, Homo sapiens
cagacagggttttggtctttgg

SEQ ID NO: 8586532 - DNA, 22 bp, Homo sapiens
cagacagggtgggtttctgggc

SEQ ID NO: 8586533 - DNA, 22 bp, Homo sapiens
cagacaggaagttcagaagaaa

SEQ ID NO: 8586534 - DNA, 22 bp, Homo sapiens
cagacatgagatacagctgcta

SEQ ID NO: 8586535 - DNA, 22 bp, Homo sapiens
cagacatgatgtaagcagaggc

SEQ ID NO: 8586536 - DNA, 22 bp, Homo sapiens
cagacatccaggtacgagcttt

SEQ ID NO: 8586537 - DNA, 22 bp, Homo sapiens
cagacaggttgcaaaacttcaa

SEQ ID NO: 8586538 - DNA, 22 bp, Homo sapiens
cagacaggtagggacagaacat

SEQ ID NO: 8586539 - DNA, 22 bp, Homo sapiens
cagacaggtagggacagaacat

SEQ ID NO: 8586540 - DNA, 23 bp, Homo sapiens
agcaccaggaacagtgtggtcct

SEQ ID NO: 8586541 - DNA, 22 bp, Homo sapiens
caagacaatgggtaagtgtaac

SEQ ID NO: 8586542 - DNA, 22 bp, Homo sapiens
agcaccaggctgttggaagccc

SEQ ID NO: 8586543 - DNA, 22 bp, Homo sapiens
caagagacttatgtggaaacct

SEQ ID NO: 8586544 - DNA, 22 bp, Homo sapiens
caacacttcttatacttactga

SEQ ID NO: 8586545 - DNA, 22 bp, Homo sapiens
agcacattcccacctgtacttc

SEQ ID NO: 8586546 - DNA, 22 bp, Homo sapiens
caacagagagaccagaaacagg

SEQ ID NO: 8586547 - DNA, 22 bp, Homo sapiens
agcaaagaagacacaggcttca

SEQ ID NO: 8586548 - DNA, 22 bp, Homo sapiens
agcacagcttagcacctggcac

SEQ ID NO: 8586549 - DNA, 21 bp, Homo sapiens
agcacagctttaagccatgtg

SEQ ID NO: 8586550 - DNA, 22 bp, Homo sapiens
caagagcatccctgcatccagc

SEQ ID NO: 8586551 - DNA, 22 bp, Homo sapiens
agcagcaggaggccattgtctt

SEQ ID NO: 8586552 - DNA, 20 bp, Homo sapiens
agcagcagatgttggaggtg

SEQ ID NO: 8586553 - DNA, 22 bp, Homo sapiens
agcagcaggctgtgtggactga

SEQ ID NO: 8586554 - DNA, 23 bp, Homo sapiens
agcagcaggaggtattgataagg

SEQ ID NO: 8586555 - DNA, 22 bp, Homo sapiens
agcagcaggattttcgttggga

SEQ ID NO: 8586556 - DNA, 22 bp, Homo sapiens
agcagcaggctagggaactgct

SEQ ID NO: 8586557 - DNA, 21 bp, Homo sapiens
agcagcagggaagcctcatcc

SEQ ID NO: 8586558 - DNA, 20 bp, Homo sapiens
cacaagagaatacacactgg

SEQ ID NO: 8586559 - DNA, 20 bp, Homo sapiens
cacaagagaatacacactgg

SEQ ID NO: 8586560 - DNA, 22 bp, Homo sapiens
agcagctcctctaggaacggat

SEQ ID NO: 8586561 - DNA, 22 bp, Homo sapiens
cacccaggctggagtgcagtgg

SEQ ID NO: 8586562 - DNA, 22 bp, Homo sapiens
cacctcaggcagcaaagtctca

SEQ ID NO: 8586563 - DNA, 22 bp, Homo sapiens
cactgctagtctgaagtactgg

SEQ ID NO: 8586564 - DNA, 22 bp, Homo sapiens
agcatagaataagctgaagtca

SEQ ID NO: 8586565 - DNA, 22 bp, Homo sapiens
cacccaggctggagtgcagtga

SEQ ID NO: 8586566 - DNA, 22 bp, Homo sapiens
cacccaggctggagtgcagggg

SEQ ID NO: 8586567 - DNA, 22 bp, Homo sapiens
cacccaggctggagagcagtgg

SEQ ID NO: 8586568 - DNA, 20 bp, Homo sapiens
agcaggtaaggcacagcagt

SEQ ID NO: 8586569 - DNA, 22 bp, Homo sapiens
agcagggttctcagttggtgct

SEQ ID NO: 8586570 - DNA, 22 bp, Homo sapiens
agcagggtatgttagagctgta

SEQ ID NO: 8586571 - DNA, 22 bp, Homo sapiens
agcaggggtggaaggtagcttt

SEQ ID NO: 8586572 - DNA, 22 bp, Homo sapiens
agcagggggcatccttgccctt

SEQ ID NO: 8586573 - DNA, 22 bp, Homo sapiens
agcagggggagttagactagat

SEQ ID NO: 8586574 - DNA, 22 bp, Homo sapiens
agcagggggagttagactagat

SEQ ID NO: 8586575 - DNA, 22 bp, Homo sapiens
agcaggggtaacagaaggaaag

SEQ ID NO: 8586576 - DNA, 22 bp, Homo sapiens
agcagggggccacagtcacagc

SEQ ID NO: 8586577 - DNA, 22 bp, Homo sapiens
agcagggggccacagtcacagc

SEQ ID NO: 8586578 - DNA, 22 bp, Homo sapiens
agcagggctggggcacgagcca

SEQ ID NO: 8586579 - DNA, 22 bp, Homo sapiens
agcagggctgtgctccttccga

SEQ ID NO: 8586580 - DNA, 22 bp, Homo sapiens
agcaggggcagggttttgtgct

SEQ ID NO: 8586581 - DNA, 22 bp, Homo sapiens
agcaggcaggaaggcagcactg

SEQ ID NO: 8586582 - DNA, 22 bp, Homo sapiens
agcaggcaggaatggtggaaca

SEQ ID NO: 8586583 - DNA, 22 bp, Homo sapiens
agcaggcactatgccaggatct

SEQ ID NO: 8586584 - DNA, 22 bp, Homo sapiens
agcaggcactatgccaggatct

SEQ ID NO: 8586585 - DNA, 22 bp, Homo sapiens
agcaggcagcatgggaccctcc

SEQ ID NO: 8586586 - DNA, 22 bp, Homo sapiens
agcaggcacttcatagggttcc

SEQ ID NO: 8586587 - DNA, 22 bp, Homo sapiens
agcaggcagctgggggagttga

SEQ ID NO: 8586588 - DNA, 22 bp, Homo sapiens
agcaggcagcctaggaagtgaa

SEQ ID NO: 8586589 - DNA, 22 bp, Homo sapiens
cacagtttctataggtcagaat

SEQ ID NO: 8586590 - DNA, 22 bp, Homo sapiens
agcaggagtttgatgcttttat

SEQ ID NO: 8586591 - DNA, 22 bp, Homo sapiens
agcaggcaaggtccgtgcctcg

SEQ ID NO: 8586592 - DNA, 22 bp, Homo sapiens
agcaggcaagcgtgagttctct

SEQ ID NO: 8586593 - DNA, 17 bp, Homo sapiens
agcaggcacgtcagcac

SEQ ID NO: 8586594 - DNA, 22 bp, Homo sapiens
agcaggcacgctccctgcgcga

SEQ ID NO: 8586595 - DNA, 22 bp, Homo sapiens
agcaggcaccagggctcgtcct

SEQ ID NO: 8586596 - DNA, 22 bp, Homo sapiens
agcaggcacaagaaagggaggt

SEQ ID NO: 8586597 - DNA, 22 bp, Homo sapiens
agcaggagcatttccatgattc

SEQ ID NO: 8586598 - DNA, 22 bp, Homo sapiens
agcaggagtgtcccctggctgt

SEQ ID NO: 8586599 - DNA, 21 bp, Homo sapiens
agcagctgcagtttctatctg

SEQ ID NO: 8586600 - DNA, 22 bp, Homo sapiens
atttgttgctagcagcactgat

SEQ ID NO: 8586601 - DNA, 22 bp, Homo sapiens
caaaaggcaggggaaagagtgc

SEQ ID NO: 8586602 - DNA, 22 bp, Homo sapiens
caaaagtaattgcagtttttgc

SEQ ID NO: 8586603 - DNA, 22 bp, Homo sapiens
atttgtctttggacctgtgaga

SEQ ID NO: 8586604 - DNA, 22 bp, Homo sapiens
atttattgaagcttattacgtt

SEQ ID NO: 8586605 - DNA, 22 bp, Homo sapiens
atttattgagacttaacaaccc

SEQ ID NO: 8586606 - DNA, 17 bp, Homo sapiens
agagttttaagaaattt

SEQ ID NO: 8586607 - DNA, 22 bp, Homo sapiens
agaggtctgagcaatctcaagc

SEQ ID NO: 8586608 - DNA, 22 bp, Homo sapiens
agaggtcttttggtctgcagaa

SEQ ID NO: 8586609 - DNA, 22 bp, Homo sapiens
agaggtcttaagatctagactg

SEQ ID NO: 8586610 - DNA, 19 bp, Homo sapiens
attcattggccagggtggt

SEQ ID NO: 8586611 - DNA, 22 bp, Homo sapiens
agaggctcactcttggaaccca

SEQ ID NO: 8586612 - DNA, 22 bp, Homo sapiens
attcatgttttcttgcttcaag

SEQ ID NO: 8586613 - DNA, 22 bp, Homo sapiens
attccagatgttactgaaaggc

SEQ ID NO: 8586614 - DNA, 22 bp, Homo sapiens
attccagtgtgcatggtacaca

SEQ ID NO: 8586615 - DNA, 21 bp, Homo sapiens
agagggagagtggcccttcca

SEQ ID NO: 8586616 - DNA, 22 bp, Homo sapiens
attccagatgaattgcatagtt

SEQ ID NO: 8586617 - DNA, 22 bp, Homo sapiens
agaggctgtgcagagggagtgc

SEQ ID NO: 8586618 - DNA, 22 bp, Homo sapiens
agagctggtttactcaggaatt

SEQ ID NO: 8586619 - DNA, 22 bp, Homo sapiens
agaggcactgttcttagcgact

SEQ ID NO: 8586620 - DNA, 22 bp, Homo sapiens
attattcaacacttgagaaatt

SEQ ID NO: 8586621 - DNA, 22 bp, Homo sapiens
attattattgttgatgttaggg

SEQ ID NO: 8586622 - DNA, 23 bp, Homo sapiens
atgacaaacaggacatcttgtgc

SEQ ID NO: 8586623 - DNA, 22 bp, Homo sapiens
atgcaccccagaagctgcagtg

SEQ ID NO: 8586624 - DNA, 22 bp, Homo sapiens
agacagaccatggctattcaga

SEQ ID NO: 8586625 - DNA, 22 bp, Homo sapiens
agacagacattctagagccacc

SEQ ID NO: 8586626 - DNA, 22 bp, Homo sapiens
agacagacatgctagttttctt

SEQ ID NO: 8586627 - DNA, 22 bp, Homo sapiens
agacagacggctttatacacag

SEQ ID NO: 8586628 - DNA, 17 bp, Homo sapiens
agacagacctctgcatc

SEQ ID NO: 8586629 - DNA, 22 bp, Homo sapiens
agacagacgtagtgtgagagta

SEQ ID NO: 8586630 - DNA, 22 bp, Homo sapiens
agacagacgtagtgtgagagta

SEQ ID NO: 8586631 - DNA, 22 bp, Homo sapiens
agacagactggtttgaattggt

SEQ ID NO: 8586632 - DNA, 21 bp, Homo sapiens
agacagactgcctgacccacg

SEQ ID NO: 8586633 - DNA, 22 bp, Homo sapiens
agacagctgctcgcagagctat

SEQ ID NO: 8586634 - DNA, 22 bp, Homo sapiens
agacaggacacaagctgcataa

SEQ ID NO: 8586635 - DNA, 22 bp, Homo sapiens
agacagcatgatacatgatgct

SEQ ID NO: 8586636 - DNA, 22 bp, Homo sapiens
agacagctagggctgcagggac

SEQ ID NO: 8586637 - DNA, 22 bp, Homo sapiens
agacagctgcctccaccacagc

SEQ ID NO: 8586638 - DNA, 22 bp, Homo sapiens
agacagacttgaaaatgttctt

SEQ ID NO: 8586639 - DNA, 22 bp, Homo sapiens
agacagactgtgtttgaatcct

SEQ ID NO: 8586640 - DNA, 22 bp, Homo sapiens
atgaacaataaaatagatcaca

SEQ ID NO: 8586641 - DNA, 22 bp, Homo sapiens
agacaaagaaaccgtagaagca

SEQ ID NO: 8586642 - DNA, 22 bp, Homo sapiens
atgaacaatgactacatattga

SEQ ID NO: 8586643 - DNA, 19 bp, Homo sapiens
agagccagacagcatagga

SEQ ID NO: 8586644 - DNA, 22 bp, Homo sapiens
agagatgaatcttgagactctg

SEQ ID NO: 8586645 - DNA, 22 bp, Homo sapiens
agagatggagagcactggggct

SEQ ID NO: 8586646 - DNA, 22 bp, Homo sapiens
agagatggagagcactggggct

SEQ ID NO: 8586647 - DNA, 22 bp, Homo sapiens
agagatggccttaggtgggaat

SEQ ID NO: 8586648 - DNA, 22 bp, Homo sapiens
agagatggatgttattatgggt

SEQ ID NO: 8586649 - DNA, 22 bp, Homo sapiens
agagatggccttaggtgggaat

SEQ ID NO: 8586650 - DNA, 22 bp, Homo sapiens
agagcctgggaatttgcatgtt

SEQ ID NO: 8586651 - DNA, 22 bp, Homo sapiens
agagcctgcagtggagaccttg

SEQ ID NO: 8586652 - DNA, 22 bp, Homo sapiens
agagcctgggcagctcctctgg

SEQ ID NO: 8586653 - DNA, 22 bp, Homo sapiens
atgtcaaatcagttttatcaga

SEQ ID NO: 8586654 - DNA, 22 bp, Homo sapiens
atgtgggtgagtgagagataga

SEQ ID NO: 8586655 - DNA, 22 bp, Homo sapiens
atgtgggttgatggaggtgtca

SEQ ID NO: 8586656 - DNA, 22 bp, Homo sapiens
agagcctggggattggcaaggg

SEQ ID NO: 8586657 - DNA, 22 bp, Homo sapiens
agagcctggtctgagataggac

SEQ ID NO: 8586658 - DNA, 22 bp, Homo sapiens
agagcctgtcaattgtaaagag

SEQ ID NO: 8586659 - DNA, 22 bp, Homo sapiens
agagcctgtgattgtcatcacc

SEQ ID NO: 8586660 - DNA, 22 bp, Homo sapiens
agagcctgtgggagatgcagct

SEQ ID NO: 8586661 - DNA, 22 bp, Homo sapiens
agagcctgttcggaggcgcccc

SEQ ID NO: 8586662 - DNA, 22 bp, Homo sapiens
agaccagctgcctcccagggcc

SEQ ID NO: 8586663 - DNA, 22 bp, Homo sapiens
agaccagggtcccacagagtct

SEQ ID NO: 8586664 - DNA, 22 bp, Homo sapiens
atggccagccactcctgatggc

SEQ ID NO: 8586665 - DNA, 22 bp, Homo sapiens
atggccagcccttcccgcagct

SEQ ID NO: 8586666 - DNA, 22 bp, Homo sapiens
atggccagcccttcccgcagct

SEQ ID NO: 8586667 - DNA, 22 bp, Homo sapiens
atggccagcctggtacttggca

SEQ ID NO: 8586668 - DNA, 22 bp, Homo sapiens
atggccagctagcacttgcatt

SEQ ID NO: 8586669 - DNA, 22 bp, Homo sapiens
atggccagctagcacttgcatt

SEQ ID NO: 8586670 - DNA, 22 bp, Homo sapiens
atggccagctcagagcactcag

SEQ ID NO: 8586671 - DNA, 22 bp, Homo sapiens
atggccagcaagttcagaattt

SEQ ID NO: 8586672 - DNA, 22 bp, Homo sapiens
atggccagtcaagcctctggct

SEQ ID NO: 8586673 - DNA, 22 bp, Homo sapiens
atggccagggtggcactgtggt

SEQ ID NO: 8586674 - DNA, 22 bp, Homo sapiens
atggccagggtggcactgtggt

SEQ ID NO: 8586675 - DNA, 22 bp, Homo sapiens
atggccagggccaaaagagatg

SEQ ID NO: 8586676 - DNA, 22 bp, Homo sapiens
atggccaggcacctctggctga

SEQ ID NO: 8586677 - DNA, 22 bp, Homo sapiens
atggccagcttataggggctca

SEQ ID NO: 8586678 - DNA, 21 bp, Homo sapiens
agagaccagctgttactccca

SEQ ID NO: 8586679 - DNA, 22 bp, Homo sapiens
agagacagaggcaatatagctt

SEQ ID NO: 8586680 - DNA, 22 bp, Homo sapiens
atggcctttctcagtggtgctt

SEQ ID NO: 8586681 - DNA, 22 bp, Homo sapiens
atggctcagcccatggaagaaa

SEQ ID NO: 8586682 - DNA, 22 bp, Homo sapiens
agagactgatggagctcactct

SEQ ID NO: 8586683 - DNA, 22 bp, Homo sapiens
aatatatagaagtacccgttgt

SEQ ID NO: 8586684 - DNA, 22 bp, Homo sapiens
aatcaaaacctacagaggtaat

SEQ ID NO: 8586685 - DNA, 22 bp, Homo sapiens
agaaatactaggaatattcata

SEQ ID NO: 8586686 - DNA, 22 bp, Homo sapiens
aatacaatcaaattcactagca

SEQ ID NO: 8586687 - DNA, 22 bp, Homo sapiens
actgcctgtgtcccttcagtgc

SEQ ID NO: 8586688 - DNA, 22 bp, Homo sapiens
aagtcacacagttaacatgagg

SEQ ID NO: 8586689 - DNA, 22 bp, Homo sapiens
aagtcactggcaaaagctgcag

SEQ ID NO: 8586690 - DNA, 22 bp, Homo sapiens
aagtcacagctaaatagctaag

SEQ ID NO: 8586691 - DNA, 21 bp, Homo sapiens
actaagagatctctgtctcat

SEQ ID NO: 8586692 - DNA, 22 bp, Homo sapiens
aagttctaattttgcattcagg

SEQ ID NO: 8586693 - DNA, 20 bp, Homo sapiens
actccaggtggcatgaggac

SEQ ID NO: 8586694 - DNA, 21 bp, Homo sapiens
aaggcagaagcatggaatgag

SEQ ID NO: 8586695 - DNA, 22 bp, Homo sapiens
aaggcagaaagggatgtgagtg

SEQ ID NO: 8586696 - DNA, 22 bp, Homo sapiens
aaggcagcttcaccacagcatt

SEQ ID NO: 8586697 - DNA, 22 bp, Homo sapiens
aaggcaggtattgatgccacag

SEQ ID NO: 8586698 - DNA, 22 bp, Homo sapiens
aaggcagagatattcttgatct

SEQ ID NO: 8586699 - DNA, 22 bp, Homo sapiens
acagttctgtcctagacttcgt

SEQ ID NO: 8586700 - DNA, 22 bp, Homo sapiens
aaggcagcctttgtttgattga

SEQ ID NO: 8586701 - DNA, 22 bp, Homo sapiens
aaggaaagctgtggttctgaga

SEQ ID NO: 8586702 - DNA, 22 bp, Homo sapiens
acaggtgttgaatgatgtcaca

SEQ ID NO: 8586703 - DNA, 22 bp, Homo sapiens
acaggtgtgttcccggaaagcc

SEQ ID NO: 8586704 - DNA, 22 bp, Homo sapiens
acagggctcccagcaggtctgt

SEQ ID NO: 8586705 - DNA, 22 bp, Homo sapiens
acagggctcgtcgggccctcgg

SEQ ID NO: 8586706 - DNA, 22 bp, Homo sapiens
aagccaggtgtttaggccagcg

SEQ ID NO: 8586707 - DNA, 22 bp, Homo sapiens
aagccaggtgtgcccaggatcc

SEQ ID NO: 8586708 - DNA, 22 bp, Homo sapiens
acatgtgtggacatgaatctac

SEQ ID NO: 8586709 - DNA, 22 bp, Homo sapiens
acatgtgtggccgctgtagaca

SEQ ID NO: 8586710 - DNA, 22 bp, Homo sapiens
acatgtgtgacaacagaggtga

SEQ ID NO: 8586711 - DNA, 22 bp, Homo sapiens
acatgtgtctaagaatgaaaga

SEQ ID NO: 8586712 - DNA, 22 bp, Homo sapiens
acatgtgtatagcctgtataga

SEQ ID NO: 8586713 - DNA, 22 bp, Homo sapiens
acatgtgtgtatacgtatttat

SEQ ID NO: 8586714 - DNA, 22 bp, Homo sapiens
acatgtgtacttttaaggatgt

SEQ ID NO: 8586715 - DNA, 22 bp, Homo sapiens
acatgtgtacatatatatgtgc

SEQ ID NO: 8586716 - DNA, 22 bp, Homo sapiens
aagggcaggtgggcatttctgg

SEQ ID NO: 8586717 - DNA, 22 bp, Homo sapiens
aagggccaagctcttctcccat

SEQ ID NO: 8586718 - DNA, 22 bp, Homo sapiens
aagggccagggctctagagata

SEQ ID NO: 8586719 - DNA, 22 bp, Homo sapiens
aagggccagggcagggttgtga

SEQ ID NO: 8586720 - DNA, 22 bp, Homo sapiens
aagggccacatttgggtccctg

SEQ ID NO: 8586721 - DNA, 22 bp, Homo sapiens
aagggccacttactcctgctgt

SEQ ID NO: 8586722 - DNA, 22 bp, Homo sapiens
aagggccacatgccatttaaaa

SEQ ID NO: 8586723 - DNA, 22 bp, Homo sapiens
aagggccattgctgagagcagt

SEQ ID NO: 8586724 - DNA, 22 bp, Homo sapiens
aagggccatcttggactcccca

SEQ ID NO: 8586725 - DNA, 22 bp, Homo sapiens
aagggccatgcctctactttct

SEQ ID NO: 8586726 - DNA, 22 bp, Homo sapiens
aagggccatcccagaacagaaa

SEQ ID NO: 8586727 - DNA, 22 bp, Homo sapiens
aagggccataacttgcagtgtt

SEQ ID NO: 8586728 - DNA, 22 bp, Homo sapiens
aagggccagtagaattttagtg

SEQ ID NO: 8586729 - DNA, 22 bp, Homo sapiens
aagggcaggaaaagatggatgt

SEQ ID NO: 8586730 - DNA, 22 bp, Homo sapiens
aaggctttgattccattgccct

SEQ ID NO: 8586731 - DNA, 22 bp, Homo sapiens
aaggtgggtggatcacgaggtc

SEQ ID NO: 8586732 - DNA, 22 bp, Homo sapiens
aaggtggtaggctatatcagta

SEQ ID NO: 8586733 - DNA, 22 bp, Homo sapiens
aaggtggtaatagtgcaggatt

SEQ ID NO: 8586734 - DNA, 22 bp, Homo sapiens
aaggtggcgctggagctggtcc

SEQ ID NO: 8586735 - DNA, 22 bp, Homo sapiens
aagtcacaagcatatatgcatt

SEQ ID NO: 8586736 - DNA, 22 bp, Homo sapiens
agcccagctgcctgcctgctgt

SEQ ID NO: 8586737 - DNA, 22 bp, Homo sapiens
agcccagctgctatgtacctgg

SEQ ID NO: 8586738 - DNA, 22 bp, Homo sapiens
agccacagggggtgagggacaa

SEQ ID NO: 8586739 - DNA, 22 bp, Homo sapiens
acagagcataatgtctagcaca

SEQ ID NO: 8586740 - DNA, 22 bp, Homo sapiens
agcccccaggagtctccacgcc

SEQ ID NO: 8586741 - DNA, 22 bp, Homo sapiens
acagatttaggactgtagcgat

SEQ ID NO: 8586742 - DNA, 22 bp, Homo sapiens
agcctgcaggatgggcagcacc

SEQ ID NO: 8586743 - DNA, 21 bp, Homo sapiens
agcctgcaatgtaggtaccgg

SEQ ID NO: 8586744 - DNA, 22 bp, Homo sapiens
agctagggctttcgtagacagt

SEQ ID NO: 8586745 - DNA, 22 bp, Homo sapiens
agctagggcaaatatgagatac

SEQ ID NO: 8586746 - DNA, 22 bp, Homo sapiens
agctctagggaagaaaggcaca

SEQ ID NO: 8586747 - DNA, 22 bp, Homo sapiens
agctccttgaaggcagtagctg

SEQ ID NO: 8586748 - DNA, 22 bp, Homo sapiens
acagcaggaattaacatataag

SEQ ID NO: 8586749 - DNA, 22 bp, Homo sapiens
acagcaggcacacaaggataga

SEQ ID NO: 8586750 - DNA, 22 bp, Homo sapiens
acagcaggatttggcgatgttg

SEQ ID NO: 8586751 - DNA, 22 bp, Homo sapiens
acagcaggcatgaagaaatgtt

SEQ ID NO: 8586752 - DNA, 22 bp, Homo sapiens
agcagtggtgtgaggagggctc

SEQ ID NO: 8586753 - DNA, 22 bp, Homo sapiens
acagaaagataggcacaaggtc

SEQ ID NO: 8586754 - DNA, 22 bp, Homo sapiens
agcagtgggtgacagagctgag

SEQ ID NO: 8586755 - DNA, 22 bp, Homo sapiens
agcagtggtccccaacctttct

SEQ ID NO: 8586756 - DNA, 23 bp, Homo sapiens
agcaggaaaccgagggtgatgtt

SEQ ID NO: 8586757 - DNA, 18 bp, Homo sapiens
agcagctttgacaggaaa

SEQ ID NO: 8586758 - DNA, 22 bp, Homo sapiens
acacatttgctaaaatgagctc

SEQ ID NO: 8586759 - DNA, 22 bp, Homo sapiens
acaccagggatatgaggaagga

SEQ ID NO: 8586760 - DNA, 22 bp, Homo sapiens
agcagggcagttaaagggtcct

SEQ ID NO: 8586761 - DNA, 22 bp, Homo sapiens
agcagggcagtgcttcagctct

SEQ ID NO: 8586762 - DNA, 22 bp, Homo sapiens
agcagggcatgaataagggttt

SEQ ID NO: 8586763 - DNA, 22 bp, Homo sapiens
agcagggccaacagtaaacacc

SEQ ID NO: 8586764 - DNA, 18 bp, Homo sapiens
agcagggcattttgccat

SEQ ID NO: 8586765 - DNA, 22 bp, Homo sapiens
agcagggcccactaggggagat

SEQ ID NO: 8586766 - DNA, 22 bp, Homo sapiens
agcagggcccactaggggagat

SEQ ID NO: 8586767 - DNA, 22 bp, Homo sapiens
agcagggcccactaggggagat

SEQ ID NO: 8586768 - DNA, 23 bp, Homo sapiens
agcagggccagaatacttgctgt

SEQ ID NO: 8586769 - DNA, 22 bp, Homo sapiens
agcagggcccactaggggagat

SEQ ID NO: 8586770 - DNA, 22 bp, Homo sapiens
acaattgctaatgcttctgttg

SEQ ID NO: 8586771 - DNA, 22 bp, Homo sapiens
agcaccatttatcatctaggta

SEQ ID NO: 8586772 - DNA, 20 bp, Homo sapiens
agcaggaaaagtgccagtct

SEQ ID NO: 8586773 - DNA, 22 bp, Homo sapiens
agcagcttggttttaggcatgg

SEQ ID NO: 8586774 - DNA, 21 bp, Homo sapiens
agcagcttgagtctggagctc

SEQ ID NO: 8586775 - DNA, 23 bp, Homo sapiens
agcagcagtgagaggtgtcttac

SEQ ID NO: 8586776 - DNA, 22 bp, Homo sapiens
agcagcagtgtgtggtcatgtt

SEQ ID NO: 8586777 - DNA, 22 bp, Homo sapiens
agcagcagtgttctggaattct

SEQ ID NO: 8586778 - DNA, 22 bp, Homo sapiens
agcagcagtcatgcctatgctc

SEQ ID NO: 8586779 - DNA, 22 bp, Homo sapiens
agcagcaggtgcttctggatct

SEQ ID NO: 8586780 - DNA, 22 bp, Homo sapiens
aattatacatgaaggcattata

SEQ ID NO: 8586781 - DNA, 22 bp, Homo sapiens
aattatacattgaacaatctag

SEQ ID NO: 8586782 - DNA, 22 bp, Homo sapiens
aattatatgttaatcttcaatt

SEQ ID NO: 8586783 - DNA, 22 bp, Homo sapiens
agaagtatgtgagaaattatcc

SEQ ID NO: 8586784 - DNA, 23 bp, Homo sapiens
agacagaggctgaggctggccgc

SEQ ID NO: 8586785 - DNA, 22 bp, Homo sapiens
agacagactttgatctggatgt

SEQ ID NO: 8586786 - DNA, 22 bp, Homo sapiens
agatggggcagaatggagccat

SEQ ID NO: 8586787 - DNA, 22 bp, Homo sapiens
agcaagcacacttcatgtgaac

SEQ ID NO: 8586788 - DNA, 22 bp, Homo sapiens
agcaaggagtagaacaagagtg

SEQ ID NO: 8586789 - DNA, 22 bp, Homo sapiens
acaatgtttttgttcaaagagt

SEQ ID NO: 8586790 - DNA, 22 bp, Homo sapiens
agatgggtaactggagtctgct

SEQ ID NO: 8586791 - DNA, 22 bp, Homo sapiens
agatgggtaactggagtctgct

SEQ ID NO: 8586792 - DNA, 22 bp, Homo sapiens
agatggggctcagtgtggaggc

SEQ ID NO: 8586793 - DNA, 22 bp, Homo sapiens
acaattctctcatatcttatta

SEQ ID NO: 8586794 - DNA, 22 bp, Homo sapiens
acaaactaaaattctttattga

SEQ ID NO: 8586795 - DNA, 22 bp, Homo sapiens
aattttatgccttgcacgttgg

SEQ ID NO: 8586796 - DNA, 22 bp, Homo sapiens
agagctgggtggtggtgactca

SEQ ID NO: 8586797 - DNA, 22 bp, Homo sapiens
agagctggggccagagtcaagg

SEQ ID NO: 8586798 - DNA, 22 bp, Homo sapiens
agagctgggtgaagtgccatca

SEQ ID NO: 8586799 - DNA, 22 bp, Homo sapiens
agagctgggtggacttgtagtt

SEQ ID NO: 8586800 - DNA, 22 bp, Homo sapiens
agagctgggtggacttgtagtt

SEQ ID NO: 8586801 - DNA, 22 bp, Homo sapiens
agagctgggtggtggtgactca

SEQ ID NO: 8586802 - DNA, 22 bp, Homo sapiens
agagctgggtggtggtgactca

SEQ ID NO: 8586803 - DNA, 22 bp, Homo sapiens
aaaatcagtacactttattttg

SEQ ID NO: 8586804 - DNA, 22 bp, Homo sapiens
aaaagagagctgaggagctcca

SEQ ID NO: 8586805 - DNA, 22 bp, Homo sapiens
aaaagagaaagtggcaggcttt

SEQ ID NO: 8586806 - DNA, 22 bp, Homo sapiens
aaaagagaatcctgtacagaga

SEQ ID NO: 8586807 - DNA, 22 bp, Homo sapiens
aaacccagggttttgtcttccc

SEQ ID NO: 8586808 - DNA, 22 bp, Homo sapiens
aaaagtactattttaacaaagt

SEQ ID NO: 8586809 - DNA, 22 bp, Homo sapiens
aaaagtatagggtttggagtca

SEQ ID NO: 8586810 - DNA, 22 bp, Homo sapiens
aaaatagttaacgttcagagta

SEQ ID NO: 8586811 - DNA, 22 bp, Homo sapiens
aaaaactgcaattacttttgtc

SEQ ID NO: 8586812 - DNA, 22 bp, Homo sapiens
aaaatgaataagttaacccagg

SEQ ID NO: 8586813 - DNA, 22 bp, Homo sapiens
aaacagagggccactgaggctc

SEQ ID NO: 8586814 - DNA, 22 bp, Homo sapiens
aaacacttcctgtaacatgaca

SEQ ID NO: 8586815 - DNA, 22 bp, Homo sapiens
aaaaatcacttttataggcagc

SEQ ID NO: 8586816 - DNA, 22 bp, Homo sapiens
aaacacaggtactgcagaagtg

SEQ ID NO: 8586817 - DNA, 22 bp, Homo sapiens
aaacacaggtactgcagaagtg

SEQ ID NO: 8586818 - DNA, 22 bp, Homo sapiens
aaacagtgtaggtggccaggca

SEQ ID NO: 8586819 - DNA, 22 bp, Homo sapiens
aaacagtgcctggcatggagga

SEQ ID NO: 8586820 - DNA, 22 bp, Homo sapiens
aaacagtgtgtttcagagaggc

SEQ ID NO: 8586821 - DNA, 22 bp, Homo sapiens
aaacagtgccaggcagatgcca

SEQ ID NO: 8586822 - DNA, 22 bp, Homo sapiens
aaacagtgatgttgagtgtaaa

SEQ ID NO: 8586823 - DNA, 22 bp, Homo sapiens
aaagttcactgaccagcactgg

SEQ ID NO: 8586824 - DNA, 22 bp, Homo sapiens
aaagttactatcacaatgaaat

SEQ ID NO: 8586825 - DNA, 22 bp, Homo sapiens
aaactgataaaataagtacatt

SEQ ID NO: 8586826 - DNA, 22 bp, Homo sapiens
aaagacacaaatgtagaccaaa

SEQ ID NO: 8586827 - DNA, 22 bp, Homo sapiens
aaactgaagtagattctgaaat

SEQ ID NO: 8586828 - DNA, 22 bp, Homo sapiens
aaattaagagtaactctgtaga

SEQ ID NO: 8586829 - DNA, 20 bp, Homo sapiens
aaattactgccacacatttc

SEQ ID NO: 8586830 - DNA, 22 bp, Homo sapiens
aaagagcaccctcaatgtctga

SEQ ID NO: 8586831 - DNA, 22 bp, Homo sapiens
aacagattgtaacctgatagcc

SEQ ID NO: 8586832 - DNA, 22 bp, Homo sapiens
aaagatcacgtcccaggactcg

SEQ ID NO: 8586833 - DNA, 22 bp, Homo sapiens
aaagccagttcttagagaaagc

SEQ ID NO: 8586834 - DNA, 22 bp, Homo sapiens
aaagccagttcttagagaaagc

SEQ ID NO: 8586835 - DNA, 22 bp, Homo sapiens
aaagccagtttctggaagtacc

SEQ ID NO: 8586836 - DNA, 22 bp, Homo sapiens
aacaaaacatttgtcttgtttc

SEQ ID NO: 8586837 - DNA, 22 bp, Homo sapiens
aaagtgggaacaatggagagtg

SEQ ID NO: 8586838 - DNA, 22 bp, Homo sapiens
aaagtggggtctagagggcctg

SEQ ID NO: 8586839 - DNA, 22 bp, Homo sapiens
aaagtcacatagcatcacttct

SEQ ID NO: 8586840 - DNA, 22 bp, Homo sapiens
aaaggaagatgccaggactctg

SEQ ID NO: 8586841 - DNA, 22 bp, Homo sapiens
aaagggcagagttcactagaaa

SEQ ID NO: 8586842 - DNA, 22 bp, Homo sapiens
aactaacagtcattaaaagaac

SEQ ID NO: 8586843 - DNA, 22 bp, Homo sapiens
aactaaatctggcatttagagc

SEQ ID NO: 8586844 - DNA, 22 bp, Homo sapiens
aactaaaactggtttgttctct

SEQ ID NO: 8586845 - DNA, 23 bp, Homo sapiens
aagcacagaatggtttaggagtt

SEQ ID NO: 8586846 - DNA, 22 bp, Homo sapiens
aagcacagaccagatctccagg

SEQ ID NO: 8586847 - DNA, 22 bp, Homo sapiens
aagcacagacacaaaaggcttt

SEQ ID NO: 8586848 - DNA, 22 bp, Homo sapiens
aagcacagataaaacaggattc

SEQ ID NO: 8586849 - DNA, 22 bp, Homo sapiens
aagcacagagatgggcacgcct

SEQ ID NO: 8586850 - DNA, 22 bp, Homo sapiens
aagcacagagaggtaaagtaac

SEQ ID NO: 8586851 - DNA, 22 bp, Homo sapiens
aagcacagactccctctgagtg

SEQ ID NO: 8586852 - DNA, 22 bp, Homo sapiens
aaatgcatcagctcataagaga

SEQ ID NO: 8586853 - DNA, 22 bp, Homo sapiens
aaatagacaggcttaaatagga

SEQ ID NO: 8586854 - DNA, 22 bp, Homo sapiens
aaatacaaaaattagccaggca

SEQ ID NO: 8586855 - DNA, 22 bp, Homo sapiens
aagtcatgtggaagaataacct

SEQ ID NO: 8586856 - DNA, 22 bp, Homo sapiens
aacaggaatgaggagaaaaggt

SEQ ID NO: 8586857 - DNA, 22 bp, Homo sapiens
aacaggaattgatgggagtcct

SEQ ID NO: 8586858 - DNA, 22 bp, Homo sapiens
aaatgtctatctggcatattcc

SEQ ID NO: 8586859 - DNA, 22 bp, Homo sapiens
aaatgtgtatatgaaacatgat

SEQ ID NO: 8586860 - DNA, 18 bp, Homo sapiens
aacatgcattagaactgc

SEQ ID NO: 8586861 - DNA, 22 bp, Homo sapiens
aacaggaattgcaggcagatct

SEQ ID NO: 8586862 - DNA, 22 bp, Homo sapiens
aacaggagaggggaatgtagag

SEQ ID NO: 8586863 - DNA, 22 bp, Homo sapiens
aaccacagacccagactagaga

SEQ ID NO: 8586864 - DNA, 22 bp, Homo sapiens
aaccacagagccccctcagatg

SEQ ID NO: 8586865 - DNA, 22 bp, Homo sapiens
aaccagaggggccctgcctggg

SEQ ID NO: 8586866 - DNA, 21 bp, Homo sapiens
aaccagagccaggctctcagc

SEQ ID NO: 8586867 - DNA, 22 bp, Homo sapiens
aactgcaatcacttttgcacca

SEQ ID NO: 8586868 - DNA, 22 bp, Homo sapiens
aactgcaattacttttgcacca

SEQ ID NO: 8586869 - DNA, 22 bp, Homo sapiens
aactgcaattacttttgcacta

SEQ ID NO: 8586870 - DNA, 20 bp, Homo sapiens
aatataattctctgaattta

SEQ ID NO: 8586871 - DNA, 22 bp, Homo sapiens
aatataatgctgttttatgcca

SEQ ID NO: 8586872 - DNA, 22 bp, Homo sapiens
aactacattgtcctttctgaag

SEQ ID NO: 8586873 - DNA, 22 bp, Homo sapiens
aacttaaacccactcatgtaga

SEQ ID NO: 8586874 - DNA, 22 bp, Homo sapiens
aactgcttagtgatggatgacc

SEQ ID NO: 8586875 - DNA, 19 bp, Homo sapiens
aagcattagccaaagcatt

SEQ ID NO: 8586876 - DNA, 22 bp, Homo sapiens
aagcatcaacactatattgatg

SEQ ID NO: 8586877 - DNA, 22 bp, Homo sapiens
acagcagctgccttcaggctct

SEQ ID NO: 8586878 - DNA, 22 bp, Homo sapiens
aagccaggaccaaactcatcct

SEQ ID NO: 8586879 - DNA, 18 bp, Homo sapiens
acagacaaaatggaaatg

SEQ ID NO: 8586880 - DNA, 22 bp, Homo sapiens
aagcagcatcctgggcagacct

SEQ ID NO: 8586881 - DNA, 22 bp, Homo sapiens
aagcagcattgtaaccaatgcc

SEQ ID NO: 8586882 - DNA, 22 bp, Homo sapiens
aagaggctagccggctcactaa

SEQ ID NO: 8586883 - DNA, 22 bp, Homo sapiens
aagaggcttcagatccttcaga

SEQ ID NO: 8586884 - DNA, 22 bp, Homo sapiens
aagcacagggactcaggaccgg

SEQ ID NO: 8586885 - DNA, 22 bp, Homo sapiens
aagcacaggatcttgaggagcg

SEQ ID NO: 8586886 - DNA, 22 bp, Homo sapiens
aagcacagaaaaggagcatgga

SEQ ID NO: 8586887 - DNA, 22 bp, Homo sapiens
aagcacagaaaaggagcatgga

SEQ ID NO: 8586888 - DNA, 18 bp, Homo sapiens
aagcacaggtgtttcagg

SEQ ID NO: 8586889 - DNA, 22 bp, Homo sapiens
aagcacagtgccaagttctatt

SEQ ID NO: 8586890 - DNA, 22 bp, Homo sapiens
aagcacagtgggcagagcagcc

SEQ ID NO: 8586891 - DNA, 22 bp, Homo sapiens
aagaaatcagaaaagcattcgt

SEQ ID NO: 8586892 - DNA, 22 bp, Homo sapiens
aagacaggaacatagcaaatcc

SEQ ID NO: 8586893 - DNA, 22 bp, Homo sapiens
aagacaggaaaagctccaggcc

SEQ ID NO: 8586894 - DNA, 22 bp, Homo sapiens
aagacaggaaaagctccaggcc

SEQ ID NO: 8586895 - DNA, 22 bp, Homo sapiens
acaaggagagcacacatgggga

SEQ ID NO: 8586896 - DNA, 22 bp, Homo sapiens
aagacataaaacagtcagcgaa

SEQ ID NO: 8586897 - DNA, 22 bp, Homo sapiens
aagacatgcagtttgttccatt

SEQ ID NO: 8586898 - DNA, 20 bp, Homo sapiens
aagagctgactcacagtggt

SEQ ID NO: 8586899 - DNA, 20 bp, Homo sapiens
aagagctgactcacagtggt

SEQ ID NO: 8586900 - DNA, 22 bp, Homo sapiens
aagagctcttcataaaggcata

SEQ ID NO: 8586901 - DNA, 22 bp, Homo sapiens
acaaggcagttaaaatggttaa

SEQ ID NO: 8586902 - DNA, 22 bp, Homo sapiens
aagagctggagctgctacagga

SEQ ID NO: 8586903 - DNA, 22 bp, Homo sapiens
ggctagggacacagctctgctc

SEQ ID NO: 8586904 - DNA, 22 bp, Homo sapiens
ggctcacgcaattatcccggcc

SEQ ID NO: 8586905 - DNA, 18 bp, Homo sapiens
ggcctctggactggcagc

SEQ ID NO: 8586906 - DNA, 22 bp, Homo sapiens
ggcctctggggtcctgagccca

SEQ ID NO: 8586907 - DNA, 22 bp, Homo sapiens
ggcctctgccccagccacacct

SEQ ID NO: 8586908 - DNA, 22 bp, Homo sapiens
ggctctgaggctatgctttaca

SEQ ID NO: 8586909 - DNA, 23 bp, Homo sapiens
ggctctgaggatggagctggtgg

SEQ ID NO: 8586910 - DNA, 22 bp, Homo sapiens
ggctctgacctcccaggcagtt

SEQ ID NO: 8586911 - DNA, 22 bp, Homo sapiens
ggctcagcacagggctggcatc

SEQ ID NO: 8586912 - DNA, 22 bp, Homo sapiens
ggctcagcacagggctggcatc

SEQ ID NO: 8586913 - DNA, 22 bp, Homo sapiens
ggctcactgcaacttccgcctc

SEQ ID NO: 8586914 - DNA, 22 bp, Homo sapiens
ggccacctccgtgaaggaatga

SEQ ID NO: 8586915 - DNA, 22 bp, Homo sapiens
ggccagagttgatggcatcttg

SEQ ID NO: 8586916 - DNA, 22 bp, Homo sapiens
ggccagcagacctcagggactc

SEQ ID NO: 8586917 - DNA, 22 bp, Homo sapiens
ggccacatgtggctgctcgtat

SEQ ID NO: 8586918 - DNA, 22 bp, Homo sapiens
ggccacatgaattcttggacag

SEQ ID NO: 8586919 - DNA, 22 bp, Homo sapiens
ggccacattcaaagctgtcctg

SEQ ID NO: 8586920 - DNA, 21 bp, Homo sapiens
ggccacagttagggctcagga

SEQ ID NO: 8586921 - DNA, 22 bp, Homo sapiens
ggccacagcaatgctgtgatgt

SEQ ID NO: 8586922 - DNA, 22 bp, Homo sapiens
ggccacagtctctggaaggatg

SEQ ID NO: 8586923 - DNA, 22 bp, Homo sapiens
ggcccagctgtatattacagtt

SEQ ID NO: 8586924 - DNA, 22 bp, Homo sapiens
ggcccagctgggcggggacacg

SEQ ID NO: 8586925 - DNA, 22 bp, Homo sapiens
ggcccagctttcattccttgct

SEQ ID NO: 8586926 - DNA, 22 bp, Homo sapiens
ggcccagtgtgggtggatgttg

SEQ ID NO: 8586927 - DNA, 22 bp, Homo sapiens
ggcccagtgtcccggtcgtggc

SEQ ID NO: 8586928 - DNA, 22 bp, Homo sapiens
ggcccatctcttgctctgggtt

SEQ ID NO: 8586929 - DNA, 20 bp, Homo sapiens
ggccagctgatgcacgatgc

SEQ ID NO: 8586930 - DNA, 21 bp, Homo sapiens
ggccagctgcatatgtcactg

SEQ ID NO: 8586931 - DNA, 22 bp, Homo sapiens
ggccagctgccaccagccctat

SEQ ID NO: 8586932 - DNA, 20 bp, Homo sapiens
ggccagctggaggcgccggg

SEQ ID NO: 8586933 - DNA, 22 bp, Homo sapiens
ggccagctgggccaccaggtgc

SEQ ID NO: 8586934 - DNA, 22 bp, Homo sapiens
ggcccagctctattgaattaca

SEQ ID NO: 8586935 - DNA, 22 bp, Homo sapiens
ggccagctggagttccgggtgg

SEQ ID NO: 8586936 - DNA, 22 bp, Homo sapiens
ggccagctggatgtgggtgacg

SEQ ID NO: 8586937 - DNA, 22 bp, Homo sapiens
ggccagctctgcacagcagctg

SEQ ID NO: 8586938 - DNA, 17 bp, Homo sapiens
ggaggcaacagacaggg

SEQ ID NO: 8586939 - DNA, 22 bp, Homo sapiens
ggaggcacacctcagactggga

SEQ ID NO: 8586940 - DNA, 22 bp, Homo sapiens
ggaggcaccactcatcatcctc

SEQ ID NO: 8586941 - DNA, 23 bp, Homo sapiens
ggaggcacttaggcagagcagag

SEQ ID NO: 8586942 - DNA, 22 bp, Homo sapiens
ggaggatgagctacgaggagct

SEQ ID NO: 8586943 - DNA, 22 bp, Homo sapiens
ggcacctgtagttattttgttt

SEQ ID NO: 8586944 - DNA, 22 bp, Homo sapiens
ggcacctgtctgctcacagtga

SEQ ID NO: 8586945 - DNA, 19 bp, Homo sapiens
ggcaccttggtcttggact

SEQ ID NO: 8586946 - DNA, 22 bp, Homo sapiens
ggcacctggatgtagcagtgaa

SEQ ID NO: 8586947 - DNA, 22 bp, Homo sapiens
ggcacctggatgtagcagtgaa

SEQ ID NO: 8586948 - DNA, 22 bp, Homo sapiens
ggcacctggaggtttactggat

SEQ ID NO: 8586949 - DNA, 22 bp, Homo sapiens
ggcacctgctcatctggactca

SEQ ID NO: 8586950 - DNA, 22 bp, Homo sapiens
ggaggcacttcccgtctcagcc

SEQ ID NO: 8586951 - DNA, 22 bp, Homo sapiens
ggaggcacttcatgctgacccg

SEQ ID NO: 8586952 - DNA, 22 bp, Homo sapiens
ggaggcacttgttaaactacta

SEQ ID NO: 8586953 - DNA, 22 bp, Homo sapiens
ggcaccatcagctgtgcagggg

SEQ ID NO: 8586954 - DNA, 22 bp, Homo sapiens
ggcagcagaactggccctgtat

SEQ ID NO: 8586955 - DNA, 22 bp, Homo sapiens
ggcagaggtgacagtgtctttt

SEQ ID NO: 8586956 - DNA, 22 bp, Homo sapiens
ggcagggcttgtctctgtgatg

SEQ ID NO: 8586957 - DNA, 22 bp, Homo sapiens
ggcagggccctgattcctgggg

SEQ ID NO: 8586958 - DNA, 20 bp, Homo sapiens
ggcagggcatcaacagctct

SEQ ID NO: 8586959 - DNA, 20 bp, Homo sapiens
ggcagggcatcaacagctct

SEQ ID NO: 8586960 - DNA, 22 bp, Homo sapiens
gggaagagggagctggaatgat

SEQ ID NO: 8586961 - DNA, 18 bp, Homo sapiens
ggctgtgcgtggaggctg

SEQ ID NO: 8586962 - DNA, 22 bp, Homo sapiens
ggctggccagggccctcgctgg

SEQ ID NO: 8586963 - DNA, 22 bp, Homo sapiens
ggctgtgcgtcatccggctgca

SEQ ID NO: 8586964 - DNA, 22 bp, Homo sapiens
ggctgtgcttggtgtccttgga

SEQ ID NO: 8586965 - DNA, 22 bp, Homo sapiens
gggaaggccttgtcagcggatt

SEQ ID NO: 8586966 - DNA, 22 bp, Homo sapiens
gggaaggccggtccagtcaggt

SEQ ID NO: 8586967 - DNA, 22 bp, Homo sapiens
gggagccacagtgaggtgcatg

SEQ ID NO: 8586968 - DNA, 22 bp, Homo sapiens
gggaagagtaactagcccatgt

SEQ ID NO: 8586969 - DNA, 22 bp, Homo sapiens
gggaagagtgtcggttgaagtg

SEQ ID NO: 8586970 - DNA, 22 bp, Homo sapiens
gggaagatagtgttgagggccc

SEQ ID NO: 8586971 - DNA, 22 bp, Homo sapiens
gggaagcaggtgcagctcgcct

SEQ ID NO: 8586972 - DNA, 22 bp, Homo sapiens
gggaagcagcattgtgctggct

SEQ ID NO: 8586973 - DNA, 22 bp, Homo sapiens
gggaagcagcattgtgctggct

SEQ ID NO: 8586974 - DNA, 22 bp, Homo sapiens
gggaaggcagtgggaggaactg

SEQ ID NO: 8586975 - DNA, 22 bp, Homo sapiens
gggaaggcagtgtctggttgaa

SEQ ID NO: 8586976 - DNA, 22 bp, Homo sapiens
gggaaggcatacctgagggaga

SEQ ID NO: 8586977 - DNA, 22 bp, Homo sapiens
gggaagcatctgagggtccact

SEQ ID NO: 8586978 - DNA, 22 bp, Homo sapiens
gggaagcatctgagggtccact

SEQ ID NO: 8586979 - DNA, 22 bp, Homo sapiens
ggctggagtgggctccagagtt

SEQ ID NO: 8586980 - DNA, 22 bp, Homo sapiens
ggctggaggtagaagaacactt

SEQ ID NO: 8586981 - DNA, 22 bp, Homo sapiens
ggctggcaggggatgtcagatg

SEQ ID NO: 8586982 - DNA, 22 bp, Homo sapiens
ggctggaggagaatgggtgtga

SEQ ID NO: 8586983 - DNA, 22 bp, Homo sapiens
ggctgcctgccgcccacttggc

SEQ ID NO: 8586984 - DNA, 22 bp, Homo sapiens
ggctgccaggagaagctcagtg

SEQ ID NO: 8586985 - DNA, 22 bp, Homo sapiens
ggctgcagttgtgtgaaggccg

SEQ ID NO: 8586986 - DNA, 22 bp, Homo sapiens
ggctgcagttgtgtgaaggccg

SEQ ID NO: 8586987 - DNA, 22 bp, Homo sapiens
ggctgcagtttgtcttttgctt

SEQ ID NO: 8586988 - DNA, 22 bp, Homo sapiens
ggctgcctcctgctgggctgga

SEQ ID NO: 8586989 - DNA, 21 bp, Homo sapiens
ggctgcagggagccctggggt

SEQ ID NO: 8586990 - DNA, 22 bp, Homo sapiens
ggctgcaggcagggtatccact

SEQ ID NO: 8586991 - DNA, 17 bp, Homo sapiens
ggctgcagtccaggagg

SEQ ID NO: 8586992 - DNA, 17 bp, Homo sapiens
ggctgcagtccaggagg

SEQ ID NO: 8586993 - DNA, 22 bp, Homo sapiens
gggagctctccctgaggcctgg

SEQ ID NO: 8586994 - DNA, 22 bp, Homo sapiens
gggagccttgggagtgccagcc

SEQ ID NO: 8586995 - DNA, 22 bp, Homo sapiens
gggagctcgtgcgcccaggtgc

SEQ ID NO: 8586996 - DNA, 22 bp, Homo sapiens
gggataggtttggaagaggtgg

SEQ ID NO: 8586997 - DNA, 22 bp, Homo sapiens
gggataggagattgggagtgtt

SEQ ID NO: 8586998 - DNA, 20 bp, Homo sapiens
gggatcaggaaaggaggcta

SEQ ID NO: 8586999 - DNA, 19 bp, Homo sapiens
gggatcagcccagggctct

SEQ ID NO: 8587000 - DNA, 19 bp, Homo sapiens
gggatcagcccagggctct

SEQ ID NO: 8587001 - DNA, 22 bp, Homo sapiens
gggatcagactctgggatgtag

SEQ ID NO: 8587002 - DNA, 22 bp, Homo sapiens
gggagtgggtttggcctaggcc

SEQ ID NO: 8587003 - DNA, 22 bp, Homo sapiens
gggcagagagctggaactcctt

SEQ ID NO: 8587004 - DNA, 22 bp, Homo sapiens
gggatccatccgtgcagcagag

SEQ ID NO: 8587005 - DNA, 17 bp, Homo sapiens
gggcagggactcctggg

SEQ ID NO: 8587006 - DNA, 17 bp, Homo sapiens
gggcagggactcctggg

SEQ ID NO: 8587007 - DNA, 15 bp, Homo sapiens
gggcaggtctggggc

SEQ ID NO: 8587008 - DNA, 22 bp, Homo sapiens
gggcaggtctgggtcagcctga

SEQ ID NO: 8587009 - DNA, 17 bp, Homo sapiens
gggcagggactcctggg

SEQ ID NO: 8587010 - DNA, 22 bp, Homo sapiens
gggcaggtgattttggctccat

SEQ ID NO: 8587011 - DNA, 22 bp, Homo sapiens
gggcaggtgacctcttgtcctg

SEQ ID NO: 8587012 - DNA, 22 bp, Homo sapiens
gggcaggtgccagctccctgtc

SEQ ID NO: 8587013 - DNA, 22 bp, Homo sapiens
gggcaggtgcccagggccagag

SEQ ID NO: 8587014 - DNA, 22 bp, Homo sapiens
gggcaggtgttgtcaatctaat

SEQ ID NO: 8587015 - DNA, 22 bp, Homo sapiens
gggcaggtggcctcttgtacta

SEQ ID NO: 8587016 - DNA, 22 bp, Homo sapiens
gggcaggtgtgcagagctgttg

SEQ ID NO: 8587017 - DNA, 22 bp, Homo sapiens
gggcaggtgtttccaaggtgag

SEQ ID NO: 8587018 - DNA, 22 bp, Homo sapiens
gggcaggtggcaaagccagagg

SEQ ID NO: 8587019 - DNA, 22 bp, Homo sapiens
gggcaggtggagggcccagcca

SEQ ID NO: 8587020 - DNA, 22 bp, Homo sapiens
gggcaggtggcagggtctctgg

SEQ ID NO: 8587021 - DNA, 22 bp, Homo sapiens
gggcccaggcctccttccttcc

SEQ ID NO: 8587022 - DNA, 18 bp, Homo sapiens
gggctcacacaggtcatc

SEQ ID NO: 8587023 - DNA, 22 bp, Homo sapiens
gggccctgggattcagagcaag

SEQ ID NO: 8587024 - DNA, 22 bp, Homo sapiens
gggccctgatctgtgagcgcag

SEQ ID NO: 8587025 - DNA, 22 bp, Homo sapiens
gggccctcagtcccaggccttc

SEQ ID NO: 8587026 - DNA, 22 bp, Homo sapiens
gggctccaaaatcctgtagcct

SEQ ID NO: 8587027 - DNA, 22 bp, Homo sapiens
gggctccaaccccagtgaactc

SEQ ID NO: 8587028 - DNA, 22 bp, Homo sapiens
gggctcagacatccctcctgga

SEQ ID NO: 8587029 - DNA, 22 bp, Homo sapiens
gggctcagaggagtggcctggg

SEQ ID NO: 8587030 - DNA, 22 bp, Homo sapiens
gggctcagttctgcttcatgct

SEQ ID NO: 8587031 - DNA, 22 bp, Homo sapiens
gtgcaggctctcgttcttgaca

SEQ ID NO: 8587032 - DNA, 22 bp, Homo sapiens
gtgcagggtagcgacggcagga

SEQ ID NO: 8587033 - DNA, 22 bp, Homo sapiens
gtgcagggtagcgacggcagga

SEQ ID NO: 8587034 - DNA, 17 bp, Homo sapiens
gtgcagggatgaaggat

SEQ ID NO: 8587035 - DNA, 17 bp, Homo sapiens
gtgcagggatgaaggat

SEQ ID NO: 8587036 - DNA, 22 bp, Homo sapiens
gtgcaggggatcaggttgcagc

SEQ ID NO: 8587037 - DNA, 22 bp, Homo sapiens
gtgcagggctggcaccggaggc

SEQ ID NO: 8587038 - DNA, 22 bp, Homo sapiens
gtgcagggctggcaccggaggc

SEQ ID NO: 8587039 - DNA, 22 bp, Homo sapiens
gtgccagtctctgagttaggac

SEQ ID NO: 8587040 - DNA, 22 bp, Homo sapiens
gtgctggaccctggaaggtggt

SEQ ID NO: 8587041 - DNA, 22 bp, Homo sapiens
gtgctggatgaaataactggaa

SEQ ID NO: 8587042 - DNA, 22 bp, Homo sapiens
gtgctgagtgcagagtgcagag

SEQ ID NO: 8587043 - DNA, 22 bp, Homo sapiens
gtgagctgttggagtggcagag

SEQ ID NO: 8587044 - DNA, 22 bp, Homo sapiens
gtgaggaagtgtttgtcaaatt

SEQ ID NO: 8587045 - DNA, 22 bp, Homo sapiens
gtgaggagggctggtcccaggc

SEQ ID NO: 8587046 - DNA, 22 bp, Homo sapiens
gtgagcagtggccagggtccta

SEQ ID NO: 8587047 - DNA, 22 bp, Homo sapiens
gtgaaaaatgatttgttaactg

SEQ ID NO: 8587048 - DNA, 22 bp, Homo sapiens
gtctttttctacgatagcgcct

SEQ ID NO: 8587049 - DNA, 22 bp, Homo sapiens
gtctttctatgcatagagcaga

SEQ ID NO: 8587050 - DNA, 22 bp, Homo sapiens
gtctttcatggatattcagttt

SEQ ID NO: 8587051 - DNA, 22 bp, Homo sapiens
gtctccagggctgctggcgcct

SEQ ID NO: 8587052 - DNA, 22 bp, Homo sapiens
gtctccagtgttcaggtgactg

SEQ ID NO: 8587053 - DNA, 22 bp, Homo sapiens
gtctccagaggttacatcctgt

SEQ ID NO: 8587054 - DNA, 22 bp, Homo sapiens
gtctagcaatgatgatgagcta

SEQ ID NO: 8587055 - DNA, 22 bp, Homo sapiens
gtctacaaagcatataaaagag

SEQ ID NO: 8587056 - DNA, 22 bp, Homo sapiens
gtacaaaagttattgcggtttt

SEQ ID NO: 8587057 - DNA, 22 bp, Homo sapiens
gtacaacatgattttactctct

SEQ ID NO: 8587058 - DNA, 22 bp, Homo sapiens
gtaggtgagtgatgctcagatt

SEQ ID NO: 8587059 - DNA, 22 bp, Homo sapiens
gtagggttggagagcacaacca

SEQ ID NO: 8587060 - DNA, 22 bp, Homo sapiens
gtaggggatggttccctagaaa

SEQ ID NO: 8587061 - DNA, 22 bp, Homo sapiens
gtagttctgcagtgtcacctga

SEQ ID NO: 8587062 - DNA, 22 bp, Homo sapiens
gtagttctgcagtgtcacctga

SEQ ID NO: 8587063 - DNA, 22 bp, Homo sapiens
gtccagctctgagaagaaacat

SEQ ID NO: 8587064 - DNA, 22 bp, Homo sapiens
gtccagctgcagctgggcagaa

SEQ ID NO: 8587065 - DNA, 22 bp, Homo sapiens
gtccagagagatcttctgatag

SEQ ID NO: 8587066 - DNA, 22 bp, Homo sapiens
gtcagaaaaagcaaggctgggc

SEQ ID NO: 8587067 - DNA, 22 bp, Homo sapiens
gtcacctctcatcacatgctac

SEQ ID NO: 8587068 - DNA, 18 bp, Homo sapiens
gtcactagttcaaacttc

SEQ ID NO: 8587069 - DNA, 22 bp, Homo sapiens
gtcactggaattacaggcatgc

SEQ ID NO: 8587070 - DNA, 22 bp, Homo sapiens
gtcactggggccacatgcagaa

SEQ ID NO: 8587071 - DNA, 22 bp, Homo sapiens
gtccaggccatggtggacacag

SEQ ID NO: 8587072 - DNA, 22 bp, Homo sapiens
gtcctctggcctttcccaggac

SEQ ID NO: 8587073 - DNA, 22 bp, Homo sapiens
gtcctgggaactggacagctaa

SEQ ID NO: 8587074 - DNA, 22 bp, Homo sapiens
gtcgggtagtgctggaaggatt

SEQ ID NO: 8587075 - DNA, 22 bp, Homo sapiens
gtcctggcccaggagtacacat

SEQ ID NO: 8587076 - DNA, 22 bp, Homo sapiens
gtcctctgtgtaggctgcagac

SEQ ID NO: 8587077 - DNA, 22 bp, Homo sapiens
ggttggtaactccctgtgcagt

SEQ ID NO: 8587078 - DNA, 22 bp, Homo sapiens
ggttggggcgagctggaggccc

SEQ ID NO: 8587079 - DNA, 22 bp, Homo sapiens
ggttccacctggcgaggggtat

SEQ ID NO: 8587080 - DNA, 22 bp, Homo sapiens
gtaattctgtgtgaatctatta

SEQ ID NO: 8587081 - DNA, 22 bp, Homo sapiens
gtacaaaagttattgcggtttt

SEQ ID NO: 8587082 - DNA, 23 bp, Homo sapiens
ggttagggaatgatctcaggcat

SEQ ID NO: 8587083 - DNA, 22 bp, Homo sapiens
ggttaggatcagatcctggagg

SEQ ID NO: 8587084 - DNA, 22 bp, Homo sapiens
ggtggggcccaggcatctgatg

SEQ ID NO: 8587085 - DNA, 22 bp, Homo sapiens
ggtggggccagggctccaacct

SEQ ID NO: 8587086 - DNA, 22 bp, Homo sapiens
ggtggggccctggcactggtat

SEQ ID NO: 8587087 - DNA, 22 bp, Homo sapiens
ggtggggagtcaggcattcttg

SEQ ID NO: 8587088 - DNA, 22 bp, Homo sapiens
ggtggggcctgctccagcggcc

SEQ ID NO: 8587089 - DNA, 22 bp, Homo sapiens
ggtggggctaggacctcaggat

SEQ ID NO: 8587090 - DNA, 22 bp, Homo sapiens
ggtggagcgcagggtgctggcg

SEQ ID NO: 8587091 - DNA, 22 bp, Homo sapiens
ggtggcagagaggaggtagttt

SEQ ID NO: 8587092 - DNA, 22 bp, Homo sapiens
gggttgggactgtcatctggag

SEQ ID NO: 8587093 - DNA, 22 bp, Homo sapiens
gggttggatcctggtggctgcc

SEQ ID NO: 8587094 - DNA, 22 bp, Homo sapiens
ggtgagggagtggaacgaggtg

SEQ ID NO: 8587095 - DNA, 22 bp, Homo sapiens
ggtgctctggtcatggtggagt

SEQ ID NO: 8587096 - DNA, 22 bp, Homo sapiens
ggtgctctttctcagacaagat

SEQ ID NO: 8587097 - DNA, 22 bp, Homo sapiens
ggtggaaggcctggaaggaggc

SEQ ID NO: 8587098 - DNA, 18 bp, Homo sapiens
ggtgagggagctggaagc

SEQ ID NO: 8587099 - DNA, 22 bp, Homo sapiens
ggtgagcactgccctgggtctc

SEQ ID NO: 8587100 - DNA, 22 bp, Homo sapiens
ggtgaggcaggtggctgctgag

SEQ ID NO: 8587101 - DNA, 22 bp, Homo sapiens
ggggcccttgtggctgcaggcc

SEQ ID NO: 8587102 - DNA, 22 bp, Homo sapiens
ggggcccttgtggctgcaggcc

SEQ ID NO: 8587103 - DNA, 22 bp, Homo sapiens
ggggtaggcaggtgatctgatc

SEQ ID NO: 8587104 - DNA, 22 bp, Homo sapiens
ggggtagggcgattgctgcttt

SEQ ID NO: 8587105 - DNA, 22 bp, Homo sapiens
ggggccagatatcactaaggtt

SEQ ID NO: 8587106 - DNA, 22 bp, Homo sapiens
ggggccagcaatgttgaggaat

SEQ ID NO: 8587107 - DNA, 22 bp, Homo sapiens
ggggtggattcctacaggtcca

SEQ ID NO: 8587108 - DNA, 22 bp, Homo sapiens
ggggtggagatggtggcccttt

SEQ ID NO: 8587109 - DNA, 19 bp, Homo sapiens
ggggtggctggggctccag

SEQ ID NO: 8587110 - DNA, 22 bp, Homo sapiens
gggtgcaggcagcccaggcagg

SEQ ID NO: 8587111 - DNA, 22 bp, Homo sapiens
gggtggaagccagagaggtcat

SEQ ID NO: 8587112 - DNA, 22 bp, Homo sapiens
gggtgagggatgagccttcttc

SEQ ID NO: 8587113 - DNA, 22 bp, Homo sapiens
gggtggtggccagcagtgggca

SEQ ID NO: 8587114 - DNA, 22 bp, Homo sapiens
gggtggtggccagcagtgggca

SEQ ID NO: 8587115 - DNA, 22 bp, Homo sapiens
gggtggtgggcacagaatctgg

SEQ ID NO: 8587116 - DNA, 19 bp, Homo sapiens
gggctctggcctcagtggg

SEQ ID NO: 8587117 - DNA, 22 bp, Homo sapiens
gggcttcaaaattggcactctt

SEQ ID NO: 8587118 - DNA, 22 bp, Homo sapiens
gggcttctgggcaccactccct

SEQ ID NO: 8587119 - DNA, 22 bp, Homo sapiens
ggggcagggaggttatcgccga

SEQ ID NO: 8587120 - DNA, 22 bp, Homo sapiens
ggggagtgttttcatgggcttg

SEQ ID NO: 8587121 - DNA, 20 bp, Homo sapiens
ggggcaggtttttatggcta

SEQ ID NO: 8587122 - DNA, 22 bp, Homo sapiens
ggggaggccagtggaccgtccc

SEQ ID NO: 8587123 - DNA, 22 bp, Homo sapiens
ggggaggcaagatgaagtgagg

SEQ ID NO: 8587124 - DNA, 22 bp, Homo sapiens
ggggaggctgatgtgggcaaag

SEQ ID NO: 8587125 - DNA, 22 bp, Homo sapiens
ggggagaattaccaaaagcgct

SEQ ID NO: 8587126 - DNA, 22 bp, Homo sapiens
ggggaggaagctggaacacggg

SEQ ID NO: 8587127 - DNA, 22 bp, Homo sapiens
ggggaggacctttccaaggctt

SEQ ID NO: 8587128 - DNA, 22 bp, Homo sapiens
gcattagacccaaggtattttg

SEQ ID NO: 8587129 - DNA, 22 bp, Homo sapiens
gcaggtggaagcagcagactca

SEQ ID NO: 8587130 - DNA, 22 bp, Homo sapiens
gccactgttgctcctcaggaaa

SEQ ID NO: 8587131 - DNA, 22 bp, Homo sapiens
gcatttatattctgttcggata

SEQ ID NO: 8587132 - DNA, 18 bp, Homo sapiens
gcatttatgcggggctac

SEQ ID NO: 8587133 - DNA, 22 bp, Homo sapiens
gcatttattatctgccaggcac

SEQ ID NO: 8587134 - DNA, 22 bp, Homo sapiens
gcatttatttctttactgcatc

SEQ ID NO: 8587135 - DNA, 23 bp, Homo sapiens
gcattgtagaatgtttagcagca

SEQ ID NO: 8587136 - DNA, 22 bp, Homo sapiens
gcattgattctgaagtgaaatg

SEQ ID NO: 8587137 - DNA, 22 bp, Homo sapiens
gccaggctaagaaaggtgtgat

SEQ ID NO: 8587138 - DNA, 22 bp, Homo sapiens
gccaggctcagcagtcaacctg

SEQ ID NO: 8587139 - DNA, 22 bp, Homo sapiens
gccaggctcagtagcgattcct

SEQ ID NO: 8587140 - DNA, 23 bp, Homo sapiens
gccaggctccggtctgtggccac

SEQ ID NO: 8587141 - DNA, 22 bp, Homo sapiens
gccaggctccccggatccctgg

SEQ ID NO: 8587142 - DNA, 19 bp, Homo sapiens
gccaggctccatagccggc

SEQ ID NO: 8587143 - DNA, 22 bp, Homo sapiens
gccaggctccaggccctcctga

SEQ ID NO: 8587144 - DNA, 22 bp, Homo sapiens
gccagctgggccttagggctgg

SEQ ID NO: 8587145 - DNA, 22 bp, Homo sapiens
gccagctgggccttagggctgg

SEQ ID NO: 8587146 - DNA, 22 bp, Homo sapiens
gccagctggtaggcacctagcc

SEQ ID NO: 8587147 - DNA, 22 bp, Homo sapiens
gccagctgtaggtggtgggttg

SEQ ID NO: 8587148 - DNA, 22 bp, Homo sapiens
gccagctgtctaagagagtaaa

SEQ ID NO: 8587149 - DNA, 22 bp, Homo sapiens
gccagctgtaagctggggtgat

SEQ ID NO: 8587150 - DNA, 22 bp, Homo sapiens
gccagctgtaagctggggtgat

SEQ ID NO: 8587151 - DNA, 22 bp, Homo sapiens
gccagctgaggccgtgcaggct

SEQ ID NO: 8587152 - DNA, 22 bp, Homo sapiens
gccagctgtttcagagcccagt

SEQ ID NO: 8587153 - DNA, 22 bp, Homo sapiens
gccagctgtttcagagcccagt

SEQ ID NO: 8587154 - DNA, 22 bp, Homo sapiens
gccagctttggcacagggtggt

SEQ ID NO: 8587155 - DNA, 23 bp, Homo sapiens
gccagctttggtctgtctcctag

SEQ ID NO: 8587156 - DNA, 22 bp, Homo sapiens
gccagcttcccatctggcttcc

SEQ ID NO: 8587157 - DNA, 22 bp, Homo sapiens
gccaggaaaagaagctggtgct

SEQ ID NO: 8587158 - DNA, 22 bp, Homo sapiens
gccaggaaaaagggtggccaat

SEQ ID NO: 8587159 - DNA, 22 bp, Homo sapiens
gccagcttggccagtggccagt

SEQ ID NO: 8587160 - DNA, 22 bp, Homo sapiens
gccaggcatgtcctctgcagaa

SEQ ID NO: 8587161 - DNA, 22 bp, Homo sapiens
gccaggaaagccactggcatac

SEQ ID NO: 8587162 - DNA, 22 bp, Homo sapiens
gcctgagggctcctagcaggct

SEQ ID NO: 8587163 - DNA, 22 bp, Homo sapiens
gcctgcagggcctgggcctacc

SEQ ID NO: 8587164 - DNA, 22 bp, Homo sapiens
gcctgcagctgcttccacacac

SEQ ID NO: 8587165 - DNA, 22 bp, Homo sapiens
gcctgcagcccctctgcagtag

SEQ ID NO: 8587166 - DNA, 22 bp, Homo sapiens
gcctgcagcccctctgcagtag

SEQ ID NO: 8587167 - DNA, 22 bp, Homo sapiens
gcctgcagcatgctaggtcttg

SEQ ID NO: 8587168 - DNA, 22 bp, Homo sapiens
gcctgcagcctcaagggctgag

SEQ ID NO: 8587169 - DNA, 22 bp, Homo sapiens
gcctgcagaggtgctgctagct

SEQ ID NO: 8587170 - DNA, 22 bp, Homo sapiens
gcctgcagaactgtgaggcaat

SEQ ID NO: 8587171 - DNA, 22 bp, Homo sapiens
gcctggagagcactgtgcgctt

SEQ ID NO: 8587172 - DNA, 22 bp, Homo sapiens
gcctggagtgcagtggcgtgat

SEQ ID NO: 8587173 - DNA, 22 bp, Homo sapiens
gcctgcagttctgtgctaggca

SEQ ID NO: 8587174 - DNA, 23 bp, Homo sapiens
gcctggagaaaagctgcagttca

SEQ ID NO: 8587175 - DNA, 22 bp, Homo sapiens
gcctgcagggtgatgggctgcc

SEQ ID NO: 8587176 - DNA, 22 bp, Homo sapiens
gcctgcagggtgatgggctgcc

SEQ ID NO: 8587177 - DNA, 22 bp, Homo sapiens
gcccctctccttgtgcacctgc

SEQ ID NO: 8587178 - DNA, 22 bp, Homo sapiens
gcccacagaggcaccaccaggc

SEQ ID NO: 8587179 - DNA, 22 bp, Homo sapiens
gcccaagctggactgcagtggc

SEQ ID NO: 8587180 - DNA, 22 bp, Homo sapiens
gccctcagagttccccacagtg

SEQ ID NO: 8587181 - DNA, 22 bp, Homo sapiens
gcagccagtatcctctgagatt

SEQ ID NO: 8587182 - DNA, 22 bp, Homo sapiens
gcagctggctctgggaaaaact

SEQ ID NO: 8587183 - DNA, 22 bp, Homo sapiens
gcagctggctcagagaggtggg

SEQ ID NO: 8587184 - DNA, 22 bp, Homo sapiens
gcagctgggccccagcctctcc

SEQ ID NO: 8587185 - DNA, 22 bp, Homo sapiens
gcagctgggacactgaggccag

SEQ ID NO: 8587186 - DNA, 22 bp, Homo sapiens
gcagctggggaggtcgtgggga

SEQ ID NO: 8587187 - DNA, 22 bp, Homo sapiens
gcagctggggccacacttaggc

SEQ ID NO: 8587188 - DNA, 22 bp, Homo sapiens
gcagctgggtctgtgtgggctg

SEQ ID NO: 8587189 - DNA, 23 bp, Homo sapiens
gcagctggttagaagggaaggag

SEQ ID NO: 8587190 - DNA, 22 bp, Homo sapiens
gcagctggttaatgggagaatt

SEQ ID NO: 8587191 - DNA, 21 bp, Homo sapiens
gcagctggtctcagagcttgc

SEQ ID NO: 8587192 - DNA, 21 bp, Homo sapiens
gcagctggtctcagagcttgc

SEQ ID NO: 8587193 - DNA, 22 bp, Homo sapiens
gcagctggtgcaaatgtcactc

SEQ ID NO: 8587194 - DNA, 22 bp, Homo sapiens
gcagctggtctggcctagagta

SEQ ID NO: 8587195 - DNA, 22 bp, Homo sapiens
gcagccagagggggtgtgatca

SEQ ID NO: 8587196 - DNA, 22 bp, Homo sapiens
gcagccagcaggaagcgggaga

SEQ ID NO: 8587197 - DNA, 22 bp, Homo sapiens
gcagcaaggatgaagcacttgg

SEQ ID NO: 8587198 - DNA, 22 bp, Homo sapiens
gcagcagatgtgggcccagagc

SEQ ID NO: 8587199 - DNA, 19 bp, Homo sapiens
gcagggtgttgactgtccc

SEQ ID NO: 8587200 - DNA, 22 bp, Homo sapiens
gcagggcagggcaagaactggg

SEQ ID NO: 8587201 - DNA, 22 bp, Homo sapiens
gcagggcagtaagagctagagt

SEQ ID NO: 8587202 - DNA, 22 bp, Homo sapiens
gcagggcaggatttgaacccag

SEQ ID NO: 8587203 - DNA, 22 bp, Homo sapiens
gcagggcagggcaagaactggg

SEQ ID NO: 8587204 - DNA, 22 bp, Homo sapiens
gcagggcatgggccctgtctgc

SEQ ID NO: 8587205 - DNA, 22 bp, Homo sapiens
gcagggcatgggccctgtctgc

SEQ ID NO: 8587206 - DNA, 22 bp, Homo sapiens
gcaggccactgtctcctctggg

SEQ ID NO: 8587207 - DNA, 22 bp, Homo sapiens
gcaggccaggctaggggctgtc

SEQ ID NO: 8587208 - DNA, 22 bp, Homo sapiens
gcagggcagctcactgtggttc

SEQ ID NO: 8587209 - DNA, 22 bp, Homo sapiens
gcagggcagctgaagctaggtg

SEQ ID NO: 8587210 - DNA, 22 bp, Homo sapiens
gcagggcagctgaagctaggtg

SEQ ID NO: 8587211 - DNA, 22 bp, Homo sapiens
gcagggcagcttagtccctgtc

SEQ ID NO: 8587212 - DNA, 22 bp, Homo sapiens
gcagggcagcttagtccctgtc

SEQ ID NO: 8587213 - DNA, 20 bp, Homo sapiens
gcaggccctctctctagtct

SEQ ID NO: 8587214 - DNA, 22 bp, Homo sapiens
gcagacaggggcttaggaaagg

SEQ ID NO: 8587215 - DNA, 22 bp, Homo sapiens
gcagacagggctacagaggtac

SEQ ID NO: 8587216 - DNA, 22 bp, Homo sapiens
gcagaggtgctcagtggcagaa

SEQ ID NO: 8587217 - DNA, 22 bp, Homo sapiens
gcagcaacgcggccctactgct

SEQ ID NO: 8587218 - DNA, 19 bp, Homo sapiens
gcagagtggggtggagggt

SEQ ID NO: 8587219 - DNA, 22 bp, Homo sapiens
gcagagtgaagggagaggtgtg

SEQ ID NO: 8587220 - DNA, 22 bp, Homo sapiens
gcagacaggcccagtggaggga

SEQ ID NO: 8587221 - DNA, 22 bp, Homo sapiens
gcagacagccagactgcactgg

SEQ ID NO: 8587222 - DNA, 22 bp, Homo sapiens
gcagacagccagactgcactgg

SEQ ID NO: 8587223 - DNA, 22 bp, Homo sapiens
gcagacaggattgggttaatag

SEQ ID NO: 8587224 - DNA, 22 bp, Homo sapiens
gcagacagcatgttgggctatt

SEQ ID NO: 8587225 - DNA, 22 bp, Homo sapiens
gcagacagatgagggtgctggg

SEQ ID NO: 8587226 - DNA, 22 bp, Homo sapiens
gcagacagactgcagtgatttt

SEQ ID NO: 8587227 - DNA, 22 bp, Homo sapiens
gcagacagactgcagtgatttt

SEQ ID NO: 8587228 - DNA, 23 bp, Homo sapiens
gcagacagagcagactaagacaa

SEQ ID NO: 8587229 - DNA, 22 bp, Homo sapiens
gcagacagaagctaagtagaca

SEQ ID NO: 8587230 - DNA, 22 bp, Homo sapiens
gcagacagaagctaagtagaca

SEQ ID NO: 8587231 - DNA, 22 bp, Homo sapiens
gcagacacagggaaggcaagga

SEQ ID NO: 8587232 - DNA, 22 bp, Homo sapiens
gcaaggagactgtagggccaag

SEQ ID NO: 8587233 - DNA, 22 bp, Homo sapiens
gagtagggatgctggtgactcc

SEQ ID NO: 8587234 - DNA, 18 bp, Homo sapiens
gcaaggcagctctctggg

SEQ ID NO: 8587235 - DNA, 22 bp, Homo sapiens
gcacagcagacttggtggggct

SEQ ID NO: 8587236 - DNA, 22 bp, Homo sapiens
gcacagagtcactagctaagca

SEQ ID NO: 8587237 - DNA, 22 bp, Homo sapiens
gcacagcacagcaacatgtttt

SEQ ID NO: 8587238 - DNA, 22 bp, Homo sapiens
gcacagagacagtcctgagatc

SEQ ID NO: 8587239 - DNA, 22 bp, Homo sapiens
gcacagagagcagtgggggaca

SEQ ID NO: 8587240 - DNA, 22 bp, Homo sapiens
gctggccacactgctgatggag

SEQ ID NO: 8587241 - DNA, 22 bp, Homo sapiens
gctggccacattgtgccgtcct

SEQ ID NO: 8587242 - DNA, 19 bp, Homo sapiens
gctgtgtgaccttgggcaa

SEQ ID NO: 8587243 - DNA, 22 bp, Homo sapiens
gctgtccatccacttcccagcg

SEQ ID NO: 8587244 - DNA, 22 bp, Homo sapiens
gctgttggcgaggagctcagct

SEQ ID NO: 8587245 - DNA, 18 bp, Homo sapiens
gctttttagtgcatcttc

SEQ ID NO: 8587246 - DNA, 22 bp, Homo sapiens
gcttttctataagaactttcaa

SEQ ID NO: 8587247 - DNA, 22 bp, Homo sapiens
gcttttatttcttcacaaaagt

SEQ ID NO: 8587248 - DNA, 22 bp, Homo sapiens
gctttgtgtgaagtccatggcg

SEQ ID NO: 8587249 - DNA, 22 bp, Homo sapiens
gctttatgggccatgcggtgtc

SEQ ID NO: 8587250 - DNA, 22 bp, Homo sapiens
gctttatgagtgaggcaggata

SEQ ID NO: 8587251 - DNA, 22 bp, Homo sapiens
gctttatgcaaacctggtactt

SEQ ID NO: 8587252 - DNA, 22 bp, Homo sapiens
gctttatggattgtaaactgca

SEQ ID NO: 8587253 - DNA, 22 bp, Homo sapiens
gctttatgctacgatttctagt

SEQ ID NO: 8587254 - DNA, 22 bp, Homo sapiens
gctttggttcaaccaggcaatt

SEQ ID NO: 8587255 - DNA, 22 bp, Homo sapiens
gctttggtcttctagctgtgag

SEQ ID NO: 8587256 - DNA, 22 bp, Homo sapiens
gctttggtgatacttgctggct

SEQ ID NO: 8587257 - DNA, 22 bp, Homo sapiens
gctttggtcaggtgtccagccc

SEQ ID NO: 8587258 - DNA, 22 bp, Homo sapiens
gctttggtacctcctgctgatc

SEQ ID NO: 8587259 - DNA, 22 bp, Homo sapiens
ggagctggtcagccttgagcat

SEQ ID NO: 8587260 - DNA, 22 bp, Homo sapiens
ggagctgttgcgcatgcgctcg

SEQ ID NO: 8587261 - DNA, 22 bp, Homo sapiens
ggagcctggcctggctctgtgt

SEQ ID NO: 8587262 - DNA, 22 bp, Homo sapiens
ggagcctgggcctcctgccctt

SEQ ID NO: 8587263 - DNA, 21 bp, Homo sapiens
ggagctgcaggagccgaaggc

SEQ ID NO: 8587264 - DNA, 20 bp, Homo sapiens
ggagctgccctgggctggag

SEQ ID NO: 8587265 - DNA, 22 bp, Homo sapiens
ggagaagaggagctggaagcct

SEQ ID NO: 8587266 - DNA, 22 bp, Homo sapiens
ggagaaagtacagcaggcaaca

SEQ ID NO: 8587267 - DNA, 22 bp, Homo sapiens
ggagccaggcatatcggggcac

SEQ ID NO: 8587268 - DNA, 22 bp, Homo sapiens
ggagccagtgccctctggtgga

SEQ ID NO: 8587269 - DNA, 22 bp, Homo sapiens
ggagcctggcaatgctgcgtcc

SEQ ID NO: 8587270 - DNA, 19 bp, Homo sapiens
ggagcctggcaggggcgtg

SEQ ID NO: 8587271 - DNA, 23 bp, Homo sapiens
ggagcctggcatatgagacgcat

SEQ ID NO: 8587272 - DNA, 22 bp, Homo sapiens
ggagcctggcccggcccttggc

SEQ ID NO: 8587273 - DNA, 22 bp, Homo sapiens
ggaaggctttgaggggtgctgg

SEQ ID NO: 8587274 - DNA, 22 bp, Homo sapiens
ggacagagggttgacagagtat

SEQ ID NO: 8587275 - DNA, 22 bp, Homo sapiens
ggagaaaggcatagcagaacct

SEQ ID NO: 8587276 - DNA, 22 bp, Homo sapiens
ggacaggggcgtggggattgtt

SEQ ID NO: 8587277 - DNA, 23 bp, Homo sapiens
ggacagggccctgccctatggcc

SEQ ID NO: 8587278 - DNA, 22 bp, Homo sapiens
gctggagttggcaaggcatgta

SEQ ID NO: 8587279 - DNA, 22 bp, Homo sapiens
gctggagttggcaaggcatgta

SEQ ID NO: 8587280 - DNA, 22 bp, Homo sapiens
gctggccaaagtgtacctggag

SEQ ID NO: 8587281 - DNA, 22 bp, Homo sapiens
gctggagtccagtggtatgatc

SEQ ID NO: 8587282 - DNA, 22 bp, Homo sapiens
gctggagtgatgcctgtgtctc

SEQ ID NO: 8587283 - DNA, 22 bp, Homo sapiens
gctggagtcttgaaagtggact

SEQ ID NO: 8587284 - DNA, 22 bp, Homo sapiens
gctggagtgctggagtgcagtg

SEQ ID NO: 8587285 - DNA, 22 bp, Homo sapiens
gctggagtgctgaggtgcagtg

SEQ ID NO: 8587286 - DNA, 22 bp, Homo sapiens
gctggaggtagggaggtcctgt

SEQ ID NO: 8587287 - DNA, 22 bp, Homo sapiens
gctggaggtttcacctgagttt

SEQ ID NO: 8587288 - DNA, 22 bp, Homo sapiens
gctggaggtggtgagaaaaggt

SEQ ID NO: 8587289 - DNA, 22 bp, Homo sapiens
gctggaggtggtgagaaaaggt

SEQ ID NO: 8587290 - DNA, 22 bp, Homo sapiens
gctggaggtggtgagaaaaggt

SEQ ID NO: 8587291 - DNA, 22 bp, Homo sapiens
gctggagtatctggggaaggag

SEQ ID NO: 8587292 - DNA, 22 bp, Homo sapiens
gctggagtatctggggaaggag

SEQ ID NO: 8587293 - DNA, 22 bp, Homo sapiens
gctggagtccagtggcatgatc

SEQ ID NO: 8587294 - DNA, 22 bp, Homo sapiens
gctggaggggtaataggatggg

SEQ ID NO: 8587295 - DNA, 22 bp, Homo sapiens
gctggaggggtaataggatggg

SEQ ID NO: 8587296 - DNA, 18 bp, Homo sapiens
gctgctggtggagggagc

SEQ ID NO: 8587297 - DNA, 22 bp, Homo sapiens
gctgctggtcctcagagctcat

SEQ ID NO: 8587298 - DNA, 22 bp, Homo sapiens
gctgctggggtggagaaacgct

SEQ ID NO: 8587299 - DNA, 22 bp, Homo sapiens
gctgctggggtggagaaacgct

SEQ ID NO: 8587300 - DNA, 22 bp, Homo sapiens
gctgctgggtccctctgtgcca

SEQ ID NO: 8587301 - DNA, 22 bp, Homo sapiens
gctgctgggtccctctgtgcca

SEQ ID NO: 8587302 - DNA, 19 bp, Homo sapiens
gctgctggctctggctgga

SEQ ID NO: 8587303 - DNA, 19 bp, Homo sapiens
gctgctggctctggctgga

SEQ ID NO: 8587304 - DNA, 22 bp, Homo sapiens
gctgctgggatcctgggtctca

SEQ ID NO: 8587305 - DNA, 22 bp, Homo sapiens
gctgctgggagggatcgtaaat

SEQ ID NO: 8587306 - DNA, 22 bp, Homo sapiens
gctgctgggaatgaacagtgtt

SEQ ID NO: 8587307 - DNA, 22 bp, Homo sapiens
gctgctggcttcctgctgtttt

SEQ ID NO: 8587308 - DNA, 22 bp, Homo sapiens
gctgctggcttcctgctgtttt

SEQ ID NO: 8587309 - DNA, 22 bp, Homo sapiens
gctgctggggccttccctcggg

SEQ ID NO: 8587310 - DNA, 22 bp, Homo sapiens
gctgctgggggaacagttaaaa

SEQ ID NO: 8587311 - DNA, 22 bp, Homo sapiens
gctgctggggtcacatggtaag

SEQ ID NO: 8587312 - DNA, 22 bp, Homo sapiens
gctgctgggatcctgggtctca

SEQ ID NO: 8587313 - DNA, 22 bp, Homo sapiens
gctgctgggcaccccctgagct

SEQ ID NO: 8587314 - DNA, 22 bp, Homo sapiens
gctgctgggcaccccctgagct

SEQ ID NO: 8587315 - DNA, 22 bp, Homo sapiens
gctgctggggccttccctcggg

SEQ ID NO: 8587316 - DNA, 22 bp, Homo sapiens
gctgctggaagcatgcgatgaa

SEQ ID NO: 8587317 - DNA, 22 bp, Homo sapiens
gctgcagggagctggaaggctc

SEQ ID NO: 8587318 - DNA, 22 bp, Homo sapiens
gctgcagggagctggaaggctc

SEQ ID NO: 8587319 - DNA, 21 bp, Homo sapiens
gctgcagggcccagggcaccc

SEQ ID NO: 8587320 - DNA, 21 bp, Homo sapiens
gctgcagggcccagggcaccc

SEQ ID NO: 8587321 - DNA, 22 bp, Homo sapiens
gctgcaggggggtctggacttg

SEQ ID NO: 8587322 - DNA, 22 bp, Homo sapiens
gctgcaggggggtctggacttg

SEQ ID NO: 8587323 - DNA, 22 bp, Homo sapiens
gctgcagggaatgtatggattt

SEQ ID NO: 8587324 - DNA, 22 bp, Homo sapiens
gctgcagggaatgtatggattt

SEQ ID NO: 8587325 - DNA, 22 bp, Homo sapiens
gctgcagggagctggaaggctc

SEQ ID NO: 8587326 - DNA, 22 bp, Homo sapiens
gctgcaggcggccgtggtggcg

SEQ ID NO: 8587327 - DNA, 22 bp, Homo sapiens
gctgcctcccagagccctgcag

SEQ ID NO: 8587328 - DNA, 20 bp, Homo sapiens
gctgaggggtctatggcata

SEQ ID NO: 8587329 - DNA, 22 bp, Homo sapiens
gctgagtgtaatgatggcagag

SEQ ID NO: 8587330 - DNA, 22 bp, Homo sapiens
gctgcaggcattttcctgggca

SEQ ID NO: 8587331 - DNA, 22 bp, Homo sapiens
gctgcaggcagaatctcccaat

SEQ ID NO: 8587332 - DNA, 18 bp, Homo sapiens
gctgcaggcgcctgcggt

SEQ ID NO: 8587333 - DNA, 18 bp, Homo sapiens
gctgcaggcgcctgcggt

SEQ ID NO: 8587334 - DNA, 22 bp, Homo sapiens
gctgcaggcgcctgcggtctct

SEQ ID NO: 8587335 - DNA, 22 bp, Homo sapiens
gctcccagactgaccagaggtg

SEQ ID NO: 8587336 - DNA, 22 bp, Homo sapiens
gctcccagcaattgaggcagcc

SEQ ID NO: 8587337 - DNA, 22 bp, Homo sapiens
gctcagggcctggctgcggact

SEQ ID NO: 8587338 - DNA, 22 bp, Homo sapiens
gctcagtgtggtcctcagatgt

SEQ ID NO: 8587339 - DNA, 22 bp, Homo sapiens
gctcagtgtgcacgagtactct

SEQ ID NO: 8587340 - DNA, 22 bp, Homo sapiens
gctcagtgtggtcctcagatgt

SEQ ID NO: 8587341 - DNA, 22 bp, Homo sapiens
gctaggaggccctgcacgctta

SEQ ID NO: 8587342 - DNA, 17 bp, Homo sapiens
gctaggagagggaggag

SEQ ID NO: 8587343 - DNA, 22 bp, Homo sapiens
gctaggagattgagctctgaag

SEQ ID NO: 8587344 - DNA, 22 bp, Homo sapiens
gctagggaacctcttctgagga

SEQ ID NO: 8587345 - DNA, 22 bp, Homo sapiens
gctagggactagggaaggagca

SEQ ID NO: 8587346 - DNA, 22 bp, Homo sapiens
gcctggcaggaatctcagtgct

SEQ ID NO: 8587347 - DNA, 22 bp, Homo sapiens
gcctggagttcagccaagtccc

SEQ ID NO: 8587348 - DNA, 22 bp, Homo sapiens
gctctgtgccagggctgggcca

SEQ ID NO: 8587349 - DNA, 22 bp, Homo sapiens
gctctgtgccacatgcagtgtt

SEQ ID NO: 8587350 - DNA, 22 bp, Homo sapiens
gctctctgccatatgaggatac

SEQ ID NO: 8587351 - DNA, 22 bp, Homo sapiens
gctctctggctagtccatcggg

SEQ ID NO: 8587352 - DNA, 22 bp, Homo sapiens
gctctctgggtgtgtctagata

SEQ ID NO: 8587353 - DNA, 22 bp, Homo sapiens
gctctgtagtatttagtaaata

SEQ ID NO: 8587354 - DNA, 22 bp, Homo sapiens
gctctctgtcgttatgcttcat

SEQ ID NO: 8587355 - DNA, 22 bp, Homo sapiens
gctctctgcaagtcagcagcct

SEQ ID NO: 8587356 - DNA, 21 bp, Homo sapiens
gctctctgcatggtggctcag

SEQ ID NO: 8587357 - DNA, 22 bp, Homo sapiens
gctctctgcagcctccttggag

SEQ ID NO: 8587358 - DNA, 22 bp, Homo sapiens
gctctctgaggtgctggcagag

SEQ ID NO: 8587359 - DNA, 22 bp, Homo sapiens
gctcccagcattgcttcccagg

SEQ ID NO: 8587360 - DNA, 20 bp, Homo sapiens
gctcccagcctgcagtcccc

SEQ ID NO: 8587361 - DNA, 22 bp, Homo sapiens
gtttcacagtctgcagaatttt

SEQ ID NO: 8587362 - DNA, 22 bp, Homo sapiens
gtttcacacatcctgcacatag

SEQ ID NO: 8587363 - DNA, 22 bp, Homo sapiens
gtttcaaataggtttcagcaaa

SEQ ID NO: 8587364 - DNA, 22 bp, Homo sapiens
gtttcaaaggtgtcaggcagtt

SEQ ID NO: 8587365 - DNA, 22 bp, Homo sapiens
gtttcaaagtcagaaaaggagg

SEQ ID NO: 8587366 - DNA, 22 bp, Homo sapiens
gtttatgaatgttactatagag

SEQ ID NO: 8587367 - DNA, 22 bp, Homo sapiens
gtttatgaatgtgtcagacata

SEQ ID NO: 8587368 - DNA, 22 bp, Homo sapiens
gtttatgaggaaaagttatgat

SEQ ID NO: 8587369 - DNA, 22 bp, Homo sapiens
gttctggaggagagcctggtgt

SEQ ID NO: 8587370 - DNA, 21 bp, Homo sapiens
gttctggaggctgcaagtcca

SEQ ID NO: 8587371 - DNA, 21 bp, Homo sapiens
gttattggttacactgcactt

SEQ ID NO: 8587372 - DNA, 22 bp, Homo sapiens
gttattgggtgcctcaggccct

SEQ ID NO: 8587373 - DNA, 20 bp, Homo sapiens
gttattggtcatttttgcca

SEQ ID NO: 8587374 - DNA, 22 bp, Homo sapiens
gttattggaaagcctggagggc

SEQ ID NO: 8587375 - DNA, 20 bp, Homo sapiens
gttattggaaatattgtgtg

SEQ ID NO: 8587376 - DNA, 22 bp, Homo sapiens
gttattggcagcatttcagagt

SEQ ID NO: 8587377 - DNA, 22 bp, Homo sapiens
gtgttcaaaatgtaggtagatt

SEQ ID NO: 8587378 - DNA, 21 bp, Homo sapiens
gtgctgggacacagccaggct

SEQ ID NO: 8587379 - DNA, 22 bp, Homo sapiens
gtgctggctggggcatcaggca

SEQ ID NO: 8587380 - DNA, 22 bp, Homo sapiens
taaaagagaatggataacagag

SEQ ID NO: 8587381 - DNA, 22 bp, Homo sapiens
taaaacttctcatttttatggt

SEQ ID NO: 8587382 - DNA, 22 bp, Homo sapiens
taaagagcacgcttttctctct

SEQ ID NO: 8587383 - DNA, 22 bp, Homo sapiens
taaagagccattgtatggtttt

SEQ ID NO: 8587384 - DNA, 22 bp, Homo sapiens
taaagagcgatatgctttaaag

SEQ ID NO: 8587385 - DNA, 22 bp, Homo sapiens
taaagattgctcaaaactgtga

SEQ ID NO: 8587386 - DNA, 22 bp, Homo sapiens
taaatgtggagactcaggagtc

SEQ ID NO: 8587387 - DNA, 22 bp, Homo sapiens
taagagaactggatagatagga

SEQ ID NO: 8587388 - DNA, 22 bp, Homo sapiens
taagagcctgtgctttgagttc

SEQ ID NO: 8587389 - DNA, 22 bp, Homo sapiens
taagagctcccttctccttgca

SEQ ID NO: 8587390 - DNA, 22 bp, Homo sapiens
taagaggatatttggccagaag

SEQ ID NO: 8587391 - DNA, 22 bp, Homo sapiens
taagacatgtccaggctgtgag

SEQ ID NO: 8587392 - DNA, 22 bp, Homo sapiens
taagacaaatactatttcaaga

SEQ ID NO: 8587393 - DNA, 22 bp, Homo sapiens
taagacaagcctcgcatttgta

SEQ ID NO: 8587394 - DNA, 22 bp, Homo sapiens
taagacaattcttcagtcacaa

SEQ ID NO: 8587395 - DNA, 22 bp, Homo sapiens
tacatggatgttatccttactg

SEQ ID NO: 8587396 - DNA, 22 bp, Homo sapiens
tacagtgaggtggtttccttta

SEQ ID NO: 8587397 - DNA, 22 bp, Homo sapiens
tacagtgtatgtatttgtaggt

SEQ ID NO: 8587398 - DNA, 20 bp, Homo sapiens
tacagacatgacaataatgg

SEQ ID NO: 8587399 - DNA, 22 bp, Homo sapiens
tacagacattcaattttgaccc

SEQ ID NO: 8587400 - DNA, 22 bp, Homo sapiens
taccagggaacagggatattaa

SEQ ID NO: 8587401 - DNA, 22 bp, Homo sapiens
taccaggagttacaggcagcag

SEQ ID NO: 8587402 - DNA, 22 bp, Homo sapiens
tactacaaggccgaagctctca

SEQ ID NO: 8587403 - DNA, 23 bp, Homo sapiens
tactataacgctgtgtcagctcc

SEQ ID NO: 8587404 - DNA, 22 bp, Homo sapiens
tacacacagaggccatgggatt

SEQ ID NO: 8587405 - DNA, 22 bp, Homo sapiens
tacacacagaggccatgggatt

SEQ ID NO: 8587406 - DNA, 22 bp, Homo sapiens
tacagacaaagagcatgcggta

SEQ ID NO: 8587407 - DNA, 22 bp, Homo sapiens
tacagacagtttttcagatatt

SEQ ID NO: 8587408 - DNA, 22 bp, Homo sapiens
tacagacaaagtgctatagggt

SEQ ID NO: 8587409 - DNA, 22 bp, Homo sapiens
tacagacagacttcccaccctc

SEQ ID NO: 8587410 - DNA, 22 bp, Homo sapiens
tacaagaggtatatagaaacag

SEQ ID NO: 8587411 - DNA, 22 bp, Homo sapiens
tacaacatgtggtcctttatga

SEQ ID NO: 8587412 - DNA, 22 bp, Homo sapiens
taagcattaactctgctgcaag

SEQ ID NO: 8587413 - DNA, 22 bp, Homo sapiens
taatataccaaactgtaatttt

SEQ ID NO: 8587414 - DNA, 22 bp, Homo sapiens
taatatatacctttgttaggaa

SEQ ID NO: 8587415 - DNA, 22 bp, Homo sapiens
taatatacttcccatagtttga

SEQ ID NO: 8587416 - DNA, 22 bp, Homo sapiens
tagcaaaagctcaacaggaagg

SEQ ID NO: 8587417 - DNA, 22 bp, Homo sapiens
tagcaaaatgtggatgtagttg

SEQ ID NO: 8587418 - DNA, 22 bp, Homo sapiens
tagcagggtaaatgtagatgga

SEQ ID NO: 8587419 - DNA, 18 bp, Homo sapiens
tagcagggcttgtccttt

SEQ ID NO: 8587420 - DNA, 22 bp, Homo sapiens
tagcaggggtagatagagtgtg

SEQ ID NO: 8587421 - DNA, 22 bp, Homo sapiens
tagcagggtctcaggagtcagg

SEQ ID NO: 8587422 - DNA, 22 bp, Homo sapiens
tagcagggtccaatgtgaggca

SEQ ID NO: 8587423 - DNA, 22 bp, Homo sapiens
tagctgggaattatctggttgc

SEQ ID NO: 8587424 - DNA, 22 bp, Homo sapiens
tagctgggaattatctggttgc

SEQ ID NO: 8587425 - DNA, 22 bp, Homo sapiens
tagcaggaaacctgtgttgagg

SEQ ID NO: 8587426 - DNA, 22 bp, Homo sapiens
tagcaggaaggttcagggccct

SEQ ID NO: 8587427 - DNA, 22 bp, Homo sapiens
tagcaggagcagcctgcctaga

SEQ ID NO: 8587428 - DNA, 22 bp, Homo sapiens
tagcaggaattggctgcagctg

SEQ ID NO: 8587429 - DNA, 22 bp, Homo sapiens
tagcagggagggccagtgtcaa

SEQ ID NO: 8587430 - DNA, 22 bp, Homo sapiens
tagcagggaaggtgtgctgagc

SEQ ID NO: 8587431 - DNA, 22 bp, Homo sapiens
tagcagggaagatgatcagaat

SEQ ID NO: 8587432 - DNA, 22 bp, Homo sapiens
tagcagggatacaaggtcgcct

SEQ ID NO: 8587433 - DNA, 22 bp, Homo sapiens
tagcagggccaggctgggaacc

SEQ ID NO: 8587434 - DNA, 22 bp, Homo sapiens
tagcaggaggcagttcctcgct

SEQ ID NO: 8587435 - DNA, 22 bp, Homo sapiens
tagatataggacagtactgtat

SEQ ID NO: 8587436 - DNA, 22 bp, Homo sapiens
tagatataaggtccttagaaca

SEQ ID NO: 8587437 - DNA, 21 bp, Homo sapiens
tagatactgtattaaacctag

SEQ ID NO: 8587438 - DNA, 22 bp, Homo sapiens
tagagtctagagtgggaccgag

SEQ ID NO: 8587439 - DNA, 22 bp, Homo sapiens
tagagtatagctaactgtatta

SEQ ID NO: 8587440 - DNA, 22 bp, Homo sapiens
tagagagagctgtggtggctct

SEQ ID NO: 8587441 - DNA, 22 bp, Homo sapiens
tagactggtgaattagggggaa

SEQ ID NO: 8587442 - DNA, 22 bp, Homo sapiens
tagacaggaaacattaggatgg

SEQ ID NO: 8587443 - DNA, 22 bp, Homo sapiens
tagaacatgctcatgtataaat

SEQ ID NO: 8587444 - DNA, 22 bp, Homo sapiens
tagggcagagtccaggatgggc

SEQ ID NO: 8587445 - DNA, 22 bp, Homo sapiens
tagggcagagtccaggatgggc

SEQ ID NO: 8587446 - DNA, 22 bp, Homo sapiens
tagggcagccacccaggctgct

SEQ ID NO: 8587447 - DNA, 22 bp, Homo sapiens
tagggcagattcggtggagttt

SEQ ID NO: 8587448 - DNA, 22 bp, Homo sapiens
tagggcagccttatagctccca

SEQ ID NO: 8587449 - DNA, 22 bp, Homo sapiens
tagggcagctgcatcaggcact

SEQ ID NO: 8587450 - DNA, 22 bp, Homo sapiens
tagggcagccttatagctccca

SEQ ID NO: 8587451 - DNA, 23 bp, Homo sapiens
tagggcagctgggagggacatgc

SEQ ID NO: 8587452 - DNA, 23 bp, Homo sapiens
tagggcagctgggagggacatgc

SEQ ID NO: 8587453 - DNA, 23 bp, Homo sapiens
tagggcagctgggagggacatgc

SEQ ID NO: 8587454 - DNA, 22 bp, Homo sapiens
tagggctgtgtctccaggacca

SEQ ID NO: 8587455 - DNA, 22 bp, Homo sapiens
taggccagattactagagtagg

SEQ ID NO: 8587456 - DNA, 22 bp, Homo sapiens
taggccaggaatcagcaagctt

SEQ ID NO: 8587457 - DNA, 22 bp, Homo sapiens
taggccaggaatcagcaagctt

SEQ ID NO: 8587458 - DNA, 22 bp, Homo sapiens
taggccagcccttagtcctgtc

SEQ ID NO: 8587459 - DNA, 23 bp, Homo sapiens
taggccagggtgacctggggaga

SEQ ID NO: 8587460 - DNA, 22 bp, Homo sapiens
taggccaggagtcagacagatt

SEQ ID NO: 8587461 - DNA, 22 bp, Homo sapiens
taggccaggagtcagacagatt

SEQ ID NO: 8587462 - DNA, 22 bp, Homo sapiens
taggccagtaaaatgtttcagt

SEQ ID NO: 8587463 - DNA, 22 bp, Homo sapiens
tagctgggagtgtctgatgggt

SEQ ID NO: 8587464 - DNA, 22 bp, Homo sapiens
tagctgggttgaggtcatctac

SEQ ID NO: 8587465 - DNA, 22 bp, Homo sapiens
tagctgggtctctgttttctca

SEQ ID NO: 8587466 - DNA, 22 bp, Homo sapiens
tagctgggactactggccctgc

SEQ ID NO: 8587467 - DNA, 22 bp, Homo sapiens
tagctgggagtgtctgatgggt

SEQ ID NO: 8587468 - DNA, 22 bp, Homo sapiens
tagctggggctttcattcttgc

SEQ ID NO: 8587469 - DNA, 22 bp, Homo sapiens
tagtttcatctccaccctgccc

SEQ ID NO: 8587470 - DNA, 22 bp, Homo sapiens
tagtttaggtcgtacaagcaaa

SEQ ID NO: 8587471 - DNA, 22 bp, Homo sapiens
tagttctgtgtagctcaagagt

SEQ ID NO: 8587472 - DNA, 22 bp, Homo sapiens
tagtttactcatctataaaatg

SEQ ID NO: 8587473 - DNA, 22 bp, Homo sapiens
tagtttaccaaattgatcttcc

SEQ ID NO: 8587474 - DNA, 22 bp, Homo sapiens
taggggaggggatcatgtgctg

SEQ ID NO: 8587475 - DNA, 22 bp, Homo sapiens
tcaaataccagcaatttcatgt

SEQ ID NO: 8587476 - DNA, 22 bp, Homo sapiens
tcaaagtcatggctagtaatga

SEQ ID NO: 8587477 - DNA, 19 bp, Homo sapiens
tcaaagtctgagtcacttt

SEQ ID NO: 8587478 - DNA, 22 bp, Homo sapiens
tcaaagagctctatcttcaaaa

SEQ ID NO: 8587479 - DNA, 19 bp, Homo sapiens
tcaaagcaagcatgttctg

SEQ ID NO: 8587480 - DNA, 20 bp, Homo sapiens
tcaaagcaaagggagatgat

SEQ ID NO: 8587481 - DNA, 22 bp, Homo sapiens
tcaaagatgataggaaatcata

SEQ ID NO: 8587482 - DNA, 22 bp, Homo sapiens
tcaaagaacatcatctgaaatg

SEQ ID NO: 8587483 - DNA, 23 bp, Homo sapiens
tattacaattggtcttattaaga

SEQ ID NO: 8587484 - DNA, 22 bp, Homo sapiens
tattacaatttacattgcactt

SEQ ID NO: 8587485 - DNA, 22 bp, Homo sapiens
tattgtgagttcagactaaaaa

SEQ ID NO: 8587486 - DNA, 22 bp, Homo sapiens
tattgtgaagggaaaaatagtg

SEQ ID NO: 8587487 - DNA, 22 bp, Homo sapiens
tattgtgttttctctgtgcgga

SEQ ID NO: 8587488 - DNA, 22 bp, Homo sapiens
tatttaattagtgattgtagag

SEQ ID NO: 8587489 - DNA, 22 bp, Homo sapiens
tatttgcttttgtgccacagat

SEQ ID NO: 8587490 - DNA, 22 bp, Homo sapiens
tatttgctgacagtgctggagc

SEQ ID NO: 8587491 - DNA, 22 bp, Homo sapiens
tataaaacagaaagcactacct

SEQ ID NO: 8587492 - DNA, 22 bp, Homo sapiens
tatcacaggtgtgatttacatt

SEQ ID NO: 8587493 - DNA, 22 bp, Homo sapiens
tattaagatacgtagttgtaaa

SEQ ID NO: 8587494 - DNA, 22 bp, Homo sapiens
tattaataagtgactactagct

SEQ ID NO: 8587495 - DNA, 22 bp, Homo sapiens
tcatttatcatttgtgctgtag

SEQ ID NO: 8587496 - DNA, 22 bp, Homo sapiens
tcatttatattgtattctgtag

SEQ ID NO: 8587497 - DNA, 22 bp, Homo sapiens
tcatttggagccttcctgtttt

SEQ ID NO: 8587498 - DNA, 22 bp, Homo sapiens
tcatttatagctaaccttgaat

SEQ ID NO: 8587499 - DNA, 22 bp, Homo sapiens
tcatttatagaagtgggcagta

SEQ ID NO: 8587500 - DNA, 22 bp, Homo sapiens
tcatttataaggatgcaattaa

SEQ ID NO: 8587501 - DNA, 22 bp, Homo sapiens
tcattggttgtcacacagggag

SEQ ID NO: 8587502 - DNA, 21 bp, Homo sapiens
tccaacatgcctgatggtgcc

SEQ ID NO: 8587503 - DNA, 22 bp, Homo sapiens
tccaaagccgactgacatctga

SEQ ID NO: 8587504 - DNA, 22 bp, Homo sapiens
tcagtgttcttatttaattagg

SEQ ID NO: 8587505 - DNA, 22 bp, Homo sapiens
tcagtgttggcattcagaaatg

SEQ ID NO: 8587506 - DNA, 22 bp, Homo sapiens
tcagtgtttcagtttggaaatg

SEQ ID NO: 8587507 - DNA, 22 bp, Homo sapiens
tcagtgttggtcaagaatcagt

SEQ ID NO: 8587508 - DNA, 22 bp, Homo sapiens
tcagtgtttacatgcatccttg

SEQ ID NO: 8587509 - DNA, 22 bp, Homo sapiens
tcagtgttgtgcacatacaaaa

SEQ ID NO: 8587510 - DNA, 22 bp, Homo sapiens
tcagtgtttcctagagcatata

SEQ ID NO: 8587511 - DNA, 22 bp, Homo sapiens
tcagtgtttcctgtggtacagc

SEQ ID NO: 8587512 - DNA, 22 bp, Homo sapiens
tcagtgtttggtttcagaattg

SEQ ID NO: 8587513 - DNA, 22 bp, Homo sapiens
tcagtgttttccagggtctact

SEQ ID NO: 8587514 - DNA, 22 bp, Homo sapiens
tcagtgtttttaaagcaatata

SEQ ID NO: 8587515 - DNA, 21 bp, Homo sapiens
tcatctggtctggggcctgct

SEQ ID NO: 8587516 - DNA, 22 bp, Homo sapiens
tcagggcatccattgcctgttg

SEQ ID NO: 8587517 - DNA, 22 bp, Homo sapiens
tcagggcatctcttaagtggtg

SEQ ID NO: 8587518 - DNA, 22 bp, Homo sapiens
tcagggcatcatcatgaatata

SEQ ID NO: 8587519 - DNA, 22 bp, Homo sapiens
tcagggcatactcttcaaggtc

SEQ ID NO: 8587520 - DNA, 22 bp, Homo sapiens
tcagggcatggctgcacttggc

SEQ ID NO: 8587521 - DNA, 22 bp, Homo sapiens
tcagggccctggacaaccctcc

SEQ ID NO: 8587522 - DNA, 21 bp, Homo sapiens
tcagggcagtgggaggttcct

SEQ ID NO: 8587523 - DNA, 19 bp, Homo sapiens
tcagggcagtccggtcccc

SEQ ID NO: 8587524 - DNA, 22 bp, Homo sapiens
tcagggcaggttaacttgggtg

SEQ ID NO: 8587525 - DNA, 22 bp, Homo sapiens
tcagggcaggttaacttgggtg

SEQ ID NO: 8587526 - DNA, 22 bp, Homo sapiens
tcagggcaggacagtgtaggcc

SEQ ID NO: 8587527 - DNA, 22 bp, Homo sapiens
tcagggcaggcgagcagctgct

SEQ ID NO: 8587528 - DNA, 22 bp, Homo sapiens
tcaggcttggtgctccagtgcc

SEQ ID NO: 8587529 - DNA, 22 bp, Homo sapiens
tcaggctgtaaatggtgtgggt

SEQ ID NO: 8587530 - DNA, 19 bp, Homo sapiens
tcagctggcaggcctcctc

SEQ ID NO: 8587531 - DNA, 22 bp, Homo sapiens
tcagctggatgtggaagtgcta

SEQ ID NO: 8587532 - DNA, 22 bp, Homo sapiens
tcagctggagatgagaaccgaa

SEQ ID NO: 8587533 - DNA, 22 bp, Homo sapiens
tcagctggagatccttgttgtg

SEQ ID NO: 8587534 - DNA, 22 bp, Homo sapiens
tcagctggaagatggtgcagaa

SEQ ID NO: 8587535 - DNA, 22 bp, Homo sapiens
tcagctggagactgctcaatga

SEQ ID NO: 8587536 - DNA, 18 bp, Homo sapiens
tcagctggggctgcagcc

SEQ ID NO: 8587537 - DNA, 22 bp, Homo sapiens
tcagctggggccccctctgtcc

SEQ ID NO: 8587538 - DNA, 22 bp, Homo sapiens
tcagctgggaagttctcgcttg

SEQ ID NO: 8587539 - DNA, 22 bp, Homo sapiens
tcagctggcagttcagaggctg

SEQ ID NO: 8587540 - DNA, 22 bp, Homo sapiens
tcagctggcatcggctcaccca

SEQ ID NO: 8587541 - DNA, 22 bp, Homo sapiens
tcagctggcaggttctgggaag

SEQ ID NO: 8587542 - DNA, 22 bp, Homo sapiens
tcagctggtgaatggactcatc

SEQ ID NO: 8587543 - DNA, 18 bp, Homo sapiens
tcagctgggtttctgggt

SEQ ID NO: 8587544 - DNA, 22 bp, Homo sapiens
tcagctgggtgagtgttctgca

SEQ ID NO: 8587545 - DNA, 22 bp, Homo sapiens
tcagctggtgagtggatagaca

SEQ ID NO: 8587546 - DNA, 22 bp, Homo sapiens
tcagctggtgccactcagtcaa

SEQ ID NO: 8587547 - DNA, 22 bp, Homo sapiens
tcagctggtgtttcttctcctt

SEQ ID NO: 8587548 - DNA, 22 bp, Homo sapiens
tcaggaagggtggtccacaggg

SEQ ID NO: 8587549 - DNA, 22 bp, Homo sapiens
tcaggaagtataatcagattca

SEQ ID NO: 8587550 - DNA, 22 bp, Homo sapiens
tcaggaagggctcagtctgtgc

SEQ ID NO: 8587551 - DNA, 22 bp, Homo sapiens
tcaggaagggtggtccacaggg

SEQ ID NO: 8587552 - DNA, 22 bp, Homo sapiens
tcagctgctcaaatttatgtca

SEQ ID NO: 8587553 - DNA, 22 bp, Homo sapiens
tcagcattcctgaagacaagca

SEQ ID NO: 8587554 - DNA, 22 bp, Homo sapiens
tcagcattgtggcagagaatgg

SEQ ID NO: 8587555 - DNA, 22 bp, Homo sapiens
tcagcatttcagaagtggcata

SEQ ID NO: 8587556 - DNA, 22 bp, Homo sapiens
tcagcattttttgggtgtaact

SEQ ID NO: 8587557 - DNA, 22 bp, Homo sapiens
tcagatttactgcagagcagat

SEQ ID NO: 8587558 - DNA, 18 bp, Homo sapiens
tcagatttaactgtatcc

SEQ ID NO: 8587559 - DNA, 22 bp, Homo sapiens
tcagatttctagcgtttggcca

SEQ ID NO: 8587560 - DNA, 22 bp, Homo sapiens
tcagatttcttcttgcaacggc

SEQ ID NO: 8587561 - DNA, 22 bp, Homo sapiens
tcagatttatgaatatactatg

SEQ ID NO: 8587562 - DNA, 22 bp, Homo sapiens
tcagatttcctgttgaagaagt

SEQ ID NO: 8587563 - DNA, 22 bp, Homo sapiens
tcagattttattttcctgttac

SEQ ID NO: 8587564 - DNA, 20 bp, Homo sapiens
tcagatttttctaactttga

SEQ ID NO: 8587565 - DNA, 22 bp, Homo sapiens
tcagacaactctggaggctggc

SEQ ID NO: 8587566 - DNA, 22 bp, Homo sapiens
tcagacagagaagtacaatgag

SEQ ID NO: 8587567 - DNA, 22 bp, Homo sapiens
tcagacagaaagatgagtatgg

SEQ ID NO: 8587568 - DNA, 22 bp, Homo sapiens
tcagacagaaggactatttgaa

SEQ ID NO: 8587569 - DNA, 22 bp, Homo sapiens
tcagacagaggagctcgtgcag

SEQ ID NO: 8587570 - DNA, 22 bp, Homo sapiens
tcagaattggaacgtgaagatt

SEQ ID NO: 8587571 - DNA, 22 bp, Homo sapiens
tcagaattggacaatagaagca

SEQ ID NO: 8587572 - DNA, 22 bp, Homo sapiens
tcagaattgtggagaaagggga

SEQ ID NO: 8587573 - DNA, 22 bp, Homo sapiens
tcagcagggcctccttgtgcag

SEQ ID NO: 8587574 - DNA, 22 bp, Homo sapiens
tcagcagggctgggagctgtga

SEQ ID NO: 8587575 - DNA, 22 bp, Homo sapiens
tcagcagggcatactgagccta

SEQ ID NO: 8587576 - DNA, 22 bp, Homo sapiens
tcagcagggccatgctctctct

SEQ ID NO: 8587577 - DNA, 22 bp, Homo sapiens
tcagcagggaggctctgtgccc

SEQ ID NO: 8587578 - DNA, 22 bp, Homo sapiens
tcagcaggcaggaggcatgcca

SEQ ID NO: 8587579 - DNA, 22 bp, Homo sapiens
tcagcaggcccatcctccaggc

SEQ ID NO: 8587580 - DNA, 22 bp, Homo sapiens
tcagcaggctgtcagcaggggc

SEQ ID NO: 8587581 - DNA, 22 bp, Homo sapiens
tcagcaggcagaaatctgcaga

SEQ ID NO: 8587582 - DNA, 22 bp, Homo sapiens
tcagatttttgagatgtctgtt

SEQ ID NO: 8587583 - DNA, 22 bp, Homo sapiens
tcactgcaacctccacctcctg

SEQ ID NO: 8587584 - DNA, 22 bp, Homo sapiens
tcactgcaacctccacctcctg

SEQ ID NO: 8587585 - DNA, 22 bp, Homo sapiens
tcactgcaacctccacctcctg

SEQ ID NO: 8587586 - DNA, 22 bp, Homo sapiens
tcactgcaacctccacctcccg

SEQ ID NO: 8587587 - DNA, 22 bp, Homo sapiens
tcactgcaacctccacctcccg

SEQ ID NO: 8587588 - DNA, 22 bp, Homo sapiens
tcactgcaacctccacctcccg

SEQ ID NO: 8587589 - DNA, 22 bp, Homo sapiens
tcactgcaacctccacctcccg

SEQ ID NO: 8587590 - DNA, 22 bp, Homo sapiens
tcactgatttgcccttatcctg

SEQ ID NO: 8587591 - DNA, 22 bp, Homo sapiens
tcagaaagaacacaggcagtag

SEQ ID NO: 8587592 - DNA, 22 bp, Homo sapiens
tcagaaagacgaaacagatggg

SEQ ID NO: 8587593 - DNA, 22 bp, Homo sapiens
tcagaaagacgaaacagatggg

SEQ ID NO: 8587594 - DNA, 22 bp, Homo sapiens
tcacagtgacagccaatgtttt

SEQ ID NO: 8587595 - DNA, 22 bp, Homo sapiens
tcaagaaactgtgctacagagt

SEQ ID NO: 8587596 - DNA, 22 bp, Homo sapiens
tcaacacttgctggtttcctct

SEQ ID NO: 8587597 - DNA, 22 bp, Homo sapiens
tcaaatgagtgactcacacagg

SEQ ID NO: 8587598 - DNA, 22 bp, Homo sapiens
tcaacaattttgagatgagaca

SEQ ID NO: 8587599 - DNA, 22 bp, Homo sapiens
tcacatgctactgagccagacc

SEQ ID NO: 8587600 - DNA, 22 bp, Homo sapiens
tcctgagagcagagtccaggtg

SEQ ID NO: 8587601 - DNA, 20 bp, Homo sapiens
tcctgagacctgggaaggtt

SEQ ID NO: 8587602 - DNA, 22 bp, Homo sapiens
tcctctggttatacttgcaccc

SEQ ID NO: 8587603 - DNA, 22 bp, Homo sapiens
tcctctggggcgtggtcctgga

SEQ ID NO: 8587604 - DNA, 22 bp, Homo sapiens
tcctctgtggaccgggctttgg

SEQ ID NO: 8587605 - DNA, 22 bp, Homo sapiens
tcctgaggcctctgtgatgtga

SEQ ID NO: 8587606 - DNA, 22 bp, Homo sapiens
tcctgaggctaaagtgcagtgg

SEQ ID NO: 8587607 - DNA, 22 bp, Homo sapiens
tcctgaggttttaaaactattc

SEQ ID NO: 8587608 - DNA, 22 bp, Homo sapiens
tcctgaggactaacaggaagga

SEQ ID NO: 8587609 - DNA, 22 bp, Homo sapiens
tcctgaggaatgtgaagagaac

SEQ ID NO: 8587610 - DNA, 22 bp, Homo sapiens
tcctgaggaaagttcatgaatg

SEQ ID NO: 8587611 - DNA, 22 bp, Homo sapiens
tcctgagatgtggagctccatg

SEQ ID NO: 8587612 - DNA, 22 bp, Homo sapiens
tcctgagataggagttgaaggc

SEQ ID NO: 8587613 - DNA, 22 bp, Homo sapiens
tcctgagagtcaagaatgcagg

SEQ ID NO: 8587614 - DNA, 22 bp, Homo sapiens
tcctgcagccattagaggtcaa

SEQ ID NO: 8587615 - DNA, 22 bp, Homo sapiens
tcctgcagagacagaggcctca

SEQ ID NO: 8587616 - DNA, 22 bp, Homo sapiens
tcctgcagacatttacaccttt

SEQ ID NO: 8587617 - DNA, 22 bp, Homo sapiens
tcctgcctagcaggtgacctat

SEQ ID NO: 8587618 - DNA, 22 bp, Homo sapiens
tcctgcctaccttgcggaggtg

SEQ ID NO: 8587619 - DNA, 22 bp, Homo sapiens
tcctgcctcacagttgaagttt

SEQ ID NO: 8587620 - DNA, 22 bp, Homo sapiens
tcctgcctcaggctctggagta

SEQ ID NO: 8587621 - DNA, 22 bp, Homo sapiens
tcctgcctctccatgctaacta

SEQ ID NO: 8587622 - DNA, 22 bp, Homo sapiens
tcctgcctcttgccttcttcac

SEQ ID NO: 8587623 - DNA, 22 bp, Homo sapiens
tcctgcctgagcgtggaggagg

SEQ ID NO: 8587624 - DNA, 22 bp, Homo sapiens
tcctgcctcttttcttattcca

SEQ ID NO: 8587625 - DNA, 22 bp, Homo sapiens
tccattcaggccagtgcaaagt

SEQ ID NO: 8587626 - DNA, 22 bp, Homo sapiens
tccattcagaaatctggctaca

SEQ ID NO: 8587627 - DNA, 22 bp, Homo sapiens
tccattcttttgctgtcttcct

SEQ ID NO: 8587628 - DNA, 22 bp, Homo sapiens
tcccagagcagtactccaggag

SEQ ID NO: 8587629 - DNA, 23 bp, Homo sapiens
tcccagcctcttctcttgcatac

SEQ ID NO: 8587630 - DNA, 22 bp, Homo sapiens
tcccagcctcctgacagttttg

SEQ ID NO: 8587631 - DNA, 22 bp, Homo sapiens
tcccagccggtgcctgggtccc

SEQ ID NO: 8587632 - DNA, 22 bp, Homo sapiens
tcccagcccaggtatgatgata

SEQ ID NO: 8587633 - DNA, 22 bp, Homo sapiens
tcccagcattaatgcctgtcag

SEQ ID NO: 8587634 - DNA, 22 bp, Homo sapiens
tcccagcctggaccctgccagt

SEQ ID NO: 8587635 - DNA, 22 bp, Homo sapiens
tcccagcctgacagtgcatcaa

SEQ ID NO: 8587636 - DNA, 22 bp, Homo sapiens
tcccagccttatctcccctggc

SEQ ID NO: 8587637 - DNA, 22 bp, Homo sapiens
tcccaggcgcctggtggggagc

SEQ ID NO: 8587638 - DNA, 22 bp, Homo sapiens
tcccagcctttctttctccagc

SEQ ID NO: 8587639 - DNA, 22 bp, Homo sapiens
tcccagccttccagtctggttt

SEQ ID NO: 8587640 - DNA, 22 bp, Homo sapiens
tcccagccttccttgtggtgaa

SEQ ID NO: 8587641 - DNA, 22 bp, Homo sapiens
tccagggctgacttgggagagg

SEQ ID NO: 8587642 - DNA, 23 bp, Homo sapiens
tccaggctgggacttcaactggc

SEQ ID NO: 8587643 - DNA, 22 bp, Homo sapiens
tccagggcttggctgggacggt

SEQ ID NO: 8587644 - DNA, 22 bp, Homo sapiens
tccaggctggagtgcagtggcg

SEQ ID NO: 8587645 - DNA, 22 bp, Homo sapiens
tccaggctggagtgcagtggca

SEQ ID NO: 8587646 - DNA, 22 bp, Homo sapiens
tccaggctggctcttcaaaatt

SEQ ID NO: 8587647 - DNA, 22 bp, Homo sapiens
tccaggctggcctcgcgtgaca

SEQ ID NO: 8587648 - DNA, 18 bp, Homo sapiens
tccaggctggattgatga

SEQ ID NO: 8587649 - DNA, 21 bp, Homo sapiens
tccaggctggaaggggcgttg

SEQ ID NO: 8587650 - DNA, 22 bp, Homo sapiens
tccaggctggacatgaggcggg

SEQ ID NO: 8587651 - DNA, 22 bp, Homo sapiens
tccaggctagcctggtagagaa

SEQ ID NO: 8587652 - DNA, 22 bp, Homo sapiens
tccaggctagagtgcagtggcc

SEQ ID NO: 8587653 - DNA, 22 bp, Homo sapiens
tccaggctagaagtcacaggcc

SEQ ID NO: 8587654 - DNA, 22 bp, Homo sapiens
tccaggctacttggattcctgg

SEQ ID NO: 8587655 - DNA, 22 bp, Homo sapiens
tccaggctaattttgcattgtt

SEQ ID NO: 8587656 - DNA, 20 bp, Homo sapiens
tccaggccttgttctcagat

SEQ ID NO: 8587657 - DNA, 22 bp, Homo sapiens
tccctggcacaagaaggctgtc

SEQ ID NO: 8587658 - DNA, 22 bp, Homo sapiens
tcctcagcattagcacagacat

SEQ ID NO: 8587659 - DNA, 22 bp, Homo sapiens
tcctcagaatcacctggcagct

SEQ ID NO: 8587660 - DNA, 22 bp, Homo sapiens
tccctcagcttgtctccatgca

SEQ ID NO: 8587661 - DNA, 19 bp, Homo sapiens
tccctcagtctgccaggcc

SEQ ID NO: 8587662 - DNA, 20 bp, Homo sapiens
tcccaggctgggctccagct

SEQ ID NO: 8587663 - DNA, 22 bp, Homo sapiens
tcccaggctggcaggcagcagt

SEQ ID NO: 8587664 - DNA, 22 bp, Homo sapiens
tccctcagatgagctcctagca

SEQ ID NO: 8587665 - DNA, 19 bp, Homo sapiens
gaggtgtctttcctgagta

SEQ ID NO: 8587666 - DNA, 22 bp, Homo sapiens
gaggtgtctgttaggaataggc

SEQ ID NO: 8587667 - DNA, 22 bp, Homo sapiens
gagtaaaagttggattacaaag

SEQ ID NO: 8587668 - DNA, 22 bp, Homo sapiens
gagtaattttcttaaaacatca

SEQ ID NO: 8587669 - DNA, 22 bp, Homo sapiens
gaggtggctccttcagggaata

SEQ ID NO: 8587670 - DNA, 22 bp, Homo sapiens
gaggtgagtggatcacgaggtc

SEQ ID NO: 8587671 - DNA, 22 bp, Homo sapiens
gaggtgagtggatcacgaggtc

SEQ ID NO: 8587672 - DNA, 22 bp, Homo sapiens
gagggtgcaggcaagagcaaaa

SEQ ID NO: 8587673 - DNA, 22 bp, Homo sapiens
gaggtctgtgtcactttagtgc

SEQ ID NO: 8587674 - DNA, 22 bp, Homo sapiens
gaggctggggtctgcctttctg

SEQ ID NO: 8587675 - DNA, 22 bp, Homo sapiens
gaggctggtaggaaaggaaaca

SEQ ID NO: 8587676 - DNA, 22 bp, Homo sapiens
gaggcctgtcgctaggcctctg

SEQ ID NO: 8587677 - DNA, 22 bp, Homo sapiens
gaggcctggtttccagcatcct

SEQ ID NO: 8587678 - DNA, 22 bp, Homo sapiens
gagggccagagtcctggggtca

SEQ ID NO: 8587679 - DNA, 22 bp, Homo sapiens
gagggccagaaagttattgaga

SEQ ID NO: 8587680 - DNA, 22 bp, Homo sapiens
gagggccacttgaatgttttca

SEQ ID NO: 8587681 - DNA, 22 bp, Homo sapiens
gagggccacgttcagggctctc

SEQ ID NO: 8587682 - DNA, 22 bp, Homo sapiens
gagggagaaggactatcaggct

SEQ ID NO: 8587683 - DNA, 21 bp, Homo sapiens
gaggctgtctgctgctggcct

SEQ ID NO: 8587684 - DNA, 22 bp, Homo sapiens
gagggccagatcccaggaggaa

SEQ ID NO: 8587685 - DNA, 22 bp, Homo sapiens
gagggccagatcccaggaggaa

SEQ ID NO: 8587686 - DNA, 22 bp, Homo sapiens
gagggccagatcccaggaggaa

SEQ ID NO: 8587687 - DNA, 22 bp, Homo sapiens
gagggccagagtcctggggtca

SEQ ID NO: 8587688 - DNA, 22 bp, Homo sapiens
gagggccagcagcctcagcatg

SEQ ID NO: 8587689 - DNA, 22 bp, Homo sapiens
gagggccaggcggagacaggcg

SEQ ID NO: 8587690 - DNA, 22 bp, Homo sapiens
gagggccaggtagatatcagga

SEQ ID NO: 8587691 - DNA, 22 bp, Homo sapiens
gagggccaggcggagacaggcg

SEQ ID NO: 8587692 - DNA, 22 bp, Homo sapiens
gagggccaggcagcaagaaggc

SEQ ID NO: 8587693 - DNA, 22 bp, Homo sapiens
gagggccagcctgccaagggcc

SEQ ID NO: 8587694 - DNA, 22 bp, Homo sapiens
gagggccaggcagcaagaaggc

SEQ ID NO: 8587695 - DNA, 22 bp, Homo sapiens
gagggccattctgagggggtga

SEQ ID NO: 8587696 - DNA, 22 bp, Homo sapiens
gagggccattctgagggggtga

SEQ ID NO: 8587697 - DNA, 22 bp, Homo sapiens
gagctccacttagcaaggccac

SEQ ID NO: 8587698 - DNA, 22 bp, Homo sapiens
gagctccagcatctctgccaaa

SEQ ID NO: 8587699 - DNA, 22 bp, Homo sapiens
gagctcattcattcattgcctg

SEQ ID NO: 8587700 - DNA, 22 bp, Homo sapiens
gagctcatccccatggtccgtc

SEQ ID NO: 8587701 - DNA, 22 bp, Homo sapiens
gagcaggcctggggtgaggcct

SEQ ID NO: 8587702 - DNA, 22 bp, Homo sapiens
gagcaggccagcaatggaaggg

SEQ ID NO: 8587703 - DNA, 22 bp, Homo sapiens
gagcaggcaaagatgaaaggag

SEQ ID NO: 8587704 - DNA, 22 bp, Homo sapiens
gagcaggatgggagctggggcc

SEQ ID NO: 8587705 - DNA, 22 bp, Homo sapiens
gagcaggcaactctgcagtgcc

SEQ ID NO: 8587706 - DNA, 22 bp, Homo sapiens
gagcaggcaactctgcagtgcc

SEQ ID NO: 8587707 - DNA, 22 bp, Homo sapiens
gagcaggcattctagtggctga

SEQ ID NO: 8587708 - DNA, 22 bp, Homo sapiens
gagcaggcattctagtggctga

SEQ ID NO: 8587709 - DNA, 19 bp, Homo sapiens
gagcaggccacacatgtgt

SEQ ID NO: 8587710 - DNA, 17 bp, Homo sapiens
gaggacagggaagtagg

SEQ ID NO: 8587711 - DNA, 22 bp, Homo sapiens
gagctgggcacacgccacttga

SEQ ID NO: 8587712 - DNA, 22 bp, Homo sapiens
gagctgggattcatctatgtct

SEQ ID NO: 8587713 - DNA, 22 bp, Homo sapiens
gagctgggatttgaacctggga

SEQ ID NO: 8587714 - DNA, 22 bp, Homo sapiens
gagctgggatttgaacctggga

SEQ ID NO: 8587715 - DNA, 22 bp, Homo sapiens
gagctccagggaacagcagcta

SEQ ID NO: 8587716 - DNA, 22 bp, Homo sapiens
gagctgggtctccaccttggca

SEQ ID NO: 8587717 - DNA, 22 bp, Homo sapiens
gagctgggtgtttatttgccaa

SEQ ID NO: 8587718 - DNA, 22 bp, Homo sapiens
gagctgggtatatggctttatg

SEQ ID NO: 8587719 - DNA, 22 bp, Homo sapiens
gagctggtcagtttcaggagag

SEQ ID NO: 8587720 - DNA, 22 bp, Homo sapiens
gagctggtggtgagaaagctct

SEQ ID NO: 8587721 - DNA, 22 bp, Homo sapiens
gagctggtgatcagctggagga

SEQ ID NO: 8587722 - DNA, 20 bp, Homo sapiens
gaggatgcagacagagggca

SEQ ID NO: 8587723 - DNA, 22 bp, Homo sapiens
gaggatgcctgggtcggggaag

SEQ ID NO: 8587724 - DNA, 19 bp, Homo sapiens
gaggatgctcggtcccagg

SEQ ID NO: 8587725 - DNA, 22 bp, Homo sapiens
gaggatgctgcagtgcaggaca

SEQ ID NO: 8587726 - DNA, 22 bp, Homo sapiens
gaggccacggaagggagctgtg

SEQ ID NO: 8587727 - DNA, 22 bp, Homo sapiens
gaggccagactgccttttatga

SEQ ID NO: 8587728 - DNA, 22 bp, Homo sapiens
gaggccagatactctcttctgc

SEQ ID NO: 8587729 - DNA, 22 bp, Homo sapiens
gaggccagatactctcttctgc

SEQ ID NO: 8587730 - DNA, 22 bp, Homo sapiens
gaggccagaatgagtctctggg

SEQ ID NO: 8587731 - DNA, 22 bp, Homo sapiens
gaggccagaatgagtctctggg

SEQ ID NO: 8587732 - DNA, 22 bp, Homo sapiens
gaggccagaatgagctgaatgc

SEQ ID NO: 8587733 - DNA, 22 bp, Homo sapiens
gaggccagaagtgcctcgggct

SEQ ID NO: 8587734 - DNA, 22 bp, Homo sapiens
gaggccagaagtgcctcgggct

SEQ ID NO: 8587735 - DNA, 22 bp, Homo sapiens
gaggccagaagtctgagatcag

SEQ ID NO: 8587736 - DNA, 22 bp, Homo sapiens
gaggccagaagtctgagatcag

SEQ ID NO: 8587737 - DNA, 22 bp, Homo sapiens
gagaagcaatcagtggccaccc

SEQ ID NO: 8587738 - DNA, 22 bp, Homo sapiens
gagaagcaggtttagcagacaa

SEQ ID NO: 8587739 - DNA, 22 bp, Homo sapiens
gagagctgtccggctgagcagc

SEQ ID NO: 8587740 - DNA, 22 bp, Homo sapiens
gagagcaggaggcagcgggacg

SEQ ID NO: 8587741 - DNA, 22 bp, Homo sapiens
gagagccatggtggagatgggg

SEQ ID NO: 8587742 - DNA, 22 bp, Homo sapiens
gagagacagcacacagtgtggg

SEQ ID NO: 8587743 - DNA, 22 bp, Homo sapiens
gagcaagagtgttggactttga

SEQ ID NO: 8587744 - DNA, 22 bp, Homo sapiens
gagcaagactacaggcagatga

SEQ ID NO: 8587745 - DNA, 22 bp, Homo sapiens
gagcacagatcctggagccaca

SEQ ID NO: 8587746 - DNA, 22 bp, Homo sapiens
gagcacagaactaaatgctggt

SEQ ID NO: 8587747 - DNA, 22 bp, Homo sapiens
gagcacagaatcttcccatgca

SEQ ID NO: 8587748 - DNA, 22 bp, Homo sapiens
gagcagagaatccagctaagtg

SEQ ID NO: 8587749 - DNA, 22 bp, Homo sapiens
gagcacattcccaggagctgct

SEQ ID NO: 8587750 - DNA, 22 bp, Homo sapiens
gagcacattcctcctgtgaatt

SEQ ID NO: 8587751 - DNA, 20 bp, Homo sapiens
gagcacagtaatgactgcta

SEQ ID NO: 8587752 - DNA, 22 bp, Homo sapiens
gagcaggaaggccagaagggtc

SEQ ID NO: 8587753 - DNA, 22 bp, Homo sapiens
gagcaggaaggccagaagggtc

SEQ ID NO: 8587754 - DNA, 22 bp, Homo sapiens
gagcaggacgtgggaatgggaa

SEQ ID NO: 8587755 - DNA, 23 bp, Homo sapiens
gagcagagcgggcgggggtcctg

SEQ ID NO: 8587756 - DNA, 22 bp, Homo sapiens
gacctggggtaagcttggcaac

SEQ ID NO: 8587757 - DNA, 22 bp, Homo sapiens
gacatgtgagagctcggttttc

SEQ ID NO: 8587758 - DNA, 22 bp, Homo sapiens
gacctgcctgagctgcctctgc

SEQ ID NO: 8587759 - DNA, 22 bp, Homo sapiens
gacatgtgtctgcaagttgatc

SEQ ID NO: 8587760 - DNA, 22 bp, Homo sapiens
gacatgtgagcaagcgtgcggc

SEQ ID NO: 8587761 - DNA, 22 bp, Homo sapiens
gacatgtgctgtctcttaaatt

SEQ ID NO: 8587762 - DNA, 22 bp, Homo sapiens
gacagctgaaaaatgtaaggta

SEQ ID NO: 8587763 - DNA, 22 bp, Homo sapiens
gacagctgaacaggtgggataa

SEQ ID NO: 8587764 - DNA, 22 bp, Homo sapiens
gacagctgcctctgtgtagatc

SEQ ID NO: 8587765 - DNA, 22 bp, Homo sapiens
gacagctggcagtggaaaggtg

SEQ ID NO: 8587766 - DNA, 22 bp, Homo sapiens
gacagcatgagagatgccagtg

SEQ ID NO: 8587767 - DNA, 22 bp, Homo sapiens
gacagcattccatctgcaggtt

SEQ ID NO: 8587768 - DNA, 22 bp, Homo sapiens
gacagcatgatcaaggagccca

SEQ ID NO: 8587769 - DNA, 22 bp, Homo sapiens
gacagcatctgtgtggcaggag

SEQ ID NO: 8587770 - DNA, 22 bp, Homo sapiens
gacagcatccaagagggaggga

SEQ ID NO: 8587771 - DNA, 22 bp, Homo sapiens
gacagcagtttttctctagggt

SEQ ID NO: 8587772 - DNA, 22 bp, Homo sapiens
gacagcagtcctggagttccca

SEQ ID NO: 8587773 - DNA, 22 bp, Homo sapiens
gacatctgaggccctcagagcc

SEQ ID NO: 8587774 - DNA, 22 bp, Homo sapiens
gacagctgggaggatgacataa

SEQ ID NO: 8587775 - DNA, 22 bp, Homo sapiens
gacagctggcagtggaaaggtg

SEQ ID NO: 8587776 - DNA, 22 bp, Homo sapiens
gacaaaactgagatcacactgt

SEQ ID NO: 8587777 - DNA, 22 bp, Homo sapiens
gacaaaacacattagtttaaaa

SEQ ID NO: 8587778 - DNA, 22 bp, Homo sapiens
gacagcagggaaagtccagacc

SEQ ID NO: 8587779 - DNA, 21 bp, Homo sapiens
gaagacaaatgggaatagctg

SEQ ID NO: 8587780 - DNA, 22 bp, Homo sapiens
gaagacaagctgagtgttgtcc

SEQ ID NO: 8587781 - DNA, 22 bp, Homo sapiens
gaagaaggtgccagaggcttac

SEQ ID NO: 8587782 - DNA, 22 bp, Homo sapiens
ctgtggagtttgtggcgctgac

SEQ ID NO: 8587783 - DNA, 19 bp, Homo sapiens
ctgtgggcggaggaggggc

SEQ ID NO: 8587784 - DNA, 22 bp, Homo sapiens
ctgtggctttctctgcctcctt

SEQ ID NO: 8587785 - DNA, 23 bp, Homo sapiens
ctgtggccacccctagctggagg

SEQ ID NO: 8587786 - DNA, 19 bp, Homo sapiens
ctgtgggtgtgcaagggtg

SEQ ID NO: 8587787 - DNA, 22 bp, Homo sapiens
ctgtgaggcctttggccagata

SEQ ID NO: 8587788 - DNA, 22 bp, Homo sapiens
ctgtgagggcagggaccagagg

SEQ ID NO: 8587789 - DNA, 22 bp, Homo sapiens
ctggttctgattttgctgcatt

SEQ ID NO: 8587790 - DNA, 22 bp, Homo sapiens
ctggttcctccatcagcaggaa

SEQ ID NO: 8587791 - DNA, 22 bp, Homo sapiens
ctgtcccacaagcagtgtgcac

SEQ ID NO: 8587792 - DNA, 22 bp, Homo sapiens
ctgggctcagtggctcatggct

SEQ ID NO: 8587793 - DNA, 22 bp, Homo sapiens
ctgggctcagtgtctcactcct

SEQ ID NO: 8587794 - DNA, 22 bp, Homo sapiens
ctgggctccactcccacagtgt

SEQ ID NO: 8587795 - DNA, 22 bp, Homo sapiens
ctgggctccactacttgctaac

SEQ ID NO: 8587796 - DNA, 22 bp, Homo sapiens
ctgggctcagcccatgctgtcc

SEQ ID NO: 8587797 - DNA, 22 bp, Homo sapiens
ctgggctcaagaagtcttccct

SEQ ID NO: 8587798 - DNA, 22 bp, Homo sapiens
ctgggctcagcaggccaaggcc

SEQ ID NO: 8587799 - DNA, 22 bp, Homo sapiens
ctgggctcaaatcctggccctg

SEQ ID NO: 8587800 - DNA, 22 bp, Homo sapiens
ctgggccctatggaagaaaggg

SEQ ID NO: 8587801 - DNA, 22 bp, Homo sapiens
ctgggccctgaagacagtcagg

SEQ ID NO: 8587802 - DNA, 22 bp, Homo sapiens
ctgggccctgaagacagtcagg

SEQ ID NO: 8587803 - DNA, 22 bp, Homo sapiens
ctgggcctcatccccagagttt

SEQ ID NO: 8587804 - DNA, 22 bp, Homo sapiens
ctgggcccaggcggctctcgga

SEQ ID NO: 8587805 - DNA, 22 bp, Homo sapiens
ctgggatggctttcctgcatta

SEQ ID NO: 8587806 - DNA, 22 bp, Homo sapiens
ctgggatgctccggcctggatg

SEQ ID NO: 8587807 - DNA, 22 bp, Homo sapiens
ctgggagtttctagagaaagac

SEQ ID NO: 8587808 - DNA, 22 bp, Homo sapiens
ctgggagtttgttagtaatgca

SEQ ID NO: 8587809 - DNA, 22 bp, Homo sapiens
ctgggaggcggaggttgcagtg

SEQ ID NO: 8587810 - DNA, 22 bp, Homo sapiens
ctggagctaataatccatctga

SEQ ID NO: 8587811 - DNA, 22 bp, Homo sapiens
ctgggagtccctggaatagctc

SEQ ID NO: 8587812 - DNA, 22 bp, Homo sapiens
ctgggagtcaccaggagcaagg

SEQ ID NO: 8587813 - DNA, 22 bp, Homo sapiens
ctgggagtcagtataagaagca

SEQ ID NO: 8587814 - DNA, 22 bp, Homo sapiens
ctgggagtccaggatacagatg

SEQ ID NO: 8587815 - DNA, 22 bp, Homo sapiens
ctgggaggcggaggttgcagtg

SEQ ID NO: 8587816 - DNA, 22 bp, Homo sapiens
ctgggagtactgggggatgtca

SEQ ID NO: 8587817 - DNA, 22 bp, Homo sapiens
ctggggctggtgaggcaggctc

SEQ ID NO: 8587818 - DNA, 18 bp, Homo sapiens
ctgggctcgagagatcct

SEQ ID NO: 8587819 - DNA, 22 bp, Homo sapiens
ctgggctctaagggagcaccgt

SEQ ID NO: 8587820 - DNA, 22 bp, Homo sapiens
ctgggctcctaaccatccaggt

SEQ ID NO: 8587821 - DNA, 22 bp, Homo sapiens
ctgggctccctcatgtgtctgc

SEQ ID NO: 8587822 - DNA, 22 bp, Homo sapiens
ctgggctccctcatgtgtctgc

SEQ ID NO: 8587823 - DNA, 22 bp, Homo sapiens
ctggggtggagattggcaatct

SEQ ID NO: 8587824 - DNA, 22 bp, Homo sapiens
ctggggtatctgccacaactct

SEQ ID NO: 8587825 - DNA, 22 bp, Homo sapiens
ctggggtgagcagaaacagggg

SEQ ID NO: 8587826 - DNA, 22 bp, Homo sapiens
ctgggggtcgcgcctctgggca

SEQ ID NO: 8587827 - DNA, 22 bp, Homo sapiens
ctgggtgttcaggagctgggct

SEQ ID NO: 8587828 - DNA, 22 bp, Homo sapiens
ctgggtgttgggtactgaccgt

SEQ ID NO: 8587829 - DNA, 22 bp, Homo sapiens
ctgggtgtagatggaagtttgg

SEQ ID NO: 8587830 - DNA, 22 bp, Homo sapiens
ctgggtgtagcccagtatgagg

SEQ ID NO: 8587831 - DNA, 22 bp, Homo sapiens
ctgggtgtcaggagacatgatg

SEQ ID NO: 8587832 - DNA, 22 bp, Homo sapiens
ctgggtgttcacccgaggcgct

SEQ ID NO: 8587833 - DNA, 22 bp, Homo sapiens
ctgggtgtgggtcaagcaacca

SEQ ID NO: 8587834 - DNA, 22 bp, Homo sapiens
ctgggttgccctgggcctgtga

SEQ ID NO: 8587835 - DNA, 22 bp, Homo sapiens
ctgggttggggttacatgactg

SEQ ID NO: 8587836 - DNA, 22 bp, Homo sapiens
ctggtggttcaggagaatggct

SEQ ID NO: 8587837 - DNA, 22 bp, Homo sapiens
ctggtgctggagcctagtccct

SEQ ID NO: 8587838 - DNA, 22 bp, Homo sapiens
cttggagatacagaggacattt

SEQ ID NO: 8587839 - DNA, 22 bp, Homo sapiens
cttggagacaggacaggcagaa

SEQ ID NO: 8587840 - DNA, 22 bp, Homo sapiens
cttcttcctgctgcagcctcca

SEQ ID NO: 8587841 - DNA, 22 bp, Homo sapiens
cttcttcccagcttccctcacc

SEQ ID NO: 8587842 - DNA, 22 bp, Homo sapiens
cttgcctacttgtcaaccagca

SEQ ID NO: 8587843 - DNA, 22 bp, Homo sapiens
cttcactgtttggttcacagca

SEQ ID NO: 8587844 - DNA, 22 bp, Homo sapiens
cttcactgggctcctgagaggg

SEQ ID NO: 8587845 - DNA, 22 bp, Homo sapiens
cttccaggacaccagggtagta

SEQ ID NO: 8587846 - DNA, 22 bp, Homo sapiens
cttcactgagtagtctagactc

SEQ ID NO: 8587847 - DNA, 22 bp, Homo sapiens
cttcacagtcaccctgctgtgt

SEQ ID NO: 8587848 - DNA, 22 bp, Homo sapiens
cttccctgataagagcctcaga

SEQ ID NO: 8587849 - DNA, 19 bp, Homo sapiens
cttcccctgttacctcact

SEQ ID NO: 8587850 - DNA, 19 bp, Homo sapiens
cttctgtgatacatcagtc

SEQ ID NO: 8587851 - DNA, 22 bp, Homo sapiens
cttctgtgaagagcagaaccat

SEQ ID NO: 8587852 - DNA, 22 bp, Homo sapiens
cttctgtgaccaccagcagccc

SEQ ID NO: 8587853 - DNA, 22 bp, Homo sapiens
cttctgtgagtcagtgtttctg

SEQ ID NO: 8587854 - DNA, 20 bp, Homo sapiens
ctttggcaatgagaacaggg

SEQ ID NO: 8587855 - DNA, 22 bp, Homo sapiens
gaaattctgtgtcccagagtgc

SEQ ID NO: 8587856 - DNA, 22 bp, Homo sapiens
gaagaaggaagatcatgcttga

SEQ ID NO: 8587857 - DNA, 22 bp, Homo sapiens
ctcagaaagggttgctgagggc

SEQ ID NO: 8587858 - DNA, 22 bp, Homo sapiens
ctcagagaacctaagcggagga

SEQ ID NO: 8587859 - DNA, 22 bp, Homo sapiens
ctcagagaagtctttgctaaac

SEQ ID NO: 8587860 - DNA, 22 bp, Homo sapiens
ctcagagaaaaggagcaagggt

SEQ ID NO: 8587861 - DNA, 22 bp, Homo sapiens
ttctttctctccacaaggcttg

SEQ ID NO: 8587862 - DNA, 21 bp, Homo sapiens
ctcagagaaatgtctgggagc

SEQ ID NO: 8587863 - DNA, 22 bp, Homo sapiens
ctcagagagggcaccagggcca

SEQ ID NO: 8587864 - DNA, 22 bp, Homo sapiens
ctcagagaggttgaacaacttg

SEQ ID NO: 8587865 - DNA, 19 bp, Homo sapiens
ctcagagaggggcagtgcc

SEQ ID NO: 8587866 - DNA, 22 bp, Homo sapiens
ctcagagagtgaattcctgcct

SEQ ID NO: 8587867 - DNA, 17 bp, Homo sapiens
ctcagagcaggacagaa

SEQ ID NO: 8587868 - DNA, 22 bp, Homo sapiens
ctcagagcccagggtacacccg

SEQ ID NO: 8587869 - DNA, 22 bp, Homo sapiens
ctcagagccagttagcaggtgc

SEQ ID NO: 8587870 - DNA, 22 bp, Homo sapiens
ctcagagccagttagcaggtgc

SEQ ID NO: 8587871 - DNA, 18 bp, Homo sapiens
ttctggctcactcatgct

SEQ ID NO: 8587872 - DNA, 22 bp, Homo sapiens
ctataattatgctcaaaatgta

SEQ ID NO: 8587873 - DNA, 22 bp, Homo sapiens
ttctgcataggctatatttgtt

SEQ ID NO: 8587874 - DNA, 22 bp, Homo sapiens
ttctgcagtgttaacaatgtca

SEQ ID NO: 8587875 - DNA, 17 bp, Homo sapiens
ttctgcatgtgaagatg

SEQ ID NO: 8587876 - DNA, 22 bp, Homo sapiens
ttctgcatgaacagtttattcc

SEQ ID NO: 8587877 - DNA, 22 bp, Homo sapiens
ctagaggtagaggcagtgggaa

SEQ ID NO: 8587878 - DNA, 17 bp, Homo sapiens
cgtgtgcttgtgtgcac

SEQ ID NO: 8587879 - DNA, 23 bp, Homo sapiens
cgtgtccttcagggagagtgtgg

SEQ ID NO: 8587880 - DNA, 20 bp, Homo sapiens
cgtgtccttggcgggagagc

SEQ ID NO: 8587881 - DNA, 22 bp, Homo sapiens
cgtgtccttttagcttcaggtc

SEQ ID NO: 8587882 - DNA, 22 bp, Homo sapiens
ctcaggagtagttcagcagctg

SEQ ID NO: 8587883 - DNA, 22 bp, Homo sapiens
ctcaggagatgacagaaggtat

SEQ ID NO: 8587884 - DNA, 22 bp, Homo sapiens
ctcaggagcttcctcagcccat

SEQ ID NO: 8587885 - DNA, 22 bp, Homo sapiens
ctcaggaggatgactgccttgg

SEQ ID NO: 8587886 - DNA, 22 bp, Homo sapiens
ctcaggaggtggtagaggccct

SEQ ID NO: 8587887 - DNA, 19 bp, Homo sapiens
ctcagctgtagctcatgtg

SEQ ID NO: 8587888 - DNA, 22 bp, Homo sapiens
ctcagctggcaattctggctcc

SEQ ID NO: 8587889 - DNA, 22 bp, Homo sapiens
ctcagcttctacctcctgagtg

SEQ ID NO: 8587890 - DNA, 22 bp, Homo sapiens
ctcagctgtctcatgggtctgt

SEQ ID NO: 8587891 - DNA, 22 bp, Homo sapiens
ctcagctgtctcatgggtctgt

SEQ ID NO: 8587892 - DNA, 22 bp, Homo sapiens
ctcaggaaaggccatgcaaggg

SEQ ID NO: 8587893 - DNA, 22 bp, Homo sapiens
ctcaggaaccgcggcagcagcc

SEQ ID NO: 8587894 - DNA, 22 bp, Homo sapiens
ctcaggaagcctgtaatgtggg

SEQ ID NO: 8587895 - DNA, 22 bp, Homo sapiens
ctcaggagatgacagaaggtat

SEQ ID NO: 8587896 - DNA, 22 bp, Homo sapiens
ctcagggctctgcatgcacacg

SEQ ID NO: 8587897 - DNA, 22 bp, Homo sapiens
ttgccctgtcagtagaagtgca

SEQ ID NO: 8587898 - DNA, 22 bp, Homo sapiens
ttgccctgtcttaagctggcaa

SEQ ID NO: 8587899 - DNA, 22 bp, Homo sapiens
ttgcatagtgctgaggttcggg

SEQ ID NO: 8587900 - DNA, 22 bp, Homo sapiens
ttgcatcttctggttgagcccc

SEQ ID NO: 8587901 - DNA, 22 bp, Homo sapiens
ttggatcaaatttcatgctgtc

SEQ ID NO: 8587902 - DNA, 22 bp, Homo sapiens
ctccactcaccagatgccagga

SEQ ID NO: 8587903 - DNA, 22 bp, Homo sapiens
ctcagtctgtcttgtctgtgtt

SEQ ID NO: 8587904 - DNA, 22 bp, Homo sapiens
ttggaagattctgtgtctggtg

SEQ ID NO: 8587905 - DNA, 22 bp, Homo sapiens
ttggaagatctaacagaggcat

SEQ ID NO: 8587906 - DNA, 22 bp, Homo sapiens
ctccaggactgaggacagagct

SEQ ID NO: 8587907 - DNA, 22 bp, Homo sapiens
ctccaggactgaggacagagct

SEQ ID NO: 8587908 - DNA, 22 bp, Homo sapiens
ctccaggactcaggcccctggg

SEQ ID NO: 8587909 - DNA, 22 bp, Homo sapiens
ctccaggacccagtggctccag

SEQ ID NO: 8587910 - DNA, 22 bp, Homo sapiens
ctccaggacagattcagggcca

SEQ ID NO: 8587911 - DNA, 22 bp, Homo sapiens
ctccaggacactaacccaggct

SEQ ID NO: 8587912 - DNA, 22 bp, Homo sapiens
ctccaggaccagggctcctgga

SEQ ID NO: 8587913 - DNA, 22 bp, Homo sapiens
ctccaggacactaacccaggct

SEQ ID NO: 8587914 - DNA, 22 bp, Homo sapiens
ctccagagtcacactgcctggg

SEQ ID NO: 8587915 - DNA, 22 bp, Homo sapiens
ctccagaggttctcatctggga

SEQ ID NO: 8587916 - DNA, 22 bp, Homo sapiens
ctccagaggtccccgcggcact

SEQ ID NO: 8587917 - DNA, 22 bp, Homo sapiens
ctccagaggtccccgcggcact

SEQ ID NO: 8587918 - DNA, 22 bp, Homo sapiens
ctccagagggtcagactctgag

SEQ ID NO: 8587919 - DNA, 22 bp, Homo sapiens
ctccagaggcgacttgcatcac

SEQ ID NO: 8587920 - DNA, 22 bp, Homo sapiens
ctccagaggatgcaggtgaggg

SEQ ID NO: 8587921 - DNA, 22 bp, Homo sapiens
ctccagaggaaagcacatagtg

SEQ ID NO: 8587922 - DNA, 18 bp, Homo sapiens
ctccagagctgtgagaca

SEQ ID NO: 8587923 - DNA, 22 bp, Homo sapiens
ccttcagccagttttctttgtt

SEQ ID NO: 8587924 - DNA, 22 bp, Homo sapiens
ccttcagcctagaacttgagag

SEQ ID NO: 8587925 - DNA, 22 bp, Homo sapiens
ccttcagcctttgtttatcaga

SEQ ID NO: 8587926 - DNA, 18 bp, Homo sapiens
ccttcagctctgccagta

SEQ ID NO: 8587927 - DNA, 22 bp, Homo sapiens
ttataacatcaatcagagttaa

SEQ ID NO: 8587928 - DNA, 21 bp, Homo sapiens
ccttgaggcccaggccaggcc

SEQ ID NO: 8587929 - DNA, 22 bp, Homo sapiens
ttaagaggagatcatactggag

SEQ ID NO: 8587930 - DNA, 21 bp, Homo sapiens
ttaagagcttagcagtaggcc

SEQ ID NO: 8587931 - DNA, 22 bp, Homo sapiens
ttaagagcaacatatggtgaca

SEQ ID NO: 8587932 - DNA, 22 bp, Homo sapiens
ttaagagccaacttatccatct

SEQ ID NO: 8587933 - DNA, 18 bp, Homo sapiens
ttaagagctgaaagggga

SEQ ID NO: 8587934 - DNA, 22 bp, Homo sapiens
ttacaaagagtgttcttttcca

SEQ ID NO: 8587935 - DNA, 22 bp, Homo sapiens
cggagtcttgctatgttgccca

SEQ ID NO: 8587936 - DNA, 22 bp, Homo sapiens
cggaggttgaggctgcagtgag

SEQ ID NO: 8587937 - DNA, 22 bp, Homo sapiens
cggcagcaaaggaagccaggtc

SEQ ID NO: 8587938 - DNA, 22 bp, Homo sapiens
cggcagggctccatgcatttct

SEQ ID NO: 8587939 - DNA, 22 bp, Homo sapiens
cggcagggttggttttctctga

SEQ ID NO: 8587940 - DNA, 22 bp, Homo sapiens
cggcacagccgggcaaggctgg

SEQ ID NO: 8587941 - DNA, 22 bp, Homo sapiens
cggatgtctttgagggagagtc

SEQ ID NO: 8587942 - DNA, 22 bp, Homo sapiens
cggggctggcacaggtgaccac

SEQ ID NO: 8587943 - DNA, 22 bp, Homo sapiens
cgtggggcgggtggacacttgc

SEQ ID NO: 8587944 - DNA, 22 bp, Homo sapiens
cgtggggacccacgtgcagcac

SEQ ID NO: 8587945 - DNA, 22 bp, Homo sapiens
cgtgggctgcgcccagttcttc

SEQ ID NO: 8587946 - DNA, 22 bp, Homo sapiens
cggggccctggggctgaaggtc

SEQ ID NO: 8587947 - DNA, 22 bp, Homo sapiens
cggggccctggggctgaaggtc

SEQ ID NO: 8587948 - DNA, 22 bp, Homo sapiens
cggggagggcagaggctccctc

SEQ ID NO: 8587949 - DNA, 22 bp, Homo sapiens
cggggaagcggttctggcggta

SEQ ID NO: 8587950 - DNA, 22 bp, Homo sapiens
cggcaggtgtgctcactctgcc

SEQ ID NO: 8587951 - DNA, 22 bp, Homo sapiens
ttattgcaactttagggataga

SEQ ID NO: 8587952 - DNA, 22 bp, Homo sapiens
ttattgcaactcctaaatagag

SEQ ID NO: 8587953 - DNA, 20 bp, Homo sapiens
cgctccagtcgctggtgtgt

SEQ ID NO: 8587954 - DNA, 21 bp, Homo sapiens
cgctgccttgggagtggacct

SEQ ID NO: 8587955 - DNA, 22 bp, Homo sapiens
cgctgcctccaggtgcagcagg

SEQ ID NO: 8587956 - DNA, 22 bp, Homo sapiens
cgctgcagaagcgtgttcagga

SEQ ID NO: 8587957 - DNA, 22 bp, Homo sapiens
cgctgcagatgggagctggttg

SEQ ID NO: 8587958 - DNA, 22 bp, Homo sapiens
cctttggtaacattccaacctt

SEQ ID NO: 8587959 - DNA, 22 bp, Homo sapiens
cctttggtaacattccaacctt

SEQ ID NO: 8587960 - DNA, 22 bp, Homo sapiens
cctttggtaattctgtgtagag

SEQ ID NO: 8587961 - DNA, 22 bp, Homo sapiens
ttattgagtttacagctttaga

SEQ ID NO: 8587962 - DNA, 22 bp, Homo sapiens
ttattgagttgtaagagctctt

SEQ ID NO: 8587963 - DNA, 22 bp, Homo sapiens
ttattgagtatctgcttggtgt

SEQ ID NO: 8587964 - DNA, 16 bp, Homo sapiens
ttattgaggccaagga

SEQ ID NO: 8587965 - DNA, 23 bp, Homo sapiens
ttattgagggtgtagattggtgt

SEQ ID NO: 8587966 - DNA, 22 bp, Homo sapiens
tttccacactgcagccagcaaa

SEQ ID NO: 8587967 - DNA, 22 bp, Homo sapiens
tttccacaatttgagcagcaga

SEQ ID NO: 8587968 - DNA, 22 bp, Homo sapiens
tttctacaacacttctgaatct

SEQ ID NO: 8587969 - DNA, 22 bp, Homo sapiens
tttctacagaagatacactgct

SEQ ID NO: 8587970 - DNA, 22 bp, Homo sapiens
tttctacaatttttggcatgag

SEQ ID NO: 8587971 - DNA, 22 bp, Homo sapiens
tttctacacttcgtggtgtttt

SEQ ID NO: 8587972 - DNA, 22 bp, Homo sapiens
tttctacagctggtgcaacttt

SEQ ID NO: 8587973 - DNA, 22 bp, Homo sapiens
tttctacaggttgatgggtttg

SEQ ID NO: 8587974 - DNA, 22 bp, Homo sapiens
tttctacagtactgatttcata

SEQ ID NO: 8587975 - DNA, 22 bp, Homo sapiens
tttcattatacagcttcataaa

SEQ ID NO: 8587976 - DNA, 18 bp, Homo sapiens
tttcattataaagcaggc

SEQ ID NO: 8587977 - DNA, 22 bp, Homo sapiens
tttcattagtatgacagcacgc

SEQ ID NO: 8587978 - DNA, 22 bp, Homo sapiens
tttcattacgtgtttgacttgt

SEQ ID NO: 8587979 - DNA, 22 bp, Homo sapiens
tttcattaaagtcaaatctggt

SEQ ID NO: 8587980 - DNA, 22 bp, Homo sapiens
tttctacatgtcagtaactgat

SEQ ID NO: 8587981 - DNA, 22 bp, Homo sapiens
tttctacatgtcaatccaaacc

SEQ ID NO: 8587982 - DNA, 17 bp, Homo sapiens
tttctacagttggcagc

SEQ ID NO: 8587983 - DNA, 22 bp, Homo sapiens
tttatgattattttaaagcagc

SEQ ID NO: 8587984 - DNA, 22 bp, Homo sapiens
ctccaggagggggatggctgta

SEQ ID NO: 8587985 - DNA, 22 bp, Homo sapiens
ctccaggagtggcctggacacc

SEQ ID NO: 8587986 - DNA, 22 bp, Homo sapiens
ctccaggagggcttcctgtgat

SEQ ID NO: 8587987 - DNA, 22 bp, Homo sapiens
ctccaggagctgtgtctttctt

SEQ ID NO: 8587988 - DNA, 19 bp, Homo sapiens
ctccaggatggctgggcga

SEQ ID NO: 8587989 - DNA, 19 bp, Homo sapiens
ctccaggatggctgggcga

SEQ ID NO: 8587990 - DNA, 22 bp, Homo sapiens
ctccaggccaagattaagtaat

SEQ ID NO: 8587991 - DNA, 22 bp, Homo sapiens
ctccaggcccacggccgcggcc

SEQ ID NO: 8587992 - DNA, 22 bp, Homo sapiens
ctccaggccagggaagtggaca

SEQ ID NO: 8587993 - DNA, 22 bp, Homo sapiens
tttcagaatatcgattcagtga

SEQ ID NO: 8587994 - DNA, 20 bp, Homo sapiens
ctctgggtcgagacagactt

SEQ ID NO: 8587995 - DNA, 22 bp, Homo sapiens
tttgttcattaaaagtgctgta

SEQ ID NO: 8587996 - DNA, 17 bp, Homo sapiens
ctctgtggaggtgttta

SEQ ID NO: 8587997 - DNA, 22 bp, Homo sapiens
ctctgtggctacacaaacctcc

SEQ ID NO: 8587998 - DNA, 22 bp, Homo sapiens
ctctgtgggaagctgggtgtga

SEQ ID NO: 8587999 - DNA, 22 bp, Homo sapiens
ctctgtgggaggaggagtaggc

SEQ ID NO: 8588000 - DNA, 22 bp, Homo sapiens
ctctgtgggccagagaggcccc

SEQ ID NO: 8588001 - DNA, 22 bp, Homo sapiens
ctctgtgggggagaggcagctg

SEQ ID NO: 8588002 - DNA, 22 bp, Homo sapiens
ctctgtgggtatttatatgtat

SEQ ID NO: 8588003 - DNA, 22 bp, Homo sapiens
ctctgtggtaaaatagcagtat

SEQ ID NO: 8588004 - DNA, 22 bp, Homo sapiens
ctctgtggtggagtgggtcacc

SEQ ID NO: 8588005 - DNA, 22 bp, Homo sapiens
tttgactcctgtgtttctggaa

SEQ ID NO: 8588006 - DNA, 22 bp, Homo sapiens
tttgaaaatttaagtgctacac

SEQ ID NO: 8588007 - DNA, 22 bp, Homo sapiens
ctctgaatggacactccagtgt

SEQ ID NO: 8588008 - DNA, 22 bp, Homo sapiens
ctgcaggagcaagcctgggaga

SEQ ID NO: 8588009 - DNA, 22 bp, Homo sapiens
ctgcaggactgaaagatgaggt

SEQ ID NO: 8588010 - DNA, 22 bp, Homo sapiens
ctgcaggaggatcctgagagtg

SEQ ID NO: 8588011 - DNA, 22 bp, Homo sapiens
ctgcaggagggctggggaagcc

SEQ ID NO: 8588012 - DNA, 21 bp, Homo sapiens
ctgcaggatgctgaagccagg

SEQ ID NO: 8588013 - DNA, 22 bp, Homo sapiens
ctgcaggagtgaaagcaggcct

SEQ ID NO: 8588014 - DNA, 22 bp, Homo sapiens
ctgcaggatttcatgggctgac

SEQ ID NO: 8588015 - DNA, 22 bp, Homo sapiens
ctgcaggatttcatgggctgac

SEQ ID NO: 8588016 - DNA, 22 bp, Homo sapiens
ctgaggtgagcttccctgggct

SEQ ID NO: 8588017 - DNA, 22 bp, Homo sapiens
ctgaggtgagaggaggccatgt

SEQ ID NO: 8588018 - DNA, 22 bp, Homo sapiens
ctgaggtggggcctgggcatca

SEQ ID NO: 8588019 - DNA, 22 bp, Homo sapiens
ctgcaggaatctgtgctaggtg

SEQ ID NO: 8588020 - DNA, 22 bp, Homo sapiens
ctgcaggacagggaggagcaag

SEQ ID NO: 8588021 - DNA, 22 bp, Homo sapiens
ctgcaggaattcaaagtgagct

SEQ ID NO: 8588022 - DNA, 17 bp, Homo sapiens
ctgaggggagtgctgtg

SEQ ID NO: 8588023 - DNA, 22 bp, Homo sapiens
ctgaggctcaagggcaggtggg

SEQ ID NO: 8588024 - DNA, 22 bp, Homo sapiens
ctgaggctaacctcgagagaca

SEQ ID NO: 8588025 - DNA, 19 bp, Homo sapiens
ctgagcagcggcagcactt

SEQ ID NO: 8588026 - DNA, 22 bp, Homo sapiens
ctgcgatgaccctctcttgctg

SEQ ID NO: 8588027 - DNA, 22 bp, Homo sapiens
ctgcctgtgtgtgcctgcagaa

SEQ ID NO: 8588028 - DNA, 22 bp, Homo sapiens
ctgctgggtccccctgctgatt

SEQ ID NO: 8588029 - DNA, 19 bp, Homo sapiens
ctgctgggtgctgagggag

SEQ ID NO: 8588030 - DNA, 22 bp, Homo sapiens
ctgctgggtttgcctttcacca

SEQ ID NO: 8588031 - DNA, 22 bp, Homo sapiens
ctgctgggtttgcctttcacca

SEQ ID NO: 8588032 - DNA, 22 bp, Homo sapiens
ctgctgggcagaggctgcatga

SEQ ID NO: 8588033 - DNA, 22 bp, Homo sapiens
ctgctgggaaggtctgctcagt

SEQ ID NO: 8588034 - DNA, 22 bp, Homo sapiens
ctggaaggagaaggaggctgtg

SEQ ID NO: 8588035 - DNA, 22 bp, Homo sapiens
ctggaaagtgaggagagttcca

SEQ ID NO: 8588036 - DNA, 22 bp, Homo sapiens
ctggaaggtggatggcgaggcc

SEQ ID NO: 8588037 - DNA, 22 bp, Homo sapiens
ctggagaaaatccatgtgtatg

SEQ ID NO: 8588038 - DNA, 22 bp, Homo sapiens
ctggagagaccgaaagaggctg

SEQ ID NO: 8588039 - DNA, 22 bp, Homo sapiens
ctggaaggcagaggttgcagtg

SEQ ID NO: 8588040 - DNA, 22 bp, Homo sapiens
ctggaagggagcactgtagaga

SEQ ID NO: 8588041 - DNA, 22 bp, Homo sapiens
ctggagagtaatctctgtgtta

SEQ ID NO: 8588042 - DNA, 22 bp, Homo sapiens
ctggagagttggaagatggact

SEQ ID NO: 8588043 - DNA, 22 bp, Homo sapiens
ctggagagttggaagatggact

SEQ ID NO: 8588044 - DNA, 22 bp, Homo sapiens
ctggagaggctgggaacaggtt

SEQ ID NO: 8588045 - DNA, 22 bp, Homo sapiens
ctggagaggctgggaacaggtt

SEQ ID NO: 8588046 - DNA, 22 bp, Homo sapiens
ctggagagatcctcctgaaaaa

SEQ ID NO: 8588047 - DNA, 22 bp, Homo sapiens
ctggagagggagccctggcagt

SEQ ID NO: 8588048 - DNA, 22 bp, Homo sapiens
tgaagatttagacctctttgcc

SEQ ID NO: 8588049 - DNA, 20 bp, Homo sapiens
tgaacactggggtgtttcag

SEQ ID NO: 8588050 - DNA, 22 bp, Homo sapiens
ccaggctgcagtcaaggggcat

SEQ ID NO: 8588051 - DNA, 22 bp, Homo sapiens
tctgcagagattctgggctgag

SEQ ID NO: 8588052 - DNA, 22 bp, Homo sapiens
tctgcagagggagtgctgggtc

SEQ ID NO: 8588053 - DNA, 22 bp, Homo sapiens
ccagcctcactggcatcaccta

SEQ ID NO: 8588054 - DNA, 19 bp, Homo sapiens
ccaggcctggcgtctccgc

SEQ ID NO: 8588055 - DNA, 22 bp, Homo sapiens
tctttattttatgcttgtgcaa

SEQ ID NO: 8588056 - DNA, 22 bp, Homo sapiens
tctttattttatgcttgtgcaa

SEQ ID NO: 8588057 - DNA, 22 bp, Homo sapiens
tctttatttctgaatcccccat

SEQ ID NO: 8588058 - DNA, 22 bp, Homo sapiens
tgactttacagatatgtttcct

SEQ ID NO: 8588059 - DNA, 22 bp, Homo sapiens
tgaccagtgacccgaggcaagt

SEQ ID NO: 8588060 - DNA, 22 bp, Homo sapiens
tgaccagtggcgctgggtgcaa

SEQ ID NO: 8588061 - DNA, 22 bp, Homo sapiens
tgaccagtgcagggggagttag

SEQ ID NO: 8588062 - DNA, 23 bp, Homo sapiens
ccagggcccctacaccactgtcc

SEQ ID NO: 8588063 - DNA, 22 bp, Homo sapiens
tgaaggagaattaataggcatt

SEQ ID NO: 8588064 - DNA, 22 bp, Homo sapiens
ccagggaaactttggagtggag

SEQ ID NO: 8588065 - DNA, 22 bp, Homo sapiens
tgacagactttacttctcctat

SEQ ID NO: 8588066 - DNA, 22 bp, Homo sapiens
tgacagactactgcctctattg

SEQ ID NO: 8588067 - DNA, 22 bp, Homo sapiens
ccagggcatgtccaagacttag

SEQ ID NO: 8588068 - DNA, 22 bp, Homo sapiens
ccagggcatgtaactaatggtg

SEQ ID NO: 8588069 - DNA, 22 bp, Homo sapiens
ccagtgggaacactggcattgc

SEQ ID NO: 8588070 - DNA, 20 bp, Homo sapiens
ccagtgggaagtgattaggt

SEQ ID NO: 8588071 - DNA, 23 bp, Homo sapiens
ccagtggcgtaaactagaggata

SEQ ID NO: 8588072 - DNA, 22 bp, Homo sapiens
ccaggtctatcaagttgggctc

SEQ ID NO: 8588073 - DNA, 22 bp, Homo sapiens
ccagggtggggtccaggaacca

SEQ ID NO: 8588074 - DNA, 22 bp, Homo sapiens
tgcagcattagtacaagtctca

SEQ ID NO: 8588075 - DNA, 22 bp, Homo sapiens
cccagcaggtgccatcactctg

SEQ ID NO: 8588076 - DNA, 22 bp, Homo sapiens
cccagcagtaaccagtggaaat

SEQ ID NO: 8588077 - DNA, 21 bp, Homo sapiens
cccaggagaagaaaagatgca

SEQ ID NO: 8588078 - DNA, 22 bp, Homo sapiens
cccaggagaatataatgttctt

SEQ ID NO: 8588079 - DNA, 22 bp, Homo sapiens
cccaggactcttcactgcagcc

SEQ ID NO: 8588080 - DNA, 22 bp, Homo sapiens
cccaggaaagtggaggcggctg

SEQ ID NO: 8588081 - DNA, 22 bp, Homo sapiens
cccaggaattggaggctgcagt

SEQ ID NO: 8588082 - DNA, 22 bp, Homo sapiens
cccaggaaatagccaggaggtg

SEQ ID NO: 8588083 - DNA, 22 bp, Homo sapiens
tgcaggtggacacgggagacgg

SEQ ID NO: 8588084 - DNA, 22 bp, Homo sapiens
tgcagtggaggccgtgagacag

SEQ ID NO: 8588085 - DNA, 22 bp, Homo sapiens
tgcagtggaagaggtggagatc

SEQ ID NO: 8588086 - DNA, 22 bp, Homo sapiens
cccaggagaatatttttgggtc

SEQ ID NO: 8588087 - DNA, 22 bp, Homo sapiens
cccaggagacagaaacagaggt

SEQ ID NO: 8588088 - DNA, 22 bp, Homo sapiens
cccaggagacagaaacagaggt

SEQ ID NO: 8588089 - DNA, 21 bp, Homo sapiens
cccaggaggagctccggctcc

SEQ ID NO: 8588090 - DNA, 21 bp, Homo sapiens
cccaggaggagctccggctcc

SEQ ID NO: 8588091 - DNA, 22 bp, Homo sapiens
cccaggaggacattccataccc

SEQ ID NO: 8588092 - DNA, 22 bp, Homo sapiens
cccaggagatctggatctcgtc

SEQ ID NO: 8588093 - DNA, 22 bp, Homo sapiens
cccaggaggcagaagttgcagt

SEQ ID NO: 8588094 - DNA, 22 bp, Homo sapiens
cccaggaggcagagatagcagt

SEQ ID NO: 8588095 - DNA, 22 bp, Homo sapiens
cccaggaggcagagcttgcagt

SEQ ID NO: 8588096 - DNA, 22 bp, Homo sapiens
cccaggaggccaaggttgcagt

SEQ ID NO: 8588097 - DNA, 22 bp, Homo sapiens
cccaggaggcgcaggttgcggt

SEQ ID NO: 8588098 - DNA, 19 bp, Homo sapiens
cccaggaggcggaggttgc

SEQ ID NO: 8588099 - DNA, 22 bp, Homo sapiens
cccaggaggcagaggttgcagt

SEQ ID NO: 8588100 - DNA, 22 bp, Homo sapiens
cccaggaggcagaggttggagc

SEQ ID NO: 8588101 - DNA, 22 bp, Homo sapiens
cccaggaggcagatgttgcagt

SEQ ID NO: 8588102 - DNA, 22 bp, Homo sapiens
cccaggaggcggaggttgcagt

SEQ ID NO: 8588103 - DNA, 21 bp, Homo sapiens
cccaggaggctgagaagagca

SEQ ID NO: 8588104 - DNA, 21 bp, Homo sapiens
cccaggaggctgagaagagca

SEQ ID NO: 8588105 - DNA, 22 bp, Homo sapiens
cccaggagtaagtgacattgtt

SEQ ID NO: 8588106 - DNA, 19 bp, Homo sapiens
cccaggagtctggctggtt

SEQ ID NO: 8588107 - DNA, 19 bp, Homo sapiens
tgccctgcacgctgtcctg

SEQ ID NO: 8588108 - DNA, 22 bp, Homo sapiens
cccaggaggttgaggctgcagt

SEQ ID NO: 8588109 - DNA, 22 bp, Homo sapiens
cccaggaggttggggctacagt

SEQ ID NO: 8588110 - DNA, 20 bp, Homo sapiens
cccaggagtgagcagcttta

SEQ ID NO: 8588111 - DNA, 22 bp, Homo sapiens
tgcagaggtgttgctgagataa

SEQ ID NO: 8588112 - DNA, 22 bp, Homo sapiens
tgcagaggtgttgctgagataa

SEQ ID NO: 8588113 - DNA, 22 bp, Homo sapiens
tgcagaggtttccaggcaagtt

SEQ ID NO: 8588114 - DNA, 22 bp, Homo sapiens
tgcagaggtttccaggcaagtt

SEQ ID NO: 8588115 - DNA, 22 bp, Homo sapiens
cccagagaaccttctgtgccac

SEQ ID NO: 8588116 - DNA, 22 bp, Homo sapiens
cccagagagcacaggtggtggg

SEQ ID NO: 8588117 - DNA, 23 bp, Homo sapiens
cccagcagagatgaggaggggtc

SEQ ID NO: 8588118 - DNA, 22 bp, Homo sapiens
cccagcagatggctatgtgcta

SEQ ID NO: 8588119 - DNA, 22 bp, Homo sapiens
cccagcagaccgctgtgatggc

SEQ ID NO: 8588120 - DNA, 22 bp, Homo sapiens
cccagcagaatctgatgagggc

SEQ ID NO: 8588121 - DNA, 22 bp, Homo sapiens
cccagcagaatctgatgagggc

SEQ ID NO: 8588122 - DNA, 22 bp, Homo sapiens
cccagcagccagaatgaggagc

SEQ ID NO: 8588123 - DNA, 23 bp, Homo sapiens
cccagcagattgtaaagtgtcca

SEQ ID NO: 8588124 - DNA, 22 bp, Homo sapiens
cccagcagccagaatgaggagc

SEQ ID NO: 8588125 - DNA, 17 bp, Homo sapiens
tgattcaactagaaact

SEQ ID NO: 8588126 - DNA, 22 bp, Homo sapiens
tgattatattctaacttcataa

SEQ ID NO: 8588127 - DNA, 22 bp, Homo sapiens
tgattatattaactatgttcct

SEQ ID NO: 8588128 - DNA, 22 bp, Homo sapiens
tgattacagtatttgagatcca

SEQ ID NO: 8588129 - DNA, 23 bp, Homo sapiens
tgattacaggaagttcaagtgtt

SEQ ID NO: 8588130 - DNA, 22 bp, Homo sapiens
tgattacattggtaatgtttat

SEQ ID NO: 8588131 - DNA, 22 bp, Homo sapiens
tgattacagtctgacagatgtt

SEQ ID NO: 8588132 - DNA, 22 bp, Homo sapiens
ccagtgttcatcaagaaaatgt

SEQ ID NO: 8588133 - DNA, 22 bp, Homo sapiens
ccagtgtggtaggtccacaggt

SEQ ID NO: 8588134 - DNA, 22 bp, Homo sapiens
ccagtgtgggctggtggaggac

SEQ ID NO: 8588135 - DNA, 22 bp, Homo sapiens
ccagtgtggccaggtgctggta

SEQ ID NO: 8588136 - DNA, 22 bp, Homo sapiens
ccagtgttattttagagtgtga

SEQ ID NO: 8588137 - DNA, 22 bp, Homo sapiens
tgatacataaaccatcattttg

SEQ ID NO: 8588138 - DNA, 22 bp, Homo sapiens
ccatggagcacctcacagaggc

SEQ ID NO: 8588139 - DNA, 22 bp, Homo sapiens
tgtaatattgtagtgacagtac

SEQ ID NO: 8588140 - DNA, 22 bp, Homo sapiens
tgtaagtagtaatggaaggaca

SEQ ID NO: 8588141 - DNA, 22 bp, Homo sapiens
tgtaaagacgcttatagcttgc

SEQ ID NO: 8588142 - DNA, 20 bp, Homo sapiens
cctgctgtgctttccatgga

SEQ ID NO: 8588143 - DNA, 22 bp, Homo sapiens
cctggaggggaccaggaccagg

SEQ ID NO: 8588144 - DNA, 22 bp, Homo sapiens
cctggaggctctgggagggcag

SEQ ID NO: 8588145 - DNA, 22 bp, Homo sapiens
tgggtcagagcagacctctgga

SEQ ID NO: 8588146 - DNA, 22 bp, Homo sapiens
tgggtcagacagccagtgggcc

SEQ ID NO: 8588147 - DNA, 22 bp, Homo sapiens
tgggtcagaatcagagagttgc

SEQ ID NO: 8588148 - DNA, 22 bp, Homo sapiens
tgggtaggtgctggggattcag

SEQ ID NO: 8588149 - DNA, 22 bp, Homo sapiens
tgggtaggtgtggcctgaatgt

SEQ ID NO: 8588150 - DNA, 22 bp, Homo sapiens
cctgccaggcgagtctaggcca

SEQ ID NO: 8588151 - DNA, 22 bp, Homo sapiens
cctgccaggccagtgagcttcc

SEQ ID NO: 8588152 - DNA, 22 bp, Homo sapiens
cctgccaggcgagtctaggcca

SEQ ID NO: 8588153 - DNA, 22 bp, Homo sapiens
cctgccaggctttgggcttctg

SEQ ID NO: 8588154 - DNA, 18 bp, Homo sapiens
cctgccagtctggagcag

SEQ ID NO: 8588155 - DNA, 23 bp, Homo sapiens
tgggtcagctgcctccaggacaa

SEQ ID NO: 8588156 - DNA, 22 bp, Homo sapiens
tgggtcagaggacctcgtggcc

SEQ ID NO: 8588157 - DNA, 22 bp, Homo sapiens
tgggtcaggctgggagtcctga

SEQ ID NO: 8588158 - DNA, 22 bp, Homo sapiens
cctgctggtgtccaggctttgg

SEQ ID NO: 8588159 - DNA, 22 bp, Homo sapiens
cctgctggcgtggctggcgccc

SEQ ID NO: 8588160 - DNA, 20 bp, Homo sapiens
cctgctgggaaccctctgaa

SEQ ID NO: 8588161 - DNA, 22 bp, Homo sapiens
cctgctgggacgtgtggttgcc

SEQ ID NO: 8588162 - DNA, 22 bp, Homo sapiens
cctgctggccagtggagggctg

SEQ ID NO: 8588163 - DNA, 22 bp, Homo sapiens
cctgctggccactgctccacct

SEQ ID NO: 8588164 - DNA, 22 bp, Homo sapiens
cctgctggcgcttgtctgggag

SEQ ID NO: 8588165 - DNA, 22 bp, Homo sapiens
cctgctggacaggggtgttcat

SEQ ID NO: 8588166 - DNA, 22 bp, Homo sapiens
tggggtaggagtcagcgagaga

SEQ ID NO: 8588167 - DNA, 22 bp, Homo sapiens
tggggtaggagtcagcgagaga

SEQ ID NO: 8588168 - DNA, 22 bp, Homo sapiens
tggggtagggaaaagaagtcga

SEQ ID NO: 8588169 - DNA, 22 bp, Homo sapiens
tggggtaggtatgaaaactagg

SEQ ID NO: 8588170 - DNA, 21 bp, Homo sapiens
cctgagggtggttgtgaagat

SEQ ID NO: 8588171 - DNA, 22 bp, Homo sapiens
cctgaggtcacaacttgcttat

SEQ ID NO: 8588172 - DNA, 22 bp, Homo sapiens
cctgaggtcatggtccagtgtt

SEQ ID NO: 8588173 - DNA, 22 bp, Homo sapiens
cctgccaggagctggtgctgca

SEQ ID NO: 8588174 - DNA, 22 bp, Homo sapiens
cctgccagagcagcttgtcctc

SEQ ID NO: 8588175 - DNA, 22 bp, Homo sapiens
cctgccagacgcaccagggggc

SEQ ID NO: 8588176 - DNA, 22 bp, Homo sapiens
cctgaggcttaatctgtcccaa

SEQ ID NO: 8588177 - DNA, 22 bp, Homo sapiens
cctgaggccctggctgtgctga

SEQ ID NO: 8588178 - DNA, 22 bp, Homo sapiens
cctgaggctccacctccagaga

SEQ ID NO: 8588179 - DNA, 22 bp, Homo sapiens
cctgaggctggcccttccatcc

SEQ ID NO: 8588180 - DNA, 22 bp, Homo sapiens
cctgaggctctcctgaataatg

SEQ ID NO: 8588181 - DNA, 22 bp, Homo sapiens
tgggagcagttgtgaagctcag

SEQ ID NO: 8588182 - DNA, 17 bp, Homo sapiens
cctgaaggcacttccag

SEQ ID NO: 8588183 - DNA, 22 bp, Homo sapiens
cctgaagggactccagagagca

SEQ ID NO: 8588184 - DNA, 22 bp, Homo sapiens
cctgaagctcttaagaccttta

SEQ ID NO: 8588185 - DNA, 22 bp, Homo sapiens
tgggccagaggcatggagctat

SEQ ID NO: 8588186 - DNA, 22 bp, Homo sapiens
tgggcagggagctggaaccaca

SEQ ID NO: 8588187 - DNA, 22 bp, Homo sapiens
ccgggagcaggcgccaccgcca

SEQ ID NO: 8588188 - DNA, 22 bp, Homo sapiens
ccctttcattggcagagctctc

SEQ ID NO: 8588189 - DNA, 22 bp, Homo sapiens
tggcctcggcatccagcaagag

SEQ ID NO: 8588190 - DNA, 22 bp, Homo sapiens
cctcagccttggccccaggcag

SEQ ID NO: 8588191 - DNA, 22 bp, Homo sapiens
tggcctcagattattgcacagt

SEQ ID NO: 8588192 - DNA, 22 bp, Homo sapiens
tggcctcagatttcaggggtgg

SEQ ID NO: 8588193 - DNA, 22 bp, Homo sapiens
tggcctcaatctgtcctccagc

SEQ ID NO: 8588194 - DNA, 22 bp, Homo sapiens
tggcctcaccactagctgggtg

SEQ ID NO: 8588195 - DNA, 22 bp, Homo sapiens
cctcagaagctcaaggacattg

SEQ ID NO: 8588196 - DNA, 22 bp, Homo sapiens
tggcctcaagtctgagggcctt

SEQ ID NO: 8588197 - DNA, 22 bp, Homo sapiens
cctcagaagactttagggaaga

SEQ ID NO: 8588198 - DNA, 19 bp, Homo sapiens
tggctagaccgcggagcca

SEQ ID NO: 8588199 - DNA, 22 bp, Homo sapiens
tggctagactcggccagccaca

SEQ ID NO: 8588200 - DNA, 22 bp, Homo sapiens
tggctagaccgcggagccaaga

SEQ ID NO: 8588201 - DNA, 22 bp, Homo sapiens
tggaagacagtgactggttgtg

SEQ ID NO: 8588202 - DNA, 22 bp, Homo sapiens
tggaagacagttgatgggagtt

SEQ ID NO: 8588203 - DNA, 22 bp, Homo sapiens
tggaagacatactgttttctta

SEQ ID NO: 8588204 - DNA, 22 bp, Homo sapiens
tggaagacaggctgtattttaa

SEQ ID NO: 8588205 - DNA, 22 bp, Homo sapiens
tggaagacaggcatggaagtgg

SEQ ID NO: 8588206 - DNA, 22 bp, Homo sapiens
tggaagacaaagattcaatatt

SEQ ID NO: 8588207 - DNA, 22 bp, Homo sapiens
tggaagacaagtgttagcatgg

SEQ ID NO: 8588208 - DNA, 22 bp, Homo sapiens
tggaagacaatgtacatgcagt

SEQ ID NO: 8588209 - DNA, 22 bp, Homo sapiens
tggaagacaatgtacatgcagt

SEQ ID NO: 8588210 - DNA, 22 bp, Homo sapiens
tggaagacaatttgaaaacatt

SEQ ID NO: 8588211 - DNA, 22 bp, Homo sapiens
tggaagacactatttaccaggt

SEQ ID NO: 8588212 - DNA, 22 bp, Homo sapiens
tggaagacaggagatgtgtgta

SEQ ID NO: 8588213 - DNA, 20 bp, Homo sapiens
tggaagacactgaagggcca

SEQ ID NO: 8588214 - DNA, 18 bp, Homo sapiens
cccggctaatttttggta

SEQ ID NO: 8588215 - DNA, 22 bp, Homo sapiens
tggaagaagctacaagcggtga

SEQ ID NO: 8588216 - DNA, 22 bp, Homo sapiens
tggaagaatagaagatggttga

SEQ ID NO: 8588217 - DNA, 22 bp, Homo sapiens
tgcctcagtttcatctgcagaa

SEQ ID NO: 8588218 - DNA, 22 bp, Homo sapiens
tgctttcagggatgtctgtgag

SEQ ID NO: 8588219 - DNA, 22 bp, Homo sapiens
tgctttattttaaatatgccat

SEQ ID NO: 8588220 - DNA, 22 bp, Homo sapiens
tgctttattggaacctcatcct

SEQ ID NO: 8588221 - DNA, 22 bp, Homo sapiens
tgctttatttataaaatagcaa

SEQ ID NO: 8588222 - DNA, 22 bp, Homo sapiens
tggaggtgagtgtggtacagca

SEQ ID NO: 8588223 - DNA, 22 bp, Homo sapiens
ccctgccttgtctgggctaggt

SEQ ID NO: 8588224 - DNA, 22 bp, Homo sapiens
ccctgcagagccagccctgacc

SEQ ID NO: 8588225 - DNA, 22 bp, Homo sapiens
ccctgcagatcagtgagaactt

SEQ ID NO: 8588226 - DNA, 22 bp, Homo sapiens
ccctgcagcattctctaactgg

SEQ ID NO: 8588227 - DNA, 22 bp, Homo sapiens
ccctgcagaccaatgccataga

SEQ ID NO: 8588228 - DNA, 22 bp, Homo sapiens
ccctgcagagaccactgacctt

SEQ ID NO: 8588229 - DNA, 22 bp, Homo sapiens
ccctgcagagaccactgacctt

SEQ ID NO: 8588230 - DNA, 22 bp, Homo sapiens
ccctgcagacgtcttgatgcct

SEQ ID NO: 8588231 - DNA, 22 bp, Homo sapiens
ccctgcagagccagccctgacc

SEQ ID NO: 8588232 - DNA, 22 bp, Homo sapiens
ccctgcagagccagccctgacc

SEQ ID NO: 8588233 - DNA, 22 bp, Homo sapiens
ccctgcagaaccacagacaaac

SEQ ID NO: 8588234 - DNA, 22 bp, Homo sapiens
ccctgaggaccaggaaggaggg

SEQ ID NO: 8588235 - DNA, 22 bp, Homo sapiens
ccctgaggagagcgcttcccga

SEQ ID NO: 8588236 - DNA, 22 bp, Homo sapiens
tggacatgtaaaggctcaaggt

SEQ ID NO: 8588237 - DNA, 22 bp, Homo sapiens
tggacatgagctgagtgggtgt

SEQ ID NO: 8588238 - DNA, 22 bp, Homo sapiens
tggacatgacctcgagcgagat

SEQ ID NO: 8588239 - DNA, 22 bp, Homo sapiens
tggacagttgtcttgtagctaa

SEQ ID NO: 8588240 - DNA, 22 bp, Homo sapiens
tggacagtaggaagagtgtggg

SEQ ID NO: 8588241 - DNA, 22 bp, Homo sapiens
ccctgcagtgtgacctcaccta

SEQ ID NO: 8588242 - DNA, 22 bp, Homo sapiens
tagtgataatgtttatgctttt

SEQ ID NO: 8588243 - DNA, 22 bp, Homo sapiens
cagggtggcactcagcgcatct

SEQ ID NO: 8588244 - DNA, 22 bp, Homo sapiens
tatcatttaacagaatcattgc

SEQ ID NO: 8588245 - DNA, 19 bp, Homo sapiens
taggtaggtaggtaggtat

SEQ ID NO: 8588246 - DNA, 22 bp, Homo sapiens
taggtaggtaaacaggactaat

SEQ ID NO: 8588247 - DNA, 22 bp, Homo sapiens
tagggacaaagagctgaggcct

SEQ ID NO: 8588248 - DNA, 21 bp, Homo sapiens
tagggcaggcattggaagaga

SEQ ID NO: 8588249 - DNA, 22 bp, Homo sapiens
tagggcagttataacattagtg

SEQ ID NO: 8588250 - DNA, 22 bp, Homo sapiens
tagggcaggtgaagaaaagcta

SEQ ID NO: 8588251 - DNA, 21 bp, Homo sapiens
tagggcaggcattggaagaga

SEQ ID NO: 8588252 - DNA, 22 bp, Homo sapiens
tagggcaggggaggaatctgaa

SEQ ID NO: 8588253 - DNA, 22 bp, Homo sapiens
tagggccagataggcttcttga

SEQ ID NO: 8588254 - DNA, 22 bp, Homo sapiens
tagggccagttagggaagcttt

SEQ ID NO: 8588255 - DNA, 22 bp, Homo sapiens
tagggccatgtctgtcttgttc

SEQ ID NO: 8588256 - DNA, 22 bp, Homo sapiens
tagggcagttataacattagtg

SEQ ID NO: 8588257 - DNA, 22 bp, Homo sapiens
tagggcagtttcatgttatctt

SEQ ID NO: 8588258 - DNA, 18 bp, Homo sapiens
tagggccaaaatggaaaa

SEQ ID NO: 8588259 - DNA, 22 bp, Homo sapiens
tagggcagtttcatgttatctt

SEQ ID NO: 8588260 - DNA, 22 bp, Homo sapiens
cagggccttttagcatcttctc

SEQ ID NO: 8588261 - DNA, 22 bp, Homo sapiens
cagggccttgttcaggagtgaa

SEQ ID NO: 8588262 - DNA, 22 bp, Homo sapiens
taggagcctgctctgcagggac

SEQ ID NO: 8588263 - DNA, 22 bp, Homo sapiens
taggagctgagacatctttaaa

SEQ ID NO: 8588264 - DNA, 22 bp, Homo sapiens
cagggcctggagctgggcctgc

SEQ ID NO: 8588265 - DNA, 22 bp, Homo sapiens
cagggcctgcttccttcttgtt

SEQ ID NO: 8588266 - DNA, 22 bp, Homo sapiens
taggaacacatcctcctctagc

SEQ ID NO: 8588267 - DNA, 22 bp, Homo sapiens
tagctttaagatgagatgtgga

SEQ ID NO: 8588268 - DNA, 22 bp, Homo sapiens
cagggcaggaatttgacattgc

SEQ ID NO: 8588269 - DNA, 22 bp, Homo sapiens
cagggcagagggaaactccttt

SEQ ID NO: 8588270 - DNA, 22 bp, Homo sapiens
cagggcagcttcctttgttagg

SEQ ID NO: 8588271 - DNA, 22 bp, Homo sapiens
cagggcaggaatttgacattgc

SEQ ID NO: 8588272 - DNA, 22 bp, Homo sapiens
cagggcagccaggccccgtggg

SEQ ID NO: 8588273 - DNA, 22 bp, Homo sapiens
cagggcagagccaggatttcaa

SEQ ID NO: 8588274 - DNA, 22 bp, Homo sapiens
cagggcagaaggcactctactc

SEQ ID NO: 8588275 - DNA, 20 bp, Homo sapiens
cagggcacactgcagcctcg

SEQ ID NO: 8588276 - DNA, 22 bp, Homo sapiens
cagggcacagttatggaggtgg

SEQ ID NO: 8588277 - DNA, 22 bp, Homo sapiens
cagggcagaaggcactctactc

SEQ ID NO: 8588278 - DNA, 22 bp, Homo sapiens
cagggcagaacatatagatagt

SEQ ID NO: 8588279 - DNA, 21 bp, Homo sapiens
cagggcacacagaggatggta

SEQ ID NO: 8588280 - DNA, 22 bp, Homo sapiens
caggctgggctccggagataaa

SEQ ID NO: 8588281 - DNA, 18 bp, Homo sapiens
tagaatcaaatattttac

SEQ ID NO: 8588282 - DNA, 22 bp, Homo sapiens
tagaatatgtggtgtatacttt

SEQ ID NO: 8588283 - DNA, 22 bp, Homo sapiens
gtgaggggccaagagtagggca

SEQ ID NO: 8588284 - DNA, 22 bp, Homo sapiens
gtgagggcagaacccccaggcc

SEQ ID NO: 8588285 - DNA, 22 bp, Homo sapiens
gtgaggggtggctgagcagttt

SEQ ID NO: 8588286 - DNA, 22 bp, Homo sapiens
caggctggagtgcagtggggcg

SEQ ID NO: 8588287 - DNA, 22 bp, Homo sapiens
caggctggagtgcagtggcgct

SEQ ID NO: 8588288 - DNA, 22 bp, Homo sapiens
tagaatatacactacagcttaa

SEQ ID NO: 8588289 - DNA, 22 bp, Homo sapiens
caggctggagtgcaatgacgcc

SEQ ID NO: 8588290 - DNA, 22 bp, Homo sapiens
caggctggagtgcagtggcgcc

SEQ ID NO: 8588291 - DNA, 22 bp, Homo sapiens
caggctggagtgcaatggtgct

SEQ ID NO: 8588292 - DNA, 22 bp, Homo sapiens
cagtgccaaggatggcctggga

SEQ ID NO: 8588293 - DNA, 22 bp, Homo sapiens
cagtggctggttagggacagga

SEQ ID NO: 8588294 - DNA, 22 bp, Homo sapiens
cagtggctgtttctggaaggca

SEQ ID NO: 8588295 - DNA, 23 bp, Homo sapiens
cagtgggcttctaactgctcctg

SEQ ID NO: 8588296 - DNA, 22 bp, Homo sapiens
cagtggggaggccaggatagaa

SEQ ID NO: 8588297 - DNA, 22 bp, Homo sapiens
cagtggggggactgaggcctga

SEQ ID NO: 8588298 - DNA, 22 bp, Homo sapiens
cagtgggtaaataagtgggtaa

SEQ ID NO: 8588299 - DNA, 22 bp, Homo sapiens
cagtgggggtgaggccgaggta

SEQ ID NO: 8588300 - DNA, 22 bp, Homo sapiens
cagtgggtatttactgattcct

SEQ ID NO: 8588301 - DNA, 22 bp, Homo sapiens
cagtgggtcctaagtacagttc

SEQ ID NO: 8588302 - DNA, 22 bp, Homo sapiens
cagtgggtagtggggattagca

SEQ ID NO: 8588303 - DNA, 22 bp, Homo sapiens
cagtgggtaggaaaggctcttc

SEQ ID NO: 8588304 - DNA, 21 bp, Homo sapiens
cagtgggctgctgcgctccag

SEQ ID NO: 8588305 - DNA, 22 bp, Homo sapiens
cagtgggatatgggggcagcat

SEQ ID NO: 8588306 - DNA, 22 bp, Homo sapiens
cagtgggaatgaagtggaggcc

SEQ ID NO: 8588307 - DNA, 22 bp, Homo sapiens
tcagagaaaggccaaaatatca

SEQ ID NO: 8588308 - DNA, 22 bp, Homo sapiens
tcagagaaaatggaaactttta

SEQ ID NO: 8588309 - DNA, 22 bp, Homo sapiens
tcagagaaataattgctgagtt

SEQ ID NO: 8588310 - DNA, 22 bp, Homo sapiens
tcagagaaatgaagtagggatt

SEQ ID NO: 8588311 - DNA, 22 bp, Homo sapiens
tcagagaaatgacaatatatag

SEQ ID NO: 8588312 - DNA, 22 bp, Homo sapiens
tcagagaacacagaggtgatgt

SEQ ID NO: 8588313 - DNA, 21 bp, Homo sapiens
tcagagaacccggcaggcaag

SEQ ID NO: 8588314 - DNA, 22 bp, Homo sapiens
cagtgtgcctgaatcaagtgtt

SEQ ID NO: 8588315 - DNA, 22 bp, Homo sapiens
cagtgtttccgtcagtatgtga

SEQ ID NO: 8588316 - DNA, 22 bp, Homo sapiens
cataaactcttgagattcttgt

SEQ ID NO: 8588317 - DNA, 22 bp, Homo sapiens
tcagctttttggattgcccaag

SEQ ID NO: 8588318 - DNA, 22 bp, Homo sapiens
tcagctttgggggtctcaggag

SEQ ID NO: 8588319 - DNA, 22 bp, Homo sapiens
tcagctttctcttctatcgata

SEQ ID NO: 8588320 - DNA, 21 bp, Homo sapiens
tcagctttgcaactgcacatc

SEQ ID NO: 8588321 - DNA, 22 bp, Homo sapiens
tcagcagaggggaaggcatctg

SEQ ID NO: 8588322 - DNA, 22 bp, Homo sapiens
tcagatgcctgtggggtctagg

SEQ ID NO: 8588323 - DNA, 22 bp, Homo sapiens
tcacaagacagaaaacatttag

SEQ ID NO: 8588324 - DNA, 22 bp, Homo sapiens
cagtgaggaagctgtctggacc

SEQ ID NO: 8588325 - DNA, 22 bp, Homo sapiens
tcacaagactgagcttgcttga

SEQ ID NO: 8588326 - DNA, 22 bp, Homo sapiens
tcacagtgtggcaactcacaga

SEQ ID NO: 8588327 - DNA, 22 bp, Homo sapiens
tcacagtgttggaatcagagct

SEQ ID NO: 8588328 - DNA, 20 bp, Homo sapiens
tcacaggagggaaggcaggt

SEQ ID NO: 8588329 - DNA, 22 bp, Homo sapiens
tcacagctttcagattgttccc

SEQ ID NO: 8588330 - DNA, 22 bp, Homo sapiens
tcacagagaactataatccatc

SEQ ID NO: 8588331 - DNA, 22 bp, Homo sapiens
tcacagagaaaagctatcacaa

SEQ ID NO: 8588332 - DNA, 22 bp, Homo sapiens
tcacaggaggaacctggcctgg

SEQ ID NO: 8588333 - DNA, 22 bp, Homo sapiens
tcacaggagcccaggggagctg

SEQ ID NO: 8588334 - DNA, 22 bp, Homo sapiens
tcacaggaccctgagggtggcg

SEQ ID NO: 8588335 - DNA, 22 bp, Homo sapiens
tcacaggacagccttccacccg

SEQ ID NO: 8588336 - DNA, 22 bp, Homo sapiens
caggtggtcaggcagatgggct

SEQ ID NO: 8588337 - DNA, 22 bp, Homo sapiens
cagtagggaatgtgggaggctg

SEQ ID NO: 8588338 - DNA, 20 bp, Homo sapiens
cagtcccaatccagggccag

SEQ ID NO: 8588339 - DNA, 22 bp, Homo sapiens
tcatttatcgctgccttttaaa

SEQ ID NO: 8588340 - DNA, 22 bp, Homo sapiens
tcatttatgcaggaatggcata

SEQ ID NO: 8588341 - DNA, 22 bp, Homo sapiens
tcatttatgtctttgccatcca

SEQ ID NO: 8588342 - DNA, 21 bp, Homo sapiens
tcatttattgagaaatgactg

SEQ ID NO: 8588343 - DNA, 22 bp, Homo sapiens
tcatttatttgactttggagtg

SEQ ID NO: 8588344 - DNA, 22 bp, Homo sapiens
tcatttatttataccattgcct

SEQ ID NO: 8588345 - DNA, 22 bp, Homo sapiens
tcattcatctggtgttagtcct

SEQ ID NO: 8588346 - DNA, 22 bp, Homo sapiens
catgtgtccacccttgaacaca

SEQ ID NO: 8588347 - DNA, 22 bp, Homo sapiens
tccaggctccctcaggatgcac

SEQ ID NO: 8588348 - DNA, 20 bp, Homo sapiens
tccaggctcctccacttagt

SEQ ID NO: 8588349 - DNA, 21 bp, Homo sapiens
catgtgtcattggagagcaat

SEQ ID NO: 8588350 - DNA, 22 bp, Homo sapiens
tccaggctcccctgcgtgctcc

SEQ ID NO: 8588351 - DNA, 18 bp, Homo sapiens
tccaggctccaggctaac

SEQ ID NO: 8588352 - DNA, 19 bp, Homo sapiens
tccaggctccattggcaga

SEQ ID NO: 8588353 - DNA, 22 bp, Homo sapiens
tccagctggcttcggaagtgga

SEQ ID NO: 8588354 - DNA, 22 bp, Homo sapiens
tccagctggcccggccatgaat

SEQ ID NO: 8588355 - DNA, 22 bp, Homo sapiens
tccaggctcagtcaagcacttc

SEQ ID NO: 8588356 - DNA, 22 bp, Homo sapiens
tccagagacttgcatgtgcttg

SEQ ID NO: 8588357 - DNA, 22 bp, Homo sapiens
tccagctgaggtggcctctgtg

SEQ ID NO: 8588358 - DNA, 22 bp, Homo sapiens
tccagctgcaaggggcacagct

SEQ ID NO: 8588359 - DNA, 22 bp, Homo sapiens
tccagctgctgacccagtagcc

SEQ ID NO: 8588360 - DNA, 22 bp, Homo sapiens
tccagctgctgccagccaagct

SEQ ID NO: 8588361 - DNA, 22 bp, Homo sapiens
tccagctgctgacccagtagcc

SEQ ID NO: 8588362 - DNA, 23 bp, Homo sapiens
tccagctgcagtgggatggggaa

SEQ ID NO: 8588363 - DNA, 21 bp, Homo sapiens
tccagctgcacaagcatgggg

SEQ ID NO: 8588364 - DNA, 17 bp, Homo sapiens
tccagcctcctctgctg

SEQ ID NO: 8588365 - DNA, 22 bp, Homo sapiens
tccagcctcctatttaccctaa

SEQ ID NO: 8588366 - DNA, 22 bp, Homo sapiens
tccagcctaggggaacagctgc

SEQ ID NO: 8588367 - DNA, 22 bp, Homo sapiens
tccagcctaatgttcttcccac

SEQ ID NO: 8588368 - DNA, 22 bp, Homo sapiens
tccagcctcatttctcctgctt

SEQ ID NO: 8588369 - DNA, 22 bp, Homo sapiens
cattcattagaatagatatgta

SEQ ID NO: 8588370 - DNA, 22 bp, Homo sapiens
cattcattacactcataaggtt

SEQ ID NO: 8588371 - DNA, 22 bp, Homo sapiens
cattcaggtacactcagtgcta

SEQ ID NO: 8588372 - DNA, 19 bp, Homo sapiens
catgttatgctgtagtatc

SEQ ID NO: 8588373 - DNA, 22 bp, Homo sapiens
catgttctaatattgtgacata

SEQ ID NO: 8588374 - DNA, 22 bp, Homo sapiens
catgttctaacaatgagaaacc

SEQ ID NO: 8588375 - DNA, 22 bp, Homo sapiens
cattcattcacattttgtctat

SEQ ID NO: 8588376 - DNA, 22 bp, Homo sapiens
cattcattcagcaactgttatt

SEQ ID NO: 8588377 - DNA, 22 bp, Homo sapiens
cattcattctgtaagtaactat

SEQ ID NO: 8588378 - DNA, 22 bp, Homo sapiens
cattcatttactttcaacagct

SEQ ID NO: 8588379 - DNA, 22 bp, Homo sapiens
cattcatttactttcaacagct

SEQ ID NO: 8588380 - DNA, 22 bp, Homo sapiens
tcccagccacaggtgtagccct

SEQ ID NO: 8588381 - DNA, 22 bp, Homo sapiens
tcccagccaggctctaccactt

SEQ ID NO: 8588382 - DNA, 22 bp, Homo sapiens
tcccagccacagtttccacctg

SEQ ID NO: 8588383 - DNA, 22 bp, Homo sapiens
tcccagccattcctttaggtgt

SEQ ID NO: 8588384 - DNA, 22 bp, Homo sapiens
tcccagcccagacttctccagt

SEQ ID NO: 8588385 - DNA, 22 bp, Homo sapiens
tcccagcccagatttgtgtgac

SEQ ID NO: 8588386 - DNA, 22 bp, Homo sapiens
tcccaggaatccgtcctctaga

SEQ ID NO: 8588387 - DNA, 23 bp, Homo sapiens
tcccaggaatctgcatttttaac

SEQ ID NO: 8588388 - DNA, 23 bp, Homo sapiens
tcccaggaatctgcatttttaac

SEQ ID NO: 8588389 - DNA, 22 bp, Homo sapiens
tcccaggaatgtctgaaagtga

SEQ ID NO: 8588390 - DNA, 22 bp, Homo sapiens
tcccaggaatgtctgaaagtga

SEQ ID NO: 8588391 - DNA, 22 bp, Homo sapiens
tcccaggacaggccacatggaa

SEQ ID NO: 8588392 - DNA, 22 bp, Homo sapiens
tcccaggaattgaagccagtgt

SEQ ID NO: 8588393 - DNA, 22 bp, Homo sapiens
tcccaggaattgaagccagtgt

SEQ ID NO: 8588394 - DNA, 22 bp, Homo sapiens
tcccaggacatgggctctgctc

SEQ ID NO: 8588395 - DNA, 22 bp, Homo sapiens
tcccaggacatgggctctgctc

SEQ ID NO: 8588396 - DNA, 22 bp, Homo sapiens
tcccaggacaggccacatggaa

SEQ ID NO: 8588397 - DNA, 22 bp, Homo sapiens
tcccaggacccaggcattcaca

SEQ ID NO: 8588398 - DNA, 22 bp, Homo sapiens
tcccaggacccaggcattcaca

SEQ ID NO: 8588399 - DNA, 22 bp, Homo sapiens
tcccaggacttccagttggagg

SEQ ID NO: 8588400 - DNA, 22 bp, Homo sapiens
tcccaggacttccagttggagg

SEQ ID NO: 8588401 - DNA, 22 bp, Homo sapiens
tcccaggagcaccttttgagcc

SEQ ID NO: 8588402 - DNA, 22 bp, Homo sapiens
tcccaggatctgagggcagaga

SEQ ID NO: 8588403 - DNA, 16 bp, Homo sapiens
tcccaggaggcggaac

SEQ ID NO: 8588404 - DNA, 22 bp, Homo sapiens
tcccaggagcaccttttgagcc

SEQ ID NO: 8588405 - DNA, 16 bp, Homo sapiens
tcccaggaggcggaac

SEQ ID NO: 8588406 - DNA, 22 bp, Homo sapiens
tcccaggaggtgcttcctagga

SEQ ID NO: 8588407 - DNA, 22 bp, Homo sapiens
tcccaggaggtgcttcctagga

SEQ ID NO: 8588408 - DNA, 22 bp, Homo sapiens
cattgattatggaaagcagtgg

SEQ ID NO: 8588409 - DNA, 22 bp, Homo sapiens
tccctcagaaattctctctgaa

SEQ ID NO: 8588410 - DNA, 22 bp, Homo sapiens
catttggtggctacagagtaac

SEQ ID NO: 8588411 - DNA, 23 bp, Homo sapiens
tcggtgggcgtggaggccgaggc

SEQ ID NO: 8588412 - DNA, 22 bp, Homo sapiens
tcggggtctttgacacgctctg

SEQ ID NO: 8588413 - DNA, 22 bp, Homo sapiens
ccaccagagggcagactgtgat

SEQ ID NO: 8588414 - DNA, 22 bp, Homo sapiens
tcgctgaggctgcacggctgcc

SEQ ID NO: 8588415 - DNA, 20 bp, Homo sapiens
tctccaccacagagagcaga

SEQ ID NO: 8588416 - DNA, 22 bp, Homo sapiens
tctcaagagggaggcaatcatg

SEQ ID NO: 8588417 - DNA, 22 bp, Homo sapiens
tctcaagctagtgtttatagta

SEQ ID NO: 8588418 - DNA, 22 bp, Homo sapiens
tctatattccagatacagatta

SEQ ID NO: 8588419 - DNA, 22 bp, Homo sapiens
ccagagagctacaaggcataaa

SEQ ID NO: 8588420 - DNA, 22 bp, Homo sapiens
tctccagaggtcccttgtctct

SEQ ID NO: 8588421 - DNA, 22 bp, Homo sapiens
tctcctggctctaaaaggctgt

SEQ ID NO: 8588422 - DNA, 22 bp, Homo sapiens
ccagcagggcagtgccctggac

SEQ ID NO: 8588423 - DNA, 22 bp, Homo sapiens
ccagcagcatcctgcagcactt

SEQ ID NO: 8588424 - DNA, 22 bp, Homo sapiens
ccagcaggtgtagggctcatgg

SEQ ID NO: 8588425 - DNA, 22 bp, Homo sapiens
ccagcagggttggtttcttctg

SEQ ID NO: 8588426 - DNA, 22 bp, Homo sapiens
tctctgtgtgttggctgtatat

SEQ ID NO: 8588427 - DNA, 22 bp, Homo sapiens
ccagcatttgcttaatttggag

SEQ ID NO: 8588428 - DNA, 22 bp, Homo sapiens
tctgcagaaggaatcagctgag

SEQ ID NO: 8588429 - DNA, 22 bp, Homo sapiens
tttgacaaaggaaaaatgcaca

SEQ ID NO: 8588430 - DNA, 22 bp, Homo sapiens
tttgatgacctgtatctttttc

SEQ ID NO: 8588431 - DNA, 22 bp, Homo sapiens
tttgattgtcacctaccttgca

SEQ ID NO: 8588432 - DNA, 18 bp, Homo sapiens
tttgattgctgtcatcca

SEQ ID NO: 8588433 - DNA, 22 bp, Homo sapiens
tttgatccgttgctggtgagga

SEQ ID NO: 8588434 - DNA, 22 bp, Homo sapiens
tttgaggttagctagcagatca

SEQ ID NO: 8588435 - DNA, 22 bp, Homo sapiens
tttggaaaaagcctgaacatag

SEQ ID NO: 8588436 - DNA, 22 bp, Homo sapiens
tttggaaacatctcagaaaata

SEQ ID NO: 8588437 - DNA, 22 bp, Homo sapiens
tttggaaatttcatcaatagcc

SEQ ID NO: 8588438 - DNA, 22 bp, Homo sapiens
tttggtcactggatttggctgt

SEQ ID NO: 8588439 - DNA, 22 bp, Homo sapiens
tttggtcaatatggtagcagca

SEQ ID NO: 8588440 - DNA, 22 bp, Homo sapiens
tttggtcaaatattatcctgag

SEQ ID NO: 8588441 - DNA, 22 bp, Homo sapiens
tttggtcctaagctgctctcta

SEQ ID NO: 8588442 - DNA, 22 bp, Homo sapiens
tttggtcctgagcaaaactatg

SEQ ID NO: 8588443 - DNA, 22 bp, Homo sapiens
tttggtccaagttttactcttt

SEQ ID NO: 8588444 - DNA, 22 bp, Homo sapiens
tttggtcattgaggaagtaaag

SEQ ID NO: 8588445 - DNA, 22 bp, Homo sapiens
tttggtcatttgcactgccaat

SEQ ID NO: 8588446 - DNA, 22 bp, Homo sapiens
tttggtcatagattgcgaacat

SEQ ID NO: 8588447 - DNA, 22 bp, Homo sapiens
tttggtcatgtgcccacccctg

SEQ ID NO: 8588448 - DNA, 22 bp, Homo sapiens
tttggtcatgtcgtcatttggg

SEQ ID NO: 8588449 - DNA, 22 bp, Homo sapiens
tttggtcagggtaggacagttg

SEQ ID NO: 8588450 - DNA, 22 bp, Homo sapiens
tttggtcataagcttttggggt

SEQ ID NO: 8588451 - DNA, 22 bp, Homo sapiens
tttggtcagataagtcaatgta

SEQ ID NO: 8588452 - DNA, 22 bp, Homo sapiens
tttggtcagcaatattgtgggg

SEQ ID NO: 8588453 - DNA, 22 bp, Homo sapiens
tttggtatttgatgggggtcct

SEQ ID NO: 8588454 - DNA, 22 bp, Homo sapiens
tttggtcagcagttggtggcgt

SEQ ID NO: 8588455 - DNA, 22 bp, Homo sapiens
tttggttcttatctttggagat

SEQ ID NO: 8588456 - DNA, 22 bp, Homo sapiens
tttggttaaacgagagaacata

SEQ ID NO: 8588457 - DNA, 22 bp, Homo sapiens
ttttaagaaatgtatgactgtc

SEQ ID NO: 8588458 - DNA, 22 bp, Homo sapiens
ttttattgcaataaagtgtgta

SEQ ID NO: 8588459 - DNA, 22 bp, Homo sapiens
ttttattgcaataaagtgtgta

SEQ ID NO: 8588460 - DNA, 22 bp, Homo sapiens
ttttattgcaataaagtgtgta

SEQ ID NO: 8588461 - DNA, 22 bp, Homo sapiens
ttttattggagtgataccaagc

SEQ ID NO: 8588462 - DNA, 22 bp, Homo sapiens
ttttattggagtgataccaagc

SEQ ID NO: 8588463 - DNA, 22 bp, Homo sapiens
ttttattggagtgataccaagc

SEQ ID NO: 8588464 - DNA, 22 bp, Homo sapiens
ttgtacaagttttgagcttaag

SEQ ID NO: 8588465 - DNA, 23 bp, Homo sapiens
ttgtcctctggatcggtttggtt

SEQ ID NO: 8588466 - DNA, 22 bp, Homo sapiens
ttgtgtcccctgttctacctgt

SEQ ID NO: 8588467 - DNA, 22 bp, Homo sapiens
ttgtgtccccctttgagagcca

SEQ ID NO: 8588468 - DNA, 22 bp, Homo sapiens
ttgtgtccaaggctatggtgat

SEQ ID NO: 8588469 - DNA, 22 bp, Homo sapiens
ttgtgtccatttgagtcatgtg

SEQ ID NO: 8588470 - DNA, 21 bp, Homo sapiens
ttgtgtccttctaaagggcca

SEQ ID NO: 8588471 - DNA, 22 bp, Homo sapiens
ttgtgtcctgatttgacacaat

SEQ ID NO: 8588472 - DNA, 22 bp, Homo sapiens
ttgtgtcctctaatctcaccac

SEQ ID NO: 8588473 - DNA, 22 bp, Homo sapiens
ttgtgtcctaacatctagttaa

SEQ ID NO: 8588474 - DNA, 22 bp, Homo sapiens
ttgtgtcctaagcaccagatgg

SEQ ID NO: 8588475 - DNA, 22 bp, Homo sapiens
ttgtgtcctatatgcatgttct

SEQ ID NO: 8588476 - DNA, 22 bp, Homo sapiens
ttgtgtccctgcggctgaggag

SEQ ID NO: 8588477 - DNA, 22 bp, Homo sapiens
ttgtgtccctggagcttctgtg

SEQ ID NO: 8588478 - DNA, 22 bp, Homo sapiens
ttgtgtccctgtaagacaaagc

SEQ ID NO: 8588479 - DNA, 22 bp, Homo sapiens
ttggagagaggctgctcaggct

SEQ ID NO: 8588480 - DNA, 22 bp, Homo sapiens
ttggagagattatcagaccagc

SEQ ID NO: 8588481 - DNA, 22 bp, Homo sapiens
ttggagatatcacaccttcaca

SEQ ID NO: 8588482 - DNA, 22 bp, Homo sapiens
ttggagagggcttggatcacac

SEQ ID NO: 8588483 - DNA, 17 bp, Homo sapiens
ttgggagagaaaggtat

SEQ ID NO: 8588484 - DNA, 22 bp, Homo sapiens
ttgggagacaaaggctctgtct

SEQ ID NO: 8588485 - DNA, 22 bp, Homo sapiens
ttgggacatctggcatacagtt

SEQ ID NO: 8588486 - DNA, 22 bp, Homo sapiens
ttgggagattcattgagccaag

SEQ ID NO: 8588487 - DNA, 22 bp, Homo sapiens
ttggccagtggaaagaggagga

SEQ ID NO: 8588488 - DNA, 22 bp, Homo sapiens
ttggccaggtgtccagcccagg

SEQ ID NO: 8588489 - DNA, 22 bp, Homo sapiens
ttggccaggtgtaggtcacacc

SEQ ID NO: 8588490 - DNA, 22 bp, Homo sapiens
ttggccagtgaaccaggcctgg

SEQ ID NO: 8588491 - DNA, 22 bp, Homo sapiens
ttggccagtgcttgtgattttc

SEQ ID NO: 8588492 - DNA, 22 bp, Homo sapiens
ttggccaggtccatttctccat

SEQ ID NO: 8588493 - DNA, 22 bp, Homo sapiens
ttggccaggcatgaataaaaga

SEQ ID NO: 8588494 - DNA, 22 bp, Homo sapiens
ttggccagctctggaaagtggt

SEQ ID NO: 8588495 - DNA, 22 bp, Homo sapiens
ttggccagcagctctggcttag

SEQ ID NO: 8588496 - DNA, 22 bp, Homo sapiens
ttggccagcgacgaccttctta

SEQ ID NO: 8588497 - DNA, 22 bp, Homo sapiens
ttgggaagaggcccctggattc

SEQ ID NO: 8588498 - DNA, 22 bp, Homo sapiens
ttgggaagtaatatggtggtct

SEQ ID NO: 8588499 - DNA, 22 bp, Homo sapiens
ttgggaagtttaatgacagact

SEQ ID NO: 8588500 - DNA, 22 bp, Homo sapiens
ttgggaagaatggaggtggtta

SEQ ID NO: 8588501 - DNA, 22 bp, Homo sapiens
ttgcaattgctatggagagcgt

SEQ ID NO: 8588502 - DNA, 22 bp, Homo sapiens
ttggaaaatgtatttctagaag

SEQ ID NO: 8588503 - DNA, 22 bp, Homo sapiens
ttggaaacgtcaccttttcctt

SEQ ID NO: 8588504 - DNA, 22 bp, Homo sapiens
ttggaaagaagggctgagcaag

SEQ ID NO: 8588505 - DNA, 22 bp, Homo sapiens
ttggaaagggaggaatgtagac

SEQ ID NO: 8588506 - DNA, 22 bp, Homo sapiens
tttcaagagggaactgaacaca

SEQ ID NO: 8588507 - DNA, 22 bp, Homo sapiens
tttattgagtatctactatgtg

SEQ ID NO: 8588508 - DNA, 22 bp, Homo sapiens
tttattgacccaaagcgagagt

SEQ ID NO: 8588509 - DNA, 22 bp, Homo sapiens
tttattgacttcagtgagtctt

SEQ ID NO: 8588510 - DNA, 22 bp, Homo sapiens
tttattgacccaaagcgagagt

SEQ ID NO: 8588511 - DNA, 20 bp, Homo sapiens
tttattgagcacgtactgtg

SEQ ID NO: 8588512 - DNA, 22 bp, Homo sapiens
tttattgagcacccgttgtgcg

SEQ ID NO: 8588513 - DNA, 22 bp, Homo sapiens
tttcaaagtaaggattttcatc

SEQ ID NO: 8588514 - DNA, 20 bp, Homo sapiens
tttattcacagagaagagtt

SEQ ID NO: 8588515 - DNA, 22 bp, Homo sapiens
tttattgaacacttgcactggc

SEQ ID NO: 8588516 - DNA, 22 bp, Homo sapiens
tttattgaattgtaaccctatt

SEQ ID NO: 8588517 - DNA, 22 bp, Homo sapiens
tttattgaacacttgcactggc

SEQ ID NO: 8588518 - DNA, 22 bp, Homo sapiens
tttcattatgttcctggaagag

SEQ ID NO: 8588519 - DNA, 22 bp, Homo sapiens
tttcattgaactaaagaatctg

SEQ ID NO: 8588520 - DNA, 22 bp, Homo sapiens
tttcattcattatacagtagag

SEQ ID NO: 8588521 - DNA, 22 bp, Homo sapiens
tttcattgagactatagacatc

SEQ ID NO: 8588522 - DNA, 22 bp, Homo sapiens
tttcattgagaatataagattt

SEQ ID NO: 8588523 - DNA, 22 bp, Homo sapiens
tttcattgacagttgggggaaa

SEQ ID NO: 8588524 - DNA, 21 bp, Homo sapiens
tttcattgaatgagataaggt

SEQ ID NO: 8588525 - DNA, 22 bp, Homo sapiens
tttcatgagattcctccacatc

SEQ ID NO: 8588526 - DNA, 22 bp, Homo sapiens
tttcatgtatttcccaaagctt

SEQ ID NO: 8588527 - DNA, 23 bp, Homo sapiens
tttcacagcttttattctgcatc

SEQ ID NO: 8588528 - DNA, 22 bp, Homo sapiens
tttcacagctgtcttccgtctc

SEQ ID NO: 8588529 - DNA, 22 bp, Homo sapiens
tttcagagaattagaagctgat

SEQ ID NO: 8588530 - DNA, 22 bp, Homo sapiens
tttatctgaaaaaactcttgga

SEQ ID NO: 8588531 - DNA, 22 bp, Homo sapiens
tttattcaagatgaggttcatg

SEQ ID NO: 8588532 - DNA, 22 bp, Homo sapiens
tttatctgaggaaagcagacaa

SEQ ID NO: 8588533 - DNA, 22 bp, Homo sapiens
tttatatttcccaggattggcc

SEQ ID NO: 8588534 - DNA, 22 bp, Homo sapiens
tttaaagaaattcctcatcttt

SEQ ID NO: 8588535 - DNA, 22 bp, Homo sapiens
tttaatgggatccatctggtta

SEQ ID NO: 8588536 - DNA, 22 bp, Homo sapiens
ttcacagagttatttttatgct

SEQ ID NO: 8588537 - DNA, 22 bp, Homo sapiens
ttcaaagagttgggtgtctggg

SEQ ID NO: 8588538 - DNA, 22 bp, Homo sapiens
ttcaaagataatgtagcatttt

SEQ ID NO: 8588539 - DNA, 20 bp, Homo sapiens
ttcaaagaccctcaggtcca

SEQ ID NO: 8588540 - DNA, 22 bp, Homo sapiens
ttcaaagagaaattgtattttc

SEQ ID NO: 8588541 - DNA, 21 bp, Homo sapiens
ttcaaagacttgatgctgacc

SEQ ID NO: 8588542 - DNA, 22 bp, Homo sapiens
ttcaaagatggagggatagatt

SEQ ID NO: 8588543 - DNA, 23 bp, Homo sapiens
ttcaaagatcttctgaaatctgt

SEQ ID NO: 8588544 - DNA, 22 bp, Homo sapiens
ttcagaggacaaccagccatct

SEQ ID NO: 8588545 - DNA, 22 bp, Homo sapiens
ttcagagaaactgaggtttaga

SEQ ID NO: 8588546 - DNA, 22 bp, Homo sapiens
ttcagagagtccagtatgcagt

SEQ ID NO: 8588547 - DNA, 22 bp, Homo sapiens
ttcagagacagcaaccaggaca

SEQ ID NO: 8588548 - DNA, 22 bp, Homo sapiens
ttcattggtcctgctcctggac

SEQ ID NO: 8588549 - DNA, 22 bp, Homo sapiens
ttccaggaattcagctctcagt

SEQ ID NO: 8588550 - DNA, 22 bp, Homo sapiens
ttccagtccagggctgtttcca

SEQ ID NO: 8588551 - DNA, 22 bp, Homo sapiens
ttccagtctggcctgtgcttag

SEQ ID NO: 8588552 - DNA, 22 bp, Homo sapiens
ttatagatctaaatgtgaaggg

SEQ ID NO: 8588553 - DNA, 19 bp, Homo sapiens
tcctgcctggggccgcctg

SEQ ID NO: 8588554 - DNA, 22 bp, Homo sapiens
tcctgcctgtttacctgtactt

SEQ ID NO: 8588555 - DNA, 18 bp, Homo sapiens
tcctgcctgtgccccagg

SEQ ID NO: 8588556 - DNA, 22 bp, Homo sapiens
tcctgcctgcaatcccagcact

SEQ ID NO: 8588557 - DNA, 18 bp, Homo sapiens
tcctgcctgcgggctccc

SEQ ID NO: 8588558 - DNA, 22 bp, Homo sapiens
tcctgcctgtttacctgtactt

SEQ ID NO: 8588559 - DNA, 20 bp, Homo sapiens
tcctgctgccacctcttctt

SEQ ID NO: 8588560 - DNA, 22 bp, Homo sapiens
ttattacactgaaagaattgcg

SEQ ID NO: 8588561 - DNA, 22 bp, Homo sapiens
ttattataatgagggataaaaa

SEQ ID NO: 8588562 - DNA, 20 bp, Homo sapiens
ttatatcataatgtgccaat

SEQ ID NO: 8588563 - DNA, 22 bp, Homo sapiens
ttatatcagaaggtgagattga

SEQ ID NO: 8588564 - DNA, 22 bp, Homo sapiens
ttattgactgatcagagaggga

SEQ ID NO: 8588565 - DNA, 22 bp, Homo sapiens
ttattgagaccgtaagtcaggt

SEQ ID NO: 8588566 - DNA, 22 bp, Homo sapiens
ttattgagaccgtaagtcaggt

SEQ ID NO: 8588567 - DNA, 21 bp, Homo sapiens
ttattgagacatttgtggaaa

SEQ ID NO: 8588568 - DNA, 22 bp, Homo sapiens
ttattgagagctgttttatggc

SEQ ID NO: 8588569 - DNA, 22 bp, Homo sapiens
ttattgagcaactctggggctc

SEQ ID NO: 8588570 - DNA, 22 bp, Homo sapiens
ttattgagcacatagtatgtgg

SEQ ID NO: 8588571 - DNA, 18 bp, Homo sapiens
ttattggtgctgctgttc

SEQ ID NO: 8588572 - DNA, 22 bp, Homo sapiens
ttattgtagcactttggcagtg

SEQ ID NO: 8588573 - DNA, 22 bp, Homo sapiens
ttattgagcacctactatgtgt

SEQ ID NO: 8588574 - DNA, 22 bp, Homo sapiens
ttattgcttttgtgcaggtgag

SEQ ID NO: 8588575 - DNA, 22 bp, Homo sapiens
ttcaaacagtgtagaatatatg

SEQ ID NO: 8588576 - DNA, 22 bp, Homo sapiens
ttcctggggtactggagaaaat

SEQ ID NO: 8588577 - DNA, 22 bp, Homo sapiens
ttcctggcattatgggaggctg

SEQ ID NO: 8588578 - DNA, 22 bp, Homo sapiens
ttcctggaaattatgctcacct

SEQ ID NO: 8588579 - DNA, 22 bp, Homo sapiens
ttcctggcaccaccacttctag

SEQ ID NO: 8588580 - DNA, 22 bp, Homo sapiens
ttcctgagtcccgggtaaagat

SEQ ID NO: 8588581 - DNA, 22 bp, Homo sapiens
ttcctgagggccccagaggagg

SEQ ID NO: 8588582 - DNA, 22 bp, Homo sapiens
ttcctgagaaatttgtacctgg

SEQ ID NO: 8588583 - DNA, 22 bp, Homo sapiens
ttccagtttgcagttgacacta

SEQ ID NO: 8588584 - DNA, 22 bp, Homo sapiens
ttcttcaataaattcccataag

SEQ ID NO: 8588585 - DNA, 22 bp, Homo sapiens
ttcttcaacaaggacactgtta

SEQ ID NO: 8588586 - DNA, 22 bp, Homo sapiens
ttcttattatgtgctctgtgaa

SEQ ID NO: 8588587 - DNA, 23 bp, Homo sapiens
ttcttatttactttggaatctcc

SEQ ID NO: 8588588 - DNA, 22 bp, Homo sapiens
ttgaaatatttgggagtgtttg

SEQ ID NO: 8588589 - DNA, 22 bp, Homo sapiens
ttgaagaaagtcatatataatg

SEQ ID NO: 8588590 - DNA, 22 bp, Homo sapiens
ttctgtgtgccagagttgtgct

SEQ ID NO: 8588591 - DNA, 22 bp, Homo sapiens
ttctgtggctgggagcctggct

SEQ ID NO: 8588592 - DNA, 22 bp, Homo sapiens
ttctgtggtctcccatgtctgt

SEQ ID NO: 8588593 - DNA, 22 bp, Homo sapiens
ttctgtgggtaatacctcatac

SEQ ID NO: 8588594 - DNA, 22 bp, Homo sapiens
ttctggagatagtcaggcatta

SEQ ID NO: 8588595 - DNA, 22 bp, Homo sapiens
ggtgcagaaggaagggagctgg

SEQ ID NO: 8588596 - DNA, 18 bp, Homo sapiens
cagatgctaggcctccag

SEQ ID NO: 8588597 - DNA, 22 bp, Homo sapiens
ggtgcagaggagccagctgggg

SEQ ID NO: 8588598 - DNA, 22 bp, Homo sapiens
ggtgcagagtccacagaaagct

SEQ ID NO: 8588599 - DNA, 22 bp, Homo sapiens
cagatgctgcctgggaatgtct

SEQ ID NO: 8588600 - DNA, 22 bp, Homo sapiens
cagatgctgctatttcaccctg

SEQ ID NO: 8588601 - DNA, 22 bp, Homo sapiens
cagatgctgctcacctgattat

SEQ ID NO: 8588602 - DNA, 22 bp, Homo sapiens
cagatgctatagtgctgccata

SEQ ID NO: 8588603 - DNA, 22 bp, Homo sapiens
cagatgctggtatgggggaggt

SEQ ID NO: 8588604 - DNA, 20 bp, Homo sapiens
cagatgctggatcttggtcc

SEQ ID NO: 8588605 - DNA, 22 bp, Homo sapiens
cagatgcttcgtgggtgagcac

SEQ ID NO: 8588606 - DNA, 22 bp, Homo sapiens
cagaggctgagcagtcagtttg

SEQ ID NO: 8588607 - DNA, 22 bp, Homo sapiens
ggggtagggtgattgtgaagta

SEQ ID NO: 8588608 - DNA, 22 bp, Homo sapiens
ggggtaggtcatagcccctcta

SEQ ID NO: 8588609 - DNA, 22 bp, Homo sapiens
ggggtatgcttagtaagtacca

SEQ ID NO: 8588610 - DNA, 22 bp, Homo sapiens
ggggtcggggcatagccactta

SEQ ID NO: 8588611 - DNA, 22 bp, Homo sapiens
cagagtgtttctttgggtgggt

SEQ ID NO: 8588612 - DNA, 22 bp, Homo sapiens
cagagtggtgcaagggcagtgt

SEQ ID NO: 8588613 - DNA, 22 bp, Homo sapiens
cagagtggtgcaagggcagtgt

SEQ ID NO: 8588614 - DNA, 22 bp, Homo sapiens
cagcagactggagtaggcagtg

SEQ ID NO: 8588615 - DNA, 22 bp, Homo sapiens
cagcagagaaattacatatttg

SEQ ID NO: 8588616 - DNA, 22 bp, Homo sapiens
cagcagagaaattacatatttg

SEQ ID NO: 8588617 - DNA, 22 bp, Homo sapiens
cagcagagaccaagtgatttga

SEQ ID NO: 8588618 - DNA, 22 bp, Homo sapiens
cagcagagaccaagtgatttga

SEQ ID NO: 8588619 - DNA, 20 bp, Homo sapiens
cagcagagacccatggggag

SEQ ID NO: 8588620 - DNA, 22 bp, Homo sapiens
ggtgtccttgtcctttggtacc

SEQ ID NO: 8588621 - DNA, 22 bp, Homo sapiens
ggtgtcctttgggggctccgag

SEQ ID NO: 8588622 - DNA, 22 bp, Homo sapiens
ggtgtccttgttgaacgaaaat

SEQ ID NO: 8588623 - DNA, 22 bp, Homo sapiens
ggtgtcctttgggggctccgag

SEQ ID NO: 8588624 - DNA, 22 bp, Homo sapiens
ggtgggaaggggccagtgtgcg

SEQ ID NO: 8588625 - DNA, 22 bp, Homo sapiens
ggtgctggttcagggtggctgt

SEQ ID NO: 8588626 - DNA, 22 bp, Homo sapiens
cagatggcaacagctctgtgac

SEQ ID NO: 8588627 - DNA, 22 bp, Homo sapiens
cagatgcttttgattctggggt

SEQ ID NO: 8588628 - DNA, 22 bp, Homo sapiens
cagatgcttgttggctggtctc

SEQ ID NO: 8588629 - DNA, 22 bp, Homo sapiens
cagatgcttggaggacacttgg

SEQ ID NO: 8588630 - DNA, 20 bp, Homo sapiens
cagaagcaaggcaggtacct

SEQ ID NO: 8588631 - DNA, 22 bp, Homo sapiens
cagaagcagattctaaagcaag

SEQ ID NO: 8588632 - DNA, 22 bp, Homo sapiens
cagaagcagattctaaagcaag

SEQ ID NO: 8588633 - DNA, 22 bp, Homo sapiens
cagaagcactaggaggaaacgt

SEQ ID NO: 8588634 - DNA, 22 bp, Homo sapiens
cagagagaatcttggcagctga

SEQ ID NO: 8588635 - DNA, 22 bp, Homo sapiens
cagagagaatcttggcagctga

SEQ ID NO: 8588636 - DNA, 22 bp, Homo sapiens
cagagagaggggctgcctggcc

SEQ ID NO: 8588637 - DNA, 19 bp, Homo sapiens
cagagagaccaaggcgcca

SEQ ID NO: 8588638 - DNA, 19 bp, Homo sapiens
cagagagaccaaggcgcca

SEQ ID NO: 8588639 - DNA, 22 bp, Homo sapiens
cagagagagcaggaaacctccg

SEQ ID NO: 8588640 - DNA, 22 bp, Homo sapiens
gggccctgcgtccggaagtctg

SEQ ID NO: 8588641 - DNA, 22 bp, Homo sapiens
gggccagctctgtgatgtaggg

SEQ ID NO: 8588642 - DNA, 22 bp, Homo sapiens
cagagagagtggggtgtggatt

SEQ ID NO: 8588643 - DNA, 22 bp, Homo sapiens
cagagagcatgggaggcccgag

SEQ ID NO: 8588644 - DNA, 21 bp, Homo sapiens
cagagagctagaacttcatga

SEQ ID NO: 8588645 - DNA, 22 bp, Homo sapiens
cagagagcttgcccttgtatat

SEQ ID NO: 8588646 - DNA, 22 bp, Homo sapiens
cagagagcttagtgtgctgcat

SEQ ID NO: 8588647 - DNA, 22 bp, Homo sapiens
gggccctgggattcagagcaag

SEQ ID NO: 8588648 - DNA, 22 bp, Homo sapiens
cagagcaggaatagggtgttga

SEQ ID NO: 8588649 - DNA, 22 bp, Homo sapiens
gggctcaggcctggcctctcac

SEQ ID NO: 8588650 - DNA, 22 bp, Homo sapiens
gggctcaggagtttgaggctgc

SEQ ID NO: 8588651 - DNA, 22 bp, Homo sapiens
gggctcaggtcagggcatcagc

SEQ ID NO: 8588652 - DNA, 22 bp, Homo sapiens
gggctcagtctggcgtggaatg

SEQ ID NO: 8588653 - DNA, 22 bp, Homo sapiens
gggctcagtctgcggcgcgcgg

SEQ ID NO: 8588654 - DNA, 22 bp, Homo sapiens
cagaggaaatgggaaggagata

SEQ ID NO: 8588655 - DNA, 22 bp, Homo sapiens
cagagcttgaatgtccatggtt

SEQ ID NO: 8588656 - DNA, 22 bp, Homo sapiens
gggggatgctcaggaggctgct

SEQ ID NO: 8588657 - DNA, 22 bp, Homo sapiens
ggggcggggctctgagaagcat

SEQ ID NO: 8588658 - DNA, 22 bp, Homo sapiens
cagcagagacggtaagcagaac

SEQ ID NO: 8588659 - DNA, 22 bp, Homo sapiens
cagcagagacggtaagcagaac

SEQ ID NO: 8588660 - DNA, 22 bp, Homo sapiens
cagcagagatgagattcctata

SEQ ID NO: 8588661 - DNA, 23 bp, Homo sapiens
cagcagagagcagacctttgtgt

SEQ ID NO: 8588662 - DNA, 23 bp, Homo sapiens
cagcagagagcagacctttgtgt

SEQ ID NO: 8588663 - DNA, 22 bp, Homo sapiens
cagcagagctgggctttgaatt

SEQ ID NO: 8588664 - DNA, 22 bp, Homo sapiens
cagcagggttaagtgactcacc

SEQ ID NO: 8588665 - DNA, 22 bp, Homo sapiens
cagcagggaagctgtgctgttt

SEQ ID NO: 8588666 - DNA, 22 bp, Homo sapiens
cagcagagctgtgtgggaaggg

SEQ ID NO: 8588667 - DNA, 22 bp, Homo sapiens
cagcaggtgtctagcaagggtc

SEQ ID NO: 8588668 - DNA, 22 bp, Homo sapiens
cagcaggtggacacactcacct

SEQ ID NO: 8588669 - DNA, 22 bp, Homo sapiens
cagcatgaccctggagcctgca

SEQ ID NO: 8588670 - DNA, 22 bp, Homo sapiens
gtctttggaggcactgttgagt

SEQ ID NO: 8588671 - DNA, 18 bp, Homo sapiens
gtctttggagtggaggta

SEQ ID NO: 8588672 - DNA, 22 bp, Homo sapiens
gtctttcttaattcaagtgctt

SEQ ID NO: 8588673 - DNA, 22 bp, Homo sapiens
gtctccagaagcctagacagcc

SEQ ID NO: 8588674 - DNA, 22 bp, Homo sapiens
gtgcaaaagtaatggcagtttt

SEQ ID NO: 8588675 - DNA, 22 bp, Homo sapiens
gtgcaaaagtaattgcagtttt

SEQ ID NO: 8588676 - DNA, 22 bp, Homo sapiens
gtgcaggagccaggggtaggaa

SEQ ID NO: 8588677 - DNA, 22 bp, Homo sapiens
gtgcctggtttggggagtgttc

SEQ ID NO: 8588678 - DNA, 22 bp, Homo sapiens
gtgcctggtatgtaggtagcgg

SEQ ID NO: 8588679 - DNA, 22 bp, Homo sapiens
cagcctaacccatctgatgcag

SEQ ID NO: 8588680 - DNA, 22 bp, Homo sapiens
gtgccctgacacacctggtgtg

SEQ ID NO: 8588681 - DNA, 22 bp, Homo sapiens
gtgcctgggacacagcagatac

SEQ ID NO: 8588682 - DNA, 22 bp, Homo sapiens
gtgcctgggcatgagcttgttg

SEQ ID NO: 8588683 - DNA, 22 bp, Homo sapiens
gtgcctggggttgagctatgaa

SEQ ID NO: 8588684 - DNA, 21 bp, Homo sapiens
gtgcatggagaaaggcttgct

SEQ ID NO: 8588685 - DNA, 22 bp, Homo sapiens
gtgcatggccagggtggtctgg

SEQ ID NO: 8588686 - DNA, 23 bp, Homo sapiens
gctgaggtcctgctgagtggtgg

SEQ ID NO: 8588687 - DNA, 22 bp, Homo sapiens
gctgaggtgaggctggaaagga

SEQ ID NO: 8588688 - DNA, 22 bp, Homo sapiens
gctggccagtgtggtgaccacc

SEQ ID NO: 8588689 - DNA, 19 bp, Homo sapiens
gctgaggtggaggaaggag

SEQ ID NO: 8588690 - DNA, 19 bp, Homo sapiens
gctgaggtggaggaaggag

SEQ ID NO: 8588691 - DNA, 22 bp, Homo sapiens
gctgggagccgtacctgtcacg

SEQ ID NO: 8588692 - DNA, 22 bp, Homo sapiens
gctgggcccagatcccaggatc

SEQ ID NO: 8588693 - DNA, 22 bp, Homo sapiens
gctgggccccatccctcgagca

SEQ ID NO: 8588694 - DNA, 20 bp, Homo sapiens
gctgggctaccactggccct

SEQ ID NO: 8588695 - DNA, 22 bp, Homo sapiens
gctgggagcaaagccatgcata

SEQ ID NO: 8588696 - DNA, 22 bp, Homo sapiens
gctgggagcaagtactcatctt

SEQ ID NO: 8588697 - DNA, 22 bp, Homo sapiens
gctgggagccctggtctgctcc

SEQ ID NO: 8588698 - DNA, 19 bp, Homo sapiens
gctgggagcagaccctccc

SEQ ID NO: 8588699 - DNA, 22 bp, Homo sapiens
gctgggagccccgagccagcgc

SEQ ID NO: 8588700 - DNA, 22 bp, Homo sapiens
gctggccatggcctgcgccatc

SEQ ID NO: 8588701 - DNA, 22 bp, Homo sapiens
gctggccatatattttgctgtt

SEQ ID NO: 8588702 - DNA, 22 bp, Homo sapiens
gctggccatggggagtgaggag

SEQ ID NO: 8588703 - DNA, 22 bp, Homo sapiens
ggaacacagtgccttacaaact

SEQ ID NO: 8588704 - DNA, 22 bp, Homo sapiens
gcttccagcaccagcagagggg

SEQ ID NO: 8588705 - DNA, 19 bp, Homo sapiens
gcttccagcactgcaggag

SEQ ID NO: 8588706 - DNA, 20 bp, Homo sapiens
gcttccagaggaggccccgt

SEQ ID NO: 8588707 - DNA, 22 bp, Homo sapiens
caagtcacatggccaactgatg

SEQ ID NO: 8588708 - DNA, 17 bp, Homo sapiens
gctggtccttggtaact

SEQ ID NO: 8588709 - DNA, 22 bp, Homo sapiens
gctggtcctggggttgcagcat

SEQ ID NO: 8588710 - DNA, 22 bp, Homo sapiens
gctggtgctctgggccctgagg

SEQ ID NO: 8588711 - DNA, 22 bp, Homo sapiens
gctggtggtaaggaggaaaaag

SEQ ID NO: 8588712 - DNA, 22 bp, Homo sapiens
gctggtgtctaacctggctctt

SEQ ID NO: 8588713 - DNA, 22 bp, Homo sapiens
cacagagacagaagcacttatg

SEQ ID NO: 8588714 - DNA, 22 bp, Homo sapiens
ggagatatttgtattctgtctc

SEQ ID NO: 8588715 - DNA, 22 bp, Homo sapiens
cacagagaatgatgagtcactg

SEQ ID NO: 8588716 - DNA, 22 bp, Homo sapiens
ggacagcatatcagcagggcag

SEQ ID NO: 8588717 - DNA, 22 bp, Homo sapiens
ggacagcacagctcttgacaac

SEQ ID NO: 8588718 - DNA, 22 bp, Homo sapiens
ggacagctctgccaggagctca

SEQ ID NO: 8588719 - DNA, 22 bp, Homo sapiens
ggacaagcctcagacaaaactc

SEQ ID NO: 8588720 - DNA, 23 bp, Homo sapiens
ggacacagagataagtgagacaa

SEQ ID NO: 8588721 - DNA, 22 bp, Homo sapiens
ggaacaggaaaggagggatgct

SEQ ID NO: 8588722 - DNA, 22 bp, Homo sapiens
ggaacagggatttggcctggtt

SEQ ID NO: 8588723 - DNA, 22 bp, Homo sapiens
ggaagacatctgcttgcaccag

SEQ ID NO: 8588724 - DNA, 22 bp, Homo sapiens
ggaagagaaatgagtcaagact

SEQ ID NO: 8588725 - DNA, 22 bp, Homo sapiens
ggaagagagggctgggcctcaa

SEQ ID NO: 8588726 - DNA, 22 bp, Homo sapiens
ggagggcaacttttcagtaggt

SEQ ID NO: 8588727 - DNA, 22 bp, Homo sapiens
ggagggcacaggaccagaaatc

SEQ ID NO: 8588728 - DNA, 22 bp, Homo sapiens
ggagggcaacttttcagtaggt

SEQ ID NO: 8588729 - DNA, 22 bp, Homo sapiens
cacaggagagctgggaggtgcc

SEQ ID NO: 8588730 - DNA, 18 bp, Homo sapiens
cacaggagatgacctgac

SEQ ID NO: 8588731 - DNA, 22 bp, Homo sapiens
ggagcaggagtctcttgaattt

SEQ ID NO: 8588732 - DNA, 22 bp, Homo sapiens
ggagcagccgcgtctcagggca

SEQ ID NO: 8588733 - DNA, 22 bp, Homo sapiens
ggagcagccacgtctcagggca

SEQ ID NO: 8588734 - DNA, 22 bp, Homo sapiens
cacagcagggatgaatggagtg

SEQ ID NO: 8588735 - DNA, 22 bp, Homo sapiens
cacagcattaactgggacagct

SEQ ID NO: 8588736 - DNA, 22 bp, Homo sapiens
ggatatatgcatgttatcattt

SEQ ID NO: 8588737 - DNA, 22 bp, Homo sapiens
ggatcagaatctttgggtgtaa

SEQ ID NO: 8588738 - DNA, 22 bp, Homo sapiens
ggcaggaagaggagggtgaact

SEQ ID NO: 8588739 - DNA, 22 bp, Homo sapiens
ggcagcttttccaggctctcca

SEQ ID NO: 8588740 - DNA, 22 bp, Homo sapiens
ggcaggaagtagcagtctgagc

SEQ ID NO: 8588741 - DNA, 22 bp, Homo sapiens
ggcaggtgtttttatattaaag

SEQ ID NO: 8588742 - DNA, 22 bp, Homo sapiens
ggcaggtgtggtgaccagagat

SEQ ID NO: 8588743 - DNA, 22 bp, Homo sapiens
ggcaggtgccttctgtgctagc

SEQ ID NO: 8588744 - DNA, 22 bp, Homo sapiens
ggcaggtgtgagctgtaaagga

SEQ ID NO: 8588745 - DNA, 19 bp, Homo sapiens
ggcaggtgtgcttatgctt

SEQ ID NO: 8588746 - DNA, 22 bp, Homo sapiens
ggcaggtgtggtgaccagagat

SEQ ID NO: 8588747 - DNA, 22 bp, Homo sapiens
ggcaggtgtggagtgttatttt

SEQ ID NO: 8588748 - DNA, 22 bp, Homo sapiens
ggcccagcccgagtcagccttc

SEQ ID NO: 8588749 - DNA, 22 bp, Homo sapiens
ggcccagcatcttgtgaagttt

SEQ ID NO: 8588750 - DNA, 22 bp, Homo sapiens
ggcccagcatcttgtgaagttt

SEQ ID NO: 8588751 - DNA, 22 bp, Homo sapiens
ggcccagcacagtgcttggggg

SEQ ID NO: 8588752 - DNA, 22 bp, Homo sapiens
ggcccagattagaagctgaatg

SEQ ID NO: 8588753 - DNA, 22 bp, Homo sapiens
ggcccagagctccctggcacct

SEQ ID NO: 8588754 - DNA, 22 bp, Homo sapiens
ggcgcagtgtgcagaggagtga

SEQ ID NO: 8588755 - DNA, 22 bp, Homo sapiens
ggcgagggagcagtgcggtggg

SEQ ID NO: 8588756 - DNA, 22 bp, Homo sapiens
ggccccaggcctttggtctggc

SEQ ID NO: 8588757 - DNA, 22 bp, Homo sapiens
cacccaggctagagtgcagtgg

SEQ ID NO: 8588758 - DNA, 18 bp, Homo sapiens
ggccagctcctgaggcag

SEQ ID NO: 8588759 - DNA, 18 bp, Homo sapiens
ggccagctcctgaggcag

SEQ ID NO: 8588760 - DNA, 22 bp, Homo sapiens
ggccagctccttggcagtgcct

SEQ ID NO: 8588761 - DNA, 22 bp, Homo sapiens
ggccagctacccatctgcgtca

SEQ ID NO: 8588762 - DNA, 22 bp, Homo sapiens
ggccactgtttcctgggcagtt

SEQ ID NO: 8588763 - DNA, 22 bp, Homo sapiens
ggctcctgtcccctcagctgct

SEQ ID NO: 8588764 - DNA, 18 bp, Homo sapiens
ggctcctgtgatcacatt

SEQ ID NO: 8588765 - DNA, 22 bp, Homo sapiens
ggctcctgtggcaagacagctt

SEQ ID NO: 8588766 - DNA, 22 bp, Homo sapiens
cactgcccttacatgccctgca

SEQ ID NO: 8588767 - DNA, 22 bp, Homo sapiens
cactgccctgggggttgccatc

SEQ ID NO: 8588768 - DNA, 20 bp, Homo sapiens
cactgccctccagcctgagc

SEQ ID NO: 8588769 - DNA, 22 bp, Homo sapiens
cactgccctcactgtggttctc

SEQ ID NO: 8588770 - DNA, 22 bp, Homo sapiens
cactgcccaggacctgccaccc

SEQ ID NO: 8588771 - DNA, 22 bp, Homo sapiens
ggcgctctggacctggctctcg

SEQ ID NO: 8588772 - DNA, 22 bp, Homo sapiens
cactgcaacctccacctcctgg

SEQ ID NO: 8588773 - DNA, 22 bp, Homo sapiens
ggctccagtttccccttggggc

SEQ ID NO: 8588774 - DNA, 22 bp, Homo sapiens
ggctccagtttgtgccttcagc

SEQ ID NO: 8588775 - DNA, 22 bp, Homo sapiens
ggctgcagaggcgatctgaggt

SEQ ID NO: 8588776 - DNA, 22 bp, Homo sapiens
ggctgcagattgtagtctgtta

SEQ ID NO: 8588777 - DNA, 22 bp, Homo sapiens
ggctgcagcagagggactcacg

SEQ ID NO: 8588778 - DNA, 22 bp, Homo sapiens
ggctgcagcagagggactcacg

SEQ ID NO: 8588779 - DNA, 22 bp, Homo sapiens
ggctgccttgaccctggctccg

SEQ ID NO: 8588780 - DNA, 22 bp, Homo sapiens
cagaacagacttaacagggctg

SEQ ID NO: 8588781 - DNA, 22 bp, Homo sapiens
ggctgctgtgacctcaggtgat

SEQ ID NO: 8588782 - DNA, 20 bp, Homo sapiens
ggctgctggtttggctctgt

SEQ ID NO: 8588783 - DNA, 22 bp, Homo sapiens
ggctgctgtactgatgtcagtt

SEQ ID NO: 8588784 - DNA, 21 bp, Homo sapiens
ggctgctgtcaccgctgtcac

SEQ ID NO: 8588785 - DNA, 21 bp, Homo sapiens
ggctgctgtcaccgctgtcac

SEQ ID NO: 8588786 - DNA, 22 bp, Homo sapiens
ggctgctggtaggggtaggaag

SEQ ID NO: 8588787 - DNA, 22 bp, Homo sapiens
ggctgctggtaggggtaggaag

SEQ ID NO: 8588788 - DNA, 22 bp, Homo sapiens
cagaagaggactgggtagctca

SEQ ID NO: 8588789 - DNA, 17 bp, Homo sapiens
ggcttcagggagctggg

SEQ ID NO: 8588790 - DNA, 22 bp, Homo sapiens
gaacattattgtacaaatgtct

SEQ ID NO: 8588791 - DNA, 22 bp, Homo sapiens
atgaatgatgccagttgaaatg

SEQ ID NO: 8588792 - DNA, 22 bp, Homo sapiens
gaaaataggctgcatctccttc

SEQ ID NO: 8588793 - DNA, 22 bp, Homo sapiens
gaaaagagaacatctgaggatc

SEQ ID NO: 8588794 - DNA, 22 bp, Homo sapiens
atcttccttcactttctcccac

SEQ ID NO: 8588795 - DNA, 22 bp, Homo sapiens
atgcttgtagtgtaatcactgt

SEQ ID NO: 8588796 - DNA, 22 bp, Homo sapiens
gacagtggttccaaggcagctt

SEQ ID NO: 8588797 - DNA, 22 bp, Homo sapiens
gacagtggattcatctagtcaa

SEQ ID NO: 8588798 - DNA, 22 bp, Homo sapiens
gacagggaggaaagagactgct

SEQ ID NO: 8588799 - DNA, 22 bp, Homo sapiens
gaccctggaactttcagcagag

SEQ ID NO: 8588800 - DNA, 22 bp, Homo sapiens
gaagcagacttttgcttatttg

SEQ ID NO: 8588801 - DNA, 22 bp, Homo sapiens
gaagcagaacccactccccaac

SEQ ID NO: 8588802 - DNA, 22 bp, Homo sapiens
gaagcagagcctaaggcagaca

SEQ ID NO: 8588803 - DNA, 22 bp, Homo sapiens
gaagcacatggctgtgagcaac

SEQ ID NO: 8588804 - DNA, 22 bp, Homo sapiens
gaagcacatggctgtgagcaac

SEQ ID NO: 8588805 - DNA, 22 bp, Homo sapiens
gacagggacgaggcttcaggca

SEQ ID NO: 8588806 - DNA, 22 bp, Homo sapiens
gacaggaaatatgggggttgtt

SEQ ID NO: 8588807 - DNA, 22 bp, Homo sapiens
gagtccagtagttaggacagag

SEQ ID NO: 8588808 - DNA, 22 bp, Homo sapiens
gagttatagatggactattatt

SEQ ID NO: 8588809 - DNA, 22 bp, Homo sapiens
gatctcaaagcagtgtgggttg

SEQ ID NO: 8588810 - DNA, 17 bp, Homo sapiens
gaggtaggaagtgagtc

SEQ ID NO: 8588811 - DNA, 22 bp, Homo sapiens
gaggtaggctgtgaaagggggt

SEQ ID NO: 8588812 - DNA, 22 bp, Homo sapiens
gagggcagaaaattatgcggtg

SEQ ID NO: 8588813 - DNA, 19 bp, Homo sapiens
gaggggaggaattgacaag

SEQ ID NO: 8588814 - DNA, 22 bp, Homo sapiens
gaggggggcgccctgcagtgca

SEQ ID NO: 8588815 - DNA, 22 bp, Homo sapiens
gaggctgtttgtggcagtgatg

SEQ ID NO: 8588816 - DNA, 22 bp, Homo sapiens
gagcagggcttgtcctcctcat

SEQ ID NO: 8588817 - DNA, 22 bp, Homo sapiens
gagcaggtctttcatggtgcat

SEQ ID NO: 8588818 - DNA, 17 bp, Homo sapiens
gagcagggatgcggttc

SEQ ID NO: 8588819 - DNA, 22 bp, Homo sapiens
gagcagggccacttctgtacct

SEQ ID NO: 8588820 - DNA, 22 bp, Homo sapiens
gagcagggagacaactctggtg

SEQ ID NO: 8588821 - DNA, 22 bp, Homo sapiens
gagcctggcctcctgcctcagc

SEQ ID NO: 8588822 - DNA, 20 bp, Homo sapiens
gagcctgggaagtctaaggt

SEQ ID NO: 8588823 - DNA, 22 bp, Homo sapiens
gagcctgggtccttccctggga

SEQ ID NO: 8588824 - DNA, 22 bp, Homo sapiens
gagctctgcagattgttttagg

SEQ ID NO: 8588825 - DNA, 22 bp, Homo sapiens
gagaggctgatcctgcagagaa

SEQ ID NO: 8588826 - DNA, 22 bp, Homo sapiens
gagaggctgactggctgtcctg

SEQ ID NO: 8588827 - DNA, 22 bp, Homo sapiens
gagaggtggaggttgcagtgag

SEQ ID NO: 8588828 - DNA, 22 bp, Homo sapiens
gagcagctcaggcacttagcca

SEQ ID NO: 8588829 - DNA, 22 bp, Homo sapiens
gagcacagtaaagcagtgtcac

SEQ ID NO: 8588830 - DNA, 22 bp, Homo sapiens
atgtacaacctgcatgacagtc

SEQ ID NO: 8588831 - DNA, 22 bp, Homo sapiens
gagctggggcggatactcagct

SEQ ID NO: 8588832 - DNA, 22 bp, Homo sapiens
gagctggggcggatactcagct

SEQ ID NO: 8588833 - DNA, 22 bp, Homo sapiens
gagctctggcagggcaggtctg

SEQ ID NO: 8588834 - DNA, 22 bp, Homo sapiens
gaggaaggagggaaagcgcgcg

SEQ ID NO: 8588835 - DNA, 22 bp, Homo sapiens
gaggaaggaatgcagtgtatgc

SEQ ID NO: 8588836 - DNA, 22 bp, Homo sapiens
gaggaagcttttgatcgcccag

SEQ ID NO: 8588837 - DNA, 22 bp, Homo sapiens
gaggaaggatttagtttgaggg

SEQ ID NO: 8588838 - DNA, 22 bp, Homo sapiens
gagctttgcattattcagaagc

SEQ ID NO: 8588839 - DNA, 22 bp, Homo sapiens
gaggaagcagggcttggctgag

SEQ ID NO: 8588840 - DNA, 22 bp, Homo sapiens
gaggaagccccattgaagccag

SEQ ID NO: 8588841 - DNA, 22 bp, Homo sapiens
gaggaagctgcgtggcatttca

SEQ ID NO: 8588842 - DNA, 22 bp, Homo sapiens
gaggaagcattgacataatctc

SEQ ID NO: 8588843 - DNA, 22 bp, Homo sapiens
gcacacagggatttttgaatgg

SEQ ID NO: 8588844 - DNA, 22 bp, Homo sapiens
gcaaaagtacagccggatttct

SEQ ID NO: 8588845 - DNA, 22 bp, Homo sapiens
gcactcaggactctcatcagta

SEQ ID NO: 8588846 - DNA, 22 bp, Homo sapiens
gcacagagcctggtaccgagaa

SEQ ID NO: 8588847 - DNA, 22 bp, Homo sapiens
gcacagagctggccctccaggc

SEQ ID NO: 8588848 - DNA, 18 bp, Homo sapiens
gcacagagcccaggctct

SEQ ID NO: 8588849 - DNA, 20 bp, Homo sapiens
gcacagagatgagcaaagta

SEQ ID NO: 8588850 - DNA, 22 bp, Homo sapiens
gcagaggggaagctgaggaatt

SEQ ID NO: 8588851 - DNA, 22 bp, Homo sapiens
gcagaggctgtagggaaggttg

SEQ ID NO: 8588852 - DNA, 22 bp, Homo sapiens
gcagaggctgtagggaaggttg

SEQ ID NO: 8588853 - DNA, 22 bp, Homo sapiens
gcagaggcctaggtggaaggcc

SEQ ID NO: 8588854 - DNA, 22 bp, Homo sapiens
gcagccaggaagcctttccctc

SEQ ID NO: 8588855 - DNA, 22 bp, Homo sapiens
gcagcaggtccgcatcatcatc

SEQ ID NO: 8588856 - DNA, 22 bp, Homo sapiens
gcagatgcaactgcaggtgagt

SEQ ID NO: 8588857 - DNA, 22 bp, Homo sapiens
gcagctttagaaacaagggctg

SEQ ID NO: 8588858 - DNA, 22 bp, Homo sapiens
gcagctttaatctgaataagta

SEQ ID NO: 8588859 - DNA, 22 bp, Homo sapiens
gcagctttaaaggaggctctga

SEQ ID NO: 8588860 - DNA, 22 bp, Homo sapiens
gcagcctgttgtaccagcctgt

SEQ ID NO: 8588861 - DNA, 22 bp, Homo sapiens
gcaggtggatcacctgaggtca

SEQ ID NO: 8588862 - DNA, 15 bp, Homo sapiens
gcaggtggatcactt

SEQ ID NO: 8588863 - DNA, 14 bp, Homo sapiens
gcaggtggatcact

SEQ ID NO: 8588864 - DNA, 22 bp, Homo sapiens
gcaggtggatcacctgaggtca

SEQ ID NO: 8588865 - DNA, 16 bp, Homo sapiens
gcaggtggatcacctg

SEQ ID NO: 8588866 - DNA, 22 bp, Homo sapiens
gcaggtggatcaccacgtcagg

SEQ ID NO: 8588867 - DNA, 14 bp, Homo sapiens
gcaggtggatcacc

SEQ ID NO: 8588868 - DNA, 22 bp, Homo sapiens
gcaggtggatattgctacttga

SEQ ID NO: 8588869 - DNA, 22 bp, Homo sapiens
gcagggtcgctctaggagatca

SEQ ID NO: 8588870 - DNA, 22 bp, Homo sapiens
gcagggtccatggaggcagccc

SEQ ID NO: 8588871 - DNA, 22 bp, Homo sapiens
gcagggtcttgagaggcagcca

SEQ ID NO: 8588872 - DNA, 22 bp, Homo sapiens
gcagggatgctgaggctcagtg

SEQ ID NO: 8588873 - DNA, 22 bp, Homo sapiens
gcaggatgggtgtagcccagca

SEQ ID NO: 8588874 - DNA, 22 bp, Homo sapiens
gcaggatgaaggcagaggctga

SEQ ID NO: 8588875 - DNA, 22 bp, Homo sapiens
gcaggatgccagggcagcagcg

SEQ ID NO: 8588876 - DNA, 22 bp, Homo sapiens
gcaggagccacttcagggatgc

SEQ ID NO: 8588877 - DNA, 22 bp, Homo sapiens
gcaggagccacttcagggatgc

SEQ ID NO: 8588878 - DNA, 22 bp, Homo sapiens
gcaggagcagtcaggggcagct

SEQ ID NO: 8588879 - DNA, 22 bp, Homo sapiens
gcaggagcagtcaggggcagct

SEQ ID NO: 8588880 - DNA, 22 bp, Homo sapiens
gcaggagcaaactgcagtgtgg

SEQ ID NO: 8588881 - DNA, 22 bp, Homo sapiens
gcagggacgccagggacagcaa

SEQ ID NO: 8588882 - DNA, 22 bp, Homo sapiens
gcagggacgccagggacagcaa

SEQ ID NO: 8588883 - DNA, 22 bp, Homo sapiens
gcagggaggaagagatgcttcc

SEQ ID NO: 8588884 - DNA, 22 bp, Homo sapiens
gccactggagacagtggggaag

SEQ ID NO: 8588885 - DNA, 22 bp, Homo sapiens
gccactggacccagggttatca

SEQ ID NO: 8588886 - DNA, 22 bp, Homo sapiens
gcattcatgcctgtgtgagctc

SEQ ID NO: 8588887 - DNA, 22 bp, Homo sapiens
gcattcattcattcattaggta

SEQ ID NO: 8588888 - DNA, 22 bp, Homo sapiens
gcattcatatggaaggaaacta

SEQ ID NO: 8588889 - DNA, 22 bp, Homo sapiens
gcattcatcaaaaatgttcctc

SEQ ID NO: 8588890 - DNA, 22 bp, Homo sapiens
gcattcatcttcatgaaagcac

SEQ ID NO: 8588891 - DNA, 22 bp, Homo sapiens
gcattcatcttcctccatgcag

SEQ ID NO: 8588892 - DNA, 22 bp, Homo sapiens
gccactggcgctgtgcagagtg

SEQ ID NO: 8588893 - DNA, 22 bp, Homo sapiens
gccactggcatctagttggtag

SEQ ID NO: 8588894 - DNA, 20 bp, Homo sapiens
gccactgggcaccagcaggg

SEQ ID NO: 8588895 - DNA, 22 bp, Homo sapiens
gcattattaactggaggaaaag

SEQ ID NO: 8588896 - DNA, 22 bp, Homo sapiens
gcagtgccgaaggtagtggttg

SEQ ID NO: 8588897 - DNA, 18 bp, Homo sapiens
gcagtgccagcctctcct

SEQ ID NO: 8588898 - DNA, 22 bp, Homo sapiens
gcagtgccttgcttctctgtct

SEQ ID NO: 8588899 - DNA, 22 bp, Homo sapiens
gctacaaactgtcatggtgctt

SEQ ID NO: 8588900 - DNA, 22 bp, Homo sapiens
gctacaaagtggtaggaggtca

SEQ ID NO: 8588901 - DNA, 22 bp, Homo sapiens
gctaagaggagcctccttctga

SEQ ID NO: 8588902 - DNA, 22 bp, Homo sapiens
gctaagaggctatatctttctc

SEQ ID NO: 8588903 - DNA, 22 bp, Homo sapiens
gcgtggggtaggtagacatgga

SEQ ID NO: 8588904 - DNA, 22 bp, Homo sapiens
gctctaggttcctagccaagtc

SEQ ID NO: 8588905 - DNA, 20 bp, Homo sapiens
gctctgaaccaagagctgtc

SEQ ID NO: 8588906 - DNA, 22 bp, Homo sapiens
gctctatgaatcacacgagggt

SEQ ID NO: 8588907 - DNA, 22 bp, Homo sapiens
gctctagatcataggtcattat

SEQ ID NO: 8588908 - DNA, 22 bp, Homo sapiens
gctctagcaaggctggcctggg

SEQ ID NO: 8588909 - DNA, 22 bp, Homo sapiens
gctctagcaaggctggcctggg

SEQ ID NO: 8588910 - DNA, 22 bp, Homo sapiens
gctctagctggcgctgacctgg

SEQ ID NO: 8588911 - DNA, 22 bp, Homo sapiens
gctctagctggcgctgacctgg

SEQ ID NO: 8588912 - DNA, 22 bp, Homo sapiens
gctctagcccatttcctgcttg

SEQ ID NO: 8588913 - DNA, 22 bp, Homo sapiens
gctctaggagaggggcagtcca

SEQ ID NO: 8588914 - DNA, 22 bp, Homo sapiens
gctctagaaagaaggatgtggg

SEQ ID NO: 8588915 - DNA, 22 bp, Homo sapiens
gctctagacagaaagaccagtg

SEQ ID NO: 8588916 - DNA, 22 bp, Homo sapiens
gctccaggctgctctgtcccat

SEQ ID NO: 8588917 - DNA, 22 bp, Homo sapiens
gctccaggctgctctgtcccat

SEQ ID NO: 8588918 - DNA, 22 bp, Homo sapiens
gctcaggggaatgggctgccgt

SEQ ID NO: 8588919 - DNA, 22 bp, Homo sapiens
gctccaggcagcatagtggatg

SEQ ID NO: 8588920 - DNA, 22 bp, Homo sapiens
gctccaggcagcatagtggatg

SEQ ID NO: 8588921 - DNA, 17 bp, Homo sapiens
gctccaggcgtgagtga

SEQ ID NO: 8588922 - DNA, 22 bp, Homo sapiens
gctctgagaggtgcagcagtaa

SEQ ID NO: 8588923 - DNA, 19 bp, Homo sapiens
gctctgagaggggcatggg

SEQ ID NO: 8588924 - DNA, 19 bp, Homo sapiens
gctctgagaggggcatggg

SEQ ID NO: 8588925 - DNA, 22 bp, Homo sapiens
gctctgaagggtgagctgttcg

SEQ ID NO: 8588926 - DNA, 22 bp, Homo sapiens
gctctgaatcaatcagataagg

SEQ ID NO: 8588927 - DNA, 22 bp, Homo sapiens
gctctgactggtgggccacagt

SEQ ID NO: 8588928 - DNA, 22 bp, Homo sapiens
gctctgagaggatgctgagcag

SEQ ID NO: 8588929 - DNA, 22 bp, Homo sapiens
gctctgagaggatgctgagcag

SEQ ID NO: 8588930 - DNA, 22 bp, Homo sapiens
gctctgagagctacacagggta

SEQ ID NO: 8588931 - DNA, 22 bp, Homo sapiens
caaatgtgtagagcttttgggg

SEQ ID NO: 8588932 - DNA, 22 bp, Homo sapiens
caaatgtgttttttcttctaca

SEQ ID NO: 8588933 - DNA, 22 bp, Homo sapiens
gctgaggaggtgtggttaggtg

SEQ ID NO: 8588934 - DNA, 22 bp, Homo sapiens
gctgaggaagtcaggtggccca

SEQ ID NO: 8588935 - DNA, 22 bp, Homo sapiens
atttgaggatagttgggtactc

SEQ ID NO: 8588936 - DNA, 22 bp, Homo sapiens
atttgagaaaggagggaacttt

SEQ ID NO: 8588937 - DNA, 22 bp, Homo sapiens
atttcttgattccaccagtgaa

SEQ ID NO: 8588938 - DNA, 22 bp, Homo sapiens
atttgcaggtgtcgattagtct

SEQ ID NO: 8588939 - DNA, 22 bp, Homo sapiens
gccctcctggcaggcagtgatg

SEQ ID NO: 8588940 - DNA, 22 bp, Homo sapiens
gccctgagttgagccttccaaa

SEQ ID NO: 8588941 - DNA, 22 bp, Homo sapiens
gccctcctgcaggggcttctgg

SEQ ID NO: 8588942 - DNA, 19 bp, Homo sapiens
gccctcctcactgagctct

SEQ ID NO: 8588943 - DNA, 22 bp, Homo sapiens
atttcttccttctcctagaaga

SEQ ID NO: 8588944 - DNA, 22 bp, Homo sapiens
gccctgcagtgcggaggtggca

SEQ ID NO: 8588945 - DNA, 22 bp, Homo sapiens
gccctccatgagacacagtgta

SEQ ID NO: 8588946 - DNA, 22 bp, Homo sapiens
gccctccaccagagcccttctc

SEQ ID NO: 8588947 - DNA, 22 bp, Homo sapiens
gcccaggagttcaagtctagtg

SEQ ID NO: 8588948 - DNA, 22 bp, Homo sapiens
gcccaggagttcaagtctagtg

SEQ ID NO: 8588949 - DNA, 22 bp, Homo sapiens
gcccaggagttgaagggctgac

SEQ ID NO: 8588950 - DNA, 22 bp, Homo sapiens
gcccaggagttgaagggctgac

SEQ ID NO: 8588951 - DNA, 22 bp, Homo sapiens
gcccaggaggtcaagtagctat

SEQ ID NO: 8588952 - DNA, 22 bp, Homo sapiens
gcccaggaggtcaagtagctat

SEQ ID NO: 8588953 - DNA, 22 bp, Homo sapiens
gcccaggaggtggaggtgcagt

SEQ ID NO: 8588954 - DNA, 22 bp, Homo sapiens
gcccagcccctgggtggacgtg

SEQ ID NO: 8588955 - DNA, 22 bp, Homo sapiens
gcccaggaggtggaggtgcagt

SEQ ID NO: 8588956 - DNA, 22 bp, Homo sapiens
gcccaggagttcaaggctgcag

SEQ ID NO: 8588957 - DNA, 22 bp, Homo sapiens
gcccaggagttcaaggctgcag

SEQ ID NO: 8588958 - DNA, 22 bp, Homo sapiens
gcccaggaggttgggctgtgca

SEQ ID NO: 8588959 - DNA, 22 bp, Homo sapiens
gcccaggaggttgggctgtgca

SEQ ID NO: 8588960 - DNA, 18 bp, Homo sapiens
gccagagggcccaaggtc

SEQ ID NO: 8588961 - DNA, 22 bp, Homo sapiens
gccagaggttcaacaactgtct

SEQ ID NO: 8588962 - DNA, 22 bp, Homo sapiens
gcccagccacagtcactttcat

SEQ ID NO: 8588963 - DNA, 22 bp, Homo sapiens
gcccagccagagctgtgtgatg

SEQ ID NO: 8588964 - DNA, 22 bp, Homo sapiens
gcccagcccagaaaggttcgga

SEQ ID NO: 8588965 - DNA, 22 bp, Homo sapiens
gcccagcaggggatggcagctc

SEQ ID NO: 8588966 - DNA, 22 bp, Homo sapiens
gcccagcaggacagagtggttt

SEQ ID NO: 8588967 - DNA, 22 bp, Homo sapiens
gcccagcaggggatggcagctc

SEQ ID NO: 8588968 - DNA, 18 bp, Homo sapiens
gccagagggaagcaggtg

SEQ ID NO: 8588969 - DNA, 22 bp, Homo sapiens
ccatttatagatgtatttggct

SEQ ID NO: 8588970 - DNA, 22 bp, Homo sapiens
aggctggctggcaggggacaca

SEQ ID NO: 8588971 - DNA, 22 bp, Homo sapiens
aggctggggaattgaatttgct

SEQ ID NO: 8588972 - DNA, 22 bp, Homo sapiens
aggctgggctccgcccaactcc

SEQ ID NO: 8588973 - DNA, 22 bp, Homo sapiens
aggctggaaagggaccagagtg

SEQ ID NO: 8588974 - DNA, 22 bp, Homo sapiens
aggctggagagtgcagtggcgt

SEQ ID NO: 8588975 - DNA, 22 bp, Homo sapiens
aggctggagtgtagcagtgcag

SEQ ID NO: 8588976 - DNA, 22 bp, Homo sapiens
aggctagaggcttctggcttca

SEQ ID NO: 8588977 - DNA, 19 bp, Homo sapiens
aggctaaagagtcttgcgt

SEQ ID NO: 8588978 - DNA, 22 bp, Homo sapiens
ccagggcctgccacttagcaag

SEQ ID NO: 8588979 - DNA, 22 bp, Homo sapiens
ccagggcaggagaaagactcac

SEQ ID NO: 8588980 - DNA, 20 bp, Homo sapiens
ccagggctggctcctgggat

SEQ ID NO: 8588981 - DNA, 22 bp, Homo sapiens
aggctgaggcaggtggatcacc

SEQ ID NO: 8588982 - DNA, 22 bp, Homo sapiens
ccaggtctggaaccaccagggc

SEQ ID NO: 8588983 - DNA, 22 bp, Homo sapiens
aggctgaggcaagaggatcact

SEQ ID NO: 8588984 - DNA, 22 bp, Homo sapiens
aggctgaggatcgtactttcca

SEQ ID NO: 8588985 - DNA, 22 bp, Homo sapiens
ccagggctggtggctgcagagg

SEQ ID NO: 8588986 - DNA, 22 bp, Homo sapiens
aggctgaggatccctgtgttct

SEQ ID NO: 8588987 - DNA, 22 bp, Homo sapiens
ccagggctggtgggagatgctg

SEQ ID NO: 8588988 - DNA, 22 bp, Homo sapiens
ccagctggcccagctgtgctcc

SEQ ID NO: 8588989 - DNA, 22 bp, Homo sapiens
aggcctctgctggaaagagttg

SEQ ID NO: 8588990 - DNA, 22 bp, Homo sapiens
ccagctggcaggagagtcaggg

SEQ ID NO: 8588991 - DNA, 22 bp, Homo sapiens
ccagctggcaggagagtcaggg

SEQ ID NO: 8588992 - DNA, 22 bp, Homo sapiens
ccagctggcactgtggctgccc

SEQ ID NO: 8588993 - DNA, 22 bp, Homo sapiens
ccagctggcactgtggctgccc

SEQ ID NO: 8588994 - DNA, 22 bp, Homo sapiens
ccagctggaagagtgcagaact

SEQ ID NO: 8588995 - DNA, 22 bp, Homo sapiens
ccagctggagccaaggtggact

SEQ ID NO: 8588996 - DNA, 22 bp, Homo sapiens
ccagctggagccaaggtggact

SEQ ID NO: 8588997 - DNA, 22 bp, Homo sapiens
ccagctggagctcgcagatagg

SEQ ID NO: 8588998 - DNA, 22 bp, Homo sapiens
ccagctggaacggcagcccagc

SEQ ID NO: 8588999 - DNA, 22 bp, Homo sapiens
ccagctggaacggcagcccagc

SEQ ID NO: 8589000 - DNA, 22 bp, Homo sapiens
ccagctggaaacaaatagagtg

SEQ ID NO: 8589001 - DNA, 22 bp, Homo sapiens
ccagcaggagactagcaacata

SEQ ID NO: 8589002 - DNA, 22 bp, Homo sapiens
ccagcaggcagtcatatccttt

SEQ ID NO: 8589003 - DNA, 22 bp, Homo sapiens
ccagcaggagatgcctgtgtct

SEQ ID NO: 8589004 - DNA, 18 bp, Homo sapiens
aggcctgggaagctgagg

SEQ ID NO: 8589005 - DNA, 22 bp, Homo sapiens
ccaggaaggcaggcctccccgc

SEQ ID NO: 8589006 - DNA, 22 bp, Homo sapiens
ccaggaaggcgttgttcctctc

SEQ ID NO: 8589007 - DNA, 22 bp, Homo sapiens
ccaggaagggctctttaaagac

SEQ ID NO: 8589008 - DNA, 22 bp, Homo sapiens
ccaggaagggctctttaaagac

SEQ ID NO: 8589009 - DNA, 22 bp, Homo sapiens
ccaggaaggtatgggaagaaaa

SEQ ID NO: 8589010 - DNA, 22 bp, Homo sapiens
ccaggaaggtatgggaagaaaa

SEQ ID NO: 8589011 - DNA, 22 bp, Homo sapiens
ccaggaaggtatgggaagaaaa

SEQ ID NO: 8589012 - DNA, 22 bp, Homo sapiens
ccaggaaggcctggatgccccc

SEQ ID NO: 8589013 - DNA, 22 bp, Homo sapiens
ccaggaaggcaggcctccccgc

SEQ ID NO: 8589014 - DNA, 22 bp, Homo sapiens
aggcctgctgtgtagcctgttg

SEQ ID NO: 8589015 - DNA, 22 bp, Homo sapiens
aggcggaagatggccccataga

SEQ ID NO: 8589016 - DNA, 22 bp, Homo sapiens
ccaggaaggtgtttaactagag

SEQ ID NO: 8589017 - DNA, 22 bp, Homo sapiens
ccaggaaggtgtttaactagag

SEQ ID NO: 8589018 - DNA, 22 bp, Homo sapiens
ccaggaagtatgacccaacaga

SEQ ID NO: 8589019 - DNA, 22 bp, Homo sapiens
ccaggaagtatgacccaacaga

SEQ ID NO: 8589020 - DNA, 22 bp, Homo sapiens
ccaggacaagccagagggacag

SEQ ID NO: 8589021 - DNA, 22 bp, Homo sapiens
ccagagaaagctcacaggcagt

SEQ ID NO: 8589022 - DNA, 22 bp, Homo sapiens
ccagagaaaaatgtgtccctgt

SEQ ID NO: 8589023 - DNA, 22 bp, Homo sapiens
ccagagaaaagaggccaaggat

SEQ ID NO: 8589024 - DNA, 22 bp, Homo sapiens
ccagaactgagaaaataaattt

SEQ ID NO: 8589025 - DNA, 23 bp, Homo sapiens
aggccagtttttcctgcttgctg

SEQ ID NO: 8589026 - DNA, 22 bp, Homo sapiens
aggccagttgttcagtgggccg

SEQ ID NO: 8589027 - DNA, 22 bp, Homo sapiens
aggccagtgtggctggagcaca

SEQ ID NO: 8589028 - DNA, 22 bp, Homo sapiens
aggccagtggttctctgtgtcc

SEQ ID NO: 8589029 - DNA, 22 bp, Homo sapiens
aggccagtgcctttccagggct

SEQ ID NO: 8589030 - DNA, 22 bp, Homo sapiens
aggccagtgcagctggaacaga

SEQ ID NO: 8589031 - DNA, 22 bp, Homo sapiens
aggccagtgcagctggaacaga

SEQ ID NO: 8589032 - DNA, 22 bp, Homo sapiens
aggccagtgccatcagggtttt

SEQ ID NO: 8589033 - DNA, 22 bp, Homo sapiens
aggcccagactcagcggggcgg

SEQ ID NO: 8589034 - DNA, 22 bp, Homo sapiens
ccagcaggaaagtgacgtttga

SEQ ID NO: 8589035 - DNA, 22 bp, Homo sapiens
ccagagctaaacacacaggctg

SEQ ID NO: 8589036 - DNA, 22 bp, Homo sapiens
ccctcagctccaccctcagcag

SEQ ID NO: 8589037 - DNA, 22 bp, Homo sapiens
ccccagcactaccagaagccag

SEQ ID NO: 8589038 - DNA, 21 bp, Homo sapiens
ccccagcaccttgccagcctg

SEQ ID NO: 8589039 - DNA, 22 bp, Homo sapiens
ccccagcacttggagtggggag

SEQ ID NO: 8589040 - DNA, 22 bp, Homo sapiens
ccccagaaggggacagagggta

SEQ ID NO: 8589041 - DNA, 22 bp, Homo sapiens
cccaggaatgaggggcggaggc

SEQ ID NO: 8589042 - DNA, 20 bp, Homo sapiens
cccaggagctgtgccccatc

SEQ ID NO: 8589043 - DNA, 22 bp, Homo sapiens
cccaggaggtagaggttgcagt

SEQ ID NO: 8589044 - DNA, 22 bp, Homo sapiens
cccaggagatgcactccattgg

SEQ ID NO: 8589045 - DNA, 22 bp, Homo sapiens
cccaggagatggtgcgtggtct

SEQ ID NO: 8589046 - DNA, 22 bp, Homo sapiens
cccaggagatggaggttgcagt

SEQ ID NO: 8589047 - DNA, 19 bp, Homo sapiens
cccaggagcagtattgatg

SEQ ID NO: 8589048 - DNA, 23 bp, Homo sapiens
cccaggagcctgagtcctctctg

SEQ ID NO: 8589049 - DNA, 23 bp, Homo sapiens
cccaggagcctgagtcctctctg

SEQ ID NO: 8589050 - DNA, 22 bp, Homo sapiens
cccaggagccatctgtcttggc

SEQ ID NO: 8589051 - DNA, 22 bp, Homo sapiens
cccaggctgccacgattactgc

SEQ ID NO: 8589052 - DNA, 22 bp, Homo sapiens
cccaggctgcatgagtccatgg

SEQ ID NO: 8589053 - DNA, 22 bp, Homo sapiens
cccaggctgatgggatgggcca

SEQ ID NO: 8589054 - DNA, 22 bp, Homo sapiens
cccaggctgatgttcagcgggt

SEQ ID NO: 8589055 - DNA, 22 bp, Homo sapiens
cccaggaggtcgaagctgcagt

SEQ ID NO: 8589056 - DNA, 22 bp, Homo sapiens
cccaggaggtcaaggctgcagt

SEQ ID NO: 8589057 - DNA, 23 bp, Homo sapiens
cccaggctacaaattatgctctg

SEQ ID NO: 8589058 - DNA, 22 bp, Homo sapiens
cccaggaggtggagcttgcagt

SEQ ID NO: 8589059 - DNA, 22 bp, Homo sapiens
cccaggctgtctgtcctttgct

SEQ ID NO: 8589060 - DNA, 22 bp, Homo sapiens
cccaggctgcgtatccacaata

SEQ ID NO: 8589061 - DNA, 22 bp, Homo sapiens
cccaggctggaattccaggcct

SEQ ID NO: 8589062 - DNA, 22 bp, Homo sapiens
cccaggctgtgcaaacttcaaa

SEQ ID NO: 8589063 - DNA, 22 bp, Homo sapiens
cccaggcttcccaatcagaagg

SEQ ID NO: 8589064 - DNA, 18 bp, Homo sapiens
cccaggctttgtgggtct

SEQ ID NO: 8589065 - DNA, 22 bp, Homo sapiens
cccaggcttttaagttagacag

SEQ ID NO: 8589066 - DNA, 22 bp, Homo sapiens
cccaggcttttctcttgcccca

SEQ ID NO: 8589067 - DNA, 19 bp, Homo sapiens
agggcggggcccaggcaca

SEQ ID NO: 8589068 - DNA, 22 bp, Homo sapiens
cctcaggatccgcaggtgcagt

SEQ ID NO: 8589069 - DNA, 22 bp, Homo sapiens
cctcaggatacaggagccacag

SEQ ID NO: 8589070 - DNA, 20 bp, Homo sapiens
cctcaggatgagggtgagca

SEQ ID NO: 8589071 - DNA, 22 bp, Homo sapiens
cctcaggccctgtccctgcgcc

SEQ ID NO: 8589072 - DNA, 22 bp, Homo sapiens
agggcctggcgcgtggccgccg

SEQ ID NO: 8589073 - DNA, 22 bp, Homo sapiens
cctcaggaaccacattgctgct

SEQ ID NO: 8589074 - DNA, 23 bp, Homo sapiens
agggcctgatggctcccgctggc

SEQ ID NO: 8589075 - DNA, 22 bp, Homo sapiens
aggggcacttctcaggctgtgg

SEQ ID NO: 8589076 - DNA, 22 bp, Homo sapiens
aggggaggtgtccccaaatctc

SEQ ID NO: 8589077 - DNA, 22 bp, Homo sapiens
aggggaggcagcgataaacctg

SEQ ID NO: 8589078 - DNA, 22 bp, Homo sapiens
agggtcaccagttcataggcac

SEQ ID NO: 8589079 - DNA, 22 bp, Homo sapiens
agggtcacctgcttgccagggc

SEQ ID NO: 8589080 - DNA, 22 bp, Homo sapiens
agggtagggccgtagggccatg

SEQ ID NO: 8589081 - DNA, 22 bp, Homo sapiens
agggtagggtaaatgatgcatc

SEQ ID NO: 8589082 - DNA, 22 bp, Homo sapiens
agggtaggtgtaagatagccct

SEQ ID NO: 8589083 - DNA, 22 bp, Homo sapiens
agggtagggcccggagacagac

SEQ ID NO: 8589084 - DNA, 22 bp, Homo sapiens
agggtaggaactgagtggaagg

SEQ ID NO: 8589085 - DNA, 22 bp, Homo sapiens
cctgagagccagtgcctgccca

SEQ ID NO: 8589086 - DNA, 22 bp, Homo sapiens
cctgagaggccctctcactgtc

SEQ ID NO: 8589087 - DNA, 22 bp, Homo sapiens
cctgagagccctagccaggcgc

SEQ ID NO: 8589088 - DNA, 22 bp, Homo sapiens
aggaggctggttcaggccatat

SEQ ID NO: 8589089 - DNA, 22 bp, Homo sapiens
aggaggctggttcaggccatat

SEQ ID NO: 8589090 - DNA, 22 bp, Homo sapiens
aggaggctgggcacagtggcct

SEQ ID NO: 8589091 - DNA, 22 bp, Homo sapiens
aggaggctgcaaccctgaggcc

SEQ ID NO: 8589092 - DNA, 22 bp, Homo sapiens
aggaggctgcaaccctgaggcc

SEQ ID NO: 8589093 - DNA, 22 bp, Homo sapiens
cagttatttcaacagagaggat

SEQ ID NO: 8589094 - DNA, 22 bp, Homo sapiens
cagttattatcttagagagaca

SEQ ID NO: 8589095 - DNA, 17 bp, Homo sapiens
aggagctgggggtggtg

SEQ ID NO: 8589096 - DNA, 22 bp, Homo sapiens
aggacaagacaaggaccagaga

SEQ ID NO: 8589097 - DNA, 22 bp, Homo sapiens
cagtgaggagtccagggcagag

SEQ ID NO: 8589098 - DNA, 22 bp, Homo sapiens
cagtgagggaagatctcagcac

SEQ ID NO: 8589099 - DNA, 22 bp, Homo sapiens
cagtgaggctctgctgagcggt

SEQ ID NO: 8589100 - DNA, 22 bp, Homo sapiens
aggagcagattggtaagatcat

SEQ ID NO: 8589101 - DNA, 22 bp, Homo sapiens
aggagccaaattactagctctg

SEQ ID NO: 8589102 - DNA, 22 bp, Homo sapiens
cagtgctttgggaggctgagga

SEQ ID NO: 8589103 - DNA, 22 bp, Homo sapiens
aggagctgggagaaggactaaa

SEQ ID NO: 8589104 - DNA, 22 bp, Homo sapiens
aggagctgggcccaaggatgct

SEQ ID NO: 8589105 - DNA, 22 bp, Homo sapiens
aggagctggccactaggatgca

SEQ ID NO: 8589106 - DNA, 23 bp, Homo sapiens
cagtggagactcatgcttcctta

SEQ ID NO: 8589107 - DNA, 20 bp, Homo sapiens
aggcagctggccaggcaggt

SEQ ID NO: 8589108 - DNA, 22 bp, Homo sapiens
aggcagctgtgaggactggatt

SEQ ID NO: 8589109 - DNA, 22 bp, Homo sapiens
aggcagctttctgtaggggtgt

SEQ ID NO: 8589110 - DNA, 22 bp, Homo sapiens
aggcagctttcagtgtctctca

SEQ ID NO: 8589111 - DNA, 22 bp, Homo sapiens
aggcagctttaactggtagtag

SEQ ID NO: 8589112 - DNA, 22 bp, Homo sapiens
aggcagcttctgattagcagcg

SEQ ID NO: 8589113 - DNA, 22 bp, Homo sapiens
aggcaggccctgggccatcccg

SEQ ID NO: 8589114 - DNA, 22 bp, Homo sapiens
aggcaggctcaggcccatgctt

SEQ ID NO: 8589115 - DNA, 22 bp, Homo sapiens
aggcaggctcaatgcccagtct

SEQ ID NO: 8589116 - DNA, 23 bp, Homo sapiens
aggcaggcagttcagctgttgtt

SEQ ID NO: 8589117 - DNA, 21 bp, Homo sapiens
catgtgtcttgtgttactgct

SEQ ID NO: 8589118 - DNA, 22 bp, Homo sapiens
catgtgtctttatggagccaca

SEQ ID NO: 8589119 - DNA, 22 bp, Homo sapiens
catgtgtctaatctactaatat

SEQ ID NO: 8589120 - DNA, 22 bp, Homo sapiens
catgtgtcttgctgccctccat

SEQ ID NO: 8589121 - DNA, 22 bp, Homo sapiens
catgtgtcttgctgccctccat

SEQ ID NO: 8589122 - DNA, 22 bp, Homo sapiens
catgtgtcctagctattctcct

SEQ ID NO: 8589123 - DNA, 22 bp, Homo sapiens
aggcacagggatgcggagccag

SEQ ID NO: 8589124 - DNA, 22 bp, Homo sapiens
aggcacaggtggacttcacagt

SEQ ID NO: 8589125 - DNA, 22 bp, Homo sapiens
aggcacagtgcctggaatcaaa

SEQ ID NO: 8589126 - DNA, 22 bp, Homo sapiens
aggcacagtggccctgtttggg

SEQ ID NO: 8589127 - DNA, 22 bp, Homo sapiens
aggaaacatgaatctgccttga

SEQ ID NO: 8589128 - DNA, 17 bp, Homo sapiens
aggaaacattttctttc

SEQ ID NO: 8589129 - DNA, 22 bp, Homo sapiens
cagggtttcaccatgttagcag

SEQ ID NO: 8589130 - DNA, 22 bp, Homo sapiens
aggaagagtgttacctatgggt

SEQ ID NO: 8589131 - DNA, 22 bp, Homo sapiens
aggaagatgtgtttagcaggtt

SEQ ID NO: 8589132 - DNA, 22 bp, Homo sapiens
aggaagcaaaaggcagggtcta

SEQ ID NO: 8589133 - DNA, 22 bp, Homo sapiens
aggaagcactggaaggggttgg

SEQ ID NO: 8589134 - DNA, 22 bp, Homo sapiens
aggaagcaccggaatgatgact

SEQ ID NO: 8589135 - DNA, 22 bp, Homo sapiens
caggtcctggcagctgactcag

SEQ ID NO: 8589136 - DNA, 22 bp, Homo sapiens
caggtcctcgggggaggccggc

SEQ ID NO: 8589137 - DNA, 22 bp, Homo sapiens
aggaatgtttagaatgtcagaa

SEQ ID NO: 8589138 - DNA, 22 bp, Homo sapiens
aggaaggtgcagtagggtgtgc

SEQ ID NO: 8589139 - DNA, 22 bp, Homo sapiens
aggaagggttctttgtgaaaga

SEQ ID NO: 8589140 - DNA, 22 bp, Homo sapiens
agctggtgctcggggagctggc

SEQ ID NO: 8589141 - DNA, 22 bp, Homo sapiens
agctggtgctgaagctcttgag

SEQ ID NO: 8589142 - DNA, 22 bp, Homo sapiens
caggctgtgggagtcaggaccc

SEQ ID NO: 8589143 - DNA, 22 bp, Homo sapiens
caggctgtggatcaggagcctt

SEQ ID NO: 8589144 - DNA, 22 bp, Homo sapiens
caggctgtgaaactgagatgcg

SEQ ID NO: 8589145 - DNA, 22 bp, Homo sapiens
agctttatatttaatgaattct

SEQ ID NO: 8589146 - DNA, 22 bp, Homo sapiens
agctttatttgtcattcacggc

SEQ ID NO: 8589147 - DNA, 22 bp, Homo sapiens
agctttattcatgatttcaggg

SEQ ID NO: 8589148 - DNA, 22 bp, Homo sapiens
agctttcacgatttggaacagg

SEQ ID NO: 8589149 - DNA, 22 bp, Homo sapiens
agctttcaggataatgaaaaag

SEQ ID NO: 8589150 - DNA, 20 bp, Homo sapiens
agcttctgctgcctttcggc

SEQ ID NO: 8589151 - DNA, 22 bp, Homo sapiens
agcttctgttcatcttccaggc

SEQ ID NO: 8589152 - DNA, 22 bp, Homo sapiens
aggaaacagaggtgccacaata

SEQ ID NO: 8589153 - DNA, 22 bp, Homo sapiens
agctttggtgctgtcacacaaa

SEQ ID NO: 8589154 - DNA, 23 bp, Homo sapiens
agctttggtgatgtgacagataa

SEQ ID NO: 8589155 - DNA, 22 bp, Homo sapiens
cagggacccgcacaggtagcat

SEQ ID NO: 8589156 - DNA, 22 bp, Homo sapiens
agctttggggacagccaaggtt

SEQ ID NO: 8589157 - DNA, 22 bp, Homo sapiens
agctttgggggaggtagtctgt

SEQ ID NO: 8589158 - DNA, 22 bp, Homo sapiens
agctttgggccactggctggat

SEQ ID NO: 8589159 - DNA, 22 bp, Homo sapiens
agctttgggggtaggtatagag

SEQ ID NO: 8589160 - DNA, 22 bp, Homo sapiens
agctttctggttacagtcttca

SEQ ID NO: 8589161 - DNA, 22 bp, Homo sapiens
cagggacagcgggactctgaca

SEQ ID NO: 8589162 - DNA, 22 bp, Homo sapiens
agctgggtttctggcaggctta

SEQ ID NO: 8589163 - DNA, 22 bp, Homo sapiens
agctggtcctaattgagccatt

SEQ ID NO: 8589164 - DNA, 19 bp, Homo sapiens
agctgggtgttagtggaga

SEQ ID NO: 8589165 - DNA, 22 bp, Homo sapiens
agctgggttgacaagatggaaa

SEQ ID NO: 8589166 - DNA, 22 bp, Homo sapiens
agctggtgctcaggggcatgga

SEQ ID NO: 8589167 - DNA, 20 bp, Homo sapiens
agctggtgaattaaagactg

SEQ ID NO: 8589168 - DNA, 22 bp, Homo sapiens
agctggtgaacctgaggcacag

SEQ ID NO: 8589169 - DNA, 22 bp, Homo sapiens
agctggtgaacctgaggcacag

SEQ ID NO: 8589170 - DNA, 22 bp, Homo sapiens
agctggtctgctgcatggagtg

SEQ ID NO: 8589171 - DNA, 19 bp, Homo sapiens
agctggggcggtgtgtgtt

SEQ ID NO: 8589172 - DNA, 19 bp, Homo sapiens
agctggggcggtgtgtgtt

SEQ ID NO: 8589173 - DNA, 22 bp, Homo sapiens
agctgggtgcccgaagccacgt

SEQ ID NO: 8589174 - DNA, 21 bp, Homo sapiens
agctgggtgctaatgacaact

SEQ ID NO: 8589175 - DNA, 23 bp, Homo sapiens
agctgggtggcctgcgtgaagct

SEQ ID NO: 8589176 - DNA, 22 bp, Homo sapiens
agctgggtggtgctgagccttg

SEQ ID NO: 8589177 - DNA, 22 bp, Homo sapiens
agctgggtgtagggctggacaa

SEQ ID NO: 8589178 - DNA, 22 bp, Homo sapiens
caggcagaggaagtctgggtct

SEQ ID NO: 8589179 - DNA, 21 bp, Homo sapiens
agctgggcctcagcctgcagt

SEQ ID NO: 8589180 - DNA, 23 bp, Homo sapiens
agctgggccaggtggtcagacct

SEQ ID NO: 8589181 - DNA, 23 bp, Homo sapiens
agctgggccaggtggtcagacct

SEQ ID NO: 8589182 - DNA, 22 bp, Homo sapiens
agctgggcagactgcagtggtt

SEQ ID NO: 8589183 - DNA, 22 bp, Homo sapiens
agctgggcagactgcagtggtt

SEQ ID NO: 8589184 - DNA, 22 bp, Homo sapiens
agctgggcagtgcttggattca

SEQ ID NO: 8589185 - DNA, 22 bp, Homo sapiens
agctggaggagtttctcctagc

SEQ ID NO: 8589186 - DNA, 22 bp, Homo sapiens
agctgggcaccccgctgcgtct

SEQ ID NO: 8589187 - DNA, 22 bp, Homo sapiens
agctgggctccaagagggatct

SEQ ID NO: 8589188 - DNA, 22 bp, Homo sapiens
agctgggcgcagtggctggtga

SEQ ID NO: 8589189 - DNA, 22 bp, Homo sapiens
agctgggcctgatttgcagggg

SEQ ID NO: 8589190 - DNA, 22 bp, Homo sapiens
agctgggcctgagctggaagct

SEQ ID NO: 8589191 - DNA, 22 bp, Homo sapiens
agctgggcctgagctggaagct

SEQ ID NO: 8589192 - DNA, 22 bp, Homo sapiens
agctggagaatgtggatgatcc

SEQ ID NO: 8589193 - DNA, 22 bp, Homo sapiens
agctggagatgagtgacgtgcc

SEQ ID NO: 8589194 - DNA, 22 bp, Homo sapiens
agctggagaatgtggatgatcc

SEQ ID NO: 8589195 - DNA, 22 bp, Homo sapiens
agctggagaaacctgggagggt

SEQ ID NO: 8589196 - DNA, 22 bp, Homo sapiens
agctggagattctggggacagt

SEQ ID NO: 8589197 - DNA, 19 bp, Homo sapiens
agctggagattggagggca

SEQ ID NO: 8589198 - DNA, 22 bp, Homo sapiens
caggaagaaagaggtgaggtgt

SEQ ID NO: 8589199 - DNA, 22 bp, Homo sapiens
caggaagaagggtggtgagtcc

SEQ ID NO: 8589200 - DNA, 22 bp, Homo sapiens
caggaagaccagggctgtggct

SEQ ID NO: 8589201 - DNA, 22 bp, Homo sapiens
agctgctgggatacagtagtga

SEQ ID NO: 8589202 - DNA, 22 bp, Homo sapiens
agctgctgggagaagtgagcca

SEQ ID NO: 8589203 - DNA, 22 bp, Homo sapiens
agtgcatgttcactggcatggt

SEQ ID NO: 8589204 - DNA, 22 bp, Homo sapiens
agtggaggttacagctgtacat

SEQ ID NO: 8589205 - DNA, 22 bp, Homo sapiens
agtggatggtattgggaccagg

SEQ ID NO: 8589206 - DNA, 22 bp, Homo sapiens
agtggagtgagtggcagaagga

SEQ ID NO: 8589207 - DNA, 22 bp, Homo sapiens
agtggccacccactgagacagg

SEQ ID NO: 8589208 - DNA, 22 bp, Homo sapiens
agtggccagcagcctagcctag

SEQ ID NO: 8589209 - DNA, 22 bp, Homo sapiens
agtggccactgacttggaaatc

SEQ ID NO: 8589210 - DNA, 22 bp, Homo sapiens
agtggccaacttatatgaaaaa

SEQ ID NO: 8589211 - DNA, 22 bp, Homo sapiens
agtgaaattcctggtctttgtt

SEQ ID NO: 8589212 - DNA, 22 bp, Homo sapiens
agtgaggtcatactggagaggg

SEQ ID NO: 8589213 - DNA, 22 bp, Homo sapiens
agtgaggtaattagagctgctg

SEQ ID NO: 8589214 - DNA, 22 bp, Homo sapiens
agtgaggtggggtcacagggac

SEQ ID NO: 8589215 - DNA, 22 bp, Homo sapiens
agtgatcagcttgaagtagttt

SEQ ID NO: 8589216 - DNA, 22 bp, Homo sapiens
agtctacaatcttaaatgaact

SEQ ID NO: 8589217 - DNA, 20 bp, Homo sapiens
ctgagctgagctccatgggt

SEQ ID NO: 8589218 - DNA, 23 bp, Homo sapiens
agttccagaaaaatgctcaagca

SEQ ID NO: 8589219 - DNA, 22 bp, Homo sapiens
ctgagctcacgccattctcctt

SEQ ID NO: 8589220 - DNA, 22 bp, Homo sapiens
ctgagctcaagcgatcctccca

SEQ ID NO: 8589221 - DNA, 18 bp, Homo sapiens
agtgtttatttaggtgaa

SEQ ID NO: 8589222 - DNA, 22 bp, Homo sapiens
agtgtgggggctttggtgtcac

SEQ ID NO: 8589223 - DNA, 22 bp, Homo sapiens
agtgtttatggaatcttagtta

SEQ ID NO: 8589224 - DNA, 22 bp, Homo sapiens
agtgtgctgagcaggtgggggt

SEQ ID NO: 8589225 - DNA, 22 bp, Homo sapiens
agtgtgctctggttgccatgct

SEQ ID NO: 8589226 - DNA, 22 bp, Homo sapiens
agtgggtggcgcagaggaggaa

SEQ ID NO: 8589227 - DNA, 22 bp, Homo sapiens
agtggtagaaaatgcagctcga

SEQ ID NO: 8589228 - DNA, 19 bp, Homo sapiens
agtggtagatgagcaggag

SEQ ID NO: 8589229 - DNA, 22 bp, Homo sapiens
agtggccagtgctgctctgggg

SEQ ID NO: 8589230 - DNA, 22 bp, Homo sapiens
agtggccaggaaaggtccagcc

SEQ ID NO: 8589231 - DNA, 22 bp, Homo sapiens
agtggccatggcaggtgagcat

SEQ ID NO: 8589232 - DNA, 22 bp, Homo sapiens
agtggccccacagtagggctta

SEQ ID NO: 8589233 - DNA, 22 bp, Homo sapiens
agtggcgtcctaggaaaggagg

SEQ ID NO: 8589234 - DNA, 22 bp, Homo sapiens
agtggcctggagccccgcctgg

SEQ ID NO: 8589235 - DNA, 22 bp, Homo sapiens
agtgggtaggcctctggtgcct

SEQ ID NO: 8589236 - DNA, 22 bp, Homo sapiens
agtgggtactgggcaggcagag

SEQ ID NO: 8589237 - DNA, 22 bp, Homo sapiens
agtgggtcagagagctccagat

SEQ ID NO: 8589238 - DNA, 22 bp, Homo sapiens
agtgggtgagcttggtctagat

SEQ ID NO: 8589239 - DNA, 20 bp, Homo sapiens
agtgggtgatgaaggaatag

SEQ ID NO: 8589240 - DNA, 22 bp, Homo sapiens
agtggggccgcggtcctgccct

SEQ ID NO: 8589241 - DNA, 22 bp, Homo sapiens
agtggctctccaagaagtcaca

SEQ ID NO: 8589242 - DNA, 22 bp, Homo sapiens
agtggggagtttccagatgtgt

SEQ ID NO: 8589243 - DNA, 22 bp, Homo sapiens
agtggctcttgggtcactgggc

SEQ ID NO: 8589244 - DNA, 22 bp, Homo sapiens
agtgtcctacagctcctgcctg

SEQ ID NO: 8589245 - DNA, 22 bp, Homo sapiens
agtgtcctcatctgtaaaatga

SEQ ID NO: 8589246 - DNA, 22 bp, Homo sapiens
agtgtcctcaggctttgttcct

SEQ ID NO: 8589247 - DNA, 19 bp, Homo sapiens
agtgtcctagtcatttgcc

SEQ ID NO: 8589248 - DNA, 22 bp, Homo sapiens
agtgtcctacagctcctgcctg

SEQ ID NO: 8589249 - DNA, 22 bp, Homo sapiens
agtgtcctagcaagccggtcct

SEQ ID NO: 8589250 - DNA, 22 bp, Homo sapiens
agtgtctttgtcaaattacagg

SEQ ID NO: 8589251 - DNA, 22 bp, Homo sapiens
agtgtcctcctctgggagccag

SEQ ID NO: 8589252 - DNA, 22 bp, Homo sapiens
cctgaggtttttggatagttgt

SEQ ID NO: 8589253 - DNA, 22 bp, Homo sapiens
cctgagtagctggaattaaagg

SEQ ID NO: 8589254 - DNA, 19 bp, Homo sapiens
cctgaggtggggtggaagg

SEQ ID NO: 8589255 - DNA, 18 bp, Homo sapiens
cctgaggtgggaggaagg

SEQ ID NO: 8589256 - DNA, 22 bp, Homo sapiens
aggtcacacaactgtcagaggc

SEQ ID NO: 8589257 - DNA, 22 bp, Homo sapiens
aggtcacagctttctcgtgagg

SEQ ID NO: 8589258 - DNA, 22 bp, Homo sapiens
aggtcacaggctttgaaatcaa

SEQ ID NO: 8589259 - DNA, 22 bp, Homo sapiens
aggtatttatgagagcacatat

SEQ ID NO: 8589260 - DNA, 22 bp, Homo sapiens
aggtacaaaagagtatatgaga

SEQ ID NO: 8589261 - DNA, 22 bp, Homo sapiens
cctgggaggctgtttccagcct

SEQ ID NO: 8589262 - DNA, 22 bp, Homo sapiens
cctgggaggctgtgggtctgct

SEQ ID NO: 8589263 - DNA, 22 bp, Homo sapiens
cctgggaggtggaggttgcagc

SEQ ID NO: 8589264 - DNA, 22 bp, Homo sapiens
cctgggagggcaagtgctgatg

SEQ ID NO: 8589265 - DNA, 22 bp, Homo sapiens
cctgggaggtggaggttgcagt

SEQ ID NO: 8589266 - DNA, 21 bp, Homo sapiens
cctgggagaattgggtgtggc

SEQ ID NO: 8589267 - DNA, 22 bp, Homo sapiens
cctgggaggctgaggctgcagt

SEQ ID NO: 8589268 - DNA, 22 bp, Homo sapiens
aggtcacagggttgaagtactt

SEQ ID NO: 8589269 - DNA, 22 bp, Homo sapiens
aggtcagacagggtgtctttct

SEQ ID NO: 8589270 - DNA, 22 bp, Homo sapiens
aggtcagaagtgccagggaatt

SEQ ID NO: 8589271 - DNA, 22 bp, Homo sapiens
aggtcagaaaaggagagcattg

SEQ ID NO: 8589272 - DNA, 22 bp, Homo sapiens
aggtcagctgcactggtgtaat

SEQ ID NO: 8589273 - DNA, 21 bp, Homo sapiens
aggtcagcccagctctggaag

SEQ ID NO: 8589274 - DNA, 23 bp, Homo sapiens
aggtcagcaggcaaggaaatggc

SEQ ID NO: 8589275 - DNA, 22 bp, Homo sapiens
aggtcagcatgagtagaaggta

SEQ ID NO: 8589276 - DNA, 22 bp, Homo sapiens
aggtcagctgctgataggcagc

SEQ ID NO: 8589277 - DNA, 20 bp, Homo sapiens
cctggggtacactggcatgt

SEQ ID NO: 8589278 - DNA, 22 bp, Homo sapiens
cctggggtatataggtgaatat

SEQ ID NO: 8589279 - DNA, 17 bp, Homo sapiens
aggtgcagaggcagagc

SEQ ID NO: 8589280 - DNA, 22 bp, Homo sapiens
cctggggtcagggacgctgtgc

SEQ ID NO: 8589281 - DNA, 22 bp, Homo sapiens
cctggggtcacttgcagccgca

SEQ ID NO: 8589282 - DNA, 22 bp, Homo sapiens
cctgtgggagcccaggcagata

SEQ ID NO: 8589283 - DNA, 22 bp, Homo sapiens
aggtggcagatgggggtgctcg

SEQ ID NO: 8589284 - DNA, 22 bp, Homo sapiens
aggtggcagagctggcccagcg

SEQ ID NO: 8589285 - DNA, 22 bp, Homo sapiens
aggtggcagactaacagaagga

SEQ ID NO: 8589286 - DNA, 22 bp, Homo sapiens
aggtggcagaggactcctcctg

SEQ ID NO: 8589287 - DNA, 22 bp, Homo sapiens
cctgtgggcgcagctggagtca

SEQ ID NO: 8589288 - DNA, 22 bp, Homo sapiens
cctgtgggaggttctgtgagtc

SEQ ID NO: 8589289 - DNA, 22 bp, Homo sapiens
agtagcttggccctttgttctt

SEQ ID NO: 8589290 - DNA, 22 bp, Homo sapiens
agtagggaatacattggggtaa

SEQ ID NO: 8589291 - DNA, 22 bp, Homo sapiens
agtagggagaccggaggccgcc

SEQ ID NO: 8589292 - DNA, 22 bp, Homo sapiens
agtaaacatgtaattgttcatt

SEQ ID NO: 8589293 - DNA, 22 bp, Homo sapiens
ctattctagattacagtataaa

SEQ ID NO: 8589294 - DNA, 22 bp, Homo sapiens
ctattggtatttgaaacataaa

SEQ ID NO: 8589295 - DNA, 22 bp, Homo sapiens
ctattgaggacataaggactct

SEQ ID NO: 8589296 - DNA, 22 bp, Homo sapiens
ctatatcatcattacctgcacc

SEQ ID NO: 8589297 - DNA, 22 bp, Homo sapiens
ctatatcataaatctgaagagg

SEQ ID NO: 8589298 - DNA, 22 bp, Homo sapiens
ctaggaggcgggggctgcagta

SEQ ID NO: 8589299 - DNA, 22 bp, Homo sapiens
agtcacagaaacccaggtgtgg

SEQ ID NO: 8589300 - DNA, 22 bp, Homo sapiens
agtcacagaaacccaggtgtgg

SEQ ID NO: 8589301 - DNA, 20 bp, Homo sapiens
agtcacaggcctggaacatg

SEQ ID NO: 8589302 - DNA, 22 bp, Homo sapiens
agtcacagggggcccctgcaac

SEQ ID NO: 8589303 - DNA, 22 bp, Homo sapiens
agtcacaggttcttgggattag

SEQ ID NO: 8589304 - DNA, 20 bp, Homo sapiens
agtcacagtatcagtcttag

SEQ ID NO: 8589305 - DNA, 22 bp, Homo sapiens
agtcacagttctgctgtctgag

SEQ ID NO: 8589306 - DNA, 22 bp, Homo sapiens
atccatgaccctctcaacaacc

SEQ ID NO: 8589307 - DNA, 22 bp, Homo sapiens
ctgtttctcccatgtccaagtg

SEQ ID NO: 8589308 - DNA, 22 bp, Homo sapiens
cttcaacagttttagaacactg

SEQ ID NO: 8589309 - DNA, 18 bp, Homo sapiens
atctcccattggccaagg

SEQ ID NO: 8589310 - DNA, 22 bp, Homo sapiens
cttctgtgttttactatatgta

SEQ ID NO: 8589311 - DNA, 22 bp, Homo sapiens
cttctgtgtagaaaggtagccc

SEQ ID NO: 8589312 - DNA, 22 bp, Homo sapiens
cttctgtggatgttggatgcat

SEQ ID NO: 8589313 - DNA, 22 bp, Homo sapiens
cttctgtggtaaactttgttgt

SEQ ID NO: 8589314 - DNA, 22 bp, Homo sapiens
cttctgtgcttcacagttgcca

SEQ ID NO: 8589315 - DNA, 22 bp, Homo sapiens
cttctgtgatttggttaggata

SEQ ID NO: 8589316 - DNA, 22 bp, Homo sapiens
atcttatttaacacagcaaaac

SEQ ID NO: 8589317 - DNA, 22 bp, Homo sapiens
atctgtcctgtgacagtgggag

SEQ ID NO: 8589318 - DNA, 22 bp, Homo sapiens
atctgtcttccaccacacatcc

SEQ ID NO: 8589319 - DNA, 22 bp, Homo sapiens
atctggttttggctgtgtccct

SEQ ID NO: 8589320 - DNA, 22 bp, Homo sapiens
atctggttcttcttaggcatca

SEQ ID NO: 8589321 - DNA, 22 bp, Homo sapiens
atctgtagaagatactctgaga

SEQ ID NO: 8589322 - DNA, 22 bp, Homo sapiens
ctggtccagtggatgctgaggg

SEQ ID NO: 8589323 - DNA, 22 bp, Homo sapiens
ctggtcccagcagagctctgag

SEQ ID NO: 8589324 - DNA, 22 bp, Homo sapiens
ctggtcaggggatggggctcag

SEQ ID NO: 8589325 - DNA, 22 bp, Homo sapiens
ctggtcaggctgaactgccaca

SEQ ID NO: 8589326 - DNA, 22 bp, Homo sapiens
ctgggtggctgtccagccagcc

SEQ ID NO: 8589327 - DNA, 22 bp, Homo sapiens
ctgggtggctgtccagccagcc

SEQ ID NO: 8589328 - DNA, 22 bp, Homo sapiens
atattcaaattacatttactaa

SEQ ID NO: 8589329 - DNA, 22 bp, Homo sapiens
atattattctagtaacagtgat

SEQ ID NO: 8589330 - DNA, 19 bp, Homo sapiens
ctggggctttggtactgcc

SEQ ID NO: 8589331 - DNA, 22 bp, Homo sapiens
ctggggcatctgacagataaat

SEQ ID NO: 8589332 - DNA, 22 bp, Homo sapiens
ctgggaggtgaacagaaaaact

SEQ ID NO: 8589333 - DNA, 22 bp, Homo sapiens
ctggggctgtgggagacaaggc

SEQ ID NO: 8589334 - DNA, 22 bp, Homo sapiens
ctgggaggtgcagcaaaaatca

SEQ ID NO: 8589335 - DNA, 22 bp, Homo sapiens
ctgggaggtggaggttgcattg

SEQ ID NO: 8589336 - DNA, 22 bp, Homo sapiens
ctgggaggtggaggttgcattg

SEQ ID NO: 8589337 - DNA, 22 bp, Homo sapiens
ctgggaggggtagccaatccta

SEQ ID NO: 8589338 - DNA, 22 bp, Homo sapiens
ctgggaggcggaggttgtagtg

SEQ ID NO: 8589339 - DNA, 20 bp, Homo sapiens
ctgggaggtcttccaaatca

SEQ ID NO: 8589340 - DNA, 22 bp, Homo sapiens
ctgggaggatacacaagatcag

SEQ ID NO: 8589341 - DNA, 22 bp, Homo sapiens
ctgggaggacaacttggagctc

SEQ ID NO: 8589342 - DNA, 22 bp, Homo sapiens
atcagtttctgtgaagaacaca

SEQ ID NO: 8589343 - DNA, 22 bp, Homo sapiens
atcaggaaagaaaagcttggcg

SEQ ID NO: 8589344 - DNA, 22 bp, Homo sapiens
ctgtctctgataagctcgaggg

SEQ ID NO: 8589345 - DNA, 22 bp, Homo sapiens
atatacttggagactatcattg

SEQ ID NO: 8589346 - DNA, 22 bp, Homo sapiens
ctgggagctggaatgggagaag

SEQ ID NO: 8589347 - DNA, 22 bp, Homo sapiens
atatacatgggaatatgtggag

SEQ ID NO: 8589348 - DNA, 22 bp, Homo sapiens
atatacctcattctttgagtgc

SEQ ID NO: 8589349 - DNA, 22 bp, Homo sapiens
atatacactccactgatacagg

SEQ ID NO: 8589350 - DNA, 22 bp, Homo sapiens
atatacaggtggtatgtgtaaa

SEQ ID NO: 8589351 - DNA, 19 bp, Homo sapiens
ctggctgcaatgccagggt

SEQ ID NO: 8589352 - DNA, 22 bp, Homo sapiens
atatacacatgtgtatacattt

SEQ ID NO: 8589353 - DNA, 22 bp, Homo sapiens
ctggctcttggctagggagagt

SEQ ID NO: 8589354 - DNA, 22 bp, Homo sapiens
ctggcaggttatagagctgccc

SEQ ID NO: 8589355 - DNA, 22 bp, Homo sapiens
ctggcaggtccagctggactca

SEQ ID NO: 8589356 - DNA, 22 bp, Homo sapiens
ctggcaggtctcgctgacgtgt

SEQ ID NO: 8589357 - DNA, 22 bp, Homo sapiens
ctggcctcacctcagacttact

SEQ ID NO: 8589358 - DNA, 22 bp, Homo sapiens
ctggcctaggaatggttttccg

SEQ ID NO: 8589359 - DNA, 22 bp, Homo sapiens
ctggccagaagcacctttggcg

SEQ ID NO: 8589360 - DNA, 20 bp, Homo sapiens
ctggccagaacgcctacaca

SEQ ID NO: 8589361 - DNA, 22 bp, Homo sapiens
ctggccagactacacatgtgtg

SEQ ID NO: 8589362 - DNA, 22 bp, Homo sapiens
ctggcacagagacagaaggatt

SEQ ID NO: 8589363 - DNA, 22 bp, Homo sapiens
ctggcacagagtgagcattcaa

SEQ ID NO: 8589364 - DNA, 23 bp, Homo sapiens
atacatggccggatatgatgttc

SEQ ID NO: 8589365 - DNA, 22 bp, Homo sapiens
atacatgtgggtctaaacatat

SEQ ID NO: 8589366 - DNA, 22 bp, Homo sapiens
ctggcagcttagcactctggtt

SEQ ID NO: 8589367 - DNA, 22 bp, Homo sapiens
ataaaaaggacagatgtggtct

SEQ ID NO: 8589368 - DNA, 22 bp, Homo sapiens
agttttgtaattctcaaaaata

SEQ ID NO: 8589369 - DNA, 22 bp, Homo sapiens
ctgcaggctgagcgcctgccgg

SEQ ID NO: 8589370 - DNA, 22 bp, Homo sapiens
ataaactcatgccaagaaatga

SEQ ID NO: 8589371 - DNA, 22 bp, Homo sapiens
ctgcctggggcatcagtcaagg

SEQ ID NO: 8589372 - DNA, 22 bp, Homo sapiens
ctgcctgtattgtctgcttggg

SEQ ID NO: 8589373 - DNA, 22 bp, Homo sapiens
ctgctgggctcctcatgtgact

SEQ ID NO: 8589374 - DNA, 22 bp, Homo sapiens
ctgctggggaggcgcctcgacg

SEQ ID NO: 8589375 - DNA, 22 bp, Homo sapiens
ctgctgggcctggtctctgagg

SEQ ID NO: 8589376 - DNA, 22 bp, Homo sapiens
atacacatatgtgtgtatatgt

SEQ ID NO: 8589377 - DNA, 22 bp, Homo sapiens
atacacatctatttaagagaca

SEQ ID NO: 8589378 - DNA, 21 bp, Homo sapiens
atacacatacacataaatgtg

SEQ ID NO: 8589379 - DNA, 22 bp, Homo sapiens
atacaagttgcccaaatgatta

SEQ ID NO: 8589380 - DNA, 22 bp, Homo sapiens
ctgctgggggacacaggtccgg

SEQ ID NO: 8589381 - DNA, 22 bp, Homo sapiens
ctgctggggtcagagcactggg

SEQ ID NO: 8589382 - DNA, 22 bp, Homo sapiens
ctgctggggtcagagcactggg

SEQ ID NO: 8589383 - DNA, 22 bp, Homo sapiens
atcccagatggaggctggtcac

SEQ ID NO: 8589384 - DNA, 22 bp, Homo sapiens
atcccaggaggctgcgcagtta

SEQ ID NO: 8589385 - DNA, 22 bp, Homo sapiens
atcccaggcggcacaggttgca

SEQ ID NO: 8589386 - DNA, 22 bp, Homo sapiens
atcccaggggttgtatcttccc

SEQ ID NO: 8589387 - DNA, 22 bp, Homo sapiens
agaacagtcgtggtgagagaaa

SEQ ID NO: 8589388 - DNA, 22 bp, Homo sapiens
agaagccaacagggcaggagag

SEQ ID NO: 8589389 - DNA, 22 bp, Homo sapiens
agaaggcactcacactggcacg

SEQ ID NO: 8589390 - DNA, 21 bp, Homo sapiens
agaaggcaaaagcagacatct

SEQ ID NO: 8589391 - DNA, 22 bp, Homo sapiens
agaaggcacagtgctgctaaga

SEQ ID NO: 8589392 - DNA, 22 bp, Homo sapiens
agaaagattttcaacaggaggt

SEQ ID NO: 8589393 - DNA, 22 bp, Homo sapiens
atcaaaacttctttagagttta

SEQ ID NO: 8589394 - DNA, 22 bp, Homo sapiens
agaaaaagaaagtggatttgtc

SEQ ID NO: 8589395 - DNA, 22 bp, Homo sapiens
atacaaaatatatactggagac

SEQ ID NO: 8589396 - DNA, 22 bp, Homo sapiens
atacaaaaattagccgggagta

SEQ ID NO: 8589397 - DNA, 22 bp, Homo sapiens
atacaaaaattagccgggagta

SEQ ID NO: 8589398 - DNA, 22 bp, Homo sapiens
atacaaaatatatactggagac

SEQ ID NO: 8589399 - DNA, 20 bp, Homo sapiens
atagatatcatctttagaag

SEQ ID NO: 8589400 - DNA, 22 bp, Homo sapiens
atagatattagcaaaattttat

SEQ ID NO: 8589401 - DNA, 22 bp, Homo sapiens
atagatatttgagttgtttcca

SEQ ID NO: 8589402 - DNA, 22 bp, Homo sapiens
atagatacattgttatatttgt

SEQ ID NO: 8589403 - DNA, 22 bp, Homo sapiens
atagagtgatgtaaggtatgtg

SEQ ID NO: 8589404 - DNA, 22 bp, Homo sapiens
atacatcatgctccatatattt

SEQ ID NO: 8589405 - DNA, 22 bp, Homo sapiens
actgggctccaaggacctggag

SEQ ID NO: 8589406 - DNA, 22 bp, Homo sapiens
actgcactcctgcctgggtaac

SEQ ID NO: 8589407 - DNA, 22 bp, Homo sapiens
actctgaactccaggaggctca

SEQ ID NO: 8589408 - DNA, 22 bp, Homo sapiens
actctgaagaagacttccagac

SEQ ID NO: 8589409 - DNA, 22 bp, Homo sapiens
actgagatttacatgttctagt

SEQ ID NO: 8589410 - DNA, 22 bp, Homo sapiens
agtgtcctggggccctaaggcc

SEQ ID NO: 8589411 - DNA, 22 bp, Homo sapiens
agtgtcctggggccctaaggcc

SEQ ID NO: 8589412 - DNA, 22 bp, Homo sapiens
agtgtcctgtgtcccagactgt

SEQ ID NO: 8589413 - DNA, 22 bp, Homo sapiens
actggctgtgcagagggcagta

SEQ ID NO: 8589414 - DNA, 21 bp, Homo sapiens
agtgtccttgatcttgccttg

SEQ ID NO: 8589415 - DNA, 22 bp, Homo sapiens
agtgtccttgattcctgttgtt

SEQ ID NO: 8589416 - DNA, 22 bp, Homo sapiens
agtgtccttgttattactgctc

SEQ ID NO: 8589417 - DNA, 22 bp, Homo sapiens
agtgtcctttctgttccagcca

SEQ ID NO: 8589418 - DNA, 22 bp, Homo sapiens
agtgtccttagttagctttggg

SEQ ID NO: 8589419 - DNA, 21 bp, Homo sapiens
agtgtccttgatcttgccttg

SEQ ID NO: 8589420 - DNA, 22 bp, Homo sapiens
agtgtccttgaggttcctagga

SEQ ID NO: 8589421 - DNA, 22 bp, Homo sapiens
actggcttggcaggaggaagat

SEQ ID NO: 8589422 - DNA, 21 bp, Homo sapiens
agtgtccttttactgtgaata

SEQ ID NO: 8589423 - DNA, 21 bp, Homo sapiens
actggccaccactggcagggg

SEQ ID NO: 8589424 - DNA, 21 bp, Homo sapiens
actgccaggagagtaggggga

SEQ ID NO: 8589425 - DNA, 22 bp, Homo sapiens
agtagaaagttgcaggaggaat

SEQ ID NO: 8589426 - DNA, 22 bp, Homo sapiens
agtatacaaataaatgtgtaat

SEQ ID NO: 8589427 - DNA, 22 bp, Homo sapiens
agtatacagtaatgacatatct

SEQ ID NO: 8589428 - DNA, 22 bp, Homo sapiens
aggtggggaaaccagcgatccc

SEQ ID NO: 8589429 - DNA, 22 bp, Homo sapiens
agtcaccattttcacctgcctc

SEQ ID NO: 8589430 - DNA, 22 bp, Homo sapiens
actcctgcttcttccctgagga

SEQ ID NO: 8589431 - DNA, 22 bp, Homo sapiens
agtcactgtttcagaactgagt

SEQ ID NO: 8589432 - DNA, 22 bp, Homo sapiens
agtcactgtcaaagccacacac

SEQ ID NO: 8589433 - DNA, 22 bp, Homo sapiens
aggtgacatgaaaaatgttgag

SEQ ID NO: 8589434 - DNA, 22 bp, Homo sapiens
accttccaggaatctgccagat

SEQ ID NO: 8589435 - DNA, 22 bp, Homo sapiens
aggtatttgttatttgagagtg

SEQ ID NO: 8589436 - DNA, 22 bp, Homo sapiens
aggtatttgtctcagattgggt

SEQ ID NO: 8589437 - DNA, 22 bp, Homo sapiens
aggtatttcccaaagtggcatg

SEQ ID NO: 8589438 - DNA, 22 bp, Homo sapiens
aggaagagcattcacatggtag

SEQ ID NO: 8589439 - DNA, 22 bp, Homo sapiens
aggaagcatgttggatccactt

SEQ ID NO: 8589440 - DNA, 22 bp, Homo sapiens
aggaagcagtttataatgcatt

SEQ ID NO: 8589441 - DNA, 22 bp, Homo sapiens
agcttccaatttctccaagaga

SEQ ID NO: 8589442 - DNA, 22 bp, Homo sapiens
agctttatggtgcctcacttga

SEQ ID NO: 8589443 - DNA, 20 bp, Homo sapiens
agctttggttaagccagtgg

SEQ ID NO: 8589444 - DNA, 22 bp, Homo sapiens
agctttggttgccatgatctga

SEQ ID NO: 8589445 - DNA, 22 bp, Homo sapiens
agctttggttgaggggagtgtg

SEQ ID NO: 8589446 - DNA, 22 bp, Homo sapiens
agctttattaactctccaggtg

SEQ ID NO: 8589447 - DNA, 22 bp, Homo sapiens
agctgtgggagaatctctgggt

SEQ ID NO: 8589448 - DNA, 22 bp, Homo sapiens
agctgtgggcctgggagagctg

SEQ ID NO: 8589449 - DNA, 22 bp, Homo sapiens
agctgggaggctcctctgtgac

SEQ ID NO: 8589450 - DNA, 21 bp, Homo sapiens
agctgtggcgaggggaacatg

SEQ ID NO: 8589451 - DNA, 22 bp, Homo sapiens
agctgggcaaaatgtgaggttg

SEQ ID NO: 8589452 - DNA, 22 bp, Homo sapiens
agctgctgtttggtgagtcttg

SEQ ID NO: 8589453 - DNA, 22 bp, Homo sapiens
agctgctgtggggctcggcctg

SEQ ID NO: 8589454 - DNA, 22 bp, Homo sapiens
agctgctgtcctaggcactgta

SEQ ID NO: 8589455 - DNA, 23 bp, Homo sapiens
agctgctgggcctgccgtggcct

SEQ ID NO: 8589456 - DNA, 22 bp, Homo sapiens
agctgctggggagggcagacac

SEQ ID NO: 8589457 - DNA, 22 bp, Homo sapiens
agctgcagccgcagctgtggcc

SEQ ID NO: 8589458 - DNA, 22 bp, Homo sapiens
agctgcagccgcagctgtggcc

SEQ ID NO: 8589459 - DNA, 22 bp, Homo sapiens
agctgcagccctcctgcatggc

SEQ ID NO: 8589460 - DNA, 22 bp, Homo sapiens
agctgcagccctcctgcatggc

SEQ ID NO: 8589461 - DNA, 22 bp, Homo sapiens
agctgcagctgttttctgagtg

SEQ ID NO: 8589462 - DNA, 22 bp, Homo sapiens
agctccaggtgcaagtcatggt

SEQ ID NO: 8589463 - DNA, 20 bp, Homo sapiens
agctccagtgctgacgcttc

SEQ ID NO: 8589464 - DNA, 22 bp, Homo sapiens
agctccagttacttacctagag

SEQ ID NO: 8589465 - DNA, 22 bp, Homo sapiens
acagccaggtaaaggcatggca

SEQ ID NO: 8589466 - DNA, 22 bp, Homo sapiens
acagccaggtaaaggcatggca

SEQ ID NO: 8589467 - DNA, 20 bp, Homo sapiens
aggatggcaagcaagtgcat

SEQ ID NO: 8589468 - DNA, 22 bp, Homo sapiens
aggcaaagaagttggtcaggag

SEQ ID NO: 8589469 - DNA, 22 bp, Homo sapiens
aggatggcgattcgagcacctc

SEQ ID NO: 8589470 - DNA, 22 bp, Homo sapiens
aggagggacctaggaatattgc

SEQ ID NO: 8589471 - DNA, 22 bp, Homo sapiens
aggagggacaccaatatatgtt

SEQ ID NO: 8589472 - DNA, 22 bp, Homo sapiens
acatacagacctgcagggcagc

SEQ ID NO: 8589473 - DNA, 23 bp, Homo sapiens
acatacataagcaccacattttg

SEQ ID NO: 8589474 - DNA, 22 bp, Homo sapiens
aggcacagagaatgccctccat

SEQ ID NO: 8589475 - DNA, 22 bp, Homo sapiens
acaggggctccgaaggtgaggg

SEQ ID NO: 8589476 - DNA, 22 bp, Homo sapiens
acagggtgactttgtgacagat

SEQ ID NO: 8589477 - DNA, 20 bp, Homo sapiens
aggagccattgactgcagca

SEQ ID NO: 8589478 - DNA, 22 bp, Homo sapiens
aggagccctgcgggaggcagag

SEQ ID NO: 8589479 - DNA, 23 bp, Homo sapiens
aggagcccaaggagaggtaactt

SEQ ID NO: 8589480 - DNA, 22 bp, Homo sapiens
aggagctgcagattctgccttg

SEQ ID NO: 8589481 - DNA, 22 bp, Homo sapiens
aggagctgcttaaatggttggt

SEQ ID NO: 8589482 - DNA, 22 bp, Homo sapiens
aggagctgctttggtgcggttt

SEQ ID NO: 8589483 - DNA, 22 bp, Homo sapiens
aggagctgctttggtgcggttt

SEQ ID NO: 8589484 - DNA, 20 bp, Homo sapiens
aggaagccaaaggctgtctt

SEQ ID NO: 8589485 - DNA, 22 bp, Homo sapiens
aggagacatctaactgtaggtt

SEQ ID NO: 8589486 - DNA, 22 bp, Homo sapiens
aggagactcagagacctggccg

SEQ ID NO: 8589487 - DNA, 22 bp, Homo sapiens
aggagactcagagacctggccg

SEQ ID NO: 8589488 - DNA, 22 bp, Homo sapiens
aggagacagccaggggcctgag

SEQ ID NO: 8589489 - DNA, 20 bp, Homo sapiens
aggacttgtttgggcagagt

SEQ ID NO: 8589490 - DNA, 18 bp, Homo sapiens
aggccagccctgctactg

SEQ ID NO: 8589491 - DNA, 22 bp, Homo sapiens
aggccagccctcacctgtgttc

SEQ ID NO: 8589492 - DNA, 21 bp, Homo sapiens
aggcccaggaatatgcatttt

SEQ ID NO: 8589493 - DNA, 18 bp, Homo sapiens
aggcatggtggtgcgcac

SEQ ID NO: 8589494 - DNA, 22 bp, Homo sapiens
aggcatggctttaggcaggcgt

SEQ ID NO: 8589495 - DNA, 22 bp, Homo sapiens
aggcatggctttaggcaggcgt

SEQ ID NO: 8589496 - DNA, 22 bp, Homo sapiens
aggcatggggctgcagtcaggt

SEQ ID NO: 8589497 - DNA, 22 bp, Homo sapiens
acattctaacattgtacagata

SEQ ID NO: 8589498 - DNA, 22 bp, Homo sapiens
aggctccagccaatgggtctgt

SEQ ID NO: 8589499 - DNA, 22 bp, Homo sapiens
aggctccacggtcactggctct

SEQ ID NO: 8589500 - DNA, 22 bp, Homo sapiens
aggcttcattacagtggttcaa

SEQ ID NO: 8589501 - DNA, 22 bp, Homo sapiens
aggcttcagttgtaccttcttg

SEQ ID NO: 8589502 - DNA, 19 bp, Homo sapiens
aggcttcaggccacatgct

SEQ ID NO: 8589503 - DNA, 22 bp, Homo sapiens
aggcttcaggaagtctcctggg

SEQ ID NO: 8589504 - DNA, 22 bp, Homo sapiens
aggcttcagcagccctctcttg

SEQ ID NO: 8589505 - DNA, 22 bp, Homo sapiens
aggctccaggcaatgtttctga

SEQ ID NO: 8589506 - DNA, 19 bp, Homo sapiens
acccagggttgatgtccag

SEQ ID NO: 8589507 - DNA, 22 bp, Homo sapiens
acccagggtttgagctctgcag

SEQ ID NO: 8589508 - DNA, 19 bp, Homo sapiens
accaggagtatcagagctg

SEQ ID NO: 8589509 - DNA, 22 bp, Homo sapiens
accaggagtaacagtgagtggt

SEQ ID NO: 8589510 - DNA, 22 bp, Homo sapiens
accaggaggctacactgtccca

SEQ ID NO: 8589511 - DNA, 22 bp, Homo sapiens
accaggagggaccctggtggcc

SEQ ID NO: 8589512 - DNA, 22 bp, Homo sapiens
accaggctgtgaagtgagacta

SEQ ID NO: 8589513 - DNA, 22 bp, Homo sapiens
accaggagtctagcctagtcaa

SEQ ID NO: 8589514 - DNA, 23 bp, Homo sapiens
agggcccaagcctggacagcagg

SEQ ID NO: 8589515 - DNA, 22 bp, Homo sapiens
accagtggatactgcttgcttt

SEQ ID NO: 8589516 - DNA, 22 bp, Homo sapiens
accagtggaattattctgtggt

SEQ ID NO: 8589517 - DNA, 22 bp, Homo sapiens
accagtgggaagtggaaaatga

SEQ ID NO: 8589518 - DNA, 22 bp, Homo sapiens
accagtggatgaatgctggacc

SEQ ID NO: 8589519 - DNA, 22 bp, Homo sapiens
accagtgggtgtcattccctta

SEQ ID NO: 8589520 - DNA, 22 bp, Homo sapiens
accaggagacatgaccaatgag

SEQ ID NO: 8589521 - DNA, 22 bp, Homo sapiens
accaggactttgtattcagctt

SEQ ID NO: 8589522 - DNA, 19 bp, Homo sapiens
accaggagacagtgagctt

SEQ ID NO: 8589523 - DNA, 20 bp, Homo sapiens
accaggagatggaggcaggg

SEQ ID NO: 8589524 - DNA, 23 bp, Homo sapiens
accaggagccaagatctccctgg

SEQ ID NO: 8589525 - DNA, 23 bp, Homo sapiens
accaggagccaagatctccctgg

SEQ ID NO: 8589526 - DNA, 22 bp, Homo sapiens
accaggagccacaggaggagcc

SEQ ID NO: 8589527 - DNA, 22 bp, Homo sapiens
accaggagccacaggaggagcc

SEQ ID NO: 8589528 - DNA, 22 bp, Homo sapiens
accaggagccatagagtcaggc

SEQ ID NO: 8589529 - DNA, 22 bp, Homo sapiens
accaggaggcctggagcacaaa

SEQ ID NO: 8589530 - DNA, 22 bp, Homo sapiens
accaatgcatgattttgtctgg

SEQ ID NO: 8589531 - DNA, 22 bp, Homo sapiens
agatcactggttacttaatgaa

SEQ ID NO: 8589532 - DNA, 22 bp, Homo sapiens
agatcaaagccatgagagattt

SEQ ID NO: 8589533 - DNA, 22 bp, Homo sapiens
agatcacagcccccagatgcca

SEQ ID NO: 8589534 - DNA, 22 bp, Homo sapiens
agatattaccagcagtctatgc

SEQ ID NO: 8589535 - DNA, 22 bp, Homo sapiens
agatattaatcgtacataaggt

SEQ ID NO: 8589536 - DNA, 22 bp, Homo sapiens
agatataataatttacaagtgt

SEQ ID NO: 8589537 - DNA, 22 bp, Homo sapiens
agatattaggaggattcataat

SEQ ID NO: 8589538 - DNA, 22 bp, Homo sapiens
attggtcagagtaaatttattt

SEQ ID NO: 8589539 - DNA, 22 bp, Homo sapiens
attggtcacctccctcagctct

SEQ ID NO: 8589540 - DNA, 22 bp, Homo sapiens
attggtcattttggtttagaag

SEQ ID NO: 8589541 - DNA, 22 bp, Homo sapiens
attggtcatgtttttgtggtaa

SEQ ID NO: 8589542 - DNA, 22 bp, Homo sapiens
attggtcaggactggcatgtgg

SEQ ID NO: 8589543 - DNA, 22 bp, Homo sapiens
attggtcataaattgagtgatt

SEQ ID NO: 8589544 - DNA, 22 bp, Homo sapiens
attggtcagccacgtagggaat

SEQ ID NO: 8589545 - DNA, 22 bp, Homo sapiens
attggtcaagtcttgcaggtga

SEQ ID NO: 8589546 - DNA, 22 bp, Homo sapiens
agagtggcagcaagtcaggtag

SEQ ID NO: 8589547 - DNA, 22 bp, Homo sapiens
agagtggcagcaagtcaggtag

SEQ ID NO: 8589548 - DNA, 21 bp, Homo sapiens
agatgctgtgctccaggagca

SEQ ID NO: 8589549 - DNA, 22 bp, Homo sapiens
agatgcttaagttttcagtgta

SEQ ID NO: 8589550 - DNA, 22 bp, Homo sapiens
caaagattttagaatttgcaat

SEQ ID NO: 8589551 - DNA, 20 bp, Homo sapiens
agcaagagtaaggacagcga

SEQ ID NO: 8589552 - DNA, 22 bp, Homo sapiens
caaagcagacgcagtaagggta

SEQ ID NO: 8589553 - DNA, 22 bp, Homo sapiens
agcaagaagctttgctgtgata

SEQ ID NO: 8589554 - DNA, 20 bp, Homo sapiens
agcaagaaggttgtgggagc

SEQ ID NO: 8589555 - DNA, 21 bp, Homo sapiens
agcaagaatcaggaaggctct

SEQ ID NO: 8589556 - DNA, 22 bp, Homo sapiens
agagtctgaggcagctgcagcc

SEQ ID NO: 8589557 - DNA, 21 bp, Homo sapiens
agagtctgagtgtgcaagggc

SEQ ID NO: 8589558 - DNA, 22 bp, Homo sapiens
agagtctgaatgctcagagttg

SEQ ID NO: 8589559 - DNA, 19 bp, Homo sapiens
agagtcggggggacatagg

SEQ ID NO: 8589560 - DNA, 22 bp, Homo sapiens
agagtgcttagtagtgacatgg

SEQ ID NO: 8589561 - DNA, 22 bp, Homo sapiens
agagtcagcttatgacacagtc

SEQ ID NO: 8589562 - DNA, 22 bp, Homo sapiens
agagtcagaaagcagacagggg

SEQ ID NO: 8589563 - DNA, 22 bp, Homo sapiens
agagggcagtctcagattggga

SEQ ID NO: 8589564 - DNA, 22 bp, Homo sapiens
agagggctgggatgtgctgtgt

SEQ ID NO: 8589565 - DNA, 22 bp, Homo sapiens
agaggctgggtacgggccacct

SEQ ID NO: 8589566 - DNA, 22 bp, Homo sapiens
agaggctgcaggctggaaatca

SEQ ID NO: 8589567 - DNA, 22 bp, Homo sapiens
agaggctccttcactctggcac

SEQ ID NO: 8589568 - DNA, 22 bp, Homo sapiens
agaggctgcacttgctcatgat

SEQ ID NO: 8589569 - DNA, 22 bp, Homo sapiens
agaggctcctcggtgcctcgtg

SEQ ID NO: 8589570 - DNA, 23 bp, Homo sapiens
agaggccagcctttggagacacc

SEQ ID NO: 8589571 - DNA, 22 bp, Homo sapiens
agaggccagcagtgcctatctg

SEQ ID NO: 8589572 - DNA, 22 bp, Homo sapiens
agaggccagcactgcagggaag

SEQ ID NO: 8589573 - DNA, 22 bp, Homo sapiens
agaggccaccagaggtggtgcc

SEQ ID NO: 8589574 - DNA, 16 bp, Homo sapiens
agaggccacagacaga

SEQ ID NO: 8589575 - DNA, 22 bp, Homo sapiens
agaggccagaaggcgcaccccg

SEQ ID NO: 8589576 - DNA, 21 bp, Homo sapiens
agagctgggacttgcctgaga

SEQ ID NO: 8589577 - DNA, 22 bp, Homo sapiens
agagctgggaccgtctggaagt

SEQ ID NO: 8589578 - DNA, 22 bp, Homo sapiens
agagctggctgtgggtgacttt

SEQ ID NO: 8589579 - DNA, 20 bp, Homo sapiens
agagctgggaagctccctat

SEQ ID NO: 8589580 - DNA, 23 bp, Homo sapiens
agaggcacagcacttggctggcc

SEQ ID NO: 8589581 - DNA, 23 bp, Homo sapiens
agaggcacagcacttggctggcc

SEQ ID NO: 8589582 - DNA, 22 bp, Homo sapiens
agaggcaccatctggaacagcc

SEQ ID NO: 8589583 - DNA, 22 bp, Homo sapiens
attacacagcggttactactag

SEQ ID NO: 8589584 - DNA, 22 bp, Homo sapiens
agaatatatgactgcaagacta

SEQ ID NO: 8589585 - DNA, 22 bp, Homo sapiens
agaatatatgactgcaagacta

SEQ ID NO: 8589586 - DNA, 22 bp, Homo sapiens
agaatatagttaccaaattctg

SEQ ID NO: 8589587 - DNA, 22 bp, Homo sapiens
atgagggcagctatgtaagtgt

SEQ ID NO: 8589588 - DNA, 22 bp, Homo sapiens
atgcatttgtaaaatataatcg

SEQ ID NO: 8589589 - DNA, 22 bp, Homo sapiens
atgcatttttgagtatgaatga

SEQ ID NO: 8589590 - DNA, 22 bp, Homo sapiens
atgatacatcttgtttatttca

SEQ ID NO: 8589591 - DNA, 18 bp, Homo sapiens
agacagacaggtttgtgc

SEQ ID NO: 8589592 - DNA, 15 bp, Homo sapiens
agacagacagtggga

SEQ ID NO: 8589593 - DNA, 22 bp, Homo sapiens
agacagacatagaaattagtaa

SEQ ID NO: 8589594 - DNA, 22 bp, Homo sapiens
agacagacacatggtaacagat

SEQ ID NO: 8589595 - DNA, 22 bp, Homo sapiens
agacagacagagaatttaaata

SEQ ID NO: 8589596 - DNA, 22 bp, Homo sapiens
agacagacaaaattcctgcctg

SEQ ID NO: 8589597 - DNA, 22 bp, Homo sapiens
atgatatacttcctagaacagt

SEQ ID NO: 8589598 - DNA, 22 bp, Homo sapiens
atgatacattgcaaaattttaa

SEQ ID NO: 8589599 - DNA, 22 bp, Homo sapiens
atgatatagagagtagattaaa

SEQ ID NO: 8589600 - DNA, 22 bp, Homo sapiens
atgatatagagagtagattaaa

SEQ ID NO: 8589601 - DNA, 22 bp, Homo sapiens
agacgagggcccccaggacagc

SEQ ID NO: 8589602 - DNA, 22 bp, Homo sapiens
agacgagggcccccaggacagc

SEQ ID NO: 8589603 - DNA, 22 bp, Homo sapiens
agactgggtttgagacttagca

SEQ ID NO: 8589604 - DNA, 22 bp, Homo sapiens
agactggggttctggcaaggag

SEQ ID NO: 8589605 - DNA, 22 bp, Homo sapiens
agagacaagggacctctggaga

SEQ ID NO: 8589606 - DNA, 22 bp, Homo sapiens
agagagcatggcacagaggggt

SEQ ID NO: 8589607 - DNA, 22 bp, Homo sapiens
agagagcattgaggaaatcttc

SEQ ID NO: 8589608 - DNA, 22 bp, Homo sapiens
agagagggcatagaaaaaggga

SEQ ID NO: 8589609 - DNA, 21 bp, Homo sapiens
agagagggagatgaaacatcc

SEQ ID NO: 8589610 - DNA, 22 bp, Homo sapiens
agagaaggtcactaaggaccca

SEQ ID NO: 8589611 - DNA, 22 bp, Homo sapiens
agagaagggtgtagcctgggcc

SEQ ID NO: 8589612 - DNA, 22 bp, Homo sapiens
agagaaaagagttcaggctttg

SEQ ID NO: 8589613 - DNA, 21 bp, Homo sapiens
agagcctgagatcttccagca

SEQ ID NO: 8589614 - DNA, 22 bp, Homo sapiens
agagccctttctccaggcacct

SEQ ID NO: 8589615 - DNA, 22 bp, Homo sapiens
agagcctgagaggataatgggg

SEQ ID NO: 8589616 - DNA, 22 bp, Homo sapiens
agagcctgaggatgtcccagct

SEQ ID NO: 8589617 - DNA, 22 bp, Homo sapiens
agagcctgaggatgtcccagct

SEQ ID NO: 8589618 - DNA, 22 bp, Homo sapiens
agagcctgagcctgaaagccct

SEQ ID NO: 8589619 - DNA, 22 bp, Homo sapiens
agagcctgagcctgatcttgaa

SEQ ID NO: 8589620 - DNA, 22 bp, Homo sapiens
agagcctgaggccaggaaaatg

SEQ ID NO: 8589621 - DNA, 22 bp, Homo sapiens
agagcctgcagctgtgaagaaa

SEQ ID NO: 8589622 - DNA, 22 bp, Homo sapiens
agagctggaatcagacctcagg

SEQ ID NO: 8589623 - DNA, 22 bp, Homo sapiens
agagctggacgtctgagcccta

SEQ ID NO: 8589624 - DNA, 22 bp, Homo sapiens
agagctggagatgcaggtttcg

SEQ ID NO: 8589625 - DNA, 22 bp, Homo sapiens
agagctggatggtcaagatggc

SEQ ID NO: 8589626 - DNA, 22 bp, Homo sapiens
agagctggatggtcaagatggc

SEQ ID NO: 8589627 - DNA, 22 bp, Homo sapiens
agagctggcagcagcttctcct

SEQ ID NO: 8589628 - DNA, 22 bp, Homo sapiens
agagctggcactgaccctcacc

SEQ ID NO: 8589629 - DNA, 22 bp, Homo sapiens
agagctggagcagccccactgg

SEQ ID NO: 8589630 - DNA, 22 bp, Homo sapiens
agagctggctgctgcggtgctt

SEQ ID NO: 8589631 - DNA, 22 bp, Homo sapiens
agagctggctggtagccctgat

SEQ ID NO: 8589632 - DNA, 22 bp, Homo sapiens
agagctggctgtgggtgacttt

SEQ ID NO: 8589633 - DNA, 22 bp, Homo sapiens
agagctggctgtgggtgacttt

SEQ ID NO: 8589634 - DNA, 22 bp, Homo sapiens
agagcacaggctcaccattgtt

SEQ ID NO: 8589635 - DNA, 21 bp, Homo sapiens
agagcacaggtggacaatgct

SEQ ID NO: 8589636 - DNA, 22 bp, Homo sapiens
agagcccaggcaggcatccagg

SEQ ID NO: 8589637 - DNA, 22 bp, Homo sapiens
agagcccatcagtggcagtgga

SEQ ID NO: 8589638 - DNA, 22 bp, Homo sapiens
agagcccagtgacatcagcaca

SEQ ID NO: 8589639 - DNA, 22 bp, Homo sapiens
agagcagatggagctggaagag

SEQ ID NO: 8589640 - DNA, 22 bp, Homo sapiens
agagcagatggagctggaagag

SEQ ID NO: 8589641 - DNA, 22 bp, Homo sapiens
agcaggaaggtctgtgtgagtc

SEQ ID NO: 8589642 - DNA, 22 bp, Homo sapiens
agcaggaaggggatgatgggca

SEQ ID NO: 8589643 - DNA, 22 bp, Homo sapiens
agcaggaaggctttgggggttc

SEQ ID NO: 8589644 - DNA, 20 bp, Homo sapiens
agcaggaatgatgctttcat

SEQ ID NO: 8589645 - DNA, 22 bp, Homo sapiens
cacagcagaaagtgtaggagga

SEQ ID NO: 8589646 - DNA, 22 bp, Homo sapiens
cacagcagacagggaggcggct

SEQ ID NO: 8589647 - DNA, 22 bp, Homo sapiens
cacagcagagggagccattgaa

SEQ ID NO: 8589648 - DNA, 22 bp, Homo sapiens
agcagggctgcagtgtgtcttt

SEQ ID NO: 8589649 - DNA, 22 bp, Homo sapiens
agcagggctctgtggagggtgg

SEQ ID NO: 8589650 - DNA, 22 bp, Homo sapiens
agcagggctgcagtgtgtcttt

SEQ ID NO: 8589651 - DNA, 22 bp, Homo sapiens
agcagggctgcggccccaccac

SEQ ID NO: 8589652 - DNA, 22 bp, Homo sapiens
agcagggctctgtggagggtgg

SEQ ID NO: 8589653 - DNA, 22 bp, Homo sapiens
caccagagtgagtggactgtcg

SEQ ID NO: 8589654 - DNA, 22 bp, Homo sapiens
caccagagtgagtggactgtcg

SEQ ID NO: 8589655 - DNA, 22 bp, Homo sapiens
agcagggcagtgatcagaaagg

SEQ ID NO: 8589656 - DNA, 22 bp, Homo sapiens
agcagggcagtgatcagaaagg

SEQ ID NO: 8589657 - DNA, 22 bp, Homo sapiens
agcagggcaggtaaggatcaga

SEQ ID NO: 8589658 - DNA, 22 bp, Homo sapiens
agcagggcagcttttttcagaa

SEQ ID NO: 8589659 - DNA, 22 bp, Homo sapiens
agcagggcaggtaaggatcaga

SEQ ID NO: 8589660 - DNA, 22 bp, Homo sapiens
agcagggcaaagtcaggctaac

SEQ ID NO: 8589661 - DNA, 22 bp, Homo sapiens
agcagggcagctgatgcgcacg

SEQ ID NO: 8589662 - DNA, 22 bp, Homo sapiens
agcagggcaaagtcaggctaac

SEQ ID NO: 8589663 - DNA, 22 bp, Homo sapiens
agcagggcactggaaggcactg

SEQ ID NO: 8589664 - DNA, 22 bp, Homo sapiens
agcagggcaaagtcaggctaac

SEQ ID NO: 8589665 - DNA, 22 bp, Homo sapiens
agcatggggctccgcaatgaac

SEQ ID NO: 8589666 - DNA, 19 bp, Homo sapiens
cactgtggtccttcactgc

SEQ ID NO: 8589667 - DNA, 22 bp, Homo sapiens
cactggtgagtccagaagtcat

SEQ ID NO: 8589668 - DNA, 22 bp, Homo sapiens
agcagtgatgcatgacagccta

SEQ ID NO: 8589669 - DNA, 22 bp, Homo sapiens
agcagggctggggcacgagcca

SEQ ID NO: 8589670 - DNA, 19 bp, Homo sapiens
agcaggtgggtaagaaaat

SEQ ID NO: 8589671 - DNA, 22 bp, Homo sapiens
agcaggtgggcatgaaagctga

SEQ ID NO: 8589672 - DNA, 22 bp, Homo sapiens
agcagggctggatttggcaaga

SEQ ID NO: 8589673 - DNA, 22 bp, Homo sapiens
agcaggtgtttgtatcataagg

SEQ ID NO: 8589674 - DNA, 22 bp, Homo sapiens
agcaggtgttggctgggccatc

SEQ ID NO: 8589675 - DNA, 22 bp, Homo sapiens
agcaggtgtcggcgagggtctt

SEQ ID NO: 8589676 - DNA, 18 bp, Homo sapiens
agcaggtgtgcagaatgt

SEQ ID NO: 8589677 - DNA, 22 bp, Homo sapiens
agcaggtgttagggatccaatg

SEQ ID NO: 8589678 - DNA, 22 bp, Homo sapiens
agcagagctgcagtggcctgct

SEQ ID NO: 8589679 - DNA, 22 bp, Homo sapiens
agcagagctattcttgtgcaat

SEQ ID NO: 8589680 - DNA, 22 bp, Homo sapiens
agcagagctttttggactcaga

SEQ ID NO: 8589681 - DNA, 22 bp, Homo sapiens
agcagagctgggatcctgggtc

SEQ ID NO: 8589682 - DNA, 20 bp, Homo sapiens
agcagagtgcccatcccgga

SEQ ID NO: 8589683 - DNA, 22 bp, Homo sapiens
agcagaggtttgttggaaacct

SEQ ID NO: 8589684 - DNA, 22 bp, Homo sapiens
agcaccaggtcgctggcacgct

SEQ ID NO: 8589685 - DNA, 20 bp, Homo sapiens
agcactaggtgtggcaggtg

SEQ ID NO: 8589686 - DNA, 22 bp, Homo sapiens
agcactgggaacgcatggggcc

SEQ ID NO: 8589687 - DNA, 22 bp, Homo sapiens
agcactgggaacgcatggggcc

SEQ ID NO: 8589688 - DNA, 22 bp, Homo sapiens
agcactggagtttagtgggatt

SEQ ID NO: 8589689 - DNA, 21 bp, Homo sapiens
agcagcagatctggtgagggc

SEQ ID NO: 8589690 - DNA, 22 bp, Homo sapiens
agcagcagatcaaacaggcttg

SEQ ID NO: 8589691 - DNA, 22 bp, Homo sapiens
agcagcagagctctggtctgca

SEQ ID NO: 8589692 - DNA, 19 bp, Homo sapiens
agcagcagaagtgtgcctt

SEQ ID NO: 8589693 - DNA, 22 bp, Homo sapiens
cacagagatggccagggcacat

SEQ ID NO: 8589694 - DNA, 22 bp, Homo sapiens
cacagagatcggaacagaagta

SEQ ID NO: 8589695 - DNA, 22 bp, Homo sapiens
agcagcctttgatcatctggga

SEQ ID NO: 8589696 - DNA, 22 bp, Homo sapiens
agcagctcatggagtaggcact

SEQ ID NO: 8589697 - DNA, 22 bp, Homo sapiens
cacagagatggccagggcacat

SEQ ID NO: 8589698 - DNA, 22 bp, Homo sapiens
cacagagatggtctggcaggtg

SEQ ID NO: 8589699 - DNA, 22 bp, Homo sapiens
cacagagcaactcaaatcagct

SEQ ID NO: 8589700 - DNA, 20 bp, Homo sapiens
cagatgggacgtggaggagt

SEQ ID NO: 8589701 - DNA, 22 bp, Homo sapiens
cagcaagaacagcctgatgtgc

SEQ ID NO: 8589702 - DNA, 22 bp, Homo sapiens
cagcaagaaaattcacatgctc

SEQ ID NO: 8589703 - DNA, 22 bp, Homo sapiens
cagcaagaatcagacaacctca

SEQ ID NO: 8589704 - DNA, 17 bp, Homo sapiens
agcctgggaaggagtga

SEQ ID NO: 8589705 - DNA, 22 bp, Homo sapiens
agcctggcttagctctctcact

SEQ ID NO: 8589706 - DNA, 21 bp, Homo sapiens
agcctgggaggcggaggttgc

SEQ ID NO: 8589707 - DNA, 19 bp, Homo sapiens
agcctggctttgctctgct

SEQ ID NO: 8589708 - DNA, 19 bp, Homo sapiens
agctacagcatggcgaggt

SEQ ID NO: 8589709 - DNA, 22 bp, Homo sapiens
agctacaagtcatcagctatca

SEQ ID NO: 8589710 - DNA, 22 bp, Homo sapiens
agctacaaaattactaagtcct

SEQ ID NO: 8589711 - DNA, 22 bp, Homo sapiens
agctacagttgccctcagcagg

SEQ ID NO: 8589712 - DNA, 22 bp, Homo sapiens
agctacagggaactaaaagcta

SEQ ID NO: 8589713 - DNA, 22 bp, Homo sapiens
agctacagctgtactctgcagg

SEQ ID NO: 8589714 - DNA, 22 bp, Homo sapiens
agcctgggcatgggacgggagg

SEQ ID NO: 8589715 - DNA, 18 bp, Homo sapiens
agcctgggctctgcctgg

SEQ ID NO: 8589716 - DNA, 21 bp, Homo sapiens
agcctgggtatcctttgagga

SEQ ID NO: 8589717 - DNA, 22 bp, Homo sapiens
agcctgggtgggggttcggaga

SEQ ID NO: 8589718 - DNA, 22 bp, Homo sapiens
agcctgggtgggggttcggaga

SEQ ID NO: 8589719 - DNA, 22 bp, Homo sapiens
agctaagacttagtgacttagt

SEQ ID NO: 8589720 - DNA, 22 bp, Homo sapiens
agctaagaacttgagctctgga

SEQ ID NO: 8589721 - DNA, 22 bp, Homo sapiens
agcctggtgatatcagtggttt

SEQ ID NO: 8589722 - DNA, 22 bp, Homo sapiens
agctctttgactaatcttgctt

SEQ ID NO: 8589723 - DNA, 22 bp, Homo sapiens
agctctttatgggtaaatgcca

SEQ ID NO: 8589724 - DNA, 22 bp, Homo sapiens
agctcttacatttaggtctatg

SEQ ID NO: 8589725 - DNA, 18 bp, Homo sapiens
agctcctggtctcaggga

SEQ ID NO: 8589726 - DNA, 22 bp, Homo sapiens
agctccagaagcctgcaaggta

SEQ ID NO: 8589727 - DNA, 22 bp, Homo sapiens
agctccagagtctgaactattc

SEQ ID NO: 8589728 - DNA, 22 bp, Homo sapiens
agctccagagccacatccatca

SEQ ID NO: 8589729 - DNA, 22 bp, Homo sapiens
agctccagaggcagtgatgaag

SEQ ID NO: 8589730 - DNA, 22 bp, Homo sapiens
agctccagccgctgatgggttt

SEQ ID NO: 8589731 - DNA, 22 bp, Homo sapiens
agctccagattaattgtaggag

SEQ ID NO: 8589732 - DNA, 23 bp, Homo sapiens
agctccagaacatagcacaggaa

SEQ ID NO: 8589733 - DNA, 23 bp, Homo sapiens
agctccagaacatagcacaggaa

SEQ ID NO: 8589734 - DNA, 22 bp, Homo sapiens
agctccagaaaggtacacacag

SEQ ID NO: 8589735 - DNA, 22 bp, Homo sapiens
agctccagggaaagagtggatc

SEQ ID NO: 8589736 - DNA, 21 bp, Homo sapiens
agctccaggctcctggggttc

SEQ ID NO: 8589737 - DNA, 23 bp, Homo sapiens
agctccagctgacgtgggcagcc

SEQ ID NO: 8589738 - DNA, 23 bp, Homo sapiens
agctccagctgacgtgggcagcc

SEQ ID NO: 8589739 - DNA, 22 bp, Homo sapiens
agctccagcggatggtcttata

SEQ ID NO: 8589740 - DNA, 22 bp, Homo sapiens
agctccaggcagcattaataaa

SEQ ID NO: 8589741 - DNA, 22 bp, Homo sapiens
agctccaggatctgaaagttcg

SEQ ID NO: 8589742 - DNA, 22 bp, Homo sapiens
agctccaggataagacaggtgc

SEQ ID NO: 8589743 - DNA, 22 bp, Homo sapiens
agctccaggataagacaggtgc

SEQ ID NO: 8589744 - DNA, 22 bp, Homo sapiens
agcccaggttgaggctgcagtg

SEQ ID NO: 8589745 - DNA, 22 bp, Homo sapiens
agccagtgcaacagcagtgaag

SEQ ID NO: 8589746 - DNA, 22 bp, Homo sapiens
agccagtgcagctggaaattca

SEQ ID NO: 8589747 - DNA, 22 bp, Homo sapiens
agccagtgccagtcatgcctgc

SEQ ID NO: 8589748 - DNA, 22 bp, Homo sapiens
agccagtgtcgtgtgacatgag

SEQ ID NO: 8589749 - DNA, 22 bp, Homo sapiens
agccagtggtgtaatgccgtct

SEQ ID NO: 8589750 - DNA, 22 bp, Homo sapiens
agccagtggaattcccaggggt

SEQ ID NO: 8589751 - DNA, 22 bp, Homo sapiens
agccagtgggattagagcctct

SEQ ID NO: 8589752 - DNA, 22 bp, Homo sapiens
agccagtgttaagtgactggtt

SEQ ID NO: 8589753 - DNA, 22 bp, Homo sapiens
cagatggcagggcagctctgca

SEQ ID NO: 8589754 - DNA, 22 bp, Homo sapiens
cagatggctgccttcttgctgt

SEQ ID NO: 8589755 - DNA, 17 bp, Homo sapiens
agcccccactcccaagt

SEQ ID NO: 8589756 - DNA, 22 bp, Homo sapiens
cagagaactccagtggctggcg

SEQ ID NO: 8589757 - DNA, 22 bp, Homo sapiens
agccagctaagggaagcatgat

SEQ ID NO: 8589758 - DNA, 22 bp, Homo sapiens
cactttatattctaagacggcc

SEQ ID NO: 8589759 - DNA, 22 bp, Homo sapiens
cactttatattctaagacggcc

SEQ ID NO: 8589760 - DNA, 22 bp, Homo sapiens
cactttatgggaagcaaaaatt

SEQ ID NO: 8589761 - DNA, 22 bp, Homo sapiens
cactttatgggaagcaaaaatt

SEQ ID NO: 8589762 - DNA, 22 bp, Homo sapiens
cactttataaaattggtgtgag

SEQ ID NO: 8589763 - DNA, 22 bp, Homo sapiens
cactttatatgcattacctcat

SEQ ID NO: 8589764 - DNA, 22 bp, Homo sapiens
cactttattataaatttgagag

SEQ ID NO: 8589765 - DNA, 19 bp, Homo sapiens
cactttatttctgttttgt

SEQ ID NO: 8589766 - DNA, 22 bp, Homo sapiens
aagccacttggggaaagatgga

SEQ ID NO: 8589767 - DNA, 22 bp, Homo sapiens
aagccagagtttttgagaactt

SEQ ID NO: 8589768 - DNA, 22 bp, Homo sapiens
aagccagatagaagaactcatt

SEQ ID NO: 8589769 - DNA, 22 bp, Homo sapiens
aagcagatgcgttggagcagtt

SEQ ID NO: 8589770 - DNA, 22 bp, Homo sapiens
aagcacagctggaacagcagga

SEQ ID NO: 8589771 - DNA, 22 bp, Homo sapiens
aagcacagctggaacagcagga

SEQ ID NO: 8589772 - DNA, 22 bp, Homo sapiens
aagacagagactctgcaacagg

SEQ ID NO: 8589773 - DNA, 22 bp, Homo sapiens
aagagccagtgggaaagtcttg

SEQ ID NO: 8589774 - DNA, 22 bp, Homo sapiens
aagagcatgttaattctaggac

SEQ ID NO: 8589775 - DNA, 22 bp, Homo sapiens
aagagccatacaagtaaaagca

SEQ ID NO: 8589776 - DNA, 22 bp, Homo sapiens
aagagccagtgggaaagtcttg

SEQ ID NO: 8589777 - DNA, 22 bp, Homo sapiens
aagaaagtgctttgtaaattat

SEQ ID NO: 8589778 - DNA, 22 bp, Homo sapiens
aacagtgagaaggtggacagga

SEQ ID NO: 8589779 - DNA, 22 bp, Homo sapiens
aacagtcacattgttcaacttt

SEQ ID NO: 8589780 - DNA, 22 bp, Homo sapiens
aacaggaaaacagcacaatagc

SEQ ID NO: 8589781 - DNA, 22 bp, Homo sapiens
aactgagacacgaactatgatt

SEQ ID NO: 8589782 - DNA, 22 bp, Homo sapiens
aactatactctgtaaatgtgct

SEQ ID NO: 8589783 - DNA, 22 bp, Homo sapiens
aaagcacattacaagctcagtc

SEQ ID NO: 8589784 - DNA, 22 bp, Homo sapiens
aaagcacatagtagaaggattt

SEQ ID NO: 8589785 - DNA, 22 bp, Homo sapiens
aaagcacagggtgctagagagt

SEQ ID NO: 8589786 - DNA, 22 bp, Homo sapiens
aaaattcattcctcagactgcc

SEQ ID NO: 8589787 - DNA, 22 bp, Homo sapiens
aaaagtgtccagattatgaaga

SEQ ID NO: 8589788 - DNA, 22 bp, Homo sapiens
aaaagtgtccagattatgaaga

SEQ ID NO: 8589789 - DNA, 22 bp, Homo sapiens
aaaaactgtaattacttttgca

SEQ ID NO: 8589790 - DNA, 22 bp, Homo sapiens
aaaaatgaattcttcagtggca

SEQ ID NO: 8589791 - DNA, 22 bp, Homo sapiens
aaaaatgtcattatggaactga

SEQ ID NO: 8589792 - DNA, 22 bp, Homo sapiens
aaaagtattttggatctcagat

SEQ ID NO: 8589793 - DNA, 23 bp, Homo sapiens
aaacttgctatggctgaaatcat

SEQ ID NO: 8589794 - DNA, 22 bp, Homo sapiens
aaacttgaaaggtactgttggt

SEQ ID NO: 8589795 - DNA, 22 bp, Homo sapiens
aaacttgatctgtgaccttgct

SEQ ID NO: 8589796 - DNA, 22 bp, Homo sapiens
aaagatcattctctggtccaga

SEQ ID NO: 8589797 - DNA, 22 bp, Homo sapiens
aaagagctttccacactagtca

SEQ ID NO: 8589798 - DNA, 22 bp, Homo sapiens
aaagatgtcatacacattaaga

SEQ ID NO: 8589799 - DNA, 22 bp, Homo sapiens
aaagcaatgcccgttcattatc

SEQ ID NO: 8589800 - DNA, 22 bp, Homo sapiens
aaacactgtacaatctgcaggg

SEQ ID NO: 8589801 - DNA, 22 bp, Homo sapiens
aaatatgttttccagttgtcat

SEQ ID NO: 8589802 - DNA, 22 bp, Homo sapiens
aaatcatgttggcacaataaaa

SEQ ID NO: 8589803 - DNA, 22 bp, Homo sapiens
aaatatgtgatcagtgaataaa

SEQ ID NO: 8589804 - DNA, 23 bp, Homo sapiens
aaatatgtctgagggcaaagaat

SEQ ID NO: 8589805 - DNA, 22 bp, Homo sapiens
aaatatgtatggagttcatgaa

SEQ ID NO: 8589806 - DNA, 22 bp, Homo sapiens
aataaacttccactgtgttttt

SEQ ID NO: 8589807 - DNA, 22 bp, Homo sapiens
aagttctatatctgcctcacca

SEQ ID NO: 8589808 - DNA, 20 bp, Homo sapiens
aagttacattgtattgtacc

SEQ ID NO: 8589809 - DNA, 20 bp, Homo sapiens
aactcctagcctcaagtgat

SEQ ID NO: 8589810 - DNA, 22 bp, Homo sapiens
aactcccactcagcttcttaat

SEQ ID NO: 8589811 - DNA, 22 bp, Homo sapiens
aatcacatgcagggcctccacc

SEQ ID NO: 8589812 - DNA, 22 bp, Homo sapiens
aacaataattgcggttctctat

SEQ ID NO: 8589813 - DNA, 22 bp, Homo sapiens
aaggccagactctggaatgaca

SEQ ID NO: 8589814 - DNA, 22 bp, Homo sapiens
aaggccagacaggaccacatct

SEQ ID NO: 8589815 - DNA, 23 bp, Homo sapiens
aaggccagaatttcaatggtgcc

SEQ ID NO: 8589816 - DNA, 22 bp, Homo sapiens
aagtacaatctttctgtaaagg

SEQ ID NO: 8589817 - DNA, 22 bp, Homo sapiens
aagggagccaagaaagcagggc

SEQ ID NO: 8589818 - DNA, 22 bp, Homo sapiens
aaggggagatgtcatgggccct

SEQ ID NO: 8589819 - DNA, 22 bp, Homo sapiens
aagctttgtccaaggccatgca

SEQ ID NO: 8589820 - DNA, 22 bp, Homo sapiens
aagctttgataattggattact

SEQ ID NO: 8589821 - DNA, 22 bp, Homo sapiens
aagctttgcaccggtggctgga

SEQ ID NO: 8589822 - DNA, 22 bp, Homo sapiens
aagctgggacttagcgcagata

SEQ ID NO: 8589823 - DNA, 22 bp, Homo sapiens
aagctgggagggagcccagagt

SEQ ID NO: 8589824 - DNA, 22 bp, Homo sapiens
aagctggggactcagaccccat

SEQ ID NO: 8589825 - DNA, 20 bp, Homo sapiens
aagctgggtaggagaggagc

SEQ ID NO: 8589826 - DNA, 22 bp, Homo sapiens
aagctggcaattatcaaaactg

SEQ ID NO: 8589827 - DNA, 22 bp, Homo sapiens
aagctggctaaataaaaggtcc

SEQ ID NO: 8589828 - DNA, 23 bp, Homo sapiens
aagctggctgggagcagaaggga

SEQ ID NO: 8589829 - DNA, 18 bp, Homo sapiens
aagctgggaaggagacag

SEQ ID NO: 8589830 - DNA, 22 bp, Homo sapiens
aagccatggtagaaaactcagt

SEQ ID NO: 8589831 - DNA, 22 bp, Homo sapiens
aaggagaaggcatcattcaagt

SEQ ID NO: 8589832 - DNA, 22 bp, Homo sapiens
aaggactgtctaaggcctccaa

SEQ ID NO: 8589833 - DNA, 22 bp, Homo sapiens
aagagtcgtttcaggacagagg

SEQ ID NO: 8589834 - DNA, 22 bp, Homo sapiens
acacctggtctttgcatgagca

SEQ ID NO: 8589835 - DNA, 22 bp, Homo sapiens
acacacagagtttatacaggca

SEQ ID NO: 8589836 - DNA, 20 bp, Homo sapiens
acacacagagacatgcgcat

SEQ ID NO: 8589837 - DNA, 20 bp, Homo sapiens
acacacagagacatgcgcat

SEQ ID NO: 8589838 - DNA, 22 bp, Homo sapiens
acacacaggtaaaggagcctgg

SEQ ID NO: 8589839 - DNA, 22 bp, Homo sapiens
acacacagcgcctaccatgtgc

SEQ ID NO: 8589840 - DNA, 22 bp, Homo sapiens
aagaggtgggttggacagatac

SEQ ID NO: 8589841 - DNA, 22 bp, Homo sapiens
aagaggtggaacagcaattcgt

SEQ ID NO: 8589842 - DNA, 22 bp, Homo sapiens
aagaggtgagaagctacactta

SEQ ID NO: 8589843 - DNA, 20 bp, Homo sapiens
aagaggtgataacaggtgag

SEQ ID NO: 8589844 - DNA, 22 bp, Homo sapiens
aagatataataactgttgtcat

SEQ ID NO: 8589845 - DNA, 22 bp, Homo sapiens
aagatatagataaaactatgca

SEQ ID NO: 8589846 - DNA, 22 bp, Homo sapiens
aagatatagataaaactatgca

SEQ ID NO: 8589847 - DNA, 22 bp, Homo sapiens
acagaagaccaagaaagcttcc

SEQ ID NO: 8589848 - DNA, 22 bp, Homo sapiens
aagattttcagctaatggtgca

SEQ ID NO: 8589849 - DNA, 22 bp, Homo sapiens
acagaagcaaaagcaggatctt

SEQ ID NO: 8589850 - DNA, 22 bp, Homo sapiens
aagcacagttcttagagttaca

SEQ ID NO: 8589851 - DNA, 22 bp, Homo sapiens
aagcacatctcctgtgcagaac

SEQ ID NO: 8589852 - DNA, 22 bp, Homo sapiens
acagagtcattcactgatgaag

SEQ ID NO: 8589853 - DNA, 20 bp, Homo sapiens
aattagatgtttaatcaata

SEQ ID NO: 8589854 - DNA, 20 bp, Homo sapiens
aactcctagcctcaagtgat

SEQ ID NO: 8589855 - DNA, 22 bp, Homo sapiens
aatgtattctgggaaaatgtta

SEQ ID NO: 8589856 - DNA, 22 bp, Homo sapiens
aatgtcttggatacagaggttg

SEQ ID NO: 8589857 - DNA, 22 bp, Homo sapiens
aactttattgttaggggctaaa

SEQ ID NO: 8589858 - DNA, 22 bp, Homo sapiens
aactttatcggaacaggtactc

SEQ ID NO: 8589859 - DNA, 22 bp, Homo sapiens
aatgttacgatcaacaacacat

SEQ ID NO: 8589860 - DNA, 22 bp, Homo sapiens
aatgttatgtggttcaacttaa

SEQ ID NO: 8589861 - DNA, 20 bp, Homo sapiens
agatgggttaaagctatggg

SEQ ID NO: 8589862 - DNA, 16 bp, Homo sapiens
agatgggtgggtcact

SEQ ID NO: 8589863 - DNA, 21 bp, Homo sapiens
agattataaagaaccttctta

SEQ ID NO: 8589864 - DNA, 22 bp, Homo sapiens
agattacagaagaataagtaga

SEQ ID NO: 8589865 - DNA, 21 bp, Homo sapiens
agattcaggacagcagtcact

SEQ ID NO: 8589866 - DNA, 22 bp, Homo sapiens
agatatgtccctgtctaatatt

SEQ ID NO: 8589867 - DNA, 22 bp, Homo sapiens
agatatgtttgtatatatttgt

SEQ ID NO: 8589868 - DNA, 22 bp, Homo sapiens
acaaaaagctccattactgtcc

SEQ ID NO: 8589869 - DNA, 22 bp, Homo sapiens
acaaaaaccgtggattcagcat

SEQ ID NO: 8589870 - DNA, 22 bp, Homo sapiens
agaggtggccatgggcgctgga

SEQ ID NO: 8589871 - DNA, 22 bp, Homo sapiens
agaggtgggagcctggtcacat

SEQ ID NO: 8589872 - DNA, 22 bp, Homo sapiens
agagtaaagtacttggaatacc

SEQ ID NO: 8589873 - DNA, 22 bp, Homo sapiens
agagtctgggcactgggaatgc

SEQ ID NO: 8589874 - DNA, 22 bp, Homo sapiens
agagtctggtgcatgataagca

SEQ ID NO: 8589875 - DNA, 22 bp, Homo sapiens
agagtctgatgtcaacagttct

SEQ ID NO: 8589876 - DNA, 22 bp, Homo sapiens
agagtctgcattgtaacaagat

SEQ ID NO: 8589877 - DNA, 22 bp, Homo sapiens
agagtctgtgctggggccagct

SEQ ID NO: 8589878 - DNA, 22 bp, Homo sapiens
agataatgttctgatccatttc

SEQ ID NO: 8589879 - DNA, 22 bp, Homo sapiens
agaggccaaagaatctacaaga

SEQ ID NO: 8589880 - DNA, 22 bp, Homo sapiens
agagcaggcataaagctttgaa

SEQ ID NO: 8589881 - DNA, 22 bp, Homo sapiens
agagcagctggggcagagacca

SEQ ID NO: 8589882 - DNA, 22 bp, Homo sapiens
agagcagctgtgacatggacag

SEQ ID NO: 8589883 - DNA, 18 bp, Homo sapiens
agagcagcggcatcacac

SEQ ID NO: 8589884 - DNA, 22 bp, Homo sapiens
agagcagcgtttgtggaacact

SEQ ID NO: 8589885 - DNA, 22 bp, Homo sapiens
agagcagctgcattcagcacct

SEQ ID NO: 8589886 - DNA, 22 bp, Homo sapiens
agagggcccatgttgggctgct

SEQ ID NO: 8589887 - DNA, 22 bp, Homo sapiens
agagggccataggtgcatagtt

SEQ ID NO: 8589888 - DNA, 22 bp, Homo sapiens
agagggcccatgttgggctgct

SEQ ID NO: 8589889 - DNA, 22 bp, Homo sapiens
aatttatttcctgccagtacac

SEQ ID NO: 8589890 - DNA, 22 bp, Homo sapiens
aatttattcccgtctctgggct

SEQ ID NO: 8589891 - DNA, 22 bp, Homo sapiens
aatttattatatcctaggggaa

SEQ ID NO: 8589892 - DNA, 23 bp, Homo sapiens
agagaaagggataacacgttgaa

SEQ ID NO: 8589893 - DNA, 23 bp, Homo sapiens
agactggggcataagaagatggc

SEQ ID NO: 8589894 - DNA, 18 bp, Homo sapiens
agactggcagggaaaggg

SEQ ID NO: 8589895 - DNA, 22 bp, Homo sapiens
agacactgatgttcagctcaat

SEQ ID NO: 8589896 - DNA, 21 bp, Homo sapiens
agacactggtttagcattcat

SEQ ID NO: 8589897 - DNA, 21 bp, Homo sapiens
agagaaagtcatggctgtggc

SEQ ID NO: 8589898 - DNA, 21 bp, Homo sapiens
agagaaagtcatggctgtggc

SEQ ID NO: 8589899 - DNA, 20 bp, Homo sapiens
agagagcacaggcaggaaag

SEQ ID NO: 8589900 - DNA, 22 bp, Homo sapiens
aatgtataaagtgttaataact

SEQ ID NO: 8589901 - DNA, 22 bp, Homo sapiens
agaatttagctccttggtcata

SEQ ID NO: 8589902 - DNA, 22 bp, Homo sapiens
agcagctcctgccatgagtgct

SEQ ID NO: 8589903 - DNA, 22 bp, Homo sapiens
agcagctgaccagtgagtcctg

SEQ ID NO: 8589904 - DNA, 22 bp, Homo sapiens
agcagctctgtttacctggagg

SEQ ID NO: 8589905 - DNA, 22 bp, Homo sapiens
agcaggcaggctgccagtgaat

SEQ ID NO: 8589906 - DNA, 21 bp, Homo sapiens
agcaggaggcagtcacagctc

SEQ ID NO: 8589907 - DNA, 22 bp, Homo sapiens
agcaggagggttttgtagagtc

SEQ ID NO: 8589908 - DNA, 22 bp, Homo sapiens
agcaggagctgtgggaagatgg

SEQ ID NO: 8589909 - DNA, 22 bp, Homo sapiens
agcaggaggagagcctggcggt

SEQ ID NO: 8589910 - DNA, 22 bp, Homo sapiens
agcaggagcccttatcaccagg

SEQ ID NO: 8589911 - DNA, 22 bp, Homo sapiens
agcaggtcttgctctcaacagg

SEQ ID NO: 8589912 - DNA, 21 bp, Homo sapiens
agcaggtgaacctccagtaca

SEQ ID NO: 8589913 - DNA, 22 bp, Homo sapiens
agcaggtgaattcctggatgtg

SEQ ID NO: 8589914 - DNA, 22 bp, Homo sapiens
agcagggctttggctggctttc

SEQ ID NO: 8589915 - DNA, 22 bp, Homo sapiens
agcagggctttgtctctgtgaa

SEQ ID NO: 8589916 - DNA, 22 bp, Homo sapiens
agcagggctttgcagacttggg

SEQ ID NO: 8589917 - DNA, 22 bp, Homo sapiens
agcaggtgacccaagcaggctg

SEQ ID NO: 8589918 - DNA, 22 bp, Homo sapiens
agcaggtgacagggctgtggtg

SEQ ID NO: 8589919 - DNA, 20 bp, Homo sapiens
agcaggtgacggggcctgct

SEQ ID NO: 8589920 - DNA, 22 bp, Homo sapiens
agcaggtgacccaagcaggctg

SEQ ID NO: 8589921 - DNA, 20 bp, Homo sapiens
agcaggtgacggggcctgct

SEQ ID NO: 8589922 - DNA, 20 bp, Homo sapiens
agcaggtgacggggcctgct

SEQ ID NO: 8589923 - DNA, 22 bp, Homo sapiens
agcaggtgagcacagccaggct

SEQ ID NO: 8589924 - DNA, 22 bp, Homo sapiens
agcagggctgtgtaggtaatga

SEQ ID NO: 8589925 - DNA, 22 bp, Homo sapiens
agcagggcttctgtgcctgtgc

SEQ ID NO: 8589926 - DNA, 22 bp, Homo sapiens
agcagggctgtgtaggtaatga

SEQ ID NO: 8589927 - DNA, 22 bp, Homo sapiens
agcagggcctctggcactggtc

SEQ ID NO: 8589928 - DNA, 22 bp, Homo sapiens
agcagggcttgccgcttgtcct

SEQ ID NO: 8589929 - DNA, 22 bp, Homo sapiens
agcagggcttctgtgcctgtgc

SEQ ID NO: 8589930 - DNA, 22 bp, Homo sapiens
agcagggctttgcagacttggg

SEQ ID NO: 8589931 - DNA, 22 bp, Homo sapiens
agcagggcttgccgcttgtcct

SEQ ID NO: 8589932 - DNA, 22 bp, Homo sapiens
agcagggctttgcagacttggg

SEQ ID NO: 8589933 - DNA, 22 bp, Homo sapiens
agcagggctttggctggctttc

SEQ ID NO: 8589934 - DNA, 23 bp, Homo sapiens
agcaggcatctgtggcacaaggc

SEQ ID NO: 8589935 - DNA, 19 bp, Homo sapiens
agcaggccacagggccagc

SEQ ID NO: 8589936 - DNA, 22 bp, Homo sapiens
agcaggcagtgtagagccttca

SEQ ID NO: 8589937 - DNA, 22 bp, Homo sapiens
agcaggcatagagtagcactca

SEQ ID NO: 8589938 - DNA, 19 bp, Homo sapiens
agcaggcaggtggcccagg

SEQ ID NO: 8589939 - DNA, 21 bp, Homo sapiens
agcaggcagtgggctggattt

SEQ ID NO: 8589940 - DNA, 22 bp, Homo sapiens
agcagaaacagccagtctggac

SEQ ID NO: 8589941 - DNA, 22 bp, Homo sapiens
acacacagaaggaagccccact

SEQ ID NO: 8589942 - DNA, 22 bp, Homo sapiens
agcagcagccgtagccttatta

SEQ ID NO: 8589943 - DNA, 22 bp, Homo sapiens
agcagcagcattgagcgcttgt

SEQ ID NO: 8589944 - DNA, 23 bp, Homo sapiens
agcagcagcaattaagtggatat

SEQ ID NO: 8589945 - DNA, 19 bp, Homo sapiens
agcagcagcaccagggatt

SEQ ID NO: 8589946 - DNA, 21 bp, Homo sapiens
agcagcagcagtggggcttct

SEQ ID NO: 8589947 - DNA, 22 bp, Homo sapiens
agcagcagattatggtctacat

SEQ ID NO: 8589948 - DNA, 22 bp, Homo sapiens
agcagcagattatggtctacat

SEQ ID NO: 8589949 - DNA, 22 bp, Homo sapiens
agccaggacagggcagctcgct

SEQ ID NO: 8589950 - DNA, 22 bp, Homo sapiens
agcatttaatcctacatagatc

SEQ ID NO: 8589951 - DNA, 22 bp, Homo sapiens
agcatttaagggtggatacagg

SEQ ID NO: 8589952 - DNA, 22 bp, Homo sapiens
agcatttaagcttctgcaaagc

SEQ ID NO: 8589953 - DNA, 22 bp, Homo sapiens
agccaggcgggtctttgctcct

SEQ ID NO: 8589954 - DNA, 22 bp, Homo sapiens
agccaggctaaatgagccatga

SEQ ID NO: 8589955 - DNA, 22 bp, Homo sapiens
agcccagctttcacccctctgg

SEQ ID NO: 8589956 - DNA, 22 bp, Homo sapiens
agcccaggtccagttcactgca

SEQ ID NO: 8589957 - DNA, 22 bp, Homo sapiens
acagacagtatggtggggctga

SEQ ID NO: 8589958 - DNA, 22 bp, Homo sapiens
acagacagtaaatagtgtggct

SEQ ID NO: 8589959 - DNA, 22 bp, Homo sapiens
acagacagtaaatagtgtggct

SEQ ID NO: 8589960 - DNA, 21 bp, Homo sapiens
acagacagtccagagaaaaga

SEQ ID NO: 8589961 - DNA, 21 bp, Homo sapiens
acagacagtccagagaaaaga

SEQ ID NO: 8589962 - DNA, 21 bp, Homo sapiens
acagacagggccagtgtcccc

SEQ ID NO: 8589963 - DNA, 22 bp, Homo sapiens
agcccaggtctggcccagcctg

SEQ ID NO: 8589964 - DNA, 22 bp, Homo sapiens
agcctgtggatccctgcactgg

SEQ ID NO: 8589965 - DNA, 22 bp, Homo sapiens
agcctgtgtgaagccctcagag

SEQ ID NO: 8589966 - DNA, 20 bp, Homo sapiens
agcctgtgtacttgcctgtg

SEQ ID NO: 8589967 - DNA, 22 bp, Homo sapiens
agcctgttctccctccagacac

SEQ ID NO: 8589968 - DNA, 22 bp, Homo sapiens
agcctgtgactctgtgaaacca

SEQ ID NO: 8589969 - DNA, 22 bp, Homo sapiens
agcctggctgggaagagcctct

SEQ ID NO: 8589970 - DNA, 22 bp, Homo sapiens
agcctggctaaattctcccatg

SEQ ID NO: 8589971 - DNA, 23 bp, Homo sapiens
agctccagggaacaggcagtagg

SEQ ID NO: 8589972 - DNA, 23 bp, Homo sapiens
agctccaggtgattgtaatgtgt

SEQ ID NO: 8589973 - DNA, 22 bp, Homo sapiens
agccctggggtgcagaaccatg

SEQ ID NO: 8589974 - DNA, 22 bp, Homo sapiens
agcctggccactcagggcctga

SEQ ID NO: 8589975 - DNA, 22 bp, Homo sapiens
agcctggccaggcctgcccagg

SEQ ID NO: 8589976 - DNA, 22 bp, Homo sapiens
acattagatgactctttctttc

SEQ ID NO: 8589977 - DNA, 22 bp, Homo sapiens
acattagataactcagaaagga

SEQ ID NO: 8589978 - DNA, 22 bp, Homo sapiens
acattagagaagcttggagatg

SEQ ID NO: 8589979 - DNA, 22 bp, Homo sapiens
acattagaacattaatattggg

SEQ ID NO: 8589980 - DNA, 22 bp, Homo sapiens
acattatagctttgagtttgga

SEQ ID NO: 8589981 - DNA, 22 bp, Homo sapiens
acattctattctgcaggacaag

SEQ ID NO: 8589982 - DNA, 22 bp, Homo sapiens
acatgtaaaagataaattaaca

SEQ ID NO: 8589983 - DNA, 22 bp, Homo sapiens
aaggccaggacaccaggggact

SEQ ID NO: 8589984 - DNA, 22 bp, Homo sapiens
aaggccagctggagggatgagg

SEQ ID NO: 8589985 - DNA, 22 bp, Homo sapiens
aaggccagcttgtagggctggt

SEQ ID NO: 8589986 - DNA, 22 bp, Homo sapiens
aaggccagcttgtagggctggt

SEQ ID NO: 8589987 - DNA, 22 bp, Homo sapiens
aaggccaggcctagcacggagg

SEQ ID NO: 8589988 - DNA, 22 bp, Homo sapiens
acatgtgttttcctacttatga

SEQ ID NO: 8589989 - DNA, 22 bp, Homo sapiens
acatgtgttaaaattctcacca

SEQ ID NO: 8589990 - DNA, 22 bp, Homo sapiens
aaggccaggcagggagctgtga

SEQ ID NO: 8589991 - DNA, 22 bp, Homo sapiens
aaggccaggacaccaggggact

SEQ ID NO: 8589992 - DNA, 22 bp, Homo sapiens
aaggccaggagacttggagtca

SEQ ID NO: 8589993 - DNA, 22 bp, Homo sapiens
aaggccaggagacttggagtca

SEQ ID NO: 8589994 - DNA, 22 bp, Homo sapiens
acatacttaacattaaagtcat

SEQ ID NO: 8589995 - DNA, 22 bp, Homo sapiens
acatacttagagtaaacaagta

SEQ ID NO: 8589996 - DNA, 22 bp, Homo sapiens
acatacttctttacattccata

SEQ ID NO: 8589997 - DNA, 22 bp, Homo sapiens
acattctgtgagtcatgtttta

SEQ ID NO: 8589998 - DNA, 22 bp, Homo sapiens
aagggcagcctgactcacggtc

SEQ ID NO: 8589999 - DNA, 22 bp, Homo sapiens
accactgagtgtccttcagggt

SEQ ID NO: 8590000 - DNA, 22 bp, Homo sapiens
aagggcagctgacagatgctta

SEQ ID NO: 8590001 - DNA, 22 bp, Homo sapiens
aagggcagcctgactcacggtc

SEQ ID NO: 8590002 - DNA, 22 bp, Homo sapiens
aagggcagctattatcgtcatc

SEQ ID NO: 8590003 - DNA, 22 bp, Homo sapiens
accagctgagttctcggatggt

SEQ ID NO: 8590004 - DNA, 22 bp, Homo sapiens
accagctgagtaggggagggcc

SEQ ID NO: 8590005 - DNA, 22 bp, Homo sapiens
accagcagagttgaggaggaca

SEQ ID NO: 8590006 - DNA, 22 bp, Homo sapiens
aagggcagctgacagatgctta

SEQ ID NO: 8590007 - DNA, 22 bp, Homo sapiens
aagggcagcttaaattggtagc

SEQ ID NO: 8590008 - DNA, 22 bp, Homo sapiens
aagggcagcttaaattggtagc

SEQ ID NO: 8590009 - DNA, 22 bp, Homo sapiens
accaggagttttgaccaggggc

SEQ ID NO: 8590010 - DNA, 22 bp, Homo sapiens
accagctggtcagttgaagatt

SEQ ID NO: 8590011 - DNA, 22 bp, Homo sapiens
accagctggtcacctgggcact

SEQ ID NO: 8590012 - DNA, 22 bp, Homo sapiens
aaggtgtcactgggacaggaaa

SEQ ID NO: 8590013 - DNA, 22 bp, Homo sapiens
acagatttgatctgagaacaaa

SEQ ID NO: 8590014 - DNA, 22 bp, Homo sapiens
acagatttggaggcctcacccc

SEQ ID NO: 8590015 - DNA, 22 bp, Homo sapiens
acagatttgactggtacctggc

SEQ ID NO: 8590016 - DNA, 22 bp, Homo sapiens
acagatttattgaagctgctgc

SEQ ID NO: 8590017 - DNA, 22 bp, Homo sapiens
acagatttggcccagccaatgc

SEQ ID NO: 8590018 - DNA, 22 bp, Homo sapiens
acagatttgttcttttgggcta

SEQ ID NO: 8590019 - DNA, 22 bp, Homo sapiens
acagattttaaatgacactccc

SEQ ID NO: 8590020 - DNA, 22 bp, Homo sapiens
acagattttaaatttgtagttg

SEQ ID NO: 8590021 - DNA, 22 bp, Homo sapiens
acagattttattattcaggtat

SEQ ID NO: 8590022 - DNA, 21 bp, Homo sapiens
acagattttatatctctgctg

SEQ ID NO: 8590023 - DNA, 22 bp, Homo sapiens
acagattttggtatttgcaatg

SEQ ID NO: 8590024 - DNA, 22 bp, Homo sapiens
acagatttttggtaaataattt

SEQ ID NO: 8590025 - DNA, 22 bp, Homo sapiens
acagatttttcagctcctgtgt

SEQ ID NO: 8590026 - DNA, 22 bp, Homo sapiens
acagctggagtgttggtgaggt

SEQ ID NO: 8590027 - DNA, 22 bp, Homo sapiens
acagctggcaggggggcatgaa

SEQ ID NO: 8590028 - DNA, 22 bp, Homo sapiens
acaggaaattggcatatcagtt

SEQ ID NO: 8590029 - DNA, 21 bp, Homo sapiens
acaggagaccgcctggcagtc

SEQ ID NO: 8590030 - DNA, 21 bp, Homo sapiens
acaggagaccgcctggcagtc

SEQ ID NO: 8590031 - DNA, 22 bp, Homo sapiens
acagcttttctgatagatcctg

SEQ ID NO: 8590032 - DNA, 22 bp, Homo sapiens
acagcttttatgggaccagcca

SEQ ID NO: 8590033 - DNA, 22 bp, Homo sapiens
acagctttgtgttaatgggaag

SEQ ID NO: 8590034 - DNA, 22 bp, Homo sapiens
acagctttatctcagggatcag

SEQ ID NO: 8590035 - DNA, 22 bp, Homo sapiens
acagctttagtgtgggtggtgc

SEQ ID NO: 8590036 - DNA, 22 bp, Homo sapiens
acaggcagagaactcagccaga

SEQ ID NO: 8590037 - DNA, 22 bp, Homo sapiens
acaggcagagaactcagccaga

SEQ ID NO: 8590038 - DNA, 22 bp, Homo sapiens
acaggaggagctgtttcaggga

SEQ ID NO: 8590039 - DNA, 22 bp, Homo sapiens
acaggaggagcagctgtgtgcc

SEQ ID NO: 8590040 - DNA, 22 bp, Homo sapiens
acaggagctctagggacagcac

SEQ ID NO: 8590041 - DNA, 22 bp, Homo sapiens
acaggagccaaacacatgccag

SEQ ID NO: 8590042 - DNA, 20 bp, Homo sapiens
acaggagatctgaggaaagg

SEQ ID NO: 8590043 - DNA, 22 bp, Homo sapiens
acaggccagaggtggggcagcc

SEQ ID NO: 8590044 - DNA, 22 bp, Homo sapiens
acaggccagaggtggggcagcc

SEQ ID NO: 8590045 - DNA, 22 bp, Homo sapiens
acaggccagcctggggtaaggt

SEQ ID NO: 8590046 - DNA, 22 bp, Homo sapiens
acaggcagagagtggcggactc

SEQ ID NO: 8590047 - DNA, 22 bp, Homo sapiens
acaggtagaaattcatctatat

SEQ ID NO: 8590048 - DNA, 22 bp, Homo sapiens
acaggctgacttcctgccatgt

SEQ ID NO: 8590049 - DNA, 22 bp, Homo sapiens
acaggctgccacttgcatccaa

SEQ ID NO: 8590050 - DNA, 22 bp, Homo sapiens
acaggtgtctgcaagttactgg

SEQ ID NO: 8590051 - DNA, 22 bp, Homo sapiens
acaggtgtccaacatttacctt

SEQ ID NO: 8590052 - DNA, 22 bp, Homo sapiens
acaggtgtcctcacagggggtg

SEQ ID NO: 8590053 - DNA, 22 bp, Homo sapiens
acaggtgtctaaggcagacagc

SEQ ID NO: 8590054 - DNA, 22 bp, Homo sapiens
acaggtgtgagaacatgccttg

SEQ ID NO: 8590055 - DNA, 22 bp, Homo sapiens
acaggtgtgcggaaagctgtga

SEQ ID NO: 8590056 - DNA, 22 bp, Homo sapiens
acaggtgtggggctgtggtact

SEQ ID NO: 8590057 - DNA, 22 bp, Homo sapiens
acaggtgtgggctgggctctga

SEQ ID NO: 8590058 - DNA, 22 bp, Homo sapiens
acaggtgtagcaggagcatcaa

SEQ ID NO: 8590059 - DNA, 22 bp, Homo sapiens
acaggtgtaggtacatttgcat

SEQ ID NO: 8590060 - DNA, 22 bp, Homo sapiens
acaggtgtatgaatatgttcca

SEQ ID NO: 8590061 - DNA, 22 bp, Homo sapiens
acaggtgtagaaaacagattat

SEQ ID NO: 8590062 - DNA, 19 bp, Homo sapiens
acagtgcatgggacctggt

SEQ ID NO: 8590063 - DNA, 20 bp, Homo sapiens
acagtgcatggggggacagc

SEQ ID NO: 8590064 - DNA, 20 bp, Homo sapiens
acagtgggtggggagcactg

SEQ ID NO: 8590065 - DNA, 22 bp, Homo sapiens
actgactcttgttaacttcagc

SEQ ID NO: 8590066 - DNA, 22 bp, Homo sapiens
actcatgtcctaggagtaaagc

SEQ ID NO: 8590067 - DNA, 22 bp, Homo sapiens
aagtgggtaactggcctttgtt

SEQ ID NO: 8590068 - DNA, 22 bp, Homo sapiens
aagtgggtacatgatgcacttt

SEQ ID NO: 8590069 - DNA, 18 bp, Homo sapiens
aagtaacagaagagcaca

SEQ ID NO: 8590070 - DNA, 22 bp, Homo sapiens
acctgggaaaaggagtggccat

SEQ ID NO: 8590071 - DNA, 22 bp, Homo sapiens
acctgggaaagccgtggaaagg

SEQ ID NO: 8590072 - DNA, 22 bp, Homo sapiens
acctgggaacgctttgtggagg

SEQ ID NO: 8590073 - DNA, 22 bp, Homo sapiens
acctgggaggcagaggttgcag

SEQ ID NO: 8590074 - DNA, 22 bp, Homo sapiens
acctgggaggcggaggttgcag

SEQ ID NO: 8590075 - DNA, 22 bp, Homo sapiens
acctgggagtatgcagtggtga

SEQ ID NO: 8590076 - DNA, 22 bp, Homo sapiens
acctgggagtcacacctgagaa

SEQ ID NO: 8590077 - DNA, 22 bp, Homo sapiens
acctgggcattttggatgatta

SEQ ID NO: 8590078 - DNA, 20 bp, Homo sapiens
acctggggttgcctgtgctc

SEQ ID NO: 8590079 - DNA, 22 bp, Homo sapiens
aagtgatttgtacaaaatgtcg

SEQ ID NO: 8590080 - DNA, 22 bp, Homo sapiens
aatctttaaggactcagtctct

SEQ ID NO: 8590081 - DNA, 22 bp, Homo sapiens
agaaacgcctgtgaaattatct

SEQ ID NO: 8590082 - DNA, 22 bp, Homo sapiens
agaaaccagggcttaccagtgc

SEQ ID NO: 8590083 - DNA, 22 bp, Homo sapiens
actgtggccaaagcctctggga

SEQ ID NO: 8590084 - DNA, 22 bp, Homo sapiens
actgtggctcatcaggctggtg

SEQ ID NO: 8590085 - DNA, 22 bp, Homo sapiens
actgtggcaaaagaacattgga

SEQ ID NO: 8590086 - DNA, 22 bp, Homo sapiens
acttatactaaagtattatttg

SEQ ID NO: 8590087 - DNA, 22 bp, Homo sapiens
tcaaacatgttagcagtctgtg

SEQ ID NO: 8590088 - DNA, 22 bp, Homo sapiens
tcaaacatgttagcagtctgtg

SEQ ID NO: 8590089 - DNA, 22 bp, Homo sapiens
tcaaacatccccaccagggact

SEQ ID NO: 8590090 - DNA, 22 bp, Homo sapiens
tcaaacactgtaacatggaaaa

SEQ ID NO: 8590091 - DNA, 23 bp, Homo sapiens
tcacacagctggtcaggtacaga

SEQ ID NO: 8590092 - DNA, 22 bp, Homo sapiens
tcacacagcttggagttatggt

SEQ ID NO: 8590093 - DNA, 22 bp, Homo sapiens
tcacacagctgacagagccttt

SEQ ID NO: 8590094 - DNA, 22 bp, Homo sapiens
tcacacagattggtagagctga

SEQ ID NO: 8590095 - DNA, 22 bp, Homo sapiens
tcacacagcagccccgggtgtt

SEQ ID NO: 8590096 - DNA, 22 bp, Homo sapiens
tcacacagctagtaagggccga

SEQ ID NO: 8590097 - DNA, 22 bp, Homo sapiens
tcacacagctcctttccttagt

SEQ ID NO: 8590098 - DNA, 22 bp, Homo sapiens
tcacacagggttctggtctcat

SEQ ID NO: 8590099 - DNA, 22 bp, Homo sapiens
tcacacagtgagaaagtgcgga

SEQ ID NO: 8590100 - DNA, 22 bp, Homo sapiens
tcacacaggtttgcaatgattt

SEQ ID NO: 8590101 - DNA, 22 bp, Homo sapiens
tcacagcaaaagtgtgcagagc

SEQ ID NO: 8590102 - DNA, 22 bp, Homo sapiens
tcacagagttaaaagtttcttt

SEQ ID NO: 8590103 - DNA, 20 bp, Homo sapiens
tcacagagtagccttgtctg

SEQ ID NO: 8590104 - DNA, 22 bp, Homo sapiens
tcacagagaggttaagcagttg

SEQ ID NO: 8590105 - DNA, 22 bp, Homo sapiens
tcacagcatttttagaaagatt

SEQ ID NO: 8590106 - DNA, 22 bp, Homo sapiens
tcacatctgcctccatagcacc

SEQ ID NO: 8590107 - DNA, 22 bp, Homo sapiens
tcacagcaccaggatctctcca

SEQ ID NO: 8590108 - DNA, 22 bp, Homo sapiens
tcacagcaaccctgaggcgagt

SEQ ID NO: 8590109 - DNA, 22 bp, Homo sapiens
tcacagcagaatttaggaggca

SEQ ID NO: 8590110 - DNA, 22 bp, Homo sapiens
tcacagcagaatttaggaggca

SEQ ID NO: 8590111 - DNA, 22 bp, Homo sapiens
tcacagcaccctgaggtgctgg

SEQ ID NO: 8590112 - DNA, 22 bp, Homo sapiens
tcacagcagggtaacaggaaga

SEQ ID NO: 8590113 - DNA, 22 bp, Homo sapiens
tcacagcagggtaacaggaaga

SEQ ID NO: 8590114 - DNA, 22 bp, Homo sapiens
tcacagcattcgcaatggacag

SEQ ID NO: 8590115 - DNA, 23 bp, Homo sapiens
tcagagaatggtatgcttttcct

SEQ ID NO: 8590116 - DNA, 22 bp, Homo sapiens
tcagagaatccgtaagtcacaa

SEQ ID NO: 8590117 - DNA, 22 bp, Homo sapiens
tcagagaatgtccttcttcatt

SEQ ID NO: 8590118 - DNA, 22 bp, Homo sapiens
tcagagaatgtgaatattaaac

SEQ ID NO: 8590119 - DNA, 22 bp, Homo sapiens
tcagagaattcgattaaatgca

SEQ ID NO: 8590120 - DNA, 22 bp, Homo sapiens
tcagagaattctcagatgactc

SEQ ID NO: 8590121 - DNA, 22 bp, Homo sapiens
tcagagacaccagagagctgtg

SEQ ID NO: 8590122 - DNA, 22 bp, Homo sapiens
tcagagaagtaaggtggggtgc

SEQ ID NO: 8590123 - DNA, 22 bp, Homo sapiens
tcagagaagtaggctaatggtg

SEQ ID NO: 8590124 - DNA, 23 bp, Homo sapiens
tcagagaagttgtaggctgggga

SEQ ID NO: 8590125 - DNA, 22 bp, Homo sapiens
tcagaagccaccttttgttggg

SEQ ID NO: 8590126 - DNA, 23 bp, Homo sapiens
tcagagagctgttgagagctgcc

SEQ ID NO: 8590127 - DNA, 22 bp, Homo sapiens
tcagagaggattttaataagtg

SEQ ID NO: 8590128 - DNA, 18 bp, Homo sapiens
tcagagagaatagtaatt

SEQ ID NO: 8590129 - DNA, 22 bp, Homo sapiens
tcagagagctggtgggcagagg

SEQ ID NO: 8590130 - DNA, 22 bp, Homo sapiens
tcacgcatggacggtcaacatc

SEQ ID NO: 8590131 - DNA, 21 bp, Homo sapiens
tcacctggcttctgacctggc

SEQ ID NO: 8590132 - DNA, 22 bp, Homo sapiens
tcacctgggagggctgtggtag

SEQ ID NO: 8590133 - DNA, 22 bp, Homo sapiens
tcagaacagtgcctggcactaa

SEQ ID NO: 8590134 - DNA, 22 bp, Homo sapiens
tcactggaaatgcacagctgta

SEQ ID NO: 8590135 - DNA, 22 bp, Homo sapiens
tcactggatcctagctgagcct

SEQ ID NO: 8590136 - DNA, 20 bp, Homo sapiens
tcactggccagagtagccct

SEQ ID NO: 8590137 - DNA, 22 bp, Homo sapiens
tcaggaaagagttagatgatta

SEQ ID NO: 8590138 - DNA, 22 bp, Homo sapiens
tcagctttctctcgccatcagg

SEQ ID NO: 8590139 - DNA, 22 bp, Homo sapiens
tcaggagctgcactgggcccac

SEQ ID NO: 8590140 - DNA, 22 bp, Homo sapiens
tcaggagcagggggaagctctg

SEQ ID NO: 8590141 - DNA, 22 bp, Homo sapiens
tcaggaggagctcataagtttg

SEQ ID NO: 8590142 - DNA, 22 bp, Homo sapiens
tcaggaggacagataaggatag

SEQ ID NO: 8590143 - DNA, 22 bp, Homo sapiens
tcaggaggatgtcggcaaattt

SEQ ID NO: 8590144 - DNA, 22 bp, Homo sapiens
tcaggaggcaagtaggtattga

SEQ ID NO: 8590145 - DNA, 22 bp, Homo sapiens
tcaggagggagtgtggatagag

SEQ ID NO: 8590146 - DNA, 22 bp, Homo sapiens
tcaggagggctaagactgtagc

SEQ ID NO: 8590147 - DNA, 22 bp, Homo sapiens
tcaggagggattgttgcctatt

SEQ ID NO: 8590148 - DNA, 22 bp, Homo sapiens
tcaggagggtctctattttcct

SEQ ID NO: 8590149 - DNA, 22 bp, Homo sapiens
tcaggagggtgacaggccctgg

SEQ ID NO: 8590150 - DNA, 22 bp, Homo sapiens
tcaggcagctccaggaatggta

SEQ ID NO: 8590151 - DNA, 19 bp, Homo sapiens
tcaggaggtcgacctggca

SEQ ID NO: 8590152 - DNA, 22 bp, Homo sapiens
tcaggaggtctgctgcggggtg

SEQ ID NO: 8590153 - DNA, 22 bp, Homo sapiens
tcaggaggtaaggtaaaacaga

SEQ ID NO: 8590154 - DNA, 22 bp, Homo sapiens
tcaggaggtaggacatactggt

SEQ ID NO: 8590155 - DNA, 22 bp, Homo sapiens
tcaggaggtccgcccgggaggg

SEQ ID NO: 8590156 - DNA, 22 bp, Homo sapiens
tcagaggtgagcttcttgctaa

SEQ ID NO: 8590157 - DNA, 22 bp, Homo sapiens
tcagaggtggcaggggtgtcca

SEQ ID NO: 8590158 - DNA, 22 bp, Homo sapiens
tcagctttctcaaagaagctgg

SEQ ID NO: 8590159 - DNA, 23 bp, Homo sapiens
tcagcctcttaggacttctcacc

SEQ ID NO: 8590160 - DNA, 22 bp, Homo sapiens
tcagcctgcgtcatggtgacac

SEQ ID NO: 8590161 - DNA, 22 bp, Homo sapiens
tcagcctctctgagtccagacc

SEQ ID NO: 8590162 - DNA, 22 bp, Homo sapiens
tcagcctcctaatttcctgtga

SEQ ID NO: 8590163 - DNA, 22 bp, Homo sapiens
tcagcctcattttctgctctgt

SEQ ID NO: 8590164 - DNA, 22 bp, Homo sapiens
tcagcctccgaaagtgctggga

SEQ ID NO: 8590165 - DNA, 20 bp, Homo sapiens
tcagccattccttacctttc

SEQ ID NO: 8590166 - DNA, 22 bp, Homo sapiens
tcagtggggtcgatgtgaggga

SEQ ID NO: 8590167 - DNA, 22 bp, Homo sapiens
tcagtgggagcaggagagtgac

SEQ ID NO: 8590168 - DNA, 22 bp, Homo sapiens
tcagtgggaggccattgaatgg

SEQ ID NO: 8590169 - DNA, 20 bp, Homo sapiens
tcagtgggaaagtgagagtg

SEQ ID NO: 8590170 - DNA, 22 bp, Homo sapiens
tcataaaacacaccaggtagtt

SEQ ID NO: 8590171 - DNA, 19 bp, Homo sapiens
tcagggggctgataggagg

SEQ ID NO: 8590172 - DNA, 22 bp, Homo sapiens
tcaggtaagtgtaatatataga

SEQ ID NO: 8590173 - DNA, 22 bp, Homo sapiens
tcaggtggaattaattaagaga

SEQ ID NO: 8590174 - DNA, 22 bp, Homo sapiens
tcaggtggagacctccttggcc

SEQ ID NO: 8590175 - DNA, 22 bp, Homo sapiens
tcagggcacgtttctgcaatgc

SEQ ID NO: 8590176 - DNA, 22 bp, Homo sapiens
tcagggcactgtcacctgatat

SEQ ID NO: 8590177 - DNA, 16 bp, Homo sapiens
tcagggcagaatggca

SEQ ID NO: 8590178 - DNA, 22 bp, Homo sapiens
tcagggcagcctaaggcacctc

SEQ ID NO: 8590179 - DNA, 22 bp, Homo sapiens
tcagggcagaatccaaagaatt

SEQ ID NO: 8590180 - DNA, 21 bp, Homo sapiens
tcagggcagctgctcttcaga

SEQ ID NO: 8590181 - DNA, 22 bp, Homo sapiens
tcaggggcccttccctcagcag

SEQ ID NO: 8590182 - DNA, 22 bp, Homo sapiens
tcaggggcttgaggtgcatgtc

SEQ ID NO: 8590183 - DNA, 22 bp, Homo sapiens
tcaggggcagctgtgctttgtg

SEQ ID NO: 8590184 - DNA, 22 bp, Homo sapiens
tcagggcaccaaaaaagatgcc

SEQ ID NO: 8590185 - DNA, 22 bp, Homo sapiens
tcagggcacaggcctgtgggtt

SEQ ID NO: 8590186 - DNA, 22 bp, Homo sapiens
tcagggcacattctgcagtggc

SEQ ID NO: 8590187 - DNA, 22 bp, Homo sapiens
tcagggcacaggcctgtgggtt

SEQ ID NO: 8590188 - DNA, 22 bp, Homo sapiens
tcagggcaatgtccctcagaag

SEQ ID NO: 8590189 - DNA, 22 bp, Homo sapiens
tcagggcaagtctcagaaggtt

SEQ ID NO: 8590190 - DNA, 22 bp, Homo sapiens
tcagggcaagattggttaataa

SEQ ID NO: 8590191 - DNA, 22 bp, Homo sapiens
tcagggcaaagggcagagtttg

SEQ ID NO: 8590192 - DNA, 22 bp, Homo sapiens
tcagggcaaaagggaaaccatt

SEQ ID NO: 8590193 - DNA, 22 bp, Homo sapiens
tcaggctgaccaggttttgctc

SEQ ID NO: 8590194 - DNA, 22 bp, Homo sapiens
tcaggctgaatcatcctagctt

SEQ ID NO: 8590195 - DNA, 22 bp, Homo sapiens
tcccttcatcagtgagcaagcc

SEQ ID NO: 8590196 - DNA, 22 bp, Homo sapiens
tccctgcacagccgagccatgc

SEQ ID NO: 8590197 - DNA, 22 bp, Homo sapiens
tccctgcagcccctgagccttc

SEQ ID NO: 8590198 - DNA, 22 bp, Homo sapiens
tcccaggattttaggctctcag

SEQ ID NO: 8590199 - DNA, 22 bp, Homo sapiens
tcccaggattttaggctctcag

SEQ ID NO: 8590200 - DNA, 22 bp, Homo sapiens
tcccaggatgtttatggctggt

SEQ ID NO: 8590201 - DNA, 22 bp, Homo sapiens
tcccaggatgtttatggctggt

SEQ ID NO: 8590202 - DNA, 22 bp, Homo sapiens
tcccaggatgttggcggcaggt

SEQ ID NO: 8590203 - DNA, 22 bp, Homo sapiens
tccgggcaactgaagggaggtt

SEQ ID NO: 8590204 - DNA, 22 bp, Homo sapiens
tccgaggccaaagctgtgaata

SEQ ID NO: 8590205 - DNA, 22 bp, Homo sapiens
tcctcagtctctcaaatgaggc

SEQ ID NO: 8590206 - DNA, 20 bp, Homo sapiens
tccaccaggaagggtaggga

SEQ ID NO: 8590207 - DNA, 22 bp, Homo sapiens
tccacagcacaaagccagtgtg

SEQ ID NO: 8590208 - DNA, 22 bp, Homo sapiens
tccacagcattattagaaggat

SEQ ID NO: 8590209 - DNA, 22 bp, Homo sapiens
tccacagaatgtaagatccaca

SEQ ID NO: 8590210 - DNA, 22 bp, Homo sapiens
tcatgtgtctgccagtgtttat

SEQ ID NO: 8590211 - DNA, 21 bp, Homo sapiens
tcatgtgtaacttttgaccac

SEQ ID NO: 8590212 - DNA, 22 bp, Homo sapiens
tcatgtgtcctagttcatataa

SEQ ID NO: 8590213 - DNA, 20 bp, Homo sapiens
tcatgtgtgtcctacagaga

SEQ ID NO: 8590214 - DNA, 22 bp, Homo sapiens
tcatgtgtctgctgcagctgtt

SEQ ID NO: 8590215 - DNA, 22 bp, Homo sapiens
tcatgtgtgtttcatgtatgga

SEQ ID NO: 8590216 - DNA, 22 bp, Homo sapiens
tcatgtgttaaactccaagata

SEQ ID NO: 8590217 - DNA, 22 bp, Homo sapiens
tcatgtgttgcactgaggacct

SEQ ID NO: 8590218 - DNA, 22 bp, Homo sapiens
tccagcccgactgggcctgccg

SEQ ID NO: 8590219 - DNA, 22 bp, Homo sapiens
tccagcctgaactttgtccaga

SEQ ID NO: 8590220 - DNA, 19 bp, Homo sapiens
tccagcctgctgtttctct

SEQ ID NO: 8590221 - DNA, 22 bp, Homo sapiens
tccagccttccttttcactctc

SEQ ID NO: 8590222 - DNA, 22 bp, Homo sapiens
tccagcctggttgcgggcatcc

SEQ ID NO: 8590223 - DNA, 22 bp, Homo sapiens
tccagccttctcaaggctggct

SEQ ID NO: 8590224 - DNA, 23 bp, Homo sapiens
tccagcctcttgctctcacatgc

SEQ ID NO: 8590225 - DNA, 22 bp, Homo sapiens
tccagccttgccacttttctgt

SEQ ID NO: 8590226 - DNA, 22 bp, Homo sapiens
tccagccttctcaaggctggct

SEQ ID NO: 8590227 - DNA, 21 bp, Homo sapiens
tccagcctttccctcacttcc

SEQ ID NO: 8590228 - DNA, 22 bp, Homo sapiens
tccaggaaatcagaagtggtaa

SEQ ID NO: 8590229 - DNA, 22 bp, Homo sapiens
tccaggaactgaagccaggtgt

SEQ ID NO: 8590230 - DNA, 20 bp, Homo sapiens
tccaggagaactgggagccg

SEQ ID NO: 8590231 - DNA, 23 bp, Homo sapiens
tccaggagaacccctgtctgtcc

SEQ ID NO: 8590232 - DNA, 22 bp, Homo sapiens
tccaggagctcatccacgtcaa

SEQ ID NO: 8590233 - DNA, 23 bp, Homo sapiens
tccaggagcatgctggctggcga

SEQ ID NO: 8590234 - DNA, 22 bp, Homo sapiens
tccaggaggaggaaggctgcca

SEQ ID NO: 8590235 - DNA, 22 bp, Homo sapiens
tccaggaggactgagggggctg

SEQ ID NO: 8590236 - DNA, 22 bp, Homo sapiens
tccaggagctcatccacgtcaa

SEQ ID NO: 8590237 - DNA, 22 bp, Homo sapiens
tccaggacagcggcaggcagat

SEQ ID NO: 8590238 - DNA, 22 bp, Homo sapiens
tccaggaatctgtgcctagccc

SEQ ID NO: 8590239 - DNA, 18 bp, Homo sapiens
tccaggactctgcgtggc

SEQ ID NO: 8590240 - DNA, 22 bp, Homo sapiens
tcccagcaagaaagggggtggc

SEQ ID NO: 8590241 - DNA, 22 bp, Homo sapiens
tcccagcctttcttttctgctg

SEQ ID NO: 8590242 - DNA, 22 bp, Homo sapiens
tcccagcagcatagctcagaat

SEQ ID NO: 8590243 - DNA, 22 bp, Homo sapiens
tcccagcagcatagctcagaat

SEQ ID NO: 8590244 - DNA, 22 bp, Homo sapiens
tcccagcagatgagctgaccta

SEQ ID NO: 8590245 - DNA, 19 bp, Homo sapiens
tcccaggaagcaaatgtca

SEQ ID NO: 8590246 - DNA, 22 bp, Homo sapiens
tcccaggaaggattcggcattt

SEQ ID NO: 8590247 - DNA, 22 bp, Homo sapiens
tcccaggaaggattcggcattt

SEQ ID NO: 8590248 - DNA, 22 bp, Homo sapiens
tcccaggatctgagggcagaga

SEQ ID NO: 8590249 - DNA, 22 bp, Homo sapiens
tcccaggaatccgtcctctaga

SEQ ID NO: 8590250 - DNA, 22 bp, Homo sapiens
tcccaggatgtgcgtgccgccg

SEQ ID NO: 8590251 - DNA, 22 bp, Homo sapiens
tcccaggatgaagacagtgttg

SEQ ID NO: 8590252 - DNA, 22 bp, Homo sapiens
tcccaggatgaagacagtgttg

SEQ ID NO: 8590253 - DNA, 22 bp, Homo sapiens
tcccaggatgttggcggcaggt

SEQ ID NO: 8590254 - DNA, 22 bp, Homo sapiens
tcccaggatgtgcgtgccgccg

SEQ ID NO: 8590255 - DNA, 17 bp, Homo sapiens
tcccaggaacagggaat

SEQ ID NO: 8590256 - DNA, 17 bp, Homo sapiens
tcccaggaacagggaat

SEQ ID NO: 8590257 - DNA, 19 bp, Homo sapiens
tcccaggaagcaaatgtca

SEQ ID NO: 8590258 - DNA, 22 bp, Homo sapiens
tcccaggaagatcccagggacc

SEQ ID NO: 8590259 - DNA, 22 bp, Homo sapiens
tcccaggaagatcccagggacc

SEQ ID NO: 8590260 - DNA, 19 bp, Homo sapiens
tcccaggaaccttttattt

SEQ ID NO: 8590261 - DNA, 19 bp, Homo sapiens
tcccaggaaccttttattt

SEQ ID NO: 8590262 - DNA, 22 bp, Homo sapiens
tcccaggaaaacactcgaggac

SEQ ID NO: 8590263 - DNA, 22 bp, Homo sapiens
tcccaggaaaacactcgaggac

SEQ ID NO: 8590264 - DNA, 22 bp, Homo sapiens
tcccagaatctccagtgctaca

SEQ ID NO: 8590265 - DNA, 22 bp, Homo sapiens
tcccagaatctttggaagagca

SEQ ID NO: 8590266 - DNA, 22 bp, Homo sapiens
tcccagaagtccagccatgggc

SEQ ID NO: 8590267 - DNA, 22 bp, Homo sapiens
tcccagaagtccagccatgggc

SEQ ID NO: 8590268 - DNA, 22 bp, Homo sapiens
tcccagaaccctgccaggtcct

SEQ ID NO: 8590269 - DNA, 22 bp, Homo sapiens
tcccagaagagatgccacttga

SEQ ID NO: 8590270 - DNA, 22 bp, Homo sapiens
tcccagaaaaaggaggctatga

SEQ ID NO: 8590271 - DNA, 22 bp, Homo sapiens
tcccacagtggtacagccctga

SEQ ID NO: 8590272 - DNA, 22 bp, Homo sapiens
tccagtggtttgaaaggggtgt

SEQ ID NO: 8590273 - DNA, 22 bp, Homo sapiens
tccagtggaacagatgttgcct

SEQ ID NO: 8590274 - DNA, 22 bp, Homo sapiens
tccagtggaaattgtgttcatt

SEQ ID NO: 8590275 - DNA, 22 bp, Homo sapiens
tccagtggcaggcggtgaggtc

SEQ ID NO: 8590276 - DNA, 22 bp, Homo sapiens
tccagtggcactggagactaga

SEQ ID NO: 8590277 - DNA, 15 bp, Homo sapiens
tccagtggaggcact

SEQ ID NO: 8590278 - DNA, 22 bp, Homo sapiens
tccagtggagtgtgggggtgaa

SEQ ID NO: 8590279 - DNA, 22 bp, Homo sapiens
tccagtggcaccttggccctca

SEQ ID NO: 8590280 - DNA, 22 bp, Homo sapiens
tccagtgggttgctgagggagg

SEQ ID NO: 8590281 - DNA, 21 bp, Homo sapiens
tccagtggggatctctgatat

SEQ ID NO: 8590282 - DNA, 22 bp, Homo sapiens
tccagtgggtctggcaagacca

SEQ ID NO: 8590283 - DNA, 20 bp, Homo sapiens
tccagtggcctgaatctgga

SEQ ID NO: 8590284 - DNA, 22 bp, Homo sapiens
tccagtggcaggcggtgaggtc

SEQ ID NO: 8590285 - DNA, 22 bp, Homo sapiens
tccagtggcttcctggaaaaaa

SEQ ID NO: 8590286 - DNA, 22 bp, Homo sapiens
tccagtggctttgctgctttaa

SEQ ID NO: 8590287 - DNA, 21 bp, Homo sapiens
tccagtggtgtctagaatgtg

SEQ ID NO: 8590288 - DNA, 22 bp, Homo sapiens
tccagtggtggtttgaagggca

SEQ ID NO: 8590289 - DNA, 22 bp, Homo sapiens
tccagtggtagtaaagaggtct

SEQ ID NO: 8590290 - DNA, 22 bp, Homo sapiens
tccagtggtggctcccggacct

SEQ ID NO: 8590291 - DNA, 22 bp, Homo sapiens
tccagtggtacatggagacact

SEQ ID NO: 8590292 - DNA, 20 bp, Homo sapiens
tccagggcaactagagtgtg

SEQ ID NO: 8590293 - DNA, 22 bp, Homo sapiens
tccagggcaccagcgtccccct

SEQ ID NO: 8590294 - DNA, 22 bp, Homo sapiens
tccagggcagccgcgggtgcgc

SEQ ID NO: 8590295 - DNA, 22 bp, Homo sapiens
tccaggaggcagggctgtgccc

SEQ ID NO: 8590296 - DNA, 22 bp, Homo sapiens
tccaggaggcagggctgtgccc

SEQ ID NO: 8590297 - DNA, 22 bp, Homo sapiens
tccaggaggaggaaggctgcca

SEQ ID NO: 8590298 - DNA, 22 bp, Homo sapiens
tccagggacctccctgagagct

SEQ ID NO: 8590299 - DNA, 22 bp, Homo sapiens
tccagggacagcgctggagcta

SEQ ID NO: 8590300 - DNA, 22 bp, Homo sapiens
tccagggagatggcagaggctg

SEQ ID NO: 8590301 - DNA, 22 bp, Homo sapiens
tccagggagagccgctgctcca

SEQ ID NO: 8590302 - DNA, 22 bp, Homo sapiens
tacaatatgtggccttttgtga

SEQ ID NO: 8590303 - DNA, 22 bp, Homo sapiens
taagtttaaatgtacatgaagc

SEQ ID NO: 8590304 - DNA, 22 bp, Homo sapiens
tacttattggttcagaagttta

SEQ ID NO: 8590305 - DNA, 22 bp, Homo sapiens
tacttccagcaatctgcatatt

SEQ ID NO: 8590306 - DNA, 22 bp, Homo sapiens
tacttccaggcggacaaagccc

SEQ ID NO: 8590307 - DNA, 22 bp, Homo sapiens
tacctgagcccagtgcagcata

SEQ ID NO: 8590308 - DNA, 20 bp, Homo sapiens
tacaggaatcaagactgcat

SEQ ID NO: 8590309 - DNA, 22 bp, Homo sapiens
tacaggaagcactcaagaaatg

SEQ ID NO: 8590310 - DNA, 22 bp, Homo sapiens
tacaggaactgggcaggacatt

SEQ ID NO: 8590311 - DNA, 22 bp, Homo sapiens
tacatacatattcatacaggtg

SEQ ID NO: 8590312 - DNA, 22 bp, Homo sapiens
tacatgtgataaattgattaaa

SEQ ID NO: 8590313 - DNA, 22 bp, Homo sapiens
tacattatcttgttatctttca

SEQ ID NO: 8590314 - DNA, 22 bp, Homo sapiens
taactgtagttataaagctatc

SEQ ID NO: 8590315 - DNA, 22 bp, Homo sapiens
taacacagtgtcctcagaaaca

SEQ ID NO: 8590316 - DNA, 17 bp, Homo sapiens
taacacaggctcagaga

SEQ ID NO: 8590317 - DNA, 22 bp, Homo sapiens
taacacatatttgcagtaagca

SEQ ID NO: 8590318 - DNA, 21 bp, Homo sapiens
taaagaagatgaatgtgatca

SEQ ID NO: 8590319 - DNA, 23 bp, Homo sapiens
gttttcaacacaataaatgtaac

SEQ ID NO: 8590320 - DNA, 22 bp, Homo sapiens
gttttattggaacacagccatg

SEQ ID NO: 8590321 - DNA, 22 bp, Homo sapiens
gttttatttccatgagagaccg

SEQ ID NO: 8590322 - DNA, 22 bp, Homo sapiens
gtttagcaataaaaacacatga

SEQ ID NO: 8590323 - DNA, 22 bp, Homo sapiens
gttagggagtcaggtggctctt

SEQ ID NO: 8590324 - DNA, 22 bp, Homo sapiens
gtgtgtcctgttttaaaatagt

SEQ ID NO: 8590325 - DNA, 22 bp, Homo sapiens
gtgtgtcctcataagatggagg

SEQ ID NO: 8590326 - DNA, 22 bp, Homo sapiens
gtgtgtcctcttaactattatg

SEQ ID NO: 8590327 - DNA, 22 bp, Homo sapiens
gtgtgtccttgggcctctgcag

SEQ ID NO: 8590328 - DNA, 22 bp, Homo sapiens
taggaagggctcagggctcggt

SEQ ID NO: 8590329 - DNA, 22 bp, Homo sapiens
taggaaggtccatgtcttatct

SEQ ID NO: 8590330 - DNA, 22 bp, Homo sapiens
taggaaggtgtttttaaggagc

SEQ ID NO: 8590331 - DNA, 22 bp, Homo sapiens
taggaaggcctgtcactacttg

SEQ ID NO: 8590332 - DNA, 22 bp, Homo sapiens
taggaagggaaaggcttcaact

SEQ ID NO: 8590333 - DNA, 22 bp, Homo sapiens
taggacagagttccctgatggc

SEQ ID NO: 8590334 - DNA, 22 bp, Homo sapiens
taggctaggctgaaggttttgg

SEQ ID NO: 8590335 - DNA, 22 bp, Homo sapiens
taggaaagcagtagagccagga

SEQ ID NO: 8590336 - DNA, 22 bp, Homo sapiens
taggaaagaaatgagtagtgat

SEQ ID NO: 8590337 - DNA, 22 bp, Homo sapiens
taggaagcatttaaagagatgg

SEQ ID NO: 8590338 - DNA, 22 bp, Homo sapiens
taggaagcattatcatcactga

SEQ ID NO: 8590339 - DNA, 22 bp, Homo sapiens
taggaagcactcatttaaagga

SEQ ID NO: 8590340 - DNA, 22 bp, Homo sapiens
taggaagcctaaattaagtggt

SEQ ID NO: 8590341 - DNA, 22 bp, Homo sapiens
taggaagcctgctgtgcacagc

SEQ ID NO: 8590342 - DNA, 22 bp, Homo sapiens
taggaagcgagcatctaactag

SEQ ID NO: 8590343 - DNA, 22 bp, Homo sapiens
taggaaggaggccatcttggcg

SEQ ID NO: 8590344 - DNA, 22 bp, Homo sapiens
taggaaggaagagcctcagatt

SEQ ID NO: 8590345 - DNA, 22 bp, Homo sapiens
taggaagcttccagaacttaag

SEQ ID NO: 8590346 - DNA, 22 bp, Homo sapiens
taggaagctgatggaactagag

SEQ ID NO: 8590347 - DNA, 20 bp, Homo sapiens
taggtgtctttgccagcttt

SEQ ID NO: 8590348 - DNA, 22 bp, Homo sapiens
tagtatatctttagtacatagt

SEQ ID NO: 8590349 - DNA, 22 bp, Homo sapiens
tagtatatctttagtacatagt

SEQ ID NO: 8590350 - DNA, 22 bp, Homo sapiens
tagtgggttaactagaagttaa

SEQ ID NO: 8590351 - DNA, 22 bp, Homo sapiens
tagtgggtttatacaatttaaa

SEQ ID NO: 8590352 - DNA, 22 bp, Homo sapiens
tagtgggtcttataattttagg

SEQ ID NO: 8590353 - DNA, 22 bp, Homo sapiens
tagtgggtggaggccagggatg

SEQ ID NO: 8590354 - DNA, 22 bp, Homo sapiens
tagtgggtgatttgatgaggaa

SEQ ID NO: 8590355 - DNA, 22 bp, Homo sapiens
tagtgggtagaggccagggacg

SEQ ID NO: 8590356 - DNA, 22 bp, Homo sapiens
tagtcaccagctacaggacagc

SEQ ID NO: 8590357 - DNA, 22 bp, Homo sapiens
tacttggtctgggcagggggtt

SEQ ID NO: 8590358 - DNA, 22 bp, Homo sapiens
tacttggtttagtttggaggga

SEQ ID NO: 8590359 - DNA, 22 bp, Homo sapiens
tactttctaagacatacaactt

SEQ ID NO: 8590360 - DNA, 22 bp, Homo sapiens
tagaatcagaagatttgactgt

SEQ ID NO: 8590361 - DNA, 22 bp, Homo sapiens
tagaataagttgatgatatatg

SEQ ID NO: 8590362 - DNA, 22 bp, Homo sapiens
tagcacaggtcttgttgccatt

SEQ ID NO: 8590363 - DNA, 22 bp, Homo sapiens
tagcaagaagggagatggggtt

SEQ ID NO: 8590364 - DNA, 22 bp, Homo sapiens
tagcaagaggaaacaaggggcc

SEQ ID NO: 8590365 - DNA, 22 bp, Homo sapiens
tagcaagaggtgaaggtttcat

SEQ ID NO: 8590366 - DNA, 22 bp, Homo sapiens
tagcaagaccaatatgtagata

SEQ ID NO: 8590367 - DNA, 23 bp, Homo sapiens
tagccagtcattccagcaaggcc

SEQ ID NO: 8590368 - DNA, 22 bp, Homo sapiens
tagccagttgcccagagtagaa

SEQ ID NO: 8590369 - DNA, 22 bp, Homo sapiens
tagccagtgggacggtgctgca

SEQ ID NO: 8590370 - DNA, 22 bp, Homo sapiens
tagccagtgccatgggactgat

SEQ ID NO: 8590371 - DNA, 22 bp, Homo sapiens
tagcagggttttgaagagggtt

SEQ ID NO: 8590372 - DNA, 22 bp, Homo sapiens
tattgagaaccctcaggaggca

SEQ ID NO: 8590373 - DNA, 22 bp, Homo sapiens
tattcatagtaaacaaaagtgg

SEQ ID NO: 8590374 - DNA, 22 bp, Homo sapiens
tattcacagttgatttacagtt

SEQ ID NO: 8590375 - DNA, 22 bp, Homo sapiens
tatgctccaaagacatgttgcc

SEQ ID NO: 8590376 - DNA, 22 bp, Homo sapiens
tatgcctggggtgctcaggcca

SEQ ID NO: 8590377 - DNA, 22 bp, Homo sapiens
tattgcagaagaaatgaatgaa

SEQ ID NO: 8590378 - DNA, 22 bp, Homo sapiens
tattggtaggactcagctgaga

SEQ ID NO: 8590379 - DNA, 22 bp, Homo sapiens
tattggtagatggagagagaca

SEQ ID NO: 8590380 - DNA, 22 bp, Homo sapiens
tattggtgatgacttgaggcca

SEQ ID NO: 8590381 - DNA, 22 bp, Homo sapiens
tattggtatctgagacagagtt

SEQ ID NO: 8590382 - DNA, 22 bp, Homo sapiens
tattggtcaagttgaggaccct

SEQ ID NO: 8590383 - DNA, 22 bp, Homo sapiens
tattggtcaatttcaccttgat

SEQ ID NO: 8590384 - DNA, 19 bp, Homo sapiens
tattggtatgtgtgaggca

SEQ ID NO: 8590385 - DNA, 22 bp, Homo sapiens
tattggtatggtaagaattgaa

SEQ ID NO: 8590386 - DNA, 22 bp, Homo sapiens
tattggtgggggcagagagaga

SEQ ID NO: 8590387 - DNA, 22 bp, Homo sapiens
tattggtgtacttatagcagag

SEQ ID NO: 8590388 - DNA, 22 bp, Homo sapiens
tatttgtatgtgtgtacatata

SEQ ID NO: 8590389 - DNA, 22 bp, Homo sapiens
tatagatagtcacttgttgcta

SEQ ID NO: 8590390 - DNA, 22 bp, Homo sapiens
tatatgatgccaaataacctgt

SEQ ID NO: 8590391 - DNA, 22 bp, Homo sapiens
tatattaaatgaccagttttaa

SEQ ID NO: 8590392 - DNA, 22 bp, Homo sapiens
tagttaaagagatccacattcc

SEQ ID NO: 8590393 - DNA, 22 bp, Homo sapiens
tatacttatgctaaaaaatgtt

SEQ ID NO: 8590394 - DNA, 22 bp, Homo sapiens
tatactttcctgcaactttgat

SEQ ID NO: 8590395 - DNA, 22 bp, Homo sapiens
tatagaagagacatgtgcatag

SEQ ID NO: 8590396 - DNA, 22 bp, Homo sapiens
tatattcaacaggctaatgtca

SEQ ID NO: 8590397 - DNA, 22 bp, Homo sapiens
tatcaaacttgttttttggtgt

SEQ ID NO: 8590398 - DNA, 22 bp, Homo sapiens
tatgcatacaatgagatattcc

SEQ ID NO: 8590399 - DNA, 22 bp, Homo sapiens
gcatttgtgtggcggaaggatt

SEQ ID NO: 8590400 - DNA, 22 bp, Homo sapiens
gcattttagaatattggagcaa

SEQ ID NO: 8590401 - DNA, 22 bp, Homo sapiens
gccaaggcctgcagcacctcat

SEQ ID NO: 8590402 - DNA, 18 bp, Homo sapiens
gccagagcatatctccag

SEQ ID NO: 8590403 - DNA, 22 bp, Homo sapiens
gccagagcatcgcaccctccat

SEQ ID NO: 8590404 - DNA, 21 bp, Homo sapiens
gccagagcagtacaatgaggt

SEQ ID NO: 8590405 - DNA, 22 bp, Homo sapiens
gccagagcagaatagagtggcc

SEQ ID NO: 8590406 - DNA, 22 bp, Homo sapiens
gccagagccggcttcacaggat

SEQ ID NO: 8590407 - DNA, 22 bp, Homo sapiens
gccagagcctgtggatttaacc

SEQ ID NO: 8590408 - DNA, 22 bp, Homo sapiens
gccagagccacttttgggtgat

SEQ ID NO: 8590409 - DNA, 22 bp, Homo sapiens
gccagaggcccaaggacagctg

SEQ ID NO: 8590410 - DNA, 22 bp, Homo sapiens
gccagcagggcggagccatcta

SEQ ID NO: 8590411 - DNA, 22 bp, Homo sapiens
gccagcaggttgtcaaggagct

SEQ ID NO: 8590412 - DNA, 22 bp, Homo sapiens
gccagcaggtggagagatcaag

SEQ ID NO: 8590413 - DNA, 23 bp, Homo sapiens
gccagagctgcctgcccttgctg

SEQ ID NO: 8590414 - DNA, 22 bp, Homo sapiens
gccagagcttcccccgagtgtg

SEQ ID NO: 8590415 - DNA, 22 bp, Homo sapiens
gccagagcttggtttttattta

SEQ ID NO: 8590416 - DNA, 22 bp, Homo sapiens
gccagagctgagtgaggttctt

SEQ ID NO: 8590417 - DNA, 22 bp, Homo sapiens
gccagagctgagacacgagtcc

SEQ ID NO: 8590418 - DNA, 23 bp, Homo sapiens
gccagaggaacgcagagctttct

SEQ ID NO: 8590419 - DNA, 22 bp, Homo sapiens
gccagcagtcctgctgtgtgcc

SEQ ID NO: 8590420 - DNA, 22 bp, Homo sapiens
gccagcagtccagtccttagtg

SEQ ID NO: 8590421 - DNA, 22 bp, Homo sapiens
gccagcagtatgtcctggcagt

SEQ ID NO: 8590422 - DNA, 22 bp, Homo sapiens
gccagcagtatgtcctggcagt

SEQ ID NO: 8590423 - DNA, 22 bp, Homo sapiens
gccagccataggccagcactgg

SEQ ID NO: 8590424 - DNA, 22 bp, Homo sapiens
gcatttctgtgcatacacatga

SEQ ID NO: 8590425 - DNA, 22 bp, Homo sapiens
gcatttcttcctggtgtgagcc

SEQ ID NO: 8590426 - DNA, 22 bp, Homo sapiens
gcatttgaaatcctctgtgacg

SEQ ID NO: 8590427 - DNA, 22 bp, Homo sapiens
gcatttgaaatgcaagaaagtg

SEQ ID NO: 8590428 - DNA, 22 bp, Homo sapiens
gcatccagtcttggctcctgga

SEQ ID NO: 8590429 - DNA, 21 bp, Homo sapiens
gcagtcactcggttggctacc

SEQ ID NO: 8590430 - DNA, 22 bp, Homo sapiens
gcagtcacagggagatggtgac

SEQ ID NO: 8590431 - DNA, 22 bp, Homo sapiens
gcagggctcagccgctcccacc

SEQ ID NO: 8590432 - DNA, 23 bp, Homo sapiens
gcccatgctgttgggcccgagca

SEQ ID NO: 8590433 - DNA, 22 bp, Homo sapiens
gccctctgtgtaacaatccaga

SEQ ID NO: 8590434 - DNA, 22 bp, Homo sapiens
gcccagtggtaaaagcaggcct

SEQ ID NO: 8590435 - DNA, 22 bp, Homo sapiens
gcctagcattgatcagcctgct

SEQ ID NO: 8590436 - DNA, 22 bp, Homo sapiens
gcctagcattgatcagcctgct

SEQ ID NO: 8590437 - DNA, 22 bp, Homo sapiens
gccctgaggggtggtgtctgta

SEQ ID NO: 8590438 - DNA, 22 bp, Homo sapiens
gccctgaggggtggtgtctgta

SEQ ID NO: 8590439 - DNA, 22 bp, Homo sapiens
gcctcagctgttgcaggggccc

SEQ ID NO: 8590440 - DNA, 22 bp, Homo sapiens
gccctgaggatttgcatttcct

SEQ ID NO: 8590441 - DNA, 22 bp, Homo sapiens
gccctgagaggcaatgactctt

SEQ ID NO: 8590442 - DNA, 22 bp, Homo sapiens
gccctgacactttgcagctgag

SEQ ID NO: 8590443 - DNA, 22 bp, Homo sapiens
gccctctgttattgcatcctta

SEQ ID NO: 8590444 - DNA, 22 bp, Homo sapiens
gccaggagactccattcatttg

SEQ ID NO: 8590445 - DNA, 22 bp, Homo sapiens
gccaggagaatgctagcagagg

SEQ ID NO: 8590446 - DNA, 22 bp, Homo sapiens
gccaggagagctccttcaggtt

SEQ ID NO: 8590447 - DNA, 22 bp, Homo sapiens
gccaggagccctgggcaagttc

SEQ ID NO: 8590448 - DNA, 22 bp, Homo sapiens
gccaggagccagcttcttagca

SEQ ID NO: 8590449 - DNA, 22 bp, Homo sapiens
gccaggaatggagaggtggcct

SEQ ID NO: 8590450 - DNA, 22 bp, Homo sapiens
gccaggtggctgagtgactgag

SEQ ID NO: 8590451 - DNA, 22 bp, Homo sapiens
gccaggtgggagacagacagca

SEQ ID NO: 8590452 - DNA, 22 bp, Homo sapiens
gccaggtggtctggctccagag

SEQ ID NO: 8590453 - DNA, 22 bp, Homo sapiens
gccaggtggtctggctccagag

SEQ ID NO: 8590454 - DNA, 22 bp, Homo sapiens
gccaggagttcagatgcatgtt

SEQ ID NO: 8590455 - DNA, 22 bp, Homo sapiens
gccaggcacagttctaggtgct

SEQ ID NO: 8590456 - DNA, 23 bp, Homo sapiens
gccaggcacatggtggacacgca

SEQ ID NO: 8590457 - DNA, 22 bp, Homo sapiens
gccagtggagcacatggtgaag

SEQ ID NO: 8590458 - DNA, 22 bp, Homo sapiens
gccagtggagactgaaacccat

SEQ ID NO: 8590459 - DNA, 22 bp, Homo sapiens
gccagtggccctctggagaagg

SEQ ID NO: 8590460 - DNA, 22 bp, Homo sapiens
gccagtggcatgcggcagggac

SEQ ID NO: 8590461 - DNA, 22 bp, Homo sapiens
gccagtggaggacccatggaga

SEQ ID NO: 8590462 - DNA, 22 bp, Homo sapiens
gccagtggatgaggacttaact

SEQ ID NO: 8590463 - DNA, 22 bp, Homo sapiens
gccagtggcttgccaggcagga

SEQ ID NO: 8590464 - DNA, 22 bp, Homo sapiens
gcccacagtacgaggctcaggc

SEQ ID NO: 8590465 - DNA, 22 bp, Homo sapiens
gagggggaaagtccctggagtc

SEQ ID NO: 8590466 - DNA, 22 bp, Homo sapiens
gcaagctgcttaagctcattgt

SEQ ID NO: 8590467 - DNA, 22 bp, Homo sapiens
gcaagctgctcttatgtggagg

SEQ ID NO: 8590468 - DNA, 22 bp, Homo sapiens
gcaagcagacattcaggtaggt

SEQ ID NO: 8590469 - DNA, 22 bp, Homo sapiens
gcaagcagttcgcagcccgcct

SEQ ID NO: 8590470 - DNA, 22 bp, Homo sapiens
gcaagctggctgttagaggatg

SEQ ID NO: 8590471 - DNA, 22 bp, Homo sapiens
gcacagcatgaagagaggaagc

SEQ ID NO: 8590472 - DNA, 22 bp, Homo sapiens
gcacagccctgagcgcatgtct

SEQ ID NO: 8590473 - DNA, 22 bp, Homo sapiens
gcacagcctgtccctgtcctgg

SEQ ID NO: 8590474 - DNA, 22 bp, Homo sapiens
gcagagctctgttcttatctcc

SEQ ID NO: 8590475 - DNA, 18 bp, Homo sapiens
gcactctgactgcagagc

SEQ ID NO: 8590476 - DNA, 22 bp, Homo sapiens
gcagcaggtgtgcttttaatga

SEQ ID NO: 8590477 - DNA, 22 bp, Homo sapiens
gcagcatccttggcctccaccc

SEQ ID NO: 8590478 - DNA, 22 bp, Homo sapiens
gcagcatctagggcactggcct

SEQ ID NO: 8590479 - DNA, 22 bp, Homo sapiens
gcagcaggatggccaattgcca

SEQ ID NO: 8590480 - DNA, 22 bp, Homo sapiens
gcagcaggagagtttgtcctgc

SEQ ID NO: 8590481 - DNA, 22 bp, Homo sapiens
gcagcaggtctgtcaatgtcat

SEQ ID NO: 8590482 - DNA, 22 bp, Homo sapiens
gcagcaggcacggtctcgacat

SEQ ID NO: 8590483 - DNA, 22 bp, Homo sapiens
gcagcaggagagtaatagcggt

SEQ ID NO: 8590484 - DNA, 22 bp, Homo sapiens
gcagcaggactgccgttaaagt

SEQ ID NO: 8590485 - DNA, 22 bp, Homo sapiens
gcagcaggaataggataagcaa

SEQ ID NO: 8590486 - DNA, 22 bp, Homo sapiens
gcagcaggaatttaaatttata

SEQ ID NO: 8590487 - DNA, 22 bp, Homo sapiens
gcagcagctctgaatgggcccc

SEQ ID NO: 8590488 - DNA, 22 bp, Homo sapiens
gcagcagctccctatccaggct

SEQ ID NO: 8590489 - DNA, 22 bp, Homo sapiens
gcagggccttagcagcggctgc

SEQ ID NO: 8590490 - DNA, 22 bp, Homo sapiens
gcaggagctggaaagtgatgtt

SEQ ID NO: 8590491 - DNA, 22 bp, Homo sapiens
gcaggagctgctctcctgacga

SEQ ID NO: 8590492 - DNA, 22 bp, Homo sapiens
gcagctggccctgacacgcaga

SEQ ID NO: 8590493 - DNA, 22 bp, Homo sapiens
gcagctggcccctttccttgtt

SEQ ID NO: 8590494 - DNA, 22 bp, Homo sapiens
gcaggaggagcattaactgagc

SEQ ID NO: 8590495 - DNA, 22 bp, Homo sapiens
gcaggagctttgcttactgctg

SEQ ID NO: 8590496 - DNA, 22 bp, Homo sapiens
gcaggaggatcacttgagccca

SEQ ID NO: 8590497 - DNA, 22 bp, Homo sapiens
gcagctggacccacacggctta

SEQ ID NO: 8590498 - DNA, 22 bp, Homo sapiens
gcagctggagaaataccaccct

SEQ ID NO: 8590499 - DNA, 22 bp, Homo sapiens
gcagctggagcatcttctcatc

SEQ ID NO: 8590500 - DNA, 22 bp, Homo sapiens
gcagctggagccagccagacac

SEQ ID NO: 8590501 - DNA, 22 bp, Homo sapiens
gcagctggatttcaagagggag

SEQ ID NO: 8590502 - DNA, 22 bp, Homo sapiens
gcaggaggccaggtatgcttta

SEQ ID NO: 8590503 - DNA, 22 bp, Homo sapiens
gcaggaggttgagccaggactg

SEQ ID NO: 8590504 - DNA, 22 bp, Homo sapiens
gcaggcctctgttgagggcctt

SEQ ID NO: 8590505 - DNA, 22 bp, Homo sapiens
gctgggttttcttccgggccta

SEQ ID NO: 8590506 - DNA, 22 bp, Homo sapiens
gctgggtggatcggaggctctg

SEQ ID NO: 8590507 - DNA, 16 bp, Homo sapiens
gctgggagggagaggt

SEQ ID NO: 8590508 - DNA, 16 bp, Homo sapiens
gctgggagggagaggt

SEQ ID NO: 8590509 - DNA, 22 bp, Homo sapiens
gctgggagggaggctataccct

SEQ ID NO: 8590510 - DNA, 22 bp, Homo sapiens
gctgggaggcagcacctttagc

SEQ ID NO: 8590511 - DNA, 22 bp, Homo sapiens
gctgggaggatctctccctgtc

SEQ ID NO: 8590512 - DNA, 22 bp, Homo sapiens
gctgggagtcgcgtctgtggcc

SEQ ID NO: 8590513 - DNA, 18 bp, Homo sapiens
gctggggttgagctctcc

SEQ ID NO: 8590514 - DNA, 22 bp, Homo sapiens
gctggggtgtggtggataagct

SEQ ID NO: 8590515 - DNA, 22 bp, Homo sapiens
gctggggtctgtgaggagggct

SEQ ID NO: 8590516 - DNA, 22 bp, Homo sapiens
gctgtgagccgctgctgagcat

SEQ ID NO: 8590517 - DNA, 22 bp, Homo sapiens
gctgtgagggcttctgaggcat

SEQ ID NO: 8590518 - DNA, 22 bp, Homo sapiens
gctgtgagtggaggaggctgag

SEQ ID NO: 8590519 - DNA, 22 bp, Homo sapiens
gcttccagtaagttgctgccat

SEQ ID NO: 8590520 - DNA, 22 bp, Homo sapiens
gctggctctgatgggctccagg

SEQ ID NO: 8590521 - DNA, 22 bp, Homo sapiens
gctggctctgccccacctgttc

SEQ ID NO: 8590522 - DNA, 22 bp, Homo sapiens
gctggctctgcacccaggcctc

SEQ ID NO: 8590523 - DNA, 22 bp, Homo sapiens
gctggctctcctcacagtacag

SEQ ID NO: 8590524 - DNA, 22 bp, Homo sapiens
gctggctcgggaagcaggggat

SEQ ID NO: 8590525 - DNA, 22 bp, Homo sapiens
gctggctcggatttgaacagga

SEQ ID NO: 8590526 - DNA, 22 bp, Homo sapiens
gctggctcggatttgaacagga

SEQ ID NO: 8590527 - DNA, 22 bp, Homo sapiens
gctgggagaggccctgaagtga

SEQ ID NO: 8590528 - DNA, 22 bp, Homo sapiens
gctgggagaggcagctttcgga

SEQ ID NO: 8590529 - DNA, 22 bp, Homo sapiens
gctgggagacagacttggaacc

SEQ ID NO: 8590530 - DNA, 22 bp, Homo sapiens
gctgggagacagacttggaacc

SEQ ID NO: 8590531 - DNA, 22 bp, Homo sapiens
gctgggagaggccctgaagtga

SEQ ID NO: 8590532 - DNA, 22 bp, Homo sapiens
gctgggagcaaagccatgcata

SEQ ID NO: 8590533 - DNA, 22 bp, Homo sapiens
gctgggaggaatttggggaata

SEQ ID NO: 8590534 - DNA, 22 bp, Homo sapiens
gctgggaggaatttggggaata

SEQ ID NO: 8590535 - DNA, 22 bp, Homo sapiens
gctggctcagggggattagcaa

SEQ ID NO: 8590536 - DNA, 22 bp, Homo sapiens
gctggctccaaaagcaggggct

SEQ ID NO: 8590537 - DNA, 22 bp, Homo sapiens
gctggcacatggctcagggcct

SEQ ID NO: 8590538 - DNA, 22 bp, Homo sapiens
gctggcacctgcaccaagcagg

SEQ ID NO: 8590539 - DNA, 19 bp, Homo sapiens
gctggcacttcaagggagc

SEQ ID NO: 8590540 - DNA, 22 bp, Homo sapiens
ggaagccaggcccagagatgct

SEQ ID NO: 8590541 - DNA, 21 bp, Homo sapiens
ggaagcagtggcggcaactcc

SEQ ID NO: 8590542 - DNA, 22 bp, Homo sapiens
ggaacagttgcgtcatgggcct

SEQ ID NO: 8590543 - DNA, 22 bp, Homo sapiens
gcttcctccctgctgctcacta

SEQ ID NO: 8590544 - DNA, 22 bp, Homo sapiens
gcttcctcctggaggtcactca

SEQ ID NO: 8590545 - DNA, 21 bp, Homo sapiens
ggactctacacaggccatctt

SEQ ID NO: 8590546 - DNA, 22 bp, Homo sapiens
ggacgcagcgagggaagcagcc

SEQ ID NO: 8590547 - DNA, 22 bp, Homo sapiens
ggacgcagcgagggaagcagcc

SEQ ID NO: 8590548 - DNA, 22 bp, Homo sapiens
ggacgcagccgagggagcaggg

SEQ ID NO: 8590549 - DNA, 22 bp, Homo sapiens
ggagaggcgatgagtcacagcc

SEQ ID NO: 8590550 - DNA, 19 bp, Homo sapiens
ggagaggctggagggatgc

SEQ ID NO: 8590551 - DNA, 22 bp, Homo sapiens
ggagaggcttccagagtcgtgc

SEQ ID NO: 8590552 - DNA, 22 bp, Homo sapiens
ggagaggaaatgccagcacttc

SEQ ID NO: 8590553 - DNA, 22 bp, Homo sapiens
ggacccagctctgagaccctgc

SEQ ID NO: 8590554 - DNA, 22 bp, Homo sapiens
ggacagaaaccatatgagtgta

SEQ ID NO: 8590555 - DNA, 22 bp, Homo sapiens
ggacagagccctggtggcctaa

SEQ ID NO: 8590556 - DNA, 22 bp, Homo sapiens
ggacagagcagacgagcagcgg

SEQ ID NO: 8590557 - DNA, 22 bp, Homo sapiens
ggacagactttacagccccggg

SEQ ID NO: 8590558 - DNA, 19 bp, Homo sapiens
ggacagacgcagagatctg

SEQ ID NO: 8590559 - DNA, 22 bp, Homo sapiens
ggacagacaaaaatagtaagca

SEQ ID NO: 8590560 - DNA, 22 bp, Homo sapiens
ggacagacagtgtgagtgaggc

SEQ ID NO: 8590561 - DNA, 22 bp, Homo sapiens
gctgcaactgttgctctctgca

SEQ ID NO: 8590562 - DNA, 22 bp, Homo sapiens
gctgatcacatttccaaaaccc

SEQ ID NO: 8590563 - DNA, 22 bp, Homo sapiens
gctgaaggtgtgtggagagagg

SEQ ID NO: 8590564 - DNA, 22 bp, Homo sapiens
gctgcaggagctggagctgtgg

SEQ ID NO: 8590565 - DNA, 22 bp, Homo sapiens
gctgcaggagattttgagagtc

SEQ ID NO: 8590566 - DNA, 22 bp, Homo sapiens
gctgcaggagattttgagagtc

SEQ ID NO: 8590567 - DNA, 22 bp, Homo sapiens
gctgcaggatgaggctctgctc

SEQ ID NO: 8590568 - DNA, 22 bp, Homo sapiens
gctgcaggatgaggctctgctc

SEQ ID NO: 8590569 - DNA, 22 bp, Homo sapiens
gctgcagggggtgggcgtctcc

SEQ ID NO: 8590570 - DNA, 20 bp, Homo sapiens
gctgccagtgcctgatgctt

SEQ ID NO: 8590571 - DNA, 22 bp, Homo sapiens
gctgccagccctcggggtctga

SEQ ID NO: 8590572 - DNA, 22 bp, Homo sapiens
gctgccaggccctggggctatg

SEQ ID NO: 8590573 - DNA, 22 bp, Homo sapiens
gctctcagaagagccaggctac

SEQ ID NO: 8590574 - DNA, 21 bp, Homo sapiens
gctctcagctgcctgctggtt

SEQ ID NO: 8590575 - DNA, 21 bp, Homo sapiens
gctctcagctgcctgctggtt

SEQ ID NO: 8590576 - DNA, 22 bp, Homo sapiens
gctctcagatgctccagcagcc

SEQ ID NO: 8590577 - DNA, 22 bp, Homo sapiens
gctcctgtttgtttgttcctga

SEQ ID NO: 8590578 - DNA, 22 bp, Homo sapiens
gctcctgtgcaggtctcggttg

SEQ ID NO: 8590579 - DNA, 22 bp, Homo sapiens
gctctatgagtttctcagttta

SEQ ID NO: 8590580 - DNA, 22 bp, Homo sapiens
gctctatgggcacagccagtgt

SEQ ID NO: 8590581 - DNA, 22 bp, Homo sapiens
gctctatggctgctgggagtcc

SEQ ID NO: 8590582 - DNA, 22 bp, Homo sapiens
gctctatgttgaccttcagtgg

SEQ ID NO: 8590583 - DNA, 22 bp, Homo sapiens
gctctatgtcgaaagccagtta

SEQ ID NO: 8590584 - DNA, 22 bp, Homo sapiens
gctcctgtcttggggcactggc

SEQ ID NO: 8590585 - DNA, 22 bp, Homo sapiens
gctctgctaatattgtagtacc

SEQ ID NO: 8590586 - DNA, 22 bp, Homo sapiens
gctctcagggtgatggcatact

SEQ ID NO: 8590587 - DNA, 22 bp, Homo sapiens
gccttcagtagtgtcagctgta

SEQ ID NO: 8590588 - DNA, 22 bp, Homo sapiens
gccttcaggaaatcagtccttg

SEQ ID NO: 8590589 - DNA, 18 bp, Homo sapiens
gccttcagactgcatgct

SEQ ID NO: 8590590 - DNA, 22 bp, Homo sapiens
gcctggggccagcttgggctga

SEQ ID NO: 8590591 - DNA, 22 bp, Homo sapiens
gcctggggaacttgatcctgtc

SEQ ID NO: 8590592 - DNA, 22 bp, Homo sapiens
gcctggggaacttgatcctgtc

SEQ ID NO: 8590593 - DNA, 22 bp, Homo sapiens
gcgctcaggtgccaggcctgcg

SEQ ID NO: 8590594 - DNA, 22 bp, Homo sapiens
gcgctaggcaagtcctttcaac

SEQ ID NO: 8590595 - DNA, 22 bp, Homo sapiens
gcgggccaccttggagagcgct

SEQ ID NO: 8590596 - DNA, 22 bp, Homo sapiens
gcgggaagaacgaccaggctcg

SEQ ID NO: 8590597 - DNA, 22 bp, Homo sapiens
gcgagaaactaagtgccctttg

SEQ ID NO: 8590598 - DNA, 22 bp, Homo sapiens
gctcagctgcacctggagagcc

SEQ ID NO: 8590599 - DNA, 22 bp, Homo sapiens
gctcagctggagagggacgggt

SEQ ID NO: 8590600 - DNA, 22 bp, Homo sapiens
gctcacagtctgctgagtgcag

SEQ ID NO: 8590601 - DNA, 22 bp, Homo sapiens
gctcacagtctgctgagtgcag

SEQ ID NO: 8590602 - DNA, 22 bp, Homo sapiens
gctcacaggcagtgttgggaga

SEQ ID NO: 8590603 - DNA, 22 bp, Homo sapiens
gctcacagccggctggcagggg

SEQ ID NO: 8590604 - DNA, 22 bp, Homo sapiens
gctcacagccggctggcagggg

SEQ ID NO: 8590605 - DNA, 22 bp, Homo sapiens
ggatggcttgcatttgaggact

SEQ ID NO: 8590606 - DNA, 22 bp, Homo sapiens
ggatgcaggaacacagcgacct

SEQ ID NO: 8590607 - DNA, 22 bp, Homo sapiens
ggatgcaggaggtcggggagca

SEQ ID NO: 8590608 - DNA, 22 bp, Homo sapiens
ggatgcaggggcagcagagcct

SEQ ID NO: 8590609 - DNA, 22 bp, Homo sapiens
ggatgcaggggcagcagagcct

SEQ ID NO: 8590610 - DNA, 22 bp, Homo sapiens
ggatgcagtgaggagcccgcgc

SEQ ID NO: 8590611 - DNA, 22 bp, Homo sapiens
ggatgctctgtctcttgctgtt

SEQ ID NO: 8590612 - DNA, 22 bp, Homo sapiens
ggagcagagctgggcttggctg

SEQ ID NO: 8590613 - DNA, 22 bp, Homo sapiens
ggatgaggaagattactgagaa

SEQ ID NO: 8590614 - DNA, 22 bp, Homo sapiens
ggagcactataatagagatttt

SEQ ID NO: 8590615 - DNA, 22 bp, Homo sapiens
ggagatggtggaagctggtgca

SEQ ID NO: 8590616 - DNA, 22 bp, Homo sapiens
ggcagcagacccctaagtctac

SEQ ID NO: 8590617 - DNA, 22 bp, Homo sapiens
ggcagcaggagccatctggtag

SEQ ID NO: 8590618 - DNA, 22 bp, Homo sapiens
ggcagcagcaaggttggagctg

SEQ ID NO: 8590619 - DNA, 22 bp, Homo sapiens
ggcactgctgtaggcagtgagg

SEQ ID NO: 8590620 - DNA, 22 bp, Homo sapiens
ggattgcaacaagctagtttag

SEQ ID NO: 8590621 - DNA, 22 bp, Homo sapiens
ggcagctgttggctctctagga

SEQ ID NO: 8590622 - DNA, 22 bp, Homo sapiens
ggcagcttgccctggtctcaac

SEQ ID NO: 8590623 - DNA, 22 bp, Homo sapiens
ggcagcagggctgtctccctac

SEQ ID NO: 8590624 - DNA, 22 bp, Homo sapiens
ggcagcagggtctagattgatg

SEQ ID NO: 8590625 - DNA, 22 bp, Homo sapiens
ggcaggggtgaggccactctga

SEQ ID NO: 8590626 - DNA, 18 bp, Homo sapiens
ggcaggggtgaaccacag

SEQ ID NO: 8590627 - DNA, 22 bp, Homo sapiens
ggcaggagaatggcgtgaactc

SEQ ID NO: 8590628 - DNA, 18 bp, Homo sapiens
ggcaggagcaagaatagg

SEQ ID NO: 8590629 - DNA, 22 bp, Homo sapiens
ggcaggagctctccagtttgcc

SEQ ID NO: 8590630 - DNA, 17 bp, Homo sapiens
ggcaggtgacagacacc

SEQ ID NO: 8590631 - DNA, 22 bp, Homo sapiens
ggcaggtgacctggcctcccag

SEQ ID NO: 8590632 - DNA, 22 bp, Homo sapiens
ggcaggtgacggggatgagtat

SEQ ID NO: 8590633 - DNA, 22 bp, Homo sapiens
ggcaggtgagagctctttgaaa

SEQ ID NO: 8590634 - DNA, 22 bp, Homo sapiens
ggccagcttctctgctgcctgt

SEQ ID NO: 8590635 - DNA, 22 bp, Homo sapiens
ggccagcttattagctcagagg

SEQ ID NO: 8590636 - DNA, 22 bp, Homo sapiens
ggccagctgtggggccgagcct

SEQ ID NO: 8590637 - DNA, 22 bp, Homo sapiens
ggccagctttgagctgcaggaa

SEQ ID NO: 8590638 - DNA, 22 bp, Homo sapiens
ggccagctttgagctgcaggaa

SEQ ID NO: 8590639 - DNA, 23 bp, Homo sapiens
ggcatgcaatggacagagctgga

SEQ ID NO: 8590640 - DNA, 22 bp, Homo sapiens
ggcatgcatgcatgcacctgtg

SEQ ID NO: 8590641 - DNA, 22 bp, Homo sapiens
ggccagctgtaagctgctgaat

SEQ ID NO: 8590642 - DNA, 22 bp, Homo sapiens
ggccaggcactgtgtgagatat

SEQ ID NO: 8590643 - DNA, 22 bp, Homo sapiens
ggcctagttttttctggtaggt

SEQ ID NO: 8590644 - DNA, 22 bp, Homo sapiens
ggcctagggcttggtcatggca

SEQ ID NO: 8590645 - DNA, 21 bp, Homo sapiens
ggcctaggggcagatggtgct

SEQ ID NO: 8590646 - DNA, 22 bp, Homo sapiens
ggcctaggaaggggatgtaact

SEQ ID NO: 8590647 - DNA, 22 bp, Homo sapiens
ggcctagcctctcctgagagag

SEQ ID NO: 8590648 - DNA, 22 bp, Homo sapiens
ggcctaggattctgcatttcta

SEQ ID NO: 8590649 - DNA, 22 bp, Homo sapiens
ggccctgggcagaggagtgggc

SEQ ID NO: 8590650 - DNA, 22 bp, Homo sapiens
ggcctcagaccggagctggcca

SEQ ID NO: 8590651 - DNA, 22 bp, Homo sapiens
ggcctgctgtgtactgatgtca

SEQ ID NO: 8590652 - DNA, 22 bp, Homo sapiens
ggcctgctggctccagcgcccg

SEQ ID NO: 8590653 - DNA, 22 bp, Homo sapiens
ggctttgacatgctgaattaaa

SEQ ID NO: 8590654 - DNA, 22 bp, Homo sapiens
ggctttgaggatacagaggaaa

SEQ ID NO: 8590655 - DNA, 22 bp, Homo sapiens
ggctttgcagtcatgttttgct

SEQ ID NO: 8590656 - DNA, 22 bp, Homo sapiens
gggaagggagggcctccagtca

SEQ ID NO: 8590657 - DNA, 22 bp, Homo sapiens
gggaaggctgcctgagggatgg

SEQ ID NO: 8590658 - DNA, 22 bp, Homo sapiens
ggctttattaagcagggtaagt

SEQ ID NO: 8590659 - DNA, 22 bp, Homo sapiens
ggctttattaactcatccgtaa

SEQ ID NO: 8590660 - DNA, 22 bp, Homo sapiens
ggctttatgtttttcatgtggt

SEQ ID NO: 8590661 - DNA, 21 bp, Homo sapiens
ggctttatgctcacccagcct

SEQ ID NO: 8590662 - DNA, 22 bp, Homo sapiens
ggctttattttgcatgaatgct

SEQ ID NO: 8590663 - DNA, 22 bp, Homo sapiens
ggctttatttgcagccattgtt

SEQ ID NO: 8590664 - DNA, 22 bp, Homo sapiens
ggctttatttcactgtaccata

SEQ ID NO: 8590665 - DNA, 22 bp, Homo sapiens
ggctttattatgtggccatgtg

SEQ ID NO: 8590666 - DNA, 22 bp, Homo sapiens
ggctttatgcacagcagatggt

SEQ ID NO: 8590667 - DNA, 22 bp, Homo sapiens
ggctttatcaaatgagaccctg

SEQ ID NO: 8590668 - DNA, 22 bp, Homo sapiens
ggctttatgcagggatagaaat

SEQ ID NO: 8590669 - DNA, 22 bp, Homo sapiens
ggctttatattgtttgagcaga

SEQ ID NO: 8590670 - DNA, 22 bp, Homo sapiens
ggctgtgcgggcagccgtggga

SEQ ID NO: 8590671 - DNA, 22 bp, Homo sapiens
gggagctgagctggaagagaat

SEQ ID NO: 8590672 - DNA, 21 bp, Homo sapiens
gggagctgacagcagcacggc

SEQ ID NO: 8590673 - DNA, 22 bp, Homo sapiens
gggagctgagctctgagccacg

SEQ ID NO: 8590674 - DNA, 22 bp, Homo sapiens
gggagctggagctggaagactc

SEQ ID NO: 8590675 - DNA, 22 bp, Homo sapiens
gggagctggagctggaagactc

SEQ ID NO: 8590676 - DNA, 17 bp, Homo sapiens
gggaagtggagaaagct

SEQ ID NO: 8590677 - DNA, 21 bp, Homo sapiens
gggagctgacagcagcacggc

SEQ ID NO: 8590678 - DNA, 23 bp, Homo sapiens
gggcaggtttttataggcttcag

SEQ ID NO: 8590679 - DNA, 22 bp, Homo sapiens
gggcaggttggcatcccgggca

SEQ ID NO: 8590680 - DNA, 22 bp, Homo sapiens
gggcaggttattggagtaggga

SEQ ID NO: 8590681 - DNA, 22 bp, Homo sapiens
gggcagtgaatattggtgggaa

SEQ ID NO: 8590682 - DNA, 19 bp, Homo sapiens
gggcagtggcactagggag

SEQ ID NO: 8590683 - DNA, 22 bp, Homo sapiens
gggcacctggctagtgacagtg

SEQ ID NO: 8590684 - DNA, 22 bp, Homo sapiens
gggcacctggctagtgacagtg

SEQ ID NO: 8590685 - DNA, 22 bp, Homo sapiens
gggcacatgcttagggaggaaa

SEQ ID NO: 8590686 - DNA, 22 bp, Homo sapiens
gggcacatgtaaagctggagaa

SEQ ID NO: 8590687 - DNA, 22 bp, Homo sapiens
gggaggtgttccagtgttggta

SEQ ID NO: 8590688 - DNA, 22 bp, Homo sapiens
gggaggtgttccagtgttggta

SEQ ID NO: 8590689 - DNA, 22 bp, Homo sapiens
gggaggttgaggctgcagtgag

SEQ ID NO: 8590690 - DNA, 22 bp, Homo sapiens
gggagggatctgctaggcaatg

SEQ ID NO: 8590691 - DNA, 22 bp, Homo sapiens
gggagggaggtgatgcttggct

SEQ ID NO: 8590692 - DNA, 22 bp, Homo sapiens
ggctacagggcctggccaaggt

SEQ ID NO: 8590693 - DNA, 22 bp, Homo sapiens
ggctacagaggccgtgagcctg

SEQ ID NO: 8590694 - DNA, 22 bp, Homo sapiens
ggctccagtttgtgccttcagc

SEQ ID NO: 8590695 - DNA, 22 bp, Homo sapiens
ggctccaggctcctatttcact

SEQ ID NO: 8590696 - DNA, 22 bp, Homo sapiens
ggctccagggagtggagagaag

SEQ ID NO: 8590697 - DNA, 22 bp, Homo sapiens
ggctaggcctcaggcctgcctg

SEQ ID NO: 8590698 - DNA, 22 bp, Homo sapiens
ggctcctgaggaccaggcacag

SEQ ID NO: 8590699 - DNA, 22 bp, Homo sapiens
ggctcctgaggaccaggcacag

SEQ ID NO: 8590700 - DNA, 22 bp, Homo sapiens
ggctggtctccaacccccgatc

SEQ ID NO: 8590701 - DNA, 22 bp, Homo sapiens
ggctggtcccgggtcctccggc

SEQ ID NO: 8590702 - DNA, 17 bp, Homo sapiens
ggctgtgccaggtgaga

SEQ ID NO: 8590703 - DNA, 22 bp, Homo sapiens
ggctgtgcagggcagagtctca

SEQ ID NO: 8590704 - DNA, 22 bp, Homo sapiens
ggctgtgccctcacatggggca

SEQ ID NO: 8590705 - DNA, 20 bp, Homo sapiens
ggctgtgcccttccgtggcc

SEQ ID NO: 8590706 - DNA, 22 bp, Homo sapiens
ggctggagacaacgtcctgccc

SEQ ID NO: 8590707 - DNA, 19 bp, Homo sapiens
ggctggagaaaggaatcag

SEQ ID NO: 8590708 - DNA, 22 bp, Homo sapiens
ggctggagaagggtggttgaca

SEQ ID NO: 8590709 - DNA, 21 bp, Homo sapiens
ggctggacatcccaggagact

SEQ ID NO: 8590710 - DNA, 20 bp, Homo sapiens
ggctgctgtgggcagagagg

SEQ ID NO: 8590711 - DNA, 22 bp, Homo sapiens
ggctgctgtttcagagactgtt

SEQ ID NO: 8590712 - DNA, 22 bp, Homo sapiens
ggctgagttctcttgctgaatc

SEQ ID NO: 8590713 - DNA, 22 bp, Homo sapiens
ggctgctggggacgtgggagag

SEQ ID NO: 8590714 - DNA, 22 bp, Homo sapiens
ggctgaggtgtggggaactata

SEQ ID NO: 8590715 - DNA, 18 bp, Homo sapiens
ggctgaggttgactagaa

SEQ ID NO: 8590716 - DNA, 22 bp, Homo sapiens
ggctgagggccagggctagtct

SEQ ID NO: 8590717 - DNA, 22 bp, Homo sapiens
ggctgaggggcccagaggaaca

SEQ ID NO: 8590718 - DNA, 22 bp, Homo sapiens
ggctgagggtatagctgtccca

SEQ ID NO: 8590719 - DNA, 22 bp, Homo sapiens
gtgccctgcatgccccgggtat

SEQ ID NO: 8590720 - DNA, 22 bp, Homo sapiens
gtgcccaggggccagctgccgg

SEQ ID NO: 8590721 - DNA, 22 bp, Homo sapiens
gtgcccaggggccagctgccgg

SEQ ID NO: 8590722 - DNA, 22 bp, Homo sapiens
gtgcaaaagcaattgcagtttt

SEQ ID NO: 8590723 - DNA, 22 bp, Homo sapiens
gtgctgggattacaggtgtgag

SEQ ID NO: 8590724 - DNA, 22 bp, Homo sapiens
gtgctgggattacaggtgtgag

SEQ ID NO: 8590725 - DNA, 22 bp, Homo sapiens
gtgctgggctccaccccagagg

SEQ ID NO: 8590726 - DNA, 22 bp, Homo sapiens
gtgctgggtgctgcagacaggt

SEQ ID NO: 8590727 - DNA, 22 bp, Homo sapiens
gtgctggtatatgactgagttt

SEQ ID NO: 8590728 - DNA, 22 bp, Homo sapiens
gtgcttctttctcctcaagcct

SEQ ID NO: 8590729 - DNA, 22 bp, Homo sapiens
gtgcttgacgtgtagccgcccc

SEQ ID NO: 8590730 - DNA, 19 bp, Homo sapiens
gtcttctgaatgtggctgc

SEQ ID NO: 8590731 - DNA, 22 bp, Homo sapiens
gtcttctgatctggttagccat

SEQ ID NO: 8590732 - DNA, 22 bp, Homo sapiens
gtctctgacctgcgtccctcct

SEQ ID NO: 8590733 - DNA, 22 bp, Homo sapiens
gtctcctgcccccggtgcttgg

SEQ ID NO: 8590734 - DNA, 22 bp, Homo sapiens
gtgaggtgggctgggctctatg

SEQ ID NO: 8590735 - DNA, 22 bp, Homo sapiens
gtcttctgttctgtgaggcttc

SEQ ID NO: 8590736 - DNA, 22 bp, Homo sapiens
gtcttctgttctgtgaggcttc

SEQ ID NO: 8590737 - DNA, 22 bp, Homo sapiens
gtcttctgtctgtctggcatgt

SEQ ID NO: 8590738 - DNA, 22 bp, Homo sapiens
gtcttctgtaagatgaggtccc

SEQ ID NO: 8590739 - DNA, 22 bp, Homo sapiens
gtcttctggaagagagccagct

SEQ ID NO: 8590740 - DNA, 22 bp, Homo sapiens
gtgatcactgcttcttccacca

SEQ ID NO: 8590741 - DNA, 22 bp, Homo sapiens
gtagatattaaaaatggcagtg

SEQ ID NO: 8590742 - DNA, 22 bp, Homo sapiens
gtagctctgtttaaagttcttt

SEQ ID NO: 8590743 - DNA, 22 bp, Homo sapiens
ggtgggcagctcttggcaggca

SEQ ID NO: 8590744 - DNA, 22 bp, Homo sapiens
gtaaatattccctcggttccta

SEQ ID NO: 8590745 - DNA, 22 bp, Homo sapiens
gtccctggatctgggacagctg

SEQ ID NO: 8590746 - DNA, 22 bp, Homo sapiens
gtcatttatcatcagaagtcat

SEQ ID NO: 8590747 - DNA, 22 bp, Homo sapiens
gtcatttaggtctgtcagaaat

SEQ ID NO: 8590748 - DNA, 22 bp, Homo sapiens
gtcctcagggaatgtggcgggt

SEQ ID NO: 8590749 - DNA, 22 bp, Homo sapiens
gtcctcaggaaagcagataaca

SEQ ID NO: 8590750 - DNA, 22 bp, Homo sapiens
gtcctctgactcagccttggga

SEQ ID NO: 8590751 - DNA, 22 bp, Homo sapiens
gtcagtgcttgaagggcagaga

SEQ ID NO: 8590752 - DNA, 22 bp, Homo sapiens
gtcagggctccactcaccctcc

SEQ ID NO: 8590753 - DNA, 22 bp, Homo sapiens
gtcagggatccactgctcttct

SEQ ID NO: 8590754 - DNA, 21 bp, Homo sapiens
gtcagggattcaagtgctcac

SEQ ID NO: 8590755 - DNA, 22 bp, Homo sapiens
ggtcagggttccaggtatcttc

SEQ ID NO: 8590756 - DNA, 21 bp, Homo sapiens
ggtcagggggtgcctccaggt

SEQ ID NO: 8590757 - DNA, 21 bp, Homo sapiens
ggtcagggggtgcctccaggt

SEQ ID NO: 8590758 - DNA, 22 bp, Homo sapiens
ggtcagggtataatcaagtgag

SEQ ID NO: 8590759 - DNA, 22 bp, Homo sapiens
ggtcaggggctgctctacagag

SEQ ID NO: 8590760 - DNA, 22 bp, Homo sapiens
ggtaggaagatagagcaaagtt

SEQ ID NO: 8590761 - DNA, 22 bp, Homo sapiens
ggtaggcagatcactgtctatg

SEQ ID NO: 8590762 - DNA, 22 bp, Homo sapiens
ggtagcaagcgcttgccctgcg

SEQ ID NO: 8590763 - DNA, 22 bp, Homo sapiens
ggtagcgagaacagaccttaag

SEQ ID NO: 8590764 - DNA, 22 bp, Homo sapiens
ggtcaggatccaagtctgtgct

SEQ ID NO: 8590765 - DNA, 22 bp, Homo sapiens
ggtcagctctttgggctggtgg

SEQ ID NO: 8590766 - DNA, 22 bp, Homo sapiens
ggtcagcagtttctttgaattt

SEQ ID NO: 8590767 - DNA, 22 bp, Homo sapiens
ggtagggcaaagtagggcacct

SEQ ID NO: 8590768 - DNA, 22 bp, Homo sapiens
ggtagggatgggatttggaagt

SEQ ID NO: 8590769 - DNA, 21 bp, Homo sapiens
ggtagggaaggttcgctggtg

SEQ ID NO: 8590770 - DNA, 22 bp, Homo sapiens
ggtagggaaggctctgcgggga

SEQ ID NO: 8590771 - DNA, 22 bp, Homo sapiens
ggtagggaaggtctcccacatt

SEQ ID NO: 8590772 - DNA, 23 bp, Homo sapiens
gggtccagagaagccattagggc

SEQ ID NO: 8590773 - DNA, 22 bp, Homo sapiens
gggtcagggctgcctgggctca

SEQ ID NO: 8590774 - DNA, 22 bp, Homo sapiens
gggtcaggctagcccagacttc

SEQ ID NO: 8590775 - DNA, 22 bp, Homo sapiens
ggtaaggagctccggcttctgc

SEQ ID NO: 8590776 - DNA, 22 bp, Homo sapiens
ggtctgggtttccccaccacac

SEQ ID NO: 8590777 - DNA, 22 bp, Homo sapiens
ggtgcagggagaggcaggcccc

SEQ ID NO: 8590778 - DNA, 22 bp, Homo sapiens
ggtgcagggagaggcaggcccc

SEQ ID NO: 8590779 - DNA, 20 bp, Homo sapiens
ggtgcaggtaacgctgtgct

SEQ ID NO: 8590780 - DNA, 22 bp, Homo sapiens
ggtggctgaatcaaatcaggcc

SEQ ID NO: 8590781 - DNA, 22 bp, Homo sapiens
ggtggctgcaatggctaacttc

SEQ ID NO: 8590782 - DNA, 22 bp, Homo sapiens
ggtgccaggctcccagctcagg

SEQ ID NO: 8590783 - DNA, 22 bp, Homo sapiens
ggggatggaggcgtgtggtcct

SEQ ID NO: 8590784 - DNA, 22 bp, Homo sapiens
ggggatggaatgtagtagtgat

SEQ ID NO: 8590785 - DNA, 22 bp, Homo sapiens
gggctgggattgcttgctgtga

SEQ ID NO: 8590786 - DNA, 22 bp, Homo sapiens
gggggcgggagacagcagtgac

SEQ ID NO: 8590787 - DNA, 22 bp, Homo sapiens
gggtcagagccgtaacaggact

SEQ ID NO: 8590788 - DNA, 22 bp, Homo sapiens
gggtcagagtaagcaaggacaa

SEQ ID NO: 8590789 - DNA, 22 bp, Homo sapiens
gggtcagagttcaggtcgaggg

SEQ ID NO: 8590790 - DNA, 22 bp, Homo sapiens
gggggcggagcacgtgaccacg

SEQ ID NO: 8590791 - DNA, 22 bp, Homo sapiens
ggggcaggagcccttcttcagc

SEQ ID NO: 8590792 - DNA, 22 bp, Homo sapiens
ggggcaggaggtgttctctttt

SEQ ID NO: 8590793 - DNA, 22 bp, Homo sapiens
gggggaagaggcatgaagtcct

SEQ ID NO: 8590794 - DNA, 22 bp, Homo sapiens
gggcctcaggccttgctctgtg

SEQ ID NO: 8590795 - DNA, 22 bp, Homo sapiens
gggcctcagctctgctctgcaa

SEQ ID NO: 8590796 - DNA, 21 bp, Homo sapiens
gggcatcctttcccaccctgc

SEQ ID NO: 8590797 - DNA, 22 bp, Homo sapiens
gggcataacgggcagccaggtg

SEQ ID NO: 8590798 - DNA, 22 bp, Homo sapiens
gggctctaggatggctccagcc

SEQ ID NO: 8590799 - DNA, 19 bp, Homo sapiens
gggctctactctcagtctt

SEQ ID NO: 8590800 - DNA, 22 bp, Homo sapiens
gggctctagaggacagcctgct

SEQ ID NO: 8590801 - DNA, 22 bp, Homo sapiens
gggctcctgcctcctggcacct

SEQ ID NO: 8590802 - DNA, 22 bp, Homo sapiens
gggctctctttttggcctgccc

SEQ ID NO: 8590803 - DNA, 22 bp, Homo sapiens
gggctccacagcagtgagtgga

SEQ ID NO: 8590804 - DNA, 22 bp, Homo sapiens
gggctccaggcaggcaggaaat

SEQ ID NO: 8590805 - DNA, 23 bp, Homo sapiens
gggctccagtctctgctcagttg

SEQ ID NO: 8590806 - DNA, 22 bp, Homo sapiens
gggctccagtttggccaggaag

SEQ ID NO: 8590807 - DNA, 22 bp, Homo sapiens
gggctcctcctctgactgtggc

SEQ ID NO: 8590808 - DNA, 22 bp, Homo sapiens
ctctggaattgacctgggaggg

SEQ ID NO: 8590809 - DNA, 22 bp, Homo sapiens
ctctggagggaggctgagctgg

SEQ ID NO: 8590810 - DNA, 22 bp, Homo sapiens
tttcttaatttgagttccacta

SEQ ID NO: 8590811 - DNA, 22 bp, Homo sapiens
tttcttgagcccaggaggtgga

SEQ ID NO: 8590812 - DNA, 21 bp, Homo sapiens
ctctgctgtctaccagctgtt

SEQ ID NO: 8590813 - DNA, 22 bp, Homo sapiens
ctctgctgtgccgccagggcct

SEQ ID NO: 8590814 - DNA, 22 bp, Homo sapiens
ctctgagctgaaacatgagcat

SEQ ID NO: 8590815 - DNA, 22 bp, Homo sapiens
tttctctctatttagacaggta

SEQ ID NO: 8590816 - DNA, 22 bp, Homo sapiens
ctctctggacttgagtatcagc

SEQ ID NO: 8590817 - DNA, 22 bp, Homo sapiens
ctctagagtacgggctggcatg

SEQ ID NO: 8590818 - DNA, 22 bp, Homo sapiens
ctctagaggcttgaatgggcga

SEQ ID NO: 8590819 - DNA, 22 bp, Homo sapiens
ctctaggccatccagggccatt

SEQ ID NO: 8590820 - DNA, 22 bp, Homo sapiens
ctctagaacagtgctgagcctt

SEQ ID NO: 8590821 - DNA, 21 bp, Homo sapiens
ctctagaaatcgaataacctt

SEQ ID NO: 8590822 - DNA, 22 bp, Homo sapiens
ctctagaatgaattagcgcagg

SEQ ID NO: 8590823 - DNA, 22 bp, Homo sapiens
ctctagacaacttgctgtgggt

SEQ ID NO: 8590824 - DNA, 22 bp, Homo sapiens
ctctagggtgcaggccccagga

SEQ ID NO: 8590825 - DNA, 22 bp, Homo sapiens
tttacacaaaagatagcacacc

SEQ ID NO: 8590826 - DNA, 22 bp, Homo sapiens
ctcctgcgggagctccgcctag

SEQ ID NO: 8590827 - DNA, 22 bp, Homo sapiens
tttatatgtgaaggtttgcaga

SEQ ID NO: 8590828 - DNA, 18 bp, Homo sapiens
tttatatggatagagacc

SEQ ID NO: 8590829 - DNA, 22 bp, Homo sapiens
ctcctgtcaataggctcctggc

SEQ ID NO: 8590830 - DNA, 22 bp, Homo sapiens
ctctacagctgctgcccctggt

SEQ ID NO: 8590831 - DNA, 22 bp, Homo sapiens
ctccctgggcagatgtggctct

SEQ ID NO: 8590832 - DNA, 22 bp, Homo sapiens
ctcccagggccatcgagtcact

SEQ ID NO: 8590833 - DNA, 22 bp, Homo sapiens
ctcccagggccatcgagtcact

SEQ ID NO: 8590834 - DNA, 22 bp, Homo sapiens
ctgagcttccagttcctccagg

SEQ ID NO: 8590835 - DNA, 22 bp, Homo sapiens
ctgagcttggcttatctccagc

SEQ ID NO: 8590836 - DNA, 18 bp, Homo sapiens
ctgaggctggcaggagcc

SEQ ID NO: 8590837 - DNA, 22 bp, Homo sapiens
ctgagcacctgctgtgtgccag

SEQ ID NO: 8590838 - DNA, 22 bp, Homo sapiens
ctgagccttattcaccagccct

SEQ ID NO: 8590839 - DNA, 22 bp, Homo sapiens
ctgagaggtaagcagcgcagtg

SEQ ID NO: 8590840 - DNA, 22 bp, Homo sapiens
ctgagagtcagtggagtggtgt

SEQ ID NO: 8590841 - DNA, 22 bp, Homo sapiens
ctgaagtttttcaatttatgtt

SEQ ID NO: 8590842 - DNA, 22 bp, Homo sapiens
ctgaagtttatgcttttcgggt

SEQ ID NO: 8590843 - DNA, 22 bp, Homo sapiens
tttttcttaaatgtgggttggc

SEQ ID NO: 8590844 - DNA, 22 bp, Homo sapiens
ctgaaggagaaggccactgttc

SEQ ID NO: 8590845 - DNA, 22 bp, Homo sapiens
ctgaagttattcagtgggctga

SEQ ID NO: 8590846 - DNA, 22 bp, Homo sapiens
ctgaagttaaagtagtttttat

SEQ ID NO: 8590847 - DNA, 22 bp, Homo sapiens
ctgaaggctaaaatggactgaa

SEQ ID NO: 8590848 - DNA, 22 bp, Homo sapiens
ctgagggctggagctgaggcct

SEQ ID NO: 8590849 - DNA, 23 bp, Homo sapiens
ctgaggggaaaagggcttcaggc

SEQ ID NO: 8590850 - DNA, 22 bp, Homo sapiens
ctgcagttctttggcttttaga

SEQ ID NO: 8590851 - DNA, 22 bp, Homo sapiens
ctgcagtgcctgccactgagcc

SEQ ID NO: 8590852 - DNA, 22 bp, Homo sapiens
ctgcagtcttccttccttaggc

SEQ ID NO: 8590853 - DNA, 22 bp, Homo sapiens
ctgccctgcttgatgacagcga

SEQ ID NO: 8590854 - DNA, 22 bp, Homo sapiens
ctgcctgaactgggtgagcaag

SEQ ID NO: 8590855 - DNA, 22 bp, Homo sapiens
ctgctccagacacctgcagggg

SEQ ID NO: 8590856 - DNA, 22 bp, Homo sapiens
ctgctgggaaggtctgctcagt

SEQ ID NO: 8590857 - DNA, 17 bp, Homo sapiens
ctgctggctggggcttg

SEQ ID NO: 8590858 - DNA, 22 bp, Homo sapiens
ctgctggaggttggagcatgca

SEQ ID NO: 8590859 - DNA, 22 bp, Homo sapiens
ctgctggaatctttaagctgga

SEQ ID NO: 8590860 - DNA, 22 bp, Homo sapiens
ccttgggaccctgctggaggtt

SEQ ID NO: 8590861 - DNA, 22 bp, Homo sapiens
ccttgggaggctcccagggaga

SEQ ID NO: 8590862 - DNA, 22 bp, Homo sapiens
ccttctgggccaacttccagga

SEQ ID NO: 8590863 - DNA, 22 bp, Homo sapiens
ttattattgtgacctgagaatg

SEQ ID NO: 8590864 - DNA, 22 bp, Homo sapiens
ttattattttgtgtacagcaaa

SEQ ID NO: 8590865 - DNA, 22 bp, Homo sapiens
ttcaaaaaggtatgttcaagtc

SEQ ID NO: 8590866 - DNA, 22 bp, Homo sapiens
cctttctgatggcctcccagcc

SEQ ID NO: 8590867 - DNA, 22 bp, Homo sapiens
cgcaccactgaattccagcctg

SEQ ID NO: 8590868 - DNA, 19 bp, Homo sapiens
cctgtggcagagtggaaac

SEQ ID NO: 8590869 - DNA, 22 bp, Homo sapiens
cctgtggagctttcagcagctc

SEQ ID NO: 8590870 - DNA, 22 bp, Homo sapiens
cctgtggctggtcaggccagca

SEQ ID NO: 8590871 - DNA, 22 bp, Homo sapiens
cctgtcacgatgactgcactct

SEQ ID NO: 8590872 - DNA, 19 bp, Homo sapiens
ttaagctaagatactagta

SEQ ID NO: 8590873 - DNA, 22 bp, Homo sapiens
ttaagctagtgaagtccctcaa

SEQ ID NO: 8590874 - DNA, 22 bp, Homo sapiens
ttaagctaattagttccagcat

SEQ ID NO: 8590875 - DNA, 22 bp, Homo sapiens
tggttcagatatggagctggga

SEQ ID NO: 8590876 - DNA, 22 bp, Homo sapiens
tgttggaaggcaagcagcaatt

SEQ ID NO: 8590877 - DNA, 22 bp, Homo sapiens
tgttggaataagtgcttgaagg

SEQ ID NO: 8590878 - DNA, 22 bp, Homo sapiens
tgttggaattaggatacagagg

SEQ ID NO: 8590879 - DNA, 22 bp, Homo sapiens
tgttgcccaggttctctcctgc

SEQ ID NO: 8590880 - DNA, 22 bp, Homo sapiens
tgtttcttctcacacaaactca

SEQ ID NO: 8590881 - DNA, 22 bp, Homo sapiens
tgtttcttatccaagtggtctg

SEQ ID NO: 8590882 - DNA, 22 bp, Homo sapiens
cctggggagccgcctgagcccc

SEQ ID NO: 8590883 - DNA, 22 bp, Homo sapiens
cctggggagagaaagcccagcc

SEQ ID NO: 8590884 - DNA, 22 bp, Homo sapiens
cctggggagagaaagcccagcc

SEQ ID NO: 8590885 - DNA, 23 bp, Homo sapiens
cctggggagctgtatccagagtg

SEQ ID NO: 8590886 - DNA, 22 bp, Homo sapiens
cctggggattctgacacggagt

SEQ ID NO: 8590887 - DNA, 23 bp, Homo sapiens
cctggggcacttgagtcctcatc

SEQ ID NO: 8590888 - DNA, 22 bp, Homo sapiens
ttctgaaagccaattcattgaa

SEQ ID NO: 8590889 - DNA, 22 bp, Homo sapiens
ttctgtcctgttggatgaatca

SEQ ID NO: 8590890 - DNA, 21 bp, Homo sapiens
ttcttcagtttaatataaaat

SEQ ID NO: 8590891 - DNA, 22 bp, Homo sapiens
ttcttcagtttggtaaatgtaa

SEQ ID NO: 8590892 - DNA, 22 bp, Homo sapiens
ctcactggcaagactacaggtg

SEQ ID NO: 8590893 - DNA, 20 bp, Homo sapiens
ctcagaaaagctaaggagaa

SEQ ID NO: 8590894 - DNA, 22 bp, Homo sapiens
ttgctgggtcagaagccaggag

SEQ ID NO: 8590895 - DNA, 22 bp, Homo sapiens
ttgatcaaatcagctactgagg

SEQ ID NO: 8590896 - DNA, 22 bp, Homo sapiens
ctcagccatgcaacatgctggg

SEQ ID NO: 8590897 - DNA, 22 bp, Homo sapiens
ctcagccatgtcatgcctacct

SEQ ID NO: 8590898 - DNA, 22 bp, Homo sapiens
cgtcctcagaggccatccgaaa

SEQ ID NO: 8590899 - DNA, 22 bp, Homo sapiens
ttccagaaatctttcagctcaa

SEQ ID NO: 8590900 - DNA, 22 bp, Homo sapiens
cgggaaggtggaggttgcagtg

SEQ ID NO: 8590901 - DNA, 22 bp, Homo sapiens
cgcagctgcacggggctgagcc

SEQ ID NO: 8590902 - DNA, 22 bp, Homo sapiens
cgcagctgcaaaggaaacattt

SEQ ID NO: 8590903 - DNA, 22 bp, Homo sapiens
cgcagctgcaaaggaaacattt

SEQ ID NO: 8590904 - DNA, 21 bp, Homo sapiens
cgcagctgagaaatatacaga

SEQ ID NO: 8590905 - DNA, 22 bp, Homo sapiens
ttctcctggagtgcttgttggg

SEQ ID NO: 8590906 - DNA, 22 bp, Homo sapiens
ttctcctggggccgtgatgtga

SEQ ID NO: 8590907 - DNA, 22 bp, Homo sapiens
ttctccttcctggttttcaggc

SEQ ID NO: 8590908 - DNA, 22 bp, Homo sapiens
ctagggctcgcaagggctggag

SEQ ID NO: 8590909 - DNA, 22 bp, Homo sapiens
ttctaccagaccccagacttgt

SEQ ID NO: 8590910 - DNA, 22 bp, Homo sapiens
gaatgagtattctttataggat

SEQ ID NO: 8590911 - DNA, 22 bp, Homo sapiens
gaatgagtagagtataaacaaa

SEQ ID NO: 8590912 - DNA, 22 bp, Homo sapiens
gaatgagttaatatttgcttgg

SEQ ID NO: 8590913 - DNA, 22 bp, Homo sapiens
gacacagtcaagagtggaggaa

SEQ ID NO: 8590914 - DNA, 22 bp, Homo sapiens
gacagacactattggtatgcct

SEQ ID NO: 8590915 - DNA, 22 bp, Homo sapiens
gacagacacctggggggttgct

SEQ ID NO: 8590916 - DNA, 22 bp, Homo sapiens
gacagacacagggccatgattg

SEQ ID NO: 8590917 - DNA, 22 bp, Homo sapiens
gacagacaaatgtttttaactt

SEQ ID NO: 8590918 - DNA, 22 bp, Homo sapiens
gacagacacaattgatccatga

SEQ ID NO: 8590919 - DNA, 22 bp, Homo sapiens
gacagaaggcatctagggcacg

SEQ ID NO: 8590920 - DNA, 22 bp, Homo sapiens
gacagaaggcatctagggcacg

SEQ ID NO: 8590921 - DNA, 22 bp, Homo sapiens
gacagacagagaatgggcttga

SEQ ID NO: 8590922 - DNA, 22 bp, Homo sapiens
gacagacactgtgtcctcactt

SEQ ID NO: 8590923 - DNA, 22 bp, Homo sapiens
gacagacaggagctcacaggca

SEQ ID NO: 8590924 - DNA, 22 bp, Homo sapiens
gacagacaggaggcattcaggg

SEQ ID NO: 8590925 - DNA, 22 bp, Homo sapiens
gacagacaggggttctcctgga

SEQ ID NO: 8590926 - DNA, 22 bp, Homo sapiens
gacagacaggaggccacctgct

SEQ ID NO: 8590927 - DNA, 22 bp, Homo sapiens
gacagacaggtgtggtaggcac

SEQ ID NO: 8590928 - DNA, 22 bp, Homo sapiens
gacagacatgggacttcatact

SEQ ID NO: 8590929 - DNA, 22 bp, Homo sapiens
gaaggccattgcgtcctgggat

SEQ ID NO: 8590930 - DNA, 22 bp, Homo sapiens
gaaggccattagagcctgtgcc

SEQ ID NO: 8590931 - DNA, 22 bp, Homo sapiens
gaaggcagtaaatggctgtttt

SEQ ID NO: 8590932 - DNA, 22 bp, Homo sapiens
gaaggccacggaatggagctgg

SEQ ID NO: 8590933 - DNA, 22 bp, Homo sapiens
gaaggccacggaatggagctgg

SEQ ID NO: 8590934 - DNA, 22 bp, Homo sapiens
gaagcagggagcagtctttgca

SEQ ID NO: 8590935 - DNA, 22 bp, Homo sapiens
gaagcagctaggatcttcattt

SEQ ID NO: 8590936 - DNA, 22 bp, Homo sapiens
gagaaacaggaattgagtcgct

SEQ ID NO: 8590937 - DNA, 22 bp, Homo sapiens
gactgcagtaagcctcatgact

SEQ ID NO: 8590938 - DNA, 22 bp, Homo sapiens
gagaaagacgtaggctgggagg

SEQ ID NO: 8590939 - DNA, 22 bp, Homo sapiens
gagaaagaaagggaagtttgtt

SEQ ID NO: 8590940 - DNA, 22 bp, Homo sapiens
gagaaagatgtaggctgggagg

SEQ ID NO: 8590941 - DNA, 22 bp, Homo sapiens
gagaaagctaaataagttgatt

SEQ ID NO: 8590942 - DNA, 22 bp, Homo sapiens
gagacagatgctgctggagcat

SEQ ID NO: 8590943 - DNA, 22 bp, Homo sapiens
gagacagatgctgctggagcat

SEQ ID NO: 8590944 - DNA, 22 bp, Homo sapiens
gagaaaggcatccttggcttca

SEQ ID NO: 8590945 - DNA, 22 bp, Homo sapiens
gagagaaaagggggaattgatt

SEQ ID NO: 8590946 - DNA, 20 bp, Homo sapiens
gagactggatctggagagac

SEQ ID NO: 8590947 - DNA, 22 bp, Homo sapiens
gagacgtggcctttgcctgagc

SEQ ID NO: 8590948 - DNA, 22 bp, Homo sapiens
gagagaaaggcttgcaggctgt

SEQ ID NO: 8590949 - DNA, 22 bp, Homo sapiens
gagagaaatgtgcagtttgggc

SEQ ID NO: 8590950 - DNA, 22 bp, Homo sapiens
gagagaaattagttggtttgct

SEQ ID NO: 8590951 - DNA, 18 bp, Homo sapiens
gagagggatccctcagga

SEQ ID NO: 8590952 - DNA, 22 bp, Homo sapiens
gagagaacacaaagggccagct

SEQ ID NO: 8590953 - DNA, 22 bp, Homo sapiens
gagagggccgggggccagctcc

SEQ ID NO: 8590954 - DNA, 22 bp, Homo sapiens
gagagggcaaggtagatgctac

SEQ ID NO: 8590955 - DNA, 21 bp, Homo sapiens
gagagggcattataggaagtg

SEQ ID NO: 8590956 - DNA, 22 bp, Homo sapiens
gacagacatttcctgatccaat

SEQ ID NO: 8590957 - DNA, 22 bp, Homo sapiens
gacagcagacagcctggcccct

SEQ ID NO: 8590958 - DNA, 22 bp, Homo sapiens
gacagcagaaaacttttgtgct

SEQ ID NO: 8590959 - DNA, 22 bp, Homo sapiens
gacagcaagagacagagcatcc

SEQ ID NO: 8590960 - DNA, 22 bp, Homo sapiens
gacagcagcataatacatgaac

SEQ ID NO: 8590961 - DNA, 22 bp, Homo sapiens
gacagcagatgaagcctgcaga

SEQ ID NO: 8590962 - DNA, 22 bp, Homo sapiens
gactgagaatcatagaaggcaa

SEQ ID NO: 8590963 - DNA, 22 bp, Homo sapiens
gactcctgggcctctgagaggc

SEQ ID NO: 8590964 - DNA, 22 bp, Homo sapiens
gaccagctctctgaagaaagag

SEQ ID NO: 8590965 - DNA, 22 bp, Homo sapiens
gactccagtgattgtcctgtct

SEQ ID NO: 8590966 - DNA, 22 bp, Homo sapiens
gaggctgaatggccagaagcca

SEQ ID NO: 8590967 - DNA, 22 bp, Homo sapiens
gaggctgagagtttgttctact

SEQ ID NO: 8590968 - DNA, 22 bp, Homo sapiens
gaggctcagagggagcatggtc

SEQ ID NO: 8590969 - DNA, 22 bp, Homo sapiens
gaggcagcttggggctgtgggt

SEQ ID NO: 8590970 - DNA, 22 bp, Homo sapiens
gaggagcacatgaggctgaggg

SEQ ID NO: 8590971 - DNA, 22 bp, Homo sapiens
gaggagcacatgaggctgaggg

SEQ ID NO: 8590972 - DNA, 22 bp, Homo sapiens
gaggagccaggaggtctccctg

SEQ ID NO: 8590973 - DNA, 22 bp, Homo sapiens
gagggatctttaggcagcctca

SEQ ID NO: 8590974 - DNA, 22 bp, Homo sapiens
gagggagctggagcagacgccg

SEQ ID NO: 8590975 - DNA, 22 bp, Homo sapiens
gagggagccgccacagactggg

SEQ ID NO: 8590976 - DNA, 22 bp, Homo sapiens
gagctgctgtgaggggagcttc

SEQ ID NO: 8590977 - DNA, 23 bp, Homo sapiens
gaggaaagaatatagatgcaatc

SEQ ID NO: 8590978 - DNA, 22 bp, Homo sapiens
gaggaaagctggtttaaagtat

SEQ ID NO: 8590979 - DNA, 22 bp, Homo sapiens
gaggaacagagggcaaggccag

SEQ ID NO: 8590980 - DNA, 22 bp, Homo sapiens
gagctgagtatcccactgaagt

SEQ ID NO: 8590981 - DNA, 22 bp, Homo sapiens
gagctgagcttaactccttgaa

SEQ ID NO: 8590982 - DNA, 22 bp, Homo sapiens
gagctgaggccagagtcttctg

SEQ ID NO: 8590983 - DNA, 22 bp, Homo sapiens
gagctgagatcatgtacactag

SEQ ID NO: 8590984 - DNA, 22 bp, Homo sapiens
gagcagtggtcacagggaggga

SEQ ID NO: 8590985 - DNA, 22 bp, Homo sapiens
gagcagtgggaaggaacagggt

SEQ ID NO: 8590986 - DNA, 22 bp, Homo sapiens
gagcatctatgtgctgggtact

SEQ ID NO: 8590987 - DNA, 22 bp, Homo sapiens
gagcatctgatgagattggatt

SEQ ID NO: 8590988 - DNA, 22 bp, Homo sapiens
gagcatctctatagtgactgtg

SEQ ID NO: 8590989 - DNA, 22 bp, Homo sapiens
gagcatctggctagaggagtga

SEQ ID NO: 8590990 - DNA, 22 bp, Homo sapiens
gagcatggatcatgtgctgggt

SEQ ID NO: 8590991 - DNA, 22 bp, Homo sapiens
gagcaggcttgcagagaagggg

SEQ ID NO: 8590992 - DNA, 22 bp, Homo sapiens
gaaacagattaacagcatattt

SEQ ID NO: 8590993 - DNA, 22 bp, Homo sapiens
gaaagccatctggctgctggga

SEQ ID NO: 8590994 - DNA, 22 bp, Homo sapiens
gaaagccatagcccagctttac

SEQ ID NO: 8590995 - DNA, 18 bp, Homo sapiens
gaaagccatgcagcagtg

SEQ ID NO: 8590996 - DNA, 22 bp, Homo sapiens
cttctgggcattcagctgcaca

SEQ ID NO: 8590997 - DNA, 22 bp, Homo sapiens
ctgtggaaagagcctttggagg

SEQ ID NO: 8590998 - DNA, 21 bp, Homo sapiens
ctgtggaagggaactagaggg

SEQ ID NO: 8590999 - DNA, 19 bp, Homo sapiens
ctgtttctgagcttgcttt

SEQ ID NO: 8591000 - DNA, 22 bp, Homo sapiens
ctgtttctttgctgtcagagag

SEQ ID NO: 8591001 - DNA, 22 bp, Homo sapiens
cttacatactgagaaaatatcc

SEQ ID NO: 8591002 - DNA, 22 bp, Homo sapiens
cttaaagagtatttaatataat

SEQ ID NO: 8591003 - DNA, 22 bp, Homo sapiens
cttatatttgtcaactttacaa

SEQ ID NO: 8591004 - DNA, 22 bp, Homo sapiens
cttatacaccctcttcccaggc

SEQ ID NO: 8591005 - DNA, 20 bp, Homo sapiens
cttccacacaagaagcacag

SEQ ID NO: 8591006 - DNA, 22 bp, Homo sapiens
cttccaatagcaacaaagatta

SEQ ID NO: 8591007 - DNA, 22 bp, Homo sapiens
cttccaagatgaacagcaagcg

SEQ ID NO: 8591008 - DNA, 22 bp, Homo sapiens
cttccagagctgggctgacctt

SEQ ID NO: 8591009 - DNA, 22 bp, Homo sapiens
cttccagaggaactctgcagtg

SEQ ID NO: 8591010 - DNA, 22 bp, Homo sapiens
cttccagaggaactctgcagtg

SEQ ID NO: 8591011 - DNA, 22 bp, Homo sapiens
cttccaggacaccagggtagta

SEQ ID NO: 8591012 - DNA, 22 bp, Homo sapiens
cttctacacgtggctgtgccaa

SEQ ID NO: 8591013 - DNA, 22 bp, Homo sapiens
cttctacaggcccagcgagtgt

SEQ ID NO: 8591014 - DNA, 22 bp, Homo sapiens
cttctacacatccctcttgctt

SEQ ID NO: 8591015 - DNA, 22 bp, Homo sapiens
cttctacaaggttgtcctctat

SEQ ID NO: 8591016 - DNA, 22 bp, Homo sapiens
cttctagccttgatgactggga

SEQ ID NO: 8591017 - DNA, 22 bp, Homo sapiens
ctgtgctgggtgtgcttatgat

SEQ ID NO: 8591018 - DNA, 22 bp, Homo sapiens
ctgtgctctggcatcgctgcaa

SEQ ID NO: 8591019 - DNA, 22 bp, Homo sapiens
ctgtgccctgtggctggcacct

SEQ ID NO: 8591020 - DNA, 22 bp, Homo sapiens
ctgtgccctggccaggcctctc

SEQ ID NO: 8591021 - DNA, 22 bp, Homo sapiens
ctgtgccctggccaggcctctc

SEQ ID NO: 8591022 - DNA, 19 bp, Homo sapiens
ctgtcaggggctggatgtt

SEQ ID NO: 8591023 - DNA, 22 bp, Homo sapiens
ctgtcagcttctcctggccaga

SEQ ID NO: 8591024 - DNA, 20 bp, Homo sapiens
ctggggagcctcgcggtggc

SEQ ID NO: 8591025 - DNA, 22 bp, Homo sapiens
ctggtcagctgaagccccacac

SEQ ID NO: 8591026 - DNA, 22 bp, Homo sapiens
ctggtcagagcaactgctcaca

SEQ ID NO: 8591027 - DNA, 22 bp, Homo sapiens
ctggggacgtcgggcagtgttc

SEQ ID NO: 8591028 - DNA, 22 bp, Homo sapiens
ctggggagaagcgactcggctg

SEQ ID NO: 8591029 - DNA, 22 bp, Homo sapiens
ctggggaacgcagcgagcagcg

SEQ ID NO: 8591030 - DNA, 22 bp, Homo sapiens
ctgggctagaaggaccaggatg

SEQ ID NO: 8591031 - DNA, 22 bp, Homo sapiens
ctgggcgcgtcccctgaggcgg

SEQ ID NO: 8591032 - DNA, 22 bp, Homo sapiens
ctgggctgtttgttctggtctc

SEQ ID NO: 8591033 - DNA, 21 bp, Homo sapiens
ctgggctggcaggcattacct

SEQ ID NO: 8591034 - DNA, 22 bp, Homo sapiens
ctgggctggagtgcaatggcgc

SEQ ID NO: 8591035 - DNA, 22 bp, Homo sapiens
ctgggctcaaatcctatctcca

SEQ ID NO: 8591036 - DNA, 17 bp, Homo sapiens
ctgggatgtggactctt

SEQ ID NO: 8591037 - DNA, 22 bp, Homo sapiens
ctgggatgtgaggagcgcctct

SEQ ID NO: 8591038 - DNA, 22 bp, Homo sapiens
ctgggagcgcagcaggcacaac

SEQ ID NO: 8591039 - DNA, 22 bp, Homo sapiens
ctgggagcaagtcaggaaaggt

SEQ ID NO: 8591040 - DNA, 22 bp, Homo sapiens
ctgggcagctgtatcagggagt

SEQ ID NO: 8591041 - DNA, 22 bp, Homo sapiens
ctgggcagctgtatcagggagt

SEQ ID NO: 8591042 - DNA, 22 bp, Homo sapiens
ctgggaagaagggacaacagcg

SEQ ID NO: 8591043 - DNA, 22 bp, Homo sapiens
ctgggaagatggtgacagaatt

SEQ ID NO: 8591044 - DNA, 22 bp, Homo sapiens
ctgggactgccattcacagcca

SEQ ID NO: 8591045 - DNA, 22 bp, Homo sapiens
ctgggaccctgccctgtggcct

SEQ ID NO: 8591046 - DNA, 22 bp, Homo sapiens
ctgggacttgcagagcaggagg

SEQ ID NO: 8591047 - DNA, 22 bp, Homo sapiens
ctgggagatgactcagagcagg

SEQ ID NO: 8591048 - DNA, 22 bp, Homo sapiens
ctgggagattgaggccatggtg

SEQ ID NO: 8591049 - DNA, 22 bp, Homo sapiens
ccaggcttcctaatgtgtgcag

SEQ ID NO: 8591050 - DNA, 22 bp, Homo sapiens
tgaaacacaagcctggttagtg

SEQ ID NO: 8591051 - DNA, 22 bp, Homo sapiens
tctttggtttctgtctctgtaa

SEQ ID NO: 8591052 - DNA, 22 bp, Homo sapiens
tctttggttgcactgcaggtgt

SEQ ID NO: 8591053 - DNA, 22 bp, Homo sapiens
tcttttggaaatgatgtgcagg

SEQ ID NO: 8591054 - DNA, 22 bp, Homo sapiens
ccagggcagtgggagaaggtgc

SEQ ID NO: 8591055 - DNA, 22 bp, Homo sapiens
ccagggcatcctcacatcgcag

SEQ ID NO: 8591056 - DNA, 22 bp, Homo sapiens
ccagggcatcacatccagtgtt

SEQ ID NO: 8591057 - DNA, 22 bp, Homo sapiens
ccagggcatgggaagaactgaa

SEQ ID NO: 8591058 - DNA, 22 bp, Homo sapiens
ccagggctgagctgtgaccatg

SEQ ID NO: 8591059 - DNA, 22 bp, Homo sapiens
ccagggctctgcttctgccatg

SEQ ID NO: 8591060 - DNA, 22 bp, Homo sapiens
ccagggctccattgctcatcct

SEQ ID NO: 8591061 - DNA, 22 bp, Homo sapiens
ccagggcaacgctgtctcagag

SEQ ID NO: 8591062 - DNA, 22 bp, Homo sapiens
ccagggcaaatgagatcatagc

SEQ ID NO: 8591063 - DNA, 22 bp, Homo sapiens
ccagggcaattatttggagggt

SEQ ID NO: 8591064 - DNA, 22 bp, Homo sapiens
ccagggcaataggaacactttt

SEQ ID NO: 8591065 - DNA, 22 bp, Homo sapiens
ccagggcaacgctgtctcagag

SEQ ID NO: 8591066 - DNA, 22 bp, Homo sapiens
ccagggcacgttgggacagtac

SEQ ID NO: 8591067 - DNA, 22 bp, Homo sapiens
ccagggcagggaccacgtgtct

SEQ ID NO: 8591068 - DNA, 22 bp, Homo sapiens
ccagggcagtgggagaaggtgc

SEQ ID NO: 8591069 - DNA, 22 bp, Homo sapiens
ccagggcaggggctggagttca

SEQ ID NO: 8591070 - DNA, 22 bp, Homo sapiens
tgaaatgatgtacaagaaggca

SEQ ID NO: 8591071 - DNA, 22 bp, Homo sapiens
ccaggcagatgggccggcttca

SEQ ID NO: 8591072 - DNA, 22 bp, Homo sapiens
ccaggaggctctgactggaccc

SEQ ID NO: 8591073 - DNA, 22 bp, Homo sapiens
ccaggaggctctgcccatccca

SEQ ID NO: 8591074 - DNA, 22 bp, Homo sapiens
ccaggaggctcttgtccctggt

SEQ ID NO: 8591075 - DNA, 22 bp, Homo sapiens
ccaggaggcggaggttgcagtg

SEQ ID NO: 8591076 - DNA, 22 bp, Homo sapiens
ccaggaggcttcgtccgtggag

SEQ ID NO: 8591077 - DNA, 16 bp, Homo sapiens
ccaggaggctgacacc

SEQ ID NO: 8591078 - DNA, 22 bp, Homo sapiens
ccaggcaggcgatggtgcagtg

SEQ ID NO: 8591079 - DNA, 22 bp, Homo sapiens
tctgggctcacgagtctggaca

SEQ ID NO: 8591080 - DNA, 22 bp, Homo sapiens
tctgggctatatggtctctgct

SEQ ID NO: 8591081 - DNA, 22 bp, Homo sapiens
ccagcactctattgaatattct

SEQ ID NO: 8591082 - DNA, 22 bp, Homo sapiens
tctgggaggctgggtcccgtcc

SEQ ID NO: 8591083 - DNA, 20 bp, Homo sapiens
tctgggagggacaagtctcc

SEQ ID NO: 8591084 - DNA, 22 bp, Homo sapiens
ccaggagcaacttgaaggcaag

SEQ ID NO: 8591085 - DNA, 22 bp, Homo sapiens
ccaggagccctgccacaatggt

SEQ ID NO: 8591086 - DNA, 22 bp, Homo sapiens
ccaggagccactcaggcccaca

SEQ ID NO: 8591087 - DNA, 22 bp, Homo sapiens
ccaggagcagggctggctgcac

SEQ ID NO: 8591088 - DNA, 22 bp, Homo sapiens
ccaggagcagagtaggtgttca

SEQ ID NO: 8591089 - DNA, 22 bp, Homo sapiens
ccaggagcaggagctggacaga

SEQ ID NO: 8591090 - DNA, 22 bp, Homo sapiens
ccaggagcaggagctgcagctg

SEQ ID NO: 8591091 - DNA, 22 bp, Homo sapiens
ccaggagcagccggcccacctg

SEQ ID NO: 8591092 - DNA, 22 bp, Homo sapiens
ccaggagcagccggcccacctg

SEQ ID NO: 8591093 - DNA, 22 bp, Homo sapiens
ccaggaggcggaggttgcagcg

SEQ ID NO: 8591094 - DNA, 22 bp, Homo sapiens
ccaggagcctgggccaggctgg

SEQ ID NO: 8591095 - DNA, 22 bp, Homo sapiens
ccaggagcctgggccaggctgg

SEQ ID NO: 8591096 - DNA, 22 bp, Homo sapiens
tctgtggctatcatactgaagg

SEQ ID NO: 8591097 - DNA, 22 bp, Homo sapiens
tgagtcagtctgccctggcttc

SEQ ID NO: 8591098 - DNA, 22 bp, Homo sapiens
tgagtcagccagagctgccatg

SEQ ID NO: 8591099 - DNA, 22 bp, Homo sapiens
tgagtcagccttggcagcccct

SEQ ID NO: 8591100 - DNA, 22 bp, Homo sapiens
tgagtcagccagagctgccatg

SEQ ID NO: 8591101 - DNA, 22 bp, Homo sapiens
ccatcctgaatggtctcagcca

SEQ ID NO: 8591102 - DNA, 18 bp, Homo sapiens
tgaggctgagggtagagg

SEQ ID NO: 8591103 - DNA, 22 bp, Homo sapiens
tgaggctgagatatcagggagg

SEQ ID NO: 8591104 - DNA, 22 bp, Homo sapiens
tgaggctgacaaaagatgaggt

SEQ ID NO: 8591105 - DNA, 22 bp, Homo sapiens
tgaggccccgaagctgaggttt

SEQ ID NO: 8591106 - DNA, 21 bp, Homo sapiens
ccagtgctacagctgcctgac

SEQ ID NO: 8591107 - DNA, 22 bp, Homo sapiens
ccagtggaaatgtggtcaggat

SEQ ID NO: 8591108 - DNA, 22 bp, Homo sapiens
ccagtggacaatttctgaggaa

SEQ ID NO: 8591109 - DNA, 22 bp, Homo sapiens
ccagtgcgagcctgtgctggcc

SEQ ID NO: 8591110 - DNA, 22 bp, Homo sapiens
ccagtgcattgccgtgtctagg

SEQ ID NO: 8591111 - DNA, 22 bp, Homo sapiens
ccaggtgtgtcaccattgccca

SEQ ID NO: 8591112 - DNA, 17 bp, Homo sapiens
ccaggtgggaggtgggg

SEQ ID NO: 8591113 - DNA, 22 bp, Homo sapiens
ccaggtggcttctgcccgatgt

SEQ ID NO: 8591114 - DNA, 22 bp, Homo sapiens
ccaggtgggaggaaagcagaga

SEQ ID NO: 8591115 - DNA, 22 bp, Homo sapiens
ccaggtgggaggaaagcagaga

SEQ ID NO: 8591116 - DNA, 22 bp, Homo sapiens
ccaggtgggaggaaagcagaga

SEQ ID NO: 8591117 - DNA, 22 bp, Homo sapiens
ccaggtggaggtgtgaggtcct

SEQ ID NO: 8591118 - DNA, 22 bp, Homo sapiens
ccaggtggataaggtttctgga

SEQ ID NO: 8591119 - DNA, 22 bp, Homo sapiens
ccaggtggccctgccctactct

SEQ ID NO: 8591120 - DNA, 22 bp, Homo sapiens
ccaggtggacttgatttgaata

SEQ ID NO: 8591121 - DNA, 22 bp, Homo sapiens
ccaggtggaggtgtgaggtcct

SEQ ID NO: 8591122 - DNA, 22 bp, Homo sapiens
ccagtcagccaagctgcagcgg

SEQ ID NO: 8591123 - DNA, 22 bp, Homo sapiens
ccagtcagagcagcgctcgcat

SEQ ID NO: 8591124 - DNA, 22 bp, Homo sapiens
ccagtcagtcagttgctggcat

SEQ ID NO: 8591125 - DNA, 22 bp, Homo sapiens
ccagtcagggcaggagcctggt

SEQ ID NO: 8591126 - DNA, 22 bp, Homo sapiens
tgagcaggtgagtctagggcag

SEQ ID NO: 8591127 - DNA, 18 bp, Homo sapiens
tgagcaggggctgacctt

SEQ ID NO: 8591128 - DNA, 22 bp, Homo sapiens
tgatacacagatttacatcaat

SEQ ID NO: 8591129 - DNA, 22 bp, Homo sapiens
cccagagcctcattctgttggg

SEQ ID NO: 8591130 - DNA, 22 bp, Homo sapiens
cccagagatgggaggtgatcgg

SEQ ID NO: 8591131 - DNA, 22 bp, Homo sapiens
cccagagctccggtcctgccca

SEQ ID NO: 8591132 - DNA, 22 bp, Homo sapiens
cccagagctcagtgtgcaaggt

SEQ ID NO: 8591133 - DNA, 22 bp, Homo sapiens
cccagagctgagtctgatatat

SEQ ID NO: 8591134 - DNA, 22 bp, Homo sapiens
cccagagctgagggggcacgtt

SEQ ID NO: 8591135 - DNA, 22 bp, Homo sapiens
cccagagctgattgttggagcc

SEQ ID NO: 8591136 - DNA, 22 bp, Homo sapiens
cccagagctgggtgggcagcgg

SEQ ID NO: 8591137 - DNA, 22 bp, Homo sapiens
tgcactgatcctgaccagtgaa

SEQ ID NO: 8591138 - DNA, 22 bp, Homo sapiens
tgcagagagatcctcagggttt

SEQ ID NO: 8591139 - DNA, 22 bp, Homo sapiens
tgcaggaatagctacagagctg

SEQ ID NO: 8591140 - DNA, 22 bp, Homo sapiens
tgcagctgctcattctctcagt

SEQ ID NO: 8591141 - DNA, 22 bp, Homo sapiens
tgcaggaagtttcctgaacttt

SEQ ID NO: 8591142 - DNA, 22 bp, Homo sapiens
tgcagctgcctagggctggctt

SEQ ID NO: 8591143 - DNA, 22 bp, Homo sapiens
tgcaggaattttttgcagaaag

SEQ ID NO: 8591144 - DNA, 22 bp, Homo sapiens
tgcaggaatgaggttctcagtt

SEQ ID NO: 8591145 - DNA, 20 bp, Homo sapiens
tgcaggaatttgcattcctt

SEQ ID NO: 8591146 - DNA, 22 bp, Homo sapiens
tgcaggaatcagaggggaagcg

SEQ ID NO: 8591147 - DNA, 20 bp, Homo sapiens
tgcagggcctaaaaagggaa

SEQ ID NO: 8591148 - DNA, 22 bp, Homo sapiens
tgcagggccttctagaccatgg

SEQ ID NO: 8591149 - DNA, 22 bp, Homo sapiens
tgcagggccttgggatgtgtcc

SEQ ID NO: 8591150 - DNA, 22 bp, Homo sapiens
tgcagggccttctagaccatgg

SEQ ID NO: 8591151 - DNA, 22 bp, Homo sapiens
tgcagggccttgttgatgtgct

SEQ ID NO: 8591152 - DNA, 22 bp, Homo sapiens
tgcagggctaagtcagagcctg

SEQ ID NO: 8591153 - DNA, 22 bp, Homo sapiens
tgcagggccttgggtctttctt

SEQ ID NO: 8591154 - DNA, 22 bp, Homo sapiens
cccagcagggtctctgtgtcta

SEQ ID NO: 8591155 - DNA, 22 bp, Homo sapiens
cccagcaggtcggtgctgcctg

SEQ ID NO: 8591156 - DNA, 22 bp, Homo sapiens
cccagcaggaggaggttgcagt

SEQ ID NO: 8591157 - DNA, 22 bp, Homo sapiens
cccagcaggcatgttgggagga

SEQ ID NO: 8591158 - DNA, 22 bp, Homo sapiens
cccagcagcttgcacagtgctg

SEQ ID NO: 8591159 - DNA, 22 bp, Homo sapiens
cccagcagcttgcacagtgctg

SEQ ID NO: 8591160 - DNA, 22 bp, Homo sapiens
cccagcagcctggatgttcttt

SEQ ID NO: 8591161 - DNA, 22 bp, Homo sapiens
cccagcagccttgtcccttctc

SEQ ID NO: 8591162 - DNA, 22 bp, Homo sapiens
tgcaggcattggtgagagaagc

SEQ ID NO: 8591163 - DNA, 21 bp, Homo sapiens
tgcaggcaggcagagatgctg

SEQ ID NO: 8591164 - DNA, 22 bp, Homo sapiens
tggacatgtcttctccaagaaa

SEQ ID NO: 8591165 - DNA, 22 bp, Homo sapiens
tggacatgtccggccagacaat

SEQ ID NO: 8591166 - DNA, 22 bp, Homo sapiens
tggaaagaaagtaaaggcgtat

SEQ ID NO: 8591167 - DNA, 22 bp, Homo sapiens
tggaaactaagactagagagac

SEQ ID NO: 8591168 - DNA, 22 bp, Homo sapiens
tggaaactaggatggaagaaat

SEQ ID NO: 8591169 - DNA, 22 bp, Homo sapiens
tggaaactatagtcacaataga

SEQ ID NO: 8591170 - DNA, 22 bp, Homo sapiens
tggaggacgtgtccaccatgaa

SEQ ID NO: 8591171 - DNA, 22 bp, Homo sapiens
tggaggagaactccctggctac

SEQ ID NO: 8591172 - DNA, 22 bp, Homo sapiens
tggaggaagtggctggccagaa

SEQ ID NO: 8591173 - DNA, 22 bp, Homo sapiens
tggaggacaggactggacagcc

SEQ ID NO: 8591174 - DNA, 22 bp, Homo sapiens
tggcagggagccaccggtcatg

SEQ ID NO: 8591175 - DNA, 22 bp, Homo sapiens
tggcagggaatacagatgttta

SEQ ID NO: 8591176 - DNA, 19 bp, Homo sapiens
tggcagggagagtttgaag

SEQ ID NO: 8591177 - DNA, 19 bp, Homo sapiens
tggcaggcccaggatggac

SEQ ID NO: 8591178 - DNA, 22 bp, Homo sapiens
tggcacttggtaaatatgtgtt

SEQ ID NO: 8591179 - DNA, 22 bp, Homo sapiens
tgctgggggtgtctcaccaggc

SEQ ID NO: 8591180 - DNA, 22 bp, Homo sapiens
tgctgggggctttctggatacc

SEQ ID NO: 8591181 - DNA, 22 bp, Homo sapiens
tgctggggctctgaccactcca

SEQ ID NO: 8591182 - DNA, 22 bp, Homo sapiens
tgctggggctctgaccactcca

SEQ ID NO: 8591183 - DNA, 22 bp, Homo sapiens
tgctgggggctttctggatacc

SEQ ID NO: 8591184 - DNA, 22 bp, Homo sapiens
tgctgggggtagctctgcgtag

SEQ ID NO: 8591185 - DNA, 22 bp, Homo sapiens
ccccaggaagcctcagatttgc

SEQ ID NO: 8591186 - DNA, 22 bp, Homo sapiens
ccccaggaagcctcagatttgc

SEQ ID NO: 8591187 - DNA, 22 bp, Homo sapiens
tgctgggggttcagatgagtaa

SEQ ID NO: 8591188 - DNA, 18 bp, Homo sapiens
tgctggggtagaatccac

SEQ ID NO: 8591189 - DNA, 18 bp, Homo sapiens
tgctggggtagaatccac

SEQ ID NO: 8591190 - DNA, 23 bp, Homo sapiens
tgctggggtagtttgtggcacag

SEQ ID NO: 8591191 - DNA, 22 bp, Homo sapiens
cccagtggggaaatagctagct

SEQ ID NO: 8591192 - DNA, 22 bp, Homo sapiens
cccagtggggagcttctgcctt

SEQ ID NO: 8591193 - DNA, 22 bp, Homo sapiens
cccagtggggagctgaggttca

SEQ ID NO: 8591194 - DNA, 22 bp, Homo sapiens
cccagtgggtcactgcatctca

SEQ ID NO: 8591195 - DNA, 22 bp, Homo sapiens
cccagtggtttgcagaaccaag

SEQ ID NO: 8591196 - DNA, 22 bp, Homo sapiens
cccagtggtgctggcatctgtg

SEQ ID NO: 8591197 - DNA, 22 bp, Homo sapiens
cccagtggcttttgcccaggtt

SEQ ID NO: 8591198 - DNA, 22 bp, Homo sapiens
cccagttgttgccggctctgga

SEQ ID NO: 8591199 - DNA, 22 bp, Homo sapiens
tgctgggcactgtctaggtact

SEQ ID NO: 8591200 - DNA, 22 bp, Homo sapiens
tgctgggcaccagtgcctgcag

SEQ ID NO: 8591201 - DNA, 22 bp, Homo sapiens
tgcttcctatccacacaatgcc

SEQ ID NO: 8591202 - DNA, 22 bp, Homo sapiens
ccccaggagcttgttttagaga

SEQ ID NO: 8591203 - DNA, 22 bp, Homo sapiens
ccccaggagatttgggagcaca

SEQ ID NO: 8591204 - DNA, 22 bp, Homo sapiens
ccccaggacgtggccctcatag

SEQ ID NO: 8591205 - DNA, 16 bp, Homo sapiens
ccccaggacttggcac

SEQ ID NO: 8591206 - DNA, 16 bp, Homo sapiens
ccccaggacttggcac

SEQ ID NO: 8591207 - DNA, 22 bp, Homo sapiens
ccccaggacgtggccctcatag

SEQ ID NO: 8591208 - DNA, 22 bp, Homo sapiens
ccccaggacacatggaccaagt

SEQ ID NO: 8591209 - DNA, 22 bp, Homo sapiens
ccccaggacacatggaccaagt

SEQ ID NO: 8591210 - DNA, 22 bp, Homo sapiens
ccccaggagaaatcttaaacta

SEQ ID NO: 8591211 - DNA, 22 bp, Homo sapiens
ccccaggagatttgggagcaca

SEQ ID NO: 8591212 - DNA, 22 bp, Homo sapiens
tgctgcctttcaatgttgtcat

SEQ ID NO: 8591213 - DNA, 19 bp, Homo sapiens
tgctgcaggatgctgctgg

SEQ ID NO: 8591214 - DNA, 19 bp, Homo sapiens
tgctgcaggatgctgctgg

SEQ ID NO: 8591215 - DNA, 22 bp, Homo sapiens
tgctcaggtcgttctgcccctt

SEQ ID NO: 8591216 - DNA, 22 bp, Homo sapiens
cccagtggaaggagtagaagac

SEQ ID NO: 8591217 - DNA, 22 bp, Homo sapiens
cccagtggcccagcatgtggtg

SEQ ID NO: 8591218 - DNA, 22 bp, Homo sapiens
cccagtggagataggagtgtgg

SEQ ID NO: 8591219 - DNA, 22 bp, Homo sapiens
cccagtggcaaagcagcttaga

SEQ ID NO: 8591220 - DNA, 22 bp, Homo sapiens
cccagtggctgtccccatgggc

SEQ ID NO: 8591221 - DNA, 22 bp, Homo sapiens
tgctctgaaggaagagccccat

SEQ ID NO: 8591222 - DNA, 22 bp, Homo sapiens
tgctctgattggagtctgttgc

SEQ ID NO: 8591223 - DNA, 22 bp, Homo sapiens
tgctctgaggcacatgccatcg

SEQ ID NO: 8591224 - DNA, 22 bp, Homo sapiens
tgctagggaagaacgagggaat

SEQ ID NO: 8591225 - DNA, 22 bp, Homo sapiens
tgcagggctacaggactacaac

SEQ ID NO: 8591226 - DNA, 22 bp, Homo sapiens
tgcaggtgcctcttgagcttgt

SEQ ID NO: 8591227 - DNA, 22 bp, Homo sapiens
tgcaggtgccatcgctgctcat

SEQ ID NO: 8591228 - DNA, 22 bp, Homo sapiens
tgcaggtgcgttttcaagcctc

SEQ ID NO: 8591229 - DNA, 22 bp, Homo sapiens
tgcaggtgctacaagaactcac

SEQ ID NO: 8591230 - DNA, 22 bp, Homo sapiens
tgcaggtgctgatacctactcc

SEQ ID NO: 8591231 - DNA, 22 bp, Homo sapiens
tgcaggtgctccgggggtgccc

SEQ ID NO: 8591232 - DNA, 22 bp, Homo sapiens
tgcaggtgctgtgtcaagagag

SEQ ID NO: 8591233 - DNA, 22 bp, Homo sapiens
tggcttggtgagcagagtgtag

SEQ ID NO: 8591234 - DNA, 22 bp, Homo sapiens
tggcttccccggagtgacatgt

SEQ ID NO: 8591235 - DNA, 20 bp, Homo sapiens
cctcctggtcaggtgtgcag

SEQ ID NO: 8591236 - DNA, 22 bp, Homo sapiens
tgggacagggaatctgatcccc

SEQ ID NO: 8591237 - DNA, 22 bp, Homo sapiens
tgggacagagtgagctttggcc

SEQ ID NO: 8591238 - DNA, 22 bp, Homo sapiens
tgggacaggaggcctctggaga

SEQ ID NO: 8591239 - DNA, 22 bp, Homo sapiens
tgggagagcactgcagccccgg

SEQ ID NO: 8591240 - DNA, 19 bp, Homo sapiens
tggcaggtagtgagcagtc

SEQ ID NO: 8591241 - DNA, 22 bp, Homo sapiens
tggcagtgggaagctggaagtc

SEQ ID NO: 8591242 - DNA, 22 bp, Homo sapiens
tggcagtgtcttatcaggagtg

SEQ ID NO: 8591243 - DNA, 22 bp, Homo sapiens
tggcagtgtcttgctggggcag

SEQ ID NO: 8591244 - DNA, 22 bp, Homo sapiens
tggccaagccactgctgggtct

SEQ ID NO: 8591245 - DNA, 22 bp, Homo sapiens
tggccacaaagagaacgaggtc

SEQ ID NO: 8591246 - DNA, 22 bp, Homo sapiens
tggccacaaagagaacgaggtc

SEQ ID NO: 8591247 - DNA, 22 bp, Homo sapiens
cctccagggcccctctcactgg

SEQ ID NO: 8591248 - DNA, 21 bp, Homo sapiens
cctccaggtgattccgtgctc

SEQ ID NO: 8591249 - DNA, 22 bp, Homo sapiens
cctccagggcccctctcactgg

SEQ ID NO: 8591250 - DNA, 22 bp, Homo sapiens
tgggcaggataatatctcatgt

SEQ ID NO: 8591251 - DNA, 22 bp, Homo sapiens
tgggcaggatgcgttgattctt

SEQ ID NO: 8591252 - DNA, 22 bp, Homo sapiens
tgggcaggcaagtgaatacctt

SEQ ID NO: 8591253 - DNA, 22 bp, Homo sapiens
tgggctccagcacctgtgctct

SEQ ID NO: 8591254 - DNA, 23 bp, Homo sapiens
tggggagagttaccctggaagcg

SEQ ID NO: 8591255 - DNA, 22 bp, Homo sapiens
cctgcaggctgcaggccagttc

SEQ ID NO: 8591256 - DNA, 22 bp, Homo sapiens
cctgccagaaaagagggagttc

SEQ ID NO: 8591257 - DNA, 22 bp, Homo sapiens
tgggtcagtttgggggccagcc

SEQ ID NO: 8591258 - DNA, 22 bp, Homo sapiens
cctgcaggtccccggatgcgca

SEQ ID NO: 8591259 - DNA, 22 bp, Homo sapiens
cctgcaggggagagacttctag

SEQ ID NO: 8591260 - DNA, 22 bp, Homo sapiens
cctgccctgtgtttggggacta

SEQ ID NO: 8591261 - DNA, 22 bp, Homo sapiens
cctgcctgcaaaatgggacaag

SEQ ID NO: 8591262 - DNA, 22 bp, Homo sapiens
tacccaggaggaaactgaggct

SEQ ID NO: 8591263 - DNA, 22 bp, Homo sapiens
tagaaatgttggtattaacatt

SEQ ID NO: 8591264 - DNA, 22 bp, Homo sapiens
cagggagaggctggtggagtaa

SEQ ID NO: 8591265 - DNA, 22 bp, Homo sapiens
tagacatattgtatttacttaa

SEQ ID NO: 8591266 - DNA, 22 bp, Homo sapiens
tagacatagtttttatgactta

SEQ ID NO: 8591267 - DNA, 22 bp, Homo sapiens
tagacagggtggcttagaaaca

SEQ ID NO: 8591268 - DNA, 22 bp, Homo sapiens
tagacaggagtcaggctagaat

SEQ ID NO: 8591269 - DNA, 22 bp, Homo sapiens
tagcataacaggtaagagtgag

SEQ ID NO: 8591270 - DNA, 22 bp, Homo sapiens
tagcattagagatagaaatagt

SEQ ID NO: 8591271 - DNA, 22 bp, Homo sapiens
tagcattaaaggtaagacatta

SEQ ID NO: 8591272 - DNA, 22 bp, Homo sapiens
cagggcaggacagatacattac

SEQ ID NO: 8591273 - DNA, 22 bp, Homo sapiens
cagggccaagcccctttggctg

SEQ ID NO: 8591274 - DNA, 22 bp, Homo sapiens
cagggcagttttacttctctct

SEQ ID NO: 8591275 - DNA, 22 bp, Homo sapiens
cagggcataagatgaggctgta

SEQ ID NO: 8591276 - DNA, 22 bp, Homo sapiens
cagggcagtaccgccctctggc

SEQ ID NO: 8591277 - DNA, 22 bp, Homo sapiens
cagggcaggacagatacattac

SEQ ID NO: 8591278 - DNA, 22 bp, Homo sapiens
cagggcagtgaagaacacacgt

SEQ ID NO: 8591279 - DNA, 22 bp, Homo sapiens
cagggcagtttgtgcctatgag

SEQ ID NO: 8591280 - DNA, 22 bp, Homo sapiens
cagggatgctgcttaggcagtt

SEQ ID NO: 8591281 - DNA, 22 bp, Homo sapiens
tagcagcacagaaagcctggag

SEQ ID NO: 8591282 - DNA, 22 bp, Homo sapiens
tacacagaggctgatgtcttag

SEQ ID NO: 8591283 - DNA, 22 bp, Homo sapiens
tacagacatttactccactcct

SEQ ID NO: 8591284 - DNA, 22 bp, Homo sapiens
caggccctgccttggcatgtgt

SEQ ID NO: 8591285 - DNA, 22 bp, Homo sapiens
caggccacgccccggcgtgtga

SEQ ID NO: 8591286 - DNA, 22 bp, Homo sapiens
caggctccttcccagggatggt

SEQ ID NO: 8591287 - DNA, 22 bp, Homo sapiens
tacagcctccacaggccaagtg

SEQ ID NO: 8591288 - DNA, 22 bp, Homo sapiens
tacagcctcgaactcctgcatt

SEQ ID NO: 8591289 - DNA, 22 bp, Homo sapiens
tacagcctcttccctggagtgg

SEQ ID NO: 8591290 - DNA, 22 bp, Homo sapiens
caggcctgtgagttgaggcccc

SEQ ID NO: 8591291 - DNA, 22 bp, Homo sapiens
caggcctgtgagttgaggcccc

SEQ ID NO: 8591292 - DNA, 22 bp, Homo sapiens
caggtggggcgccctcaggcag

SEQ ID NO: 8591293 - DNA, 22 bp, Homo sapiens
caggtggggagagtgtggagca

SEQ ID NO: 8591294 - DNA, 22 bp, Homo sapiens
caggtggggcagctgtgggagc

SEQ ID NO: 8591295 - DNA, 22 bp, Homo sapiens
caggtgggcttgggagaacact

SEQ ID NO: 8591296 - DNA, 22 bp, Homo sapiens
caggtggcttattagggtcagt

SEQ ID NO: 8591297 - DNA, 22 bp, Homo sapiens
caggtgggcgtggcgagaaggc

SEQ ID NO: 8591298 - DNA, 22 bp, Homo sapiens
tatgaacattttggtatatatg

SEQ ID NO: 8591299 - DNA, 22 bp, Homo sapiens
tatgatattctaaattgacacc

SEQ ID NO: 8591300 - DNA, 22 bp, Homo sapiens
tatatacaaggtaggtttaggt

SEQ ID NO: 8591301 - DNA, 22 bp, Homo sapiens
tatattcaatgattagtatcag

SEQ ID NO: 8591302 - DNA, 22 bp, Homo sapiens
tatattcattttaaagccatct

SEQ ID NO: 8591303 - DNA, 22 bp, Homo sapiens
cagggctgctggccgtgccctc

SEQ ID NO: 8591304 - DNA, 22 bp, Homo sapiens
cagggctggatcctccagactc

SEQ ID NO: 8591305 - DNA, 22 bp, Homo sapiens
tagtacagagacactggaggaa

SEQ ID NO: 8591306 - DNA, 22 bp, Homo sapiens
tagtacagtactgggctctagt

SEQ ID NO: 8591307 - DNA, 22 bp, Homo sapiens
cagggccacacggaagggaaca

SEQ ID NO: 8591308 - DNA, 21 bp, Homo sapiens
cagggccaatcctgacctcta

SEQ ID NO: 8591309 - DNA, 22 bp, Homo sapiens
cagggccaagttggtgcctttt

SEQ ID NO: 8591310 - DNA, 22 bp, Homo sapiens
cagggccaagctgcagcatctg

SEQ ID NO: 8591311 - DNA, 22 bp, Homo sapiens
cagggccaccgtgtttgctgct

SEQ ID NO: 8591312 - DNA, 22 bp, Homo sapiens
cagggccaccctctgctgggtg

SEQ ID NO: 8591313 - DNA, 20 bp, Homo sapiens
cagggccacgctccaaggca

SEQ ID NO: 8591314 - DNA, 22 bp, Homo sapiens
cagtctggactcaggcatacct

SEQ ID NO: 8591315 - DNA, 22 bp, Homo sapiens
cagtctggactcaggcatacct

SEQ ID NO: 8591316 - DNA, 22 bp, Homo sapiens
cagtctggaggtcagctggctt

SEQ ID NO: 8591317 - DNA, 22 bp, Homo sapiens
cagtctggatctgtgctgctgt

SEQ ID NO: 8591318 - DNA, 22 bp, Homo sapiens
cagtctggcacagcacactgaa

SEQ ID NO: 8591319 - DNA, 22 bp, Homo sapiens
cagtctggcacagcacactgaa

SEQ ID NO: 8591320 - DNA, 22 bp, Homo sapiens
tcaaaggaatttgattttgatg

SEQ ID NO: 8591321 - DNA, 21 bp, Homo sapiens
tcaaagcacatatttgcacat

SEQ ID NO: 8591322 - DNA, 22 bp, Homo sapiens
cagtagcatgcaccaggagggt

SEQ ID NO: 8591323 - DNA, 22 bp, Homo sapiens
cagtgggtcctgcgtctgccag

SEQ ID NO: 8591324 - DNA, 22 bp, Homo sapiens
cagtgggtgagaggaaaagctt

SEQ ID NO: 8591325 - DNA, 22 bp, Homo sapiens
cagtgggtgaaagatggctaag

SEQ ID NO: 8591326 - DNA, 22 bp, Homo sapiens
cagtggtttaggtcaaggggag

SEQ ID NO: 8591327 - DNA, 22 bp, Homo sapiens
cagtggcagagaacagagacct

SEQ ID NO: 8591328 - DNA, 22 bp, Homo sapiens
cagtggcaatgggacagagcac

SEQ ID NO: 8591329 - DNA, 22 bp, Homo sapiens
cagtggcaatgggacagagcac

SEQ ID NO: 8591330 - DNA, 22 bp, Homo sapiens
tcactgcaacctccacctcctg

SEQ ID NO: 8591331 - DNA, 22 bp, Homo sapiens
cagtggattagccagagctgga

SEQ ID NO: 8591332 - DNA, 22 bp, Homo sapiens
cagtggattaaggagggcagct

SEQ ID NO: 8591333 - DNA, 22 bp, Homo sapiens
cagtggaggccttgggaccttt

SEQ ID NO: 8591334 - DNA, 22 bp, Homo sapiens
cagtggaggctcaagtgtgctt

SEQ ID NO: 8591335 - DNA, 22 bp, Homo sapiens
cagtggagtgggactggtctga

SEQ ID NO: 8591336 - DNA, 19 bp, Homo sapiens
cagtggagattggaggagg

SEQ ID NO: 8591337 - DNA, 22 bp, Homo sapiens
cattttggctattgtaaatagt

SEQ ID NO: 8591338 - DNA, 22 bp, Homo sapiens
tcctgaggctcactttgaatgt

SEQ ID NO: 8591339 - DNA, 22 bp, Homo sapiens
tcctgagggcgattcagcaggt

SEQ ID NO: 8591340 - DNA, 22 bp, Homo sapiens
cattttatgtttatggagtgct

SEQ ID NO: 8591341 - DNA, 22 bp, Homo sapiens
catttattggcatgtagtaggt

SEQ ID NO: 8591342 - DNA, 22 bp, Homo sapiens
catttccacttctgaaaactgg

SEQ ID NO: 8591343 - DNA, 21 bp, Homo sapiens
catttcatgattatagaaatg

SEQ ID NO: 8591344 - DNA, 22 bp, Homo sapiens
catttcattcctttgaaagtgg

SEQ ID NO: 8591345 - DNA, 22 bp, Homo sapiens
catttcatagttgtcacaataa

SEQ ID NO: 8591346 - DNA, 22 bp, Homo sapiens
ccacagggcacagacaggaagc

SEQ ID NO: 8591347 - DNA, 22 bp, Homo sapiens
tcctggctaacacggtgacacc

SEQ ID NO: 8591348 - DNA, 22 bp, Homo sapiens
tcctgccttgcctgggacatca

SEQ ID NO: 8591349 - DNA, 22 bp, Homo sapiens
tcctgccttgcctgggacatca

SEQ ID NO: 8591350 - DNA, 22 bp, Homo sapiens
tcctgccttcatactgctgtat

SEQ ID NO: 8591351 - DNA, 21 bp, Homo sapiens
tcctgccttagtccagagcag

SEQ ID NO: 8591352 - DNA, 22 bp, Homo sapiens
tcctgccttagagcaaggaaaa

SEQ ID NO: 8591353 - DNA, 23 bp, Homo sapiens
ccaagactgttaggagtggggag

SEQ ID NO: 8591354 - DNA, 22 bp, Homo sapiens
tcctgagggctgcagtcatagg

SEQ ID NO: 8591355 - DNA, 23 bp, Homo sapiens
tcctgagggtttcccagccttgg

SEQ ID NO: 8591356 - DNA, 22 bp, Homo sapiens
tcctgaggtatatgctttgcag

SEQ ID NO: 8591357 - DNA, 22 bp, Homo sapiens
tcctgaggtgctcagccaggaa

SEQ ID NO: 8591358 - DNA, 22 bp, Homo sapiens
tcctgaggtgctcagccaggaa

SEQ ID NO: 8591359 - DNA, 22 bp, Homo sapiens
tcctgaggtggattgagcagag

SEQ ID NO: 8591360 - DNA, 22 bp, Homo sapiens
tcctgaggtggattgagcagag

SEQ ID NO: 8591361 - DNA, 22 bp, Homo sapiens
tcctgaggtggattgagcagag

SEQ ID NO: 8591362 - DNA, 22 bp, Homo sapiens
ccagagggagccaccagggtgt

SEQ ID NO: 8591363 - DNA, 22 bp, Homo sapiens
ccagagggaagaggaagcgctg

SEQ ID NO: 8591364 - DNA, 22 bp, Homo sapiens
ccagaggctggcagccagctga

SEQ ID NO: 8591365 - DNA, 22 bp, Homo sapiens
ccagagagggcgccacctggag

SEQ ID NO: 8591366 - DNA, 22 bp, Homo sapiens
ccagagggcaaaatgaagctta

SEQ ID NO: 8591367 - DNA, 20 bp, Homo sapiens
ccagagggtagggccgcccc

SEQ ID NO: 8591368 - DNA, 22 bp, Homo sapiens
ccagaggggctgagcaggtcac

SEQ ID NO: 8591369 - DNA, 18 bp, Homo sapiens
ccagagggtgcgtcagct

SEQ ID NO: 8591370 - DNA, 18 bp, Homo sapiens
ccagagggtgcgtcagct

SEQ ID NO: 8591371 - DNA, 22 bp, Homo sapiens
ccagatttgagcgtcttaaacc

SEQ ID NO: 8591372 - DNA, 22 bp, Homo sapiens
tctctgtaaggaagaattagat

SEQ ID NO: 8591373 - DNA, 22 bp, Homo sapiens
tctctgtagggctgcttgagta

SEQ ID NO: 8591374 - DNA, 18 bp, Homo sapiens
ccacccagggggagagga

SEQ ID NO: 8591375 - DNA, 22 bp, Homo sapiens
tctagaaagtactagagctggt

SEQ ID NO: 8591376 - DNA, 22 bp, Homo sapiens
tctcaggaatagagtggcagca

SEQ ID NO: 8591377 - DNA, 22 bp, Homo sapiens
tctcaggaaaaatccctagctt

SEQ ID NO: 8591378 - DNA, 22 bp, Homo sapiens
tctcaggagccacagcgggagt

SEQ ID NO: 8591379 - DNA, 22 bp, Homo sapiens
tctcaggagtagtgggatccat

SEQ ID NO: 8591380 - DNA, 22 bp, Homo sapiens
tctcaggactttgggaagctca

SEQ ID NO: 8591381 - DNA, 22 bp, Homo sapiens
tccagcagaaaagaggtaggga

SEQ ID NO: 8591382 - DNA, 22 bp, Homo sapiens
tccagcagaaccagagacctgg

SEQ ID NO: 8591383 - DNA, 22 bp, Homo sapiens
catgtaaagaatttcacacaag

SEQ ID NO: 8591384 - DNA, 20 bp, Homo sapiens
catggtggaggagcagggcc

SEQ ID NO: 8591385 - DNA, 22 bp, Homo sapiens
tccagagtttgagtctccttcc

SEQ ID NO: 8591386 - DNA, 22 bp, Homo sapiens
tccaagatctacagcagtttag

SEQ ID NO: 8591387 - DNA, 22 bp, Homo sapiens
tccaagagttcaaggctacagt

SEQ ID NO: 8591388 - DNA, 22 bp, Homo sapiens
catgctgggtaaaggtggtgaa

SEQ ID NO: 8591389 - DNA, 22 bp, Homo sapiens
tccaggcttgagaccaggctct

SEQ ID NO: 8591390 - DNA, 22 bp, Homo sapiens
tccaggctttggggcaggagcg

SEQ ID NO: 8591391 - DNA, 22 bp, Homo sapiens
catgtggcacaaagaaggaaat

SEQ ID NO: 8591392 - DNA, 22 bp, Homo sapiens
tccaggctttttcatgctgtct

SEQ ID NO: 8591393 - DNA, 22 bp, Homo sapiens
catgtgtcaaatgatgtagctg

SEQ ID NO: 8591394 - DNA, 19 bp, Homo sapiens
catgtgtcaatactgtacc

SEQ ID NO: 8591395 - DNA, 22 bp, Homo sapiens
catgtgtcacagccttttattg

SEQ ID NO: 8591396 - DNA, 20 bp, Homo sapiens
catgtgtcagttctcaccca

SEQ ID NO: 8591397 - DNA, 22 bp, Homo sapiens
catgtgggaagaggccagctgg

SEQ ID NO: 8591398 - DNA, 22 bp, Homo sapiens
tccaggctgggctgaagggtgc

SEQ ID NO: 8591399 - DNA, 22 bp, Homo sapiens
tccaggctgtgcatgagtttag

SEQ ID NO: 8591400 - DNA, 22 bp, Homo sapiens
tccaggctcctgactttttggg

SEQ ID NO: 8591401 - DNA, 22 bp, Homo sapiens
tccaggcttcacgtctgccctc

SEQ ID NO: 8591402 - DNA, 22 bp, Homo sapiens
tccaggctgtgcgcaccgtgtg

SEQ ID NO: 8591403 - DNA, 22 bp, Homo sapiens
cattacaaccccaaattacaaa

SEQ ID NO: 8591404 - DNA, 22 bp, Homo sapiens
cattacaaacatgttaagattt

SEQ ID NO: 8591405 - DNA, 22 bp, Homo sapiens
tccaggggtgatttttgacttg

SEQ ID NO: 8591406 - DNA, 22 bp, Homo sapiens
tccagggtgtgtttactggggt

SEQ ID NO: 8591407 - DNA, 22 bp, Homo sapiens
tccagggcatggggagagagtg

SEQ ID NO: 8591408 - DNA, 22 bp, Homo sapiens
tccaggggacactgtttctcca

SEQ ID NO: 8591409 - DNA, 19 bp, Homo sapiens
tccaggggctccacctcct

SEQ ID NO: 8591410 - DNA, 21 bp, Homo sapiens
tccaggggccagcacccaagc

SEQ ID NO: 8591411 - DNA, 22 bp, Homo sapiens
tccaggggagactagacccaca

SEQ ID NO: 8591412 - DNA, 22 bp, Homo sapiens
tcacttattgctcatctcatgc

SEQ ID NO: 8591413 - DNA, 22 bp, Homo sapiens
tcaggaagttttgaatcaactg

SEQ ID NO: 8591414 - DNA, 22 bp, Homo sapiens
cagtggttttcagctgggagtt

SEQ ID NO: 8591415 - DNA, 22 bp, Homo sapiens
tcaggaggccaccaggacctgt

SEQ ID NO: 8591416 - DNA, 22 bp, Homo sapiens
tcaggaggccggcaggatttga

SEQ ID NO: 8591417 - DNA, 22 bp, Homo sapiens
tcaggaggccgtgtgctcagtg

SEQ ID NO: 8591418 - DNA, 22 bp, Homo sapiens
tcaggaggcctgagtagctcta

SEQ ID NO: 8591419 - DNA, 22 bp, Homo sapiens
tcaggaggcggaggttgcagtg

SEQ ID NO: 8591420 - DNA, 22 bp, Homo sapiens
tcaggaggcgtctcgctggggc

SEQ ID NO: 8591421 - DNA, 22 bp, Homo sapiens
tcaggaggcggtgctgcctttg

SEQ ID NO: 8591422 - DNA, 22 bp, Homo sapiens
tcaggaggctcaagacctggca

SEQ ID NO: 8591423 - DNA, 22 bp, Homo sapiens
tcaggaggcgtgctggggtaca

SEQ ID NO: 8591424 - DNA, 21 bp, Homo sapiens
tcaggaggctcagactcctgc

SEQ ID NO: 8591425 - DNA, 18 bp, Homo sapiens
tcaggctgccctgtgtct

SEQ ID NO: 8591426 - DNA, 22 bp, Homo sapiens
catcaggaaaaaactggagcca

SEQ ID NO: 8591427 - DNA, 22 bp, Homo sapiens
catcaggaataaatgaggctgt

SEQ ID NO: 8591428 - DNA, 22 bp, Homo sapiens
tcatacaaggagggtgttcaaa

SEQ ID NO: 8591429 - DNA, 22 bp, Homo sapiens
ttttacttcattcctgacttca

SEQ ID NO: 8591430 - DNA, 22 bp, Homo sapiens
ttttattgggagtcctctactg

SEQ ID NO: 8591431 - DNA, 22 bp, Homo sapiens
ttttattgggagtcctctactg

SEQ ID NO: 8591432 - DNA, 22 bp, Homo sapiens
ttttattgggagtcctctactg

SEQ ID NO: 8591433 - DNA, 22 bp, Homo sapiens
ttttattggtaatgataaaagt

SEQ ID NO: 8591434 - DNA, 22 bp, Homo sapiens
ttttattggtaatgataaaagt

SEQ ID NO: 8591435 - DNA, 22 bp, Homo sapiens
ttttattggtaatgataaaagt

SEQ ID NO: 8591436 - DNA, 16 bp, Homo sapiens
ttttattgtgacagcc

SEQ ID NO: 8591437 - DNA, 16 bp, Homo sapiens
ttttattgtgacagcc

SEQ ID NO: 8591438 - DNA, 16 bp, Homo sapiens
ttttattgtgacagcc

SEQ ID NO: 8591439 - DNA, 22 bp, Homo sapiens
ttttattgtctgtattgcctat

SEQ ID NO: 8591440 - DNA, 22 bp, Homo sapiens
ttttattgtctgtattgcctat

SEQ ID NO: 8591441 - DNA, 22 bp, Homo sapiens
ttttattgtctgtattgcctat

SEQ ID NO: 8591442 - DNA, 22 bp, Homo sapiens
ttttattgtctcccagttctgg

SEQ ID NO: 8591443 - DNA, 22 bp, Homo sapiens
ttttattgtcaatgaagacaga

SEQ ID NO: 8591444 - DNA, 22 bp, Homo sapiens
ttttattgtcaatgaagacaga

SEQ ID NO: 8591445 - DNA, 22 bp, Homo sapiens
ttttattgtcaatgaagacaga

SEQ ID NO: 8591446 - DNA, 22 bp, Homo sapiens
ttttattgtctcccagttctgg

SEQ ID NO: 8591447 - DNA, 22 bp, Homo sapiens
ttttattgtctcccagttctgg

SEQ ID NO: 8591448 - DNA, 22 bp, Homo sapiens
ttttacaagctgagtcgttaaa

SEQ ID NO: 8591449 - DNA, 22 bp, Homo sapiens
ttttacaagctgagtcgttaaa

SEQ ID NO: 8591450 - DNA, 22 bp, Homo sapiens
ttttgtgtgtggtgatacaaag

SEQ ID NO: 8591451 - DNA, 22 bp, Homo sapiens
ttttttatctatggtagtacca

SEQ ID NO: 8591452 - DNA, 22 bp, Homo sapiens
ttttttatatcaactgaagtct

SEQ ID NO: 8591453 - DNA, 22 bp, Homo sapiens
ttttttatagcaatgaacccac

SEQ ID NO: 8591454 - DNA, 22 bp, Homo sapiens
ttttggtacatgcaatagcaat

SEQ ID NO: 8591455 - DNA, 22 bp, Homo sapiens
ttttggtcaacagtacatgcgg

SEQ ID NO: 8591456 - DNA, 20 bp, Homo sapiens
ttttggtcttcagacaaggc

SEQ ID NO: 8591457 - DNA, 22 bp, Homo sapiens
ttttggtctgtagagtgactct

SEQ ID NO: 8591458 - DNA, 22 bp, Homo sapiens
ttttggtctccaagccatgtgt

SEQ ID NO: 8591459 - DNA, 22 bp, Homo sapiens
ttttggtcaggttggtctcgaa

SEQ ID NO: 8591460 - DNA, 21 bp, Homo sapiens
ttttggtcctggcttaggagc

SEQ ID NO: 8591461 - DNA, 22 bp, Homo sapiens
ttttggtcagtgtactgggctg

SEQ ID NO: 8591462 - DNA, 22 bp, Homo sapiens
ttttggtttggctccaaatagg

SEQ ID NO: 8591463 - DNA, 22 bp, Homo sapiens
tttctattctggatctgtggca

SEQ ID NO: 8591464 - DNA, 22 bp, Homo sapiens
tttgcttcacaagtatggttct

SEQ ID NO: 8591465 - DNA, 22 bp, Homo sapiens
tttggcaggtggcagctctggg

SEQ ID NO: 8591466 - DNA, 22 bp, Homo sapiens
tttggctcggctgctgatggtg

SEQ ID NO: 8591467 - DNA, 23 bp, Homo sapiens
tttggctccatgggtggctcatt

SEQ ID NO: 8591468 - DNA, 22 bp, Homo sapiens
tttggctcccacagattgcttt

SEQ ID NO: 8591469 - DNA, 19 bp, Homo sapiens
tttggctctggtcagagag

SEQ ID NO: 8591470 - DNA, 22 bp, Homo sapiens
tttggctctggttctggctcca

SEQ ID NO: 8591471 - DNA, 18 bp, Homo sapiens
tttagtggtgcatttgac

SEQ ID NO: 8591472 - DNA, 22 bp, Homo sapiens
tttatctgttcctcttggaggc

SEQ ID NO: 8591473 - DNA, 22 bp, Homo sapiens
tttatctttaggactttgcaga

SEQ ID NO: 8591474 - DNA, 22 bp, Homo sapiens
tttattggaacacagccatgac

SEQ ID NO: 8591475 - DNA, 22 bp, Homo sapiens
tttattggaacacagccatgac

SEQ ID NO: 8591476 - DNA, 22 bp, Homo sapiens
tttattgctgtgttagggacag

SEQ ID NO: 8591477 - DNA, 22 bp, Homo sapiens
tttattggatggatggatggat

SEQ ID NO: 8591478 - DNA, 22 bp, Homo sapiens
tttattggatatttacaagata

SEQ ID NO: 8591479 - DNA, 22 bp, Homo sapiens
tttattggatatttacaagata

SEQ ID NO: 8591480 - DNA, 22 bp, Homo sapiens
tttattggatgggtcagctcta

SEQ ID NO: 8591481 - DNA, 20 bp, Homo sapiens
tttattggcctttcaggaac

SEQ ID NO: 8591482 - DNA, 22 bp, Homo sapiens
tttatttataagccacttgctg

SEQ ID NO: 8591483 - DNA, 22 bp, Homo sapiens
tttattgtgttgaaactgaatt

SEQ ID NO: 8591484 - DNA, 22 bp, Homo sapiens
tttattgggcctggaggatcta

SEQ ID NO: 8591485 - DNA, 22 bp, Homo sapiens
tttattgggtgcagtgcccaca

SEQ ID NO: 8591486 - DNA, 22 bp, Homo sapiens
tttattgccctgtagtacagga

SEQ ID NO: 8591487 - DNA, 22 bp, Homo sapiens
tttacagagagagaactggact

SEQ ID NO: 8591488 - DNA, 19 bp, Homo sapiens
tttacaagttctttgtatg

SEQ ID NO: 8591489 - DNA, 21 bp, Homo sapiens
ttgttcttccagaagcaaagt

SEQ ID NO: 8591490 - DNA, 22 bp, Homo sapiens
ttgttcttggagcaggcagaga

SEQ ID NO: 8591491 - DNA, 22 bp, Homo sapiens
tttaacagatgtgaaattttca

SEQ ID NO: 8591492 - DNA, 18 bp, Homo sapiens
tttcacaacctccagagg

SEQ ID NO: 8591493 - DNA, 22 bp, Homo sapiens
tttcacaagacagctactgttg

SEQ ID NO: 8591494 - DNA, 22 bp, Homo sapiens
tttatttatccttctggattgc

SEQ ID NO: 8591495 - DNA, 22 bp, Homo sapiens
tttcacaggagtcctttctata

SEQ ID NO: 8591496 - DNA, 22 bp, Homo sapiens
tttctaaatggtggctgcattg

SEQ ID NO: 8591497 - DNA, 22 bp, Homo sapiens
tttcgagggattagctaggact

SEQ ID NO: 8591498 - DNA, 21 bp, Homo sapiens
tttcggtcccagatgcctgtg

SEQ ID NO: 8591499 - DNA, 22 bp, Homo sapiens
tttcataacctcaagctacagt

SEQ ID NO: 8591500 - DNA, 22 bp, Homo sapiens
ttgttcttacttaagagtgaat

SEQ ID NO: 8591501 - DNA, 22 bp, Homo sapiens
ttgttatttaggtctgggttag

SEQ ID NO: 8591502 - DNA, 22 bp, Homo sapiens
ttgtgctctaaggtcagggcga

SEQ ID NO: 8591503 - DNA, 22 bp, Homo sapiens
ttgtagattggagagtgtgtga

SEQ ID NO: 8591504 - DNA, 22 bp, Homo sapiens
ttgtattggcaaagaacttgag

SEQ ID NO: 8591505 - DNA, 22 bp, Homo sapiens
ttggctcctgttcctctgtctg

SEQ ID NO: 8591506 - DNA, 22 bp, Homo sapiens
ttggcagatgaacacaactgga

SEQ ID NO: 8591507 - DNA, 22 bp, Homo sapiens
ttggcagagagtatgctgaaga

SEQ ID NO: 8591508 - DNA, 22 bp, Homo sapiens
ttggctgttttataggtcagtt

SEQ ID NO: 8591509 - DNA, 22 bp, Homo sapiens
ttggctgtgaggggttgcacag

SEQ ID NO: 8591510 - DNA, 23 bp, Homo sapiens
ttgggaaatagttaagacatgag

SEQ ID NO: 8591511 - DNA, 22 bp, Homo sapiens
ttggggagaaatgaaatgaagt

SEQ ID NO: 8591512 - DNA, 22 bp, Homo sapiens
ttggggcagttattctgtgccc

SEQ ID NO: 8591513 - DNA, 22 bp, Homo sapiens
ttggatgtttgaaatcacgtac

SEQ ID NO: 8591514 - DNA, 22 bp, Homo sapiens
ttggaagacattaaagagagtg

SEQ ID NO: 8591515 - DNA, 22 bp, Homo sapiens
ttggaagaggaaaatgagccta

SEQ ID NO: 8591516 - DNA, 22 bp, Homo sapiens
ttggaagagagccacagttaat

SEQ ID NO: 8591517 - DNA, 22 bp, Homo sapiens
ttggaagaccagaggccttgtc

SEQ ID NO: 8591518 - DNA, 22 bp, Homo sapiens
ttggaacagagccctaaggaca

SEQ ID NO: 8591519 - DNA, 20 bp, Homo sapiens
ttggaacagtggatcagcag

SEQ ID NO: 8591520 - DNA, 22 bp, Homo sapiens
ttggaacagtgtgaaaaggtta

SEQ ID NO: 8591521 - DNA, 22 bp, Homo sapiens
ttggaacatccaggacagatat

SEQ ID NO: 8591522 - DNA, 22 bp, Homo sapiens
ttggaagacagtgaaacagcac

SEQ ID NO: 8591523 - DNA, 22 bp, Homo sapiens
ttggaagacagccgtctttatt

SEQ ID NO: 8591524 - DNA, 22 bp, Homo sapiens
ttggaagacaatgctgattctc

SEQ ID NO: 8591525 - DNA, 22 bp, Homo sapiens
ttggaagaaatatcaatagtgt

SEQ ID NO: 8591526 - DNA, 23 bp, Homo sapiens
ttggaacacagtaaatgcacaat

SEQ ID NO: 8591527 - DNA, 22 bp, Homo sapiens
ttgcttctggaactttctgttc

SEQ ID NO: 8591528 - DNA, 22 bp, Homo sapiens
ttgctcagtggcagggctggta

SEQ ID NO: 8591529 - DNA, 22 bp, Homo sapiens
ttgccagtttccctggatgtgt

SEQ ID NO: 8591530 - DNA, 19 bp, Homo sapiens
ttccaaaatcaggatttga

SEQ ID NO: 8591531 - DNA, 22 bp, Homo sapiens
ttccatcacatcactgaagaca

SEQ ID NO: 8591532 - DNA, 22 bp, Homo sapiens
ttcccaggtaattctgaggcag

SEQ ID NO: 8591533 - DNA, 22 bp, Homo sapiens
ttcccaggactctgggtgtctt

SEQ ID NO: 8591534 - DNA, 19 bp, Homo sapiens
ttcccaggaaaggggtgca

SEQ ID NO: 8591535 - DNA, 22 bp, Homo sapiens
ttcagaaatgtcagccatcaga

SEQ ID NO: 8591536 - DNA, 20 bp, Homo sapiens
ttcagaaataaggaatgagg

SEQ ID NO: 8591537 - DNA, 22 bp, Homo sapiens
ttcagaaggattttaacacatg

SEQ ID NO: 8591538 - DNA, 22 bp, Homo sapiens
ttcagaagttttcaaaactaag

SEQ ID NO: 8591539 - DNA, 22 bp, Homo sapiens
ttcagaataactttttattgaa

SEQ ID NO: 8591540 - DNA, 22 bp, Homo sapiens
ttcaagtcaaggaaagaggtct

SEQ ID NO: 8591541 - DNA, 22 bp, Homo sapiens
ttcagacaaatttgaggaagct

SEQ ID NO: 8591542 - DNA, 22 bp, Homo sapiens
ttcagacacagcgctgggaaat

SEQ ID NO: 8591543 - DNA, 22 bp, Homo sapiens
ttcagaatgtgaccttatttgg

SEQ ID NO: 8591544 - DNA, 22 bp, Homo sapiens
ttcagaatgtactgatagaaca

SEQ ID NO: 8591545 - DNA, 22 bp, Homo sapiens
ttcatacatttttactaacagc

SEQ ID NO: 8591546 - DNA, 22 bp, Homo sapiens
ttcagacattgctctccaccca

SEQ ID NO: 8591547 - DNA, 22 bp, Homo sapiens
ttcatagaaagtgcttagattg

SEQ ID NO: 8591548 - DNA, 22 bp, Homo sapiens
tcctctggctctttccctagga

SEQ ID NO: 8591549 - DNA, 22 bp, Homo sapiens
tcctctggcccagctgcctctg

SEQ ID NO: 8591550 - DNA, 22 bp, Homo sapiens
tcctctggaacctcacccttgc

SEQ ID NO: 8591551 - DNA, 22 bp, Homo sapiens
ttagtggtgttggtgaggactg

SEQ ID NO: 8591552 - DNA, 22 bp, Homo sapiens
ttagttgatgttctggaggtag

SEQ ID NO: 8591553 - DNA, 22 bp, Homo sapiens
ttcaagaggcttaattctggat

SEQ ID NO: 8591554 - DNA, 22 bp, Homo sapiens
ttcaaaagcggtccaggaagat

SEQ ID NO: 8591555 - DNA, 22 bp, Homo sapiens
ttatttatggcactgttggtgg

SEQ ID NO: 8591556 - DNA, 22 bp, Homo sapiens
ttctttggcttacgtctggcct

SEQ ID NO: 8591557 - DNA, 22 bp, Homo sapiens
ttctggagtttgaagatcaggt

SEQ ID NO: 8591558 - DNA, 22 bp, Homo sapiens
ttctgaggcatagaggatgaga

SEQ ID NO: 8591559 - DNA, 22 bp, Homo sapiens
ttctgaggcactggctctccca

SEQ ID NO: 8591560 - DNA, 22 bp, Homo sapiens
ttctgaggctttcccgtcccct

SEQ ID NO: 8591561 - DNA, 22 bp, Homo sapiens
ttctgcattgacttttatttcc

SEQ ID NO: 8591562 - DNA, 22 bp, Homo sapiens
ttctgcattcaaattatgtgag

SEQ ID NO: 8591563 - DNA, 22 bp, Homo sapiens
ttctgcattggagtctattctt

SEQ ID NO: 8591564 - DNA, 22 bp, Homo sapiens
ttctgccatttacaaatttcat

SEQ ID NO: 8591565 - DNA, 22 bp, Homo sapiens
ttctcacactttccactgaggt

SEQ ID NO: 8591566 - DNA, 22 bp, Homo sapiens
ttctatcatacttgaatacatt

SEQ ID NO: 8591567 - DNA, 22 bp, Homo sapiens
ttctatattggaagtgagaaat

SEQ ID NO: 8591568 - DNA, 22 bp, Homo sapiens
ttctccaggggagggttctcca

SEQ ID NO: 8591569 - DNA, 19 bp, Homo sapiens
ttctccagggacttaggga

SEQ ID NO: 8591570 - DNA, 19 bp, Homo sapiens
ttctccaggctgcagaggg

SEQ ID NO: 8591571 - DNA, 22 bp, Homo sapiens
ttctccagcctattggcctatc

SEQ ID NO: 8591572 - DNA, 22 bp, Homo sapiens
ttctaaaataagtttatctggt

SEQ ID NO: 8591573 - DNA, 22 bp, Homo sapiens
gcgcagctttgtaaagatctgg

SEQ ID NO: 8591574 - DNA, 22 bp, Homo sapiens
caaaggcaatcttgttctctgg

SEQ ID NO: 8591575 - DNA, 22 bp, Homo sapiens
caaactttcagttataacatga

SEQ ID NO: 8591576 - DNA, 21 bp, Homo sapiens
caaaacttaggtgacttagga

SEQ ID NO: 8591577 - DNA, 23 bp, Homo sapiens
gcctgggagttgcgatctgcccg

SEQ ID NO: 8591578 - DNA, 18 bp, Homo sapiens
gcctgggaggaggaaatg

SEQ ID NO: 8591579 - DNA, 22 bp, Homo sapiens
gcctgggagggcagcagtgtgg

SEQ ID NO: 8591580 - DNA, 22 bp, Homo sapiens
gcctgggagtgcacagtgaggt

SEQ ID NO: 8591581 - DNA, 22 bp, Homo sapiens
gcctgggagtgcacagtgaggt

SEQ ID NO: 8591582 - DNA, 22 bp, Homo sapiens
gcctgggagcacatcggggtcc

SEQ ID NO: 8591583 - DNA, 22 bp, Homo sapiens
gcctgggagattaattaggaag

SEQ ID NO: 8591584 - DNA, 22 bp, Homo sapiens
gcctgggagatgcgttgtggcc

SEQ ID NO: 8591585 - DNA, 22 bp, Homo sapiens
gcctggagctcggctgagggcg

SEQ ID NO: 8591586 - DNA, 22 bp, Homo sapiens
gcctgggagagggatagtgcag

SEQ ID NO: 8591587 - DNA, 22 bp, Homo sapiens
gcctggagctcatgtgggcatt

SEQ ID NO: 8591588 - DNA, 22 bp, Homo sapiens
gcctgctggatcaagcttatgc

SEQ ID NO: 8591589 - DNA, 22 bp, Homo sapiens
gcctgctgccaccctggctccg

SEQ ID NO: 8591590 - DNA, 22 bp, Homo sapiens
gcctccagcccacgcaggcctg

SEQ ID NO: 8591591 - DNA, 22 bp, Homo sapiens
gcctccagggtagaggaggaag

SEQ ID NO: 8591592 - DNA, 19 bp, Homo sapiens
gccaggcctggacctgcag

SEQ ID NO: 8591593 - DNA, 19 bp, Homo sapiens
gccaggcctggacctgcag

SEQ ID NO: 8591594 - DNA, 22 bp, Homo sapiens
gccaggcctgcaagtgctggtg

SEQ ID NO: 8591595 - DNA, 22 bp, Homo sapiens
atttattggatgcttacttggg

SEQ ID NO: 8591596 - DNA, 22 bp, Homo sapiens
atttattggtttgcatggtgaa

SEQ ID NO: 8591597 - DNA, 22 bp, Homo sapiens
atttattgagcctttcctatgt

SEQ ID NO: 8591598 - DNA, 22 bp, Homo sapiens
atttattggatgcttacttggg

SEQ ID NO: 8591599 - DNA, 22 bp, Homo sapiens
atttattggatgcttacttggg

SEQ ID NO: 8591600 - DNA, 22 bp, Homo sapiens
gccaggccactcccgggtcctg

SEQ ID NO: 8591601 - DNA, 22 bp, Homo sapiens
gccaggcatttgttaggtgctg

SEQ ID NO: 8591602 - DNA, 22 bp, Homo sapiens
gccaggcatttattgattgaat

SEQ ID NO: 8591603 - DNA, 22 bp, Homo sapiens
atttattggtttgcatggtgaa

SEQ ID NO: 8591604 - DNA, 22 bp, Homo sapiens
atttattgagcctttcctatgt

SEQ ID NO: 8591605 - DNA, 22 bp, Homo sapiens
atttattgagcctttcctatgt

SEQ ID NO: 8591606 - DNA, 22 bp, Homo sapiens
atttattgagagggaggggaat

SEQ ID NO: 8591607 - DNA, 22 bp, Homo sapiens
atttattgagagggaggggaat

SEQ ID NO: 8591608 - DNA, 22 bp, Homo sapiens
atttattgagagggaggggaat

SEQ ID NO: 8591609 - DNA, 22 bp, Homo sapiens
atttattgagacttaacaaccc

SEQ ID NO: 8591610 - DNA, 22 bp, Homo sapiens
atttattgagacttaacaaccc

SEQ ID NO: 8591611 - DNA, 22 bp, Homo sapiens
atttattatgggatttggctca

SEQ ID NO: 8591612 - DNA, 22 bp, Homo sapiens
atttaattttctcaacagtgct

SEQ ID NO: 8591613 - DNA, 22 bp, Homo sapiens
atttaatttggagagagaaacc

SEQ ID NO: 8591614 - DNA, 22 bp, Homo sapiens
attggaaagttcttaagggata

SEQ ID NO: 8591615 - DNA, 22 bp, Homo sapiens
attggaaatactgagagataaa

SEQ ID NO: 8591616 - DNA, 22 bp, Homo sapiens
attggaaatacagtagaaaaat

SEQ ID NO: 8591617 - DNA, 19 bp, Homo sapiens
attggagcagaaaggtggt

SEQ ID NO: 8591618 - DNA, 22 bp, Homo sapiens
attggagccccagaagcaaggt

SEQ ID NO: 8591619 - DNA, 22 bp, Homo sapiens
attggaagtatttcatcaaaag

SEQ ID NO: 8591620 - DNA, 22 bp, Homo sapiens
gccaggagtgtcccactcattt

SEQ ID NO: 8591621 - DNA, 23 bp, Homo sapiens
gccaggagtgggtagactaatgc

SEQ ID NO: 8591622 - DNA, 22 bp, Homo sapiens
gccaggagtgtgtggctatgtt

SEQ ID NO: 8591623 - DNA, 22 bp, Homo sapiens
gccaggaggtcagcccctcaac

SEQ ID NO: 8591624 - DNA, 22 bp, Homo sapiens
gccaggaggtcagcccctcaac

SEQ ID NO: 8591625 - DNA, 21 bp, Homo sapiens
gccaggagtagattacattta

SEQ ID NO: 8591626 - DNA, 20 bp, Homo sapiens
gccaggagggtgtgatgagc

SEQ ID NO: 8591627 - DNA, 22 bp, Homo sapiens
gccagctggctgcaggtcccag

SEQ ID NO: 8591628 - DNA, 19 bp, Homo sapiens
gccaggagggctctggctg

SEQ ID NO: 8591629 - DNA, 19 bp, Homo sapiens
gccaggagggctctggctg

SEQ ID NO: 8591630 - DNA, 22 bp, Homo sapiens
gccaggagggaaaggacaattt

SEQ ID NO: 8591631 - DNA, 22 bp, Homo sapiens
gccaggaggcttaactggacag

SEQ ID NO: 8591632 - DNA, 22 bp, Homo sapiens
gcagcaggcatggccgccctgg

SEQ ID NO: 8591633 - DNA, 22 bp, Homo sapiens
attccttctattctctgtgggt

SEQ ID NO: 8591634 - DNA, 22 bp, Homo sapiens
gcagcaggcacttaccgttgct

SEQ ID NO: 8591635 - DNA, 22 bp, Homo sapiens
gcagagcttctgtccttcagga

SEQ ID NO: 8591636 - DNA, 22 bp, Homo sapiens
gcagagcttctgtccttcagga

SEQ ID NO: 8591637 - DNA, 22 bp, Homo sapiens
gcagcaggcttttcataccttg

SEQ ID NO: 8591638 - DNA, 22 bp, Homo sapiens
gcagcagggagcaggggtgtca

SEQ ID NO: 8591639 - DNA, 22 bp, Homo sapiens
gcagcagggtgccagctttgca

SEQ ID NO: 8591640 - DNA, 22 bp, Homo sapiens
attctacacaaagcaagaagac

SEQ ID NO: 8591641 - DNA, 22 bp, Homo sapiens
attctacatttggagtgatgtc

SEQ ID NO: 8591642 - DNA, 22 bp, Homo sapiens
attctacagggtacgttgggga

SEQ ID NO: 8591643 - DNA, 22 bp, Homo sapiens
attctacatgatagaagggaga

SEQ ID NO: 8591644 - DNA, 22 bp, Homo sapiens
attctacagatgaaagcggctg

SEQ ID NO: 8591645 - DNA, 22 bp, Homo sapiens
attctacaggactggcaatccc

SEQ ID NO: 8591646 - DNA, 22 bp, Homo sapiens
attctacacctctctcatttag

SEQ ID NO: 8591647 - DNA, 22 bp, Homo sapiens
attctacacaacatgatgatgg

SEQ ID NO: 8591648 - DNA, 21 bp, Homo sapiens
attcagagtaattcatcttta

SEQ ID NO: 8591649 - DNA, 22 bp, Homo sapiens
attcagtggatatcttcacttt

SEQ ID NO: 8591650 - DNA, 22 bp, Homo sapiens
attattggtacaccgtagtcat

SEQ ID NO: 8591651 - DNA, 22 bp, Homo sapiens
attattggacacttcttctgca

SEQ ID NO: 8591652 - DNA, 23 bp, Homo sapiens
gcagagctgccctattgccttgg

SEQ ID NO: 8591653 - DNA, 21 bp, Homo sapiens
gcagagctggaaccaggaccc

SEQ ID NO: 8591654 - DNA, 22 bp, Homo sapiens
attctattttttaagaagtagt

SEQ ID NO: 8591655 - DNA, 22 bp, Homo sapiens
attctagtgtttccattacaag

SEQ ID NO: 8591656 - DNA, 22 bp, Homo sapiens
attctagagcagtgattctcat

SEQ ID NO: 8591657 - DNA, 22 bp, Homo sapiens
attctgtgatagttgatcctta

SEQ ID NO: 8591658 - DNA, 22 bp, Homo sapiens
attctgtctttttaaaataata

SEQ ID NO: 8591659 - DNA, 22 bp, Homo sapiens
attctgtcatttcaagaaaaac

SEQ ID NO: 8591660 - DNA, 22 bp, Homo sapiens
attctgtcattacaaaaggcag

SEQ ID NO: 8591661 - DNA, 22 bp, Homo sapiens
attcttaattgccatgctgtat

SEQ ID NO: 8591662 - DNA, 22 bp, Homo sapiens
attcttattatagtaaaacagt

SEQ ID NO: 8591663 - DNA, 22 bp, Homo sapiens
attgctggctgccatcttgccc

SEQ ID NO: 8591664 - DNA, 22 bp, Homo sapiens
attgctgggaatatttagccca

SEQ ID NO: 8591665 - DNA, 22 bp, Homo sapiens
attgaagtcctaatctccagta

SEQ ID NO: 8591666 - DNA, 22 bp, Homo sapiens
attacaagtagactaactttca

SEQ ID NO: 8591667 - DNA, 22 bp, Homo sapiens
attacaataatacatgctcatt

SEQ ID NO: 8591668 - DNA, 22 bp, Homo sapiens
attaagatgtgggaaaatttaa

SEQ ID NO: 8591669 - DNA, 22 bp, Homo sapiens
attaatatacactgttagcatg

SEQ ID NO: 8591670 - DNA, 20 bp, Homo sapiens
attaatgaatacattttgat

SEQ ID NO: 8591671 - DNA, 22 bp, Homo sapiens
gatgaggcataaacacagtcac

SEQ ID NO: 8591672 - DNA, 22 bp, Homo sapiens
atgttttctagagtttaaaatc

SEQ ID NO: 8591673 - DNA, 22 bp, Homo sapiens
gaaagcacaggctcaggaacag

SEQ ID NO: 8591674 - DNA, 22 bp, Homo sapiens
atgcatttatgtgtgtacattg

SEQ ID NO: 8591675 - DNA, 21 bp, Homo sapiens
atgcatggatttcagtgagag

SEQ ID NO: 8591676 - DNA, 22 bp, Homo sapiens
atgcagcagtttacaaagcaat

SEQ ID NO: 8591677 - DNA, 23 bp, Homo sapiens
atgcaaagtgctgtcatgtagac

SEQ ID NO: 8591678 - DNA, 22 bp, Homo sapiens
atgcaaagcaccacactaagat

SEQ ID NO: 8591679 - DNA, 22 bp, Homo sapiens
ctttggtctgtggcttgggtct

SEQ ID NO: 8591680 - DNA, 22 bp, Homo sapiens
ctttggtctccgtcatcaatca

SEQ ID NO: 8591681 - DNA, 22 bp, Homo sapiens
ctttggtctcttctaaagaatg

SEQ ID NO: 8591682 - DNA, 22 bp, Homo sapiens
ctttggtctgtccatcctgcct

SEQ ID NO: 8591683 - DNA, 22 bp, Homo sapiens
cttttattttgaattaagggct

SEQ ID NO: 8591684 - DNA, 23 bp, Homo sapiens
atgaaacatcacaatggtaccat

SEQ ID NO: 8591685 - DNA, 22 bp, Homo sapiens
atctacaggatagtttaatatt

SEQ ID NO: 8591686 - DNA, 22 bp, Homo sapiens
atctagaggagggctgctggat

SEQ ID NO: 8591687 - DNA, 22 bp, Homo sapiens
cttggcctgcaggcagcagcgc

SEQ ID NO: 8591688 - DNA, 22 bp, Homo sapiens
cttggtcaaatgcaggcttccc

SEQ ID NO: 8591689 - DNA, 22 bp, Homo sapiens
cttggtcatttcttgtcctgtt

SEQ ID NO: 8591690 - DNA, 22 bp, Homo sapiens
cttggtcatcgataattgaatc

SEQ ID NO: 8591691 - DNA, 22 bp, Homo sapiens
cttggtcatgcaagatatcgat

SEQ ID NO: 8591692 - DNA, 22 bp, Homo sapiens
cttggtcagaggggctggcatg

SEQ ID NO: 8591693 - DNA, 22 bp, Homo sapiens
cttggtcacagttcccaacatt

SEQ ID NO: 8591694 - DNA, 22 bp, Homo sapiens
cttggtcacaggcttgtgtgct

SEQ ID NO: 8591695 - DNA, 22 bp, Homo sapiens
cttggtcaggcttttgtaactg

SEQ ID NO: 8591696 - DNA, 22 bp, Homo sapiens
cttggtcagctcgagagtttgt

SEQ ID NO: 8591697 - DNA, 22 bp, Homo sapiens
cttggtcatttggggctgctat

SEQ ID NO: 8591698 - DNA, 22 bp, Homo sapiens
cttggtctagtgagtgagcata

SEQ ID NO: 8591699 - DNA, 22 bp, Homo sapiens
atggagcaaatggggctgcagg

SEQ ID NO: 8591700 - DNA, 22 bp, Homo sapiens
atggagcacacgccatcacata

SEQ ID NO: 8591701 - DNA, 22 bp, Homo sapiens
atggaagactaacagaaacatg

SEQ ID NO: 8591702 - DNA, 22 bp, Homo sapiens
gacagcaacctcatgagaaact

SEQ ID NO: 8591703 - DNA, 22 bp, Homo sapiens
gacagcaaagcagagccaaggc

SEQ ID NO: 8591704 - DNA, 22 bp, Homo sapiens
gacagatgtgggtgacagcagc

SEQ ID NO: 8591705 - DNA, 23 bp, Homo sapiens
gacagagtgagaccttgtcttac

SEQ ID NO: 8591706 - DNA, 23 bp, Homo sapiens
gacagagtgagaccttgtcttac

SEQ ID NO: 8591707 - DNA, 22 bp, Homo sapiens
atggccagtgtttccctcagtt

SEQ ID NO: 8591708 - DNA, 22 bp, Homo sapiens
atggccagttagaaatcaaaaa

SEQ ID NO: 8591709 - DNA, 19 bp, Homo sapiens
atggccagtttagaggttt

SEQ ID NO: 8591710 - DNA, 22 bp, Homo sapiens
atggccagtctgttggacagca

SEQ ID NO: 8591711 - DNA, 22 bp, Homo sapiens
atggccagtgttgagatcaggc

SEQ ID NO: 8591712 - DNA, 22 bp, Homo sapiens
gagccagcgccttgcctctggg

SEQ ID NO: 8591713 - DNA, 22 bp, Homo sapiens
gagccagctgagctgcactgtc

SEQ ID NO: 8591714 - DNA, 22 bp, Homo sapiens
gagccagctatgtagcaagagg

SEQ ID NO: 8591715 - DNA, 22 bp, Homo sapiens
atggccagtctgttggacagca

SEQ ID NO: 8591716 - DNA, 22 bp, Homo sapiens
atggccagtctgactagtttcc

SEQ ID NO: 8591717 - DNA, 22 bp, Homo sapiens
atggccagtctattcatggtta

SEQ ID NO: 8591718 - DNA, 22 bp, Homo sapiens
atggccagcaaggtagggcaat

SEQ ID NO: 8591719 - DNA, 22 bp, Homo sapiens
atggccagattatatggttttt

SEQ ID NO: 8591720 - DNA, 22 bp, Homo sapiens
atggccagatgaaataatagag

SEQ ID NO: 8591721 - DNA, 22 bp, Homo sapiens
atggcaggatacccagtccggc

SEQ ID NO: 8591722 - DNA, 22 bp, Homo sapiens
atggcagggcacagctctagtt

SEQ ID NO: 8591723 - DNA, 22 bp, Homo sapiens
atggcagggcagcctctcagag

SEQ ID NO: 8591724 - DNA, 20 bp, Homo sapiens
gaggctgcggactgctggac

SEQ ID NO: 8591725 - DNA, 22 bp, Homo sapiens
gaggctgcggggaggagcctgc

SEQ ID NO: 8591726 - DNA, 22 bp, Homo sapiens
atgtcttttatggagatgtcat

SEQ ID NO: 8591727 - DNA, 22 bp, Homo sapiens
atgtctttgccatagttcatat

SEQ ID NO: 8591728 - DNA, 22 bp, Homo sapiens
gaggcctggctgggaggaggtg

SEQ ID NO: 8591729 - DNA, 22 bp, Homo sapiens
gaggccaggggtcagcaattgg

SEQ ID NO: 8591730 - DNA, 22 bp, Homo sapiens
gaggcctggagccgcctaggcg

SEQ ID NO: 8591731 - DNA, 23 bp, Homo sapiens
gaggcctggccctgccacatctc

SEQ ID NO: 8591732 - DNA, 22 bp, Homo sapiens
atgtggcttttcctgggttcct

SEQ ID NO: 8591733 - DNA, 22 bp, Homo sapiens
atgtggcttagttaggtgcccc

SEQ ID NO: 8591734 - DNA, 22 bp, Homo sapiens
gaggctgctttgatgacaggag

SEQ ID NO: 8591735 - DNA, 22 bp, Homo sapiens
gaggctgctgttagccctgggc

SEQ ID NO: 8591736 - DNA, 22 bp, Homo sapiens
atgtgtccacaggtgtgagaga

SEQ ID NO: 8591737 - DNA, 22 bp, Homo sapiens
atgtgtccattatcagttctgg

SEQ ID NO: 8591738 - DNA, 22 bp, Homo sapiens
atgtgtcctctggcaggtttag

SEQ ID NO: 8591739 - DNA, 22 bp, Homo sapiens
atgtgtccaaggccacaatagc

SEQ ID NO: 8591740 - DNA, 22 bp, Homo sapiens
gaggggaagacttctggacagt

SEQ ID NO: 8591741 - DNA, 22 bp, Homo sapiens
gaggggagaaggcactaaccag

SEQ ID NO: 8591742 - DNA, 22 bp, Homo sapiens
atgtgtcctgctgtgtcacaca

SEQ ID NO: 8591743 - DNA, 22 bp, Homo sapiens
gaggggagacagggaaatcagt

SEQ ID NO: 8591744 - DNA, 22 bp, Homo sapiens
gaggggagaggcttatggatca

SEQ ID NO: 8591745 - DNA, 22 bp, Homo sapiens
gaggggagcccccatcctccag

SEQ ID NO: 8591746 - DNA, 16 bp, Homo sapiens
gaggggagcagtaggc

SEQ ID NO: 8591747 - DNA, 22 bp, Homo sapiens
gaggagctctgctccatccttc

SEQ ID NO: 8591748 - DNA, 22 bp, Homo sapiens
gaggagctgaggctgaggcctc

SEQ ID NO: 8591749 - DNA, 22 bp, Homo sapiens
gaggagctgcagggggagtcta

SEQ ID NO: 8591750 - DNA, 17 bp, Homo sapiens
gaggagctccagtaggt

SEQ ID NO: 8591751 - DNA, 22 bp, Homo sapiens
gaggagctcatgaaagcggtgt

SEQ ID NO: 8591752 - DNA, 22 bp, Homo sapiens
gaggccaggggcctggagatga

SEQ ID NO: 8591753 - DNA, 22 bp, Homo sapiens
gaggccaggggcctggagatga

SEQ ID NO: 8591754 - DNA, 22 bp, Homo sapiens
gaggccaggggtcagcaattgg

SEQ ID NO: 8591755 - DNA, 22 bp, Homo sapiens
gaggccaggggagtcagcgtcc

SEQ ID NO: 8591756 - DNA, 22 bp, Homo sapiens
gaggccaggggagtcagcgtcc

SEQ ID NO: 8591757 - DNA, 22 bp, Homo sapiens
gaggagctgggctgagagggtc

SEQ ID NO: 8591758 - DNA, 22 bp, Homo sapiens
gaggagctggctgtcgggaggc

SEQ ID NO: 8591759 - DNA, 22 bp, Homo sapiens
gaggccaggagtgctgtaagtt

SEQ ID NO: 8591760 - DNA, 22 bp, Homo sapiens
gagctgggcctcagaacacagt

SEQ ID NO: 8591761 - DNA, 22 bp, Homo sapiens
gagctgggcctcagaacacagt

SEQ ID NO: 8591762 - DNA, 22 bp, Homo sapiens
gagctgggcctcagaacacagt

SEQ ID NO: 8591763 - DNA, 23 bp, Homo sapiens
atggtcagaattttccagctgag

SEQ ID NO: 8591764 - DNA, 22 bp, Homo sapiens
atggtcaggcaaggagggctgg

SEQ ID NO: 8591765 - DNA, 22 bp, Homo sapiens
gagctgggcctgcgagtgctgc

SEQ ID NO: 8591766 - DNA, 22 bp, Homo sapiens
gagctgggcctgcgagtgctgc

SEQ ID NO: 8591767 - DNA, 22 bp, Homo sapiens
gagctgggcgagccggggaagt

SEQ ID NO: 8591768 - DNA, 22 bp, Homo sapiens
gagctgggcgagccggggaagt

SEQ ID NO: 8591769 - DNA, 21 bp, Homo sapiens
gagctgggcgaggctccgggg

SEQ ID NO: 8591770 - DNA, 21 bp, Homo sapiens
gagctgggcgaggctccgggg

SEQ ID NO: 8591771 - DNA, 22 bp, Homo sapiens
gagctggggcagcttaggagtg

SEQ ID NO: 8591772 - DNA, 22 bp, Homo sapiens
gagctgggctggcttcctccct

SEQ ID NO: 8591773 - DNA, 22 bp, Homo sapiens
gagctgggctggcttcctccct

SEQ ID NO: 8591774 - DNA, 22 bp, Homo sapiens
ggcatcagaggtgtgttctgct

SEQ ID NO: 8591775 - DNA, 22 bp, Homo sapiens
ggcatagatttctttaggttta

SEQ ID NO: 8591776 - DNA, 22 bp, Homo sapiens
cacccaggttggagtgcagtgg

SEQ ID NO: 8591777 - DNA, 22 bp, Homo sapiens
caccctgcccactagcaatctg

SEQ ID NO: 8591778 - DNA, 22 bp, Homo sapiens
ggcagctgacctagcaccatcc

SEQ ID NO: 8591779 - DNA, 22 bp, Homo sapiens
ggctcaagcagtctgcctgcct

SEQ ID NO: 8591780 - DNA, 22 bp, Homo sapiens
cactgcccaccaagtggctggt

SEQ ID NO: 8591781 - DNA, 22 bp, Homo sapiens
ggctagggactcctcctcaggg

SEQ ID NO: 8591782 - DNA, 22 bp, Homo sapiens
cactggaatggatagagcagag

SEQ ID NO: 8591783 - DNA, 22 bp, Homo sapiens
cactggaaccaagacccagggc

SEQ ID NO: 8591784 - DNA, 22 bp, Homo sapiens
cactggaatgttgaggagacaa

SEQ ID NO: 8591785 - DNA, 22 bp, Homo sapiens
cactggaggtcagtggagcact

SEQ ID NO: 8591786 - DNA, 22 bp, Homo sapiens
ggcctctcatgtcctgggcttc

SEQ ID NO: 8591787 - DNA, 22 bp, Homo sapiens
cactgagagatgtgtcacagca

SEQ ID NO: 8591788 - DNA, 22 bp, Homo sapiens
cacagtggcaggtgtgggttgt

SEQ ID NO: 8591789 - DNA, 22 bp, Homo sapiens
cacagtggctttgctggtctcg

SEQ ID NO: 8591790 - DNA, 22 bp, Homo sapiens
cacagtggtttccgattcagac

SEQ ID NO: 8591791 - DNA, 22 bp, Homo sapiens
cacagtggattgggtgatgccc

SEQ ID NO: 8591792 - DNA, 22 bp, Homo sapiens
cacagtggaaacagctaagcct

SEQ ID NO: 8591793 - DNA, 17 bp, Homo sapiens
ggcagagctgacagggc

SEQ ID NO: 8591794 - DNA, 21 bp, Homo sapiens
ggcagagctggggcctccagc

SEQ ID NO: 8591795 - DNA, 19 bp, Homo sapiens
ggcagagctcctgctttct

SEQ ID NO: 8591796 - DNA, 22 bp, Homo sapiens
ggcagagcgcatgcgtcgcaga

SEQ ID NO: 8591797 - DNA, 22 bp, Homo sapiens
ggcagagctagtggcttctctt

SEQ ID NO: 8591798 - DNA, 22 bp, Homo sapiens
cacagtgtggcaaatttcaact

SEQ ID NO: 8591799 - DNA, 22 bp, Homo sapiens
cacagtgtgactgaccttcagc

SEQ ID NO: 8591800 - DNA, 22 bp, Homo sapiens
cacagtgtctgtgcttcagtgt

SEQ ID NO: 8591801 - DNA, 22 bp, Homo sapiens
ggcagcagtggctgctattgtc

SEQ ID NO: 8591802 - DNA, 22 bp, Homo sapiens
ggcacagtgattaagagccagt

SEQ ID NO: 8591803 - DNA, 22 bp, Homo sapiens
ggcacatgtatgtgggagtgtg

SEQ ID NO: 8591804 - DNA, 23 bp, Homo sapiens
ggatgggcaagcctagtgcctac

SEQ ID NO: 8591805 - DNA, 22 bp, Homo sapiens
cacagggagaggaacagcgcag

SEQ ID NO: 8591806 - DNA, 22 bp, Homo sapiens
cacagcttagaaaagaagccat

SEQ ID NO: 8591807 - DNA, 22 bp, Homo sapiens
cacagctgtgagaagggagcct

SEQ ID NO: 8591808 - DNA, 22 bp, Homo sapiens
cacacgagccctggagccagca

SEQ ID NO: 8591809 - DNA, 22 bp, Homo sapiens
cacagctggtgacagagcccag

SEQ ID NO: 8591810 - DNA, 22 bp, Homo sapiens
cacagctgaagtagccatgtgg

SEQ ID NO: 8591811 - DNA, 20 bp, Homo sapiens
ggaggcgctgggctcgcgct

SEQ ID NO: 8591812 - DNA, 22 bp, Homo sapiens
cacagcttcccgtgcatggaga

SEQ ID NO: 8591813 - DNA, 22 bp, Homo sapiens
cacagcttgggctctgacaata

SEQ ID NO: 8591814 - DNA, 22 bp, Homo sapiens
ggaggccaaggcaggtggatcg

SEQ ID NO: 8591815 - DNA, 22 bp, Homo sapiens
ggaggccaaggcaggtggatcg

SEQ ID NO: 8591816 - DNA, 22 bp, Homo sapiens
cacaaaatctttctcgattatt

SEQ ID NO: 8591817 - DNA, 22 bp, Homo sapiens
ggaaaaggccattgtttctctg

SEQ ID NO: 8591818 - DNA, 21 bp, Homo sapiens
cacaccaaacaggaacaggga

SEQ ID NO: 8591819 - DNA, 22 bp, Homo sapiens
gctgtggagtacagagctggtt

SEQ ID NO: 8591820 - DNA, 20 bp, Homo sapiens
gctgtggcaagtgctcactg

SEQ ID NO: 8591821 - DNA, 22 bp, Homo sapiens
gctgtgctgattcattccctgc

SEQ ID NO: 8591822 - DNA, 22 bp, Homo sapiens
caaggaggcagtgggacttgaa

SEQ ID NO: 8591823 - DNA, 22 bp, Homo sapiens
caaggattaatagaatgaatca

SEQ ID NO: 8591824 - DNA, 22 bp, Homo sapiens
caaggcagaattcagactcagg

SEQ ID NO: 8591825 - DNA, 22 bp, Homo sapiens
gctgtggcctccagcactcccc

SEQ ID NO: 8591826 - DNA, 20 bp, Homo sapiens
gctgtggccgtgccagactc

SEQ ID NO: 8591827 - DNA, 22 bp, Homo sapiens
gcttctgacagcacctgaactt

SEQ ID NO: 8591828 - DNA, 22 bp, Homo sapiens
gcttggccagcagccgggatgc

SEQ ID NO: 8591829 - DNA, 22 bp, Homo sapiens
gcttggccctgccgcctgggtc

SEQ ID NO: 8591830 - DNA, 22 bp, Homo sapiens
cacaaaatatcaagcactttta

SEQ ID NO: 8591831 - DNA, 20 bp, Homo sapiens
gctgaggtggaggaaggaga

SEQ ID NO: 8591832 - DNA, 22 bp, Homo sapiens
gctgaggtggaggaaggagacc

SEQ ID NO: 8591833 - DNA, 22 bp, Homo sapiens
gctgcagacttctcatctcatt

SEQ ID NO: 8591834 - DNA, 18 bp, Homo sapiens
gctcctggagtctgactc

SEQ ID NO: 8591835 - DNA, 22 bp, Homo sapiens
gctcctgaaggctctgcagggt

SEQ ID NO: 8591836 - DNA, 22 bp, Homo sapiens
gctgcatggagggtgcccagga

SEQ ID NO: 8591837 - DNA, 22 bp, Homo sapiens
gctgcatgacagacaggcctgg

SEQ ID NO: 8591838 - DNA, 22 bp, Homo sapiens
gctgcagtgagccaagatcgtg

SEQ ID NO: 8591839 - DNA, 22 bp, Homo sapiens
gctgcaggtttgtctagtctgg

SEQ ID NO: 8591840 - DNA, 22 bp, Homo sapiens
gctgctggagagcgagactgtt

SEQ ID NO: 8591841 - DNA, 22 bp, Homo sapiens
gctgctggagctttgcagaagg

SEQ ID NO: 8591842 - DNA, 22 bp, Homo sapiens
gctgctggatgcgcttgatggt

SEQ ID NO: 8591843 - DNA, 22 bp, Homo sapiens
gctgctggagctttgcagaagg

SEQ ID NO: 8591844 - DNA, 22 bp, Homo sapiens
gctgctggcactggagtgagcc

SEQ ID NO: 8591845 - DNA, 22 bp, Homo sapiens
gctgctggcactggagtgagcc

SEQ ID NO: 8591846 - DNA, 22 bp, Homo sapiens
gctgctggatgcgcttgatggt

SEQ ID NO: 8591847 - DNA, 22 bp, Homo sapiens
caagacaagatctaagcatgct

SEQ ID NO: 8591848 - DNA, 22 bp, Homo sapiens
gctgctggcatctagggggtgg

SEQ ID NO: 8591849 - DNA, 22 bp, Homo sapiens
gctgctggccccacatgctcca

SEQ ID NO: 8591850 - DNA, 18 bp, Homo sapiens
caagagctgctcctggcc

SEQ ID NO: 8591851 - DNA, 22 bp, Homo sapiens
caaggacactgatgttcatcct

SEQ ID NO: 8591852 - DNA, 22 bp, Homo sapiens
cagcatttagaatttgaagtgt

SEQ ID NO: 8591853 - DNA, 18 bp, Homo sapiens
cagcattagcagcttcca

SEQ ID NO: 8591854 - DNA, 22 bp, Homo sapiens
cagcatttatcttgtagcagga

SEQ ID NO: 8591855 - DNA, 22 bp, Homo sapiens
cagcattttccatagaaagaag

SEQ ID NO: 8591856 - DNA, 22 bp, Homo sapiens
cagcattttcttaatgtaggtg

SEQ ID NO: 8591857 - DNA, 22 bp, Homo sapiens
cagcagagtttggcttctaatg

SEQ ID NO: 8591858 - DNA, 22 bp, Homo sapiens
cagcagagtaggtgctacttct

SEQ ID NO: 8591859 - DNA, 22 bp, Homo sapiens
cagcagagtaggtgctacttct

SEQ ID NO: 8591860 - DNA, 22 bp, Homo sapiens
cagcagagcttatgttgggtca

SEQ ID NO: 8591861 - DNA, 22 bp, Homo sapiens
cagcagagtaattctcacctct

SEQ ID NO: 8591862 - DNA, 21 bp, Homo sapiens
cagcagagtaatgcattcgta

SEQ ID NO: 8591863 - DNA, 22 bp, Homo sapiens
cagcagcaacaacggaagcctt

SEQ ID NO: 8591864 - DNA, 22 bp, Homo sapiens
cagcagcaacaacggaagcctt

SEQ ID NO: 8591865 - DNA, 22 bp, Homo sapiens
cagcagatgccaagttgtagtc

SEQ ID NO: 8591866 - DNA, 22 bp, Homo sapiens
cagcagcactctgcgggtcccc

SEQ ID NO: 8591867 - DNA, 22 bp, Homo sapiens
gtagggcaacatgggcactagg

SEQ ID NO: 8591868 - DNA, 22 bp, Homo sapiens
gtagggataggtgtccagagac

SEQ ID NO: 8591869 - DNA, 22 bp, Homo sapiens
gtagggagcccagagcccagtg

SEQ ID NO: 8591870 - DNA, 22 bp, Homo sapiens
cagcaggatttgaaaggaagag

SEQ ID NO: 8591871 - DNA, 22 bp, Homo sapiens
cagcaggatttgaaaggaagag

SEQ ID NO: 8591872 - DNA, 22 bp, Homo sapiens
cagcagctacttggagcagcag

SEQ ID NO: 8591873 - DNA, 22 bp, Homo sapiens
gtatttctggttaaatgtgcta

SEQ ID NO: 8591874 - DNA, 22 bp, Homo sapiens
gtatttctagaaccaaaagcca

SEQ ID NO: 8591875 - DNA, 22 bp, Homo sapiens
gtatttctagaaaatgcagatt

SEQ ID NO: 8591876 - DNA, 22 bp, Homo sapiens
ggttcccggatctccgagtccc

SEQ ID NO: 8591877 - DNA, 23 bp, Homo sapiens
ggttcctgagcagggatctggaa

SEQ ID NO: 8591878 - DNA, 22 bp, Homo sapiens
ggttcctgatcgttgtctctct

SEQ ID NO: 8591879 - DNA, 22 bp, Homo sapiens
ggttcctgatagattccttttg

SEQ ID NO: 8591880 - DNA, 22 bp, Homo sapiens
ggttctaggattaggaggccca

SEQ ID NO: 8591881 - DNA, 22 bp, Homo sapiens
ggttcctgtgtactgtggctta

SEQ ID NO: 8591882 - DNA, 22 bp, Homo sapiens
ggttgcaaactcctgggatcaa

SEQ ID NO: 8591883 - DNA, 22 bp, Homo sapiens
gggtgggactctttggcctgag

SEQ ID NO: 8591884 - DNA, 22 bp, Homo sapiens
gggtgggagaaatgagtatcta

SEQ ID NO: 8591885 - DNA, 22 bp, Homo sapiens
gggtgggactgaagtctgaggg

SEQ ID NO: 8591886 - DNA, 22 bp, Homo sapiens
gggtgggaaggctaagggattg

SEQ ID NO: 8591887 - DNA, 21 bp, Homo sapiens
gggtgggaggacacagcaggc

SEQ ID NO: 8591888 - DNA, 20 bp, Homo sapiens
gggtgggagagtctgagggt

SEQ ID NO: 8591889 - DNA, 22 bp, Homo sapiens
gggtgggagtctggccctcaaa

SEQ ID NO: 8591890 - DNA, 22 bp, Homo sapiens
ggtgggtatagttagggcctct

SEQ ID NO: 8591891 - DNA, 22 bp, Homo sapiens
cagcaaggccattggatgcagt

SEQ ID NO: 8591892 - DNA, 22 bp, Homo sapiens
cagcaaggccattggatgcagt

SEQ ID NO: 8591893 - DNA, 22 bp, Homo sapiens
ggtgggtaaaactgctggcact

SEQ ID NO: 8591894 - DNA, 22 bp, Homo sapiens
ggtggggctgcaagcagttcgg

SEQ ID NO: 8591895 - DNA, 22 bp, Homo sapiens
ggtggggctcagcaatctgtgt

SEQ ID NO: 8591896 - DNA, 23 bp, Homo sapiens
gggaaaggatatgatcctagggg

SEQ ID NO: 8591897 - DNA, 22 bp, Homo sapiens
gggaaggacacagccatgactg

SEQ ID NO: 8591898 - DNA, 22 bp, Homo sapiens
gggaaggacattctgggctcag

SEQ ID NO: 8591899 - DNA, 22 bp, Homo sapiens
gggacaatggaggcctctctcc

SEQ ID NO: 8591900 - DNA, 22 bp, Homo sapiens
gggaaggaggtggacctgcccc

SEQ ID NO: 8591901 - DNA, 22 bp, Homo sapiens
gggaaggagcctgcttgctaga

SEQ ID NO: 8591902 - DNA, 22 bp, Homo sapiens
gggaaggacattctgggctcag

SEQ ID NO: 8591903 - DNA, 22 bp, Homo sapiens
gggacagacccatgggccaggt

SEQ ID NO: 8591904 - DNA, 22 bp, Homo sapiens
gggacagaaggaagtgagcaca

SEQ ID NO: 8591905 - DNA, 22 bp, Homo sapiens
gggacagaaggaagtgagcaca

SEQ ID NO: 8591906 - DNA, 22 bp, Homo sapiens
gggacagacccatgggccaggt

SEQ ID NO: 8591907 - DNA, 22 bp, Homo sapiens
gggacagaggcaaactagcaga

SEQ ID NO: 8591908 - DNA, 22 bp, Homo sapiens
ggcttttgctgtgttttccaga

SEQ ID NO: 8591909 - DNA, 22 bp, Homo sapiens
cactggctgggccagcactcct

SEQ ID NO: 8591910 - DNA, 22 bp, Homo sapiens
cactggctgagcttctctaggg

SEQ ID NO: 8591911 - DNA, 22 bp, Homo sapiens
cactggctatgagggagatggg

SEQ ID NO: 8591912 - DNA, 22 bp, Homo sapiens
cactggctccctgatttgaagc

SEQ ID NO: 8591913 - DNA, 22 bp, Homo sapiens
cactggcttgatgggtaatgcc

SEQ ID NO: 8591914 - DNA, 22 bp, Homo sapiens
cactggctaaaaaagaggcaga

SEQ ID NO: 8591915 - DNA, 22 bp, Homo sapiens
cactggctaaagataagctcaa

SEQ ID NO: 8591916 - DNA, 22 bp, Homo sapiens
cactggcattagtcacgaggca

SEQ ID NO: 8591917 - DNA, 22 bp, Homo sapiens
cagacaggggtaaccttcctca

SEQ ID NO: 8591918 - DNA, 22 bp, Homo sapiens
cagacagggccctgtgatggta

SEQ ID NO: 8591919 - DNA, 22 bp, Homo sapiens
cagacagggccctgtgatggta

SEQ ID NO: 8591920 - DNA, 17 bp, Homo sapiens
cagacaggctgtcaccc

SEQ ID NO: 8591921 - DNA, 22 bp, Homo sapiens
cagacagggacctcgctccaga

SEQ ID NO: 8591922 - DNA, 22 bp, Homo sapiens
gggcaagcagtggctaccagta

SEQ ID NO: 8591923 - DNA, 22 bp, Homo sapiens
gggagggcttggacccagatgt

SEQ ID NO: 8591924 - DNA, 20 bp, Homo sapiens
gggaggccagcctcagagaa

SEQ ID NO: 8591925 - DNA, 20 bp, Homo sapiens
gggaggccccagagtccagg

SEQ ID NO: 8591926 - DNA, 20 bp, Homo sapiens
gggaggccagcctcagagaa

SEQ ID NO: 8591927 - DNA, 22 bp, Homo sapiens
cagacaggctagccagactcac

SEQ ID NO: 8591928 - DNA, 22 bp, Homo sapiens
gggaggtcagggtgcctgctgg

SEQ ID NO: 8591929 - DNA, 22 bp, Homo sapiens
cagaagtggcctcagagggagt

SEQ ID NO: 8591930 - DNA, 22 bp, Homo sapiens
cagacagaaggctccttgaggt

SEQ ID NO: 8591931 - DNA, 22 bp, Homo sapiens
cagacagaaggctccttgaggt

SEQ ID NO: 8591932 - DNA, 22 bp, Homo sapiens
cagacaggcaggtgagagctcc

SEQ ID NO: 8591933 - DNA, 22 bp, Homo sapiens
cagacaggagactggatcatgg

SEQ ID NO: 8591934 - DNA, 22 bp, Homo sapiens
cagacaggaattctggcgtggt

SEQ ID NO: 8591935 - DNA, 22 bp, Homo sapiens
cagacaggcaggtgctgctttg

SEQ ID NO: 8591936 - DNA, 22 bp, Homo sapiens
cagacaggctagccagactcac

SEQ ID NO: 8591937 - DNA, 19 bp, Homo sapiens
gggagcaggaaagctgtgg

SEQ ID NO: 8591938 - DNA, 21 bp, Homo sapiens
cagaggcctatcacagactcc

SEQ ID NO: 8591939 - DNA, 22 bp, Homo sapiens
cagaggcctatccagtgtccat

SEQ ID NO: 8591940 - DNA, 22 bp, Homo sapiens
cagaggccatatttcttcactc

SEQ ID NO: 8591941 - DNA, 22 bp, Homo sapiens
cagaggcccagtgagagggctg

SEQ ID NO: 8591942 - DNA, 22 bp, Homo sapiens
cagaggccagggggctcacaaa

SEQ ID NO: 8591943 - DNA, 22 bp, Homo sapiens
cagagctggtgtgtcctggcat

SEQ ID NO: 8591944 - DNA, 22 bp, Homo sapiens
ggggaagaatgctctctagaga

SEQ ID NO: 8591945 - DNA, 22 bp, Homo sapiens
cagaggccacctgtggccactg

SEQ ID NO: 8591946 - DNA, 22 bp, Homo sapiens
gggtgctcatggataaggcgaa

SEQ ID NO: 8591947 - DNA, 22 bp, Homo sapiens
gggtgctcctggcggcctcttt

SEQ ID NO: 8591948 - DNA, 22 bp, Homo sapiens
gggtgctgaggaagacagcagg

SEQ ID NO: 8591949 - DNA, 23 bp, Homo sapiens
gggtgctgcctgtagtcatgctg

SEQ ID NO: 8591950 - DNA, 22 bp, Homo sapiens
gggtcgggcaggcgccctcgtc

SEQ ID NO: 8591951 - DNA, 22 bp, Homo sapiens
cagaggcctggcttggacacct

SEQ ID NO: 8591952 - DNA, 22 bp, Homo sapiens
cagaggcctggcttggacacct

SEQ ID NO: 8591953 - DNA, 22 bp, Homo sapiens
gggtgcaggggaccctagggac

SEQ ID NO: 8591954 - DNA, 22 bp, Homo sapiens
gggtgcaggggaccctagggac

SEQ ID NO: 8591955 - DNA, 22 bp, Homo sapiens
cagaggtgtacagagggaggcc

SEQ ID NO: 8591956 - DNA, 21 bp, Homo sapiens
cagaggtggcctgacctctga

SEQ ID NO: 8591957 - DNA, 22 bp, Homo sapiens
cagagtaaacctgtcatcaaga

SEQ ID NO: 8591958 - DNA, 22 bp, Homo sapiens
cagagtaaggagctgtcaaacg

SEQ ID NO: 8591959 - DNA, 22 bp, Homo sapiens
cagaggcttcaagtcattctcc

SEQ ID NO: 8591960 - DNA, 22 bp, Homo sapiens
cagaggctgggacctcaggcat

SEQ ID NO: 8591961 - DNA, 22 bp, Homo sapiens
gggcgcagccaatcctggccct

SEQ ID NO: 8591962 - DNA, 20 bp, Homo sapiens
ggggaagaaaaggatgtgat

SEQ ID NO: 8591963 - DNA, 19 bp, Homo sapiens
cagagctgctggcctcgtc

SEQ ID NO: 8591964 - DNA, 22 bp, Homo sapiens
cagagctgcagattgaaggcat

SEQ ID NO: 8591965 - DNA, 22 bp, Homo sapiens
gggcgaggactgactctgggca

SEQ ID NO: 8591966 - DNA, 22 bp, Homo sapiens
gggcgagggcgaaagcgagagc

SEQ ID NO: 8591967 - DNA, 22 bp, Homo sapiens
cagagccagctgtccttggcat

SEQ ID NO: 8591968 - DNA, 22 bp, Homo sapiens
atccaacacgtatttgctggcc

SEQ ID NO: 8591969 - DNA, 22 bp, Homo sapiens
ctgtggagcttgtggcagtggg

SEQ ID NO: 8591970 - DNA, 22 bp, Homo sapiens
ctgtggaggtaggagcaggaca

SEQ ID NO: 8591971 - DNA, 22 bp, Homo sapiens
ctgtggagtcctggggaatgga

SEQ ID NO: 8591972 - DNA, 22 bp, Homo sapiens
ctgtggagtgcttggctcagtg

SEQ ID NO: 8591973 - DNA, 22 bp, Homo sapiens
ctgtggagcagggcagggtcac

SEQ ID NO: 8591974 - DNA, 22 bp, Homo sapiens
ctgtggagatgcagaccaggcc

SEQ ID NO: 8591975 - DNA, 22 bp, Homo sapiens
ctgtggagcagggcagggtcac

SEQ ID NO: 8591976 - DNA, 22 bp, Homo sapiens
atccacagaaggaacttgaaag

SEQ ID NO: 8591977 - DNA, 22 bp, Homo sapiens
atcctttaagttaataaaattc

SEQ ID NO: 8591978 - DNA, 22 bp, Homo sapiens
atcatgtgtaatttcaagctac

SEQ ID NO: 8591979 - DNA, 22 bp, Homo sapiens
ctgtgatgttagctctgtgtta

SEQ ID NO: 8591980 - DNA, 22 bp, Homo sapiens
ctgtgatggtcaggccctatct

SEQ ID NO: 8591981 - DNA, 22 bp, Homo sapiens
ctgtgatgatggaaactttctt

SEQ ID NO: 8591982 - DNA, 22 bp, Homo sapiens
ctgtgatgacaggcagggccaa

SEQ ID NO: 8591983 - DNA, 18 bp, Homo sapiens
ctgtcttttttctctcca

SEQ ID NO: 8591984 - DNA, 22 bp, Homo sapiens
ctgtcttttactatcatttact

SEQ ID NO: 8591985 - DNA, 22 bp, Homo sapiens
ctgtcttttcttctcattgatg

SEQ ID NO: 8591986 - DNA, 22 bp, Homo sapiens
ctgtcctccggccacctacagt

SEQ ID NO: 8591987 - DNA, 22 bp, Homo sapiens
ctgtcctctgtcctcagcagga

SEQ ID NO: 8591988 - DNA, 22 bp, Homo sapiens
ctgtcctcatctgccccaaggg

SEQ ID NO: 8591989 - DNA, 21 bp, Homo sapiens
ctgtcctcagatgtggacgag

SEQ ID NO: 8591990 - DNA, 22 bp, Homo sapiens
ctgtcctccagacgacagtccc

SEQ ID NO: 8591991 - DNA, 22 bp, Homo sapiens
ctgtcctcaccttggcaggggg

SEQ ID NO: 8591992 - DNA, 22 bp, Homo sapiens
ctgggtcccacagcctgctggg

SEQ ID NO: 8591993 - DNA, 22 bp, Homo sapiens
ctgggtagaagattcctcagga

SEQ ID NO: 8591994 - DNA, 22 bp, Homo sapiens
ctgggtagctgctgctccttca

SEQ ID NO: 8591995 - DNA, 22 bp, Homo sapiens
ctgtcctcaacccatccttctc

SEQ ID NO: 8591996 - DNA, 22 bp, Homo sapiens
atatggcaaaggggaattaagg

SEQ ID NO: 8591997 - DNA, 22 bp, Homo sapiens
atatggcagaccaattagaagc

SEQ ID NO: 8591998 - DNA, 22 bp, Homo sapiens
atatgacagcggattcacatat

SEQ ID NO: 8591999 - DNA, 22 bp, Homo sapiens
atatatcatgagtaaaacttga

SEQ ID NO: 8592000 - DNA, 22 bp, Homo sapiens
ctgggactttgtaggccagttg

SEQ ID NO: 8592001 - DNA, 22 bp, Homo sapiens
atatatactttgacacattctg

SEQ ID NO: 8592002 - DNA, 19 bp, Homo sapiens
ctgggaggtgttcagagaa

SEQ ID NO: 8592003 - DNA, 22 bp, Homo sapiens
atataacatacatacagaaaag

SEQ ID NO: 8592004 - DNA, 22 bp, Homo sapiens
ctgggacaagctctgtctagct

SEQ ID NO: 8592005 - DNA, 22 bp, Homo sapiens
atataactcttgttcttatagt

SEQ ID NO: 8592006 - DNA, 22 bp, Homo sapiens
atatataagctgatgagccaca

SEQ ID NO: 8592007 - DNA, 22 bp, Homo sapiens
atatataatacttgctgtgggc

SEQ ID NO: 8592008 - DNA, 22 bp, Homo sapiens
atatataacctggataaggctt

SEQ ID NO: 8592009 - DNA, 20 bp, Homo sapiens
atataataaattttggttac

SEQ ID NO: 8592010 - DNA, 20 bp, Homo sapiens
atataataaattttggttac

SEQ ID NO: 8592011 - DNA, 22 bp, Homo sapiens
atataatacaacctgctaagtg

SEQ ID NO: 8592012 - DNA, 22 bp, Homo sapiens
ctggcttctgggccagggcaga

SEQ ID NO: 8592013 - DNA, 22 bp, Homo sapiens
ctggcagctgcccgagatgccc

SEQ ID NO: 8592014 - DNA, 22 bp, Homo sapiens
agttggaagacaccctgaaatc

SEQ ID NO: 8592015 - DNA, 19 bp, Homo sapiens
agttggggcagggaagaga

SEQ ID NO: 8592016 - DNA, 19 bp, Homo sapiens
agttggggcagggaagaga

SEQ ID NO: 8592017 - DNA, 19 bp, Homo sapiens
agttggggcagggaagaga

SEQ ID NO: 8592018 - DNA, 22 bp, Homo sapiens
agttgctctaggtgaggtcttt

SEQ ID NO: 8592019 - DNA, 22 bp, Homo sapiens
ctgaggcctctctcctgggctt

SEQ ID NO: 8592020 - DNA, 22 bp, Homo sapiens
ctgaggctggggaagggaagtg

SEQ ID NO: 8592021 - DNA, 18 bp, Homo sapiens
ctgaggcttagagaggtt

SEQ ID NO: 8592022 - DNA, 22 bp, Homo sapiens
ctgaggcttgtcctctcagctt

SEQ ID NO: 8592023 - DNA, 22 bp, Homo sapiens
ctgaggcttctctagttcagct

SEQ ID NO: 8592024 - DNA, 22 bp, Homo sapiens
ctgaggtacctggagcaggtcc

SEQ ID NO: 8592025 - DNA, 20 bp, Homo sapiens
ctgaggggtctgacttggac

SEQ ID NO: 8592026 - DNA, 22 bp, Homo sapiens
agtttaactttggaaaactata

SEQ ID NO: 8592027 - DNA, 22 bp, Homo sapiens
agtttacaacagtagctatgga

SEQ ID NO: 8592028 - DNA, 20 bp, Homo sapiens
ataaaataactgccacaaga

SEQ ID NO: 8592029 - DNA, 22 bp, Homo sapiens
ctgccaggcagcagagggagaa

SEQ ID NO: 8592030 - DNA, 22 bp, Homo sapiens
ctgccaggattctgtgaacccc

SEQ ID NO: 8592031 - DNA, 22 bp, Homo sapiens
atactttagagctagattgcct

SEQ ID NO: 8592032 - DNA, 22 bp, Homo sapiens
ctggcagctctactcagagcct

SEQ ID NO: 8592033 - DNA, 22 bp, Homo sapiens
ctggcagcgtgagcagcatcca

SEQ ID NO: 8592034 - DNA, 22 bp, Homo sapiens
ctggcagcggtttgcagcctgg

SEQ ID NO: 8592035 - DNA, 22 bp, Homo sapiens
ctggagtgaagtctggcagctt

SEQ ID NO: 8592036 - DNA, 22 bp, Homo sapiens
ctggagggctgcagcgaggctg

SEQ ID NO: 8592037 - DNA, 22 bp, Homo sapiens
ctggagtgcagtggcatgatca

SEQ ID NO: 8592038 - DNA, 22 bp, Homo sapiens
ctggagagaccgaaagaggctg

SEQ ID NO: 8592039 - DNA, 22 bp, Homo sapiens
atacagaattcactacagtttc

SEQ ID NO: 8592040 - DNA, 22 bp, Homo sapiens
ctggagccccagacagggagag

SEQ ID NO: 8592041 - DNA, 22 bp, Homo sapiens
ctggagggaggaggctgctatt

SEQ ID NO: 8592042 - DNA, 22 bp, Homo sapiens
ctgcttctccaaagtaggactt

SEQ ID NO: 8592043 - DNA, 22 bp, Homo sapiens
atacaagtgatataattgtttc

SEQ ID NO: 8592044 - DNA, 19 bp, Homo sapiens
atacaagactagcatttac

SEQ ID NO: 8592045 - DNA, 22 bp, Homo sapiens
ctgcccaccgtgtgcacgtgcg

SEQ ID NO: 8592046 - DNA, 22 bp, Homo sapiens
ataaatatcactgttgtccctc

SEQ ID NO: 8592047 - DNA, 22 bp, Homo sapiens
ctgctctgcaaggcacagtgat

SEQ ID NO: 8592048 - DNA, 22 bp, Homo sapiens
ctgctctgctgatcagtgtctc

SEQ ID NO: 8592049 - DNA, 22 bp, Homo sapiens
ctgctctgctgatcagtgtctc

SEQ ID NO: 8592050 - DNA, 20 bp, Homo sapiens
ctgctctgctttgcaggtgg

SEQ ID NO: 8592051 - DNA, 22 bp, Homo sapiens
ctgctctggggaagccagatgt

SEQ ID NO: 8592052 - DNA, 22 bp, Homo sapiens
ataatacatggttgatcttttc

SEQ ID NO: 8592053 - DNA, 22 bp, Homo sapiens
cggctcactgcagctccgcctc

SEQ ID NO: 8592054 - DNA, 22 bp, Homo sapiens
cggccagtgccgctctcgcctc

SEQ ID NO: 8592055 - DNA, 20 bp, Homo sapiens
cgaggccaaggggctgggcc

SEQ ID NO: 8592056 - DNA, 22 bp, Homo sapiens
cgaggaagaagtttgagtcaag

SEQ ID NO: 8592057 - DNA, 22 bp, Homo sapiens
aggtggggtgagctgcagacta

SEQ ID NO: 8592058 - DNA, 22 bp, Homo sapiens
aggtggggtgttggatgtttat

SEQ ID NO: 8592059 - DNA, 22 bp, Homo sapiens
aggtggggtgagctgcagacta

SEQ ID NO: 8592060 - DNA, 22 bp, Homo sapiens
aggtgggggctgtgtccttgac

SEQ ID NO: 8592061 - DNA, 19 bp, Homo sapiens
cctttggtttccatgacat

SEQ ID NO: 8592062 - DNA, 19 bp, Homo sapiens
cctttggtttccatgacat

SEQ ID NO: 8592063 - DNA, 22 bp, Homo sapiens
cctttggttgagtgaaagtaag

SEQ ID NO: 8592064 - DNA, 22 bp, Homo sapiens
cctttggtggttttcagagatc

SEQ ID NO: 8592065 - DNA, 22 bp, Homo sapiens
cctttggtcttgatgaactgtt

SEQ ID NO: 8592066 - DNA, 22 bp, Homo sapiens
cctttggtgttattgggagaca

SEQ ID NO: 8592067 - DNA, 22 bp, Homo sapiens
cctttggtggttttcagagatc

SEQ ID NO: 8592068 - DNA, 22 bp, Homo sapiens
cctttggtggcttcaaaatggc

SEQ ID NO: 8592069 - DNA, 22 bp, Homo sapiens
cctttggtcacctccactctta

SEQ ID NO: 8592070 - DNA, 22 bp, Homo sapiens
cctttggtcacctccactctta

SEQ ID NO: 8592071 - DNA, 19 bp, Homo sapiens
cctttggtttttggttcat

SEQ ID NO: 8592072 - DNA, 22 bp, Homo sapiens
aggtggctctgacagctctggt

SEQ ID NO: 8592073 - DNA, 20 bp, Homo sapiens
aggtggctcttcctgggctt

SEQ ID NO: 8592074 - DNA, 22 bp, Homo sapiens
aggtgctgttggcagcgggcag

SEQ ID NO: 8592075 - DNA, 19 bp, Homo sapiens
aggtgctggtgagggtgtt

SEQ ID NO: 8592076 - DNA, 22 bp, Homo sapiens
aggtgctggagtctgggcagga

SEQ ID NO: 8592077 - DNA, 22 bp, Homo sapiens
aggtgctggcgccccaggagac

SEQ ID NO: 8592078 - DNA, 22 bp, Homo sapiens
aggtgctgccccgagaaggatg

SEQ ID NO: 8592079 - DNA, 17 bp, Homo sapiens
aggtgctggagcatcag

SEQ ID NO: 8592080 - DNA, 22 bp, Homo sapiens
aggtgctgaactggtgaggtct

SEQ ID NO: 8592081 - DNA, 22 bp, Homo sapiens
aggtgcaggagctgtgcaggga

SEQ ID NO: 8592082 - DNA, 22 bp, Homo sapiens
cctgggagaactgctgggttgg

SEQ ID NO: 8592083 - DNA, 22 bp, Homo sapiens
cctgggacgactctgtaccctt

SEQ ID NO: 8592084 - DNA, 19 bp, Homo sapiens
ccttggagttccaggtgga

SEQ ID NO: 8592085 - DNA, 22 bp, Homo sapiens
ccttgctcaagctagtgacggg

SEQ ID NO: 8592086 - DNA, 22 bp, Homo sapiens
aggtgggggctgtgtccttgac

SEQ ID NO: 8592087 - DNA, 22 bp, Homo sapiens
aggtggggctgggaaagattcc

SEQ ID NO: 8592088 - DNA, 22 bp, Homo sapiens
aggtggctgtattcagctgtaa

SEQ ID NO: 8592089 - DNA, 22 bp, Homo sapiens
aggtggcttctggccaggtgtg

SEQ ID NO: 8592090 - DNA, 21 bp, Homo sapiens
aggtggctgcatcctcagaag

SEQ ID NO: 8592091 - DNA, 22 bp, Homo sapiens
cctgccaggacattgcttgaag

SEQ ID NO: 8592092 - DNA, 22 bp, Homo sapiens
agggtgaatctcacaactctta

SEQ ID NO: 8592093 - DNA, 19 bp, Homo sapiens
agggtcaggacaaggactt

SEQ ID NO: 8592094 - DNA, 22 bp, Homo sapiens
agggtcagctggctgtcagggg

SEQ ID NO: 8592095 - DNA, 22 bp, Homo sapiens
agggtcagagatcggccatgtg

SEQ ID NO: 8592096 - DNA, 22 bp, Homo sapiens
agggtcagagatcggccatgtg

SEQ ID NO: 8592097 - DNA, 22 bp, Homo sapiens
agggtcaggagacactggcaac

SEQ ID NO: 8592098 - DNA, 22 bp, Homo sapiens
cctggcagcgtgccgagctgcg

SEQ ID NO: 8592099 - DNA, 22 bp, Homo sapiens
cgggttcacgccattctcctgc

SEQ ID NO: 8592100 - DNA, 23 bp, Homo sapiens
cgggtaggaacatcaggatgtga

SEQ ID NO: 8592101 - DNA, 22 bp, Homo sapiens
cgggtaggaacaaagagctgca

SEQ ID NO: 8592102 - DNA, 22 bp, Homo sapiens
cgggtaggaacaaagagctgca

SEQ ID NO: 8592103 - DNA, 22 bp, Homo sapiens
agtcccagatctacaggaggga

SEQ ID NO: 8592104 - DNA, 21 bp, Homo sapiens
ctcagacagggaggctctggg

SEQ ID NO: 8592105 - DNA, 18 bp, Homo sapiens
ctcagacaggctgtgcta

SEQ ID NO: 8592106 - DNA, 22 bp, Homo sapiens
ctcagacacagccccacgaagt

SEQ ID NO: 8592107 - DNA, 22 bp, Homo sapiens
ctcagaaagtgacaggggggtg

SEQ ID NO: 8592108 - DNA, 22 bp, Homo sapiens
ctcagaaatcccactctgtgta

SEQ ID NO: 8592109 - DNA, 22 bp, Homo sapiens
ctcagaaattacaaaagggaca

SEQ ID NO: 8592110 - DNA, 22 bp, Homo sapiens
ctcagacatttgtagaaagtgc

SEQ ID NO: 8592111 - DNA, 22 bp, Homo sapiens
ctcagctgcagcctggctggca

SEQ ID NO: 8592112 - DNA, 22 bp, Homo sapiens
ctcagggacttggatcctggcc

SEQ ID NO: 8592113 - DNA, 22 bp, Homo sapiens
ctcagggaggcctctgctggtt

SEQ ID NO: 8592114 - DNA, 22 bp, Homo sapiens
agtctccagaaatatagcagtg

SEQ ID NO: 8592115 - DNA, 22 bp, Homo sapiens
agtctccacaacagccctgata

SEQ ID NO: 8592116 - DNA, 22 bp, Homo sapiens
ctcagggagtagcacatgtgga

SEQ ID NO: 8592117 - DNA, 22 bp, Homo sapiens
ctcagtgggaggagtcagttgc

SEQ ID NO: 8592118 - DNA, 19 bp, Homo sapiens
ctccagaatacatgttcct

SEQ ID NO: 8592119 - DNA, 22 bp, Homo sapiens
ctccagagacacttctcatgat

SEQ ID NO: 8592120 - DNA, 22 bp, Homo sapiens
ctccagagacacttctcatgat

SEQ ID NO: 8592121 - DNA, 22 bp, Homo sapiens
ctcgcaggacagtgctaggact

SEQ ID NO: 8592122 - DNA, 22 bp, Homo sapiens
ctccagagagtccagctctggg

SEQ ID NO: 8592123 - DNA, 22 bp, Homo sapiens
ctccagagagtccagctctggg

SEQ ID NO: 8592124 - DNA, 23 bp, Homo sapiens
agtgctggagaagcttctggctt

SEQ ID NO: 8592125 - DNA, 22 bp, Homo sapiens
agtgctggaaagggacggagga

SEQ ID NO: 8592126 - DNA, 22 bp, Homo sapiens
ctcctgagggatgcttaggctt

SEQ ID NO: 8592127 - DNA, 22 bp, Homo sapiens
agtgctggagggaggcaggttc

SEQ ID NO: 8592128 - DNA, 22 bp, Homo sapiens
agtgctggagggaggcaggttc

SEQ ID NO: 8592129 - DNA, 22 bp, Homo sapiens
agtgctggattacaggcgtgag

SEQ ID NO: 8592130 - DNA, 22 bp, Homo sapiens
agtgctggattacaggcgtgag

SEQ ID NO: 8592131 - DNA, 22 bp, Homo sapiens
agtgctgggtactgttcccatt

SEQ ID NO: 8592132 - DNA, 22 bp, Homo sapiens
agtgctgggctatctactgcta

SEQ ID NO: 8592133 - DNA, 22 bp, Homo sapiens
agtgctgggattgcaggcatga

SEQ ID NO: 8592134 - DNA, 22 bp, Homo sapiens
agtgctggcccatagctgctgg

SEQ ID NO: 8592135 - DNA, 22 bp, Homo sapiens
agtgctgggattacaggcataa

SEQ ID NO: 8592136 - DNA, 22 bp, Homo sapiens
ctctcgccagcggggctgcgct

SEQ ID NO: 8592137 - DNA, 22 bp, Homo sapiens
agtgggaaactggagagacttc

SEQ ID NO: 8592138 - DNA, 22 bp, Homo sapiens
agtgggacagtgtagagcgtca

SEQ ID NO: 8592139 - DNA, 22 bp, Homo sapiens
agtgggactgctatgacagaag

SEQ ID NO: 8592140 - DNA, 22 bp, Homo sapiens
agtggtgtcgtgggagtggaag

SEQ ID NO: 8592141 - DNA, 22 bp, Homo sapiens
cctcagagactgcatcttccct

SEQ ID NO: 8592142 - DNA, 22 bp, Homo sapiens
cctcaaggatgattctgaaaga

SEQ ID NO: 8592143 - DNA, 22 bp, Homo sapiens
cctccaggaacttgagagacac

SEQ ID NO: 8592144 - DNA, 21 bp, Homo sapiens
cctccaggagcagagccctga

SEQ ID NO: 8592145 - DNA, 22 bp, Homo sapiens
cctccaggctgaatatctagaa

SEQ ID NO: 8592146 - DNA, 22 bp, Homo sapiens
cctccaggataagtcagggcct

SEQ ID NO: 8592147 - DNA, 20 bp, Homo sapiens
cctccaggcacacccatgtg

SEQ ID NO: 8592148 - DNA, 18 bp, Homo sapiens
agggccagctgtgagtag

SEQ ID NO: 8592149 - DNA, 22 bp, Homo sapiens
agggccaggatcacagccaaga

SEQ ID NO: 8592150 - DNA, 22 bp, Homo sapiens
agggccagctgatgagaatgag

SEQ ID NO: 8592151 - DNA, 22 bp, Homo sapiens
agggccagctagagccctcgcc

SEQ ID NO: 8592152 - DNA, 22 bp, Homo sapiens
agggccagggaaacgatcagca

SEQ ID NO: 8592153 - DNA, 22 bp, Homo sapiens
agggcagctggaaggtggcttc

SEQ ID NO: 8592154 - DNA, 22 bp, Homo sapiens
agggcagctaaggtgctgactg

SEQ ID NO: 8592155 - DNA, 22 bp, Homo sapiens
agggcagcggtgcttgtgttat

SEQ ID NO: 8592156 - DNA, 22 bp, Homo sapiens
agggcagcctctcagcctaggt

SEQ ID NO: 8592157 - DNA, 22 bp, Homo sapiens
agggcagcctgagtgctggccc

SEQ ID NO: 8592158 - DNA, 22 bp, Homo sapiens
agggcagcattgcctttctcca

SEQ ID NO: 8592159 - DNA, 22 bp, Homo sapiens
agggcagcagctcctcctagct

SEQ ID NO: 8592160 - DNA, 22 bp, Homo sapiens
cccagcctcagctttacttcca

SEQ ID NO: 8592161 - DNA, 22 bp, Homo sapiens
cccagcagtttgcttagagtga

SEQ ID NO: 8592162 - DNA, 22 bp, Homo sapiens
cccagcagttgttggtgcacat

SEQ ID NO: 8592163 - DNA, 22 bp, Homo sapiens
cccagcagtggttctcaaactt

SEQ ID NO: 8592164 - DNA, 22 bp, Homo sapiens
cccagcagtacccaagcccttg

SEQ ID NO: 8592165 - DNA, 22 bp, Homo sapiens
cccagcagtagagctcatatgg

SEQ ID NO: 8592166 - DNA, 22 bp, Homo sapiens
cccagcagtgacccagtgatac

SEQ ID NO: 8592167 - DNA, 22 bp, Homo sapiens
cccagcctgatctcggccagct

SEQ ID NO: 8592168 - DNA, 22 bp, Homo sapiens
cccagcctggtgcactgtgggg

SEQ ID NO: 8592169 - DNA, 22 bp, Homo sapiens
cccagcctctgggttctgccgg

SEQ ID NO: 8592170 - DNA, 22 bp, Homo sapiens
cccagcctctgtttgctcctct

SEQ ID NO: 8592171 - DNA, 22 bp, Homo sapiens
cccagcctctggattctgccct

SEQ ID NO: 8592172 - DNA, 22 bp, Homo sapiens
cccagcctctgggctcacccaa

SEQ ID NO: 8592173 - DNA, 18 bp, Homo sapiens
cccagcctctcctttcta

SEQ ID NO: 8592174 - DNA, 22 bp, Homo sapiens
cccagctctctgctcttagcct

SEQ ID NO: 8592175 - DNA, 22 bp, Homo sapiens
aggctgtgtgctccttatgaga

SEQ ID NO: 8592176 - DNA, 22 bp, Homo sapiens
aggctgtgtttcccctggagct

SEQ ID NO: 8592177 - DNA, 22 bp, Homo sapiens
agggaagggcagggtctatgca

SEQ ID NO: 8592178 - DNA, 19 bp, Homo sapiens
agggaatccggctgaggga

SEQ ID NO: 8592179 - DNA, 22 bp, Homo sapiens
agggaaggaaaagctgtcgctt

SEQ ID NO: 8592180 - DNA, 22 bp, Homo sapiens
ccccagcagactcagggcaggt

SEQ ID NO: 8592181 - DNA, 22 bp, Homo sapiens
agggagcagcagccacaggatg

SEQ ID NO: 8592182 - DNA, 22 bp, Homo sapiens
agggagcatgggtgaagcaggc

SEQ ID NO: 8592183 - DNA, 22 bp, Homo sapiens
agggagccaggaacgcaggtcg

SEQ ID NO: 8592184 - DNA, 22 bp, Homo sapiens
agggagccaggaacgcaggtcg

SEQ ID NO: 8592185 - DNA, 22 bp, Homo sapiens
aggctgaggcaggtggatcact

SEQ ID NO: 8592186 - DNA, 22 bp, Homo sapiens
aggctgaggcgggaggatcact

SEQ ID NO: 8592187 - DNA, 22 bp, Homo sapiens
aggctgaggcaggtggatcatt

SEQ ID NO: 8592188 - DNA, 22 bp, Homo sapiens
ccagtgtgcattatcatgtgtc

SEQ ID NO: 8592189 - DNA, 22 bp, Homo sapiens
ccagtgtgccaatttacagctg

SEQ ID NO: 8592190 - DNA, 22 bp, Homo sapiens
ccagttgggatttgtcctggtt

SEQ ID NO: 8592191 - DNA, 22 bp, Homo sapiens
ccagtcactggaaaatgggaat

SEQ ID NO: 8592192 - DNA, 22 bp, Homo sapiens
ccagtcactctgtgagagctac

SEQ ID NO: 8592193 - DNA, 22 bp, Homo sapiens
aggctgagcctgggcgtggtgg

SEQ ID NO: 8592194 - DNA, 22 bp, Homo sapiens
aggctgagcggggtcccagagc

SEQ ID NO: 8592195 - DNA, 23 bp, Homo sapiens
aggctgagctctcccagcttcag

SEQ ID NO: 8592196 - DNA, 19 bp, Homo sapiens
ccagtgcaaggtaagatag

SEQ ID NO: 8592197 - DNA, 22 bp, Homo sapiens
ccagtgcacagccaggcaggtg

SEQ ID NO: 8592198 - DNA, 22 bp, Homo sapiens
aggctctgatgcaagcccaggg

SEQ ID NO: 8592199 - DNA, 19 bp, Homo sapiens
aggctctgagctcctggag

SEQ ID NO: 8592200 - DNA, 22 bp, Homo sapiens
aggctctgagtagagctgccag

SEQ ID NO: 8592201 - DNA, 22 bp, Homo sapiens
aggctgagccacggggctggct

SEQ ID NO: 8592202 - DNA, 22 bp, Homo sapiens
aggctgagccacggggctggct

SEQ ID NO: 8592203 - DNA, 22 bp, Homo sapiens
aggctgagataggtggatcatt

SEQ ID NO: 8592204 - DNA, 20 bp, Homo sapiens
aggctctgcctgcaggccca

SEQ ID NO: 8592205 - DNA, 22 bp, Homo sapiens
aggctgagagcaacgtgtcaga

SEQ ID NO: 8592206 - DNA, 22 bp, Homo sapiens
aggctgagactgtgcattagtg

SEQ ID NO: 8592207 - DNA, 22 bp, Homo sapiens
ccaggcctcacctgcccaccta

SEQ ID NO: 8592208 - DNA, 22 bp, Homo sapiens
ccaggcattgtgagtgggcagg

SEQ ID NO: 8592209 - DNA, 22 bp, Homo sapiens
ccaggcatggggagagccagat

SEQ ID NO: 8592210 - DNA, 21 bp, Homo sapiens
ccaggcatgactgcagagagc

SEQ ID NO: 8592211 - DNA, 22 bp, Homo sapiens
aggcaggtttcccggctgtcaa

SEQ ID NO: 8592212 - DNA, 23 bp, Homo sapiens
aggcaggtttgggctcttcttgt

SEQ ID NO: 8592213 - DNA, 22 bp, Homo sapiens
aggcaggtttactcttatttgg

SEQ ID NO: 8592214 - DNA, 22 bp, Homo sapiens
aggcaggttggtgagaagactg

SEQ ID NO: 8592215 - DNA, 18 bp, Homo sapiens
aggcaggtgctggaagtc

SEQ ID NO: 8592216 - DNA, 18 bp, Homo sapiens
aggcaggtgctaatattt

SEQ ID NO: 8592217 - DNA, 22 bp, Homo sapiens
aggcagccagttcaggtttctt

SEQ ID NO: 8592218 - DNA, 22 bp, Homo sapiens
ccactggaagatgctgaggtca

SEQ ID NO: 8592219 - DNA, 22 bp, Homo sapiens
aggcataggacatctatgtcat

SEQ ID NO: 8592220 - DNA, 22 bp, Homo sapiens
aggccagctgttactagagcca

SEQ ID NO: 8592221 - DNA, 22 bp, Homo sapiens
aggccagcttccagaggggcag

SEQ ID NO: 8592222 - DNA, 22 bp, Homo sapiens
aggccagctcaccctggctcct

SEQ ID NO: 8592223 - DNA, 22 bp, Homo sapiens
aggccagatgtcgggctagaag

SEQ ID NO: 8592224 - DNA, 22 bp, Homo sapiens
aggcccagctgggccaggaaca

SEQ ID NO: 8592225 - DNA, 18 bp, Homo sapiens
aggcccgttgtgtggaat

SEQ ID NO: 8592226 - DNA, 22 bp, Homo sapiens
aggccctctagaggagtgtttg

SEQ ID NO: 8592227 - DNA, 22 bp, Homo sapiens
aggccctccattgatgtttatt

SEQ ID NO: 8592228 - DNA, 22 bp, Homo sapiens
agctgggaagagttttctgcag

SEQ ID NO: 8592229 - DNA, 22 bp, Homo sapiens
agctgggaagactggaagacag

SEQ ID NO: 8592230 - DNA, 22 bp, Homo sapiens
caggcctggttgagccctgaga

SEQ ID NO: 8592231 - DNA, 22 bp, Homo sapiens
caggcctggggctggcttccag

SEQ ID NO: 8592232 - DNA, 22 bp, Homo sapiens
caggcctcccggtgcacactga

SEQ ID NO: 8592233 - DNA, 22 bp, Homo sapiens
agcttaaagtatttaaatttca

SEQ ID NO: 8592234 - DNA, 22 bp, Homo sapiens
agcttgtaacagacataaaaat

SEQ ID NO: 8592235 - DNA, 22 bp, Homo sapiens
cagggccagcgcccaggcccag

SEQ ID NO: 8592236 - DNA, 22 bp, Homo sapiens
cagggccagccgcagcatccac

SEQ ID NO: 8592237 - DNA, 22 bp, Homo sapiens
cagggccagcgtctcgggctat

SEQ ID NO: 8592238 - DNA, 22 bp, Homo sapiens
aggaactgatgagcagccaggg

SEQ ID NO: 8592239 - DNA, 22 bp, Homo sapiens
aggaactctgtctccagagttg

SEQ ID NO: 8592240 - DNA, 22 bp, Homo sapiens
aggaacaggcctcgttttctat

SEQ ID NO: 8592241 - DNA, 22 bp, Homo sapiens
aggaagctcctggagagccagt

SEQ ID NO: 8592242 - DNA, 22 bp, Homo sapiens
aggaagcagcccatggatatag

SEQ ID NO: 8592243 - DNA, 18 bp, Homo sapiens
aggaagcaggaggaaggc

SEQ ID NO: 8592244 - DNA, 22 bp, Homo sapiens
agctttatagaaaggatcagtg

SEQ ID NO: 8592245 - DNA, 22 bp, Homo sapiens
agctttatataaaagagtacat

SEQ ID NO: 8592246 - DNA, 22 bp, Homo sapiens
agctttatatgttgtttctcca

SEQ ID NO: 8592247 - DNA, 18 bp, Homo sapiens
aggaaagacgaagagggc

SEQ ID NO: 8592248 - DNA, 22 bp, Homo sapiens
cagggccagcccgacgtggtgc

SEQ ID NO: 8592249 - DNA, 22 bp, Homo sapiens
cagggccagccatcctgctggg

SEQ ID NO: 8592250 - DNA, 22 bp, Homo sapiens
cagggccagccatcctgctggg

SEQ ID NO: 8592251 - DNA, 22 bp, Homo sapiens
cagggccagcccactagcgagg

SEQ ID NO: 8592252 - DNA, 22 bp, Homo sapiens
cagggccactgtagatgaggag

SEQ ID NO: 8592253 - DNA, 22 bp, Homo sapiens
cagggccagagagggctggctg

SEQ ID NO: 8592254 - DNA, 22 bp, Homo sapiens
agctgctgaatgacactgcaag

SEQ ID NO: 8592255 - DNA, 22 bp, Homo sapiens
agctgctgaagtgagagaattg

SEQ ID NO: 8592256 - DNA, 22 bp, Homo sapiens
agctgctgagagtctgccgggc

SEQ ID NO: 8592257 - DNA, 22 bp, Homo sapiens
agctgctgagccaggctgatgt

SEQ ID NO: 8592258 - DNA, 22 bp, Homo sapiens
caggacagaccaagatcgtgct

SEQ ID NO: 8592259 - DNA, 22 bp, Homo sapiens
caggacagaccaagatcgtgct

SEQ ID NO: 8592260 - DNA, 22 bp, Homo sapiens
caggacagagcccagactgtgt

SEQ ID NO: 8592261 - DNA, 22 bp, Homo sapiens
agctggctgggtgccagtctcc

SEQ ID NO: 8592262 - DNA, 22 bp, Homo sapiens
agctggcttcacaggcagtgtg

SEQ ID NO: 8592263 - DNA, 22 bp, Homo sapiens
agctggctttgagctgggaggt

SEQ ID NO: 8592264 - DNA, 22 bp, Homo sapiens
agctggcttgcatgctaaggag

SEQ ID NO: 8592265 - DNA, 22 bp, Homo sapiens
caggagtctctcttgagcccag

SEQ ID NO: 8592266 - DNA, 22 bp, Homo sapiens
caggaggtgacttccaggggtt

SEQ ID NO: 8592267 - DNA, 22 bp, Homo sapiens
caggaggtgccctctagtggca

SEQ ID NO: 8592268 - DNA, 22 bp, Homo sapiens
caggaggtggagctcaagtggt

SEQ ID NO: 8592269 - DNA, 22 bp, Homo sapiens
caggaggttgtaagagcaggcc

SEQ ID NO: 8592270 - DNA, 22 bp, Homo sapiens
caggaggttggtagcagtagat

SEQ ID NO: 8592271 - DNA, 22 bp, Homo sapiens
cagctctgaagaaaggtgtcta

SEQ ID NO: 8592272 - DNA, 22 bp, Homo sapiens
cagcttcttacgagctggtact

SEQ ID NO: 8592273 - DNA, 22 bp, Homo sapiens
agctctgagttggggaggagca

SEQ ID NO: 8592274 - DNA, 22 bp, Homo sapiens
cagctttgcaggctggtcagtg

SEQ ID NO: 8592275 - DNA, 22 bp, Homo sapiens
cagctttggagtgtgagtgctg

SEQ ID NO: 8592276 - DNA, 22 bp, Homo sapiens
cagctttggcccagtcgggagg

SEQ ID NO: 8592277 - DNA, 22 bp, Homo sapiens
cagctttgtcctgcaaacctga

SEQ ID NO: 8592278 - DNA, 21 bp, Homo sapiens
cagctttgtctgtcttcgggg

SEQ ID NO: 8592279 - DNA, 22 bp, Homo sapiens
agctgcagtcaagctgggccac

SEQ ID NO: 8592280 - DNA, 22 bp, Homo sapiens
agctgcaggcctctcctgggga

SEQ ID NO: 8592281 - DNA, 22 bp, Homo sapiens
agctgcaggttcagcattccac

SEQ ID NO: 8592282 - DNA, 22 bp, Homo sapiens
agctgaggcatggacaggctgc

SEQ ID NO: 8592283 - DNA, 22 bp, Homo sapiens
agctgaggccacgagtgaaggg

SEQ ID NO: 8592284 - DNA, 22 bp, Homo sapiens
agctgaggcctgatttcgccgt

SEQ ID NO: 8592285 - DNA, 22 bp, Homo sapiens
agctgaggctctgagagggaag

SEQ ID NO: 8592286 - DNA, 23 bp, Homo sapiens
agctgaggctgtgggtgtcagag

SEQ ID NO: 8592287 - DNA, 22 bp, Homo sapiens
aggacagcattttcagcatctc

SEQ ID NO: 8592288 - DNA, 21 bp, Homo sapiens
aggacaggaactggctgaata

SEQ ID NO: 8592289 - DNA, 22 bp, Homo sapiens
aggacagcccttgagagcacat

SEQ ID NO: 8592290 - DNA, 22 bp, Homo sapiens
aggacagcccccaacagcaaca

SEQ ID NO: 8592291 - DNA, 22 bp, Homo sapiens
aggaagctggtgtgaggatgaa

SEQ ID NO: 8592292 - DNA, 22 bp, Homo sapiens
cagtcctggagcccttcttggc

SEQ ID NO: 8592293 - DNA, 22 bp, Homo sapiens
cagtcctgagctcctgggctga

SEQ ID NO: 8592294 - DNA, 18 bp, Homo sapiens
cagtcccaaaccttagga

SEQ ID NO: 8592295 - DNA, 22 bp, Homo sapiens
aggagctcaaagatgccaggag

SEQ ID NO: 8592296 - DNA, 22 bp, Homo sapiens
aggagctcattgaagtggatga

SEQ ID NO: 8592297 - DNA, 22 bp, Homo sapiens
aggagagaatgttccaggcttg

SEQ ID NO: 8592298 - DNA, 22 bp, Homo sapiens
aggagagcaggccagccgtccc

SEQ ID NO: 8592299 - DNA, 22 bp, Homo sapiens
aggagctgaaacttctcatatg

SEQ ID NO: 8592300 - DNA, 22 bp, Homo sapiens
aggaggaatacaatccagcagc

SEQ ID NO: 8592301 - DNA, 21 bp, Homo sapiens
aggaggagagcttggcctacc

SEQ ID NO: 8592302 - DNA, 22 bp, Homo sapiens
aggaggcaaaggtctctgataa

SEQ ID NO: 8592303 - DNA, 20 bp, Homo sapiens
aggaggcaatgtagataagc

SEQ ID NO: 8592304 - DNA, 22 bp, Homo sapiens
aggcacagcctcccttcacatg

SEQ ID NO: 8592305 - DNA, 22 bp, Homo sapiens
catggccagggcagatggcagg

SEQ ID NO: 8592306 - DNA, 22 bp, Homo sapiens
aggcacaggcctcagcacccag

SEQ ID NO: 8592307 - DNA, 22 bp, Homo sapiens
aggcacaggaatgtcatccagt

SEQ ID NO: 8592308 - DNA, 22 bp, Homo sapiens
aggaggcactcactctcagggt

SEQ ID NO: 8592309 - DNA, 22 bp, Homo sapiens
cattatctcttctatatgctag

SEQ ID NO: 8592310 - DNA, 22 bp, Homo sapiens
cattcatttgcccagtaagtca

SEQ ID NO: 8592311 - DNA, 22 bp, Homo sapiens
cattccgctccccttccttgcg

SEQ ID NO: 8592312 - DNA, 19 bp, Homo sapiens
aggcagcacccagtccttg

SEQ ID NO: 8592313 - DNA, 22 bp, Homo sapiens
aggcagcagtcatgaggaaaga

SEQ ID NO: 8592314 - DNA, 22 bp, Homo sapiens
aggcagcatttctgcttatcca

SEQ ID NO: 8592315 - DNA, 22 bp, Homo sapiens
aggcagcatttgaatccaggtc

SEQ ID NO: 8592316 - DNA, 22 bp, Homo sapiens
aggcagcagaaaacaaatggtt

SEQ ID NO: 8592317 - DNA, 22 bp, Homo sapiens
aggcagcagaggttgaggaaag

SEQ ID NO: 8592318 - DNA, 22 bp, Homo sapiens
agaatataaagataattctgtt

SEQ ID NO: 8592319 - DNA, 22 bp, Homo sapiens
agaagtttgttatgtaaacaaa

SEQ ID NO: 8592320 - DNA, 22 bp, Homo sapiens
agacacagcaataactactgtt

SEQ ID NO: 8592321 - DNA, 22 bp, Homo sapiens
agacacagaagttgctgttggg

SEQ ID NO: 8592322 - DNA, 22 bp, Homo sapiens
agacacatcttaggttgtcagg

SEQ ID NO: 8592323 - DNA, 22 bp, Homo sapiens
agacacagtgttgaaggctagt

SEQ ID NO: 8592324 - DNA, 22 bp, Homo sapiens
agacagtgcaagaagagcaggc

SEQ ID NO: 8592325 - DNA, 22 bp, Homo sapiens
agacagtgcaagaagagcaggc

SEQ ID NO: 8592326 - DNA, 17 bp, Homo sapiens
agacaggttatagttga

SEQ ID NO: 8592327 - DNA, 21 bp, Homo sapiens
agacaggtcagggagaggtga

SEQ ID NO: 8592328 - DNA, 22 bp, Homo sapiens
agacaggtgctcgcccaagtcc

SEQ ID NO: 8592329 - DNA, 22 bp, Homo sapiens
agacaggtgttttacaacttcg

SEQ ID NO: 8592330 - DNA, 22 bp, Homo sapiens
agacagtgatggacaggcagac

SEQ ID NO: 8592331 - DNA, 22 bp, Homo sapiens
atgtaaacactcactgtgcccc

SEQ ID NO: 8592332 - DNA, 23 bp, Homo sapiens
atgtaaacttcagagtcattgcc

SEQ ID NO: 8592333 - DNA, 22 bp, Homo sapiens
atgtaaacttagataagcagta

SEQ ID NO: 8592334 - DNA, 22 bp, Homo sapiens
atgggaggaaggaggcccttga

SEQ ID NO: 8592335 - DNA, 22 bp, Homo sapiens
atgggaggatgctcgggtgctc

SEQ ID NO: 8592336 - DNA, 22 bp, Homo sapiens
atgggaggcaaagatcgcagaa

SEQ ID NO: 8592337 - DNA, 22 bp, Homo sapiens
atgggaggcaggctcagaaccg

SEQ ID NO: 8592338 - DNA, 22 bp, Homo sapiens
atgggaggcagcagagcccagc

SEQ ID NO: 8592339 - DNA, 22 bp, Homo sapiens
agactctgaggagccctgagac

SEQ ID NO: 8592340 - DNA, 22 bp, Homo sapiens
attatacattttgtgtagagat

SEQ ID NO: 8592341 - DNA, 22 bp, Homo sapiens
agagggagtgaaatggaataga

SEQ ID NO: 8592342 - DNA, 22 bp, Homo sapiens
agagggtgctggagagacattg

SEQ ID NO: 8592343 - DNA, 22 bp, Homo sapiens
agagggtgaatgagatagaaaa

SEQ ID NO: 8592344 - DNA, 22 bp, Homo sapiens
agagggtatgagtggggctaaa

SEQ ID NO: 8592345 - DNA, 22 bp, Homo sapiens
agagggtagaagacagggttgc

SEQ ID NO: 8592346 - DNA, 22 bp, Homo sapiens
attctgtatttctaataagatc

SEQ ID NO: 8592347 - DNA, 22 bp, Homo sapiens
attctgtatttggatataaggg

SEQ ID NO: 8592348 - DNA, 22 bp, Homo sapiens
attctggacaatgagaaactgg

SEQ ID NO: 8592349 - DNA, 22 bp, Homo sapiens
attcaggagtgtgccaggaagg

SEQ ID NO: 8592350 - DNA, 22 bp, Homo sapiens
attaaagaaacccagcatgtga

SEQ ID NO: 8592351 - DNA, 22 bp, Homo sapiens
attaaacaatgtaaagttcttg

SEQ ID NO: 8592352 - DNA, 22 bp, Homo sapiens
agagtggcctggcctggggcat

SEQ ID NO: 8592353 - DNA, 22 bp, Homo sapiens
agagtggctctgctgggcacag

SEQ ID NO: 8592354 - DNA, 22 bp, Homo sapiens
agaggtatatattctccatatt

SEQ ID NO: 8592355 - DNA, 22 bp, Homo sapiens
agagggtggtgaggcctggttc

SEQ ID NO: 8592356 - DNA, 22 bp, Homo sapiens
atttattattgtggttacttct

SEQ ID NO: 8592357 - DNA, 22 bp, Homo sapiens
atttattgaacactgactatgt

SEQ ID NO: 8592358 - DNA, 22 bp, Homo sapiens
atttattgaacactgactatgt

SEQ ID NO: 8592359 - DNA, 22 bp, Homo sapiens
atttattgaacactgactatgt

SEQ ID NO: 8592360 - DNA, 22 bp, Homo sapiens
atttattatgggatttggctca

SEQ ID NO: 8592361 - DNA, 22 bp, Homo sapiens
atttagtgaaacccataaagca

SEQ ID NO: 8592362 - DNA, 22 bp, Homo sapiens
atttagcaagagtacaaaataa

SEQ ID NO: 8592363 - DNA, 22 bp, Homo sapiens
agagtgggacacgggcgctgtc

SEQ ID NO: 8592364 - DNA, 22 bp, Homo sapiens
agcaaaataaggtaatttattg

SEQ ID NO: 8592365 - DNA, 22 bp, Homo sapiens
agcaaacagtttctggggatct

SEQ ID NO: 8592366 - DNA, 18 bp, Homo sapiens
agatgaaagcaaatgaca

SEQ ID NO: 8592367 - DNA, 22 bp, Homo sapiens
atttattgaagcttattacgtt

SEQ ID NO: 8592368 - DNA, 22 bp, Homo sapiens
atttattgaagcttattacgtt

SEQ ID NO: 8592369 - DNA, 22 bp, Homo sapiens
agatggttttgtctttatgatt

SEQ ID NO: 8592370 - DNA, 22 bp, Homo sapiens
agatggttcagaattataaaga

SEQ ID NO: 8592371 - DNA, 22 bp, Homo sapiens
agatggttctcagaaactcaac

SEQ ID NO: 8592372 - DNA, 22 bp, Homo sapiens
agatggttatctaagtgaaaaa

SEQ ID NO: 8592373 - DNA, 22 bp, Homo sapiens
cagcagaggaaagcaaatctaa

SEQ ID NO: 8592374 - DNA, 22 bp, Homo sapiens
cagcagaggcacgtctgtgaat

SEQ ID NO: 8592375 - DNA, 22 bp, Homo sapiens
cagcagagggagccattgaaat

SEQ ID NO: 8592376 - DNA, 22 bp, Homo sapiens
cagcagagggagccattgaaat

SEQ ID NO: 8592377 - DNA, 22 bp, Homo sapiens
cagcagagcttattaactaaaa

SEQ ID NO: 8592378 - DNA, 22 bp, Homo sapiens
cagcagaaacccagcaaagcca

SEQ ID NO: 8592379 - DNA, 22 bp, Homo sapiens
agcctgtccagaggacagggct

SEQ ID NO: 8592380 - DNA, 22 bp, Homo sapiens
cagcagcagccccaggaaggtt

SEQ ID NO: 8592381 - DNA, 22 bp, Homo sapiens
cagcagaggttttgctccatga

SEQ ID NO: 8592382 - DNA, 22 bp, Homo sapiens
cagcagaggttttgctccatga

SEQ ID NO: 8592383 - DNA, 22 bp, Homo sapiens
cagcagcagcttagtggtcccc

SEQ ID NO: 8592384 - DNA, 19 bp, Homo sapiens
cagcaagaatgaaggcata

SEQ ID NO: 8592385 - DNA, 22 bp, Homo sapiens
cagcacagagtattttattgat

SEQ ID NO: 8592386 - DNA, 23 bp, Homo sapiens
agcctcagccggtggcagaagtg

SEQ ID NO: 8592387 - DNA, 22 bp, Homo sapiens
agcctcagggctctgcgcagac

SEQ ID NO: 8592388 - DNA, 22 bp, Homo sapiens
cagcacagtacaaggcacggat

SEQ ID NO: 8592389 - DNA, 22 bp, Homo sapiens
cagcacagggacaatagcagat

SEQ ID NO: 8592390 - DNA, 22 bp, Homo sapiens
cagcacagctggctctggaagc

SEQ ID NO: 8592391 - DNA, 22 bp, Homo sapiens
cagcacaggaatatggtggaca

SEQ ID NO: 8592392 - DNA, 22 bp, Homo sapiens
cagcacaggaatatggtggaca

SEQ ID NO: 8592393 - DNA, 22 bp, Homo sapiens
cagcaggaggtgagtagcaggt

SEQ ID NO: 8592394 - DNA, 22 bp, Homo sapiens
cagcaggaggtgagatgtgacc

SEQ ID NO: 8592395 - DNA, 22 bp, Homo sapiens
agctcagaaatgccagtaggta

SEQ ID NO: 8592396 - DNA, 23 bp, Homo sapiens
cagcaggagggtgcctgggctgc

SEQ ID NO: 8592397 - DNA, 22 bp, Homo sapiens
cagcaggaggcatggcttccct

SEQ ID NO: 8592398 - DNA, 22 bp, Homo sapiens
cagccctggccccaggtggtct

SEQ ID NO: 8592399 - DNA, 22 bp, Homo sapiens
agctcctgtgtgaagcctccct

SEQ ID NO: 8592400 - DNA, 22 bp, Homo sapiens
cagccctgggatcttagtgcct

SEQ ID NO: 8592401 - DNA, 23 bp, Homo sapiens
agctccagggaacaggcagtagg

SEQ ID NO: 8592402 - DNA, 22 bp, Homo sapiens
agctccagggaaagagtggatc

SEQ ID NO: 8592403 - DNA, 22 bp, Homo sapiens
agccctcatggaacagctccta

SEQ ID NO: 8592404 - DNA, 22 bp, Homo sapiens
agcccagctttgaaccatatca

SEQ ID NO: 8592405 - DNA, 22 bp, Homo sapiens
agcccaggaagttgaggcttgc

SEQ ID NO: 8592406 - DNA, 22 bp, Homo sapiens
agcccaggaatctgcatcttga

SEQ ID NO: 8592407 - DNA, 22 bp, Homo sapiens
agcccaggagtttgaggctgtg

SEQ ID NO: 8592408 - DNA, 22 bp, Homo sapiens
cagacagagctcacaagtcttt

SEQ ID NO: 8592409 - DNA, 22 bp, Homo sapiens
cagacagacctgcaagggcaca

SEQ ID NO: 8592410 - DNA, 23 bp, Homo sapiens
agccaggggatcttgggccctgg

SEQ ID NO: 8592411 - DNA, 22 bp, Homo sapiens
agccagtgattctgatgtactg

SEQ ID NO: 8592412 - DNA, 22 bp, Homo sapiens
agccagtgatgaagactctgga

SEQ ID NO: 8592413 - DNA, 19 bp, Homo sapiens
agccagtgagcctctgggt

SEQ ID NO: 8592414 - DNA, 22 bp, Homo sapiens
agccagtgacatacgattggga

SEQ ID NO: 8592415 - DNA, 22 bp, Homo sapiens
cagaagctggtacaaggcctag

SEQ ID NO: 8592416 - DNA, 22 bp, Homo sapiens
agccaggacgttgctcagctcc

SEQ ID NO: 8592417 - DNA, 22 bp, Homo sapiens
agccaggacatctctagctgct

SEQ ID NO: 8592418 - DNA, 22 bp, Homo sapiens
agccaggatggtctcgatcggc

SEQ ID NO: 8592419 - DNA, 22 bp, Homo sapiens
cagaagcattccagcaaatagt

SEQ ID NO: 8592420 - DNA, 22 bp, Homo sapiens
cagaagaaagtggggagacaag

SEQ ID NO: 8592421 - DNA, 22 bp, Homo sapiens
cagaagacagctgtttcactcg

SEQ ID NO: 8592422 - DNA, 22 bp, Homo sapiens
cagaactgacctctgattctag

SEQ ID NO: 8592423 - DNA, 23 bp, Homo sapiens
cagaaatgacagtaagcaccctg

SEQ ID NO: 8592424 - DNA, 22 bp, Homo sapiens
agccacagcaacaagtgcaatt

SEQ ID NO: 8592425 - DNA, 22 bp, Homo sapiens
agccacagcacattgtaagaaa

SEQ ID NO: 8592426 - DNA, 22 bp, Homo sapiens
agccacagcatgtgtgtatgta

SEQ ID NO: 8592427 - DNA, 22 bp, Homo sapiens
agccacagagcaggagaccttt

SEQ ID NO: 8592428 - DNA, 17 bp, Homo sapiens
agcagaagtcagaggga

SEQ ID NO: 8592429 - DNA, 22 bp, Homo sapiens
agcagaagaaagccacatgact

SEQ ID NO: 8592430 - DNA, 22 bp, Homo sapiens
agcacagattctgaagagtcct

SEQ ID NO: 8592431 - DNA, 22 bp, Homo sapiens
agcacagcctctggtttctgac

SEQ ID NO: 8592432 - DNA, 21 bp, Homo sapiens
attttctctggatgatggtca

SEQ ID NO: 8592433 - DNA, 22 bp, Homo sapiens
agcacagataacatggagtgga

SEQ ID NO: 8592434 - DNA, 22 bp, Homo sapiens
agcacagatgcatgatcaccag

SEQ ID NO: 8592435 - DNA, 22 bp, Homo sapiens
agcacagagttgctcactgccg

SEQ ID NO: 8592436 - DNA, 22 bp, Homo sapiens
agcacagagttgctcactgccg

SEQ ID NO: 8592437 - DNA, 22 bp, Homo sapiens
agcacagatgtgagtggaggct

SEQ ID NO: 8592438 - DNA, 22 bp, Homo sapiens
agcacagagctaggagtggagg

SEQ ID NO: 8592439 - DNA, 22 bp, Homo sapiens
agcacagagttgcagagagcgt

SEQ ID NO: 8592440 - DNA, 22 bp, Homo sapiens
agcagcagaagggagacccagg

SEQ ID NO: 8592441 - DNA, 22 bp, Homo sapiens
agcagcagaaggtttgcaccca

SEQ ID NO: 8592442 - DNA, 22 bp, Homo sapiens
agcagcacatggggctggcaac

SEQ ID NO: 8592443 - DNA, 22 bp, Homo sapiens
agcagcagaaagttgatggcag

SEQ ID NO: 8592444 - DNA, 22 bp, Homo sapiens
caacttcactgtgcctctagtt

SEQ ID NO: 8592445 - DNA, 22 bp, Homo sapiens
cacagggcagtgctgcccactc

SEQ ID NO: 8592446 - DNA, 22 bp, Homo sapiens
cacaggaggaggccagagcgta

SEQ ID NO: 8592447 - DNA, 22 bp, Homo sapiens
cacaggagggagcgggcagcca

SEQ ID NO: 8592448 - DNA, 22 bp, Homo sapiens
agcaggagaacactgtggctct

SEQ ID NO: 8592449 - DNA, 22 bp, Homo sapiens
agcaggagacatgggggtggtg

SEQ ID NO: 8592450 - DNA, 22 bp, Homo sapiens
agcaggagagcagtgcgtggtc

SEQ ID NO: 8592451 - DNA, 22 bp, Homo sapiens
agcaggagatggggcgtgatgt

SEQ ID NO: 8592452 - DNA, 22 bp, Homo sapiens
agcagctgtactttcatctgtt

SEQ ID NO: 8592453 - DNA, 20 bp, Homo sapiens
agcagctgtgttttcatcct

SEQ ID NO: 8592454 - DNA, 22 bp, Homo sapiens
agcagcttatcttggagaggca

SEQ ID NO: 8592455 - DNA, 22 bp, Homo sapiens
agcagcttcctgtttgcaggca

SEQ ID NO: 8592456 - DNA, 22 bp, Homo sapiens
cacaggaagcaagcctggggcc

SEQ ID NO: 8592457 - DNA, 22 bp, Homo sapiens
cacaggagctgtggggcagtgt

SEQ ID NO: 8592458 - DNA, 22 bp, Homo sapiens
caccaggggcagagaccaaagt

SEQ ID NO: 8592459 - DNA, 22 bp, Homo sapiens
caccagggtacaatttcgcaga

SEQ ID NO: 8592460 - DNA, 22 bp, Homo sapiens
caccagggcagcagcctagtct

SEQ ID NO: 8592461 - DNA, 18 bp, Homo sapiens
agcaggtgctgtttcttt

SEQ ID NO: 8592462 - DNA, 22 bp, Homo sapiens
agcaggtggaaaattcttatca

SEQ ID NO: 8592463 - DNA, 22 bp, Homo sapiens
agcaggtgcgttacttcactct

SEQ ID NO: 8592464 - DNA, 21 bp, Homo sapiens
agcaggtgctgttggaggaaa

SEQ ID NO: 8592465 - DNA, 22 bp, Homo sapiens
caccagggacaatgctaggggt

SEQ ID NO: 8592466 - DNA, 22 bp, Homo sapiens
agcaggtggacagaggaagaaa

SEQ ID NO: 8592467 - DNA, 22 bp, Homo sapiens
agcataagttggtacagccact

SEQ ID NO: 8592468 - DNA, 22 bp, Homo sapiens
agcagggcagtgcttcagctct

SEQ ID NO: 8592469 - DNA, 22 bp, Homo sapiens
agcagggcctgagtgacctaac

SEQ ID NO: 8592470 - DNA, 22 bp, Homo sapiens
agcagggcctggcactcctggg

SEQ ID NO: 8592471 - DNA, 16 bp, Homo sapiens
agcagggcgggaagga

SEQ ID NO: 8592472 - DNA, 22 bp, Homo sapiens
agcagggctcacattagtggat

SEQ ID NO: 8592473 - DNA, 22 bp, Homo sapiens
agcagggctctgccatgggccc

SEQ ID NO: 8592474 - DNA, 22 bp, Homo sapiens
agcagggctccatttcactgcc

SEQ ID NO: 8592475 - DNA, 22 bp, Homo sapiens
agcagggctcctgaaagccgcg

SEQ ID NO: 8592476 - DNA, 22 bp, Homo sapiens
agcaggtgatcgcgtgtgctcc

SEQ ID NO: 8592477 - DNA, 22 bp, Homo sapiens
agcaggtgatgtgagtctggaa

SEQ ID NO: 8592478 - DNA, 22 bp, Homo sapiens
agcaggtgccaggtgtacccgc

SEQ ID NO: 8592479 - DNA, 22 bp, Homo sapiens
agcaggtgcatggcgagcgcgg

SEQ ID NO: 8592480 - DNA, 22 bp, Homo sapiens
actatacattgaatgttaaggt

SEQ ID NO: 8592481 - DNA, 22 bp, Homo sapiens
actatatgtgaaggtagaattt

SEQ ID NO: 8592482 - DNA, 22 bp, Homo sapiens
accttaaaggccgaagtaaaga

SEQ ID NO: 8592483 - DNA, 22 bp, Homo sapiens
actaaactgaagcatgaaaagg

SEQ ID NO: 8592484 - DNA, 22 bp, Homo sapiens
actaaagctcacagagttgaac

SEQ ID NO: 8592485 - DNA, 22 bp, Homo sapiens
actaaactgttcatcagcatct

SEQ ID NO: 8592486 - DNA, 19 bp, Homo sapiens
actaaaaatgatgtttgag

SEQ ID NO: 8592487 - DNA, 22 bp, Homo sapiens
acctggacacctgctgtcatct

SEQ ID NO: 8592488 - DNA, 22 bp, Homo sapiens
aggtagcagcctagcagggact

SEQ ID NO: 8592489 - DNA, 22 bp, Homo sapiens
actggacagaggaaatatggag

SEQ ID NO: 8592490 - DNA, 22 bp, Homo sapiens
agtggctgctatgatcaggaca

SEQ ID NO: 8592491 - DNA, 23 bp, Homo sapiens
agtggctgagagtgtttcatatg

SEQ ID NO: 8592492 - DNA, 22 bp, Homo sapiens
agtggctgatgtaggcagtggg

SEQ ID NO: 8592493 - DNA, 22 bp, Homo sapiens
agtggctgatgtaggcagtggg

SEQ ID NO: 8592494 - DNA, 22 bp, Homo sapiens
actgcaaagggaagccctttct

SEQ ID NO: 8592495 - DNA, 22 bp, Homo sapiens
actgcaacctccacctcctggg

SEQ ID NO: 8592496 - DNA, 22 bp, Homo sapiens
actgcaacctccgcctgccagg

SEQ ID NO: 8592497 - DNA, 22 bp, Homo sapiens
actgatcacatagatatattcc

SEQ ID NO: 8592498 - DNA, 22 bp, Homo sapiens
actccagggctccatcccttgt

SEQ ID NO: 8592499 - DNA, 22 bp, Homo sapiens
actccaggcatctgcttctgct

SEQ ID NO: 8592500 - DNA, 22 bp, Homo sapiens
actccagggaggtgagtgtgcg

SEQ ID NO: 8592501 - DNA, 22 bp, Homo sapiens
agtctgggaactgggaacgttt

SEQ ID NO: 8592502 - DNA, 17 bp, Homo sapiens
agtctgggacctgcgtg

SEQ ID NO: 8592503 - DNA, 22 bp, Homo sapiens
agtctgggctgtctgcaggagt

SEQ ID NO: 8592504 - DNA, 22 bp, Homo sapiens
agtctggggtctggtagaacga

SEQ ID NO: 8592505 - DNA, 22 bp, Homo sapiens
agtctgggagggatgccagtgt

SEQ ID NO: 8592506 - DNA, 22 bp, Homo sapiens
actgaacaccatttataacatt

SEQ ID NO: 8592507 - DNA, 22 bp, Homo sapiens
atatcttttagagcaagcttgt

SEQ ID NO: 8592508 - DNA, 22 bp, Homo sapiens
atatatttgagaatattcatga

SEQ ID NO: 8592509 - DNA, 22 bp, Homo sapiens
atatattcttaaagaatctgac

SEQ ID NO: 8592510 - DNA, 18 bp, Homo sapiens
atatattgacaagaggga

SEQ ID NO: 8592511 - DNA, 22 bp, Homo sapiens
atatattggtgtcagaaagagt

SEQ ID NO: 8592512 - DNA, 22 bp, Homo sapiens
actttggtttccctgttcgtaa

SEQ ID NO: 8592513 - DNA, 22 bp, Homo sapiens
actttggttataggagccaaaa

SEQ ID NO: 8592514 - DNA, 19 bp, Homo sapiens
actttggtgattagaggga

SEQ ID NO: 8592515 - DNA, 22 bp, Homo sapiens
actttggttcacagctgttcat

SEQ ID NO: 8592516 - DNA, 22 bp, Homo sapiens
actttggtgcgaagtcacttta

SEQ ID NO: 8592517 - DNA, 20 bp, Homo sapiens
actttggttattgggaccat

SEQ ID NO: 8592518 - DNA, 17 bp, Homo sapiens
actttggtcctgtgctc

SEQ ID NO: 8592519 - DNA, 22 bp, Homo sapiens
actttggtctctgcccctggtg

SEQ ID NO: 8592520 - DNA, 22 bp, Homo sapiens
actttggtgaatcagttttgtt

SEQ ID NO: 8592521 - DNA, 22 bp, Homo sapiens
actttggtcttagaggaggaat

SEQ ID NO: 8592522 - DNA, 22 bp, Homo sapiens
actttggtcccatgtgtgtaaa

SEQ ID NO: 8592523 - DNA, 22 bp, Homo sapiens
actttggtgatacagatacggc

SEQ ID NO: 8592524 - DNA, 22 bp, Homo sapiens
atatacaaagggcaacctcgct

SEQ ID NO: 8592525 - DNA, 22 bp, Homo sapiens
atatacacatctttttaaatat

SEQ ID NO: 8592526 - DNA, 22 bp, Homo sapiens
atatacacagagcttatggtga

SEQ ID NO: 8592527 - DNA, 22 bp, Homo sapiens
agaaacagcattagcatcaatt

SEQ ID NO: 8592528 - DNA, 22 bp, Homo sapiens
agaaacagaagggaaagctttt

SEQ ID NO: 8592529 - DNA, 22 bp, Homo sapiens
atccagagacccaaggacagaa

SEQ ID NO: 8592530 - DNA, 22 bp, Homo sapiens
atccagagtaatacagaatgca

SEQ ID NO: 8592531 - DNA, 22 bp, Homo sapiens
atccagagaggttaggtgacat

SEQ ID NO: 8592532 - DNA, 22 bp, Homo sapiens
atcatttaaaacaagtctctat

SEQ ID NO: 8592533 - DNA, 22 bp, Homo sapiens
acttggctagagccaggaggct

SEQ ID NO: 8592534 - DNA, 22 bp, Homo sapiens
actgttatgggtgtcagcttaa

SEQ ID NO: 8592535 - DNA, 21 bp, Homo sapiens
actgtgactgggtgtatgggt

SEQ ID NO: 8592536 - DNA, 22 bp, Homo sapiens
aggctagggtaacagatgtggc

SEQ ID NO: 8592537 - DNA, 22 bp, Homo sapiens
aggcgcacagggtgttgatgtg

SEQ ID NO: 8592538 - DNA, 22 bp, Homo sapiens
aggctgagtttctcattctcgc

SEQ ID NO: 8592539 - DNA, 22 bp, Homo sapiens
aggctgagtgctcccctagatg

SEQ ID NO: 8592540 - DNA, 22 bp, Homo sapiens
aggctgagggctcctgagggca

SEQ ID NO: 8592541 - DNA, 22 bp, Homo sapiens
aggctgaggctttccttggaga

SEQ ID NO: 8592542 - DNA, 22 bp, Homo sapiens
aggctgaggctggcagctccag

SEQ ID NO: 8592543 - DNA, 22 bp, Homo sapiens
acatttatataactcactagga

SEQ ID NO: 8592544 - DNA, 22 bp, Homo sapiens
acatttattttggcacggcaca

SEQ ID NO: 8592545 - DNA, 22 bp, Homo sapiens
acatttattttcagctgggaaa

SEQ ID NO: 8592546 - DNA, 22 bp, Homo sapiens
acatttatataactcactagga

SEQ ID NO: 8592547 - DNA, 22 bp, Homo sapiens
acatttattactcaggttgttg

SEQ ID NO: 8592548 - DNA, 22 bp, Homo sapiens
acatttatatttagtggggaat

SEQ ID NO: 8592549 - DNA, 22 bp, Homo sapiens
aggcagggctgggattagactc

SEQ ID NO: 8592550 - DNA, 22 bp, Homo sapiens
aggcaggggagctggaagggta

SEQ ID NO: 8592551 - DNA, 22 bp, Homo sapiens
aggcaggcagggctcactgtct

SEQ ID NO: 8592552 - DNA, 22 bp, Homo sapiens
aggcagggaccagttgttttct

SEQ ID NO: 8592553 - DNA, 22 bp, Homo sapiens
aggcagggctcatttcttaggc

SEQ ID NO: 8592554 - DNA, 22 bp, Homo sapiens
acatgatttgcatgatttgtaa

SEQ ID NO: 8592555 - DNA, 22 bp, Homo sapiens
agggaagccctggctgagaccc

SEQ ID NO: 8592556 - DNA, 22 bp, Homo sapiens
agggaagcttgttactgagaag

SEQ ID NO: 8592557 - DNA, 22 bp, Homo sapiens
agggacagatgaatgactgagt

SEQ ID NO: 8592558 - DNA, 23 bp, Homo sapiens
agggagctaaaaggctggagcag

SEQ ID NO: 8592559 - DNA, 22 bp, Homo sapiens
accaggagttgggggtgggacc

SEQ ID NO: 8592560 - DNA, 23 bp, Homo sapiens
accaggagttgtctcaggaaaca

SEQ ID NO: 8592561 - DNA, 22 bp, Homo sapiens
aggctgcagaacagtcaggtgc

SEQ ID NO: 8592562 - DNA, 22 bp, Homo sapiens
agggaagaggaccagagtctct

SEQ ID NO: 8592563 - DNA, 22 bp, Homo sapiens
agggaagaggaccagagtctct

SEQ ID NO: 8592564 - DNA, 22 bp, Homo sapiens
aggctggagtgtgcagtggcgc

SEQ ID NO: 8592565 - DNA, 22 bp, Homo sapiens
acccaggcctgagagacaggag

SEQ ID NO: 8592566 - DNA, 22 bp, Homo sapiens
agggcctgggccagcacccttt

SEQ ID NO: 8592567 - DNA, 22 bp, Homo sapiens
agggcctgggatgtcctcctag

SEQ ID NO: 8592568 - DNA, 22 bp, Homo sapiens
accctaataatcacagactagt

SEQ ID NO: 8592569 - DNA, 22 bp, Homo sapiens
agggcctggtgacctgggtcct

SEQ ID NO: 8592570 - DNA, 22 bp, Homo sapiens
agggagctctgggggcacacgg

SEQ ID NO: 8592571 - DNA, 22 bp, Homo sapiens
agggagctctgggggcacacgg

SEQ ID NO: 8592572 - DNA, 22 bp, Homo sapiens
agggagctcacagtccagtaga

SEQ ID NO: 8592573 - DNA, 22 bp, Homo sapiens
agggagctcgatgcctgagtgt

SEQ ID NO: 8592574 - DNA, 22 bp, Homo sapiens
acccaggagcaggctgggcagt

SEQ ID NO: 8592575 - DNA, 22 bp, Homo sapiens
acccaggagcaggctgggcagt

SEQ ID NO: 8592576 - DNA, 22 bp, Homo sapiens
acagtgataaaatttcacatgt

SEQ ID NO: 8592577 - DNA, 22 bp, Homo sapiens
acagtgattctgcaaaccatat

SEQ ID NO: 8592578 - DNA, 22 bp, Homo sapiens
acagtgcaaaccctcgggaaag

SEQ ID NO: 8592579 - DNA, 22 bp, Homo sapiens
aggcagctggaggcagagacta

SEQ ID NO: 8592580 - DNA, 22 bp, Homo sapiens
aggcagctggaggcagagacta

SEQ ID NO: 8592581 - DNA, 22 bp, Homo sapiens
aggcaggcacacttcctccagg

SEQ ID NO: 8592582 - DNA, 22 bp, Homo sapiens
aggcagcatgctctgcttctac

SEQ ID NO: 8592583 - DNA, 22 bp, Homo sapiens
aggcagcatccagaggagaatg

SEQ ID NO: 8592584 - DNA, 22 bp, Homo sapiens
aggcagcatccagaggagaatg

SEQ ID NO: 8592585 - DNA, 19 bp, Homo sapiens
acagtttgggaaatgagca

SEQ ID NO: 8592586 - DNA, 22 bp, Homo sapiens
aggcagcatgggccccagctcc

SEQ ID NO: 8592587 - DNA, 22 bp, Homo sapiens
aggaggaaaaaggccacagcaa

SEQ ID NO: 8592588 - DNA, 22 bp, Homo sapiens
aggagtcataaatgtgaacaaa

SEQ ID NO: 8592589 - DNA, 22 bp, Homo sapiens
aggagtcagatatgggaaagtt

SEQ ID NO: 8592590 - DNA, 22 bp, Homo sapiens
aggagtcaggaccaaatggaaa

SEQ ID NO: 8592591 - DNA, 22 bp, Homo sapiens
acaggtggtctttgctcctttt

SEQ ID NO: 8592592 - DNA, 22 bp, Homo sapiens
acaggtgtaaaacccaggatgg

SEQ ID NO: 8592593 - DNA, 22 bp, Homo sapiens
acaggtgtaatttgcccgaggt

SEQ ID NO: 8592594 - DNA, 21 bp, Homo sapiens
aggagctgtgttagctggtcg

SEQ ID NO: 8592595 - DNA, 21 bp, Homo sapiens
aggagctgtgttagctggtcg

SEQ ID NO: 8592596 - DNA, 22 bp, Homo sapiens
acaggtggcttattggctgatt

SEQ ID NO: 8592597 - DNA, 22 bp, Homo sapiens
acaggtggcttccattttctaa

SEQ ID NO: 8592598 - DNA, 22 bp, Homo sapiens
acaggtgggcttaagagtcggc

SEQ ID NO: 8592599 - DNA, 22 bp, Homo sapiens
acaggtggggcacttggagcct

SEQ ID NO: 8592600 - DNA, 22 bp, Homo sapiens
acaggtggggaggctgaggttc

SEQ ID NO: 8592601 - DNA, 22 bp, Homo sapiens
acaggtggtaaaatggactgtc

SEQ ID NO: 8592602 - DNA, 22 bp, Homo sapiens
acaggtggtagagtggaaagag

SEQ ID NO: 8592603 - DNA, 18 bp, Homo sapiens
acagggagggcgctgggg

SEQ ID NO: 8592604 - DNA, 22 bp, Homo sapiens
acagggcacctgaggtaggaag

SEQ ID NO: 8592605 - DNA, 22 bp, Homo sapiens
acagggcaacctctgggagact

SEQ ID NO: 8592606 - DNA, 22 bp, Homo sapiens
acaggtggaggctttaggaggt

SEQ ID NO: 8592607 - DNA, 22 bp, Homo sapiens
acaggtggagtggttagcaggc

SEQ ID NO: 8592608 - DNA, 22 bp, Homo sapiens
acaggtggccccgagggagtgg

SEQ ID NO: 8592609 - DNA, 22 bp, Homo sapiens
acaggtggcataggcagtttga

SEQ ID NO: 8592610 - DNA, 22 bp, Homo sapiens
acaggtggcactgctgttactc

SEQ ID NO: 8592611 - DNA, 22 bp, Homo sapiens
acaggtggcagaagcatttact

SEQ ID NO: 8592612 - DNA, 22 bp, Homo sapiens
acaggtggacacagcagcagtc

SEQ ID NO: 8592613 - DNA, 22 bp, Homo sapiens
acaggtggaaacatggtgttgg

SEQ ID NO: 8592614 - DNA, 22 bp, Homo sapiens
aggaatgtagtttgagtagaaa

SEQ ID NO: 8592615 - DNA, 18 bp, Homo sapiens
acaggctgtgggaatggt

SEQ ID NO: 8592616 - DNA, 22 bp, Homo sapiens
agctttatgggagcttagataa

SEQ ID NO: 8592617 - DNA, 22 bp, Homo sapiens
acaggctgcccgctccccacct

SEQ ID NO: 8592618 - DNA, 22 bp, Homo sapiens
acaggctggtggtcctggccat

SEQ ID NO: 8592619 - DNA, 22 bp, Homo sapiens
acaggctggtggtcctggccat

SEQ ID NO: 8592620 - DNA, 22 bp, Homo sapiens
agctttatgcttcctacaagct

SEQ ID NO: 8592621 - DNA, 22 bp, Homo sapiens
agctttatgaggagaccttagt

SEQ ID NO: 8592622 - DNA, 22 bp, Homo sapiens
agctttatcccttgcccatcga

SEQ ID NO: 8592623 - DNA, 22 bp, Homo sapiens
agctttatcttcacctgggaat

SEQ ID NO: 8592624 - DNA, 22 bp, Homo sapiens
agctttatcacaatattggcta

SEQ ID NO: 8592625 - DNA, 22 bp, Homo sapiens
agctttatcagaggagtctcta

SEQ ID NO: 8592626 - DNA, 22 bp, Homo sapiens
acaggcctgatgccttggctgg

SEQ ID NO: 8592627 - DNA, 22 bp, Homo sapiens
acagctgtgggctctgcatata

SEQ ID NO: 8592628 - DNA, 22 bp, Homo sapiens
acagctgtgatttctatcatga

SEQ ID NO: 8592629 - DNA, 22 bp, Homo sapiens
agctgggtcttgggccaggaga

SEQ ID NO: 8592630 - DNA, 22 bp, Homo sapiens
agctgggtgaaggcagatggct

SEQ ID NO: 8592631 - DNA, 22 bp, Homo sapiens
acagctcagacatcactgctct

SEQ ID NO: 8592632 - DNA, 22 bp, Homo sapiens
acagctaggtcttcagcacttt

SEQ ID NO: 8592633 - DNA, 22 bp, Homo sapiens
acagctaggaaatggaagaact

SEQ ID NO: 8592634 - DNA, 20 bp, Homo sapiens
agctgggcaattatgactat

SEQ ID NO: 8592635 - DNA, 22 bp, Homo sapiens
agctggggctgcagagaacagg

SEQ ID NO: 8592636 - DNA, 22 bp, Homo sapiens
agctggggctgcagagaacagg

SEQ ID NO: 8592637 - DNA, 22 bp, Homo sapiens
agctgggtcaataggaaatgta

SEQ ID NO: 8592638 - DNA, 22 bp, Homo sapiens
agctggggttgcacacattttg

SEQ ID NO: 8592639 - DNA, 22 bp, Homo sapiens
agctgggggttggataagggta

SEQ ID NO: 8592640 - DNA, 22 bp, Homo sapiens
agctgggggtagtgagaaataa

SEQ ID NO: 8592641 - DNA, 22 bp, Homo sapiens
agctgggggtagtgagaaataa

SEQ ID NO: 8592642 - DNA, 22 bp, Homo sapiens
agctggggctgtggttgtgatt

SEQ ID NO: 8592643 - DNA, 22 bp, Homo sapiens
agctggggctgtggttgtgatt

SEQ ID NO: 8592644 - DNA, 22 bp, Homo sapiens
agctgccccatgagaggcaggt

SEQ ID NO: 8592645 - DNA, 22 bp, Homo sapiens
agctgcaggcccatgctcagtc

SEQ ID NO: 8592646 - DNA, 22 bp, Homo sapiens
acagcagacagtcggcttcctg

SEQ ID NO: 8592647 - DNA, 22 bp, Homo sapiens
acagcagacagtcggcttcctg

SEQ ID NO: 8592648 - DNA, 21 bp, Homo sapiens
acagcagacaggcttaggacc

SEQ ID NO: 8592649 - DNA, 22 bp, Homo sapiens
aacagaagggggtatttacatt

SEQ ID NO: 8592650 - DNA, 22 bp, Homo sapiens
aacagacatatttttaatatgc

SEQ ID NO: 8592651 - DNA, 22 bp, Homo sapiens
aacagacagaaaaatgtgatct

SEQ ID NO: 8592652 - DNA, 22 bp, Homo sapiens
aacagacaactcctgtggctca

SEQ ID NO: 8592653 - DNA, 22 bp, Homo sapiens
aacactttcttccttgctcagg

SEQ ID NO: 8592654 - DNA, 22 bp, Homo sapiens
aacactgtatcagtcttcaata

SEQ ID NO: 8592655 - DNA, 22 bp, Homo sapiens
aacacagttttccaaaatagag

SEQ ID NO: 8592656 - DNA, 22 bp, Homo sapiens
aaggctggttccatccctggtg

SEQ ID NO: 8592657 - DNA, 22 bp, Homo sapiens
aaatgcatttttaattagaccc

SEQ ID NO: 8592658 - DNA, 22 bp, Homo sapiens
aaggcagccatgtgctttgggt

SEQ ID NO: 8592659 - DNA, 22 bp, Homo sapiens
aaggcagcagtgcacgactgat

SEQ ID NO: 8592660 - DNA, 22 bp, Homo sapiens
aaggcagcaggatttggtgact

SEQ ID NO: 8592661 - DNA, 22 bp, Homo sapiens
aaggcagccagatcctttgggt

SEQ ID NO: 8592662 - DNA, 22 bp, Homo sapiens
aaggcagcaactaatggatctc

SEQ ID NO: 8592663 - DNA, 22 bp, Homo sapiens
aaggcagcaccgcctcctgaaa

SEQ ID NO: 8592664 - DNA, 22 bp, Homo sapiens
aacatgtgtcttgcatttcttg

SEQ ID NO: 8592665 - DNA, 22 bp, Homo sapiens
aacatgtgtctggctagattgt

SEQ ID NO: 8592666 - DNA, 22 bp, Homo sapiens
aacatgtgtcttgcatttcttg

SEQ ID NO: 8592667 - DNA, 22 bp, Homo sapiens
aacccgggaggtggaggttatg

SEQ ID NO: 8592668 - DNA, 22 bp, Homo sapiens
aacccgggaggcggaggttgtg

SEQ ID NO: 8592669 - DNA, 22 bp, Homo sapiens
aacctcaaactcttgggcttaa

SEQ ID NO: 8592670 - DNA, 22 bp, Homo sapiens
aacctgctttctcagagaaggg

SEQ ID NO: 8592671 - DNA, 22 bp, Homo sapiens
aatggccagctgggagagttga

SEQ ID NO: 8592672 - DNA, 22 bp, Homo sapiens
aatggccatatcattgcagagc

SEQ ID NO: 8592673 - DNA, 22 bp, Homo sapiens
aatggctctgatgttgttgtga

SEQ ID NO: 8592674 - DNA, 23 bp, Homo sapiens
aagtgggtttagacagtcatttt

SEQ ID NO: 8592675 - DNA, 22 bp, Homo sapiens
aagtgggttggacaaatgaccc

SEQ ID NO: 8592676 - DNA, 20 bp, Homo sapiens
aagtgggtttattctttttc

SEQ ID NO: 8592677 - DNA, 22 bp, Homo sapiens
aagtgggtttgaaatgctttca

SEQ ID NO: 8592678 - DNA, 22 bp, Homo sapiens
aatagattcatggttaagagca

SEQ ID NO: 8592679 - DNA, 22 bp, Homo sapiens
aacatgtgagcaggttttttat

SEQ ID NO: 8592680 - DNA, 22 bp, Homo sapiens
aacatgtgtctggctagattgt

SEQ ID NO: 8592681 - DNA, 22 bp, Homo sapiens
aagcaagacagaagttactgcc

SEQ ID NO: 8592682 - DNA, 22 bp, Homo sapiens
aagcaagagttggagtgatgtt

SEQ ID NO: 8592683 - DNA, 22 bp, Homo sapiens
aagcaagcccaggctcagtcaa

SEQ ID NO: 8592684 - DNA, 22 bp, Homo sapiens
aagatgcctgtagcaggaagat

SEQ ID NO: 8592685 - DNA, 22 bp, Homo sapiens
aagatgctaattgtggaagttg

SEQ ID NO: 8592686 - DNA, 22 bp, Homo sapiens
aagatgctggcaggaatagcta

SEQ ID NO: 8592687 - DNA, 22 bp, Homo sapiens
aagatgcttgcaaatttctgaa

SEQ ID NO: 8592688 - DNA, 22 bp, Homo sapiens
aagatgcttccactgcagtggc

SEQ ID NO: 8592689 - DNA, 22 bp, Homo sapiens
aagatggtttctgtaggtttat

SEQ ID NO: 8592690 - DNA, 22 bp, Homo sapiens
aagcacaatttaggactgaaat

SEQ ID NO: 8592691 - DNA, 22 bp, Homo sapiens
aagcagagcctgagacagggat

SEQ ID NO: 8592692 - DNA, 22 bp, Homo sapiens
aagcagagccaccagctttgga

SEQ ID NO: 8592693 - DNA, 22 bp, Homo sapiens
aagcagagaccggctaatggag

SEQ ID NO: 8592694 - DNA, 22 bp, Homo sapiens
aagcagagaaaagcttaggttc

SEQ ID NO: 8592695 - DNA, 22 bp, Homo sapiens
aagcagagaatctgggagcgag

SEQ ID NO: 8592696 - DNA, 19 bp, Homo sapiens
aagcagactctgagccagg

SEQ ID NO: 8592697 - DNA, 18 bp, Homo sapiens
aagcagacagcagacagt

SEQ ID NO: 8592698 - DNA, 21 bp, Homo sapiens
aagcagacctgagcacagaac

SEQ ID NO: 8592699 - DNA, 22 bp, Homo sapiens
acagcagagcaccagggccact

SEQ ID NO: 8592700 - DNA, 21 bp, Homo sapiens
acagcagagatcaagactaag

SEQ ID NO: 8592701 - DNA, 22 bp, Homo sapiens
acagcagagccagtggctctag

SEQ ID NO: 8592702 - DNA, 22 bp, Homo sapiens
acagcagagacactcaggaggc

SEQ ID NO: 8592703 - DNA, 22 bp, Homo sapiens
acagcagagacactcaggaggc

SEQ ID NO: 8592704 - DNA, 22 bp, Homo sapiens
acagcagagacactcaggaggc

SEQ ID NO: 8592705 - DNA, 22 bp, Homo sapiens
acagcagagaactttagagggt

SEQ ID NO: 8592706 - DNA, 22 bp, Homo sapiens
aagcagaggaccgacggaggga

SEQ ID NO: 8592707 - DNA, 22 bp, Homo sapiens
aagcagaggccacagagtgggc

SEQ ID NO: 8592708 - DNA, 22 bp, Homo sapiens
aagcagagggtatggccaggtt

SEQ ID NO: 8592709 - DNA, 22 bp, Homo sapiens
acagcagagtggagatgagcac

SEQ ID NO: 8592710 - DNA, 22 bp, Homo sapiens
acagcagaggaaaagtctgata

SEQ ID NO: 8592711 - DNA, 21 bp, Homo sapiens
aagcagcttaataaagtatgt

SEQ ID NO: 8592712 - DNA, 21 bp, Homo sapiens
aagcaggaacttcaaagggac

SEQ ID NO: 8592713 - DNA, 22 bp, Homo sapiens
aagagcaacttggaaacactca

SEQ ID NO: 8592714 - DNA, 22 bp, Homo sapiens
aagagcaccttaattatgcaga

SEQ ID NO: 8592715 - DNA, 22 bp, Homo sapiens
aagagcagaagtccttggatcc

SEQ ID NO: 8592716 - DNA, 22 bp, Homo sapiens
acacaaaatcaaagtcctaggc

SEQ ID NO: 8592717 - DNA, 21 bp, Homo sapiens
aagagacatttctcatcagca

SEQ ID NO: 8592718 - DNA, 22 bp, Homo sapiens
aagagacagagccatgtttcta

SEQ ID NO: 8592719 - DNA, 22 bp, Homo sapiens
aatttcagttgctaataagttc

SEQ ID NO: 8592720 - DNA, 20 bp, Homo sapiens
aattttatctccatcctttg

SEQ ID NO: 8592721 - DNA, 22 bp, Homo sapiens
aagaaacaaccactgctctcct

SEQ ID NO: 8592722 - DNA, 22 bp, Homo sapiens
aagaaaaggtaaccgcttatct

SEQ ID NO: 8592723 - DNA, 22 bp, Homo sapiens
aaacacattttaggaaaatcta

SEQ ID NO: 8592724 - DNA, 22 bp, Homo sapiens
aaagagctcttactctagtgta

SEQ ID NO: 8592725 - DNA, 22 bp, Homo sapiens
aaagagctgggacttaaagtgc

SEQ ID NO: 8592726 - DNA, 22 bp, Homo sapiens
aaagagctgatagcatctgttt

SEQ ID NO: 8592727 - DNA, 22 bp, Homo sapiens
aaagagcccttccatgactctt

SEQ ID NO: 8592728 - DNA, 22 bp, Homo sapiens
aaagagccagggcattaggtga

SEQ ID NO: 8592729 - DNA, 18 bp, Homo sapiens
aaagagccacccagggcc

SEQ ID NO: 8592730 - DNA, 22 bp, Homo sapiens
aaagagccagctacctcagttt

SEQ ID NO: 8592731 - DNA, 22 bp, Homo sapiens
aaagagctatacaaccatgtcc

SEQ ID NO: 8592732 - DNA, 22 bp, Homo sapiens
aaagagcctatattcagctgca

SEQ ID NO: 8592733 - DNA, 22 bp, Homo sapiens
aaaatatgactgtgctccttaa

SEQ ID NO: 8592734 - DNA, 22 bp, Homo sapiens
aaaatatgtataactcttctgc

SEQ ID NO: 8592735 - DNA, 22 bp, Homo sapiens
aaaaagcttaaatgagcagttc

SEQ ID NO: 8592736 - DNA, 21 bp, Homo sapiens
aaaaagctggggcatgcatgc

SEQ ID NO: 8592737 - DNA, 22 bp, Homo sapiens
aaaaagtctgcaaaggaggttg

SEQ ID NO: 8592738 - DNA, 22 bp, Homo sapiens
aaaaggaggtcactttattcct

SEQ ID NO: 8592739 - DNA, 22 bp, Homo sapiens
aaaaggcagtgcaagagagggt

SEQ ID NO: 8592740 - DNA, 22 bp, Homo sapiens
aaacagctgggaggtagaggcg

SEQ ID NO: 8592741 - DNA, 22 bp, Homo sapiens
aaacatctcaaagaggtatttg

SEQ ID NO: 8592742 - DNA, 22 bp, Homo sapiens
aaagccagaattcgtccagcct

SEQ ID NO: 8592743 - DNA, 22 bp, Homo sapiens
aaagccagaattcgtccagcct

SEQ ID NO: 8592744 - DNA, 22 bp, Homo sapiens
aaacactgtgggacatcttact

SEQ ID NO: 8592745 - DNA, 22 bp, Homo sapiens
aaagccaggcagccaagccagt

SEQ ID NO: 8592746 - DNA, 22 bp, Homo sapiens
aaacatgggcttcctgatgcga

SEQ ID NO: 8592747 - DNA, 22 bp, Homo sapiens
aaagatcagtctgaagcaacat

SEQ ID NO: 8592748 - DNA, 22 bp, Homo sapiens
aaagagcaagctgagatttgaa

SEQ ID NO: 8592749 - DNA, 22 bp, Homo sapiens
aaagaacaaattagctgtttta

SEQ ID NO: 8592750 - DNA, 22 bp, Homo sapiens
aaagactgcaaaaacgcacaga

SEQ ID NO: 8592751 - DNA, 22 bp, Homo sapiens
aaagactgaggggaaagtgatg

SEQ ID NO: 8592752 - DNA, 22 bp, Homo sapiens
aaagactgggactgcagcaggc

SEQ ID NO: 8592753 - DNA, 22 bp, Homo sapiens
aaagactggttggggtgggcag

SEQ ID NO: 8592754 - DNA, 22 bp, Homo sapiens
aacatagacccagttcaacaaa

SEQ ID NO: 8592755 - DNA, 22 bp, Homo sapiens
aaagcagaggtgatatgactta

SEQ ID NO: 8592756 - DNA, 19 bp, Homo sapiens
aaagcagaggagcatctga

SEQ ID NO: 8592757 - DNA, 22 bp, Homo sapiens
aaagcagaggttgcagtgagct

SEQ ID NO: 8592758 - DNA, 22 bp, Homo sapiens
aaagcagattctgatgcagtag

SEQ ID NO: 8592759 - DNA, 22 bp, Homo sapiens
aaagcagagatcatggcttgta

SEQ ID NO: 8592760 - DNA, 22 bp, Homo sapiens
aaagcagactgatttgcatcac

SEQ ID NO: 8592761 - DNA, 22 bp, Homo sapiens
aaagcagagcagggcacttatg

SEQ ID NO: 8592762 - DNA, 22 bp, Homo sapiens
aaagcagaactgagagagctgg

SEQ ID NO: 8592763 - DNA, 22 bp, Homo sapiens
aaagattatggcattgaaatac

SEQ ID NO: 8592764 - DNA, 22 bp, Homo sapiens
aaagtaagatttgcatttcaga

SEQ ID NO: 8592765 - DNA, 22 bp, Homo sapiens
aaagtaagggttaatctacttt

SEQ ID NO: 8592766 - DNA, 22 bp, Homo sapiens
aacatttgtttcgttatgtgaa

SEQ ID NO: 8592767 - DNA, 22 bp, Homo sapiens
aacccaggagacaggttgcagt

SEQ ID NO: 8592768 - DNA, 22 bp, Homo sapiens
aacccagggtggaggttgcagt

SEQ ID NO: 8592769 - DNA, 22 bp, Homo sapiens
aacccgggaggcagaggttgtg

SEQ ID NO: 8592770 - DNA, 22 bp, Homo sapiens
aaaggcaggactgcagcatagg

SEQ ID NO: 8592771 - DNA, 18 bp, Homo sapiens
aaaggcagattactggga

SEQ ID NO: 8592772 - DNA, 22 bp, Homo sapiens
aaaggcagtgtgatactgtggt

SEQ ID NO: 8592773 - DNA, 22 bp, Homo sapiens
aaaggcaggctttcacatctca

SEQ ID NO: 8592774 - DNA, 22 bp, Homo sapiens
aagatcaagatcagagaacagc

SEQ ID NO: 8592775 - DNA, 22 bp, Homo sapiens
aagcaggagagcctgggcgagc

SEQ ID NO: 8592776 - DNA, 22 bp, Homo sapiens
aagcaggagagcctgggtgagc

SEQ ID NO: 8592777 - DNA, 22 bp, Homo sapiens
aagcaggcagggtggagagttt

SEQ ID NO: 8592778 - DNA, 22 bp, Homo sapiens
aagcaggcatgggaggccatcc

SEQ ID NO: 8592779 - DNA, 22 bp, Homo sapiens
aagcaggcatcttggaggtcaa

SEQ ID NO: 8592780 - DNA, 22 bp, Homo sapiens
aagcaggcattccagagacaat

SEQ ID NO: 8592781 - DNA, 22 bp, Homo sapiens
aagaggggtggtctgtgaggat

SEQ ID NO: 8592782 - DNA, 22 bp, Homo sapiens
acacagaggctccagagataga

SEQ ID NO: 8592783 - DNA, 22 bp, Homo sapiens
acacagaggtggccactctttt

SEQ ID NO: 8592784 - DNA, 22 bp, Homo sapiens
acacagagggcagaagatacat

SEQ ID NO: 8592785 - DNA, 22 bp, Homo sapiens
acacagaggaaagtgtgaaggg

SEQ ID NO: 8592786 - DNA, 21 bp, Homo sapiens
acacagaggcatcatcacttt

SEQ ID NO: 8592787 - DNA, 22 bp, Homo sapiens
acacagaggcatgacagtggct

SEQ ID NO: 8592788 - DNA, 22 bp, Homo sapiens
acacagagttattatgtgaact

SEQ ID NO: 8592789 - DNA, 22 bp, Homo sapiens
acacagagtttgacacatggga

SEQ ID NO: 8592790 - DNA, 22 bp, Homo sapiens
acacagagtatttagaaggggt

SEQ ID NO: 8592791 - DNA, 22 bp, Homo sapiens
acacagagtccttactgaggta

SEQ ID NO: 8592792 - DNA, 22 bp, Homo sapiens
acacagagtccttactgaggta

SEQ ID NO: 8592793 - DNA, 22 bp, Homo sapiens
agcagatgtttcagagcaggct

SEQ ID NO: 8592794 - DNA, 22 bp, Homo sapiens
agcagatgtgtctctgcactgt

SEQ ID NO: 8592795 - DNA, 22 bp, Homo sapiens
agcagatgagcctcatgactgg

SEQ ID NO: 8592796 - DNA, 18 bp, Homo sapiens
agcagagcccatgcattc

SEQ ID NO: 8592797 - DNA, 22 bp, Homo sapiens
agcagagcaaagctcagaaatg

SEQ ID NO: 8592798 - DNA, 22 bp, Homo sapiens
agcagagaggaggtggccctgt

SEQ ID NO: 8592799 - DNA, 22 bp, Homo sapiens
agcagagccaggtctctctgta

SEQ ID NO: 8592800 - DNA, 19 bp, Homo sapiens
agcagagcagggccgtggg

SEQ ID NO: 8592801 - DNA, 22 bp, Homo sapiens
agcagagcagatagtattatct

SEQ ID NO: 8592802 - DNA, 22 bp, Homo sapiens
acacatgtttgtgtagtcagtt

SEQ ID NO: 8592803 - DNA, 22 bp, Homo sapiens
acagacaagtagttcagacaag

SEQ ID NO: 8592804 - DNA, 22 bp, Homo sapiens
acagacagggcacctgcctcct

SEQ ID NO: 8592805 - DNA, 22 bp, Homo sapiens
acagacagattttgtctgatgt

SEQ ID NO: 8592806 - DNA, 22 bp, Homo sapiens
acagacagacagattgcatatg

SEQ ID NO: 8592807 - DNA, 22 bp, Homo sapiens
acagacagaggctccatgagga

SEQ ID NO: 8592808 - DNA, 22 bp, Homo sapiens
acagacagaggctccatgagga

SEQ ID NO: 8592809 - DNA, 22 bp, Homo sapiens
acagacagacagagaactattc

SEQ ID NO: 8592810 - DNA, 22 bp, Homo sapiens
acagaaaaatgagggagctgga

SEQ ID NO: 8592811 - DNA, 22 bp, Homo sapiens
acagaaaatgccagaagggtgg

SEQ ID NO: 8592812 - DNA, 22 bp, Homo sapiens
acagaaacccagaaaacctctc

SEQ ID NO: 8592813 - DNA, 19 bp, Homo sapiens
agccagggtccagacatgt

SEQ ID NO: 8592814 - DNA, 21 bp, Homo sapiens
acagagaaagagcagcctcct

SEQ ID NO: 8592815 - DNA, 22 bp, Homo sapiens
acagagaaactaaggagtttgg

SEQ ID NO: 8592816 - DNA, 22 bp, Homo sapiens
acagagaaagtgggctgaagat

SEQ ID NO: 8592817 - DNA, 22 bp, Homo sapiens
acagagaaagttcctctcaggc

SEQ ID NO: 8592818 - DNA, 22 bp, Homo sapiens
acagagctaatgttgcataggc

SEQ ID NO: 8592819 - DNA, 22 bp, Homo sapiens
agaggctgtgcccaccaggcaa

SEQ ID NO: 8592820 - DNA, 22 bp, Homo sapiens
agaggctgatggagtagtgtct

SEQ ID NO: 8592821 - DNA, 22 bp, Homo sapiens
agagggggaaaatagaggtgtt

SEQ ID NO: 8592822 - DNA, 22 bp, Homo sapiens
agagggggcagcggaccagtga

SEQ ID NO: 8592823 - DNA, 22 bp, Homo sapiens
agagggggcagcggaccagtga

SEQ ID NO: 8592824 - DNA, 22 bp, Homo sapiens
agaggctgaatgatgtcatcat

SEQ ID NO: 8592825 - DNA, 22 bp, Homo sapiens
agaggctctggtgcagcatgca

SEQ ID NO: 8592826 - DNA, 22 bp, Homo sapiens
agaggctctggtgcagcatgca

SEQ ID NO: 8592827 - DNA, 18 bp, Homo sapiens
acaagcaggggcaaacac

SEQ ID NO: 8592828 - DNA, 22 bp, Homo sapiens
acaagcagtaaaggccacagtc

SEQ ID NO: 8592829 - DNA, 22 bp, Homo sapiens
acaacaatctaccctagcttct

SEQ ID NO: 8592830 - DNA, 22 bp, Homo sapiens
agataatgattctgcatttcta

SEQ ID NO: 8592831 - DNA, 22 bp, Homo sapiens
agataatggagggatttgcatt

SEQ ID NO: 8592832 - DNA, 22 bp, Homo sapiens
acaagagattatctacagatga

SEQ ID NO: 8592833 - DNA, 22 bp, Homo sapiens
agagacagatctgagggacctc

SEQ ID NO: 8592834 - DNA, 22 bp, Homo sapiens
agagcctggcaaaaggtcctgc

SEQ ID NO: 8592835 - DNA, 22 bp, Homo sapiens
agagcctggacttttctgagcc

SEQ ID NO: 8592836 - DNA, 22 bp, Homo sapiens
agagcctggaggttctgctgaa

SEQ ID NO: 8592837 - DNA, 22 bp, Homo sapiens
aattctgatgaataaatcatcc

SEQ ID NO: 8592838 - DNA, 22 bp, Homo sapiens
agagcctgctgtgtaagtcaca

SEQ ID NO: 8592839 - DNA, 22 bp, Homo sapiens
agagcctggacctgagctacaa

SEQ ID NO: 8592840 - DNA, 22 bp, Homo sapiens
agagcctggacctgggctctga

SEQ ID NO: 8592841 - DNA, 22 bp, Homo sapiens
agagcctggacctgagctacaa

SEQ ID NO: 8592842 - DNA, 22 bp, Homo sapiens
agagcctgcatctagcctcaga

SEQ ID NO: 8592843 - DNA, 22 bp, Homo sapiens
agagcctgcatcaggcttgggg

SEQ ID NO: 8592844 - DNA, 22 bp, Homo sapiens
agagccagttacaactgtggag

SEQ ID NO: 8592845 - DNA, 22 bp, Homo sapiens
agagacaggatatctgctcatg

SEQ ID NO: 8592846 - DNA, 22 bp, Homo sapiens
aatgtaaaatatcttgtacttg

SEQ ID NO: 8592847 - DNA, 23 bp, Homo sapiens
aatgggtgcaactatccatgaca

SEQ ID NO: 8592848 - DNA, 23 bp, Homo sapiens
agaagcagcttctggagtatcgg

SEQ ID NO: 8592849 - DNA, 22 bp, Homo sapiens
agaagcagactctgaggcaagg

SEQ ID NO: 8592850 - DNA, 22 bp, Homo sapiens
agaagcagcaagcccttcaaag

SEQ ID NO: 8592851 - DNA, 20 bp, Homo sapiens
agacaatgagtgacagagtt

SEQ ID NO: 8592852 - DNA, 19 bp, Homo sapiens
agacaatggggttggcagt

SEQ ID NO: 8592853 - DNA, 22 bp, Homo sapiens
aatggcaattcagtgaaattat

SEQ ID NO: 8592854 - DNA, 22 bp, Homo sapiens
aatggccagcaacaggagtgaa

SEQ ID NO: 8592855 - DNA, 22 bp, Homo sapiens
aatggccagacagatggctgct

SEQ ID NO: 8592856 - DNA, 22 bp, Homo sapiens
agaaatagaggaaaggtttgac

SEQ ID NO: 8592857 - DNA, 22 bp, Homo sapiens
agaagcagaaaagggcactttt

SEQ ID NO: 8592858 - DNA, 22 bp, Homo sapiens
agaagcagaaactgggcttgtg

SEQ ID NO: 8592859 - DNA, 22 bp, Homo sapiens
agaagcagaaggaagcagggcc

SEQ ID NO: 8592860 - DNA, 22 bp, Homo sapiens
aatgagttctggttcattttat

SEQ ID NO: 8592861 - DNA, 22 bp, Homo sapiens
aatatagaatcactttccttca

SEQ ID NO: 8592862 - DNA, 22 bp, Homo sapiens
aatatagttctggtattgttaa

SEQ ID NO: 8592863 - DNA, 22 bp, Homo sapiens
actgggctgttttttgagtgga

SEQ ID NO: 8592864 - DNA, 22 bp, Homo sapiens
actgggctgtggacacccagcg

SEQ ID NO: 8592865 - DNA, 22 bp, Homo sapiens
actttatgatacagggaagggt

SEQ ID NO: 8592866 - DNA, 22 bp, Homo sapiens
actttatgctaaactttactct

SEQ ID NO: 8592867 - DNA, 21 bp, Homo sapiens
actttatgacctacccttttt

SEQ ID NO: 8592868 - DNA, 20 bp, Homo sapiens
actttatgagttcaattttg

SEQ ID NO: 8592869 - DNA, 23 bp, Homo sapiens
actttattgaccccaggtcagtt

SEQ ID NO: 8592870 - DNA, 22 bp, Homo sapiens
actttatgtttgatatctatgg

SEQ ID NO: 8592871 - DNA, 22 bp, Homo sapiens
actttatgtgcttgctctttcc

SEQ ID NO: 8592872 - DNA, 22 bp, Homo sapiens
actttatttcctattgcatcca

SEQ ID NO: 8592873 - DNA, 22 bp, Homo sapiens
actttatgacaccctttagtga

SEQ ID NO: 8592874 - DNA, 22 bp, Homo sapiens
actgcactccagcctgggtaac

SEQ ID NO: 8592875 - DNA, 22 bp, Homo sapiens
actctgcttgggccatatctgg

SEQ ID NO: 8592876 - DNA, 22 bp, Homo sapiens
actggacagaggaaatatggag

SEQ ID NO: 8592877 - DNA, 22 bp, Homo sapiens
actggaggggaaaatggtagta

SEQ ID NO: 8592878 - DNA, 22 bp, Homo sapiens
actggcctatcagcatgagtct

SEQ ID NO: 8592879 - DNA, 22 bp, Homo sapiens
actggccctggctgctaggctg

SEQ ID NO: 8592880 - DNA, 22 bp, Homo sapiens
actggcccgggagcagaggcct

SEQ ID NO: 8592881 - DNA, 22 bp, Homo sapiens
actggccaggcacagctgtggg

SEQ ID NO: 8592882 - DNA, 22 bp, Homo sapiens
actggccatgaacttgggatct

SEQ ID NO: 8592883 - DNA, 20 bp, Homo sapiens
acgtggccaccagtggctta

SEQ ID NO: 8592884 - DNA, 20 bp, Homo sapiens
acgtggccaccagtggctta

SEQ ID NO: 8592885 - DNA, 23 bp, Homo sapiens
actctcaggttctttccagcagg

SEQ ID NO: 8592886 - DNA, 22 bp, Homo sapiens
actatacaccaaaatattaagg

SEQ ID NO: 8592887 - DNA, 22 bp, Homo sapiens
actcactgggtcccggaagccc

SEQ ID NO: 8592888 - DNA, 22 bp, Homo sapiens
aagcattttgccacttgaagtt

SEQ ID NO: 8592889 - DNA, 22 bp, Homo sapiens
aagcatttgtgaaattcagatg

SEQ ID NO: 8592890 - DNA, 22 bp, Homo sapiens
acagcctgtttgatctggtgct

SEQ ID NO: 8592891 - DNA, 22 bp, Homo sapiens
acagcctgtgtaccagctggga

SEQ ID NO: 8592892 - DNA, 21 bp, Homo sapiens
acagcctgtcatctcatggtc

SEQ ID NO: 8592893 - DNA, 21 bp, Homo sapiens
aagctacagaaaataatttga

SEQ ID NO: 8592894 - DNA, 22 bp, Homo sapiens
aagctagattggcattcatttc

SEQ ID NO: 8592895 - DNA, 22 bp, Homo sapiens
aagctacattaagcagatttac

SEQ ID NO: 8592896 - DNA, 22 bp, Homo sapiens
aagctagataacttttatattt

SEQ ID NO: 8592897 - DNA, 22 bp, Homo sapiens
aagctattgaatttatagcata

SEQ ID NO: 8592898 - DNA, 22 bp, Homo sapiens
acagggcagagtgaaatgctat

SEQ ID NO: 8592899 - DNA, 22 bp, Homo sapiens
acagggcagcaactttgtgcct

SEQ ID NO: 8592900 - DNA, 19 bp, Homo sapiens
acagggcagcaataggata

SEQ ID NO: 8592901 - DNA, 22 bp, Homo sapiens
acagggcagagggcagttggta

SEQ ID NO: 8592902 - DNA, 22 bp, Homo sapiens
acagggcagagaggcaggcttg

SEQ ID NO: 8592903 - DNA, 22 bp, Homo sapiens
acagggcagaaatgttgcatct

SEQ ID NO: 8592904 - DNA, 22 bp, Homo sapiens
acagtgttgaggtgcttgtttc

SEQ ID NO: 8592905 - DNA, 22 bp, Homo sapiens
acagtgttcttgatattacagt

SEQ ID NO: 8592906 - DNA, 22 bp, Homo sapiens
acagtctttcagtaataatact

SEQ ID NO: 8592907 - DNA, 22 bp, Homo sapiens
acagtctgtcccccaggtgcta

SEQ ID NO: 8592908 - DNA, 21 bp, Homo sapiens
aaggagcctaggaggctcagg

SEQ ID NO: 8592909 - DNA, 22 bp, Homo sapiens
aaggagagagctttgctggaac

SEQ ID NO: 8592910 - DNA, 22 bp, Homo sapiens
aaggacaggctaacctgacatt

SEQ ID NO: 8592911 - DNA, 20 bp, Homo sapiens
aagctggaagaccagcattg

SEQ ID NO: 8592912 - DNA, 22 bp, Homo sapiens
aaggaggcaccctgagcctgcc

SEQ ID NO: 8592913 - DNA, 22 bp, Homo sapiens
aaggaggcactcgctctcaggg

SEQ ID NO: 8592914 - DNA, 22 bp, Homo sapiens
aaggaggcagaactcacatgga

SEQ ID NO: 8592915 - DNA, 22 bp, Homo sapiens
accctgcagggcagaggctggt

SEQ ID NO: 8592916 - DNA, 22 bp, Homo sapiens
acccaggatgataatgttcaca

SEQ ID NO: 8592917 - DNA, 22 bp, Homo sapiens
acccaggatagagtgctgcagt

SEQ ID NO: 8592918 - DNA, 22 bp, Homo sapiens
acccaggagccgtgagaggtta

SEQ ID NO: 8592919 - DNA, 22 bp, Homo sapiens
acccaggaggcaaggttgcagt

SEQ ID NO: 8592920 - DNA, 22 bp, Homo sapiens
acccaggagctctggggtcctc

SEQ ID NO: 8592921 - DNA, 22 bp, Homo sapiens
acccaggaggcagaggttgcag

SEQ ID NO: 8592922 - DNA, 22 bp, Homo sapiens
acccaggaggcagaggttgcag

SEQ ID NO: 8592923 - DNA, 22 bp, Homo sapiens
acccaggataatctgtgtatct

SEQ ID NO: 8592924 - DNA, 22 bp, Homo sapiens
acccaggaggtggaggctgcag

SEQ ID NO: 8592925 - DNA, 22 bp, Homo sapiens
acccaggatagagtgctgcagt

SEQ ID NO: 8592926 - DNA, 22 bp, Homo sapiens
acccaggaggtgacacagggct

SEQ ID NO: 8592927 - DNA, 22 bp, Homo sapiens
acccaggaggtgacacagggct

SEQ ID NO: 8592928 - DNA, 22 bp, Homo sapiens
acccaggaggtggaggctgcag

SEQ ID NO: 8592929 - DNA, 22 bp, Homo sapiens
accaggctgttgggcccagtgt

SEQ ID NO: 8592930 - DNA, 22 bp, Homo sapiens
accaggcttaatcctttgctat

SEQ ID NO: 8592931 - DNA, 19 bp, Homo sapiens
accaggcttatggtcagtg

SEQ ID NO: 8592932 - DNA, 22 bp, Homo sapiens
accaggcttgataccaagaaat

SEQ ID NO: 8592933 - DNA, 22 bp, Homo sapiens
accatgttggccaagctggtct

SEQ ID NO: 8592934 - DNA, 21 bp, Homo sapiens
accaggcttgtgggagggagc

SEQ ID NO: 8592935 - DNA, 22 bp, Homo sapiens
accagggcaaatgtttgtactc

SEQ ID NO: 8592936 - DNA, 22 bp, Homo sapiens
accaggcttgatgatttgctta

SEQ ID NO: 8592937 - DNA, 22 bp, Homo sapiens
acattcttgaagtgaagtttat

SEQ ID NO: 8592938 - DNA, 22 bp, Homo sapiens
aaggccagggatgccagctcgg

SEQ ID NO: 8592939 - DNA, 22 bp, Homo sapiens
aaggccagggatgccagctcgg

SEQ ID NO: 8592940 - DNA, 22 bp, Homo sapiens
acattgttctacttctagttag

SEQ ID NO: 8592941 - DNA, 22 bp, Homo sapiens
acattgttgtgcaattatagtt

SEQ ID NO: 8592942 - DNA, 21 bp, Homo sapiens
gttctacagttttagaattcc

SEQ ID NO: 8592943 - DNA, 22 bp, Homo sapiens
gttctacatgacactcaacatt

SEQ ID NO: 8592944 - DNA, 22 bp, Homo sapiens
gttctacagttcctattactta

SEQ ID NO: 8592945 - DNA, 22 bp, Homo sapiens
gttcaaaggcctgtggaaaggg

SEQ ID NO: 8592946 - DNA, 22 bp, Homo sapiens
gttcaagaccagcctggccaac

SEQ ID NO: 8592947 - DNA, 22 bp, Homo sapiens
gtgtgtccaaggcacggatgac

SEQ ID NO: 8592948 - DNA, 22 bp, Homo sapiens
gtgtgtccaaggccacaatagc

SEQ ID NO: 8592949 - DNA, 22 bp, Homo sapiens
gtgtgtccacacatacatacat

SEQ ID NO: 8592950 - DNA, 22 bp, Homo sapiens
gtgtgtccaggcgggagtcaag

SEQ ID NO: 8592951 - DNA, 23 bp, Homo sapiens
gtgtgtccattcgcactcttagg

SEQ ID NO: 8592952 - DNA, 22 bp, Homo sapiens
gtgtgtcctcagtagtggcatg

SEQ ID NO: 8592953 - DNA, 22 bp, Homo sapiens
gtgtgtcccttggaacctcagc

SEQ ID NO: 8592954 - DNA, 22 bp, Homo sapiens
gtgtgtccctacaacagcttca

SEQ ID NO: 8592955 - DNA, 22 bp, Homo sapiens
gtgtgtccctcctctcctgagt

SEQ ID NO: 8592956 - DNA, 22 bp, Homo sapiens
gtgtcctcttattgctcttggc

SEQ ID NO: 8592957 - DNA, 22 bp, Homo sapiens
gtgtccttatgcataccagagt

SEQ ID NO: 8592958 - DNA, 22 bp, Homo sapiens
gtgtgagctcagccttgggaga

SEQ ID NO: 8592959 - DNA, 22 bp, Homo sapiens
gtgtggggccaggatcagggct

SEQ ID NO: 8592960 - DNA, 22 bp, Homo sapiens
gtgtgggctatgtgcgtgggca

SEQ ID NO: 8592961 - DNA, 22 bp, Homo sapiens
gtgtgggcagggccgtgctccc

SEQ ID NO: 8592962 - DNA, 22 bp, Homo sapiens
gtgggctggaccctcctgctcc

SEQ ID NO: 8592963 - DNA, 22 bp, Homo sapiens
gtgggctgcttcctccttccac

SEQ ID NO: 8592964 - DNA, 22 bp, Homo sapiens
gtgggctcccctggcatgtcca

SEQ ID NO: 8592965 - DNA, 22 bp, Homo sapiens
gtggggaggcctaagcaagttg

SEQ ID NO: 8592966 - DNA, 22 bp, Homo sapiens
gtggggaggcattcttctccct

SEQ ID NO: 8592967 - DNA, 22 bp, Homo sapiens
gtgggcagtgtgtcagtatctt

SEQ ID NO: 8592968 - DNA, 22 bp, Homo sapiens
gtgggcagacatgatagaagga

SEQ ID NO: 8592969 - DNA, 22 bp, Homo sapiens
gtgggcagagcaagggaactca

SEQ ID NO: 8592970 - DNA, 20 bp, Homo sapiens
gtgggcagcaggcatactgg

SEQ ID NO: 8592971 - DNA, 22 bp, Homo sapiens
gtggtgtaggtcacagttagga

SEQ ID NO: 8592972 - DNA, 22 bp, Homo sapiens
gtggtccaaggagtttccagca

SEQ ID NO: 8592973 - DNA, 22 bp, Homo sapiens
gtggtcaggttatcagatcata

SEQ ID NO: 8592974 - DNA, 22 bp, Homo sapiens
gtggtgaagccccatctctgct

SEQ ID NO: 8592975 - DNA, 18 bp, Homo sapiens
gtggggtgttgtgaggat

SEQ ID NO: 8592976 - DNA, 22 bp, Homo sapiens
gtggggtgggctgagttaggcc

SEQ ID NO: 8592977 - DNA, 22 bp, Homo sapiens
gtggtcagagatgacagtgggt

SEQ ID NO: 8592978 - DNA, 22 bp, Homo sapiens
gtggtcagaatggagcccagga

SEQ ID NO: 8592979 - DNA, 22 bp, Homo sapiens
gtggtcagaaatctcagtggca

SEQ ID NO: 8592980 - DNA, 22 bp, Homo sapiens
gtggtatctgtctcccccactg

SEQ ID NO: 8592981 - DNA, 22 bp, Homo sapiens
gtggtcaggggctgaggtgccc

SEQ ID NO: 8592982 - DNA, 22 bp, Homo sapiens
gtggtcagtggtacagtttgaa

SEQ ID NO: 8592983 - DNA, 22 bp, Homo sapiens
gtggtcagttaggcaatcatgt

SEQ ID NO: 8592984 - DNA, 22 bp, Homo sapiens
gtggtcagggagcagagccatg

SEQ ID NO: 8592985 - DNA, 22 bp, Homo sapiens
gtggtcaggcagtgggagagaa

SEQ ID NO: 8592986 - DNA, 22 bp, Homo sapiens
gtggtcagccccggtgagccct

SEQ ID NO: 8592987 - DNA, 22 bp, Homo sapiens
gtggtcagcagcagtgggagtg

SEQ ID NO: 8592988 - DNA, 22 bp, Homo sapiens
gtgggtgcggggagccgaggcg

SEQ ID NO: 8592989 - DNA, 22 bp, Homo sapiens
gtgggtgatgtactggaggcca

SEQ ID NO: 8592990 - DNA, 22 bp, Homo sapiens
gtgggtcagcaagccaggagta

SEQ ID NO: 8592991 - DNA, 22 bp, Homo sapiens
gtgggtaattggagggctgcct

SEQ ID NO: 8592992 - DNA, 16 bp, Homo sapiens
taaatctgtgatcaca

SEQ ID NO: 8592993 - DNA, 19 bp, Homo sapiens
taaatctgtattcttcaaa

SEQ ID NO: 8592994 - DNA, 22 bp, Homo sapiens
taaaactgaatacatactgagg

SEQ ID NO: 8592995 - DNA, 22 bp, Homo sapiens
taaaggcagccactgagctcaa

SEQ ID NO: 8592996 - DNA, 22 bp, Homo sapiens
taaaggcagtaattcctgagtt

SEQ ID NO: 8592997 - DNA, 22 bp, Homo sapiens
taaaggcacggagttgttatgg

SEQ ID NO: 8592998 - DNA, 22 bp, Homo sapiens
gtaaatataaatgctagctgcc

SEQ ID NO: 8592999 - DNA, 22 bp, Homo sapiens
gtaaatattaaaggctgctaga

SEQ ID NO: 8593000 - DNA, 22 bp, Homo sapiens
ggtgtcctcggattcagggcag

SEQ ID NO: 8593001 - DNA, 21 bp, Homo sapiens
ggtgtcctgagggataggtag

SEQ ID NO: 8593002 - DNA, 22 bp, Homo sapiens
ggtgtcctcactatagcaagtc

SEQ ID NO: 8593003 - DNA, 22 bp, Homo sapiens
ggtgtcctcatgattttctaga

SEQ ID NO: 8593004 - DNA, 22 bp, Homo sapiens
ggtgtcctgggcaggcagctga

SEQ ID NO: 8593005 - DNA, 22 bp, Homo sapiens
ggtgtcctgtcagctagagtga

SEQ ID NO: 8593006 - DNA, 22 bp, Homo sapiens
gtaaactattctttcaggagct

SEQ ID NO: 8593007 - DNA, 22 bp, Homo sapiens
gtatggcactatcctctctgat

SEQ ID NO: 8593008 - DNA, 21 bp, Homo sapiens
gtatggcattgattagttact

SEQ ID NO: 8593009 - DNA, 22 bp, Homo sapiens
gtatatcagacactcatatgta

SEQ ID NO: 8593010 - DNA, 21 bp, Homo sapiens
gtatatcagcagtgaattcaa

SEQ ID NO: 8593011 - DNA, 22 bp, Homo sapiens
gtatatcaccccaagcagctga

SEQ ID NO: 8593012 - DNA, 22 bp, Homo sapiens
gtatatcaggcagaatgttctc

SEQ ID NO: 8593013 - DNA, 22 bp, Homo sapiens
ggtgtcctactgcttggttgct

SEQ ID NO: 8593014 - DNA, 19 bp, Homo sapiens
ggtgtcctagagataagag

SEQ ID NO: 8593015 - DNA, 22 bp, Homo sapiens
ggtgtcctacagggccgcaggc

SEQ ID NO: 8593016 - DNA, 22 bp, Homo sapiens
ggtgtccatcaggctgtgcttc

SEQ ID NO: 8593017 - DNA, 22 bp, Homo sapiens
ggtggcagttacaggggcaaat

SEQ ID NO: 8593018 - DNA, 22 bp, Homo sapiens
ggtgcaggagcggggtgctcgg

SEQ ID NO: 8593019 - DNA, 22 bp, Homo sapiens
ggtgcaggagcggggtgctcgg

SEQ ID NO: 8593020 - DNA, 22 bp, Homo sapiens
ggtgcaggcggtggggcaagta

SEQ ID NO: 8593021 - DNA, 22 bp, Homo sapiens
ggtgcaggaatctgcaattgaa

SEQ ID NO: 8593022 - DNA, 22 bp, Homo sapiens
ggtgcaggacgaagtgggggtt

SEQ ID NO: 8593023 - DNA, 22 bp, Homo sapiens
gggtggggttcaggaatcttca

SEQ ID NO: 8593024 - DNA, 21 bp, Homo sapiens
gggtggggttccagccttttc

SEQ ID NO: 8593025 - DNA, 22 bp, Homo sapiens
gggtggggtgtatcggatccta

SEQ ID NO: 8593026 - DNA, 22 bp, Homo sapiens
gggtggggccaggcaatttgca

SEQ ID NO: 8593027 - DNA, 22 bp, Homo sapiens
gggtggggcccaggaaatctat

SEQ ID NO: 8593028 - DNA, 22 bp, Homo sapiens
gggtggggtgtatcggatccta

SEQ ID NO: 8593029 - DNA, 22 bp, Homo sapiens
ggtgagggtaaatataggcaaa

SEQ ID NO: 8593030 - DNA, 22 bp, Homo sapiens
gtcaggaaaacccgggttgact

SEQ ID NO: 8593031 - DNA, 22 bp, Homo sapiens
gtcaggagagacctgttctcct

SEQ ID NO: 8593032 - DNA, 22 bp, Homo sapiens
gtatgtctatttcaaatagctg

SEQ ID NO: 8593033 - DNA, 22 bp, Homo sapiens
gtattacatttagtaattaggc

SEQ ID NO: 8593034 - DNA, 21 bp, Homo sapiens
gtcagctgtgtgtgaggaccc

SEQ ID NO: 8593035 - DNA, 22 bp, Homo sapiens
gtcagctgcagtgggcacagcc

SEQ ID NO: 8593036 - DNA, 22 bp, Homo sapiens
gtcagctgcacaggtgggagct

SEQ ID NO: 8593037 - DNA, 22 bp, Homo sapiens
gtccagtgacaagtagctggcc

SEQ ID NO: 8593038 - DNA, 22 bp, Homo sapiens
gtccattttattcagagacttt

SEQ ID NO: 8593039 - DNA, 22 bp, Homo sapiens
gtcccagggaagaaggcagcac

SEQ ID NO: 8593040 - DNA, 22 bp, Homo sapiens
gtcccagggaagaaggcagcac

SEQ ID NO: 8593041 - DNA, 22 bp, Homo sapiens
gtccttcaaggtccttggtgtg

SEQ ID NO: 8593042 - DNA, 22 bp, Homo sapiens
gtcctgggtccccgcaggtcag

SEQ ID NO: 8593043 - DNA, 22 bp, Homo sapiens
gtcccagggatgcagacatgag

SEQ ID NO: 8593044 - DNA, 22 bp, Homo sapiens
gtcccagggatgcagacatgag

SEQ ID NO: 8593045 - DNA, 22 bp, Homo sapiens
gtcccagggaggttcagggctt

SEQ ID NO: 8593046 - DNA, 22 bp, Homo sapiens
gtcccaggtgcccagtgggcag

SEQ ID NO: 8593047 - DNA, 20 bp, Homo sapiens
gtctggcttcgtgattctgg

SEQ ID NO: 8593048 - DNA, 22 bp, Homo sapiens
gtctgagggttgtgctggagga

SEQ ID NO: 8593049 - DNA, 22 bp, Homo sapiens
gtctgaggcgaggcctgagaac

SEQ ID NO: 8593050 - DNA, 22 bp, Homo sapiens
gtctgagggacagagtcctggc

SEQ ID NO: 8593051 - DNA, 22 bp, Homo sapiens
gtctctgagctctgagctggct

SEQ ID NO: 8593052 - DNA, 22 bp, Homo sapiens
gtccttcatctggagcctggtc

SEQ ID NO: 8593053 - DNA, 22 bp, Homo sapiens
gtggacaggcaggctgtcgggg

SEQ ID NO: 8593054 - DNA, 22 bp, Homo sapiens
gtggatggtggtccagtatcat

SEQ ID NO: 8593055 - DNA, 22 bp, Homo sapiens
gtggatggattgaggcagtggg

SEQ ID NO: 8593056 - DNA, 22 bp, Homo sapiens
gtggatggccctgcacacaggt

SEQ ID NO: 8593057 - DNA, 22 bp, Homo sapiens
gtggcacagccaagcctcactc

SEQ ID NO: 8593058 - DNA, 22 bp, Homo sapiens
gtggcacagggtgtggcacaca

SEQ ID NO: 8593059 - DNA, 22 bp, Homo sapiens
gtggcacagagatggggcatga

SEQ ID NO: 8593060 - DNA, 19 bp, Homo sapiens
gtggcagcagatttggtgt

SEQ ID NO: 8593061 - DNA, 22 bp, Homo sapiens
gtgaaggattggagggcatctt

SEQ ID NO: 8593062 - DNA, 22 bp, Homo sapiens
gtgacagtggtcacttgtagtt

SEQ ID NO: 8593063 - DNA, 22 bp, Homo sapiens
gtgcctggaatgcgcctcggcg

SEQ ID NO: 8593064 - DNA, 22 bp, Homo sapiens
gtgcctgctgcagagtcgctgt

SEQ ID NO: 8593065 - DNA, 20 bp, Homo sapiens
gtgcctggagaagaggctgt

SEQ ID NO: 8593066 - DNA, 22 bp, Homo sapiens
gtgcctggcatgcgccggtgct

SEQ ID NO: 8593067 - DNA, 22 bp, Homo sapiens
gtgcctggcagggtcagctgct

SEQ ID NO: 8593068 - DNA, 22 bp, Homo sapiens
gtggctccttttcaggaggctg

SEQ ID NO: 8593069 - DNA, 22 bp, Homo sapiens
gtggcctggcgagctggcgcgg

SEQ ID NO: 8593070 - DNA, 22 bp, Homo sapiens
gtggccctgtcccaggcctcct

SEQ ID NO: 8593071 - DNA, 20 bp, Homo sapiens
gtggcccttaaagagggaag

SEQ ID NO: 8593072 - DNA, 19 bp, Homo sapiens
gtggcctgcgctgggtgcg

SEQ ID NO: 8593073 - DNA, 22 bp, Homo sapiens
gtggcctggaaaggctggtctg

SEQ ID NO: 8593074 - DNA, 22 bp, Homo sapiens
gtgggatgcttaggatcttgcc

SEQ ID NO: 8593075 - DNA, 22 bp, Homo sapiens
gtgggatgcagtggtgagtggc

SEQ ID NO: 8593076 - DNA, 22 bp, Homo sapiens
gtggctgctggtactctgggaa

SEQ ID NO: 8593077 - DNA, 22 bp, Homo sapiens
gtggctgcagcggctgtggaga

SEQ ID NO: 8593078 - DNA, 22 bp, Homo sapiens
gtggctgcagcccagcggcacg

SEQ ID NO: 8593079 - DNA, 22 bp, Homo sapiens
gtggctgcagagggcacagcat

SEQ ID NO: 8593080 - DNA, 22 bp, Homo sapiens
gtggctgctggtactctgggaa

SEQ ID NO: 8593081 - DNA, 22 bp, Homo sapiens
gtggctgctgtcctctctggtt

SEQ ID NO: 8593082 - DNA, 22 bp, Homo sapiens
gtggctggagtatgaggaaagg

SEQ ID NO: 8593083 - DNA, 22 bp, Homo sapiens
gtggctggccctggaccctaag

SEQ ID NO: 8593084 - DNA, 22 bp, Homo sapiens
gtggctggtttcctgcatgcaa

SEQ ID NO: 8593085 - DNA, 22 bp, Homo sapiens
gtggcaggggtattccagctga

SEQ ID NO: 8593086 - DNA, 22 bp, Homo sapiens
gtggccagaagactgcaatgct

SEQ ID NO: 8593087 - DNA, 22 bp, Homo sapiens
gtggccagaagttaagtggtta

SEQ ID NO: 8593088 - DNA, 22 bp, Homo sapiens
gtggccagaaccaggagaatga

SEQ ID NO: 8593089 - DNA, 22 bp, Homo sapiens
gtggccagagattaaatagagt

SEQ ID NO: 8593090 - DNA, 22 bp, Homo sapiens
gtggccagaatcttgaggcctt

SEQ ID NO: 8593091 - DNA, 22 bp, Homo sapiens
gtggccagaggtcccatgtgtc

SEQ ID NO: 8593092 - DNA, 22 bp, Homo sapiens
gtggccagaggatttgttcagt

SEQ ID NO: 8593093 - DNA, 22 bp, Homo sapiens
gtggccagcaagtgctgcctct

SEQ ID NO: 8593094 - DNA, 22 bp, Homo sapiens
gtggccagccagggtgctgatg

SEQ ID NO: 8593095 - DNA, 22 bp, Homo sapiens
gtggccagagtgtcattttatt

SEQ ID NO: 8593096 - DNA, 22 bp, Homo sapiens
gtggccagccccatggacagtt

SEQ ID NO: 8593097 - DNA, 18 bp, Homo sapiens
gtggccagcctggtcttg

SEQ ID NO: 8593098 - DNA, 18 bp, Homo sapiens
gtggccagcctggtcttg

SEQ ID NO: 8593099 - DNA, 22 bp, Homo sapiens
gtggccctctgatagggtcagg

SEQ ID NO: 8593100 - DNA, 22 bp, Homo sapiens
gtggccctcagcagttgccaag

SEQ ID NO: 8593101 - DNA, 22 bp, Homo sapiens
gtggcccaggcttggcgctggc

SEQ ID NO: 8593102 - DNA, 22 bp, Homo sapiens
gtggccaggacattgccaggca

SEQ ID NO: 8593103 - DNA, 22 bp, Homo sapiens
gtggccaggagaccttgggcat

SEQ ID NO: 8593104 - DNA, 22 bp, Homo sapiens
gtggccagctgtcagcaccctt

SEQ ID NO: 8593105 - DNA, 22 bp, Homo sapiens
gtggccaggagaccttgggcat

SEQ ID NO: 8593106 - DNA, 22 bp, Homo sapiens
gtggccaggagagggtgggaca

SEQ ID NO: 8593107 - DNA, 22 bp, Homo sapiens
ggaggtgggctaaggactctct

SEQ ID NO: 8593108 - DNA, 22 bp, Homo sapiens
ggaggtgggagcctccagtggt

SEQ ID NO: 8593109 - DNA, 22 bp, Homo sapiens
ggaggtggcctgaaaatgtggc

SEQ ID NO: 8593110 - DNA, 22 bp, Homo sapiens
ggaggtggaggttgcagtgagc

SEQ ID NO: 8593111 - DNA, 22 bp, Homo sapiens
ggaggggagatgtttgggctca

SEQ ID NO: 8593112 - DNA, 22 bp, Homo sapiens
ggaggggaggtccagctgatct

SEQ ID NO: 8593113 - DNA, 22 bp, Homo sapiens
ggaggctccatgagctcctgca

SEQ ID NO: 8593114 - DNA, 22 bp, Homo sapiens
ggaggctccatgagctcctgca

SEQ ID NO: 8593115 - DNA, 22 bp, Homo sapiens
ggaggccatgggcagaatcttt

SEQ ID NO: 8593116 - DNA, 22 bp, Homo sapiens
ggaggcctagccagctccagtt

SEQ ID NO: 8593117 - DNA, 22 bp, Homo sapiens
ggaggctgagaagtccaagatc

SEQ ID NO: 8593118 - DNA, 22 bp, Homo sapiens
ggaggctctcctggccttgtct

SEQ ID NO: 8593119 - DNA, 22 bp, Homo sapiens
ggaggctcgctggtcgcacagc

SEQ ID NO: 8593120 - DNA, 22 bp, Homo sapiens
ggagggcatcaatcaggcctgg

SEQ ID NO: 8593121 - DNA, 21 bp, Homo sapiens
ggagggcagcccagactggct

SEQ ID NO: 8593122 - DNA, 22 bp, Homo sapiens
ggagggcacaggaccagaaatc

SEQ ID NO: 8593123 - DNA, 22 bp, Homo sapiens
ggagggacccactctagaggtg

SEQ ID NO: 8593124 - DNA, 22 bp, Homo sapiens
ggagggacccactctagaggtg

SEQ ID NO: 8593125 - DNA, 22 bp, Homo sapiens
ggagggacccactctagaggtg

SEQ ID NO: 8593126 - DNA, 22 bp, Homo sapiens
ggagggctcgtcatccaccact

SEQ ID NO: 8593127 - DNA, 22 bp, Homo sapiens
ggagtgggaacaatgacatggt

SEQ ID NO: 8593128 - DNA, 22 bp, Homo sapiens
ggagtgggaacaatgacatggt

SEQ ID NO: 8593129 - DNA, 22 bp, Homo sapiens
ggagtgggcagcactgccctgt

SEQ ID NO: 8593130 - DNA, 22 bp, Homo sapiens
ggagtgtcccgattttccaggt

SEQ ID NO: 8593131 - DNA, 22 bp, Homo sapiens
ggcacactcaccacgtggaggg

SEQ ID NO: 8593132 - DNA, 22 bp, Homo sapiens
ggcaaggccttgcccagcattc

SEQ ID NO: 8593133 - DNA, 22 bp, Homo sapiens
ggcaaggcctgcagctcagtgt

SEQ ID NO: 8593134 - DNA, 22 bp, Homo sapiens
ggcacagcacagagcacatgta

SEQ ID NO: 8593135 - DNA, 22 bp, Homo sapiens
ggcagagcttgttccttctgtt

SEQ ID NO: 8593136 - DNA, 23 bp, Homo sapiens
ggcagagagcatggctggggccc

SEQ ID NO: 8593137 - DNA, 22 bp, Homo sapiens
ggcaggtgctaagagaggtaaa

SEQ ID NO: 8593138 - DNA, 22 bp, Homo sapiens
ggcaggtgcgcatgttgcatta

SEQ ID NO: 8593139 - DNA, 17 bp, Homo sapiens
ggcaggtgcggggccgc

SEQ ID NO: 8593140 - DNA, 22 bp, Homo sapiens
ggcaggtgctcaaaaatatttg

SEQ ID NO: 8593141 - DNA, 20 bp, Homo sapiens
ggcaggtgctcgcttggtct

SEQ ID NO: 8593142 - DNA, 22 bp, Homo sapiens
ggcaggtgctctgtgggcctgg

SEQ ID NO: 8593143 - DNA, 22 bp, Homo sapiens
ggcaggctgggagtcatcagag

SEQ ID NO: 8593144 - DNA, 22 bp, Homo sapiens
ggcaggtgaggcatgtgcctgg

SEQ ID NO: 8593145 - DNA, 22 bp, Homo sapiens
ggcaggctgggtgtcatggagt

SEQ ID NO: 8593146 - DNA, 22 bp, Homo sapiens
ggcaggtgagttcattatctgc

SEQ ID NO: 8593147 - DNA, 22 bp, Homo sapiens
ggcagaggaagctggaagtggg

SEQ ID NO: 8593148 - DNA, 22 bp, Homo sapiens
ggcagaggaagctggaagtggg

SEQ ID NO: 8593149 - DNA, 22 bp, Homo sapiens
ggcaggcagatggctgcaccaa

SEQ ID NO: 8593150 - DNA, 22 bp, Homo sapiens
ggcagctgtctctgagttagca

SEQ ID NO: 8593151 - DNA, 22 bp, Homo sapiens
ggaaacattccaagagttgaaa

SEQ ID NO: 8593152 - DNA, 20 bp, Homo sapiens
ggaaacatttttatttccat

SEQ ID NO: 8593153 - DNA, 22 bp, Homo sapiens
ggaaaacaagagaatgatgttt

SEQ ID NO: 8593154 - DNA, 22 bp, Homo sapiens
ggaaaacagcgattggtatcat

SEQ ID NO: 8593155 - DNA, 22 bp, Homo sapiens
gcttctggggttctggcatgct

SEQ ID NO: 8593156 - DNA, 22 bp, Homo sapiens
gcttctggagtcttcagaggaa

SEQ ID NO: 8593157 - DNA, 22 bp, Homo sapiens
gcttctggagtcttcagaggaa

SEQ ID NO: 8593158 - DNA, 22 bp, Homo sapiens
ggaaagagggacccagcttggt

SEQ ID NO: 8593159 - DNA, 22 bp, Homo sapiens
ggaaagagttttggtatatttg

SEQ ID NO: 8593160 - DNA, 22 bp, Homo sapiens
ggaaagaggatagtgggtaggt

SEQ ID NO: 8593161 - DNA, 23 bp, Homo sapiens
ggaaagagaggagttgtgcatag

SEQ ID NO: 8593162 - DNA, 22 bp, Homo sapiens
ggaaggtgctccctggacagag

SEQ ID NO: 8593163 - DNA, 18 bp, Homo sapiens
ggaaggtgatgtgaaaag

SEQ ID NO: 8593164 - DNA, 19 bp, Homo sapiens
ggaaggtgacagtggtgaa

SEQ ID NO: 8593165 - DNA, 22 bp, Homo sapiens
ggaagaaatctggttaagagat

SEQ ID NO: 8593166 - DNA, 17 bp, Homo sapiens
ggaagaaaaggatcatc

SEQ ID NO: 8593167 - DNA, 22 bp, Homo sapiens
gcttcagactggagcagaggaa

SEQ ID NO: 8593168 - DNA, 22 bp, Homo sapiens
gcttcctgggacaggctatgtg

SEQ ID NO: 8593169 - DNA, 22 bp, Homo sapiens
gcttcaggctgaattcctccta

SEQ ID NO: 8593170 - DNA, 22 bp, Homo sapiens
gcttcagggttatgcaagagtg

SEQ ID NO: 8593171 - DNA, 23 bp, Homo sapiens
gcttctagtcaatttcaccagga

SEQ ID NO: 8593172 - DNA, 23 bp, Homo sapiens
gcttctgccatttgctagctgtg

SEQ ID NO: 8593173 - DNA, 22 bp, Homo sapiens
gctgggctccaccctcaactgt

SEQ ID NO: 8593174 - DNA, 22 bp, Homo sapiens
gctgggccagagcagcagcact

SEQ ID NO: 8593175 - DNA, 22 bp, Homo sapiens
gctgggctgagctagacttggc

SEQ ID NO: 8593176 - DNA, 22 bp, Homo sapiens
gctgggctgagaagttaagcaa

SEQ ID NO: 8593177 - DNA, 22 bp, Homo sapiens
gctgggctcttatcacctgtac

SEQ ID NO: 8593178 - DNA, 22 bp, Homo sapiens
gctgggctctgtcatgccttcc

SEQ ID NO: 8593179 - DNA, 22 bp, Homo sapiens
gctgggctctgtcatgccttcc

SEQ ID NO: 8593180 - DNA, 21 bp, Homo sapiens
gctgggctccagtctgccgct

SEQ ID NO: 8593181 - DNA, 21 bp, Homo sapiens
gctgggctccagtctgccgct

SEQ ID NO: 8593182 - DNA, 22 bp, Homo sapiens
gctgggctgcgtcggggaagcc

SEQ ID NO: 8593183 - DNA, 22 bp, Homo sapiens
gctgggctgagctagacttggc

SEQ ID NO: 8593184 - DNA, 22 bp, Homo sapiens
ggagctcctggcagtgacagag

SEQ ID NO: 8593185 - DNA, 17 bp, Homo sapiens
ggagctccagctactgc

SEQ ID NO: 8593186 - DNA, 22 bp, Homo sapiens
ggagctctctcagggggtccaa

SEQ ID NO: 8593187 - DNA, 22 bp, Homo sapiens
ggaggagcatgagagggtagtg

SEQ ID NO: 8593188 - DNA, 22 bp, Homo sapiens
ggaggaagggtagcataatgta

SEQ ID NO: 8593189 - DNA, 22 bp, Homo sapiens
ggaggaagtgcagttctactac

SEQ ID NO: 8593190 - DNA, 22 bp, Homo sapiens
ggaggacactggctctgccttc

SEQ ID NO: 8593191 - DNA, 22 bp, Homo sapiens
ggaggacaggggctgcagcaca

SEQ ID NO: 8593192 - DNA, 22 bp, Homo sapiens
ggaggacaggggctgcagcaca

SEQ ID NO: 8593193 - DNA, 22 bp, Homo sapiens
ggaggccagcctgaggctgagg

SEQ ID NO: 8593194 - DNA, 22 bp, Homo sapiens
ggaggccacggtttagcaccga

SEQ ID NO: 8593195 - DNA, 22 bp, Homo sapiens
ggaggccacctgacctgctgtt

SEQ ID NO: 8593196 - DNA, 22 bp, Homo sapiens
ggaggccaccatggagtcactt

SEQ ID NO: 8593197 - DNA, 22 bp, Homo sapiens
ggaggccaattttctaactgca

SEQ ID NO: 8593198 - DNA, 22 bp, Homo sapiens
ggaggccagtcctggccgggct

SEQ ID NO: 8593199 - DNA, 22 bp, Homo sapiens
ggaggccatagtttgggagtca

SEQ ID NO: 8593200 - DNA, 22 bp, Homo sapiens
ggaggccatcagggagggcatt

SEQ ID NO: 8593201 - DNA, 22 bp, Homo sapiens
ggaggccatcagggagggcatt

SEQ ID NO: 8593202 - DNA, 22 bp, Homo sapiens
ggaggccatctggctggaggct

SEQ ID NO: 8593203 - DNA, 22 bp, Homo sapiens
ggaggccatctggctggaggct

SEQ ID NO: 8593204 - DNA, 22 bp, Homo sapiens
ggaggccatctggctggaggct

SEQ ID NO: 8593205 - DNA, 22 bp, Homo sapiens
ggaggccagggtgggtggatcg

SEQ ID NO: 8593206 - DNA, 22 bp, Homo sapiens
ggaggccaggtgggagtcatct

SEQ ID NO: 8593207 - DNA, 22 bp, Homo sapiens
ggaggccagggtgggtggatcg

SEQ ID NO: 8593208 - DNA, 22 bp, Homo sapiens
ggaggccaggaaggctcggaga

SEQ ID NO: 8593209 - DNA, 22 bp, Homo sapiens
ggaggccaggaagagccgccct

SEQ ID NO: 8593210 - DNA, 22 bp, Homo sapiens
ggagcctggttactagagcctg

SEQ ID NO: 8593211 - DNA, 22 bp, Homo sapiens
ggagaggtgagaggtacaagtt

SEQ ID NO: 8593212 - DNA, 22 bp, Homo sapiens
ggagaggtgtattcagtgggtc

SEQ ID NO: 8593213 - DNA, 21 bp, Homo sapiens
ggagaaggacaatgttgagta

SEQ ID NO: 8593214 - DNA, 22 bp, Homo sapiens
ggagaaggaatattggagtagg

SEQ ID NO: 8593215 - DNA, 17 bp, Homo sapiens
ggagacagggtctttaa

SEQ ID NO: 8593216 - DNA, 22 bp, Homo sapiens
ggagacacgggtgctgaggacc

SEQ ID NO: 8593217 - DNA, 22 bp, Homo sapiens
ggagacagcaggaagaaatatc

SEQ ID NO: 8593218 - DNA, 22 bp, Homo sapiens
ggaagtatttgtttttgcatcc

SEQ ID NO: 8593219 - DNA, 23 bp, Homo sapiens
ggaagtcagcggagaggtggctg

SEQ ID NO: 8593220 - DNA, 22 bp, Homo sapiens
gggccagtctgactctgctggt

SEQ ID NO: 8593221 - DNA, 22 bp, Homo sapiens
gggccagtagcacctgtgtgga

SEQ ID NO: 8593222 - DNA, 22 bp, Homo sapiens
gggcagctcggaagtgggaaag

SEQ ID NO: 8593223 - DNA, 22 bp, Homo sapiens
gggcagctcctgtggaatccac

SEQ ID NO: 8593224 - DNA, 22 bp, Homo sapiens
gggcagcagaattggacagaaa

SEQ ID NO: 8593225 - DNA, 18 bp, Homo sapiens
gggcagcacagcagcctc

SEQ ID NO: 8593226 - DNA, 22 bp, Homo sapiens
gggcagcaaatctgagtctggt

SEQ ID NO: 8593227 - DNA, 22 bp, Homo sapiens
gggcccagcgtggttccatctg

SEQ ID NO: 8593228 - DNA, 19 bp, Homo sapiens
gggcccagcatggagggtt

SEQ ID NO: 8593229 - DNA, 22 bp, Homo sapiens
gggcccagccctctgctcactg

SEQ ID NO: 8593230 - DNA, 22 bp, Homo sapiens
gggcccagcactggctgggatc

SEQ ID NO: 8593231 - DNA, 23 bp, Homo sapiens
gggcccagcacaggacctggcag

SEQ ID NO: 8593232 - DNA, 22 bp, Homo sapiens
gggccagtgagtcgggagagct

SEQ ID NO: 8593233 - DNA, 22 bp, Homo sapiens
gggccagtgaacaatgagggaa

SEQ ID NO: 8593234 - DNA, 22 bp, Homo sapiens
gggccagtgggacctgggtctc

SEQ ID NO: 8593235 - DNA, 22 bp, Homo sapiens
gggccagttctccgcctctttt

SEQ ID NO: 8593236 - DNA, 22 bp, Homo sapiens
gggccatgagaggttcatcaac

SEQ ID NO: 8593237 - DNA, 20 bp, Homo sapiens
gggagaagggctgatgagag

SEQ ID NO: 8593238 - DNA, 22 bp, Homo sapiens
gggaggcgccgagggtagctaa

SEQ ID NO: 8593239 - DNA, 20 bp, Homo sapiens
gggaggcgagggctgagcag

SEQ ID NO: 8593240 - DNA, 18 bp, Homo sapiens
gggaggccccagcaggag

SEQ ID NO: 8593241 - DNA, 18 bp, Homo sapiens
gggaggccccagcaggag

SEQ ID NO: 8593242 - DNA, 22 bp, Homo sapiens
gggacctgccattgctcacagg

SEQ ID NO: 8593243 - DNA, 22 bp, Homo sapiens
gggacctgccaaggccacccag

SEQ ID NO: 8593244 - DNA, 22 bp, Homo sapiens
gggacctggcgagggtcacaca

SEQ ID NO: 8593245 - DNA, 22 bp, Homo sapiens
gggacctgcgccactcactgtc

SEQ ID NO: 8593246 - DNA, 22 bp, Homo sapiens
gggacctgggccagaggacagt

SEQ ID NO: 8593247 - DNA, 22 bp, Homo sapiens
gggacgggcacggagggccctc

SEQ ID NO: 8593248 - DNA, 22 bp, Homo sapiens
gggacgagccccaggctggagg

SEQ ID NO: 8593249 - DNA, 22 bp, Homo sapiens
gggacgagatcttggcagtgtg

SEQ ID NO: 8593250 - DNA, 22 bp, Homo sapiens
gggcagaggggcgcttccctct

SEQ ID NO: 8593251 - DNA, 22 bp, Homo sapiens
gggatggggagctggaaagggg

SEQ ID NO: 8593252 - DNA, 22 bp, Homo sapiens
gggatggctgcctgcatcagga

SEQ ID NO: 8593253 - DNA, 22 bp, Homo sapiens
gggatggctttgtggctgactc

SEQ ID NO: 8593254 - DNA, 22 bp, Homo sapiens
gggatggctcaaaggagtcagg

SEQ ID NO: 8593255 - DNA, 22 bp, Homo sapiens
gggatggcctagactagcttgg

SEQ ID NO: 8593256 - DNA, 18 bp, Homo sapiens
gggctaggcaaggaccac

SEQ ID NO: 8593257 - DNA, 22 bp, Homo sapiens
gggctgagaattcagctttcct

SEQ ID NO: 8593258 - DNA, 22 bp, Homo sapiens
ggggaagggagtccaagtgtta

SEQ ID NO: 8593259 - DNA, 22 bp, Homo sapiens
gggtgggatggcaggagccgct

SEQ ID NO: 8593260 - DNA, 17 bp, Homo sapiens
gggtgggcactgctggc

SEQ ID NO: 8593261 - DNA, 23 bp, Homo sapiens
gggtgggccaaattaggtagcct

SEQ ID NO: 8593262 - DNA, 22 bp, Homo sapiens
gggtgggccccaggtatctgta

SEQ ID NO: 8593263 - DNA, 22 bp, Homo sapiens
gggtgggccactgagcagcgtg

SEQ ID NO: 8593264 - DNA, 22 bp, Homo sapiens
gggtgggcccagcccagagaag

SEQ ID NO: 8593265 - DNA, 19 bp, Homo sapiens
gggtgaggaagagcgttgc

SEQ ID NO: 8593266 - DNA, 22 bp, Homo sapiens
gggtggctgagaacaggacccc

SEQ ID NO: 8593267 - DNA, 22 bp, Homo sapiens
ggggtaggaagagaaaatagtg

SEQ ID NO: 8593268 - DNA, 22 bp, Homo sapiens
gggggtggttctaagtcctata

SEQ ID NO: 8593269 - DNA, 22 bp, Homo sapiens
gggggtaggcagacaaggacat

SEQ ID NO: 8593270 - DNA, 22 bp, Homo sapiens
gggggctgtcctgtgcattgta

SEQ ID NO: 8593271 - DNA, 19 bp, Homo sapiens
ggggagaactagagacagc

SEQ ID NO: 8593272 - DNA, 22 bp, Homo sapiens
gggaacagggcctgagctgggg

SEQ ID NO: 8593273 - DNA, 22 bp, Homo sapiens
gggaagagaccgtaccctggcc

SEQ ID NO: 8593274 - DNA, 22 bp, Homo sapiens
gggaagagaggaggtggtttcg

SEQ ID NO: 8593275 - DNA, 21 bp, Homo sapiens
gggaagactgtcaggattcct

SEQ ID NO: 8593276 - DNA, 22 bp, Homo sapiens
gggaagacttagtcggttcaat

SEQ ID NO: 8593277 - DNA, 22 bp, Homo sapiens
gggaccaggtcagggctctgac

SEQ ID NO: 8593278 - DNA, 22 bp, Homo sapiens
gggaccaggtcagggctctgac

SEQ ID NO: 8593279 - DNA, 18 bp, Homo sapiens
gggaagaggatctggccc

SEQ ID NO: 8593280 - DNA, 22 bp, Homo sapiens
gggaagagatttccacatcatt

SEQ ID NO: 8593281 - DNA, 22 bp, Homo sapiens
ggctttgggattcagcatgaga

SEQ ID NO: 8593282 - DNA, 22 bp, Homo sapiens
ggctttgggccctcaagtctcc

SEQ ID NO: 8593283 - DNA, 18 bp, Homo sapiens
ggctttggctcttaccgc

SEQ ID NO: 8593284 - DNA, 22 bp, Homo sapiens
ggcttctcagcacactgtccac

SEQ ID NO: 8593285 - DNA, 22 bp, Homo sapiens
gggaacagagtgccagactgac

SEQ ID NO: 8593286 - DNA, 22 bp, Homo sapiens
ggctttggtagacacagattga

SEQ ID NO: 8593287 - DNA, 22 bp, Homo sapiens
ggctttggggtgtgcagagatg

SEQ ID NO: 8593288 - DNA, 22 bp, Homo sapiens
ggctttgggggtgtccaagaaa

SEQ ID NO: 8593289 - DNA, 22 bp, Homo sapiens
ggctggcttgccaagctcaggg

SEQ ID NO: 8593290 - DNA, 22 bp, Homo sapiens
ggcttcaggggcccagtcagca

SEQ ID NO: 8593291 - DNA, 22 bp, Homo sapiens
ggcttcagtggccagagatgat

SEQ ID NO: 8593292 - DNA, 22 bp, Homo sapiens
ggcttcagtgagctgagctcac

SEQ ID NO: 8593293 - DNA, 22 bp, Homo sapiens
ggcttccatgtgaaattctttg

SEQ ID NO: 8593294 - DNA, 22 bp, Homo sapiens
ggctgcaggaacgacggagggg

SEQ ID NO: 8593295 - DNA, 22 bp, Homo sapiens
ggctgcaggaacgacggagggg

SEQ ID NO: 8593296 - DNA, 22 bp, Homo sapiens
ggctgcctgggagccctcctct

SEQ ID NO: 8593297 - DNA, 22 bp, Homo sapiens
ggctggcctctacagggaggca

SEQ ID NO: 8593298 - DNA, 22 bp, Homo sapiens
ggctgctgaacaagggaaccct

SEQ ID NO: 8593299 - DNA, 22 bp, Homo sapiens
ggctgctgaacaagggaaccct

SEQ ID NO: 8593300 - DNA, 22 bp, Homo sapiens
ggctggcctcagggtcctcgct

SEQ ID NO: 8593301 - DNA, 22 bp, Homo sapiens
ggctgcagaagtacttccggat

SEQ ID NO: 8593302 - DNA, 22 bp, Homo sapiens
ggctcctggggaggtgagcttg

SEQ ID NO: 8593303 - DNA, 22 bp, Homo sapiens
ggctctagagactctagagaaa

SEQ ID NO: 8593304 - DNA, 22 bp, Homo sapiens
ggctctaggcggagtcccgcga

SEQ ID NO: 8593305 - DNA, 22 bp, Homo sapiens
ggctctaggcggagtcccgcga

SEQ ID NO: 8593306 - DNA, 22 bp, Homo sapiens
ggctctagagctgtgcacacat

SEQ ID NO: 8593307 - DNA, 22 bp, Homo sapiens
ggctcctgggcagctgctccct

SEQ ID NO: 8593308 - DNA, 22 bp, Homo sapiens
ggcaggtgctgggagcatctca

SEQ ID NO: 8593309 - DNA, 20 bp, Homo sapiens
ggcaggtgctgtcccctcct

SEQ ID NO: 8593310 - DNA, 22 bp, Homo sapiens
ggcaggtgctgggagcatctca

SEQ ID NO: 8593311 - DNA, 22 bp, Homo sapiens
ggcaggtgcttgtcgaaggcct

SEQ ID NO: 8593312 - DNA, 22 bp, Homo sapiens
ggcaggtgcttgtcgaaggcct

SEQ ID NO: 8593313 - DNA, 22 bp, Homo sapiens
ggcaggtggaagttggcagagc

SEQ ID NO: 8593314 - DNA, 22 bp, Homo sapiens
ggcaggtggaaggtctccattc

SEQ ID NO: 8593315 - DNA, 22 bp, Homo sapiens
ggccagaaagttaagctgtggc

SEQ ID NO: 8593316 - DNA, 18 bp, Homo sapiens
ggccagagggagggtccc

SEQ ID NO: 8593317 - DNA, 22 bp, Homo sapiens
ggcccagcgaggccacctacag

SEQ ID NO: 8593318 - DNA, 22 bp, Homo sapiens
ggcccagccttggggtttcttt

SEQ ID NO: 8593319 - DNA, 22 bp, Homo sapiens
ggcccagcctggcaacaatgac

SEQ ID NO: 8593320 - DNA, 22 bp, Homo sapiens
ggccattgcaacgtcaggagga

SEQ ID NO: 8593321 - DNA, 19 bp, Homo sapiens
ggcccaagtactgagtgcc

SEQ ID NO: 8593322 - DNA, 22 bp, Homo sapiens
ggcccacttgaaatggagctca

SEQ ID NO: 8593323 - DNA, 22 bp, Homo sapiens
ggcccagccggcgagtctcgcg

SEQ ID NO: 8593324 - DNA, 22 bp, Homo sapiens
ggctcctgctgtcctttgaagc

SEQ ID NO: 8593325 - DNA, 23 bp, Homo sapiens
ggctcctgcttcatgtcccacct

SEQ ID NO: 8593326 - DNA, 21 bp, Homo sapiens
ggctcctgctttgtgaggggc

SEQ ID NO: 8593327 - DNA, 22 bp, Homo sapiens
ggctcctgcacctgtccctctg

SEQ ID NO: 8593328 - DNA, 22 bp, Homo sapiens
ggctcctgatttgagggggctg

SEQ ID NO: 8593329 - DNA, 22 bp, Homo sapiens
ggctcagtgtttgtggaacata

SEQ ID NO: 8593330 - DNA, 22 bp, Homo sapiens
ggctcaggactgcagcgtagag

SEQ ID NO: 8593331 - DNA, 22 bp, Homo sapiens
ggctcagcttggtgcgcagaaa

SEQ ID NO: 8593332 - DNA, 22 bp, Homo sapiens
ggctcagcttggtgcgcagaaa

SEQ ID NO: 8593333 - DNA, 22 bp, Homo sapiens
ggctcagcttatctgggcaggc

SEQ ID NO: 8593334 - DNA, 22 bp, Homo sapiens
ggctcagcgcgctgggagggag

SEQ ID NO: 8593335 - DNA, 22 bp, Homo sapiens
ggctcagcttatctgggcaggc

SEQ ID NO: 8593336 - DNA, 22 bp, Homo sapiens
ggctcagcgcgctgggagggag

SEQ ID NO: 8593337 - DNA, 22 bp, Homo sapiens
ggctcagccccgtaacacagca

SEQ ID NO: 8593338 - DNA, 22 bp, Homo sapiens
ggcctgggcccactgtcaagag

SEQ ID NO: 8593339 - DNA, 22 bp, Homo sapiens
ggcctgggcccactgtcaagag

SEQ ID NO: 8593340 - DNA, 22 bp, Homo sapiens
ggccctctgctctgagatgaag

SEQ ID NO: 8593341 - DNA, 22 bp, Homo sapiens
ggccctctggtgagtatcacat

SEQ ID NO: 8593342 - DNA, 22 bp, Homo sapiens
ggccctctgtggctgccatgga

SEQ ID NO: 8593343 - DNA, 22 bp, Homo sapiens
ggccctcttttggtttggatgt

SEQ ID NO: 8593344 - DNA, 22 bp, Homo sapiens
ggccttggagtcctccactgga

SEQ ID NO: 8593345 - DNA, 22 bp, Homo sapiens
gaggaatgttattaaaggagct

SEQ ID NO: 8593346 - DNA, 23 bp, Homo sapiens
gaggacacagcccagacagccgt

SEQ ID NO: 8593347 - DNA, 21 bp, Homo sapiens
gaggaatggtttgcaaagcac

SEQ ID NO: 8593348 - DNA, 22 bp, Homo sapiens
gaggaaggtcccatcagaattt

SEQ ID NO: 8593349 - DNA, 22 bp, Homo sapiens
gaggaagggactttattatctg

SEQ ID NO: 8593350 - DNA, 22 bp, Homo sapiens
gaggaagggctgcctgccgggc

SEQ ID NO: 8593351 - DNA, 22 bp, Homo sapiens
gaggaagggctgcctgccgggc

SEQ ID NO: 8593352 - DNA, 23 bp, Homo sapiens
gagctgggatacaggcttactgc

SEQ ID NO: 8593353 - DNA, 23 bp, Homo sapiens
gagctgggatacaggcttactgc

SEQ ID NO: 8593354 - DNA, 22 bp, Homo sapiens
gagctgggagctgggatttgga

SEQ ID NO: 8593355 - DNA, 18 bp, Homo sapiens
gagctgggagaaggaagg

SEQ ID NO: 8593356 - DNA, 22 bp, Homo sapiens
gagctgggacttggaatccaca

SEQ ID NO: 8593357 - DNA, 22 bp, Homo sapiens
gagctgggaggactgggaactt

SEQ ID NO: 8593358 - DNA, 22 bp, Homo sapiens
gagctgggagttatagcatgtt

SEQ ID NO: 8593359 - DNA, 22 bp, Homo sapiens
gagctgggagttatagcatgtt

SEQ ID NO: 8593360 - DNA, 22 bp, Homo sapiens
gagctgggagttatagcatgtt

SEQ ID NO: 8593361 - DNA, 22 bp, Homo sapiens
gagctgcttctgtgtgccgggt

SEQ ID NO: 8593362 - DNA, 22 bp, Homo sapiens
gagctggccgcagagagggcag

SEQ ID NO: 8593363 - DNA, 22 bp, Homo sapiens
gagctggccgcagagagggcag

SEQ ID NO: 8593364 - DNA, 22 bp, Homo sapiens
gagctggcaggaggctccccga

SEQ ID NO: 8593365 - DNA, 22 bp, Homo sapiens
gagctgggacatgggtcctctc

SEQ ID NO: 8593366 - DNA, 22 bp, Homo sapiens
gagctgggaagatagcttgagc

SEQ ID NO: 8593367 - DNA, 22 bp, Homo sapiens
gagctgggaagatagcttgagc

SEQ ID NO: 8593368 - DNA, 22 bp, Homo sapiens
gagctgggaagatagcttgagc

SEQ ID NO: 8593369 - DNA, 22 bp, Homo sapiens
gagctggctccgccatgctgct

SEQ ID NO: 8593370 - DNA, 22 bp, Homo sapiens
gagctggctcctccgaggatgg

SEQ ID NO: 8593371 - DNA, 22 bp, Homo sapiens
gagctggcctcaggcacaggag

SEQ ID NO: 8593372 - DNA, 22 bp, Homo sapiens
gagctggcctcaggcacaggag

SEQ ID NO: 8593373 - DNA, 22 bp, Homo sapiens
gagagtggaaagcaagctgagt

SEQ ID NO: 8593374 - DNA, 22 bp, Homo sapiens
gagagtggatggagctgcgaag

SEQ ID NO: 8593375 - DNA, 22 bp, Homo sapiens
gagataatgatgctaacccagt

SEQ ID NO: 8593376 - DNA, 22 bp, Homo sapiens
gagatataacctaaaggtcact

SEQ ID NO: 8593377 - DNA, 22 bp, Homo sapiens
gaggaggcttccgggaggcacg

SEQ ID NO: 8593378 - DNA, 22 bp, Homo sapiens
gaggaggctgtttctctgcatt

SEQ ID NO: 8593379 - DNA, 22 bp, Homo sapiens
gaggaggctgaacaatgccctg

SEQ ID NO: 8593380 - DNA, 22 bp, Homo sapiens
gaggaggctggcgccgcctgcc

SEQ ID NO: 8593381 - DNA, 22 bp, Homo sapiens
gaggagggagctggaagctctt

SEQ ID NO: 8593382 - DNA, 22 bp, Homo sapiens
gaggagggagctggaagctctt

SEQ ID NO: 8593383 - DNA, 18 bp, Homo sapiens
gaggcctgagaaccaggt

SEQ ID NO: 8593384 - DNA, 22 bp, Homo sapiens
gaggcctgaggctgcctggagc

SEQ ID NO: 8593385 - DNA, 22 bp, Homo sapiens
gaggccctgaagacagctgggg

SEQ ID NO: 8593386 - DNA, 22 bp, Homo sapiens
gaggccctccagctgtcagctg

SEQ ID NO: 8593387 - DNA, 22 bp, Homo sapiens
gaggcagctgggctggtggttt

SEQ ID NO: 8593388 - DNA, 22 bp, Homo sapiens
gaggcagctgaaggagtgacag

SEQ ID NO: 8593389 - DNA, 22 bp, Homo sapiens
gaggcagctgaaggagtgacag

SEQ ID NO: 8593390 - DNA, 22 bp, Homo sapiens
gaggcagcaggctgaggaggat

SEQ ID NO: 8593391 - DNA, 22 bp, Homo sapiens
gaggcagcagaacatggaagag

SEQ ID NO: 8593392 - DNA, 22 bp, Homo sapiens
gaggcagcagaacatggaagag

SEQ ID NO: 8593393 - DNA, 23 bp, Homo sapiens
gaggcagctcctgcagtgccctg

SEQ ID NO: 8593394 - DNA, 22 bp, Homo sapiens
gaggtcagtcagaccagggttt

SEQ ID NO: 8593395 - DNA, 22 bp, Homo sapiens
gaggtcaggctcaagctgggcc

SEQ ID NO: 8593396 - DNA, 22 bp, Homo sapiens
gaggtccattttcacatatgat

SEQ ID NO: 8593397 - DNA, 22 bp, Homo sapiens
gaggtaggtgtaggaggcctgc

SEQ ID NO: 8593398 - DNA, 19 bp, Homo sapiens
gaggtcagcaagaagtatt

SEQ ID NO: 8593399 - DNA, 22 bp, Homo sapiens
gagtcaggagttatgctccacc

SEQ ID NO: 8593400 - DNA, 22 bp, Homo sapiens
gagtcagaccgactgggctcat

SEQ ID NO: 8593401 - DNA, 22 bp, Homo sapiens
gagtcagaccgactgggctcat

SEQ ID NO: 8593402 - DNA, 22 bp, Homo sapiens
gagtcagaatgtcctcctgcgg

SEQ ID NO: 8593403 - DNA, 22 bp, Homo sapiens
gaggtggtggtggaggcatagc

SEQ ID NO: 8593404 - DNA, 22 bp, Homo sapiens
gaggtggtcgaggaggggtacc

SEQ ID NO: 8593405 - DNA, 22 bp, Homo sapiens
gaggtgtcactattttgcttat

SEQ ID NO: 8593406 - DNA, 22 bp, Homo sapiens
gaggtgtcagggtagtcatgat

SEQ ID NO: 8593407 - DNA, 22 bp, Homo sapiens
gaggtggttcaggtagagccca

SEQ ID NO: 8593408 - DNA, 22 bp, Homo sapiens
gaggtggtttgtggtgactcat

SEQ ID NO: 8593409 - DNA, 22 bp, Homo sapiens
gaggtgtcccgcagtccccaag

SEQ ID NO: 8593410 - DNA, 22 bp, Homo sapiens
gaggtgtccctgaccctttgca

SEQ ID NO: 8593411 - DNA, 22 bp, Homo sapiens
gaggtgtcctagaagtattcag

SEQ ID NO: 8593412 - DNA, 22 bp, Homo sapiens
gaggtgtcatttagttaatcag

SEQ ID NO: 8593413 - DNA, 22 bp, Homo sapiens
gaggtgtcatcaggcagctctg

SEQ ID NO: 8593414 - DNA, 22 bp, Homo sapiens
gaggtgtcatgagggcctgctc

SEQ ID NO: 8593415 - DNA, 22 bp, Homo sapiens
gaggtgtcgtagattattctca

SEQ ID NO: 8593416 - DNA, 22 bp, Homo sapiens
gaggtgtcctcagccaactctg

SEQ ID NO: 8593417 - DNA, 22 bp, Homo sapiens
gaggtgtctgctgtgttcaaag

SEQ ID NO: 8593418 - DNA, 22 bp, Homo sapiens
gaggtgtctagatctaccagta

SEQ ID NO: 8593419 - DNA, 22 bp, Homo sapiens
gaggtgtctgagtggggacctg

SEQ ID NO: 8593420 - DNA, 22 bp, Homo sapiens
gagtcagaaagtagtgtgccta

SEQ ID NO: 8593421 - DNA, 22 bp, Homo sapiens
gaggtgtctggcctttgtagga

SEQ ID NO: 8593422 - DNA, 22 bp, Homo sapiens
gaggggcagtgcacccgggccc

SEQ ID NO: 8593423 - DNA, 22 bp, Homo sapiens
gaggggcagaatgtgatcaggg

SEQ ID NO: 8593424 - DNA, 22 bp, Homo sapiens
gaggggcagaggtagagaacaa

SEQ ID NO: 8593425 - DNA, 22 bp, Homo sapiens
gaggggcacagtaaagggtccc

SEQ ID NO: 8593426 - DNA, 22 bp, Homo sapiens
gaggggagtgtcctccgggccc

SEQ ID NO: 8593427 - DNA, 22 bp, Homo sapiens
gaggggagtaaagtcatgttac

SEQ ID NO: 8593428 - DNA, 22 bp, Homo sapiens
gagggcagtgaattttgaagct

SEQ ID NO: 8593429 - DNA, 22 bp, Homo sapiens
gagggcagtagcctcgtaccct

SEQ ID NO: 8593430 - DNA, 20 bp, Homo sapiens
gagggcaggcacccatttca

SEQ ID NO: 8593431 - DNA, 22 bp, Homo sapiens
gagggcaggggtcttgcacggt

SEQ ID NO: 8593432 - DNA, 22 bp, Homo sapiens
gagggccaatggatttcaactg

SEQ ID NO: 8593433 - DNA, 22 bp, Homo sapiens
gagggccaatgtgtccctgagc

SEQ ID NO: 8593434 - DNA, 22 bp, Homo sapiens
gaggggaaagtgtgaggctgcg

SEQ ID NO: 8593435 - DNA, 22 bp, Homo sapiens
gagggccaaagagcaagagcct

SEQ ID NO: 8593436 - DNA, 22 bp, Homo sapiens
gagggccaaagagcaagagcct

SEQ ID NO: 8593437 - DNA, 22 bp, Homo sapiens
gagggccaactagcaccacttt

SEQ ID NO: 8593438 - DNA, 22 bp, Homo sapiens
gaggctgcccaactggagtgga

SEQ ID NO: 8593439 - DNA, 22 bp, Homo sapiens
gaggctgcccacacctgcgccg

SEQ ID NO: 8593440 - DNA, 16 bp, Homo sapiens
gagggcagaggcggaa

SEQ ID NO: 8593441 - DNA, 22 bp, Homo sapiens
gagggcagagtctaatgatgca

SEQ ID NO: 8593442 - DNA, 22 bp, Homo sapiens
gaggctgggaagtccaagacca

SEQ ID NO: 8593443 - DNA, 22 bp, Homo sapiens
gatgcagggctggcaggagctt

SEQ ID NO: 8593444 - DNA, 22 bp, Homo sapiens
gatgaggaatgctcagctcaat

SEQ ID NO: 8593445 - DNA, 22 bp, Homo sapiens
gatatacataggtttctatgca

SEQ ID NO: 8593446 - DNA, 22 bp, Homo sapiens
gatagataaaactatattttca

SEQ ID NO: 8593447 - DNA, 22 bp, Homo sapiens
gatatacagagcattctttgat

SEQ ID NO: 8593448 - DNA, 22 bp, Homo sapiens
gatatacaatccacagttgatt

SEQ ID NO: 8593449 - DNA, 22 bp, Homo sapiens
gatataaattaatcaagtgcaa

SEQ ID NO: 8593450 - DNA, 22 bp, Homo sapiens
gataccagacagggagggagaa

SEQ ID NO: 8593451 - DNA, 22 bp, Homo sapiens
gataaagtagatttgttctaga

SEQ ID NO: 8593452 - DNA, 22 bp, Homo sapiens
gataaacttgtggagttttggt

SEQ ID NO: 8593453 - DNA, 22 bp, Homo sapiens
gagtttaatcattgttctatcc

SEQ ID NO: 8593454 - DNA, 22 bp, Homo sapiens
gagtttttccaaggtcacatga

SEQ ID NO: 8593455 - DNA, 22 bp, Homo sapiens
gagtgggtgagagacttggcac

SEQ ID NO: 8593456 - DNA, 22 bp, Homo sapiens
gagtgggtgacagaaggaggta

SEQ ID NO: 8593457 - DNA, 22 bp, Homo sapiens
gagtgggtgaatgtgctcataa

SEQ ID NO: 8593458 - DNA, 22 bp, Homo sapiens
gagtgggtaccggagcaggtgc

SEQ ID NO: 8593459 - DNA, 22 bp, Homo sapiens
gagtgggtaccggagcaggtgc

SEQ ID NO: 8593460 - DNA, 22 bp, Homo sapiens
gagtgggtaaaggtgcttggct

SEQ ID NO: 8593461 - DNA, 22 bp, Homo sapiens
gagtgggtccacagaggtgaca

SEQ ID NO: 8593462 - DNA, 22 bp, Homo sapiens
gagtgggtctcatatatctggc

SEQ ID NO: 8593463 - DNA, 22 bp, Homo sapiens
gagtgctggaggtgtgagtggg

SEQ ID NO: 8593464 - DNA, 22 bp, Homo sapiens
gagtgctgaatgcgagaacaga

SEQ ID NO: 8593465 - DNA, 22 bp, Homo sapiens
gagtgctgtatctgagaaagca

SEQ ID NO: 8593466 - DNA, 22 bp, Homo sapiens
gagtgctgtaggactgagccct

SEQ ID NO: 8593467 - DNA, 17 bp, Homo sapiens
gagtgctggtggagctc

SEQ ID NO: 8593468 - DNA, 22 bp, Homo sapiens
gagtgctggggtgcagagaggt

SEQ ID NO: 8593469 - DNA, 22 bp, Homo sapiens
gagtggctgagtaagaggggag

SEQ ID NO: 8593470 - DNA, 22 bp, Homo sapiens
gagtggccagtggtggcatgtc

SEQ ID NO: 8593471 - DNA, 22 bp, Homo sapiens
gagtggctattgatccgtgatg

SEQ ID NO: 8593472 - DNA, 22 bp, Homo sapiens
gagtggctccaatttggtccta

SEQ ID NO: 8593473 - DNA, 21 bp, Homo sapiens
gagtgggacatgggagtggtt

SEQ ID NO: 8593474 - DNA, 22 bp, Homo sapiens
gagtggagcaaaagaggtagat

SEQ ID NO: 8593475 - DNA, 22 bp, Homo sapiens
gagtgactctagaaagtttctt

SEQ ID NO: 8593476 - DNA, 22 bp, Homo sapiens
gagtgagggccaacatccagct

SEQ ID NO: 8593477 - DNA, 22 bp, Homo sapiens
gagtctcctactggctgtcctt

SEQ ID NO: 8593478 - DNA, 22 bp, Homo sapiens
gagtccttttcatagcagtggg

SEQ ID NO: 8593479 - DNA, 22 bp, Homo sapiens
gagtccttccagcaggcattta

SEQ ID NO: 8593480 - DNA, 19 bp, Homo sapiens
gagtcctgtgctccttgtt

SEQ ID NO: 8593481 - DNA, 20 bp, Homo sapiens
gagtccttatgggctgaggt

SEQ ID NO: 8593482 - DNA, 22 bp, Homo sapiens
gagtccttaatacactggtgga

SEQ ID NO: 8593483 - DNA, 22 bp, Homo sapiens
ctggctgtgaaatggcagtgtc

SEQ ID NO: 8593484 - DNA, 22 bp, Homo sapiens
ctggctgtaacattttgccata

SEQ ID NO: 8593485 - DNA, 22 bp, Homo sapiens
ctggctgtcttctgggagctgt

SEQ ID NO: 8593486 - DNA, 22 bp, Homo sapiens
ctttatgaacctgttcagcttg

SEQ ID NO: 8593487 - DNA, 21 bp, Homo sapiens
ctttggtttcctcctgccttc

SEQ ID NO: 8593488 - DNA, 21 bp, Homo sapiens
ctttggtttctgacttgcata

SEQ ID NO: 8593489 - DNA, 22 bp, Homo sapiens
ctttggttctgtccttcccaga

SEQ ID NO: 8593490 - DNA, 22 bp, Homo sapiens
ctttggttcaggagtacctctc

SEQ ID NO: 8593491 - DNA, 22 bp, Homo sapiens
cttggatgccagcggcctccta

SEQ ID NO: 8593492 - DNA, 22 bp, Homo sapiens
cttggctgaactccaggatgca

SEQ ID NO: 8593493 - DNA, 22 bp, Homo sapiens
cttgggagtagaggcaggagca

SEQ ID NO: 8593494 - DNA, 22 bp, Homo sapiens
cttgggagtagaggcaggagca

SEQ ID NO: 8593495 - DNA, 22 bp, Homo sapiens
cttgggaggcagaggttgcagt

SEQ ID NO: 8593496 - DNA, 22 bp, Homo sapiens
cttgggaggagaacaaagctcc

SEQ ID NO: 8593497 - DNA, 22 bp, Homo sapiens
cttggggaggacgcagtgtcct

SEQ ID NO: 8593498 - DNA, 22 bp, Homo sapiens
gaaataattctgtgtctgaaca

SEQ ID NO: 8593499 - DNA, 22 bp, Homo sapiens
gaaataatttagaaggtattcc

SEQ ID NO: 8593500 - DNA, 22 bp, Homo sapiens
gaactgagttttctgcctggac

SEQ ID NO: 8593501 - DNA, 22 bp, Homo sapiens
gaactacagtgcattttcttaa

SEQ ID NO: 8593502 - DNA, 22 bp, Homo sapiens
gaacctggaatgtggcgcccaa

SEQ ID NO: 8593503 - DNA, 22 bp, Homo sapiens
gaacccaggaggttgcagtgag

SEQ ID NO: 8593504 - DNA, 21 bp, Homo sapiens
gaacccagcagcagtgctctg

SEQ ID NO: 8593505 - DNA, 22 bp, Homo sapiens
gaaagggataccatgttacttg

SEQ ID NO: 8593506 - DNA, 22 bp, Homo sapiens
gaaagggaatggatttctgttg

SEQ ID NO: 8593507 - DNA, 22 bp, Homo sapiens
ctttgttttactcagaggcatg

SEQ ID NO: 8593508 - DNA, 22 bp, Homo sapiens
gaaaagagacagggtgggtgat

SEQ ID NO: 8593509 - DNA, 22 bp, Homo sapiens
gaaaagagacagggtgggtgat

SEQ ID NO: 8593510 - DNA, 22 bp, Homo sapiens
gaaaagagtcctgtgtgaggag

SEQ ID NO: 8593511 - DNA, 22 bp, Homo sapiens
gaaaagagtcctgtgtgaggag

SEQ ID NO: 8593512 - DNA, 22 bp, Homo sapiens
gagaaacaacacttgatgcctt

SEQ ID NO: 8593513 - DNA, 22 bp, Homo sapiens
gagaaaagcgaaggacctggag

SEQ ID NO: 8593514 - DNA, 22 bp, Homo sapiens
gactttatcctgcctgaccacg

SEQ ID NO: 8593515 - DNA, 22 bp, Homo sapiens
gactttataaatgagaggcgga

SEQ ID NO: 8593516 - DNA, 22 bp, Homo sapiens
gactttatcttgtccttcctgc

SEQ ID NO: 8593517 - DNA, 22 bp, Homo sapiens
gactttattactaaccctgtga

SEQ ID NO: 8593518 - DNA, 22 bp, Homo sapiens
gactttatgaagagatgaccaa

SEQ ID NO: 8593519 - DNA, 22 bp, Homo sapiens
gactttattcgttaactgttaa

SEQ ID NO: 8593520 - DNA, 22 bp, Homo sapiens
gactttattatagtggcaatag

SEQ ID NO: 8593521 - DNA, 22 bp, Homo sapiens
gactttatttccttatttgtga

SEQ ID NO: 8593522 - DNA, 22 bp, Homo sapiens
gactttattttaacggagattc

SEQ ID NO: 8593523 - DNA, 22 bp, Homo sapiens
gagacacaggcacagaagaggc

SEQ ID NO: 8593524 - DNA, 22 bp, Homo sapiens
gagacagagaggtactcaacat

SEQ ID NO: 8593525 - DNA, 22 bp, Homo sapiens
gagagctgaggggcctggcact

SEQ ID NO: 8593526 - DNA, 22 bp, Homo sapiens
gagagctccatgttcatgctgt

SEQ ID NO: 8593527 - DNA, 22 bp, Homo sapiens
gagacagatctcggctccatgc

SEQ ID NO: 8593528 - DNA, 22 bp, Homo sapiens
gagacagatctcggctccatgc

SEQ ID NO: 8593529 - DNA, 22 bp, Homo sapiens
gagagctgggaaagccgtggag

SEQ ID NO: 8593530 - DNA, 22 bp, Homo sapiens
gagagctggccagcttcagtat

SEQ ID NO: 8593531 - DNA, 22 bp, Homo sapiens
gagagctgggggactgtggatg

SEQ ID NO: 8593532 - DNA, 22 bp, Homo sapiens
gaccagggtcactcacagggct

SEQ ID NO: 8593533 - DNA, 22 bp, Homo sapiens
gaccagtcattactcatgccct

SEQ ID NO: 8593534 - DNA, 22 bp, Homo sapiens
gacaggcaggccagggctgtgg

SEQ ID NO: 8593535 - DNA, 22 bp, Homo sapiens
gacaggcatgctttcaggacta

SEQ ID NO: 8593536 - DNA, 22 bp, Homo sapiens
gacaggaggcagagctcaggtg

SEQ ID NO: 8593537 - DNA, 22 bp, Homo sapiens
gacaggcacgaaattgggctgg

SEQ ID NO: 8593538 - DNA, 22 bp, Homo sapiens
gacaggcaattaccagcgccca

SEQ ID NO: 8593539 - DNA, 22 bp, Homo sapiens
gacccaggagtgcagagagtgg

SEQ ID NO: 8593540 - DNA, 22 bp, Homo sapiens
gacccagggtatccagagctgc

SEQ ID NO: 8593541 - DNA, 22 bp, Homo sapiens
gacccaggggcagggagaaagt

SEQ ID NO: 8593542 - DNA, 22 bp, Homo sapiens
gactgtccagaattcctaggtg

SEQ ID NO: 8593543 - DNA, 22 bp, Homo sapiens
gactggggtaaggtgaggaggt

SEQ ID NO: 8593544 - DNA, 22 bp, Homo sapiens
gacccagggtttctgcacaggg

SEQ ID NO: 8593545 - DNA, 22 bp, Homo sapiens
gactttaaaatgctagaacagg

SEQ ID NO: 8593546 - DNA, 22 bp, Homo sapiens
gaaggagaccctgaagatgctg

SEQ ID NO: 8593547 - DNA, 22 bp, Homo sapiens
gaaggaagggctggctgtcttg

SEQ ID NO: 8593548 - DNA, 22 bp, Homo sapiens
gacacagctttctgaagagcat

SEQ ID NO: 8593549 - DNA, 22 bp, Homo sapiens
gacacagcactgtacaaggaat
